United States Patent 11,242,544 (MICROBIOMES AND METHODS FOR PRODUCING MEDIUM-CHAIN FATTY ACIDS FROM ORGANIC SUBSTRATES) - sequence listing, part 8

SEQ ID NO: 439 - DNA, 236975 bp, Unknown
  Metagenome-assembled genome
ttctaaagctggtcgaattaattcaaattgttgccgagtaatattgctgggataatttttcatagcttaaactcgctttttacatagaagtatatcaaaaatcatagatcttggacagcttcttaatgacctgctttttatttaatggatagaagaataataggataatagcagctaatccacaacaaaccgctggaatcccggttgccatataataaatactgttagcaactgcatcgctttggacaacaccaccggccgcagaggattggtaaccgatcagagttagcataataccgccaaatccaccagcaagtgcctgggcaaccttacgggaaaacgaattgataccatagaccataccgtcttcacgaatacccgttaagacctgctggttgtcaatcacgtcggtaataaatgcccagaccatcatactaaacattccggcaccaagcgctcccaatagaaccatagccaggtagacaataacactgtgtgtatgcaaaattgccaaggtcgtataaatcgccgcgccaaagaataatgcaacgacagagctttcttttcgaccgtattttttgacgatccagccactaaaaggtgctaagataataataatcacgtagttaaaaatcatcgctacagacatggcagccgtgttccgaaaataatcattaaacaggtaggcaattgttaccatactcaagttttggttgataacaaccacaatatcgacgatcaccaacacaatcaacgctttgttcttcaacaaattaaccagcaataatttcattggaaccggttcgcttttttctgtccgaatccgttccgaagtcatcttggttaggacaatgtaggaaagaaagccgaggatggaacaggcaatcacgacgataaagaatcgctcgccactgatttgtgtcgaactgcccacatacataaacaatgggacgacataggcaacaatcgagccaccgactgccgcaccaatacttctaaaggtggaaagagatgttttatcactgggctgatccgataatgacgatgccattgacccataaggaatattaacagccgagtaaaagatcccccaaagaagataggtcagaaaaacataccccaatctaagtcccatcgacaggtccttgacccacggcacaaataacacaattgaaaagaccagcaatggatatttcatcctccgtacccagggcttaaaacgaccttctttagtcagctggctattatccaccatccgaccgacagtgacgtcagcgactgcgtcaactaatctggctattaaaaacagtagtccgaccatcgcaccggataatccgagaacgttggtatagaaaatcattaaaaatgaattaaccatgttgaacgaaaaattattcccgatatcgccgaacatataaccaattttatctttccagccaaatggatgggcatcggtaatagtaatggtttgttttgcctgtaaggaagctgcctcttgcgttttatcatgagttgtagaaaccgcttgtgttttatccataaagttcacgtcctaattttttcttcctattgttatcgcttacatttattcataaaaaaatggcttcggcctggttagtgtcgaagccatttttctgtcacttatttagtggttaattttttagcctgatcctgtgtgtctgattttactttatatcccaaatttggaatggctgtccagcgattctttaaataacggaccaccatcttaggttcacgggaccgggtgaaaatccctttcttatttccctgtacacgctgaataccgaacttggtctggaagtccgcaaagttccaaagctgttcaccgacgaagtttggaatttcatcaaagactttgcttgccattcgatagtaatcttcttggaattcttccgagaatggctcaccatagttactgtgtaatccggctacggtgtcagcgccatattccgtatatataatcggtttttcagggaatttggcttggtactcgagtaattcatccctggtggccttttccgccgtctttaaatcaccattgccgacataccaaccgtaataacggtttaaggcaatcacatcaaccaggtcgatacacttatccgttcgtggatttgccatcataatacttgtgtacgtacatggccgtttttgtggatcgagtcgacgagccaaatcaaagagtggtttgaaatactcgtgcgcgccctttgagaaagttgccgcctcattggcgattgaccacattgcaacacaagcatgatttttatcacgatcaatgatttcttgaataacttgttggtgggcagctgctgttttcatcgttttccaggtgtcgtcttcgaaatcgtcctgttccaaaatcgatagattgaaatcaaatgacgccatcaagcctacagcaggtgtttcatctatgacaacaatcccttctcgatcacaaagccgcatcatttcctctgaataaggataatgggaggttctaaaggagttggcacccatatctttcattaaattgatatctaaaacgttgaccggttcattaaagccccgaccgtgaacataggtatcctcatgcttaccgaaacctttaaagtagaatggctgcccattgaacagaaattgaccgtccctgacttcaattttacgaatgccaaaagcttctgaataactgtccaccagttcgccgtttttgaaaccatcaacttgggccgaatacaaataagcatttaacggctgccaaagacggacatccgtcaaagtcacgctactatccgtaccactgacttcagccaccggatgaccatcctgatccaaaatggttactttaactttatccaagccatcactgatttgtgttttaatttcaatctctgcagatgaacggtccaaatcaacattcgggacaattgtgatatcttgaatatagtctttaggcgtcgagtaaatcttaaccgggcgctgaaggcccgcgtaattgaagaagtcaaaattctcatccaaatgacgaacaacgtgtccatcttcgtcggttgattcggaatagttgccgaccggtaacgtcgaataatccaagacgttgctgagtttaacggttaagcggttattgccgtcgttcaaataatcgttaatcacaacctcaaacggggtgaatccgcccttgtgatgtgtgatctcttggccgtttaggtaaacccacgcctcatgagtagctgatccgaatcgtaaaacaagcctttcgcttcttaatgccctggcaatgctaaagttggtttcataccaaacgtaaccgacgtgctcacgaatttcttgagaagctgtttgatcattaaacgaagccggaaccgaaatcacatcttcagtcggtaaaggctgtttgggatcaattggctgaacttctttgtcaatcataaatttccagagacctgataagtcgattaaagcccgacttggggttgtcattgggtatagcatatttgaattcctccattactggttaataaccttttgatttaacattacatttacaagatagtcttaatataattgatttcgcacaagacttctcgtacaattttgactataagcagatttattttacttttattgaaaccgctatcatttatttgaaacaaggagctcacaatctcatgataaaagaggacgccatttacattgcaaaggccttacaaatcaccactaagctggacgtccaattagttgatctgtccggcaatcaattttaccagtcaacaagttatgccctgccaaaattccaagacttaccggataccaatcaacttttgccgattttaaatcaacaccactcgaatgactatttgcattacaacaatgctgcccaattggaatatctcgctatcggattgtttaatgacgataacctggccggtgcctgtttagtcggcccgtttatttccaaagccgctaccattgactcgatcaatcaaatcttattgacgactcatcttacggtaagtgagagacgccaactcacccagttttataatgctttgccgattcttaacacttccgaaatcggcgcaaccggtgacttactggttaatttattttcagccccagcgattaaagcccatgccgtacagttgttaaagcccgaccaaccgcttcacgccaaaacggttcaagccattaacgcagaaaatcaacaagcaattgaaaaacgttatcaattggaagccgatatgatgcaactggtggccactggcaatctggacaagattagtcagtttcaacagccactgacccaactaatttcattattcagcagtcgtgtcccaaatcaaccgctccgttccggaaaaaatatctgctttgtcaataacaccttgtgtcgaatcgccgctaaacagggtggcgttcatcccgtttttttagacagcatctctgaaaaatctgcggttctcatcgagaagcagaataccattcaaggattaaaaaacctggttctctcaatgcttcgtgattacactcaattggtgatggacacctcttcggcaaatttcagtccgattgtcaaacgggcgattgattttatcctgattcatcttggtcaccaattttcactcgctgatgccgctcgacaattaagtaccaatccggcctatctttcccgtaaattcaaagaagaaaccgggctgacattcacagcattcacaaaccaccgacggatcaaaattgctaaggattatctggtgaatcagcaattgtccatcaccgacattgccggtctgatcggttataatgacctgacctattttacccgggtatttaaaaagcaaaccggtcaaacaccgcttcagtatcgaaaaaccagctattcgcattcataaataccgttttgtggcttcggcaacttctcccaacccacaaatcaaggtataatattgctaactagaaattattcagaacgttatccatacgccaacagttcttttctaatgtgttctgaaaactttcacactatcattatttggaggtatcctttttgaaaatcaatcaatttgcatatgtacccacacctcatcatcaaattgttaaagaactggccaatagccgtttcttgtcggccagaacgcaaaagatggctgatccggtgatgctgtatcgcgccttattattgaaattctttatggagaagcgacagagtcgggccgttcgaattcaaaaagtcaccaatctcatggcaacggctacacttaacgcctatgattacaccaccacccaaagtattgttaccaaaacagccttttataatgttgccctccaactactgggctttcaggttggcttggacttcgaattggaccacccatttgctgcaatggcccagttcaaattgccaatcgccaatgtcgacgatcaattaagccgtgaacagttggtggatgcttggtatcgactattaaatacccgcacgaaattcggtcagacattaattgactatttggcaggcgaaggttattacgcccaattttacgacgatcaaaacttaaaccggcccctcttttttaatggcaaggcacaagcagtatttgataccagcagcctcatttctgacgtggtttacgttgaagcaccgctagataccgaccatgacggtcaacgggatttattaaaagccgaaattattcgccccgccaataccgaagatggtttaaaagtccctaccgttttcaccgccagcccatacgatcaaggaaccaatgacgaagctgctgataaactcacccacgacgtcaatcatccccttagcagaaaacagcctaaccagttaacctacgaagatattcaggcaagtgacgagcagccgaaacttcctgcaccccgaaaggttaatggcgataccgacgttgccgaagaaacatttgtcaaaacatggacttattcattaaatgactattttctggcgcgcgggtttgccgttgtttattcatcaggtgtcggtaccaaggattccgatggcgtgcggacaaccggtacccgtgccgaaacgttgtcagctaccgcgattattgagtggctgcatggtgatcggactgcctttaccaatcgaaccgatcaaatcggaatcaaggcttggtggagtaatggtaacgttggtatgaccggccgttcttatttaggaacactatccaccgctgcagcaatgaccggagttgccggtttaaagacagccgttgttgaagccgggatttccaattattatgattactatcgggaaaacggtttggttgtcgctcctggtggttttcagggtgaagataccgacgttcttggtgaattaacatttagccgggaacaatcggcagccgactatttgaagattaaggatacttggctggatcaactgaaaaagttaaccagcggtcaggatcgggataccggcaattacaattcattctgggatgccagaaacctgcttaaacatgtcaatatcaaatgcgatatgttactggttcatggtctaaatgactggaatgttaaattgtcccacgtctggaatttacgcaaccgtttaaaaaaggaagcgattacccaaaagctgattttgcaccaaggtcaacatgagtacctgaacaacttccgttcggttgattacactgatttggttaatttatggctatccaataaattatatgacgttcaaaacaacgctaacgatatcctgccggacgtattggttcaggataatgccgagccggaaacctggcacacctatcaagattggggcaatccttccgctgacacgtattcattaagcgattcccgctttactaatttaaatgagaataacgtctttagtgatcatttggacgatgatctgttcaaaaactatgtcaaagataccgctaaatggcaacgggcactctttaacaaatcacacaccaaaatggataagcacgccattcaattgatttcagaaccattaaagaaagatctgatcgttgatgggcaagccaaattaaccctttcagcggccagcagtgaaactattggtttgctgagcgctgctttggtcgattacggaaaagccaaacgactaacggccgttccccaaatcctggccgctcaaaaaattatcaccggctataactggcgcaaagataacctaagggaatttacctttgagaaaaaagcgtcaacctacaagaagtttaccgatgcccatatgaatatgcagaaccgtcagaattcgtaccgagtcgacgatcttaaacccggtcagtactatacagttgaattggcatttcagccaactttctggcgattgctggcaggacatcaactcgggattattatttacgcaaccgatatggattacaccattcgcggcaaccaagacatcacttacacgattgctctggacgaatcgaagcttgaaataccatttttacccagtgatgcgaacgctaaatagaagtgttatcattatgattaatcaaacaaattctagaaagcacggtgatttgaatgaaacaaggaaccaaaatcattactttggataacggctatcatttatggaccaacacacagggcgagggtgatattcacctgttagcccttcatggtggccccggtggcgaacatgagtattgggaagacgctgctcaacaattaaaaaaacagggtctcaacgttcaggtcacaatgtacgatcaattagggtcatggtattcagacagtcctgatttcagtgatccaaaagtgcgcaaagatatcttaacttacgagtatttcttggatgaagttgacgaagttcgtgataaattaggcttggataatttctacttaatcggccaatcttggggtggcttattggtccaggaatatgctgaaaagtatggcatgcatttaaagggtgccattgtgtcatcgatggttgaccgaatcgacgactataccaaacatctggaacaggttcgtgaggaagccctaacgcccgatcaagttgcctatatgaagaaatgcgaagcaaataacgattatgataatgacaaatatcaatcctatgttgatatcttgaataagggctacattgatcgaaaacaaccttcaaagctttcccacttaatcgatgtgaccaacaatgatatttacggtgccttccaaggcgacaatgagtttgtcattaccggtaaattagccgaatggaactttaccgaccaccttaagaacattaaagtcccaacgctggtaacctttggtgaacacgaaacaatgccgattgaaaccggtaagcgaatggctgacatgattccaaacgccaagtttgtttctactcccgaaggtggtcatcaccacatggttgataacccggatgtttactacaagcatttggcagactttatccgtcaggttgaaaataatacgtttaatcaataaaaaataatctgagattaacccggttataaactgatatctatcagttcttgattggatttaatctcagattatttttatgtcataactaaaatgactttatcttttaaaacgatgcttctctatatctccatcaacgtatgtgaaaccgtcttcggtgaacagtaaaataaccagaaaccagacgctgattataccgatttcttgtgcgggcgcaaaccacacaactattaaggctaatatcagtattgtgacaatcagcgttgtgtaactaatgctggccgtcctgttctttggattgttacgaggctttcttttatagtagcttttcatcatgatttgataataaaaagttgaaaaaacaattaaaccagttgctaaagcaacaaattgtaaccaatcaaactcaaaaagcaaatcacaaaaagacgctgctattccgaataacactattggcaggttcttcaacaaactataatgccaagcaaacgtcaaaaaatcatcccccaatccgacattaatcagtgtcctgcgccatacaggctcaaaatgaccgtccccatcaggatcaggccaatccccaagaagctcgccaggttaaccggttctttccaaatataaaccgcaataatggttgttaataccatgccgatgccacaccagattgcataggcaatgtttagattcaccgttttcattgataacgccaagaaatacaggcacgtcatataggaaataattgcaccaactgttggcagcaacacactgaatccttctgaggcctttaacagactggtgcctaataactcgcccaagatagcgagcaacaagaacaagtaccccataagctttcctccgtttaatatcagccgagccgattgcccacctgttgataatagtaaacacccattctgtcaaaagcatcttcataaaccaatcgatccgacttccctgcaagaaagtgatcatattcttcagttgaaacaccggtaatcgattgaaccttcgttggcgttaaggccaagtcatgaatttcaaatttaataccgttcaataaataagccgaacgcatatccaaattcggcatcagtttctgaaaagccacttttctgaacctgtcagctgccggatcatactccccgactgctgcgtgtccggtaataaacgttgaataatcatcgacttgaatcactgcttgaacctgatcatcggtgtagtggagttgtcgctgccaatttttgataagttgaagatcatattgaatctgcttgttttgcgtcatgccttacttttcctccaagaatttagtcttcactgatcatcataacagagaaattcttttctggatttaaaaaatagtcaagaaaactggtttatttctcgtatttaataactataaggtcccaagtaggacttaagaaagttgaggaataagctatgacaaaaacgaagatttatcaagtcgataacgtcaagggagtttacattccctacacaaccgcaatggaaggaaagaatcggcctgaatttgtagcatcatcagattcacaatgctacttttttaaactaattgatagcggtgctaacgaattaaatcggttctatcccttaaaagattggcaattatccggcttacaagggccaacatttgttgatatcggtcacgcattgccagtcgaaaaaaccgctcttcaaagagctgattacattggcagtgtgtcggatcgtgatgattggattttaaataattttatcaaacaatattacgaacaatgatccgctattaaaaaagaagctttcaaatcactttacagctgtgatttaaaggcctctttctttttgccaaaggcatcaatcaacttttttcaggtcagtctgtcgctcaaaatacaacatgatgccaaacggcacaattaaaaagatacctatcaccacgtatgtccaatgctgccagctactaataaaaaagccgaacaaaaaatttccaagtggttgaatgccgtcaaagcacaggtaggttaacccgaaaacccgtcccaagaattccaaatcggtttcgttttgaatcaatgtcgttatactaccgaagaacctggcttggacaatgccacaaatcaacgcaatcaaaatccaagtataaaatgacagaaacgttccacaaataatcagcacggtaccgtaaaataattcttcatagtagatcactttaattgaaacggttcgtttctcaagtgtcagccaaatcccgccaattaagccaccaattgcatatacagttaaaaacaaactgtaattttccgaacgaccgccaaaaaagtgactgctgatatacggtgctgctaataaataacccgcaaaacaaaagttaaaaatagccattgaaaacagattcatgattaatttggggtgtttttttacgtaagcaaacccgattaaattactttttaagattgactgtggttcttgatccgccagtctcttagttggctgatatgaaatcaacaaattcaacaggattgcaatcacaaatgacatcgcattaatcattaagaattcattgaattcaatacttttaattgccagcaataccccaccaattagtggtgcgagaacgcttgcaaaattaaagaacatattggcaaccgcattgaaccgctgtaaaccggcattatcaattatttccggtgcaatagctttggccgctggaaaattaattgccagcatcaaattcagtacgaaagtaattgtcaataaaagccaaatttgaggcttttgattatcaacgataatgccgccggccaaacacatcgatgccgacatcaaatcggttcctactaaaacaacctttcgattatattggtctacaagccgtccaactaaaaggtcccctaacaaaaatccgatgccgccgataccttcaataatgccaagcaacttcgtattaccggtcattcgcacaatcagccaattaaggcccaacaaataaatcgccgaccccagttgagaagcaaacgggctgaaaatcagcgaaaagtagcttctttttactttagtttccatgataacgattcctcaattaacctctgaacgaccgacctattccgtcgaagatcttcattctcataccttatttcctggttgatctccgctgtagtagtttgatcggcagcacatacgtatctaatagtttttcgtcatttttttccaacctgttgaataataatcgcaccaacaaatcggcaatatcgctaaccggctggactatcgtactgagctcagggttatattcctgcacatattttgagccgtcataaccaatgacctgtatatcttcggggacctttaaccccaatttttgagcttcctgaatacatagaagtgccgtcaaatcatcagtacaaaagaccccgtccggttgatgggataccaatttttcacgaatagtcgcccgtttaattgttggtgttgaattaaacggaaattcaaccgtgttaaccggtacctttcgatttttggcagccgttttaaaaccggttagccgcgcattgtttggtgcctttttctcaagactgccggaaaccagcattaaattagttgaccccttttcgatcattgtagtagcagccaattcaccaccagccaaattatcgctgctgactgtcggaatcttattttggaaatagcggtcatatgacacaatcggcagccccgacagccggtattctttaataccctcgttgtgggagccggtaataatgccgtcaacctgattagccatcagcatttttaaatattgctgttctttttcgggattatccatactattacagataatcgctttatagccccgattgaataaacgattttcaatttcttcgaccacttcggcaatcagaggattctcaagactggcaaagatcaatccgactaatttgaattgcttgccgtgcagggctcgggcggccaaactgggttgataactcaattgctgcatcgccgaaaacactttttcttttgtgtcagacgacaaataaccccgatcgttaattactctggaaacggttgtgattgaaacccctgccaatttggcaacatccgctaatttaggctgcataacttcaccttcttatgtatctaccacataacctgtatcattttttaaaaatccattaaaacattattttaagtatatcatatcgaaaaagttttttatgaaactttatgtcaaacgattgacatacaaattcatgagcgtatgatatgttggtgaaaggggttacaaaaaatatgagaggtgagcattttgatcagtaatcagcaaaatccaacttggtggcagaatgccgttggctaccagatatatccaaaaagcttttttgacagcaaccatgacggtattggtgacattcaaggcattatttcaaagatgccatacattaaatctttaggcgttaattttgtctggctctccccattttttgcctcaccaaatattgataacggttacgatgtttccgattatcaagcaattgatcctcaatatggcactttggatgacatttttgagatgattgaccaatttcatcaaaataatattcgagttgtctttgatttggttatcaatcacacgtcggatcaacatcactggtttaaggaagctaagaaatccgttgataatccttaccatgatttttatatttggcgtaaacccgtaaatggaagcgtccccaataactgggtttcgttattcggcggatccgcttgggaatacaatcccgcaacgaaagattattactatcatctatttgccaaacaacaaccggatctgaactgggaaaatccaaaggtccatcaagccgttgccaagatcatcgattggtgggctgaacgcggtgttgacggtttccgtttggatgcgatctcccatctcaagaaagaccaacgtttcaaagacgtcaccaaccaggaagatgcgatgaacaacgtttccggtattgaccaattattggccaatctcagtaccgatttcaagcgcaaccatctgatgaccgttggcgaggccggcggtgttccggttgaacaggccaagcgctgggtggattctaaaaagggctacttcgatatgatcttccaatttgatcacgttagcttttgggaaaaattcactgttggtaaagtcgacgtcgcaaagcttcgagtcgccctcacccgttggcaaaacgggctggacaataatggttggaacgcacttttcttggaaaatcacgatttgccccgtgccgtatcatacttcggaaatgatcaaaagtttcgaagtcaaagcgcgaccgcattggctatgatgtactttctcatgaaaggcaccccctttatttaccagggtcaggaacttgggatgacaaacgttgacttcaatgatattaaccaatttcgcgatttagattcacaacggttttatcgggaagaattagccaagggtgcttcgccggaagaaacattggttaaacttcgtgccaaaagtcgtgacaacgccagaacacccatgcagtggaatgatcagccaaatggtggtttcagtgatcatcaaccttggatttcaagcaatccaaatgcacgttacattaacattgccaatgaagttgaacagcctgaatcggtactcaatttttaccggcagctaatccatcttcgcttaaaagatccaattctgcttaacggtcaatatcaactcattgaaacccatgatcatcaatcctttgtctatcagcgggaagaaaatcatgttggctacttggttatcaccaatctaagtgatcaaccggccaccgtcacaatttccgatcgttatcaaaatagacaactcgttttaacaaatacaaccgagaaacagcaatcatcaaccatggcactcaagccatgggcagcctatctatataaatatgagaggaattaaaaaaatgaaactcactaacaaagccatgctcattacttatcctgacagtctgggcaacaatatcaaggaacttcaatccgttttagccaaccatttaaaaggcgttattggcggtgtccatctcctgccattcttcccatcgtcaggagatcgcggcttcgcaccaatggattacaccaaagtggatgaaaaattcggaaactgggatgatgttcaagagttggcaaaatcctattatctgatgttcgatttcatggtcaaccacatttcaaaaaagtccaaatactttaaagacttccagcaaaaccacaatgcatctgcctaccgggatttatttattcactgggatgaattttggccaaagggtcgcccaacccaggaagatattgacctgatctataaacgaaaaccaaaggcaccggttcaggaagttagatttgcggacggacagtcggaaaaagtttggaacacctttggcgaagaccaaattgatcttgatgtcacgaaacaagtcaccaaagacttcatcaaacaaacgttaaactttttgatggaccacggtgcttcgatcattcgtcttgatgcctttgcctatgccgttaaaaaattgggaaccaacgatttctttgttgaaccggaaatttgggacttattaaacgaaatcaaccaaattacagcaccaaaggcaacaacgttattacctgaaattcatgaaaattaccatattgttcgaaaattaactgatcacaactactttagctatgactttgcacttccaatcgtgaccctttacagcttatattcgggtaagtcggatcgtttggcagattggttgcgtcaaagtccgatgaaacaattcaccactcttgatacccatgatggtattggggttgtggatgccaaagatattttaacggacgatgaattggattacaccaaagcagagatgtacaaagtcggtgccaacgtgaagaaagtctactcaagtaccgcctatcacaatttggatgtttatcaaatcaacaccacttactactccgctttaggcgacaacgatcaagcctatctgcttgcccgggccattcaaatttttgcaccgggaattcctcaaatttattacgttggtctactcgccggtaagaatgacctggcacttctggaaaagacgaaggaaggccgtaacattaaccgtcattattattcacttgacgaagttgatcaagaagttcaacgccccgtcgttcaagcactattcaaattattgaagttccgtaacgccagtccggctttcgatcttgacggtcaaatcaaagtcagccagccaagtgaaaccgaaattaaagtgacccgtcaatcagccaatggtaaggcaaaagcagcgttaaccgccaacctgaaatctcaggaatttaccattgaccaaatcacagccgacggcaaaacaacccgggtcttaaccagcaacctgtcactcgtcgactaaccgtaatcagttggaaagaggatttgttatgaaaatgactcaaacactgccaaaaggatccgatgtcgtggcggattctgaacacattacaaataaagagcgcctcagctatggggccagtgattttgcctgcaatgtcgcaaacggcatggtcggtacctatttaatgtattactacaccgatgtttttggattagcggccggtgcaatcggaacgctattcttcgttgccagaattgtggacgcgatttccggacctacatgggggattatgatcgatcggacccacacccgttggggcaagagtcgtccctacttcttgtggttctcaattccctacgctatcttctttattcttgcgttttcgtccgttcctttaggtccattgggtaaattaatttgggcttatgttacttacatcgctattgatattctgtatttaggtattaacatccctattacatccatgctgccaagcttaactgccagcccccaagagcgggttaagttcagcactgttcgtcaagttctggcaacaaccggtgctacattaatctcaattgccgttttaccggctgttcaattactgggtcacggaaatgataaacagggatttcttgtaaccgctattattgtggctgtcctaacagcttttctgttattagtcactttcaagaatacccatgaacgggtccacccaaagcatcaaacaaagttgtcactgaagcagtcggccagcgccctcaaaggcaattggccgtggatgattatttcatcaatgtatttcttcttctggattggcatgcaaaccaagcttcaagtcactgtttactttttcaagtacaacatgcacaacgccgatctggcttcatttatgctaggattgcaagcgctgtcactagttgtaattgtctttactccatttctaaccaggcacttcggtaaaaaaggcaccatggtcatcggtttgggactttgtgtgattagtcaattggttctgggcgttggtgccaaaatgatgaacgtaccaattctcgccggtgcaacgattctgggatactttggcaacggattctttgccggattactacccgtcatgttggccgacacggttgattacggcgaatggaagaacggtgtcagagcagaaggtttggttacctcgttctccggaattgcttccaaccttggtatgggaatgggtggtgtcgttaccggcttcctgcttagtatgaacggctacgttgctaaccatgcccaaacaccccaagctttaaacgccattgaaatgaactttgtttgggtgccgcttatcggttttggaatcggtttgattttaatgcatttctataaattcgataaaatgcaaccaaagattgaagctgatctaaaagcacgtcacgaagcagccgattaaccgcgtttacgttaatacagtttttatcaattcaatgcaaaaagacataaactgggaatttcagtttatgccttttactttcacttatattgattgctttatttataacgtttcattctttgcccgttcacgcaaactcagcttctcaacgttcaagaccttatcaaccagtccctcataaaagctgttttcatgactgacaataataacattacccgagaagcggtcaattgcccgcttcagggcttccttggtttcttcatccaaatggttggtcggctcatccatgatcaggaagttgcttggcacaaattccatcatagccagcttaaccttggtttgttctccaccggacaactcgtgaatgggtttaattgcattttgtgcatccaacccacactttgccaattttgttcgaatcgttcgctgacttaatttagaatacttatccgagataatctgcatcggtgtcatccgattattgtcccaagccaaatcctggctgaagtaattaataatcgcggatggtgaaaatttagcagtaccgccctttgccggcaatttcttcaaaatggtcttaatcaatgttgatttaccaacaccgttaaagccactaaaaccgactttttcgcccattgaaatagtaaaggttaccggtgctaacaatggtttgttgtatccaacggataatttctcaaccgttaaggcttcgtgtgatccggtatcctcatatggaaaattgaagctggcagaaatattagttgaaggtggatcgattttatccatatgggaaagcttcttctcacgggacttggccatcgttgacttggatccggccttattcttccgaataaaacgttcggccttctcaatttcaacttgttgcttgtcatactgcttttgctgaaactcttcccgctcttttcgttgacgcatggcttttttaaagtttccacgatacttcgtgatcttaccaaaagccacgttaataatacaattggtaattcgatccaaaaagtcataatcatgtgagaccaccatagcggctccgctaaaattatttaaatagtcaaccaaccactcgatttggttgacatccaaatagtttgtcggctcatcaagaaggatgatgtccggatcagcaagtagcattttagccaagataatcttggaacgctggccacctgacattttgccaaccaggtgatcgcggccaatactgtctaatcccaaaccgacaacggtctgttcaatgcgcgtatcaacatcataaaaatcactggaatccaactcgtcttgaattgtgccggctcgttccaacaatttatcgtcagccgtttcggcataagtctcatataatttggtcaacgtttcatttttcttgtacaagtccgcaaatgcggttctcaaaaattgaatcaatgttaaatcgtcttcaatatcggcatactgatccaagtagccgatttttatattcttctgccatttgatgtcaccggttaagggcaattgagtatcggtaataattttaatcaaagtagattttccaacgccattttgaccgacaacacccatatgctcgcccttttccagggtaaactcggcatctttatacaaatctttttcagcaaaactcatcgaaagatttgaaactgatagtagtggcaacttgttcacctcacgttaaatacttttgtgtcgaaatactgcatacaattcgttacgttactctaattaggacgactagtcaacaagtagtgcgcgaagcaaagcggttaacctacggagcataaagcgttgtttggggaaaagcccgcttttggctttttaccaaacaatcctttatgtgcagtaggttgctttgtggagcggtcctaagaagtgcgcgaagcaaagcggttaacacccagaacgtaaggcgtcagtttgggaaatcccgattttggatttttcaaactgatcccttacgtggcgtggtgttgctttgtggagcggtcctaacaagtgcgtgcaacaaagcgcttagcacccagagcataaggcgttagtctgggaaatcaatgtacgttaaagcgatctgttaaataacccttacacaaacagaatttctcttcaaaaggcttggtcaattttccgtttggtatataatgtaaccattacacaactgaaaaggacgaaatttattatgaatatcagagaaatcgaatatatcaccatccctgtctccgacttagaagtcagccgtcgcttctaccacgaagtttttgatctgccgatcgtcaaacttccaaatggtgacatgggtgccgacctgcgaaaaatgtttttagattttcgtgttgtcgacaaagtaacaccaatttcgtttggcctaatcgcaaaagattcgatagccgacattcaagcgcatttgattaactacttcgtcgatatcgtcagtgacccaaccgaaaaaaccgaaaacaggagaaacgttaattcaattacgattcttgacccggataagaatcaaattgaagttaacgagtttaaataaaatgtccccaagtcgttatttgggaaccaaggcactgcaaatagctaaatggatcggctttttaatcatctatttatttgcttcggccaccctggaagtagccggtgactatgtccataatgaatttctttcccgtcatattctgggagtggctttggttgtcaccgccgctgcactggcattaattgcttggcggtatggcaaacagttggatgccgataacccacgacgctttggtaagtcaaaattaacccggcaaaagatagctcaattcgtcctgatcttcgttctaatggttgcctttcaaatgttttggagttatttaatttcaaaacacatcttggtaacccccgataaccaaaaagctgtcgaagcggaccaacttagattaccagtttggaacgccattttttcagtgattctggctcctatttttgaggaactgatttttcggggaatctttatgaattatttcttcaataaagataatcgcttaaataatattctcgccattgtgatcagcggactgttgtttggctatgctcacgaattacaattcaatgtcaactggttaatgtattccggtttaggatgcttcttatcatatacctacatgcatttccgcgatattcgatacagcatcgggcttcattttttgaataattttgtgtcgatgatttaaattctaccattgaccctaaaaaatcggcattattcagtttgaactgaataatgccgatttattctaactaaggatttttcggtgcagacagcttctcttgagctttcttaggaatctgtttccacttggcttgatcataatcaacaacctttttagcttttgaccagccgattttgatataacgacccttaacaaatttatggccggcaaatgacccaacttccattttctttgccttgccgtctttatcataaccagtaatctcataataataaccggttggatatcccttcggctctttctctgttcgggcaacatcgcccacctgaccgtaataataggtcttaccataattaatgtggtaccaaacgccgccaacaatcgcaagaacaaccacaatgacgagcgtataaagcgttccttttttcatttatcaaattctcctatgggttagttactagtgtaactaactatatagagaagtgtcctcgttgtcaatcgttacgttttatttttgaatcatcttttccagataactctctaacttcggatcgtgagcatgtagatacatgcccttgatacctcgtcgcaacaagacattcaacgaatttctcagcaggatttctttactctgttcataatcctgtccgctcaaatcttgtcggtgtttaaagatttcgacatctgtcaccttacttggatccacgcccaatcgattgtcagctgttaaataaaacggtggtccaataataataccgatgtagttcagatcaaatccctgaaccgtgtaaatgctcccaacttcgttaattgtttggggctgttccgcccatggtgtactggtaaaattatactgatcccacggcagatgaaagttcccttcattaacaaggtgtttaccgccatccaaggttgaaggatacccactggttgaagtcattcgtgataacccataatgatcgtttttttgcatgatttgccgaaacattttttgcgcatccgaatagattcgaaagtcatagtccccaacatccgttggcaccggcccaatgatgtcgccatcaatgaaatgatccagccaatccattaatttagggcctgcctgcatccgaaactgctcttttaaatgaacaaagtcatgtgggtatttgtcaatcaatttcaataagcgatccttggtccagaaacttttcgtacgtaatacctggtggggatcaaacacaactattgtcactttacttaattgaataatgtcttccagctgattatcaccataatagttattataatgatcagccttgctcagtaacaaatgggcttcgtcgatcacggttaggttgacgtgtttctgctgtttatgcagtttgttgataaaacttgtcggtcgttgataatactttttaagcatatgtggcgtttctccggccaattcccgatacacttttaacaattccggatgattcaccaaaaaataagcttcgtcaacttcctgtgcaagttccgtaaataattgatttaaaatcaaactttttccggtaccggcatcccccatcaacacaaacaccgcgtgaccatcctgatttaaatggtgttttgtaaatgcggttattctttcaagcacttgcttttgatgtgtcgttaattgaatattcttggaaaatgcatttaatgtatgtgattccaatgattgcatattgttcgatccacctcataacgcgacttatttactcattgcattcattttatcatcttaacctgtcttatcaccagatgtgaacgattttggttgcaattcccctccaatgcctcaataataaaagtaactaacgaactattaataggaggacaatcatgccaacctttaaaaacgccaaaatctttctggggactaacgcgaccacctttgcatccgcaatgaatattacggatggcgttgtcacccacattggggaaacaagtgaagtcaccgatcccgatgccgttgaccttcacggtaaaacggttcttcccggcatcatcgatgtgcatacccatcccaaatacatcgcagatgcactgcatggggttgcttgtacgccgccaaaggtcaatagtatcgccgatatgaaagctgcactcaagcactcttccgcatacggtcaaagtgcctcaatttggatcgaaggctggggatttgacgaatccaagttggccgaacatcgttcaccaactgccgacgacttggatgaggtttccaaaacccagcccatctttatttaccgttcggattgtcattcttccgtcggtaattccaaagcattggaattggccggaattgatgccaacacgcctaatccggccggcggctttattggtcatttcccagatggccgaccaaatggctacatgaaggaagttgctgcaacccagctgctgattcaagctaaatctgctcagagttatctggatgatgttgacaatatggctaatagttccgaccattatttaaaaaacgggattattgccattggtgaattaatgggtcgtttccgtccatataattcgcttcagctctatcaggatgcactggtggatggttttaaacctaaaacagctatttactatgtctttgatgaaatcatgcccggtcaagttgttgaaccaacctcacaggatcaattacggatcgccggtatcaaagtcttcatggatggcagcatttccggtgaaactgcctacaataaagcgccttatccggatggcaaacaaggtgttcttctaacagacgcggatcgattgaaacaggctgtttggtatgccaccgaacaccatctgcaggtggctgttcacgctatgggcgacgctgccattcaactcgtggttgatgtcacagctgatttaacaccttggctggacgatcgcccttccattcggattgaacacgcttcattgttatcggaccaaatgctaaaagaaatcaaccgtgccagaatgaattacgctttggtgacccaaccgattttcttcttcgctgaggacgaatcctaccgagcttatttaaacgatgctcaattcaagaacgcctaccgaattaaatcgatgctgaattccaatgccatgatggcactaagctcggatgcaccctgcacgccatgggaagaacccgacagcccgtttgttgggatttacgcagccgtcacgcgaaccgctgccaataacgatatcgttaatgcaaatgaagctatcaccgtacccgaagccgttctagcctatacaaatacgggtgccagggttggcggatttacccacaatgggcaacttcgcccgggatatgctggtgatttcgtcgtcttggatcaggatattttctccatccctgccgaagaaattaaggatattcgcgttgagcaaacgtggatggcaggtgaaaaggtttatcaaaaataataatttaaaaaagaatctttcgtgaagcaccaacactgcctcaagaaagcaaaaaaaccgaagcgaccagaatcgctttggctttttgttttggggtgttagctcatttaacaatatcacgcaggaggtacactgcgaataataaatagttatggcaaaattcaattaagctttagcattcccctgtttatctttttcaccagcttgaaccggatcttccttctttaatacaaaggctgcaaagattgttacaacagcaacgattgcaccaagaatcaaataagtgtggtggaagcccatggaatcatacatactaccagcggcagcagagaagatgaagacggaaatctgcttggcaaagttcgacgccaacgcgtaaaccgttgcgtaaactcgaacatcaaaggcaccggcaatgtatttcataattgaaacaagtaccaatggcatttcgaaaccggcaagtaaacgaagtacaataacccaaatcaagcttggtgataatgctgatccgataattcgaatggcaagaatcacaccataagcaatcaacccgtttcgtgaaccaattcggttgataatccaaggcattgggaacatcaacaggaattcaagaccaatttgggcagtggtcatataactataagcttgtgttccggcagctgctgtgtggaaaaatgtcttaaagaagataatgaattgttgatcaaaaacatcgtaaattgctgaggtaccaatgtagaagatggataaataccagaagttcttaagcttgaaaatttgaccaatttgcttcaagtcaagtgagttggaagtatcaccggcagccgatgcattatccatatcaatcttgtcactgaataatagtaatccagtcaaaatggtagctgaaattgtacatgcccagaagattgaatttggttgccataagaagatttgaccaccaacaaatgaagcagtcataccggctaacgaaccacccattcgtgagtgaccatattcaaaaccgttggctaagctggcacgttgaacgtattgttcaataactgaaacaccaccgttaaagataaagcaaagataaatacctgtaacgattgcaaccagcatcgagttaatttgcattaatggtaagaagacccactggaagtatggtccaattaacattgcggcaattgcaatggtgaataacaagtttttcttaaacaagagcttatcggaaatcacaccgaatgctggttgaaatagcagtgataaaccggccatggccgagaaaacaaccccggcctcggcaccgttcatatgaccaacctgctccatccaaagggttaaatacccaaaaataatttgccacataaagaagtaagtgaagtgggtaaatggaaatccccaaaagtgcttgctctctttctttcgtggaacgtttgcatcgttttgcataacgcgaagcctcctaaataatctattcaatttttatgttcatgtgaactatttcactttaatgattgcaaaaatagaagcgaatgactaaaacagctactttgcttccatcgagttgaaaaacaatgaggtaatctatggtatgaaattaatcatagttatatggcgtcggtttaccaaagtttggtgtcccgtcttcattccatgtaaacgcctgtacttttgtgtgacggttaggatcatagagtggatcacccttaatatccgtataattacggcaatggtaaaccattaaatccgttttgccatcttcagccaccgtaaatgaattatgccccggtccatactgatgcgttgccaaatcgctcttgaaaacgggttccttggcttttgaccagttggacgcatctaacaaatcaacatcatcggcaaccgtcagcatgcccatcgcatagttctcgtcggtagcgcttgcagaataggttaagaagaaccggccatttcgatgaataacagcagggccttcattaacccagaagccacgaatttcccagtcatattccggtttggaaatcatgaccggtttagtcttcagcgtccagggatttgacatttcggcaatgtataaattggaattgcctttaatgttagtgtccttttgcgcccaaacgtagtaaagtttgccatcatgttcaaatgttgtggcgtctaaacagaacgtatccatccccgtctcaacctgaccatgctcaaaccagtcgtcctcgcctctcatcggatcgacagcgtcgcattcgatacagaacatccggtgttggaacatgcctaacttatccaaggcagtcgtttccgcagctgcaaaatagataaaccacttgccatcggtataatgaatttccggtgcccaaatcaattggctcatgggaccgctttcatgtttgcgccaaattgtccgtggtgcagcgtgggccaaaccttccaaggtatgtgcccggcgaatctcgattaggttataagcaggcaccgaggcggtaaagtaataatagccgtccgtatgtttataaatgtatggatcggctctctgaacaatcaaagggcttgtgtaatcagtcaatgtcattctccttttcctatcacgtgatatctcttatctcttgtgcacgctcttatcatatggttacacgaaaacgattacaatggtttttataaactttaatttgaattttgacttcaaaacaggtttttgctaatataaaagtcgtcttaagcggttacatttaaaaagatttataaaaacatgactctttcactaaaagtgcagttaatcaccgtataatgatataaatcacaagtaaaataacataagatagattatgaaaggtgatgccctatggatttggatatctccaaagactcattggaagtttataaagcgcttgcaagctcagtgaggatcgatatcattcaagaactgtcctcaaagcgcatgagtgtgcaagacctatcaaaaacattaaagttaagtagcgccattgttttaatgcatctcaataaattggcagaagccggtattattggctttgaacgccatggccataaaaaaatatcctacttaaaagttgataacatcaatgttcatttccccaaaacaatttatccggcatttgccgtatacgatactcaggtcccggttggccaatttaccgattattccgtcaccccttcctgtggattggcaggaaaaaacgattatatcggtaaagttgataaccccacttattttatgagtccggaccgcattaaagctggaatgatttggtggacggaggggtttgttgaataccagtttcccaactacttagaggaaaaagacaacctggaaatgctggacctttcaatggaactcggctccgagtttcccttttccaataatgtctggccgtctgatatttcgttttatattaatggtgacgaagtcggtacctggaccagtcctggtgacttttcagatattcgtggcaaatatacacctgcctgggtaccggataacgttaaccaatatggccagttaaaaattgtcaggataacggatcacggcagctatttggatggtcagccctttaccgatgtttctattgatgatatcgactggcaccagccaacatttaccgtcagatttgcaattaaggatgatgccaaacataaaggcggctgtactatttttggtcaaggattcggcaattatgaccaggatatttcaatgaaactcttccacagttaattaatctaataaatgaggtggcaatgtcatggaaactgatgataaaaagcgtgaatttatcttgagttatttggaaacccaacctaatcaagtcaatttaaaagttgttcgccagttaattgagtttagtaaaaacaacaattacgctgcacccgatattttgtatgaattaatgttgatggatcaaacccacgaaaaaattttgaccgctacttttgatttggattttgtggatggtgtgaagctttttaataataaagccgatcgttggttaaccgatcggggccaaaaatatcttcaaagtttaaaactgcaggaaagtcaatccattcattccaatcttgacccaggaaatgctggtgacaccgacacggcttatgatggttacctcactcaattaattgcctgcaaagataaaatgcagacggaagctgacaaagtcaccttacaagaattcacaatcgatttgcgtcatctactaactgacagtaaaaagcttgaagaaggtgcacttaataaattccaaccctttatagaacgaaattggcgtgatttatcaacacccatgacaccgattttagtagaattgtcacgtcgttttttgtttgcgatggcttacgatgcttaactttatagcttcattttgaaagcttcatgatttcaactcaaaaagcactttaccatgccatttttatagtttggcagtaaagtgttttttaaattagcttataaaacaaccttttcctaaaccttatcaataagttgtccaccagaacgctcaaaaatgctttttccaactttctggacaattaatgcaatcataaccggggcgatgatgccaattgccaacctcacaggcaggcttctcataccgatcagtaagcataggtccaaaaataatttatgtccatacataattgcaagggtatgccgtccaataatcggcagtccaaacttaatcggtattttagaagtaaaatacgcacagaccattattgccagcgaaaaaatgacgggaataacagccactgccagcccaatcggcagcgaactttgcattaaatgtgactttaaagacagtcgaaaactaaaatcccccttagaatgtatataaatgatcaatccggcaagtgccataatcggcatattgacttcaatcttttcaagccatttcaaatgcccatggaataacaagtatcctaaataggtataaaacgccgttattaatacggtatccattccccatggcatcatagcaaagccatttatatgcatccacgtaacctgctgataaccggttcccaaaaatagtcctgcaattgttatcaaaaggatgataagccaatttttggtcactgaaatcaatacagtgacagccataatcgtcagcaaatacacgttaataaaccaaaaggtacttgtataaaagttcagtgtccttccgccaagaaccaaatcaaataggtgtttcatcaaaaattgattactttgatgatgaatgaccgtatagaggcaaatgagcaatagaccaatccccgcgtacatcaacagctcactaattacccgttttttaaaaaatgtcaaccatgcgtcggtgcttttcaaaggctttaagaaaatcccggcaattagaaagaatagtgggatatgccaccaatacagaaagtgggccgttgagcttccggtcaaaatatgccccagcacaattgcgatgatcccataagctttcgcaatgtcgagccattctacccgattattcggttctccagaattcgttttaaaatgtttagccatgagatacttgcgttcctctttgatcattcttgtacagcatcatgacagctgccataaatagtgcaataccaataacggtcatccactggctgccaagaatgcctttatcaaagttataaccaaaataatcggcaaagcttgcacctattggccgtgtcaggatataagcaaaccagaatgacgcaatttcagcaaccccgttttcttttggcttaaacattgcccgatagaccaataccatgaggaaaataagtcctaatacaacacccgtattaagaaagcccagtcctaatcccgtaggatcagtgttatacccgccgcttctcgcagttgcaaaccaatccccggcagccgtcccaagcataaaggtcgcagccactgtcaaccaataaaaggcctctttatatcttgacataatatggtgaattgataaatcctttgtggtagcataccacgccacgaaaaagccaatcatcagcacaaagaaaatcagggtcgtttcagcataatgaagaccggttacagcctttaaagtatccgcagaaaaagttccaaaaaccgccaacaagccaactgaattccagtaaaagattggatgatacttatcagatttgatctgcagatacaaaaatacaataaatagtgataatgaccaaccgaccgtaaacaattcaccgagcgtttgatgctgttgtccgaaaatttgacttgaaaaatccgaagctgattcccccagcatagttgaaattaatttggaaatccaaaacagcatcgtaatggcaggcaccttgttttccaatactttatgtttcacaactatcacctcaccttaattagtgatttcagattagcatttactaaagacagcttcactctgttttacgtgagagaaaaatgtgagaatctcagaaaaaaaataaccaagacaattttcacattagccttggtcatcattatatttaataaaattttattagcctacttaatcccaacaacttcctgcagccattccatgcccaactcgaaccatcgtgccatatgtttatcagcgcgatcacggttgacaatagctgtccacttatttgcaagggcaatgccatgattgcctgttccaaattcatggacttcaaacggcacgttgttctttgccaatgcctcagcgtaaacgtgaacatgatccaggaatggtgttaattcatcattgattgatccccaaataaacgttggtggtgttatcgaagaaaccgtctttgaaacatccaggctcctaatgcccatttttttatccaatgtcggcttaataaccggataacccaacatggcaaactttgcgtggctatgtttctcatttgaatagtcggctgccagctgaccacctgcagaaaatccgataatacctaatttatcggtatcaacatttaattcatcggcatgcttaataatgtagtcaaaagactgctcaatagacgccttggcatcctgataatttttcttttccaaaaccggatacttaacgacaaaggcttggaatgcttgagttgcaaatgtcagtgccacccgttcggtatctcgttcttttaattgtttataactgccaccgccaataatcacaatgccgggaagcttttcatccgttttactttgataaatgtctaatgaagactcttctgattgatcaagtccgatattcctaatatccatgaaatcacctcagtgtctatgataagtggatttcatgaaaattaccatgaccaatatgacaaatatttgtggttttcttacaaggacagccactttcgatacctataataattcgttatatcgttattgaatcgcttgataatgacaagttttcacatttattgttaagattgacggaataaattgacttacgtccaatgaataacatataataccctttgttatttccggggtctaattatcattctgaggagcaaggtcatatgtcttggtttattaaacgaaaaaaaatagttatctttttagcctcattcttaattgcaggtggcgtatttattgctaccggcagagtcgcagatacaagttccgaggaagtccaggttgaatacagttcaccggtcatcacgcatgcctatgccttgaagaaaaaagctattttgtacaataatgtcaaactcacccaagcgataaacggcagttcatttttaaaaaccgcctggtatcgaacacatgccgctaaactttcgatcaatggcaaaacacaaacggcttatcaagtcaaagacaatagtggcaaatatacgttttgggttttgcggtcacaattaaaatcgattaacagtaactcctacaagttgaagcttgccggagccaacaatcgattctatcataagaaaattggcttcttcggtgactcaattccttccggatgggatggttatcatttctacatgaacaattcatacccggattggatgaataaatatcttggtactgataatcgtgttgaaaacttttcagttccccacgccaaaattgttggcaaaagatttgcatatattggcacaacaagggttgcacaagacttgcccgtcgctattaagtaccatgaaaacgacattcgtaatatgaatatgatctttattcatattggtacaaatgactacaccaattattcaggatcggggagtttgagaaatgttatcgcccatttaaagcgaaacgtgatggcaatcaaactgttgaatccaaccgccaaactttatggcgtcttaccattaacgcgctatgatgctaacggtcaaaatcgacaaaacatgtcggatatgtatggctacactttcggccaactcagaagtgccgaagccaaattatatcgccaattaggtgttaatgtgatcaactttgacacaattgcaccgaatttgattaccgatcaaaataaagatatcgtgtatgaggatcatgagattcacccaacgccacaggttgcccaaaaactgggttattacttggcaaaatacctaatcagcaaataaaaagaaaagatggtcaggacttatcatcccgatcatctttttctttttgtcatacgtgattcccaaccgttgttaatcttaatatcagtccagtcagatgctcacttattgcttaagatttaatgtgaccaattggtaatttgtcttaacattgctaacctgcttcttggtttgctttccttttttcttaatcgtcgtcacggtatgaaccgtcgacttggcctgctgcactttggtgacaatcaattttgtcccactatccaataaatattccttttcaccaacattcgtagaaaccggatcgatatatgcgccgtgatagccggtcggcaaattgatttttaatacaacatgctgtttggaaaaacccaatgcaatcatttggctaagcgtacaggatgaataagccggatcgtggtattgacggccaacctttagcgattgactaccaagggactttgccagtccttctttggaaatgccacggtaaacagttgtcggctgatcaagatgaaacgcttggatgccggtactaattgacttgatgctggttttaacctttgccgaagcagcgtcatcaggctgacgaagtgccgtgttaatcttgccatatccgttatttgtataataacgaattgcctttacttgtcccttacttaactttttagcccactttttagacgaaaccgtaagctgcttaatcttttcaggattattcttaatacccgctattgaataaacgtacttgattgggttaatgaacgcaaactgatttttattcccgggaattgtcacaacatagccatttcgactggtaagcttgtcctttaccgttaaaacactgttttttgtgactgatacccagtgatcatcatccacacgtccatttgcaatgctgtacaatctcgctagtttattcgttaccaactgtcgtttacccacgttaacagcgtgtgcataataattagtcgtgacataggttgtttggttgccctgcacttctttccgaacagattgggcttggaccggtagttggacaaaaatcccaaccagaaaaatcgttcctaaaagcagtcttttaaatttggtcatttttataactcgtcccttcgaaaactataggcaacattttacacgaatttaactgctttgcaagttcgactaaaattctgactcacgcctcctttaaaatgacccagccctaaaagcattttcttctactattattaaaaagattgatacaagtttcgcagattaacgttgtaaattaaatgtaatttcttcgttaaatttggttaacaactttctcaaaataattaaactttcaaatttcacttgtgttgtaaccgctttttgcctaacaataaggttgagttattaggagggttcatatcatgcaagaaacagcttcacgttcgattgggaaatcgcgaaaagtcccgttgtttatcctgtacaccgccacctttatttttatctgcttattaacctattcgctaccttggctggcgggaagaaccttgatctggaatgtcgacggtattgcacaacatttcccgattttggcacagttccaacggattttgcagggcaccgcacaccaatcactattcggttggtcatggaatttgggtgccggtgcggatcagttaacaacttttgctttttacattgtcggtgatcctttcagttacctgattgccctatttccagctgacaaacttgaactgggctatcaagtcttaattctgcttcgattatactgtgcgggtttggcatttcttgcttgggcaaatcaacgttcattcagtcgtcatagcaaactaatcggcacgttgatttatactttttccgggtacaatttttacgtctccatgcaccatccttttttcctattaccgatgatcatctttccgcttctggcgatgggcgtcgaaaaagtgcttcataaacagaactggctgccactggcacttgcgaccgcattagctttaatcagcaatttttactttgcctacatgctggcactcggtacctttgtctatttattgacccgctatttacactatcgccacgttagtcccgaaaagttaccaaacactaaaattatttattgtgtcatccaagcggtcataaccggattattgatggctggtatcacacttttcccgacgcttctagccgttttaaattcaaccagaattgcctatcacgctaagtttgccaacggcttattattatatccggcaaaatactacttttctttacctaatcaactgattaccagcacaaccattaaagattactggctggttcttaacttctgtggtttggcctttttagctgccatttatgtcttgaaacatttcaaagcaaacagggcactggccattattttgcttgttattctggtttcaatcctgctgccacaagtcagtgcaacagcaaatgccctttcgacgccttcaaaccgctggttatttctggcagtcctgccaatgagtttagcagtaatgatttttgtcgatcaattaccgcatttaacgcgcagcgacttgaaatggttgattggatcaaccgttgccctaatcgcgcttgtctggattacaaagggattaacgttaaacgtccaacaaaatgacctgattgcttacggatttctaattggttttcttttattaattgcatgtcaaacgtctctgaaactatcgttaaaaacggtcgcagtgactctaaccgggttggttttaattaatctggtaagcaatggtcagggatggttaagtccaaataatagccggaatctaaattccgaattgatgtcgggatcagctgctaaatggttaaaagactattatgacggtgcacaaacagcactgccaaataccggtggcttttatcgaacaacaactatgaaccaatattatcgccatcgaactgctggtaataatatccctatggttctcggtacccatgacttgggcgcttattactcaattcaaaacggttatttattaaaatttaaccgatcacttggaaattccgattccgtggtcaactcagtgatcggtgaaggcgatggtcgtacgaccctacttaacctaatgggtgttcaatacatgtttgccaaaaccgatattattaagcgtccccaagcagttccatatgggtttcattttgttaaaaacaatcagggaggtattcttgattttcctgaacttccggttcccggcctcagtaatcactcaggtaccgtgctgttaaaatcagatctggcgcttccgttggtttatatgcaaaatcatgccattacggcagctgattataacagtttgtcaccacttcagagagaacaagccctattatcgggtgccgaagttcaaaaacccgttgatggtgtctcatcgacttctcccaaaccaactgttaagaccgttggttatacgactcagatgtatgatcaacacttggttaataaccctattaaggcaacactctatcgaatgaggcattcaccaaacatcagatatcgtcaggctgccgctaaattcaagacgacattgccggccaacaaaattgcgatctgggaaaaagcaaccggtcttaacccaaagggaacacccttaaaaaacgttattgctaaaaatcgggaagtcgttgaacgccacgaggccgaaaatcaaagcggcttaaagatcatggataacgatgcacagggacaccacttggcataccgattgaatttaagggaccccaacaaataccgtaacagtgaactgtacctggtcattgatggcatttcagaaacccgtcatacaatgatggaccgccttgataacctgcgtgcggattcaattgtgagcggaacgccggtttccaagctgcaaaagattgatcgtttaagaaccgccgccgcatttccggatttgggcggttactcaatatctgtacaaaccggtacaacgacagctcatgtccgtcaactgccgatgaataacctttcagattatgaagaccgacagcacattgttctaaaccttgggtacacctcaaaggcaaatcgtgcactgatcctacgtttcagaggcgttaaacaattgcacttcaagagtctcaaaattatggcagtgccatttaatagaacttataaccgcaggattaaccaacttcagcaaaccggtcttcagtatcaaaaagtcaccaatgatactgtttccgggtataccgacttaacaaatcgtcctcggattatgaccacttcgattccgtattcaaccggctggcatcttcaaattgatggtcgcaatgctgaaacattccgtgttaataccggttttgtgggtgcccaggttcctgaaggccaccactttattaaattaaagtacgaaacacccggttttaaacctggtatcctcctatcgattgcaggtatcatctggtgggtcattttttcattgatatatggcatgactttgttgatgaaacaccgaaaatagtgacgaacttgagcgtctgtatcaattccctaatccaatttttaaattaaccattaaaagttgcctttttacttttcaaacctgtcattttgattacaattagagattggaagtgaggtaatcaatacttctttaaccatgtcagcgttcaattttgctttaaggttaatttatggttactatgaaaaaatacaaaaagcaatcaaattagtggttgcctgattaatattgcaaatcaagtcttttaggaagggttcggtgatcgcaccaaaattatgagaaaaaagagaattgaatggatcgatattgctaaagcctatggtattatagcggtcgtcatcggccacgctttggcaagtggtacaaccacgcatatcatttattggtggcatatgccgttgttcttcgttattggtggtttctttttaaaaccaataaatgctaagaaattaattgaatggaaaaggttctttaataaacgactttatcgagatctgttgatctactttatggcgggaatcgggctcattcttttgtacagcattttgtataataaagattggcaatacctggttaaccatctatcacgattaattgtcggtggccggacattaaacctttacacaagtacgttttggttcattaatgtttatctgctgtcgatctgcgcagtaacacttttaatttcaacagtaaaatctcgctggatacagttgggaattgtatcagcagctttatttgcaggtacttgttacgataagattgattggatgcacctctacagctttgaaacaatgccgtggaatgtggacattgttttaattgcagcattctttacctatatcggttatctgtttttccacactcattatcaatggatcgaaaagccggtaccaattgcaagtcttttagtactttccggaacattagttgtcctctatttgaataacagttttgattttcaattttcattgaaatcccacgagatccaatcttcgttaccaaaagtggttatgttggcaacgattccactcattttttcatttggcgtaatgggtctttcctatctaacatcccatcttgaaagcagctttatcttggcaacaatcggtcaacatacaatgattatcatgtacctgcacaacgccctactggatatcacttcaatggccggtatcgaaaatgttgcaaccaaggtgattattgcaattatcgttccaatgctgattactttggttaaacgcccggttacaagaaaccgcagcctttaccttgacagttaatcattacaaaagcgtttgagaatccttttccctttatagaggaagctcaaacgcttttatagctcaaattcaaccataaatggcattttaaccgcttaacgaccggtcagtgctacaatgatacttgaatcattaatcatcattggaagtgattttttggaaaatcctgagattcaaccacatcaagaaaaaaacaccaatcgtcttgtcctttcaaccgcatggaaaatcgttcaagatgctgactatcaagcagttacgatggatgccgtcgctataaatgctcacctgtctaaaaccgagctttatcaaaaatggcccgaccgtgccacgttggtaacagccgcattttctcattacgattcaatggccgttaatctgcacgttccaaacggtggtcacttagaacgtgatttaagtaaattattcaaagaactactaccggaaattaatgaattgagccgccccaagttcgccgggctagtgccggaaagattacaagatgtctcgctggatcagattttttcaatcggtccaggcaaggattttcataaagtcttgatgactatgctgaaacgggccaataaacggcacgaaatccagctagaccaattgtcggaaaatgttcttaacctgcccgcacttctattagttaaccaaattattcagggaaaacaggttgttaagaaaaatttggaccaactcattacagaaatcctgctaccggtttttaccgcgtcaaaagtgaaatggatataatctaattaaaaataagcaagaaaaagggatcagacttatttcaaaaccaaaatggctggaaataatatctgatcccttttaaatcgccaaacccaaagtgtccattaacgagtctctacgtgaaacgtcattaattgtctgttaatgaaagactcgcgctattcctgcaatatcagaccgctgtccatttcgaatcggctgtaccataatccgtggcggccaactttcaataacgcggtttccaccaagataaatggcaacatgccaaatcgtatgggtgcccggttgataataaaagaccagatcacccctttgacgatgattataggaaacatgcatcaactttttacttgcccaaagatttctggaattccattcgtttcccggaaatgcatgatgaatcgaactaatcggtgccggatcaataccaccggcatataatgcctgcatcactaaaccggaacaatcagtcccgtatttaggactggatgaagccccaaccaggtatggattccccatatatcggtaagcctgatgaatcattgcgtcgatatgtgcctttcgtccctgccaagcatttgcttttaagggtgccacataactgtcaatccctgtccaggatgtcttagtaaatcccattttcagccaggttgcttcattcacattaccggtcacttttaaatggtgccggctttgaaattgcctgaccgcatgataagttgcctgattgtatttattatagccggcaaaagtccccattttacgcataatgtaccaggttttaataccttcaaacccccgtttaaccgtatagccgatctgcccatagggtttaatctgttgataatgaacctgatagtattgcttggggttttgatacccgcttgtcttggcaacaactgccttatttgccgtcacgtactgttgatgattcgtttcaagtgcagtgactctgccatctttttgaacaacctcatcaatctttaaaaaatgaccctttttaaccaagttggatttcaccgttcgcgctgaatctttatatagccgaaccgcttttttcgttttaacaatacccggatttgacgtaaatgatgatgctgacgcctggaattccccggcaaggccaaataaggcccctacacctaaaataattgctaacctaactcgtcgtttcatctcaatctcccctcaaatgatctaataactcaatgcccgataagcatccctgcttcgatgcctctgcaaagtttgaacagtcatgcttgcccgtttggctgtccatggatcgttgtaatatgcccgggttgctgaataacccgttattgccaatgcatgattcacaaacccatcaacgccgtggacccaaacaacaaccggatggtcctgcctaattgattgcttaatcctgccaaaacctgctccggtcatattgattgccgatcctgcatgatttttaaccaatttcattaagcctttgggataaatccaccaaccggatgttgaataaggattaccaacaaatcccttattaggatttttgctgcgcggcatttcacgcgccaactgcattttggtcacatccgctccggcatactgcagcatcatggtcgtcgcagcaatttcacatccggttggcagctgcggcctttgtgcaaccatcggaacgtttaatcgcagatacgattgattcatcgcacttttatgaatccaaccaacggttttgtgctgataggcaatttttaaccaagtgccatcaatggtgacctcttcacgattaacgtgaacctccttacccgcatattggcttgcatacgcaatcggatcaacattttgggcagaagttaaccgtcctccggtttggtatatcccattatttcgggatgtgccattccctacttttaaataatagtttgccggtgtattggaatacacctcttgataagtcgaatcggcaaatgctttcccggaaaagccaaacaccagaaagcacgttaataagcctacgaaataataaatactcctcattaaagtcccctttttcccttccattaatataattgctattaaatgataagttagattatataggaaaaacggagatttgcatataactttgtgcaaaaggattattttatccggctgatttcggcatgttatccactacaattaaaaagagctgagcagaatccccgtatccctcaacctccaactttgggtatacagttgtatcgactgtatcgccacatttctttataaaccggtttcttataacaaattctccggatatggtttgattgcgacagcaccccaaatcatccggctgatatcactaaaggttacatcactttcggtataaatattttcttgaatattttgagcatgcctccgaatgaccgaaaaaatagctgccattgtaaggcttctatcaatcggccttaacacgcccgcttttattcccatctcaaataaagatgcaattggattatttgggcctatgagcttagaaatataatcgggaaagtctttggacaaggatttgatttgctcgataatcgataagctgttggggttatcaagagaaaaatcatacattgcccgaatataagcaaaacaacgtttctcaatagccactcttttgtccaagacaatctgcatgcccggggtttgttccaactgattaatttcccgtaagtaaaccccttccaataaggcccgtttgtctttgaaataaagatagatattagattgagatattccaaccttttttgccacttggattgttgaaaccgatggggcaccctcactcacaattagttgtgccgttgcatccaatattttcttttcttttgttaaatcttttttcttcatatacatagattacccaaaaaagaaatcagtttcaaggttgacaaaagataggactatctcttataatctgttctataaaagatagtcctatcttttaaggaggagactttatgaaaataactttacttggttcacttggtcatatcggcagtattgttgcaccagccttgctgaaggatggtcatgatgtcacaattatcacaacaagccaaaagcgagctgctcaaatcaaagaattgggtgccaatgcagcaattggtactatgactgatgaagacttcctttctcggcaatttcaaaacgccgatgttgtctatttaatgatctctggaaacagtgatggttcaatatttgaaaatgccaaaaaacagggtcaaattttttcaaatgccgttcgaaaagctaacgttaagaacgttgtcgacctcagtagcattggcgcgtacgaaccagaggccggtagtttgtatgcgtaccactttattgaagataagctccgtgagttaaatgatgtcaacgttgcattcgttcgtcctgtcggcttctacagtaacctatacactaatgtgcagagtattcggcagaatcacgtcatttattcaaatattccggaacaaaccgaaggaaaacgggtctctccgattgatatcgctaaggtggtcttaaaacttttggagcaaactccagaaggcaagaccattcactatgtatacagtgatacttttagtatgcaccaattaatcgaaatgcttaaagtgtcccttccaatgccagatcttcattttgttcagataacggatcaagaggctgaaaaccagttactctccaatggcattccaatgtcaatcgcaaaatcgtttgtccagatgaatgcttttcaacgaaatccagaaaagctttatgaagatcttaatcgtcaatcccctgttgccgggcattataagctaactgattttgtccaggaattcaccgcctctttcaatgatcaaaagccatcaggaggatcaaatacactcgtggacaaatagagcaaaaaagttgaaacaatataaaaagaaccagaatgacagtgatcaaataaccgtacactaattgggactgctcctcaaagcaacgccctatactccgaacgtaaatcgctttgtttcgcacactaatccgaattgctgcatgatgttgctcaccagattttccagcaccgcttttcaaacaaaaccaatcactgttataaatggtcctcaagatattagatttttttcacgaattttctatctctaaatattaagaaatgagcaaaaatactaagtcattagtgtccttgctcattttttaattccctttacctatttcctcatccatgtcaataattgttagccaaagggttcaatgtcaaccattcccgaccctaaactttccaattctttagatcgcttagatattgtgagtatctaatttttttcaactgatgtttaacacgataactcgaaacccatttccaaaaccaattttgtcgcgtatttctcttaaataactgattttgccaatatgtaatatcggcggcaatttgtttctggctcaaccagggataatcatgtcttaaataagagttgcaacttttaaacggtctgaccgtccaatattgatgaccgataaactggcttcgcgtgacctgaaaatagcgggcctgcccagatgatagtcgataaattcttctaaccaatccgattccaaacggtggttgagacgtttgcagcagccttttccgatcatcaacggatttggatttttctgtacgcaaatagggtgccaagggaatcacaatcaatgcattctgcatttcgtttcttccacgggaatcgctatttaatgcatgctgaagatcccttgttaaacgatacttgaccacccggccattgggtcgaataacatcggcacaccaaatttgtttaagcctcgccatcttgattcacctacctcaatctgatctattgcgattcattgtatcattagaaaccaatagaaaaggcgtggacggctaaatgtaaactgaatttaacggaaaagtctaaagtgacgtgccttattcactatatataacagtgctcatcactattcctgcgcggataaacacaaaaacacgccaagtctttatccttgaacaagcgtgcgaacttccaggatcttaaactcagtgtgctgtatttgtttttgattcgtgtgcaaaaggcatcaaaaacgcactagtaaatatttaatttaacagttggtttacgaaatttgatttaggaaagactttcccggtaattgattgccgatttcaaaatttgataaaattgttttgcccaagtcgctaaacgttgaacgaatgcccagttgattgccattcgcattgggggatgcagcaatcaacggaacaaattctctggtgtggtcaaagcccttaaatgtaggatcattaccgtgatcagcagtaattaaaatcaagtccgtgggcgtcatcttctcaataatttcttttaattgagaatctattctcattagttctatcccataaccttgtggatcccttgcatgaccatatttatccaaatttcccaaatccgcaaaaatcaaaccgatactttgagtttccatggtttcaaggagcttgtagaaactgctttgtttgttataaatctgaatccgattttcaattccccgaccggaaaaaagatcatttaccatgccaataccggaaaccggggtatggttctcagcaaggaaatccaagacggtattagcttttggcacaattgcaaaatcacgccgattatcggtaagcttaaaatctgaaagggtcttaccaacaaatgggcgagcaacaactctgccgatttctaaatgactttcatcgaccacgaaacgaatatatctacaaatccgatacagttcctcgagcggtactactgcttcattggaggacacctgcaatactgaatcgcttgaagtatatacaattaagtcaccttcttccgattgctgttgaccaaaatccttaatcgcagttaatgttgcagctggacgatttagaatcactttacgatttgaaaacgtctcaattttgtgaatcagccgagacgaaaaaccacttggaaatgtatccaattgctcttttagcggtgcacccatcatttcccaatggccattcaaactgtccttaccagcagaaatctcctgcattctgccaacttgacttattagtggtttcgtcgctaaaatccccgttaacggcgattgacgtggaatatttcccaatcccagtttagttaatgttggcaaggctaaagatccccgccagtaatcgcaaacatgtcccaacgtatctgaaccttggtcgctaaatttatcggcatcggcagcttcgccaatcccgactgaactaagcaaaatcacgacaactcgcttaaatctcctcatgattaattcacccggtgaagcttacgttaaatcccccttaacagaaaagctgaaattcttagcctttcattattagtgtagcatctcaggacaaaaagattattgtactaagttacaaaatattggtgacgattattgtggtagtatacaacaactattttgaagatttcccgcaaccacgcgttataatagcattttttgtagtttatacttaaataaagaatggcttaccaatgtgtacgtacgaatcaaaatgcgttaaagtagactaaaaagttagtacacttttagggtgaagaataatgattgatttgcgaacagtagttaaaaaagaaaagaagcgtatctttcaggttaatagcgcctcccttcatgggcgaactgcaaatgcaattacaatcatggataacgacgcggtccatcaatgggcccgaagtggggaaatcgtcattacaagttcccgaatgatgcccgaaaatatcgatattgccaaacaagtgatccagaaacttgcgcagaaaaacacttgttgtctgatggtaaaaccatacactgacagtatcagttcaaagtttccggcggaactcagggactatgccgatcaactcgatttccccctattcgaaatcgataaagatgttacatatattcaaattatgaatgattttaatacgttactttttcaagaccggcgaaccaacaaaatggccgatcttgatttggattatttactaaaatcaaactcagccagcgataaggactttgattttatttcaggtctaaagggcgttgatttatacaaattgtataccagagttacaagaatttctttggctgaaacaccaaaatccagtgaacggatgatggttcagtataatttgatcagtcaattacatgcactttttgcaaaactcgaaacggataaaaagatcacgacttactttgttttggagtcagcagacggtgccacgatcgtttctttcttcaacgacgaccaagctgaaaagccgccttatgacagacaggtttatcatcgacttatgagcaccatcaaaatcccccacttttcgttatatgagggtgttgccagtcttcatgaagccaaaaacctccaccgctcttttaccgaggcgtgtttcggcatggatgttgctaaaacaatggattggcaaaatcatccggtcttttaccgtgacgtcagtctctgggaattagttaatcaaatttccagaattcaggacagcaggctgtatccggttgaaatggatcaaatattgactaataaagaagtctttgaaactgttcaacaattttttaatcataatgaatcgattaaagagaccagtgaagcactttacacccatcccaatacggttcgttatcgattaaacatgatttacaaacaaacgggattggattatcggcgaacaaatgataaatttctgatctacattgcattaattgaaaaattgctgtcggaaaaagaatagtgtgcgcagcaaagcggttaacattcggagcataaggcgtttatttcggaaatcccgggtttggattttggaaataaatcccttatgtgtagaatgttgctttgaggagcagtcctagaagtgtgtggaaaaagacgtttttgatcccagagtacaaggagctaaattcaatattcccgaatttggaatattggatttagtttcttgtatggcagggatcagtcttttggaacagtcctaaaatagtgtgcgcagcaaaacactcacccataacccaaaaatgcctgccaatttcacattggcaggcatttttttcttataaactaaacgcgccacgtaccatccatatttttacgaatgatttttgtccgtccaagatcaacatcgtctttggctaactcaatgatgccctcttttagcggctcgggtaaatcccatacaattctgtaaaactcatcggttgtcattgaagtaccggtgatttcttcatattgtcgaattgcttttttacgaagtgcggaaaagatctctccggcctcacgatctgaatacaactgctcttgtagaaaaacgatttgaaactgatataaatagtctttggcaatatcctcaatctgagtatgttccaatactttcatcatagatcaatcctccatttttcaaaacagtgacaattgatggggctctctctaagccccttacaattacaaatcaaagcgaatcagtcataactcaatttaaatgaggtaggtgtttatttcgcagatttggtgaccatttgtctgcaaacctagaataacacctactttccggaaaaccggtgaaatttacgaatctgtacaaaacatttacaataatcagtctaaaaggcatccccgtcattatggatgaagtcgggaatgccttttagttatgattaaaaatagacaaatagaaaaattaattatacttccaatgttttttgcaatgttttcaacttgaaagctgcttctgttgcatccaatccggctttgaggtcaattgaaacgccggcttgtagtaacgctgcaccaaacaaagctacaaaattcgtaacaaaaagacgctgtgcgctgtatcccattgttccaatccgccaaatttttccctgaaggctgccaaaggaactggaaatttcaacaccaaagtttttaagtagtgtgcttctaaaggtatccccatccaatccggtgggaatttgaacacaggtcaccatcggcatgtcatgatcgccctcatgatagatagtcaatcccatcgcatccaaaccggcattcagtgcccgatgtactgttaaatgacgggcaaatctggcatccaatccctcctgaagtgccaaacgtaacccctcattcaaagcataatcggcaaccgttgcttcagtatggtgattgagtcgcctgggtgaccaataatcctgtagttgggttaaatcaagatagttactggtaataaaggtatcgccattggtgtccaacgcggtcctgacgccttgttcaactcgtttacgctgattgatttcttcagcaaaccgatcattgaacgttatcggggtaatgccggatggaattgaaagacatttttgggcaccgccaacaaccgcgtccaactgccacttatcagcctccaccggcgttcccatgtaagaagcaaccgcatcaacgaccaagaaaccaccgtattgatgaaccgcttcgcccaaacgatcaatcggctgcaaccggccagttgaggtctcaccatgaacgattgcgacaacttttggttttaagcgattaatttcgtcaataatttgatcctgatcaaaaacggttccccattcggttgacatagtggtcactttaccaccggctctctgtgccaattcaacaaataaatccccaaagcgaccaaatacaggaactaaaaccgaatctccggggctgacaatacttccgataactgcttcgtttccggcacggctggtaccatcaatcggaaatgcccactgattctttgttctaaagctttttcggatcatcaccatgttttcgttcataatatcggtaaaatcaggatcaaactgtcccaatatctgattactcattgcttgtgagacccgtggatcaaccatcgtcggccccggtgtcatgattaaccggtgatttatttttaattcactcatatgaatcgctcctcttccagatgcatcaataactgaacttgttatttattcccattaaatgcagatacctttttacatcaggttaaatgaattttggaaagaaatcattggtacaattgcacaaaaattacttttaaattgttgcctgcatccaagtgccctaaaaacatagaaaaattttttaattgattttggaccaagtaaaaatctaaatcttagcatgaactttatccttacttattatttacaaaagcaaggccaaaaatataccgaatttttacgccgatcctgtatcgtaaagttgttaaaaaattgaagctattgaggagtggaattgatgaaaaagcatagattggtttcaggcttggcattattaacaattgcaattggtttgggtggttgtgcaaagaccagtgccgagaatacttccaataattggggcaccattgttaaagaggcaaaaaaagagggtgacgttaagtcggtcggaatgccaaattcttgggctaactggggtggcacatggaatgatcttaaaacccaatacaagatttttcattctgataccgatatgtccagtgcgcaggaattgcaaaaattcaaatccgaaggcacctctaaaaacgcacctgatattggtgatattggcattaacgttgccccttccgccgaacaggaaggtctgctcgccaaatataaaaccaagtattggaatcaaattccaagttgggctaaagataaaaagggatattggtcagctggttataccggcagcattgtcttcattaccgataaaaagaatgtcaaggcagccgatgccccaacttcatggaaacagcttgcttcaggcaaatataaagtagcagtgggcgacgtttcaaccgaagctcaagcccagtactccattctggcagcagcttatgccaatggcggcagtgaagccaatctaacgcccggtctaaactattttgccaaattgcaaaaagaaaagcggctgtcaacggttgacacaaccattcaaaatcttcaaaaaggtgaaatctcggttgctgtgatgtgggacttcaacgcaatgaattacgcccatcaaattgattccaaacgctataagatcaccgtcccaaccgatggaaccgttcgaagcggttatgccgaagtggtcaataaacacgctactcatccctatgccgcaaaacttgcccgatcctacatcctctcaaataaaggccaaatcaatttagctcaaggttacgcccgaccaattcgaagcaacgtgaaacttccggaaagtgcccaaaagaagttgcttccagaaaatgccttcaaaaaggtttatcacgttaaaaataataatacttggaataaaacaaccctaaaattgggacaattatggcagaataaagttttaggagctaagtaatatgatcaatcggctcaaaatatatggcccgtttgcgttgctgattattcttgttctacttcttcctttaattgtcatgattatttcaagttttcaggcaattaacggtgggtttactttgtcaaattaccaccaaatcatgacaaatcagtattaccaccaagccatcttcaacagtttaaaaatctcgtttatcgcgtcaatctgttcactggttgtcgcagtggcgggtgcctgggcactaacccatttaaaagaagagaccaagaacacactcattaccatttttaatatgtcatccagttttgccggggttcccctggcattttctttaatcattctttttggtaatgccggtgtcgtaaaagctatcgcaacggctcttcacctaaccaaccactttaatatttattcgttaaccggcctaacgttttcctacacctttttcgaaattccgctgggcattatgttcctatttccggtgttggaggatcttaatccggattggaaagaggcatcccaggtattgggcgccaatcaggcgttctttttacgcaaagtcattatcccgattattttgccgaatctagtagaagttttcatcctgctgtttgccaacgcaatgggcacttacgaaactgcgtatgcgttaaccggaaacaacatcgtttccatccccatcctgatcgggtcattaatcaatggtgaattaaccgctaatctgccgcttgcctgcgcctttgccagcctctttgcaattctgatgaccttaatggtgatgctcggtaatcgactcaccaaatccaaaagcgagggggcaaagtaatgaagaaacacaaacaaacgcttatcccgaaaatgatcattgcgttaatctctatttatctcgttgcccccattattgcgacaactctttactccttttcaacatcgtgggttaaaaccattttgccggaaggattaacgtttcactggtatgctcaactgatcgccaatccggactttgtttcagcaatgatccgctcgcttgggcttggcatcctgacgacgattatcgcaatgacctgttttttgccaattattttttacgccaatgtctacaacccgggactaaaagcccgactgcgttttatcaccgttttaccatttacaattcccggaattattttggtaaccggtctgatccaggtttatcaaaacattgccgtcccaaaaatcatcattttgttgttggcgatcacattattgagcctgcctttaacctatcaaacattggataacgcctttatttccagagattttcgggccatgttcgaacaatcattgattttaggcgataagccggttcatgctttcataaaagtgattcttccaaacatcaaagttgggattttcgtcgccagcctactcacgtttacaactgcttttggcgaatatgtgatcaccaatatgcttcttggcggtgattttgaaacgttgaaaatttatatgtaccgcttaatgcaaagcaacggtcaagccagcagtgtgctgacaaccatctactttgcaattctggccttcatttcattagtgcttgtactcatcgttcaaaagggatcggcatccaaaggaaaggagtgacatgatggcatcagatttcttaaaagtaaccgatttaagtatcaccttatcaggtaacaacgtcatcaataacatgactttcagcatcaagcccaatacgctcacgacctttcttggtccaagcggtagcggcaagacaaccgttctacgggcaattgccggactaaacacccaaatttcaggaaaaatttatttagatggccaagaaattcaacagctgccggttaatcaacgacacattggcatgattttccaatcatatgcactgtttcccaatctcagcgttttcgaaaatgtcgcctatgggttgagagttcaaaaggtttcggcaacagccatcaaggataaagtgacccgaatgctgaatcttgttagtttggcagacaaaaaagacgccttccccgataatttgtcgggcggtcaaaagcaacgggtcgccattgcccgggcaatggttctcgaacccaagctattattgctggacgagcctttaagtgctttggatgcaaagattcgtgtagacctgcgtacccagattcgccattatcagcaggaattgggcatcactatgctgtttgtcactcatgatcagggtgaagcaatggcaatctcggatgacatcattgtcatggatgatggtcgggttcagcaacaaggttctcccctcaccatttataccaagccccgcaatcaatttatcgcccaattcatcggaaaccataacttactgagcggtaaagatcttatgcggctcggctttaaacgcgctcaaaaaaggttgattgatccaaacgatcagtatattgtcagaccggaattatttgttaaagactcttcaggtcagtcaaaagaaaccatgccgatttccggaaaactgacatcgattgctgttctgggtgaccgcattcgttatgaaatgcaaacgccccaacaaattcgtttaaaagttgagacgttaaatcaaggccttccgctcggtatcaacaccagtcaaactctctacctctccccggatgacattgagaaagtcggtgattagttttgctatcaaacaacgattttaaccggattgacagaaaaacatggaacggtcatacccatactgaattttgtccccacggttccggggaagacacagaagacttcattaaggcagcgatccaagccggctttaaaacctactccgttacggaacattttccgatgccgcccgacttttatgagcatgctgtcggctccaggcatgccatctacacagcggccatgtcagacagggaactaccggaatatttgaggaaaatgaaccggttaaaagaaaaatatgctgataaaattcggcttctaatcgggtttgagatcgactatttctcacagtatcaacgctggacggctcagatgctggatgtttacggctccgcaatcgatgatgccatcctatccgttcattttctgccaaccgttaacggattacgtgccatcgacgactccgatttggactttcgaaccggcgttctggccgcctatggcacaccggtcggcgttgccaatgcctatctaaaaacggttgcagaagcaattgattggcaggtgaccaacaagccacagcgttacggtcacatcatgctgtatcggaaatggcgaaacctgttcgatagcagaaccgtgtgggaagatcacgcaacaagggacctgttaaaacatatcctacagaagattgctgccagacatgaatttttggactgcaatatggccggtctgtttcgaacctcccaaaccgaaagttctcctaatttcacctggttggcccaagcacaacaattcggtatcccactggtttatggtgcggatgcccatcgagtagccgacgttgcccaaggatacaatacctaccttgaaaatggttatgataaataggagaattagttaccatgaaattacaaatccacgatcatcatccctttaaaatctgtcagctcaccgacatccatcttggtgattacccgttcaatgacgccgatttaaaaacactggccagtttaaaggtcctatttgatacacattcctttgatcttatcatgattacaggtgatcttttatggggattacagtcctccgatcccgctaaaaggcttgggaaactctatgatcttcttaatcaatacccgactcctgtagccatcacctatggcaaccatgatacagaaggcattttcagccggacggatctgcgtgaaattgaaagtcacctcattcatcctgccgacaagcatcactcaatgatcattgatgacagagaatcctatgccttggaaatttatgacgatcaacaactggcccatattgcttatgtttgggatagcggcgcttattcccactggcaaaagaccgatcaatacgctgccgttgagccggaacaaattgattggttcttaaagctgccatacgcaagaacctcaaaaaagatggatctgggatttttccatattccgtttccggagtatcaatccgcggccaatcagataatcgatggctttaatcatgaaaaagtctgttcgccgacgacaaattccgggctgttttatgccctcttgcgacaaaaaaacgtgaaagcaacctttgttggtcacgatcacgacaataactttacgagttcttttcggggaatccagttaaactatggtaatgtcaccggttataactgttatggcgagctgacgcgaggcgtgcgggaaattgatgtctcaaaagacgcaatcaaaacgaggattattttgttctctgaaacatcagataattgctccgattaacccataacgccactttcaaccagaacgtaaatgccgatagcaataaagataatcgggatcatcacactcttataatggtcaagcttatccttaataatcggcaaattagcaattttgtagcccaaataacaccagacaccggtcataattgtaaaaacaattaccgtcacaaccagctcaaagatcgtgtactctgtaaataatgggatataaactgtcagattacccgccccgtttgaaacagtcaccaaccccacactgaccatctgaggattaatcagtttggaaagtgcggttgctctgggactgattttctttgtctgcttaatttccgcttgaatttcggcttcttcggcctcgtcgcttttgccggaatgatgacggtattcaagccacttcttaatacctaaaacaatcggaatcacaccaagccagccaactttatccgttggcaagaaactaagaccgtatgccgcaaagacgctgaccagtaccagtagctcaaaaccaacgaattgcccccacacaatatcacgttttctcaaaaccgcatcaacttgagagaaccagacggccaagacaaaggtgtcgtcaatattggtaccaataaatgaaacaatgctggtaataattgtcgtaaccatcgtcattcccccaaacctgattttaaatcacagttacctgtggatactttattaatgattggtttcactaacttcagtataccctactccataaagtcttagtgcaaagtgtttgcctaaggctttatttatatgtatgctgatggggaaatattaaatgatggatgcagcttcaatttgaacagcttgcaaaaatgcttttgcagcgagcttaacaaatggggatataaattgaatccgcatctatgtatctacgcatttaaagggggatataaaatcatgacaaaagttacttttattggtattggcgatatgggatcccaaatgatcacccacttgccttctgccggttacgatgtcaccatttgggataaggatccggaaaaaatcaccaacattggcaattcggacatccatgcggcttcctcattggctgaagcggtcaaagcttcaaaagtgattatcacgtctgtcatgtctgacgacgtattgacccttcatctcggtcacgatggcaaacccgggattgtgaactttctacagcccggcagtaccttgatcattacatcaacacttgatcctgaaaaaatctttgcggttaacaaagcccttccaaaagacacccaattgttggacgtcccgatcatcggtggtgttagatatgccagagaaggctcactggtactgattgccagtggcgccaaagaggcgtttgacaacgttcttcctgtcctcaaggcttttggaaccgtcaaatacgttggtgaattgggtaacggtgccaaattaaaactcatcacaaacgttggcatcatggcagccgaagccggtattcgagaaacgttggatttagcggacgcttacgatattgattacgatacagtcttgggtctcatgcagatgggcccgttaaaaccggttgtcagccgagccttggataccagcaatccacgtcctctcaagggatcggttgccgatgaagaagaactgctcaacgccactaaggacctaatcaagttgccgttggcaaaaggatcccgtgaccgtttgagagatgcggttgacgcggttgaaggcgaagcccgctttattgatattaccaataagaatacggcgttaccaaagtttaaataagcttgatgcactcgacattcaagcgtactgattcaatttaaaagatcaacaaagcaaaagtatcttcaactttcatttacgaaaattgaagatacttttttaatttgattgattttggaggaaatcaatatcatggaaaagtcgactattgcttttaaaattctgccagggattctttaatcgcatcttcataaatcccaagtccggccttgatttgttcttcggtcgccaccaacgggctcaggaagcgaatgacattatcatggacaccggcattttccatgatcaatccatgtgaaacggcatgcttgataattttggaaaccaattccggatagggctccttggtttccttgtcttttacaaattcaacgccgatcatactgccgatgccgcgaacatcgccaatctcttcatagcgtgacttcatatcggtaaacctatcaaaagccatttggccgatccgtgtagcccgatccgttaatttctggtctttgatgatatcaagtacctgaaggccggcagcacacgccaaagcattgccaccaaaggtactgccgacaatgccgggttgcacgccttccataatatgcgaaccggccgtcacagccgccaaaggtaatccagcgccaatcgacttggccattgcaatgatatccggtgcaaatcctttttccttccaataatttgaaacaaatagtttaccggaacgggcaaatccggattgaacctcatcggcaaccaacataatcccattttcatcacaaatttttcgaagtgccgctacatattcaaaaggtgccggaataaaaccgccctcaccttgaattggttcgatgacgattgcagcaacctgctttgccggaacggcttgttcaaagacatactgaagtttgtcaagatagtattgaatactctcttcgcgtgagtatccccgtggtgcccgatataaatacggaaactctgcccggtgaataccacccatcgctggttcaatcccatatgaatacgtctttttagccgtcattgttgacgttaatgcggtccgcccgtgaaaagcaccggaaaacacaatcacgtcgccccggccggtaaatgattttgcaattttaacggcattttcgactgcttctgcgccggagttaacgaacatcgttttcctggtatccgcgttaacgggcgccaactcattgatccgagcagccaaatcaacgtaattggcatgggtggtaatgttgatcatcccgtgaaaaaaccgatctgcctgctgtttaaccgcatcaatcacccgttgctggccatagccaacattcataacgccgacgccggcaacccaatcaaggaaccggttaccatcaacatcctcaatcatggcgccacttccacgatcaatgacgacagggtaattgcatagaacagcggatggaacattttcagctcgtttggctaaaattttcttggcattgggtcctggaagcggcatcgcaacttgaggcaatgccccttgtaattcatcagtttcgagcataaacaacacacctttcatttttaaatcaaatggcacatcatgtgacaagatccatcaaaaacggttgctgacaaaatttattgactgttaatgattagaatattaccacctttttttgcttaatcaagctttaaattaaaaacacgttagataatttaacatttaattaaatttaggttgctttattcacattttgatcctataattttggcaattcatgttatgtgttctaacattgttaaccgtcttttttggatttagcgaaggagtgctgttcatgcgtgaaaaactatcggataccaattatgttgcaccttctcaagaaattagtccccagcagcccagctcggctgctacaaatacttccggattaaaagcaaattcactctctttttttgaagtgttaggcgagtctgttgccaatattgcgcctactgcaacgccggcgattacaatcccagtcgtctttgcactagcaggcaacggtacttggatttcctatatcattgcaacagttgcctgtgtccttttagccaagcaggtaaatgtcttttctcgtcgatacgccacttccggtagtatctatacttatgtgaccgatgggcttggcagccgggtcggtttcatgtcaggtgccagtatcctgttcgcgtacatcaccaccgcagtggcagttttggcaggctttgccatctatgcgcataacttacttgcctactttaacctgtcactgccttatccggttttaatggcaatcggaactgtcagtgcatggttcatggctcaaaaaggtgttgaactttcaaccaaaaccatgatgaccatggaattcctatccgtttcaattatttcaattcttggtattgttctcctgttcagccatcatttttcaatcaatcccaataatgtcgccttcaccaatatatcgttcagtcacgtcgcatccggtcttgggctggcattctttagctttgtcggttttgaaggtgccgcttcaatgggaaaagaagctaaagaaccgcttaaaaatattccacgggctgtcatcagcagtccacttgccgttggcattttctttgttatcatgtctttaattatgatgatgggcttttcgggaaccggtcactcacttggcgaatccacatccccacttgcttttttggctaccagcaaccatgtctcatttcttggttactgcattacgctgggggctgtcatcagtttctggtccagtaccgtaggcgtgattacggccgggtccagaattatgatgaagatgagtcacgaaggttatttaccaaaaatagttgcgtttgttaacgaaaaaaagaaaacgcccacctttgggatcggcatttccggagcaatcatcggtctactgggggtcggttttgccctaatgacgacaattgaaaacacctatgaatggtttggaacaattgccgtttggggatttttaattgcttatcttctggttaccatcagtgccccggtctttcttcacaagtacgacgaactaaaagcacgacacatcatttcatccgtcattaccggtattctcctaatgatcccacttgtcggaagtgtttatccacaaccggaaggcccagccaaattcttcccatatatcttcggtgcctggctggcaatcgccttcctgtttcatgaatttaaagatcaacagatggcctcaatcaaacaatcggacgaaatcaaaacacaaaagtcttaaaatcagcaacgtctaactgagattttgttatcccccaaaaacgagtgctttacaaagaagtggaaacgattaatcaaacagcctcaacaattaaatatcaattcgaatagaagaagcttccttgattatgcggtatactgaggttgttcattacttttccgtcaatcatttaagggggtcgatcgtattgagacttaaaaatatcaatgtgccatcagctgtcaaagccggtatggtggccggattcttatccggacttgttaaactcggctgggaggatgtcttgcctccaagaacaccacaaagagacgccacaaacccaccacaggcaatgttggaaaaattcggagttcctacttcaattacccattcaacctatacttattcagaacagaaaatgccttgggtgagctttatcattcactttggtttttcaacgacgtttgcggttggctacagtgtcatgcaacacgtgattccccctgttcgtttgggacacggggcacttgccgggataggtctttggggtgcttttcaccttggcgtattgccaaaaatgggcttaacaccggaggcaaaggatctccccatcgaggaacaggtttcagaagctttgggccacattgcctggatgagtacgattgatcttgtaagtaatgcgttgtatcagggaaaacaattagataagtaagtttattaaagtaaaacagatggttcggattgccgagttggtgacctgaaacatctgttttttgtttgttcgattatatactcgaacaagtcataactgcctgtttaaagccacaacctcaagatgtgtttaaacatttcaacagctgtcagaaattcccactaaaaatagcgatgatacctctaataacattttttaaacggaaccaacaatatatgcctatttaattcgaaaaataactaatcatcagtcaaaaatgttatggtagtgttagagggtatatctttgataatcatataagggggaggatatcgttgagagcaacaaaattagttcgatttatgttacttatactcggtgcattgctactatgtattggtttcggctctgctaatgcttccgtcgcgaaggcagggcctatttatactgatgaatcgcaagttgaaattccctatgtcaccatcaactttacttacgatgatggctcaaccactaagattatcgacaccgtgtatgaacagggaagtgtatatgcaaactcatggcattacgttaatgattatcttcccaagggatataaattcgattttaataacaaagccgattatccagtacaataccagcaaagcggaaaagttttagtttggaccagcatgggaaattcaaaagtaaacatcccgatcctaccaattgatgccaacaacgcatccgtcactatccgttacctcaatgcgctaacccacgaacccattcatgatccggttcaggtcaccggcacggttggaaatcgctatgatgtttctgacaaacagataacaattaatgactacaaattggatgaaagtggtgactcttggcctgccaacatcatcggaacgttcactaaagagcctcaaactgtcaccttttactatttgccaaaagcaggaaacattaccatcaactatatggataaagcgttaaataaagagatttcggatcctgtcgtcctttctgaccattacgttcgtgatccatatgatattacaaacgaggaaaaaaccatcccaaattacaaactcgttgaaaaacctgctgcactaaagggtgaatttaaacttgatccacaaactttcacgttctactatgcccaaaaggctcaagatgtgactgttcaatatttagatgaaaatgatcaatcgattgcaaaaccacaaacgatttcgggttacgttggagatgcttacgatgcaaccactgatcagtatcaattaaccatttctgggtacacgttggacactaatagattacccaaaaatggcacgggaaaatttagcagggatgctcaaaccgtgacgtatttttacaaaaagcaatcaacacccgtcaaaccagaagagccgggtacccccggcacaccaacaacgccattgattcctgcaaaaccttcaataccaacgacaccattagtcccttcaacgccgattatcaagcctaatctgcctaattacgctgcaaccaagggcacggttgtctattccttgaaaaaaatcggcctatatcgatccgcgaatttttcaaaacaagccagaagcgcttggtatgttaagaagcctagagtccatcgaccaatgtttgtcgtaaccggctacaccagatcggcttcgggtacattaagatacaaggttcgcgatgttaaccacttaaccactcatcgttacaagacaggctacgtgacagcaagctggcgttacgtacgacccgtttactatgctaaaaaacatgccaaaatcaccgttatcaatccaaggggagttaatgcctaccggaaagaaaatctgactaaaaagacgcgccattatcgtcaaggtaccgtgttgaccgttaaacgactggtcaagcataacctcacgacccggtttgttctgtccaacggtcgatttgtgaccgcaaacagaaagttggtcactatgggatctcaaaaaccggttcgatacgttcagacgaagcgccctatcaatcgatacaaaactgttaatctgaccaagaaaaataaattattttccaagaataccaagattaaagtgattggctttgacttttcacggcctcacagcaccactcagaagggcgcgttaagataccgtgttgccggtggttatattaccggtaacactgcttatgtcaaaaaaatagccaattaaaaatgagctcatatcaaattcacattaaagaaggagtcgccctgattgtcagagtgactccttctttatggttttcttatcctattgattacattgataacaacttccgatacatttcaggtcgtcgatcacgaaagacaccccagtctcggcgggttttatttgcttcgtccaaatccagttctgctacaataaaatcctcggtttttcgatcagcctgtttaagaatatcgccaaactgatcggtaataaatgatgtgccataaaaggtcatttgagtctcatcaatttcagtgccgattctattgctcaccacaactggaatgagattggcagcagaatgtccttggattgtccgttgccaatgaggttgactatcccgttttaaaaccggttcactaccaatggcggttggataaaagataatctctgcccccattaatgtgagaatcctggcagtctcaggaaaccattgatcccagcatattccggcaccaatgcgcccatacttggtcttccaaactttaaacccagtatctcccggagaaaaatagaatttctcttcataattatgaccatccggaatgtgggtttttcgataaacatccaacacttttccatctgcatcaataacaaccaatgaattgaaaaatgtgtttccgtatcgttcaaagaaactcacaggcaaaacaactgccaactttttggccaaaaatgacagtctggcaatgaccggattttcatttagcggtgtcgccaactcaaagtatttatacttttcctgatgacaaaagtatggcgtctcgaacaactcctgaagcaggataatttgggcaccggcctttgctgcacctttgattaactcttccgcttttgttaagttctgggctgtatcccatttgcaagccatttgagtagccgcaactttaacttttctcaagtgatcgcccccagcattcctgatagtattacaaacttataggccaaatttttctttagtatcttccaatgcaccgtgcattcgctcaatgacctgatccaattgatcatattcaatgattgcaggcggctcgaaacgaatagtcttcgaattaacgagggttcccgctgtcagcacccctctatcaaagagtccttttgcgacactgtacccgatttcgtcagaataaaattctaccccgatcatcaaaccaatgccccggacttcctgaatgacttccggaaattcatctgccaaagcttgaagtttaggaatcaaatagtttccttttgccctggcctgacccggaatatcggcttttagcatgtatgaaatagtcgcaattgcagctgcacagcaaaccggattgccgccaaacgttggtgatcctaataaccatggattatcaattaactgctgcacccacatttttggccgacaaatcaaacctgtaatcggcataataccaccgccgaatgcttttccgtaagtcaaaatatccggtaccacatcttcagcctcacaacgccacattgatcctgttcgacccattccgcattgaatttcatcaaaaattaaagcaacaccatattcatcacaaatctcacgaacttctttgagatatccctttggtggcactataattccggcttcaccctgaactggctcaataataactgccgctaccgtttcgccgacagccactaaattacggattgctttacgcatatcctcagcattgccatattcaacgtgttcaacctgttgaaccatcggaatgtaaggctttcgatatgttccttttccacccatggaaattgcacccattgattttccatgaaaagcgccaatggttgaaatgtaccagcgaccgcccgttgcaatccgagctagtttcaaagccatttcaaccgcttctgcaccaccatttgtgaagaaacatttttccaaatctccgggcgtaatatcggcaaccgctttggctaaataaccccgcagaggatccaacagttcctgggaatgaagcgcctgatgctccagctgcgctttaacggcatccaagatgtacttatttcgatgaccgcttgtataaatgccgaagccgcctaaacaatcaataaattcttcgcccttcaaaccatgaatgaccgcatcctgatcggtccattccaatacggctgcgtcagttgatacagattttctgtactttaaccatccgggtgacacgtagttatcaaaatagttcaacgtgtcctttgtcattttgtccttttgatcgtcggtcatctcgtttcctttaataaagccaaggatttcatcaagatcatcaatcacggactcttttgaagcatcttttgtaatcggttctttttccatcgcaatcactcctcatttaattaattgactcgtcttttgatactgccactcaccgccaaccatcgtgccaaccacttgaacatctttcatatctcgtgccgttgtatgttcaagatttcgatccaaaacggttatgtcagcaaatttaccagctgataatgaaccgattttattttcataactgcaggccttggcagcattaatcgtatgggctaacaatgcctggcccaaattcagtcgttgatcggcatgccaaccctttgccggttcaccaatcagagtttgactggtcatcgcaaaataaatattctgcatgggtgtcacattgactactaccggactatccgtcccaaatgccattggaatgtgatgagtctcaaaaaataggaacggccacatggtctggctgcgtttgccaacatacaagtcagccgtttgataatccaacaacggatgacttggttgtaccgaagcaaccacaccgctttgcgccatcagtgacaaatccgtcgggtcaattgtttcgagatgttccaaacaatgttgacctgtctttaattgtccaaactgattctttgcggcaatgaaatcgaccaaagcctcatgaattgcccgatcaccaatcgcatgaattcgcagtggtaactgatttgcctgtgccgaaaaaatcaactgtttcatttcagatgccggtatcattggtctgccatgatcctcttttccttcatatgctgctttcatccaagctgtataactgctggtaacaccatcaaagaagagtttcccaccagcaacacgaatccgttcggtagcgtacctggccgataattgtttcagcggccccacgccccgtttgaaataaggatataaatgaacccgaatcggtagtcgattttgatgagccagtaaatggtaggctgccggataaatctggtcatccagttcggcagctgttttagcgggcaatagtgccaaatcacaaatcgacgttaagccaaacttggtcaagtgttttaggtaaggtcccagcacggccgccttttgttccgttgaataattgaagatttggtgtaaaaaggccatcgctgtttgttcaccaataacgccggtcggatctcctctggcagtcacaaccacgtccttgtcaaaacgagttgaattgaccgacggcaataacttgtttaatgcttcggtgttcagccaaagcgtatgcagatcatccgcaatcactgccacgggatgatccgggaaataacgatccaaggttgctcgacaaggcatccgcttatccgtccatgacggtacataccagcccttggcaactatccattgttcgggtttcaattgatcacggatgaccttttgatccagttcttttgcacacgccaattcggaatttcctgaaatcagtgttatctggtgacaataaaccaaagccgataagaacatgtgactatggctctcaatgaacccgggaacaatggtctgatccccaaaattggtcacggttggccgagttgccaaaaaacgggttggaatctggtcaggatagacaccagcaatctgatgatcgacaacgacaatcgctccggaaataaatttctcggattctgcggtaaaaatcgagttgcttttcaagatttgaactttagccatctgctttcatctcctcatttacctttggaccgtttaatttttctcacctgaaaaaccgcattcactgcaattcccaaaacaatgaccagcatcatcagcgtagaaatggcattaatctcaggtgtaatgccggtttttaccatcgcataaacctgcagcggaaaagtcgtgctggcgggtcccgtggtaaagaagctgataatgacgtcatcgattgataaggcaaacgagaatccggccccactgataactccaggtatgagaagcggtagcatcacttgcatgaaagctttgaaaggtgtagcacccaaatccaatgcggcttcctcaagtgtttggtcaattccgatcaatcgggaacgaaccgtcaaaacgacaaacggaatacagaaagtgacatgtgccagaatcaatgaaaataagctgagtggaatacctgccaatgaataaatcgataggagtgcaattcctaaaacaacttccggaatcacaattggaatatagagcaccttatccaaaactgctttcccgggaaaatcatatttattcatcgcaactgcaccaactgtaccgataacagtcgcaagtgctgcactgacaattcccacaatcaacgtattttccaacgctgacatgatttggacattttgaaaaaccagatagtaccattttgtagtaaaccctttgaatagaatgttcagcttggacgtgttaaatgaaaaaacgacaatgaccagaatagggagatacagaaaaacaaataccagtccgattaacgaatttttccaaagactcccactatttgatttttccatgctaacgacctcccagatccgacatatcaccaccccgacgttgaaaaacgatcagtagaataatcgtcagtagaatcagcattaccgaaatagcggatcccagtggccaattacgcgatgtctgaaattggttttcaattaaattccccatcatggtactggtaccgccacccatgacatcactaacaaagaagtatccgagcgatgggataaaaaccataatacatcccgcaaaaataccgggcttagaaagtggaataatgatttctttgagtatttgccacttggttgcacccaaatcttcggccgcctcaatcaagttatgatcaatccgatcaagtgaattaaaaattggaatgatcataaacatcagcagtaaataaaccatcccaagcacaataccattagtgttatagaccatcgccaaaggatgattaataatgcccaatttctccaaagtggtgttcacaattcccgtctttcgaagcaatgtgacccaactaaaaagtctgacaagcgaatttgaaacggaaggcacaatcaccagtgccatcaaaatggttttggcaacaggtcccttttgtgcaatgaacatggcaaacgggtaagcaattatcagacagatgatggtacttaatccacctatccagatggattgtgcatatatcatcaggttttgggtctcaaagacctgggcgaagttatttaacgtcaatttatagacaatcccaccataaaagtcccgcgacatgaagctcatgaccaaaacgtatattagcggaatcacaaccaacagcaacatccaaagtgaaatgggtagaatctggctccatttcgttagtgtcttcgacaaatgatgtgttttttgtttggtaacggataaggtgtccctatcaatacttttttccatttttactcacctcacgactgttggttcacagttgaaaaatccggattatctacgacgttgtaaacatcgtcggaagcagtctcaaccaaaatggcatcggataattcccaataaacaaataccgacgttccaattggtagcagtacctgttcacccggcgtattcatttttaaagccatgccattcggtaaccgtaatacagtcttgttcatgttacctgcgtaataatgttcagcgacagttgccggaatatgaaaaccggcaacttcggtttcagacaattttactttttccggtcgaatcacaatattaacaatttggctttcggataccggtttcttggattgaatggacagatacccattttcaattgtgacctttgcgccggctttggtgatttcggacaccttgccgtaaaaaatattggattcaccgataaaattagccacaaaacaggttttaggcttttcatacaatgttctgggatctgcaatttgttccagatgccctttattcataacggcaatacgatcactcatcattaaagcttcttcctgatcatgtgtgacgtatacaaacgtaattccaagttttcgttgaagacgctttaattccaattgcatttgtttacgaagtttaagatccaatgccgaaagcggctcgtcgagtaaaagtacctggggatgattaatcagtgcccttgcgatggcaattcgctgcttttgaccacccgaaagttgatccaatttccggttaccatagccttcaagttgaacaagtttcagcattttttcaacttgaaggctccgctttggctttggtactttagccatttttaatccgaacgcaatattttgggcaactgttagatgtggaaatagtgcgtaattttgaaacacggtattaattttccgcttataaggtggtaaatcacccaccggtttttcatcaaggaggatttcgccgctggttggttcctcaaagccggcaatcatccgaagcgtggtggttttgccacagccggaaggccccagcatggtgagaaattcgccttcataaaccgtaaaattgagatctttaataattttaacgtcaccgtaatttttcttgatcgaagaaagtttgatcatttctttcatatcagtcatcctttctacaaggcattttctccacgttccccggttcgaatccgcatcacttcttccaatggggaaacaattactttaccatccccgacttccccagtggagagtcgttcgtgaatatcaatcagaatattacctactaaatgatctttgacgtaagtaatcacgtgaattttcggtaacagattaatatggaactcaccaccctttaaaatggtggttgttttttcgcccttttggtttccagcacccattgctgacaaaatcgtcataccggagacacccctgtcagacaaaatctgtttgacctcttccaggttttctggtcgaatcgttatttcaagtttcttcacgttaatcacctttcctttaagtgcttcgatttggcatgatggtttattgatcacccttaaaatcattccaaaccttatcaatttttgttgtgtttctaccaaggttcaaaaccgtttgggaacgcgccagtatattgttcggaaccgttaccgctggattatcacgaagcttctttggcaacagcttgactgctttcttatttggattgtagtaaggaaatgctttggaaaatttaacgctggttttgggttccagcatgtagttgatgaatttatcaacattggtcccgttcggcgctttctttaatttcatgaaaacgtcataggcaaagtaaattgattcctttgggtaaacgattttaatgtcatgattattctgcatagccagtgcaatttcaccaccgtagatcaggccagctgatacttcgccgttgattaaagacgttttcgggcttgagccgtcaaaaatcttaatattcggtttcaacttggcaagatacttactggcatccgacagggcggatttactggtatcattaatcttgtgaccggttgccatcaatgcacagccaacaactgcccgtgaatcttcaaccgtgaccagagcgtctttgaattccggttttaacagatcctgataacttgtaatcggcgttttgacttttttgtcgttgtaggcaattcccatgaccgttcccaaatatggtgccgagtattgattggacttatcataaggttcattcaaagcagtttgacttaaattcctataattgggaatctctgccttgttcaatttatccagcctgccaagttttcgaagaacttgaacatacataccaggcgctaaaaccatatcataggttccattagcggatgaaagcactttggaaagcatctggtccggatcggaataagaagtgtaattaatcttaatacctgtttccttggtaaattgatccagcacgctttgcggtacatattcactccagccaatcacattaagcgtcttactgtgttttgcggcatgtgaactggcacatccggataaaatgaacagacaaatgacaagtacaatgctcaatagcagtgcttttagccttttcattaactcgcctccaattcttagtagcattcaatgtaagattaagtaacatttatttattgaaattaagtataatcatctttcaattaaatacccattgccaaaaagggccaattttgttaactcttttaagtaaccaatacttaaaaagaagtacaaaattggccttttcagcaaaaaaaattttgaattatcttttatttttaattttatggcatataatataacattataaaacaattagaatttgggtgattctctaatgaaaactttctcaacaaatgatctatatgttcttaataatattgtccatcatatttactgctgtaagaatcccaatcaaatgagagaacagttgatttctcagctgtcatttctactcgattttgatggcagtaccttttacttggcatccccgcaaaacgatcaacaactaaccagcccggttgttgttaatattgacccggtatttggccaaaaatatttagcctgttacgatcagctggactactcaaaagggttaatgtttactggaagaagcatgacatatcgagaaagtgatattattccggatactcaacgaattcattcaaaatactaccagattttttacgcaaaatacgggtttcattattcacttcattcaagtattgcttttcagggtcatttcctgggtattctttcattcttcagaacaaaggggaaacctaatttcacccaaaatgacatcgagttgatcggtttattaaccaaccatctggaagcccgcctgtttaacgattatcaagcagcctgttcctgcaaaaacaaattaactttgcacgatgctgctctacgctatggcttgactaaacggcaacaagttattacccgaagtttgctggatgggatggacaatgatgaaatttgcgcccaactttatatcaccaacaatacgctgaagaaacacatcttgaatgtttatcggaagttggggattaataatcgggtgcaactgtttaagatggtgagggagaaagaataattgagtttttcgtatacctttccatagccattatttaagggaagatttgagtgaaagtaaatcagtttgttcaactttcattgattaacacgtaaaaaagattatcttttctcaactaataatttaatacaaattgtagtattaggtttaacatcatatcaaaagtagtattatgtgagcataggaagggagattaaaatatgttttatcaaaaattgaaattactgcgaaaaaaatatcagtatacccaggaagaccttgcaaaggcacttaactacacccaaggtgcaattaattcttgggaacataatataagtcgtccaccattagaaatcatttgtcaaataaacaggatttttaaagtttccactgattatctaatttgtaaaccagaatctattaccttgaacagtaaaaagattagacaaagaaaacacaagtcctaaatcatccgagttaaaatatgttcctaatggatcatagaatcggctttcaaccgattttacgatccatttttatttaaatctacgcactatcacatcgtgaggtaaaaaaagattacctttttgatcatctatactaagcaaagatgattttagcttagtgtaactggtcatatacattaattcagaaacataatcctcaacattttttcattccacgactttattgattcattaaattttttatgtcttaaacaaaaaagcaagtctaattacagactcactaacaaatcttaggaatgatcaaattcctacatcaaattcaacatcattagtttattcatccactaaagcaaatcatcctacgggctttcctttaacaaagaagtccattatcaaaaaagtattagattaatacgtaagactttaacacaaatattcaaacaataaaaatctccgtttctttttgtgttcttgcttaaagcatgcctcaaaaatcaacatcctgatggaccatgcaaataattgagtacaacacttaaatttagcatcctactaaggcctgaaccagcaagcaaaaacatgcaagattgagacatcattgatttaacatcctactaaagcctgaaatccttaaatgatcaagttgccaaagggtttaacatcattgatttaacatcctactaaagcaaaagtaagccattacctaaacaaagacttgggtttaacatcattgatttaacatcctactaaagccatcactgatgtcgatggcatcgttattttgggtttaacatcattgatttaacatcctactaaagcaattgaatcgcacgcgcaatcgccttatgagggtttaacatcattgatttaacatcctactaaagctatcttttgctgtggcgaccgtgacctgtggggtttaacatcattgatttaacatcctactaaagcgtaggttctcttgcgtcccgtcggcactgggggtttaacatcattgatttaacatcctactaaagcataccgttgagtttatcggcggtaattaaagggtttaacatcattgatttaacatcctactaaagcacaataatagatgttacgaatatctttattgggtttaacatcattgatttaacatcctactaaagccacgctgtataatgcacgtcatccggttcaagggtttaacatcattgatttaacatcctactaaagcccgttaaattatcatcataatttaatggttagcattatgccaatcaacgaagtcttcatcgatgtagtaaaaatcagcgtttccatagaaatcttgatgctccatttctgtgaattcgataagtacaaccgacacccttatctctttaatcatcgcctctatctctctcaattgatcaattgaaagatattgtctgacattggtaaaaattaaagtcgtctttaaatgacattcttcatacactttaaggattgattcaatcatagcacacgggttgttggcagtaccagaatcaaaatgaatttttgcaaatcttgtgagttccttcaaatcgaaatcataggtgacctcaatgggcaaatcgatcatgtacagctgttcctgaaccgtattgtaaagtctgttcagcgaatcatggattctattcctttgtggatcggttaagtcatcaagaaacgctttcgtgattcgactcaaatagcgtcgttcaatctcctcaccaccagtacagacgtctccaaccagatcaattgtcttagaaacttcaagttcatcataagtatcgctacaaaccttaatctgaccgccatctcgaaatcctcttaacaaatcctgataaacaaccgagctgttcgttccaatcactgtgacctgctcattagaaactttaaccggttgatggctagcgtaagaaataatcataaaatcaccgtccggtcagacgtattgcgaacatcttcttttggctttccggtcagaaaatgcatgtcactatactgcttttcagtcagcatcaacgattgaattaccccagcttccggtaaaaaagttgaaactctcttttccataaagttagccgattgccgacttacacaaacccggacataaacagaatactgaatcatcaagaatccctcattaataagttgcttacggaagcgccgatattcccgtctttggtgtgctgtatcaacaggtaaatcaaacattatcattaatcgcattatttggtacctcatctctgaatcccacctcaatttgaattttgttacttttaccactcaaatacttgagacaattccgaacgtgctcggtcaaagcgtttttgagcagtgttgatttaccattaaacccgatttccatgcttaatagctgaaccaacccatacttcacatcgggtgtcagctggtcaaatttttgtgaagcaatccaaaaatctacaacgggacggaatggttccattaagtctgaccccaagttaaacggattctcttcacctctgtgatgaataccaatataagttaaatagccattactcacaatttcttgattaattgatgatagtaaaatcgaatacccataatccaatgctgaattgattgcagaaccatttcgacgggaaaagtcattattaaataataatggaaaatactttctggcaactactgcttcccgattactgggatcggctacctccagtttatccagttcttcatttacttctgttgtatcctttttatagaatgctaaaacattgacttgattggtcattttgctgccaacaattttggtccataagacttcctttcgttgctcatcccagttcacctgttcttgcagcaattttacgcttcgattgttcgggtaatacccgaccgtttcgcaaatcggttgattggtcccgtctgtgaaaatcaccttcgttcctacttgtgccaactcactgattagagccgtagtaatcacagctcttgtcgtcgaaatcaacaatatactaatatcatcaattggaatctgattgattccatcattagtctggacgatcatcatatgtgatgaataggataattttgcgtgttgtgtaataataaccgaacgccaccccaatataaacatctccttgaaattcgaaatctgacagtgtattattttagttaagggattgatcatccctgtttaacatcattgatttaacatcctggtttaaagtcaaacaaggcagtaatgccaagttcttacttatgactcacgtatgtgagcatacatataaaaaatggaatcattctctttaatgggaatggttccatttttgtattcacattaaagatcgctaagtttaatttgtctttcaaatagccccgttggtgactgatagcaaataatcgaatcaggatcaatggttaatccatttgaagcttgcatttttccaaatggtgaagaaatacctagatatcttaaatttgacattgttgcattcgcatgtaacccattcaaaattgcgtcaattgtttcatacttaccataactagttaacttactgccatcatattggttgctgagtggcagattcacaaaaatgcctcttcctttatgaagcgattctcgataatgcctttgatcatacagttcaaaatattgatcaaccttttccaaaatctcgtcataaacatcaattagattttgattttcatcctggcttttcaccttaccattcttactcaaaacctgcatcgctttatccgataaaacaagctgtttggcgttgtactggtaagatgaacttcccagcataaatttcttattgccgtcaacaataagttgtcgataataaacttttccgaggagtacatcaaattcatccactgtctcagtaatttcaccggtcttgcgatttttctttttcttggtgaactggggctttagaacctcatgaacagcattaaggtaactatcatggccttccttctcagcctttttaagcttagttacagctcgcatcggtatcccgaccactttgtaattatcttcttttttaccatgaacacgaacaattgccatataggcatctatatttccgctataaccgccatagacatcgaccggtttgctattcttaatcgggattaactttcgtttatcggcatctgaagccggataaatcgtttggttaaacaatgcatcctgccttgtataaacttcttgggaaaccaacatgaatttataatgataaaccttttttaattgcttaactgacccgtgcttctcccaaacaatttcgccggtttctgaatcaacaattttatccaagctttcattatctttcaaatcatgtaagaaattgaaatttctaatattgagatcttgatcctctgctttcttaaaatcaccatagacaaaatatggccttaacttgggataacggagatataaataatccccaacatacgcagtcaaatatgcatccattgcatgatgataatcattcacattccgattcttaatcaagtgaaagtcttcgcgcaattgacgattcattttagcactcacttcaataatagttgtaccggcttgactatattcatttcctaagatattagccactaatcgaataacctgactggtttcaactaattgccgatgaataaacccttttgcgctatatttactaatcttctcaggatcggtagtcaagttctgaaatttgcggttactaatcaagccattattcaaaagatctttccaaaagcccattctttttgcgccaaagaatttaagcggtactcgattggacttccttgcattttcttctttactaatgagtaccctattgtcaatcgaatcatctttaataaatgcctgtggaagaatgtgatcaatatcataattgggtaaattatcaatattaattgtcttgtcttcatacatatctttacccatttgagtaaaatataaataaagcttatcagaaagcacttttttactgtcagcaaccgatccaagctctgccattaatcccgatttcatgatttctctaggtatattcttatacgctgcttgtagctgacgttgacgtgaaaccgtccgttgcggattattttcaagtgaccttgtaaattcaatcgcaattttatccggtgcatacccaaccgccttgacaacatcttgaaccactttatctacttgacgaatagcctttttattttggggtgaagtaaatgcatcatccaaaatatcatcaacattatttgcctcgtggaactgcttggcattctcgtcatgaatttgtttggcaaactcatctctggattgaatttgcataaagttatcgtttgttttccaaagctggtccagaatcgaatcgccattctgatcttttaagcctgtcaaaagtttcttggatagtcgcccccaacccgtgtagcgctttgttaataatgcttttctctgtggctctgtcagccaatccaactgattcagctttgcctggtagatttttctatcttcaaaaaccgttgaccattcgataatttcttcatagtctgcctgacgatttggatcatcgaccttttctccaaaaatatcccgaaaatcaatatacgttgataagcttgaattgaatttatccggatcagccagaccggaaatcatcacagagggtaactcccaatttgttcggatatatgtctgcagtttttttgttcgaatagtcttttgctttttaaatagattgttaaaaagatcctgcttctgacttggactaagtcgactatcgtttactttaagcatatttaattcattcaaagctttgaacttttcgtaaatcagactggcatctggtaaaacatcttcagctaccagatagctgtccttggttgtcattctgcgaataaacctattcgcggaagccattcgatctaccttttgatcaaaattccaaggtgtaatttctccctcttgtccgggtttacgtatcatccaggcaaagtctgcacctgaagttttttcttggtcccgctttgtgataagcggtcccacgtagtatggaatccgaaaagcaaccaattcatctaatttgtacttgccaccatttggtttatgagtgtttgggttcggtttttttaagaatggataatagcgcccctggttttcaataattcggtccaattccaattgatgcaactggtgagggataacgccattggccgatgtccgctgcttgggcataaaacttgcctgttcaataagacgctgaatttttggagaacgtttggaatcttcgtccaaattctttttaattgctgcgtaaaaatcatcctgattcagtgttttatcatcagacttgccaacgtattgtgtataagcttccctcaacttaatccctttggctgaatcatcccccaattcatgaatcaatcccatcagtaaatctaaatggtctttatggtcattatatttatccaccattgattcggacaacgactttcctttgggaacaattgcgttcaacgtaatttgagcatacaagtcgcgaataatcgtcactatttcctggcgggattcgtccaagttctccacgagtgcaggcaacttgtcatcaatgtcttcatcatccaaccgaattacccaatccttagcattttgagtatctaagtttaaaatgacgtccagttttgtcttatatccaagaatagctttggaaaattcagttgcaatcctggtatattgcttatcaattggcttgtcattataaatcacaggcaataactttgcgacctgcttttgagtatcaagtttcaaagcgtcgttatccaaaagcttattggtcatctcatcaacttgatccatattaatttgaaatggctcatccagaataacttgcctgtacagctcatttagacgatcaaattgactggtaaaatcaatatttgatgttttaaatgaatcaacagttgctgaattcagaaaatttcctcgatacttcacaatatgatgaatagctagatagacttctcgaatatcaaacttgcgcttctcggtcattaaagcatatcgcaaatgatacatggttggatactgtcgataaaacgccgcatctgttttatcgggaaataacgttgatccattaaaatgcttattgtcatctttgggtgaaaggttggattgcctcagtcgtggcaggaagtttggatcaacttctgataagtaaggatcaaatagtcgattcagtaaattcaatcgccacttgcggcgtttcagtcgtcgacgtgttgtccgaaatgcccgcctatcagccgccgtttgaccctcttgaaagagtcgaacgccaatgacatgtttcccttttgcccgaatgggtttttgatgcttatcaattgcggcatagccaattgatgatgtcccaatgtctaatcccaatgtgtacttaacttgttccccatcatgattactttccactttaatcccctcaatctacttaatcttgtgaaccaattaaccttattatcttatgctatctaatgataatcaatagtgaatatgtatttttgtaaacacttattaaaaatagttttataatgattttttgccaatgagcctatagaaatctccaccagaatcccagcaaacacccaatttaaaacacattaattacgcatcaacagttaatataaaaggcattatacctgtagacgtttccattctactgttctaaaagcaactgtttccgttacgttaaacagtttacgatgtgctcgtttattctttaagcaaaacaaaaaagcatccgattgataatcgaatgcgatactctatgactttgctttaagccagccgcgtcccagcgtccaagttattatccagctgataaatatgctcaacatcaatcactacaacggccgcacggggaaagcggtcaaagattttcggtggcaaaatttttttcgccaatgaatcaccctcgtgaatatgggacttgccctcaaagcgaaatcctttttgtgccgatcgatcagccacggctacggccgcataagcattttgcttcaaattatggtaggcatgacggaacgtatgctcataatacaatagatgggaatcatccattacctgcagtgatcccttgggaccaacttttggaacaccattttcatcagcagttgccaaaaaaggtaattgctcgttaatcatatttttcatttcttcagacagattagccatattatcactcctttttattttctataattatgaagacaccagacgtaatcatcaagtttgtgcataacagcacgttaacttttgaaccctttcgagcacaaaagaaaacacctatcggggacgataggtgccgtattcatattttgggggtatatgaatatgaagaaaagttaccttccagatagcaactattttcttcggggtagcatgaacagtaacacactgtgaaactattcatggcataaattatagcaccattccagattaatcaacagcgtatcatcataattataaacgattattatataaaacattaattatcattccgcttaattaattttgtttttattttttcaataaaaaaggcgcctacgaaacgcttatccaaaggtttcgcaggcacctattcaattttatctgttaattaccaactgccactgatgctttatacttatcagtaatctcttccaattgactaattgcttgagcgacgtccggctccgtgaccttaaacggcaaaagatggattgctttttccggcgtcactgtttcagcagcaattgcatgtaccaatttgtctgatggattcttaaaactcaattccttgagactgcgtggcaacttcagtgttccgtaaagtttcaacagaatttgaatttcttcaaagtgcttttccagggaaagctgtaccaaatttccataggctacccgttcaccatgcaacaacggctttgtttcatcgaaagttgtcaatgcatcatgaactgaatgagaaccggtggaacgactgtattcatcaccccagccgccaacagttccagctgtacatataatggtttcaacaacactcaaccattcatcagtcagcttgccggctttcatatcctgaacagctgcaaccgaattcttcaacaaaacatccttacagttttcagacatctgtttggaaatcgtcagtgccacattcaatggtcccttctcttccaaatccttaaaaattaattcggattcgtaaaacttggccaaggtatcaccgatcccggctacgaagtaatcaattggtgagtttaaaataactttcggattaatcaagagtaaattagtagcattatcataaacctcatggtcaatatgctcgccattttctttataacgcacactcaagcaagaccatggcgcacaattactggctaaagtcggaatcgtcacaattggccgatgttcataatgggccgcactcttggcggtatccagaactttgccaccaccaagaccgataattaattggatgtcattatcgcgtacaagtcctctgatccgtgcaatctcttcaggtgaacattcaccattgaaataaatatcgtgaaccgtgacttcaggatcccatgcgggtaaatatggttttgcggcattcagcgacttaacaccgtgaagaaatagaacccgggtataatcgttattttttatgtacttcggtaagtaatcataagcgtccaaatttgacaaatattgttgtggtccgatgcgtgaaatgatcatatcattttcctccaattgtttgatacttcgaggcacttatgttaattcatccgaataaaacaggcttttccgtatgtatgataaaataattaatataataaaagaaattctaattctaaatattatgaatgtcaactattttttagataaaagtaacattcctacgtcattaccaatagttaatttcaatcaaattaaccattgacttcttttgacggttcattactttgcctttgattggtttgattactttgaagaaaaaaagctgcttaacatcgaccacataacaaaaatatcctcaaatcttttagcgattctaaggacattttgggtcatcattatcattttctaagacgaatcaattgtttcatgggtattttgctttgcttggcttccagtttctcttcatcaattaatttttcaatccgataccagtaccagccttccaaaatcccaaccccataatgcaaaacgatcttgccaagcaatcgatccaattcagtaaaatccgttttacttgtttgttgatagataaacttatcataaaaagtgaccggttgactgagtaaatgatcattaatcagaacccggatcggctggttctcctcttgcagctcctgccacatgtagctataatcccgccggatggatgctgaaagcttctgttgtctttcaaataatttaaactcatcaatcagatcgcatgaaaggccactaagaccctcatttatttccaagagtgtttgattctcccggggaaaaagtgttggcactttaatctgctcgacctcattttcaaccgttttgagccgatcacataaccagataaacccacaataatcagcagctttgttagtccaccaaatgcgaaaagaagttcccgattcaattaacacttccaagaatgataaattatctcgaatcttttgaatctcttcttttacagaataaccatgcgtatttcgtgaaagttcttctaaaaaagaggctcttgttctaacgatattcgccgttttgatatttccaaaatcaagcgataaaggcaacgtcaatattcgctgcttaacatgtttttttcgataatagtatcgcaaaagaccgctaaacgtatcatcaaaagtcacatcgaccggcatatcttcatctccaatgcatgtcattaatgtcattttacaataattaaccacgacactaaagttgaattccaagaatcaatcgattaccataaaattaattaaaaataacaaaggtggctattatgcaaaataaaaaacatttaacaggaccacaaatcgtcggctggattatctggtggtttgttaccatcctgatcttacttgtattagtggcaatcatggtttttaatccacactcatggatcacgaatacagttgccgttatctttggcacgctctatgtcatccagcagatcattatgattttttgcttaaaaagacttcatcgaaacgacaactatgcttggccgattgtcgccattgttgttggcgtattgggaagcatcctatacattattcccggtatttgggcgcttatgatcaataacagcgcgcaaaaccgccaccgaaatactattaactaacaaaaggcagcctctcggatagtgtccgtttgaggcatgccttcttatattcttattaaattcactttatcagtcattaaatttttgaatgccactatacccgactggaaataaaccgataggccaaccagccgaaaaaggccaatgcggcgacacctgttaaccaaaatccccaaataatgaccttggtcaaaataaaaaagatcaaaatcagtccgataaaaccgccgaagaatcgcaataacgaaaaccccatccgaaaaagcaggtaaatccaaccaaacatcaggaacaatatcaagcccatcttaaagcctcctcaaatcattcacttattttagtttattcagcgagtcttttaacaaattcatttcgcttagaaaacggaactgttgtaatactttcagaattaaatagattaacaatcgtatcgtcaacaggcgcttcctcatcatttacaaacgcatagaaatccgtttttctcttaactactgggactgtttgtctaacatccattgcaacagtcttcgcataatactcattatgtggtgtatttaagacgcgaattagtttgtccggaatatctctaatacctgcaattgaaaattcgtaatgcaaaaccatcccactgatcccaattaagtttggtccgtcataagctcgtatatcattttcagttaaaaattcagcaacatcgtttacaaaaagtttggagaccctctctttagataacataaacatatcatttacaaagagcattgcctgtataagcaagttttgtttaaccggataatcactaatgttagcatcaacgtacaactcatgtgtcacttcattaaatttaacagagtaagacttcaattgttccttaagaatagtcatccgcttccttgatcgcgtaataaacatgccatcactttcaaggtcatcaagaatataaccggcatccgttaatcgaacatttccttctacctcactggcatatagaatgatcgcatcattatgtcgatcaaaaaacggtgtatcaattcgaatataattttgatctgtattggaaaaagtaatcgattttttattgaaatcattaacagatttctctaaattatctatcgttatcattcgatacacctccagtaagttattttggatattccgtaacattagtataagccaaaaagtcctcaagagcagcaaaaagagacgtgatattatggatttctgctggtaatggaattgcaataacgtcctttcgtaacccctttacaaaatgataaacatgcatatgattttccggaatcagtgtgccgtcaggattcctgtgagtaccattgtgaatatcaattcgtattaagtgatcatttgtttgttgaaacctgatatgtaagctaaatcgttttgaatcgaacggatttcgatagcgatgcaaaaaatattctatatgatttttaaaatcaacaacgggtgtatcatctttaatacgcccaattaacggcatgtcttctggtatttgccgcgtacatctttttaaagattgtagaagttcttttacttcattatccgttaaaccacctaaatccaatttgtcacgcccctcatgttctagttggtacaagttaattaaagaaaaacaggttaaccaaattgttcacccactataattttattaatatatcataacttgattcgtaataaatatcaataattaattcacgtgaagccattaaaagcccccataagcgcatgtagaaactccttgcttatgggggccattagttaccaatattttcaatgatcacaataaaacttttcaaacgctatattcttaatgctaacgcgccggcatgctctgcccaaggatcaaatcaaccaactgctctgctttcaatccattaatataatcattcaaattaacggctttcagtgcatcagttaagtcttcccgacgcattttcgttccgatcagcgtattaagtaaggcctgatggtcgtctttaccgaaaaagtcaccataaatcgagcagtctttcattcgaccgttcgcgacatcaacataaatttcaacagtacctaccgaatccaaatgtgtatcgtgctcatacttatattccggggctgccccataattccaatcccaattcttatactttttggctgccaaggcatcaatttgtttccaatcggctgtggtcaactcataatatttaatatcatcatcggttttcgcgcccacaatcttcttggtcatgatatgcataaacgcttccggtgataagtcctgataatcagatgccaaatgactgcgaatgtccgttactctggccttgaccgacctaatcccctttgaaatcagcttcttttcatttggtgtcaatgaacgcaccatgctttcataatcaatatccagcaggagtgaaaagccaccataaatccgttggttaacaattgccattgcaccgccggaaattttcttaccatcaattgtcaggtcgtttcgaccgctatcctcaatgtttttgacacccattgattgaagtgcctcaattcccggtcgatacattttagcaaaattgccgtataaatccggcgtagcggcatcagccagaaagcaaaaattaatgccatgacgatcacaatagaccgaaccgccacccgtatctcgacgaacaacctgaatgtgatggtcgtcaacatattgttgattgatttcctgacgggcattttgaaattcaccgatttcgattttgggatcacagttatatggaaacaaaatcggttcatccaagaacagatgattcatgcaccatacctggctggctaacgctaaagcaccatcgtaaatccgtttgccgtttcgttttaattcaacaacgtacattttctgcgccccctacaaatgaccgatcacttgcgtcatatcctgatttaatcgaaggctttgtccttggagctcttccgggatctgataatccttctgattcagcatgacatacaaagcgttgggattttcccgagtcatcttccaaaatggcttgcgaataatccaaggcgttgtattccccacaccaatttccaaataaagaactttacgcccatgccatcggtctaaaaagtcatgatagtttttcgcctcccgatgccattcttcatcttccaccatccctgcatccgttcgcttattgacttcaagcggtgctccgcaattcgggcattttggaatcaagctttccggcacccgcaactctttttgctccctaaccatcttccgaatcaagtcatcatcccggtaagtcaccggggtgcaaaattttgaacattgcattcttgaatactgtccctgatagttaaaaatccggttgcggtcaaaatgggctttctccaaagtgttatccccatttgtgttaataatggtgtaatggcggtcaccatgatccatgaatgcccgaaaatgatgatacagtttaccttccggttgctcaataccgtttagcaggacgaatcgactctcaaatgcccagtattccgaccagtcttcaaagtcggccaaaaaggcctgcagcatatcataaaaatggtacttctgaataaaatcagcaaaatgggtttcaaatctcggcccaacgtagctgaaaccatcggctgccggcattccggcaccaatgccgacaacggttgcttcggcttcatcaatcaaagcccgtaattgatcagcctgactaccggtttgccccaaagatttccaaatttgtgttgcttgaaccattcttattctccctccaattcatgaagataaagtgccttatcaagatccgaattgaccgcgaaaatgacgtctggtgcattgatatgactgcttaaatagtcattcaccgtattaacggcaatttgggctgccaaatcgtgtggaaagcgaaactcgccagtagaaatacaacaaaaagccaattcggacaggtccttttgttcggctaatttcaaacaggattgataggaatcggccaacagctgccttcttaatggcgtaacttggtgaatgatgaccggcccaaccgtgtgaataacaaatttggcaggtaaattaaatccgggtgtgagtttcgctttccctgttgcttccaaccgttcgccagccatggctttttgatcggccaaacgcaattgaatacctgctttggtatgaatctggttatccaaacagccgtgatttgggataaagcatcccagcattctcgaatttgccggattaacgattgcatcaaccgccaactgggtaatatccccctgccataaatagattttaggccgaatcatgtctaaatctgactgataaatgattgaggcaacatgattttcattaaatagataccgatcctgaacccgcataaaggaatcacttgccggtgccggcccacgcaagttaaacagttttcgcaataaccgtttttgcgccgttgcatcatcggaaatgacttcgggtctcacattggccgatttcaatcgttcctgttgcatatacttaattaagaatcgtcgtcgcgcttgctgatccaagacacggtcaactccttttccccattttttaacaatcactcaatcaattcaggcaccctttagttgattaaaagcggactcgtcaacatcctttaatttaaccagccaattttggctgtcatcgggagaattcagcagttttggatcatcttgtaacttggtatttttctcaaccacttttccggctaatggagacggcacatccaaaacggttttggacgcttctaattttgctaacgcatccccttttgaaacggccttttcatttttgaattcaacgtaaccgaccgtaccgatatcatcttgtaattccggcgttaacgaaattgtatacacaccattattttcatcaacaaacaagtaatctccacgttttttcatgatttaacatcctttcggttattgatatttattaaagtaatccacatcactctggttggtttcagaacgaatttcatcccgggttttcttggaaagtgacccgccgaaatccataaactccacaatgtctttgaaggcgtttgcaggaatagctaaatccgcccacttttctttggtcagtgttaaatcaatgtcatcttccctaccggcttttaacttggaaacaaaatcgggttcggtaataaacatcgatgacgcgccgaccatatctgcatgttcggaggcctcaaccgctttatcggcagaattaatcccaccggtcgcaatcacgggcacccgtccacgcatatgtcgcagaacaacatcgttaatgagttcacccttatgcttatcggagcgaaccgtttccctgaaaatattatgaccccagctggcaatcgcaaagtactgaacatcggcaacgttgagtagtcgatcaaagtattgattgaattcatcaacactgtaaccgatttccgaaccacgcgtttcttcgggcgttcctcgaaacccgataataaagttttcagcgtgctcgtcatcgaccactttttgaacggcctgcatgacctcaacgccaaatcgggcccggttttcaatcgattgcggtccgtattcatcggttcgctgattggaaaattttgagaaaaactgttgtggtaatagtctctgggcatttgaaatttcaacaccgtcaaaaccggctttaatagcgcgccgagttgcgttggcatactgggaaacaacatgtttgattttacgcttactcattgccagcacatcatgcttgaccggtgaattcagatgcatcccgcttggtccataaaccacgccaaagtccttaagactgattcgggcaaaccggccggcatgtgttaattgcaaaattgctttggcaccaccggatttcattgctgtggcaagtcgactcaagcctttaatatacgtatcgtccctgacacttggaccatattcaaaaagctgcgcgtattcttcaatataggcagccgttgtgacttgcagcggtgcagaattcacccgacgctttgcataagcaacatctgcatcggaaatatagccctcgctggttgaagcgttcaacgtgatcggatttaaagagaaccgattagccaatttaatcccatttggcagcgtaatcggcatgaataatggtgcatacttagtcgtcgttgtttgtgccatatctaaatatccccctttaatttataatgtaataaataattgtacataatttaagtataccatgatcaaagggcatttaacgttaatgatgtaaacggttactaaagtgtaaaataaaaagaccatttaactggtctttagatacgtctgctaagttaacaacatgctaaggtgccacaatctttgtccgactctttccctgaccttcagtctgtacctgaatttggtagggaatccgttcctgtagcattgtgacgtgactgataataccaatcatccggttgtggctttcaatattttccaaggcggccattgccatcgaaagtgactcttgatcaagcgatccaaagccttcgtcgacaaatagcgtgtcaatactgattccaccggactcattttgaatcacttcgcccaacgcaagtgccaagctcaacgcggcaataaagctttcaccaccggaaagtgtatgaacgcttcgcaactggccgacattatcgtcataaacatcaatttcaagaccggtgtttttctgatatgcgcctgcctctttgtgtaattgcatggcataacgtccggaacttaactgttttaaatgctgattggcgactttgaggatttcctttagttgtgcctgtagaacatatcgttccaagcccaacttggcatccccgctgccattaaccgtttcaaccaacagttgaagctggttaatggtctcttgttgatcatgaatggcatgatcatttttcttaacccgttttaatagttcatcattaatcaaagtctgccgatacttttcatcatattgatcctgtagttgatcccgggcttgaacaagttgggcaagttgggtctgttcttctttcaaatcaaccagttggtgctcacccacaattttttcgtacgttgaaattgatgccgcaacattttttagttggtcttgataatgatcgatttgtttctgaaggtcagccaactgcgatacatttttcactgacttctccagcatatcccagctcttcgttccaaacttttttaaaacagctgctgttatatcattttgaatcgtgtctattttttccctggtatggtcgatctgcttcttcaagctgatttcagttgcctgggaagcagccagtgtacgcttggtatcctccagttggttacggttggtctcaaccgcttgatcataatcggcaattgcttgttgtaacttacccaagtgttgatccaaagaagccaagtcactaaattcgcttggtaagcgatgtgcaacatcatccagttgaacgtcatatttttgctgagtagactgtgcgttttgataatctgcctttaattggtcgacttgcggcatcagttgatccagatcctgtttaatgtggacctgtttttcctgttcggctttcaaatcatcctgttgtttttgaataacatgtcgttcacgcaaatttttttcattatcatcggcaacttgttgactaacagccgccaagctatccggggtctcctgcaaaatgtgttctgccatgagttcggcaaccagttccttaaaggtactattgatctgttggtcctgcttatcagactgcttgacctgttcgttaattttggttctgtcagtggcttgttgattttgcagctgctgtaaatgggcttctgcggttttaatgtcatcatcactgacactgggtaagtcggcaacgtgtgcagggcttggatgatccgtacttccacagaccggacagggacttcccggctccaattgtttaaccaaattgacaatctgattacttaaccaattattgcgtaaagccgtatacgcagtctgggcatggtctacctgagcggttaatttgagcaactcattttgactttgcctaattcttactttcaactcatgattggtctgctggtccaaatccagtttagtcagttgcttggaagccgtttccaaggttttggctgtctgagtcaactcgtttaactgctcagtcagtccaacaacttgagtcagcttttcggtaatttgatcattttgttttgtcagatcagagacccttttctgtttagcctcaagcttacggccagtcttttcaacgactgcttttgcctgcttcagttgatcccgtaactcactcgcctgtttaaatatcggtcgttgattctccaacaccgatttctgactaagtcgttgttcttgctcaggctttttcgcctgcaagttaatctgttgtttcgactgcttttcaagtgctttggttcgagtttggcttgtttcattgacttcttttaattttcgctgatcatttgatacgtcactttgtaattcctgaaattgttcatatttgggtttcaaatctttcgcccattccaactgcgccacctgctcgcgtaattgatcatattgaggctgcagggcttttaaatcaacctgctgatgccgttgatcagccaactgattaatctgttgattcatctcaccatctgcatgaaacttttgattggcttcttcataacgcttctgggcagactgatgctgtgcttttaagttctttaaagctgtattggcttgtccctgctgctgagataggatcactatctgatcactaacattgcgcgccttaacgtcatccggtgcatcatccaaccagaccacttttgccaaatcattgtcaatcgcctgcttggcatctttatttttagtgttttgcttcttgagcatatcccttagtgcatcactccacctttgataaagctgagtacgaaaaatttttcgcaaaacatcttctttatcagagctggaagcggtcagaaagcgtcgaaattctccctgcggcaataaaacaatttgaacaaattgttcacgactgatttgcagaacatccagtaatttaagattgatgtcccgcattttagtcatctcatcggcttttttgccatccttgaaaatctcaagttttccgctgctttcaaatattttggtaccggttccccgtttcttatccaactcttgtttagggaaccggttaatccgataagtctgtccctgatgctcgaataacagggtgacttctgtcggtgccttggtatccgcaaaatccgagcgcatgctttgcggtgttcgatcatcactggcactgtcgccgtacaaagcaaatgtcatcgcatcaaaaatagtcgttttcccactaccggttttcccggaaatcaaaaaaacagaggcctcatcgagtttggtgaagtcaattgtttcattttcatatggtccaaaattttttagtgttaattttaacggcttcactatttaatgcccccattgtcagcaatttttaacgcttcctgtgcccatttgatttgttgcgatgacaactcatcttttgcaacctgtttgtaaaaatcacctaacaaatccattgggtctttttgtcgaatctgctcaccactttcaccggaatcttcaatgtcggtttcataaccatccgcccgatcaagggaaataatgtttggataaatgtcacgaagcctggccatgacgtttggaatcggtttgcggtcttttaacgtgatcccaaaatagttatccagctttagatgctcataaaaatggttatctgccaacgtctcaaaattttcggttaattgttgaacatctctgatcggcgttagcggcttaaaagtcaacttgaacggttctgtatcgacaataaagacaccctttttctgattggcttcagataatgaaaacttcacgggtgacccgctatagcgggcattttccgcatgtaaagcatccttaccgtgtaaatgtcccaaagcaacatagtcaaagccctctaatagtccaaccggaacagctgccagtccacccactttcaactgggtttccgaatcagtggtcgcactcccatccacaaaaaagtgggagattaaaagatgctttttattaggatcaaacaaggacttcattttattgacaatcggcacaaacgcttggtccaaatgctgtaagctgtcgtcattaaaatattgttgtgcatcgaacggttcaaaatatggtaataagaacagttgcgtgtctggcaactcgacaggagtaaatgcctggtccaaccgggtatgcatataaaattgggtacttttgaaccacggtgttccggttgaaaggcgaatagcactgtcgtgattaccggaaatagcgtagattggtaacttgtcgaccaggttcagctgctgcagcatgtgattaagttgagctacagaagcttcagccggcatactccgatcgtataaatcgccggcaatcatcacaccatccacgtgttcgttcaaagcaatctgctcaatttgtttgaatgcatggttttgttcatcggttaaatcaaagccatgcagccgacggccaatatgccagtcggcagtatgtaaaaagcgcatatccgctacttcccttcagtttttaaactttttcaaatcaattcaattagataaatgaccactatctctacgacaatgttaatttccccacagaaccaaaatgtgtcttaattatataacaaacgtacgttcattttaaccattttttatcgatggacatatctgaccaataaccgcccattcagaataatcgcattgtgcgtcactttcactttaatcgattttcctctagtcactgaaaaaattggcttgccatcgtgattggcgatctcaatcaattctacttctttctcattggtactaaccaccctataatatttcgtctgcttatttaaatcgatagaattacataaaatgttatcaacagcaacgtttaacgaattcacggccttttgaggatagtcccttaatccgccctttctgatttttcttaataacaacctcaaatcatcaatcacatcaagcgagtacatattttcgtcttcatattgtgtgatgtaacgaaggattttcggcaaatccctgggcaagaaaaatatttctgattccggaactgtatataccgtcacctccgaattaatttctcgtgtaaaaaacgacaagttgcaatgtttcattgcaaattcgttgtagttaataaaagctaattccagatacatcatcaattcattatttctcatttcagtttccccgatacacttcatatatagcataaattatcatttatattataaacatgatcatgacgttatatacgattgaatctccatatttcataaaagcttcaatttaatttcaaaaaaaggtcacattttttctgccataaaaatcaatcgaagtaaatttcattgatttaataatactttgcaaaacttccaatccatcagaataaactattcggaaaaaacgacaaatgtttcgcttacatgacaacatttacattttctgtcaaactttctatcctaaattgacatattatgttgtgtaactcaataatatcaacatacattaacgtcttcatatcactaaatggtgtcagacggtacagatattctaggaggggtttaaaatgaaggctaaatacttcatgatatacattattttatttctgctatttatcagcagcatggcaatgacatcgcttaatagtattgaggtctacgcagatacttcaaaaagcagtaacgcaggctacaagaatctattaaatgcggattcaggagtcggtaacattgaaaacataaacaatgacattgacaactacacgcccaattccagtcattcatatgacaatcgcttaaaatcagaagttttttacattaatttaacggcaaactttgaatccggcggtgaaatcactatcagtccggattattcaaataatcccggatcggatgttcctgcaatcattggcaatgcatacgtatataacagtgattcgaaagaaacggttcctttatacacggataacacaaccagtacgccttcaaataacggattttcaatgattaaatcaggaaatgattacaaaatatcaattccaagaaatgataagatttcaaactacaccattgtttttacaatattacccctcacttccggaaattcagttgagctgcatccatcctacggtgctgatttgacagcccaaaataacgatgggaatgtagatggcagtgcttattctaatgaacatggctgggggattctttggggacaaatggagaatagcagtactccggaaatgacaagttcagcaactgtcacacaaggtgatcaaattcccctatcatcttttgtaaaggattataaagcaaccgaaaatcagcaatttgttattcgagacagcgagggtaagttattaaaaactacttcgaagtcagtcgataattggacaaatttacccgttggcaaatactacctgacttactacacccaagatcagaataatgacaatatttggaatacaacaatcattacaattaaaaatccgacacctcttcctgataccaataccaacaccgataccggcaaacaaaacacgacaccgactgaaccaacaccaactaaaggtactgtaataacacgctatgttgatcaagatagtactcggattgcacctgatcacacccaagacggcatcacaggtgaaccctataaaaccactcaagagtcaattagtggttatacgctcagcgagattccggggaatgccactggaacctatactgacggtacggttcttgtaacttatgtatattcaaaaaatgcgtctatagctccaagcattaataatagtcaggttccggttaaaggagaagcagtttatgccattaaaaaaatcggtttatacaaaagccctaatttttcaaagaaaaacagaataaaatggtatgggattgccaagcggattaatagagccgagtttatcattcgaggatataagcgagacaaatttgggcatctaaaataccgtgtacagcagtacaatccttatacgcaaaagtatgtgaacggaacaaggggatatatatcttcaagttcaaaagatgtcatttccgcatattatgctttggttccaaaacgtcaaaaaatcaccatcatcaataaaaggggcattaattcctacaagaatcaatcattaacaaaaaaagtaagtcaccacaaaaggggagaaacgctactcgttaaaaaaatcattcaatacaagctttcaactcgctttatattggccaatgggtcttatattactgccaataagaagttcatcctaacagaaaaatagccatgcgcaaaattatatatgcggtaaatagctaacggggtttataattaatttataggccccgtttttggtattagaagcgatggccaatatactatagcaaaatggggtaatcaaattgtcgttaaaaaagtgcacacgtttcatctttttaatctttgccacaattctctttggcgtcagcgttctctcacctaacaatgccaacgcttcatcaaccaacgatattttccgaagcgcttataatattggtcggcaaaaacatatcctgaccaacacaaatatgacttttaaagactttaaagccatctgtaagaacagtcttttccctagtttcctcaaacaacttaaagcaaatccggaaacaacctttcaacaatacatagcaaaagatcactacgaagttccgattcatcgtgttggggatcatcctcaaacaatttcactgaaaaaggctaatgtcaccgcttcacaaactgataactcatcaaccgatcaatcagactatcaaatggagccgggagacattttaatcatttatgggaccagctcctttaaagaagccaaaatattcggccactgtgcgatcgctatttcttccaatgacattcttcatatgcccggaatgaacctgggtactcagcaatggacaaaaaaacgcttcttcgattactacaccggtcgtggctcttacatcgaagtctatcggatgacaagtcatcccgagtatgccaaagaggctgctcaatacgcttataatgatatgtacaaaacggatagtcccgtttataatctcgagccatggttataccaaaaggaaaaatcctattgttctaaatatgtctatctcgcctattggtttggcgctgcccacgctgctttaaagcggtttgttaccggatttcactatattatgccccatcatctgatttatgacttttcaagtggttattcgccggcggatatttataaggtaaccgaataagcaaaggcaaattaaagatttaaaagggattgaccactcttgtgaaaacgcttaacatatttagtggagtagtttcagtgttgtttcaaggaggcaatcatgaagaaacagggtatctttacaagttatttaaaaaagtcatttctactaggagcatcagtagtattacttggatttgtcactgaaagttcactcactatcaaagcggatacaccaaccacaacgacgtcagtcacaaataagtctgcaccggacatttcaaatgcgacctattataaatcttcagcgactcaactcgctaaaatggttcgcaagggacaggtcacacctacacaattgattgcccacgctgttgccaaaatcaaagcagataatccccaattaaatgcggttatttccatgagagaagatcaggcaatacaagaggccgccaatctaaaagatacgggacaaccattttatggcgttcctttgttgatcaaaggcctcggtcaaccaattagcggctcttcaaatactgacggtcttatcgctttaaaaaatcggacggccaccactaccagttcatttgttcaacggttgcaatcaatgggctttattgtcatcggccaaactaattttcccgaacttggtttaatcaatattaccaattcaacgcttaacggtgtcgcccataatccgtggaatcacgcggataatacgggtggttcatcaggcggggcggttgccagcgtggcagatgatattgttccggttgccacaggtaatgatgccggtggctcattgcggattccggcttcttggagtggcgttatcggcctgaaaccaacccaaggtgttattgaaggtgacgatacaacgccgtccacggttaattttgccgatgctaagaacattcaggatttgcagacattatttgatggtttgttaagtacgtctgatcattcgggcgccaacatgctaaaagccgtcccaagtcatttaaagaaagttccaatcgcttactcaaccaaatcacctgttaacacgcctgtcagcaaggatgccgttaatgcggttaagcaagctgttacattcttaaagtcaaaggggtttaaagttgttcatgtaaactcacccgtagatggtgttaaactgatgcacatttattaccttgaatcaaccggcaccggtaccgacgctaataagcttgttaaaagcgcactagggcgggatatgacatttgacgatgtttcccctatgacctgggcactttatcaagctgatcaaaaacaaccgaccaatgttgattcaatcgtaaacaacgaattcaacttggttaaccaacaaatgaccgcttttcatcaaaaatacccactgtacttaacgccaaccactgcagtgacggcacctaaaaatactgatcctgcttatttgccagagtatgttgaaaagctcaagacgatcggtaatcttgaccatgatcagcagatacaaaccatctatgatgcgtggcttcatggattaaccaaaacacctttcacccaacttgccaacatctcaggggaaccggctatcagtctaccaacctatgtcagcaaacaaaacatgccgcttgggatccagtttgaagcggcaaagggtgaagataagctccttttaaaattaggtgcttatttccaagatcataatcaattcaagtttttagataactacaagcaatcccagacaagttctaccaagcccaaaattgcaattgcaaaaacccaactgacattatataaagataagaacctcactaaaagggttaaaacctacccgtttagaagcaaacaatccgctcatcacttcaaattattgggaacagttttctcaacaaatggtgcaactcgctatcaggtgaagggtggctatattacagctaatccaaagtatgtcacaattaaaaaataacgcactaaaaagcagcagcctcattttccaatgaggctgctgctttttagtgctcaattaaccggcaaaaaagtgtccaccaaaatcgtttatgataagcgaacacttttagctaaatcaattaaaattgcagatcaatatgacactttagtttattcaccgggtttgtaatcctgatcaataatcatgacgggcttaataaccgagccatcattcgaagctttgtttgcttcattaatttgctcgaaagtataaaacttctccagtttatcaaatgggaactgtccggctttccagaaattgatcagtttttgaagagccaattgtggaattgcatcccccatcaatacgccatccacgtgtttttgaagtgcagttaattcattccacggcataaattccaatgtctttgcggtaacagcaatcggtgccaagtgaccgcccgaagccaacgcggtaattgcttggtgcataattgcagaaataccagtcgtatcaatagcgaagttaacgccttcaccatttgtcaattctttaaccttatcaacccaattctctttcaaactgttaatcgtatcggtagcaccaagctcttttgccatttccagacgactatcatggatgtcgacacaaataatcttggagcatcccttgatctttgcagccattaaagcacctgaaccaacggcaccggtcccgacaattgcaatcgtgtcgccctcttttggtttcaacccgttaaagacggttcccgaaccggtaacaaagccacagcctaacggtccgacttttcgtaagtcaatatccttatcaatcacggtgacgttacgctcttgaaccagtgtttctgtcgtgaacgatgattgattaaagaagttgtggataggtgacccatcatcacgggtaaatgcgaatgagccgtctggacgggttccagccatgttcaatttggcccaattaatacaggaagacggatgaccggtcaggcagttgtggcaagtaccatcgtagtcatatgacagaataacgtgatcaccaaccttaaccgtgctgacctgtgagccgactttttcaacgattccggcgccttcgtgtccgacaacgcctggataaggatactctccggcagaaccgtttcgaacagcttcgtcggtatgacaaattccgctggcaacgatgtgcaccaatacttcgtgggctttcggctgatcatcgacttccaaactttccaacttgaattcagcattcaacttttcgatgacggcacctgtaatttgtttagccataattaaaacttcctctcaaaaataaaaccgaactataatcatcctgtaagcccttccaccattttcagaatacaacgatttttatgcggtcacaatcatttagacttgtaattttatgcacaattaacaatgacacaacaaaaaaacaagcggcctacctgtaaccgcttgttataaggcgtggataattattcacataagaaataatcaaaagtcgactttttcctgtcaccgtgctattgattaactacacaatttccccaacaattttatgttccgcaaacagtgctgaaacacctcccgtatgccagaaaacaacgttacttccgggcttgattttcccggttctgacatagtccagcaatccggcaaaggcttttccggtatacacaggatcagttaaaataccttcagttcttgccagtaatcgaatggcattcgaaccggcttcactcggaatttcgtatccgtcaccaaagtatgactgatcaaaatgggcatctgtcagtgaaattctggtctcaagatccaataaccccaacgcatcatttcccagatcaactactttttgatagtggctttccggcttgggactcacatttatcgacaatatttgagttggatgggcttctttggaaaatacttttgcgcctgcaatcaatccggctgccgtaccgcctgtcccactgccatggacaacataatcgatcgccacatcgggaagtcggtcaaccagctctttgaagccaagcacaaatccaaccgacccaatcggtgttgccccgcctaccggaataatataaacgtgatgcccgttcgcttccaaatgcttcttttctaccagggcctgctgcatcgatatctcatcggcttgtgcttcggtacgacccttcatcgaaacatagtggatttgagcgcctaaaattttatccagtaaaatatttgcccgatcatcctgttgatcatttggcgtaatggtctccaaatataaaatcgtgtttaggccaagtcgattggctgccacagccgtttccatcgcgtggttggactgggtggccccaaatgttatgaccgtatcagctcctttttgacgcgcatcccccaacaaatattcaagcttacggattttattgccgccgaatagattgggacccgtgaaatcatcccgttttaagtacagattaatgcccaactgtttggacaaacgatccaggcgatggaccggtgttgggaagaagccgagtttctctttaggaagctgtttacaaactgtcatttctattaatcctttctgcttaccttaacgattaatgtcatttctatttagtcgtaatgtccttgctgaaatacttttgcgacaaacgcttcaatgtcccgtcttttctgagttggtcgagaactttgttaaacttatcttttaattttggtgactttttattaaagaggccggaaatttttgccggcttctgttcggaatccttcagtaatcgatacttaagccctttaatcgagttgtctttggcatatgtcagcaatgccgattccgcattaattgcgccctgtgcccgaccctgtttgattaaatccaagctggtctggaactgctcctgtggcacgataactgcgccaaatttcttggcaatcagctcattatccgatcctgtcgcttcggcaaatttcttgtctttaatatccgcagtcgttttaatggcattacttccggaacgggtaattaagacataacgtgaatacacatagggctttgagaacaggtactgttttcggcgctccggtgtttgggtgatattattcaataccacatcgtacttgccgctgcccagaccggcaatcaaactatcccattttgttggaacaaagtttgccttgacccccagtttcttagcgactgcctttccaagttcaacctcaaatccggtaagcttgccatcttttcgataggaatacggcggatacgtcccctcaagtccgatcgtcagctgcttggattgtttaagttccgatcgataagtaccattttttgatgacgatgagcttgaaccacaagcagttaaggccacacctgctaacgcaatccccacaaccaacagtgatctttttaaagccaactttaatttcatgacaatttcctcccgatatcccgactgacttctaacgactaccctgattttaaaaaaaagtccgcccccatgcaccaaaatgcatagggacggactttccgtgttaccacccatatttgcgtcaatcaacgcctctaattgttaacgtgaccaatctcacgtaccttgagctttcactcttggtaatcactccgagttcatcttcaaacaacgttctgctctgccctctcactaacgacagtcgctatcagcatctttattgccctactcttctcatcacagtgataatgattaaatattgattagattcttaaatgttaataagtattctacactaagaatccggattgtcaatataattgcgtcatccggcttcgaaatcttgacaccatccccgccttccgctaaaattaatgtattctatgcgaaaggaaagatagcaatgacatctcacgtttatcaaacttggcaaagccggtaaacaggtcacacggacgggtgcgacttgatcttaagcatgcgatcatgaacgcatctgtgccggcaatctttccgaaaagaaacggtctgtgcagatgattccggacaggccgagttaattaacgagtacttcggtcaaatccgggtactcgtttttttgttcgcaataattctcaatcgttaagcaatttattattatttcatattattgaagggaagttattcatcatgagaaagaaattaaccatacttggcgttattttcattatttttgcaattttaggttacgcttactttgataatcaaaagaagcagcagtcccaatcaaaaccaaccataggcattctgcaattaatgtcccaccctgctcttgattccattcataagggtatcattgccggattaaaggacgaaggctatacgcctggtaaaaacattaaaatcgatttccaaaatgcggaaaatgatcaaagcaatttaaagacaatgagcaccaaatttgccaatgaaaatgctgaccttaccatcggtattgccacacctgccgcacaggcactggctaataccatgaaaaagagtccggttattcttggcgccattaccgatccgaaaggtgccggcctggttaaaaacaatcaaaaacccggtggcaatattaccggcgtttcagaccaagcacctttaaaggaacaacttggtttaatcaaacagtttatgccaaaaatgaagacgttgggcattatctatacatcaagtgatgattcagcagtggcccaatataagaaattcgtcgtactgtgcaagcaggaacatatccgtttaaaggcttattcaattgccaacaccaatgatttaacccaggtcgccgaacaggccgctcactcagttgatgcgatctacgttccaaccgacaacacaattgccggtgcaatgcaaacgctggttggtgctgccgacaaggccaaggttcctgttttcccagctgttgatacaatggttaaggccggtggtgttgccacttatggcattaaccaatacgaattgggcgttgcaaccggtaagatgtctgctcaaattttgaaaggcaagaagaaaccgtcaaccaccccggttaagttcttccgtcatggtaaattaatcatcaatcaaaagcaggctgataaattagggattaaagtgcccgccaacctgcttaaagaagcgcagcaaaaaggagaaattattaaatgagtattattgtctcggctatcgggcagggcctgatctggggaattgtcggaatcggattgtttctgacatttcgaattcttgattttcccgatatgaccgttgaaggtacatttccaatgggagcggcagcgtgtgtggccgcaatctatcacggcttttctccattgactgccactttgattgcgtttggtgttgggatgattgccgggtttgtaaccggcattctttacacaaagggtaagattccggtgcttttagccggcatccttgtcatgaccgccgcatactcggttaacttccgaattatggatcgggcaaacctgtccctttttgacaagccatcattgttaaccggtaaatttatggattccttgccaaactactttaacagtgttgttcttggactcatctttgtcaccgtcgtgtcactgttaattatttatttcttgcagaccaatttaggtcaggcctttattgcaaccggtgataacccgacaatggcccgttcacttggtattagtacggatgccatgcagattatgggattaagtgtttccaacggcttaattgccctgggtggtgctttggttgctcaaaataacggctttgcggatgttaacatgggaatcggtgtcatcgttgttgctttggcttccattatcatcggtgaagttgtatttggcgatttaacaatgaatgagcggctaattgcggttacaatcggtagtattttgtaccggttcgttatcctgattgttttaaaactgggcttcaacgccaacgacctaaacttgatttcagcaattgtcctagcgctcttcatgatgttcccggtattcgaaaaacgtttcaggattcgccaaacactatcaagggggctaagcaaacatgactgaaccgatttttgaattaaaagatattgtggtgaccgtcaaccaaggaacccctgaacaaatcaatatcatggaccatgtcaattttgcaatctaccctggtgactttatcaccatcttagggtctaacggagctggaaaatccacactgtttaacgttatcggtggtaatattcgggtcacaagcggccaaattttactgcataatcgtgatattaccaacatgtccgttgaacgacgtacccgatttctcagccgggtttttcaggatccaaagatgggcactgcgccccgaatgaccgtttcagaaaatttgttattgtcaatgaaacgtggtcagcatcgtggcttgggccctcgtggcttaaaacaaaacatggcgcagtttaaagagcttacctcggttatgaataacggccttgaagaccggcttaatactgctaccggaaaattgtcaggcggtcagcgacaggctctaagtttcttaatggcaacaatcaagcgaccggaaatcctcttactggatgaacatacggctgctcttgatccacaaacgtcacaagaattaatgaatgcaaccaataatcaaatcacaaccaatcatttgacttgtttgatgattacccaccatttggatgatgcgctgaagtatggcaatcgattgattgttctggatcacggtaaaatcacctatgacatttcaggcagcgaaaaagatcatttaaccaaggaagaattgctaggattctttaacgaaatcgaaagttaacaatcctaatagtggcattatctgatcactcttcgatatactaataaagataagtaaccagtcaactcttactcatgatatcgaggtgatcgaaaatggcacgtccacaaaccaaaagggctttgctttcacaatctcaagataatttcaaaaaaatgtcgtccttaattgatcaattcacacctgagcaggaacagcaaattttttcgtttgaggatcgggatcgtaatgttcgtgatgtgttaattcacctatacgagtggcatcaactgttactcaactgggttgaagaaaatcacgtcaatcatcatcaggcagattttctgccggttccttacacttggcgaacctatggtgatatgaatgttcaattgcaaaaaaagcatcaggatacgtcattaaatgacgccaaagcgatgattgccgaaagccacacaaaggtgatgactttaattaaccaatttagtgatgaggcgttattcaccaaaagatattttccttggaccggtaccacttctgtcggcagttactgtgtttcagccacttccagtcattatgattgggcattaaaaaaattaaaaaagcatcaacgaactttaaaagaataagaaaaagacgcatcgagacagtcggacggcaagggtttgcccaccactgtcttgatgcgcttttttgtttagagatcaaaaaatgtgacgccctgattaaggctgttacttgtttaccacattcctggattgaccggcaataaaggcttttagattttcaactgcaattcccataagacgttcacgaatttcagttgccgcccatgcaatatgcggtgtcaggaacacgtttttagccgttaatagtggattgtcagcattaatcggttcctgggtagtgacatctgcaccataagcgtatattttgccgctatttagtgcatttgccacatcattttcgttgatcaacccaccacgggctgtattgagaagaataacgccatcctgcattttcgcaattgtcgcttgatttatcatttcttcagtttgaggtgtttgcggtgtatgcaaactaacaatatccgatttggtcaatacatcttccaaactgacctgtttgagccaatcctcacttacttcccgttcatgatgattataaaagattatgttcatcccgaatgaatgggcaatttgagccgttgcctgaccaatatgaccatatccgataatcccaagtgtctttcctgttaacgaaataagtggcgttttccaaaaagtaaaatcagttgccgaactccattcaccattccgaacggcttcactgtgcaatccgacctgatttgtaatttcaagcagcagcgcaaaagtgtgttgggcaactgcatccgtgccatagcttgggatattggtgaccacgacattattgtctttggcagctgctatatcaaccacattataccctgtcgcaagaacaccgatgtactttaactttggtgcctcattaatcacttttttatccagaggcgttttatttgtcagtacaatttcagcatccccaatgcgttcaagaatggtcgcatcgttttcttccgtccggtcataatttttgaaatccccgaattgcttaaatccatcccaactcaaatcaccgggattgagtgcaaacccatccaaatctataattttcatctctagtcgcctccataaatagttatgcctatcataccgcaccaccattttaatttgtgggcaaaagatcgttttttgtgccgaatgttaaccgctttgctgcgcacacttgtccttgcgcttgaatcactataatcacaatgatatgatcttgttgaaatagatgttatcttgggaggtttatcatgggaaagaaagaatggctgttatcactcgctgtcacaattttattagcaccaacactaccgtttgcgcaagcagttttacctgattctgttgccgttactcagacagtggctgctaaatcaaaagctacatctagatcaaccgttgtttctgccattaaacaaacaccggatctcaatccaaccgccaaagtgcgccactttagccaggcaacctacgcaaaatacggtgcactattcgataaaaactataacgttgagaaaatgagcccctacagcgttttcggagacgcccaagaagcctacgtttacacgtcatcacctatactgaagagatacatgtacgccgctatgcagaactggaacaaggcgttgggcaccaaagtatttaaccttggtaccaaatcccacaaaaccatcaccgtaaaatggaaatataatggcgccagtgaagaatgggacggtatgtatcaggataacagcctttggatcaacaaagacgattttgacaatgtaaactacgtccccaacacttaccaagcagctctcaataaagagatgcccggcgctggcaatcccaattcaagtacctataaacagcaatacattaactactggatcgccattatcacccatgaattaggtcacagtctcggccttgatcattcaccgtacacaaccgatatcatgttttcggattccgaaactgccggacctgattttaaatacacatggaaacgggctaaagtagacggaagttacgcagaatttaaaaattccctgtcacaacgggatattaatcgagcaaagctgactaaattacttggttactggtaagctttattaatttcgagaaaaagtcacctcatacttacatttcaaataactaaatgaatgactcccaagagaggttgtgacaaacatcgctttgtccatcccctcttttttgtagcaacaatcttcttattgccataatgacttatccttgcggctctactttttatgacaaattggtacaaacaatcaagaaagaagggtttctcagcttcttcacgattaattcacacttttttctagattgtgcaaatttaaagatgcaaacatttcacatttgtaagcgtttgaaatacactgataccgtgcagaaggtatcttctttattaaagttaattgtgaaatactatataaattcttctttatttgttcacggaaaattaatagatattttgtaaaattaactcagataaaagaaaaggaagtgaacaacatggaaaacaaacaacaagcaacaccaagaaagaaatttaagatgccttctgcgtataccatcttatttctgattatcattcttgttgctattttgacttggattattcctgccggtcagtattcaactgacaaagcgggaaacattattgcgcatacctataaagcggtagcgtctaatcctcagggaatctgggatgttttcacggctccgatttatgggatgatcggtaatgatcatactgaaggggccatctcaatttcactgtttattctggtaatcggtggtttcttgggcgttgttaatcaaaccaaagcattggacgacggcatctcgtcggttgtttccaaatacaaaggcaaggaaaagattttaattccattattaatgatcttatttgcccttggtggttcaacatacggtatggctgaagaaaccattgccttttatccactactcattccggttatgatcggggttggttttgataaaatggtggctgtcgcaattgttctggtcggttctcaagtgggatgtctagcatcaacggttaacccgtttgcaacgggggttgcttcacaaacgcttaacatctcaccgggtgatggcattctgtcacgaattgtgttgttaattatcactgttgcaattagtattttctacgtttatcgttacgcttcgaagattgaaaaggatccagctcagtcaatcgtctttgatcaaagagaagacgatctcaaacgattcgcattggatcataaagatcaatccggtgcaaagatgtccggtcgtcaaaaagctgttctctggttattcggattaaccttcctgctaatgattatcgggttgattccttgggatcaaatcaatgccaaatggacattctttgccagcttcactaagtggttgcaaggtattcctgtcttaggcgacttgattgggtcaaatctggtaccattcggttcctggtacttcactgaaattacaaccctattcttcttgatgtcggtcattattatgttcgtcttcaagatgaaagaaagtacctttgtagactcattcctaaacggtatgggcgaattcttaggtgttgcaatcatcgtggctgttgctcgtggaattcaagtaatcatgaacgacggaaacatcactgcaacggttcttcactggggtgaaatggggctttcaaatctcggctcagttgtcttcatcattcttgcttatatcttctacattccaatgtccttcctgattccatccacatccggccttgctgccgctacgatgggtatcattggaccaatgggtaagtttgccggcgttgacccaagcctggttgtcactgcctatcaaagcgcctctggttgggttaacttgattaccccaacttccggtgtcgttatgggtgccttggcaatcgccaacgtcaacatcaccgtttggtggaaattcatgttcaagttaatgatttacttgttcctgacaaccgctatcttccttggtgttatggcattactgtaatgtaagatttaataaaattcattggtcatctttggtcaatgaattttattgtgtcgctaaaattcgactaatgataagtgaatgatctgattctcattaacaactctttgcgctaatcagccaaaaaatcaagtctacattgttaacttaacaggaggtcactattatgcaaaaaattgttaccgaaacacaacaaaatcaagctgtcgacgctttaaaacgccttgtcagcaagccatccgttcacgatgacgataccgtcacagagacaaccccgtttggcaagggcatcgatgacgctttaacagaggttttaaagattgccgatgaaaatggctttaagacctacaaagatccaaaaggtaattatggttatgcagaaatcggttccggagacgaaacatttgggattatcggccacgttgatgttgtgccaaccggtgatccaaatgattgggatcataacccctttgacgcaaccgttgtcgatggccatatcttcggtcggggcacccaagatgacaaagggccttcaatggcagccatgtttgccgttaaagcccttgtggatcaaggctaccactttaataagacgatccgttttatctttggaaccgacgaagaaacgttatggcgtgacatgaaagtttataacaagaacgaaaagccgattaatttaggaattgcgccggatgcagaatttccactgatttacgctgaaaagggattggaacaagcctacttggttggtcccggacaggacgatctcacagtcgacctacaaggcgcattcaatgcagttcctgcaaaagccagttataacgggccaaaattagtagaagttaagcaggcactggatgtccaccatttcaaatatgagaataacggtgctgacggtattaccgtattgggcaagtccgttcatgccatgaatgcaccacaagggaccaacgctgtcttgagattggctatcgcattggacgaagtctttccaagcaaaacccttgatttccttggtaaattattcaaagaggacgcaaccggtaccaatgttttaggtaatatcgaagacaaacaatcggggcatctgacatttaatatttccagcttgaagattgataagcaagaaacccggatgcaaatcgacatgcggattccggtaacggttgaccgcgatgatttgattgataaattaaagaccgccgttgatccatacgggttacactacgaagcatttgactatctggcaccactctacgtgccaactgacagtcacttggtcaaaacgttgatggctacctataaagatcttaccggagatgatactcagccacagatttccggaggtgccacttacgcccgaacaatgcacaattgtgttgcatatggcgccatgttacccggcacgccggacttcatgcatcaagtcaacgaaaactgggaactcaaatccatgttcaaagccatggacatctatgccgaagcgattaaacgactttgtgtggatgataaataatagatactaaccggtcattcagcacgattaaaaggttcaagcaaattttgcctgagccttttttactgtctttttatcaacctatattgttatttttacactaattaggtaccgaaacaaaatcgttgaccttttttgtccaagggaatatactactcattgttaggtacctaagaaaataatttgaaggagatttttatatgacagacaaaaatgatttattgcgaaaaatctttggtttccttcacggctcacaacgccttgctcggcattcggctcgtccttaccagttaagaggacagcaccgggtactgcacgttttggctaaagaaggatctttgattcaatcacaactagctgaaattttggacattcgtccatcctcgctaaccgaattattgtccaagttggaagatcgcggtttgatcaaccgcacccccgacgaaaacgataagcgtgttaccaatgtttccctgacggatgaaggtaaaaaagcaatcgaaagtgacgacagctcttccgacgatttgattaattcgatttttgatggtctttccgacgaagaaatcgaccaattaaacggtctgttcgataaattgaacggatcacttaaagagaaactccctgctcgtgatgaacgaccagatggttttccaggtcatcgtcatcaccatcatggctttggcggtcccggtttcggtggccctcatggtggacctcacggacacggttttgaccgtccaagattctaaattagaatacgcttaaaaggtctttacaatgatactttgacagcgtgaacgggactgagacaaaagtaattttgtccagtcccgtttcatttcatcacgatgatgacactctgaaagttaaccgcccttttcccactctcttttttatctaaccggattgacactcacagattgagaaaccacccgcttattccttagatgggcctgagcagcagccaatctggcaaccggtactcgaaatggcgagcacgaaacatacgaaacatcaagttgttcaaagaattcaattgatttgggatcgccaccaatttcaccacagacaccgataggcaatcttggtttggtaaagcgccccttttctaccgccatcttcatcagctgaccgaccccctcaacatcaactgtttggaatggatcggccggtaaaataccttgtttgatatattccggcataaaagaactcacatcatcccgtgaaaatccgaatgtcaattgtgtcagatcatttgtgccaaaactgaagaagtcggaaacctccgcaactttatcagccgtcaggcaagcccgtggcatttccatcattgtgccaaccgtgtattgcagacgggcattcttctcatcaaagagctgttcaatctgcttcacaactaactctctaacccaactcatttccgcttttgaaccggttaacggaatcataatatgtggttcaataatcacattttcgtctaacagttgcagggcagcaccaataattgcccgaacttgcatctgatagatatccgggaaggtgaccgccaatcgatccccacgatgtcccaacattgggttcaattcctttaaggcgtcaacccgctgcgccaggtacgctggttcgatatccagttgtgccgcaacttcatgaatctctttttcatcatgcggcaagaattcatgtagaggtggatcgagcaatcgaattgttactgaacggccttccgataatttatacaatccgtaaaaatcgccctgttgcatgtccaataatcgctttagcggcaactttcttgcttcggcattttctgcaataattaaacgacgcatctcgagtaaccgttccggcttgaaaaacatatgctcggttcgcgccaacccaatgccgtcagcatcaaacttcaaggcctgagaaaaatctgccggcgtatcagcgtttgcataaacaccaaggtgactttcctgttttgcccatcccaacagcgtcgataaattctcattaacggccatatcagtggttttaatctgaccgatataaatgttaccctgtgtgccatcaactgaaagccaatcgccttcatgtaactgatgacctgaaaatgatgcagttttgtgctgataatccacttgtaaatgattgacgcccactgtagccggtgttcccattccccgcgctaccacagccgcatgagaagtcataccgccacgcgacgtcacgattgcttcactaacaaccattccttcaatatcttccggggaggtatcttgacggaccagaataactgcctggtgtttctcatcatgagcagccttagctgcctcagccgtgaaataaacgcgaccggtggcggcaccaggagaagccggcaagccactggcgacaatgtcatttttagcaagctcctgctcatcgaattcgggataaagaattgcctgtacggactctggtttaatccgcataagtgcctcctgcctggaaatcaggccctcatcaaccatatccacagcaatcttaacggcagctgttggcgtacgtttaccatccctggcctgaagcatataaagcttcccgttttcaattgtaaattccaaatcttgcatatcacgataataaaattcaagcttggccgcaattgctacaaattgctcatagagatgcggcattgtttcccttaatgtactgattggctgcggtgttcgaatcccagcaactacatcttctccctgcgcattcaataggtactcaccaaataactgtttttccccagtagcaggatctctggtaaaggccacaccggtgccggaatctttgccggcatttccgaagaccatcatctgcacattaacggcggtccctaaaaagctgggaatattattctcacgacgataaattttggcccgatgattattccatgattcaaataccgagttaatggctgccaataactgttctgtagggtcttgaggaaattcccgatgcaactcattcatataaatctttttgaattcgcttacaatttgttttaaatcatcggtggttagatccaaatcagattgatagtgattttgttgtttcaaattctcaatgaccatatcaaaagttgcttccgaaataccttcgaccacgttgccaaacatggccaatagccggcgataactgtcataggcaaatcgttcattagccgttattttagcaagagctgccactgtctgatcgtttagcccaatatttaaaatcgtatccatcataccgggcattgaaattgcggctccagagcgaaccgataccagtaatggtgcgcttggactgtcaaagcttttaccgaccttttggcttaactgatccagtgcttcttttatttgatctaaattatcatcatttaattgattgtgattcttataaaaggcgttgcaggcttctgttgaaattgtaaaaccacttggcaccggaaaccccagattggtcatttgagccaaattagctccctttccgcctaataaacgacgcatatccttattgctttcttcaaacgtataaatatatttcattctattacgccctttctcaattcactaaaacatttcattaagtgtcattatcatatatgagacgttctaataatgcaagtcgtccttaaaggaacgttttaataaagtgtcgatcaaggctcgtcactctgcgttttataacaatcaaaaaaatattttaatcaatctattaagaatcaataagacgttttatttaacttattttatgatatgataaacttgtcaattaaatgcttgtcaacagacctcaatttaaaatttggagagattactttggaattaaccccacgtcaagaacaaattatcaacattgtcaaaacagcgcaaccgattaccagccaaagaattgccgacaaactccagctcagcatgccgacaattcgaaccgatttgagacttttaacggctttcggtattttggatgccaagcctaaaatcggctacacctatgatgaatcaccggacaaggttttaaattaccagcaattatttgaaacgtctatttcagaaattctccaaaaaccaactaagatcatggaagcggctaccttgacagaagccgttaacaccctctttatcgaagatgttggctcactatatgtggtagatgaacatcttcatttggtcggtcttatttcacgtaaggatttactacgggcaacactaaacaacacaaacgcttccttaacgctcgcaagcaccgtgatgacacgaatgcccaacatcttcactgtcacgccggatatgccaattattaaagccggtcaactattactggatcgaaaagtagattcactccctgtggttgaccaaaatgatcatcaaaaagtcatcggcaaaattactaaaaatcgcattttccagcattttatcaaaatcgggttagcaaaaaaataggatgatatcaatctgacaatatgccagaattgatgtcatcctattttgcgaaacaactattaatttttaatcttaagagataatagctaacccaatcttacttttgatagaaccatcccgcgtaatgttttgtccattttaactggccattgactaaatgactgcttttatacgaaattctggttttaccctggtatgggccaaacatcattctcagatacgtctgaccaccgttcttataagttcctttaactaaataggaaaccggcgtacttcgccggtaagacaccttttcaatggtagtcgtcgacttcggcaatgtcttaatcgtcacacccttggcatcaacagacaaagtgggataaaagcccccgtttttggaataccgggacgtaaacgttcccttcaaaattttaggcatcccgcttgtccattttgccgccatcgttggcgtttgtagtgcaatgacaccacctaacgcaatcatcgaagtcactaaaaccctgtatatttttttatcctgcattcaactcacccctcacatagcatcataccatgtcaggaatcattaggattaataaagtcattggcaaaataatctactcatctaatgaacattccaaataaatcgtgccggcaaccggattataacggtaaggcgcaatctctttaaagccggcttcccgataaatcttctgggccgctttcatttgaggaatcgtatccagacgaacggttttatatcccatgctctgggcgcttgccaaaattctggcaaccaattcatgaccgagtcccaggcttcgaaactgcgttctaacatataaccgcttcatttccgcaaccccggattcaaaccgatggattgcaatgccgccggccaactgttgatcaacgtatgccaaaattaggtcacccgttgatcccccataccgtttgggtaattcattcaactcatcgtcaaagttttgaaagcttaaatccatatgcaatgactgaccatattcaataaataacgccttggcaatttcgaaatcacgcgacgttttggcatgtcgataagtaatctgtgcatttggttgttccataagatccctccatatctgaatattaggggccattttacaataaggacgatgaaaaaatcaaggttgtgttgaaggccgttcagctgtccaagtgcgtcttcactttttgtcttgtcccgtcacatcttcggaaacttcatgcaatttcttgtccaacgccaattttgcttcatgttctctttcactggctgccttttgtggcaaaatcaaattcaaaacaatgccaatgactgttgcaaaggccaatcctgtaaattgaaatttaccaagttgaagataggcattcccaatgccgatcaccatcaccgttgaggcaatcatcaagtttcgttttaagcccatatcaatcttgttttcaaccatgacctgaatgccggcagtcgcaatcgtaccaaacagcaggaagctgatcccgccaataaccggtaacggcatctgcatgatcaatacattcaatttgttcacaaaagcaaacaggatagcaaacccggcagctcccattaacacataaacactgtggattttggtaatggccataaccccaatattttcaccataactggtcatggcgggcgcaccaaccaaaccggcaaacagtgaagctgcaccatcaccggccaaggttctgttcaaacccggatccttgaagaagtcccgattggttaattcgtccaagaccataatatgacccatgtgctctgtcatcgtgacaaacgcaattggcgtgatcgataaaattgctgcccaatcaagtttaaaatgataagacaaaccgggaatttcaaaggccggcattttaaaccacggggcaaccgcgatcgcatgcagattcaccaatccgaaaatcgctgaaatgacataaccacaaacaatagcaagtaaaacgggaatcagcccaataaagcccttaaagagcatgttgaatccgattgccaaaaataatgtgaccaatgcaataatgaaatattccaaattataatgtgtgcctttcatcatggcatctttagcggcactaccggcaagtgagagcccaatcaccatcacaatggggccaaccacaattggtggcaatatcttatctacccaatccgaaccaatcgcccagataatgccggcaacaatcatataaacaattccgacaccaacaattccttgaccgaccgccggatagccggcggtatgcattagcgcatacattggtgtaataaaggcaaaacttgatcccatgtaagccgggatctttcgttgcgtaatcataatatgtagcaatgttccgacaccggaagcaaacaacgcaatacttggacttaaaccaaccagtaaaggcacaattaccgttgacccaaacattgaaaacatgtgttgaagagaaaggccaacccacggccagaacggcggcatatcgtgaatatccaaaattgcgcggtcatcatgaaactcatttttatctgccattattgttaaacaccccttatatattttggaacattcactcatcaaaaaatccatcatccccgggattaccagtaagatgatggattttaattcaggtcaataacccgatttaaatgtcgtattcttactggcctcacgggaccggagttaaagatcttaacgttcaaattaaattatagtatagcgaagagtgggattcaaggcggttatctgttagccatataaacaaccgatcaaatagttatggtccgattgcctataaagccggaaattgttttgaatacgatgctttatccaagcaccccaacctactcttcaatcagtcttcgacagacttccgtcatggaacgaaacttgatttgcggcggcatcacttcatcgggttcgtcataactgctcccccgaacatctccgttatatcgatttaattccgacgtattaaagtgtttttcaattccctgtttgggcagtccgaactgtaaagcgccctgataattaacaaacatgccgactttttcaaaatattttggcagatgattaattcgcagataggtttgcaactcttcagggtcatgttttaccaattccctgacaaaagtggaaatacagtccggtcgggtctcgggcagaaaatcatttaatccggcaattaatggaaaaccgtctttttcagtcgaatggtcaatcaaaaagaaacgttcaaaatctgcggtgactgtttgcatctctttattagcaatttgccaatgctctccgatatgcaccaagatccgtctgccacggggaaatcccaaaggaattgccagccccaatggctcatcggattgattcactgccgcaataccaccataaagcctctccgttgcatgctcatcctgaatgatatccaatggcacaccagaataaactttttccaggctaaccaacatattcatataactaatgtctttaccaacaggtgtaaaaccaacgtcaagaaatagtcggctttgtgcaagttgttcttttgaaaaatcatcgtcaaaatgaagtgagtctcccattgccaaagtaggcagataaaacataatgccgtcattttcaagcatcatttcccggtactcaggtgttgtccggctcaccacgacccgatcagaaaaactattcacacgtgtaatcagtgaatcaatcgcatcatccattttcgggcgaatcttttcaaaattaggattgtcaaaaactgaatcggtcataaaatctcctcattatgctatatccgattaaccgattttatgatcgttataatcgaattttctctttccaaaagttcaatattcaatttatctttaatgagtatatctggattgagagaattgtgcaacgctggggatattccgggtgttaaccgctttgcctcacacacttttttaggactgctcctcaaagcaacgttctgcatgtaagggattgatttcaaaaatccagaaccgggattttccaaatcaacgccttacactccgaacgttaaccgctttgatccgcacactatacttaggactgctcctcaaagcaacaccactccatataagggattgattcgaaaaatccaaacccgggatttctccaatcaatcccttatattccgggtgttaaccgctttgcctcacacacttttttccatatcaatatgcggaatatcatcctccaaatacacgtcacttacatcatgaaatccaaatgaatgatagaaatctttcaaataggcttgccctgccaacacaatcttgttagcatttggtattaatcgaacagattcttcgagtgctttttgaaccagctgttttgccaaccccttaccacgataatccttggcaacaatcactctgccgatcctggcaatagtttctttctcgtctggaataattctcaggtaagccatcaggtctcctgtatcatctctaaaagttaaatgataggaaatcaagtcatcatcatcaacttcttggtaaggacatttctgttcaaccacaaaaactgcaacccttaatttataaatatcgaataattctctgttcgttaattcgctgaatgtctttgtttcaattttggtcacgattcgaatcctcctataataagtacaacgttttctctttctgttataatatattcgactaggttaacttgcaagataactgtaagaatgaggtattgatgtgaataagcatgacaatgaaccacagtataaaaaatatgatttcaactcggagcaaacccgcagcagtcagcgtaaaagacaatatagcggctggtggtttgcgcttctgatactaattattgcgcttggaattgcagtttcactcagctggttcttaacaagggacagtagcaagtcgtcaaaccgttcctcgacaaacaatatcagccgaacgattaaaaagtcggaaagtgccttgaagaaccgaaaaaccaaaggcgctctgacaagtaagctggaaagcaatcgtgttaattcgttcaaaaagcaactgaatcaggctgataacaacgggataaccaggcaacagcgctctcaattacaagaaaggattaatcaggaatccaatcaatcagttaaaagcaaggaacaaagtctgttaaatcaaacgcaaagcagatctaatcaaccaccaaaaaagcccaaagctgcagatccctttgcgacaagccacaccttttcatctattcaagacgctaagaattgggccaatgcaacaaaggaagagtggttgaaagccggctatgttaactatacaattacatcaaacggtcagggatattatacattaaaatttgtcaaataaggaacttcttacatctactcgtgattaatcccaaaccggtactggttaagttcatgtctattttgacacaaattaaacgcaattcattttcttaacctgtagaaagacttatgatgatattgaaagggtgatgaagaatggacatcaaagtgccacttacaaagggctttttgcccgataaatacgcaaagcatactgccccggctaatattgccaatggcagtccaattatttcgtttccaattcaaattacaggtgttccaaaagaagctaaatcgttagctttaacattgattgattgggatgctgttccggtcagcggatttccatggatccattggatcgctgcaaatatttcgccggatgttttggaaattcctgaagataatagtcgaaacctgactgtcccgatggttcagggccgtaatagtactgccggcggattagttggtaacaacgatcccgatactgcttggcattacaatggaccaaatccccctgataaggttcacaattatcatttatcagtcttcgcattagatagtgaacttccattgaaaaatgggttttggcttaatgaactccaagatgcaatgagaggacatattttagatactgcagaaattgtcctgccaagccaaaattagttttttggatctcatcagaggtgtttaatcacaactattttgtgttccagctaaaacaaactaaattagtgatataataaacatattaatttatcgcaagggggccgcttcttatggaagccaattataaaaccatcttggtacctgttgatggatccaaacaagctgaagatgcattagctaaaggtgctttaatcgcaaaaaacaacaatggccatttggacgtccttcacgtccttagcacaacccaatacggctacaactatggtggaatggttgatggcgatgtcatcaataacttagttgaagataccaccgattatcttaacaagctgattgctcgtgttaaaaaggatgcgggaatcgacgatatcaacattcatatccgtttcggcaatccaaagacagtcattgcttttgaatttccccgtgatcataaatctgacctgatcgttattggtgcaaccggtatgagtcgtcttcaacgcgtacttgaaggatcggtttcttcatttgttaatcgcaacgctcactgtgatgtcatggttgcacgtacgaatcaaaagaatgaaccatcggtaccggaaaagaaataggatcatttttgaagcatgtccaactaaatatcaatgcagaattaaaagtaaggcaattttctgttgtcttacttttttattgctctcatctcaaaataggtttccagagtgtcttttctttatccgcctccttcaatcaggtatgatgaaattagttatgtaagcgctatatattgattggaggaatgatgtatgaaagtgctagttattggcggtatcgcgggcggcccttcgtttgcaacccgtttgcgccgaatcaatgaaaatgctgaaattattatttttgagcgtggtgcagcaatttctgttgccagttgtgcccttccctactatttgggtggtttgattagaaaccgatcagcagttattgaacgaaccccggaaattttgaagcaaaaaaataacatcgacgttcgtctgtataacgaagtaacttcaatcgatcccgataaaaaggttgtccatgtcattgaccatcaaaatgatcaaacctatacggaaaattatgacaaactcattatttcaaccggagcaagtccttccgtaccagcgattaagggtatcgataaagccgatgatgcctttgttttacgtgcgattaccgatgctgacaagatcaagcattttttagatacccgtcatccaaaacgcgtcacaatcctgggcgccggcactatcggaattgaagttgccgaaagctttgttaacaataatatggatgtgacaatcgttgaacaatccgatcaagtcgcggcaccttttgatactgaaattgccgatattgtggctcaagaactcgatgaaaaaggcgttcacgttctgctcaaccataccatcaaagaaatcaccgataatggcaaaaccctaattttcgatgatgggtcagctcaccataccgatatgttatttttgggtactggtgtccaacccaacagtcaggttgccggtgccgctggagttaaattatcagatgatcaacacatcattgtcgatcatcatttaaaaacaaatttacctgatatctatgcaatcggggatgttgttgaaaccaccagtatcattaccggccaaccaattccaagtctgttgtcaagtgccgccaatcggcaaggacatttattggcagacattctaaatggtagtcctttggaatataagggattcattggcgcaggtgtatccaagttctttgacttaaccgtcagctacgttggttacacggaacaagcgttgcagcaatccgggattaatgactatcgctcggtctttattaccccgtttgatcacgcctacttcttcccaaatgctgatcgggtcaactttaaactgctttaccaggacaagaccggtaagattcttggcggtcaagcggtcggaagaaacggtattgataaacgaatctctcaactttcagttgcgatcaccggtaatttaaatgtagccgacctgccatcccttgagatcccttactcgccaccatattcatcaaccagggatgttttgaatattgcaggttacgttgcaattaatcaattgaccaaccgaacagcaaccatcaaactcgccgatatcccgcaagacgatcttaataacgcctttttcctggatattcgtgaagctggtaagcctgaagccggttcgatcaagccaacccttaatattccgttgtcagatcttcgtgaccgaatcaatgaggttccaacggataagaaagtctatattacctttagaaaaggcttgggtccctataatgcatcacgtattttagccggtaagggaatcaaagcaattatgattgaagaataattgctttaaaaaagtaaaagtagtcgtcaccaatctcttctcagagtattttatacgaatctaaaagtccttttaataaaaggacttttttatgttacgttttatgacattcaggtggcgattatatgactctttttcaaaaagataacagtacgcccagtatcaattatcgttaaatcttaacgctttattgtaataacaccatcatgtttttcatgaaaaagcattgaaagcacagcttctgcagcgtatgatcatgtttaagatcttcaagttcgtttaaagatcaggcggctataaataagatcaccaatgtcatactttctgacaggggtgatgcaagcaggcggcaggcttgtcaaaattgaataaagaggtgttttgtaatgatgaaaatacttgtgaagaaaactgaccaagcatctacaaaatcattcaatgttgccaagtctgctgatcagctgatggttacgcctgacgcagatatttcgacaggccaggccgtacttttaggcctacagcatttattggcgatggacgtttatgtagtgccaatcatcatcgccggaatgttgagcttaccactagcaaacaaaatgggattaattcaagcgacctttttagcagctggtgttggaacgatcctgcaaaccggtgtttttatgaagatgccagtcactcaaggtgcatcatttgtgccacttggtgcacttgctggaatttatatggcagccggacgcggtaccataggaatggcaactatctttggatcacttatcgttggtgcattttttgtactgttcttgggattcacacgtgcagtgcccaaactgattcataaatttgtcccttccctagttggtggcaccattatcacaaacgtgggcctatcattaatcccctcggctctcaatgataatatctttcaagcaagcggaaatttaaacacaaatgtcttgttgggtatgattactgcaggcgctttagtattctgtgtgattatcagtttgcattttccacagtacaatcgtatttttcgattaggctcaattttaattgcactaactgttggtacaattgccgcagctctaatgggacaattttcatttaaatcagttctcactgcgccgtggttcagcttacccaaattctccttaaccagttatggacttcacttctcactttcgccaattttaaccatgctgattatctacatggtattgatgaccgaaacgacaggtacttggtttgccgtttcagcggttactggcactaaattaacgccccagcgtatcaaccgcggtgtctttggagaaggcatttcatgcctggtatccgctttggtcggttccacaccggttacaggatattcaacaaacgcgggcattatttcaatcaccggggttgccagtaagaaggcctttatcagtgccggtgtttggttcattctctttagctttgttggcaaattgtctgcccttttggcagcaattccttcagcggttatcggcggtgtctttgcgattatctgttcaacgattatgctgaatggcctaagagtggtgagtcaaagtcattttgccgaacgcgatctctatatcttgggaatccccatcatcctaacattagccttggtcttaatgccaagtagtttaaaaaacgaagtcccaacatttgcgcaatacttactggattcaccaattgccacagcagccattactgcaattgttttaaatcaactattacccgaaaattcacaaccaaaattatcaaaaacagcaagataggagtgtttatatagatggaaaatattaatatcgatcagtttatgtccctggcagcaaaagaagctgaaaataatttaagaaccggagacggcggcccatttggagctgtcattgcaaatggccaagacattttagtcacagctcacaaccaagttttaaaagatcaggatccaactgcccatgcggaaattaccgcgatccgaaaagctaccaaaaagcttggcagttatgatttaagcggctataccctgtatacgtcatgctacccatgtccaatgtgtcttggtgcgatcatttggtccaacataaaagttgcttattatggtaatacagcaaaggatgctgctaaaatcggattccgcgatgactatatttatgattttatcaaaaacagtggtcgaaatgaaaacgtcttggatttaagaccaagccatagagatctgaccattaaagcatttaatgagttcagtgaccagagaacaaaggtcatttactagtgtgtggatcaaagcgattagcacccggaatataaggcgttgattggagaaatcccgggtttggatttttcgaatcaatcccttatatggagtggtgctgctttgaggaacagtcctagaaaagtgtgtggatcaaagcggttatcgttctacatgtaaggcgtcccttttaagaatcccgggtttggatttttaaaagggatcccttacatgtagaacgatgctttgaggaacagtcctagaaaaatgcatagatcaaagctatcatatcgatagataaagccaagatagggaggcatccttatcttggctttttatcatttttcactttcatagcctttcaaatcgtttgttaattaagttgcaatccttctcataattgactaaaattattcttaacactgaacggaggaacactatggattcaaaaaataccacaaagattaatctgtttcaattagtcatgctggcactcggatcactggatcactcattggatcaggatggctgtttggttcctgggaagcatccagaattgccggacccgcctcaattatttcctggattattggtggcttggtcattggtgcggtagcctatgattatgttgaaatcggtgcaatgtttcccgaagccggtgggatgagcaaatacgcccaatattcacacggaccgctcttgggatttattgctgcttgggcaaactggatctcactaatcacgttaatcccgattgaagcagttgcagccgttcaatacatgagtacatggccctggtcgtgggcaaactggacgcatcaatttttaaaagacggcacgatcaccaattccggattattggttgtttttggctttatccttatttttacattgctaaactactggtcggtcagaatactgaccggatttacaagcctaatttctattttcaaaattggtgttccgactttaaccattgttatgttaacgatttcagggttccatcctcaaaactatgggcagtcatggcatgattttatgccttatggaacggcaccggtctttgcggcaacctccgttgcaggcattatcttttcatttaatgcttttcaaaccgttattaacatgggaagtgaaattaaaaattcccgtaaaaatattggtcgtggtattgcaatctcactattgatcagtggtgtcctctacatcattttacaaagtacttttattaccgccattgatccggcaatgattgcaaaatccggttggcacggtatccaatttaactcgccctttgccgatcttgcaattttgcttggtattcactggttatccgttttgctttacatggacgcctttgtctccccttttggaaccggtgtttcatttgtcgcgtcaactgcacgggcgctttacgcaatggaaggcaatcaccatatcccaagctttatcggcagaatcaacatcacctatggcatccctcgagtcgccatcatcgtcgataccattctaagcatggtcatggtttctatttttcgatcgtgggcagtactggcaaccgtaatctgtacatcgactctaattgcctacctaaccgggccggtcaccgctgtttcatttcgaaaaatggggcctgattttaaacgaccggtgaaattaaagcaccttggttggatggcacctttttcttttgtattggcatccttagcaacttattgggcgatgtggccaaccaccattgaagttattttaattattattttgggtctgcccttttatttctactatgaatataaagccggttttgttaatacacgtaaagctttttggtccagtctttggatgatcgtttatctcatctttatctccgttatttcatacgccggaagccatcaatttaacgggatgaactggattccgtatcctgttgattttatcgtcatcatcattgcctctttaggcttttattattggggcattcatagttggcaaatttttccggattattatcaggcaaaaaaattgaacgagaccgttaaaccggaagaaaatgactcaacctattgacacgaaaaacgtggcattcaaaataaattcctgtcaggcaggcattttgcacattatcatataaaaatacaatttcgatactattcctaaaaaagtataaaatcttctcctgactatcatgatagtcaccaatcgacttttttcattttacttcatttgcaataattttctcatttgttacactggttgtcattgcaaataggaggtacaaatggattctgacaaaacgactaagattggattatttcaacttgtaatgttaacgcttggttccttaattggatcaggctggcttttcggttcttgggaagcttcgaaaatagcaggccccgctgctattatttcatgggtcatcgggggtgcggtcattgccgcaattgcttacgattatgttgaacttggcgcaatgtttccggaagccggcgggatgagccgatacgcacaatattcccacggaccgcttctgggatttatttcttcatgggccaattggatttcattaattacgttaattccaatagaggccgttgctgccgttcaatacatgagttcatggccgtggtcgtgggcaaactggacccatcaattcttgaaaaatggcaccattaccacagcaggcttaatggtggttttcttattcatgttggttttcactcttttgaacttctggtcagttaaaattctaaccagttttaccagtttaatctcggtttttaagatcggggtaccaacgctaaccattattatgctgacaattgccagctttcatcccgaaaactatggccattcactccacgaatttatgccatacgggtcagcaccgatttttgcggctacgtcatcagccggtattattttctcgttcaatgcctttcaaacggttattaatatgggaagtgaaatcgaaaacccaaagaaaaatatcggtcatggcattttcatttcacttttgattagtgggattatctacattgtccttcaaagtgtctttataacggcaattaagccatccgcagttgcagcacacggctggagtggtattaacttcaattcaccatttgccgacttggcaattatgctgggaatccgctggttatccgttttgctttacatggatgccttcgtttctcccgtcggaaccggtgtctcgtttgccgcatcaacaggccgagcactttacgcgatggaaagtaaccagcatattccgagtttcgtaggtaagatcaatcaaaaatatgggattccccgggttgcgatgattgttaacctggttttaagtatgctgatggtttctgtatttagatcatgggcaaccttggcaacggttatctgtacgtcaaccttaattgcgtacttaaccgggccggtaacagcggttgcctttcgaaaattggccccagattttaaacgtcctgttaagttaaagcatttaaattggatggcaccactttcgtttgtcttggcttcacttgccgtatattgggcaatgtggccaacaaccgttgaagttattttggttattttattaggattaccattctatttttactacgagtaccgggctggttatgtgaatacccggaaagcattttggtcaagtatgtggatgattttttatctcattttcatttcaatcatgtcctacattggcagtcaccaatttaacggtatcaattggatcccgtatccttgggactttgtcgttattattattgcatcccttggcttttattattggggaatcaagagtgctcacgtcttcccggacttttatcaggccaaggaattaaatgatacggtaaaagaatagtcaatataatttataacaacgaatcatttttgagcctataaccaaaaagcgtcaaattgtctatcttcagatccttctgaatagtcaatttgacgctttttaagtaaacattgtcctcccaaggcaattcctatcatacaacgataatccgttaaaaataaaggacgctaagcaagatgaccaccccgctggacaaatcttcctcatcatctgtaagcctttaaccacaaaaaaaggaagttgagataaatatgacttcatcgcaacttcccttaggcatataagtgcccctgccaaggttcttttatcataacacctatttggcattcaggtgttacttcagtcgttcaaataatcattttgggaagaatttcccacctgtcagattacacccactgtccttatccttaagacaattcattgattaagaaaatatttcaaacaccccataactattggcaaatcattaaccacgtgttatattaaggacattggaggatgatagatatgaatatgactaaattcgcaacaaaagcttctattacattgggggcagctttaggattaggcttgtttattgcacaacaacctgcacacgctgctacttggcacaagggaacaccttcagccgttcggggaacttggaaaacaaaatcaacaagtatcgccgttggttcaaaaaagcaaacggcttatgacaaggtaaccatcgccaaaaatgcactttccgattattcctacactggtaaaaataaattaggaatgaaaggcacatcagcaaaatacgccgtgaccggaaaatatacctacataattaaggccaaggttgcaaagaatgtgacacttactcttcacgttaaaaaatcaagtagtaaagtgattgttatcggtaatggtacaaagaataccaaccctgctaaatattacaaggcttaagctggcaaaaaagattctactcctcactttgtgttggagcggaatcttttttgttagatgaatggttgaatttttgctgacaaggttggcaagcccactaactggtgctatattaggagaattgggaggtgagtattttaagatgaatcaatcagtcaggaaaagtatagtcgtttttgtaacagcatttatattgacagtagtttttacaccattagccagtcacgcggatacttggcacaaaggaacaccaaccgcccttcgaggtaattggaagtcaaacgccaaaacagagtcaactgccagtggcaaagaaatcgtatattatacactatcatttagtaagacagccgtcggtaattcagctacaatcaatggaaaaacactgcagtttagacttcacgctgtcgattatcaaaaaatcagcaagcaaacctatctgatccgaacactattcacagataatcaaaatggcattttaaccgttaaacaaaccggtaagaagaaaatcgttgtcggtaacggcactaacaatacagataaagaatcctactataaaatggacaagtaagaagaacggctatgatcagccgcctttttaatacctgtccattttttgttattcaattaaaccggccacgattaacataagccaatttccaaatgtctatttaaagaaatcgagcatcaatttacagaaaaagataaccaaaaccacaataataatcggcttagccacttttcggccgccttttttaaaccatgaggcccccaaataattaccaacgatcgaaaataggccggctgttaatcccagtggtaaaagaactttcgcgttaaataggaaaacagccaatgcagttatattggtcgttaggttaatcactttggttgtgccggcagcaacgttaatcggcaaatggtcgaggccggttagcagtaaaatcaaaaacgttccggttcccggtccataaaaaccatcatagccgccgatcacaaacgaaatagcagcagcgataaccatttgtcgattcgaaatgcccgtttgtacaaaaccggcagctcccagtgcctttttgttggtcaataaatagatagctgtcactggtaaaacaattgcaagaatgattctaaagtaaaaatcagaaacatgaagtgccagttgtgacccggttgatgaacccagaatagcagcaatgaccgtaaaaatagacaggcccaaacgaagatacccgcttctcgcaaacttcagagttgcaacaaccgtccccatcgcagaggatagcttattcgtgccaatcgcaaaatgaaccggcatcccggtcattaaataggccggcagtgagatcaatccgccacctccggcaatggcatccacgaatccggctaaaaacaccagcggacaaacaattataaaggtaagcatgacaacccccgtcttgaaatgagttaatacttaccagtttaaattgcagaaatccaattgtaaacatgccataaccaaataatatttcgattcataaacaatcgagtgaaattcttaattttatcacggtactacacgtgttagaatgattattgtaattgttcatttgtttaatactatttattaacaatgaatacaatattttgaattaatttggaggaatttttttatgaagaaagcaatgttgtttgtctttggggtatgtttattagctttggggggctgtgccaacacatcaaaggtcgtttccaagtcatctaaagccgtcgactcaatcaagagtggacaggcgatcgtcacattaaagaccaagaccagtgcaggtacccaacaaacgattgatggtggtacatttacactgaatccattcgttgtcgctttgaaccagtctaatcaaagccaaccaaccagccattattatatcaacaagaatgttctttacattcaaatgaacaaagtttggtacaaacagactgtttctaaaaacagccagatcattaagaacacacgaagtcaaatgtctgctcaatcagcagctcaaatccttaagggcatcaaaaaagatttgaaattaaagagcaatgacaaaacgtacaccctttcttacgatggcaacagtaagaaagcaacaagcaccgctaaaaaggtattggttgctcaatcaggtcaagccggtaagcaaaatgccagccaaattgacgtttcacatctgaccttcaaatatactgttaataagaagacctatttgccaactaaatccaatatcaagatcaaatatacaagcaagggccaatctacaaccagcactgtaagtggcagctacgcagatcttaacaaggttaagaaagtagacatcccacaaagtgttaccagctcagctaaaaagttcccagctggtttagctaaatacatgttttaattagttcaaaggaacgcttcttatcctgaacaaccgtttaaaacagtcggctgatatcctatcattaggaataaagacatgatcataaatctccgtcattgagggcggaacaactcctctcaatgacggggattttttatgattattaataattgatcccaagagtatcgcacaaaatggtatgatattataagtattaacatatttgaaaggatgtccgttcataatgaaatcgaagcggaatacattaattatcagttttcttgcgccactaattatagtaacctgctattttatttatcgtcagtttgcgccgttcggcagttcgtcggtgatgactgtcgatatggggcaacaatacattgatttctttacttactttagaaccacacttcttcataacccaggtggcatattctattcatttaataaagccttgggtggcgacatgttgggaacgtggagttattacctcatgagccccttaaacctgctgatcctactatttccgctcagcaaacttcctgcagtcgttggcgtcatcacaattttaaaatatgctttggctggactcaccgccggctacatgttcatcaagcttcagaagacaaccggatggatggtcgttgcattttcaacatgttacgccttgatgggctggatggtggcaaaccagctcaataccatatgggtagacggcgtcatcttgttaccgctcatttatttgggcttaacccatattctttccggaagttcaagtaagctctatatcattagccttgcagccattttaatgattaactactacatcggttggatgatcgctatttttgtatccgcctatgttgtcgtgtttacactatgcaaagcttaccaaacatcaacttcttatctaaaggtatttctaaaatggttgggggcttccttaatcagtggtgcgttatccgcatggattctgattccgaccttttacgcgcttctaaaaagtaaatctgatttttctcaatcccccttcttttttacctttgagtacaacccgattcgaatgatcgcaaaatttgttaatggcgcctttgactttacccaattaccaaaaggaacgccaaatatttttgttggtagtattgttttgatcatgtgcctgtattacttttttgccccatcaatcaaaaaacgattgaagatcgcaaatggcctgctgcttgtctttttaatcctgtcaatgtgttttgaaccactggacgttatttggcatggacttgcactccctgtgtggtatccctatcgcttttcatttattttctctttcctaatgattctaattgccttttcggcacttcaggatattctcaagaacggactttcatggcttggatttgatatttcactgggtattattgtccttggatttgtttatatcgctattgccatgaagaagttcgaattcttaaccattggcaaattggtaacaggcatcgtcttcctgatactggctgttttattgctgttcttctggaacagattccctaaaaaagcctttttcccgttattattattcttactggtcggtgccgagatgggtaccaatctaaccgtatcgttagccactcttggctacctggatgcagctgactacaccgaattttcaacattaatgagggaagcaagcgccaagaccaaaaagatggatcccggtttttatcgaaccgcggccacctttagccgaaccagaaacgatgccatgaccggtaatttctatggtggttctgtcttctcctcaacactggaaacagcaacgactaatttctataacaatatcggtaatcccagtggtacctattatgccgtttattctaacgggactgtctttacagattcattattatcgatgaagtattacttcacaccacgacatgttaaaaataaagttgagtcgcgtcggtcacttaattatttgacgccactgacctcccgtcccgacttagtagattattccaaaaaagcccataccagtttaatcaacatttataagaacccgtatgcattaccactaggctttctgtcaagacgtcaattcatgttcccaatcaataatatgaatgaaacggctgcctaccaaaaccagattgcttcccaacttgaccccagagtgggtaacctgttctcaagtatcaggccggcagaagtcacttatgataatgcctaccctgccgccaacttctctaattcacagatccgcaaaaaggacaaaaccgaaccggctggacttacattaaccattccggttaagaaacacacatcttattacatgtcacttggtccacggatgacacaggacacgctgacttacctggttgacaacaagccactgcaacaatatcgaacttccgcaaaagaaaccctattaaatttcgcaacaggtaccaataagaatcgtacggttcatttgcaaattcttgccaatgtcaaccatgccccattggaaaatgttttcctttatgcccttgataataataaagtcaaacaattatctacggatttaaagaagaattcatataaggtgacaaaatataccgatcgttctattaccgggacgatcgcttctccaagcgatgatcgaaccatgacgaccactattccatattccaagggatggtcggcaaccgttgatggcaaaaacgtcacgccaaagagatgggcaaacatgttcatgtatatcaatgttaataagggtaagcacactgttaagtttacctatacccccgtcggtttcaaaagtggcctaaccatttcattagtcgcattgattgggttaatcggcctatgtgggtatcaattttatcgacgcaaaaaagtcaccgacataaagtcaactcattaatccaactcactcatcctattggaacatttcaaaaacgcccgctggcttccccagttgaggcgtttttgtttgtcaatcattaaaagggtttatctttgtccgcaatatctcttggcaaccctttggcttgccgatcccgatcatcatacagataccacacaccgcttaaggtaaaaacgattatcccggcaatcattaatttcactgaaaagcttaagatcagataggacgtgaccagaagtgccaaaatcggaatcaataagccgcccggcaaccggaaacctcttggcaatttactgtgattttgtaatcgaatcgatgcaagaatagtaggaacatattgaacaaacgatgtaaaaacgatacacgatgcaaggaatagataattccctgatagtagcatcaaggcacatatcccgcaggaaagcagtaatgagacaatcggcacaccgcgcttgtcttgatgccccaacacccgtggtaataattgatgttcggaagccagcgaacttgcaattaaaggagtggaaaatgaaatcgacagcgccacgccaagaattgaaatcagcatcccaatcaaagctaaatcataaccaagctggccggcgaaatgaaagaacgaagccgcaatcggtacattatcagtcgcaaggtccttgccggaaacaccaattgctgtcatttgtacaatcatatataggagcgcagaggtcaataggacacttattaaggcaatcggcagcgtcttctcgggcttcttcattttggaagcagcaattggtaaaaacgaaaaaccggtaaacatataaaaaaccataccaaagccttcattaaaacggttgaatagcggtgctgaatttgaaacagttcccgaaagattactaaagttggccggatgaataaagaacaaaccggcaatgacaaataatattaaaacaccaactttggcaatggttgaaatattatcaacccaatccataaactttgaaccaattagattcagcaacgtcaaaacgcctaatatcaaaagtgccactacgagataatggctatgctgattcagggttggaaacacacttttcaagctggtgacaagtgctgaaatttcggttgccattgtaataatacccaacagccaagtaaaaataccgatttcaaatcctgcaaaccggccaaacgctgtatatgtgtataaccacgcaccaccatctccgggaattttactggcaaggttggcaaaacaaagtgcaatcatcaacacagccaagccggccaacggcatcagtagaagactgacatcccctaatttggcatagattctgcttggcattaaaaaaatcccggagccaataatgccatcgacgcccaataggaaaacacttaggaagctcaattgttttttagtagtggccgtcattttaccatctcctttagatgacttttattcttaaaacgcttacattattgattttagtttaacacgctacttattctttgatactttgatgcacttggtgaaattaaaaaccatcattatttttttagatttaccaattctgtagaattcaatttttaaaaagtcaattgataaattgaatagtatggacgtcaattaacttttaaaataattattttgttatcaataaggattaaataattacttttcaaccaacttttaagtctcaaactaaaaaaatagcatcgaaataacaattaattaccttttaaaagttagtatttttattgcatcacgataaccaacgccatattctgacatctttttgtaacattcaaaccaaacctgtgatcgattccattgcctgtttatgagcaataactgttatttttttaggtggacaatcacattacatatattactcgaatgtaagataagtcacttccacgacacaaactcgtacacttctcgatattgtctcgtaacaataagcggttatactcttaggagttaatcgttgctggttaacatattggaaagaaacagaaatttctcgaatctacttataggagtgtctatcttgaaaaaatttatcacaaccattctcgcaacatcagcagctgccgttggcttgttctttgcaggcgcagcaggtgcaaatgcatccacgacctacacggttaagtccggcgactctgtctgggcaatctcgcaacaattcggttcatcaattaatgcaatcgaaggcgcaaacagcatctcaaatcatttgatcatgccaggtcaaaaattggtaattcctgacggaacttcgaccacagctgctactaccaacactacttcagcagccactcagtcaactaccaatactcaacaaaaggctagttacagccaaccagctgccaacactactgcaaacacaacttcagcaagcagtaatgcttcatacgacagcagcacaaagagcgctgttttaagtcaaatggcttctagaaccggcgtttcagcagctacttgggatgcaatcatctctcgtgaatcaaactggcaaccatcagttcgtaatagttcaagtggtgcttatggtttattccaaaacatgcacatcaatggcggttcagttcaacaacaagttgacgctgccgttagcttatacaaccaacaaggcatgagcgcatggtctttaggttaagctaaatcattaaattaaattttaagtcattccaaattttgggaatggctttttattatgtcaccggcaaaaagcatagccagccatccaatgaatgaagaattggattcgccggttatgctttttattttgattcgtttagtttttctttgttttacagcacatcgtgaattgtaataacacccacaacatgatcatcattatcccgcacaattaaattggaaatattacgacttgccatcattcgccatgcgtcccgattacgcttttcctggttaatgctgacaaatcccctagtcatatagtctctagctgttgaccgtttaactgccgggacatccagaaacttttttcggatatcgccatcggtcacaatccccgtgatttggttggtctctatatcccgtaccaaggtaattccaagcccaaaattactgattgtataaataacatcattgattttggtatcttcctcgacatacgggatctttgtatgcataacatgcttaacctgttgcagcagcatcttgccgatactgccaccaggatgatattgtgcaaactgtttcttgtcaaatgatcgaatcttttccagtgcaactaataaagcatctcccaaaaccaacgttgccgttgtagaagatgtcggggccaaccctgtaacatcggcttcttttttgacacttaaattaatcactaaatccgtattttttgctaaggtcgaattaggattcccagtaagagcaacggtactaattccgtttggaaaaattgttttcattgcaaacaacgtctgaacgacttcttgtgtttcaccactgtttgacaccaataaaacggtatcgttttttgcaagtcgtcccaaatcgccgtgaaaagcagtggcggcatcaattgtaaaacttgattgcccaattgacgaaagtgatgctgaaattttttcagcaataatttctgacttaccgattccaataaaaataacccgaccagttgtttcgttaatcatattgaccaagtcatcaaaatgttcgtcaagtcgttgagacacttcatctaaagcctgcttttcagattcaaaaatatcttgagcaagttcatagtaagccatcttgaaccaactcctctttttgctgacgattttcatcaaacaatttaacggccgtcgttaaaatcggcttaattttattgagataaagctgattgtcagcatctgaaattgccgagggcggatctggatggacctccgcaaaaatgccatcgacaccaatcgtcaaggctgccctcattaatggaaaagcaaaatcccgattgccacccgagtgactaccgtgcccgcccggcacctgaacagagtgagttgcatcaaagatcaccggaaagccaatttctctaagctgaatcaggctggtcatgtcgacaactaattgatggtatccaaacatagtgccacgttccgttagcaatattttatttgaaaacggcgtgactttatcaacagctccctgcatatcaccgggcgccataaactgtgcctttttaatgttcacaacccgactggttgctgctgcagcaactaataaatcagtttgcctgcttaaaaaggccggtatttgtaagacgtcagccacttcggcaaccggcgcacattgataagattcatgtacatcagtgacaatcggcacatggtaagtttctttaatcctgcggagaatagccaatccgttttccaacccggcaccccgctttgagtctccggagcttctgttagctttatcaaatgatgatttgaatacatagttaatgtttaagtcatccgttatttcttttagtgtttcggcgacttgagcacaggtctcataagactcaattgcacatggtccggctaataaggtgaggcggtcatcacgaaactgataatcaggaaaaatcgttgaaatttttgtcattataaccctccttgagttaaaaataaccattaaataacgacaaccggtaacgttaaacctaatctttcccctcatattcctctaaatatccaagatttatgtgttgaccacttcctttcagaagtgccattttcatctgccatcaattgtggttccatgaaaaaccatatttaagccagaccatctctgaaattatttatcattagcattatttttttgtgatttatggaagtatagcactgtaagtaccctattaacaaataatgggctattcctttttgagacacctttcattctaaataaggactaagacggttttgacgtggatatggcattggctaataccaaaaccttttccaaataaatggttggattttttcccatccaattggcggtttttatccatccctattatttttatactattggtatcaatttaaaactttaatcaccatatagaagggaattatgtaaattatgaactcatttcgccaccaaacaactcaacgtcttgtcttgctttcaatgtttatcgccattattattgttcaatcactggtgccttttttaggctacatgacgattggtgtcgtcagtattacacttattcagctaactgtcgccatctctgctattctactgggaaatcgggctggattgatgaccggttttgtctgggggcttctttcatttatccgctcatggacgtctccaagcagcccgttggaagttcttatgtttcacaacccgttcattgccattctcccaagagttttagtgggacttcttgccggaatcgcttataatgtgatcagcaaacgaaaaaatgacattttagccgctagtgtaagcggtttagtcgcatcagttacaaataccgttctagtgttggggctgagtgcctttttcttcattggccttcatgcaactatgggaaccgtttccggtacccaatggctttggatcttattggggattgccggaaataatgggatctttgaaggtatcttttcatttgtcgtgacaccgattattgtgacgccgctactaaaatcaagtcatttaaaacatcttttgcagggagactaaatgatggactggtatcttgaccgttctgcccatacctttcgttatcagcaacttattgaccgcatccaaatcggtattcaaaatggcgaacttttacctggtgagaaattaccctcagagcgtcaattagcgcagcaactgggaatagaccgctctacggttaaccgcgcctatagtgaattagctgccagtaacattgtttctcaggctgtcggccagggtacccgtgttaaaaagcagcctaatgccgataaccactcaaattggttggcatacttacgaacacaatctgatcctttggaaccaccgtttgaaccaacggaccaagcaagccgactggatttaacgactaacattcttccgcctcaactatggccgacactgccaccggtgaaattcccccattatctgccaagagacgggtcatcaaacgctgttctgggattatcaggattacgacattgtatcttagaggcgaccgtttcaaagcaactaaatgccaagatcgatgatacgcaaattttgattacttccggtattcagcaagcttttacacttttggttgaaggtctacttgcacccggtgattcggttgcaattgagtcaccctcctcattgaatcaattaaaaatttttcaattgctgggcatcagaatttatcgagtgccgattacccaaaccggtcgactcaatttgtcccagttggctaaactaaaacggcaacaccaaatcaaactgctttttgtcatgccaaatttacaaaatcccacaggtgcaaccatgacacttgaagataggaaagccttggtaaaggcctgccgtgacttatcactgcctattgtagaaggtgatcccttccaaccattgtcccaatccaaaatcccgacattattttgtttggaccccgacaacgtcatatatgccagcacactcagcttgttgatgggcactcaaactcggatcggttggttattcgggccggcacacgtcatgtaccaattggggattttacgcgataaactcggggaaagaatcggaatggcacaacaattagtcgcccaagaattcttatgtagtccggcttttaaagatcaacagaaccaattacaccagcgtttatcggctaagaaggaacagttattgttgaaactgtccccgctgataaagtgtgattggattagcatcaccccttctcaaaccggtttttttctctggattaatttactgcacctgccgcaacttcaaccacgggattacgttcttttccgtaagtatggtttgttgattttgccagcgccctactttggtagtccaacgaatggctttcgccttagttttgtggctttagagaccgatcaacaattcgatgatatagaaagtcgcatggacaaagctttaaaaacactgcatcaaaagtttaataaaattccaaaaaatagttagccggcctttatcaaaggaaccggttcaaaaaagcagcccattaacgttatctcaacgaaaaacgtagagacaatatcagttaacggactgcttttattctactcaaccattattccagcttgagggcttcggccaactgacgtcttcaatggctttttacttagactttcacgtcatcttgataactcgaaatcacttcaaggaattgatcgccatacttatccaacttactctccccaacacctttaacatccaatagttcagatgcgttggtaggcatttcggaacacatttcatgtagtgttttatctgaaaaaataacgaagggcggtacaccttgcttttcggccaatcgaagacgcaattgacgtaattgttcaaacagctcatcatttaccggtaaactcttagttgccttggctgccattttacgcgaaaccttctcttttccctgcagcaccgttaatcccaaggccgtgacttttaaaacaggatattgaccaccatcagcggccaaataccctgcagccgtcaaataatcaattaattccgcaatttccctttttgaccgtcctttcataataccgtaagttgaaagtacgtcaaagcggaattttttgattttttgatccttggatcccgccagtacttgagcaaccagtgttttcccaaaatgttcattcatccggcgaacacacgacaataccttttgcgtatcaattgtaatatcttgagaatccctggtatcaaggcaattactgcatcggccacatgtaggcccatcctccccaaaatagttaagaatgaactgctgtaaacattgttccgtattggcatattgcgtcataacctgtagtttttcatattcacgctgcttactttgttcgtcacgatcagactggtcgatgaagaaatgttgcgtttgaacgtctgctattttaaataataaaatcgcttcacttggcaaaccatcccgtccggctcgacccgcttcctgataataagcttccaaacttccgggaaccgaatcatgaatcacaaatcggacattgcttttatcaattcccattccaaacgcattagtcgcaaccataaccaatgctctatcatataaaaaatcatcctggttttgccgacgttcttctcgacttagaccgccatgatacatcgttaccgagaaatgacgcttccgcagcaattttgtcaagcgttcaacttctttacgtgtactggcatagataatccctgactgatccgagttaagcttcaaataatcgagtaaatatcgatcgctgtcttgatctttaacaactttgaaggataaattatcccgttcaaaaccggtcttaacttcatctacaaggtctaagcgtgcctttatgtcttcggcaactcgcggtgtggcagtcgctgtcaatgcgacgattgtgggccgtgtcggcagttcatgcagccgatcggttagcgctaaatagcttggtcgaaaatcatgtccccactgcgagatacaatgggcttcatcaacggcaaccaaatcaatcggtaggctggccaactgtgagaatgcgcccgaatcaagtcgctccggggagacataaagtaacttaacggccccttctctgacttgttcaaagcgttcgtcaatttcttcaaagctcaacgtgctattaacaaaggtagcgggaatgccggtttcattcagggcatccacttgatctttcatcaatgcaattagtggtgacacgacaagtgttaccccttttaacagcaacgccgggatttgataacacaacgatttcccgccgccggtcggcataatggtcaagacatttttatgagccagaatgtcgtcaataaccgcctgctgtcccggtcgaaagctgtcatatccgaatttggtttttagaagtgcttggggtgtcattggaattttctacctttctggaaatacggtttacattaactatgtacgtcaaaatgtgccaagaatttttaaaaatacttgaattaatgtcaaaaatcatttcttccaataggataccatgtttaagcgacaactttcattcatttttggtcaatgttagctgcacgcttaaataaccatctgctaaagcttcttaaagaaacatcccttcttttagatagtcaaaaaaacaactccaaatccaatgattatttcattgacaaacttaaatttaagaggtaatctttagccaagataatgttatatgatatatagtattgctgattcaacaatatgcagtactaaatagctcctgttcgctacataattattgccagcaccgatccaatacatccaactaaacaatttggagatgagctctcatgaaccattacatggaagaattcaaattattattagaccaattaaccgttgacgaaaggacagaagtcactcacttttatcaagaatacttacaggacggccactttgattcttataatgcatgcgttaaagaattaggaacaccgcgccagcttgcaagaaagatcttagctgattactcaattaaagcctcaactgctccaagaactgcttcctcaaaaaagcaacgctcaaaaaacgacgttaaaaccatttggctcattttattagcactattttcttcacccgtcgctatcccgcttatcgttgttgcaggcgcccttctggtagcagtaattgctgtggcaggtgcactcatcatcagtctaattgccatattctttacggccgttatcagcggactttggtcggcagcaatcggggtcagcaccatattaatacaagtttggaccggactattttatcttggcattggcttgtcgtttattggcattttagtcatgcttgttccggcatttaagaattcaattgatagattgatccataaaatgacacttttttcaaaatggttatatgatcaaatcatgcctaagaatcaggctgaaaaaaagagaagaggttaccaacgatgaaaaaaacatttctaatcggattgtgcatttttatttttggtattatctgtttttctgttggacttagtcatggcggttacaaaactgtttattgggaccatggacttaatattgaaggtgttggaaaaaatagagaacgttcagcatattttacaaaagttaaacaacttaaagtctctacctcaaacccggtaacgattcaaagaggcccggtttcaaaaatcaaagtaacctatcctgataaaacaacagttactagcaccaatggcctcttaaatgttcagggatccaagcattggaaaaaagcctttgttttatttgggttccacaccgtcagagataattttggcaatacggttattacagttcctaaaaacactaaatttaacacaatcaattgtgatattaacgaatttgatagtgataacttggatggtcacgttactcttaacggcctctcaacaaaacgactctccttttctggcgaatcccatctttcacttaataacattgcggcatctgataaattaaaagttgataacatgggacgaattgcgatctcttcaagtaactttaaagacggttcggttcacaatgattttggaagaatcaacttaaaatccaacaaatttgaccgcttatcggccgaaacagatgccggcaatatttcatttaatacgcagaacgtctcagaatatttttctgccaacagccaagccggttcgatcgacggtcgggttaaacgaaaccatcgaacccaaatttctgcttcaacgtctgtgggcagtaagtccatctttgggcactcagttaagaaatatggtcattcaaacatcaaaaatcctgtcacctatcgatttattaccgaagttggccacataaggatcaaataagctgacatctagacaataagtaaatcctaagcgtatcacgagcattcatccagcacttaggatgtcaactaagtcataacaaaagccatcacattgaagtgaacccttaaagttgtccaagtttaagggttcactttacattttcggaagaaagctgatggttttttgtttgtaatattataaaggttacttatatgcagggtgatgatcgacaaagtagcggtatcctgtaggtaaaacaactcaacaagcaggtgaatatatgccaagaaagcgacttaataagtccaaacatcgaacatttaaaatgacgttattgatactcttatcgataatagttctgggaatatttttattcttctatatgggatacaatgttaagtacgacctgcgagttcaaatagactcacttttggcctctcatacagaaaaacatctaagaagattgaacactatttcagttaacagagaaactttttgtttcctaaaaaattctcccgacagtaaaataggcgatctatcagattttcaaggaaacctcggtgactcaagcgatggctattacacgggggcaattaacggcaggactaccggcattattatgaccaaggagaattatcattggcaactcacgtccatccagatttacaagaagtaatgattaaataaaaaacgaaaatgccataaaaataacaaatccaacattttcgtgattatttcgccatttgataatacagtgaaaaagcggataccaacacataccaaagtaaaaacatggctactaacataaataccttgagaagaatattttgaacaggcaaatcagcatatcgattatcaatccagttgttggaatttttttcttttatatgtggtttcgaaccaagcaggatcaaataaatgattattatattaaatatcctcagtcttcttgtctcaacactgcattctgataaagccccaactttaaatattgacaaatatgatcatcatcaagaaataaatttttttgatttatcccaaaataatgatcaagttcatataaaattctccgtttgtttgctatctgaattgtcctataaatggggatttcatgcccaattaccgatcggccatccttaaacgattgcttaccaaaagaatcttgattataaaaaccgcttgagtcgcttaattgaaaaatgaatcttccactttgagctctcatcctatcaaaattaattgttggttttaaagtaaaataaatgtttggaataaaatgattgcccccgacagatgtcgttcttgctatatcaataaggaatcccagaagatttggaaggctagtatatgttggcatctgtttgacatcttttacattgaaatccctgtatgcatatgtcatataattctcatatgaagtagataatcgagagtctgatttcttaaccattttcacaaggtcagcaatgttggctgttaactcgccaatttctttttgccatccgtctttttgaaaatgactttgacctagatatttttgaatattcggaattaactcggattcaatatatctttcaatatatttcttcttatttgaaaatatgccttgtgttagaacttcactaattttagatgtaagattgctaatattagtctgagaaaatatatcaagagattttaattggaatgaatattctaaatatttaggatctaacggaataaacatatcaggatcaaatatgtaaacgtaacctgggctgaatttacttttattaagattaagcgcatcaccacaagcaaagtaaagagcaactagtggtgcagttgttacatctaaaagcggagtcggtattccatgatgttgacaatatgccaaaaaattttgatctatctcagctgatcgattatttgtctcagcgtgaaactcatttaaaattgaatttaaaccatagtcagttataaaactatagaatgtccttgtctccactgaatcatgccgttgaaatgtcttcgtctctgaatgaacccttctaaataaagtagccatatttttactatcaccattatctttactttcccctctgaagagaaatggttctagtggaagcttttcaataacttttaagtagcttgaaactgtcgatatctttttcatatatttccccactttacatacaaccaataatataactgaactaaaacaaaaaaattgcctatctctcagcgactttccttaacaaactcgattcaattacttatgcgtcccccgagaactaaatggcggttctcgtacattcacataatttcaaaaatcattgacctaacagcattcttcaaaaattatctattcaggattgaacatattttgaatacaaatgccgtaagaatgccgtaaaaaattaactagctggcgggcagatacataatcactttcgtttgaatttgatattagaactattcttaatatcttttcgcataagtattctttctttttggttaaatatttccatgttatcaactatcgctttcttaaaccattggtttgccaatgattttggcttgggagtagcggttgaattacttagccaataattatttaaaattctccaaagcagggttctcttccaatatgtcataattcgccacaatatataaaacattgcaaacaaaattaattcgtacacagccatatatatgtctgctaacaaaagattgctaatacaggcaatcaaatctatatagcaaagcagtttaaaagttccttcatagctactcgaaaaacgtaaatatatttttaaaatacttaaccgcctttgtacattactatcttggttttcaatagatagtgcttcttgaacacttaatgcaattccttcagtaattggatactgaatattatttttttgcataactccaaaaagattaaaaaaccttagaattattaatttattaaaattgtaaaaattggttgtcatgaatggaggaacgtgttcatcaaaaaatttacttgaatgttcaaataaatatgcacctgccacgaaagcaataaaaaatgtagaaatatttccactttgcaactgtgagtggttataagactgattataaataaaaaataataatccaatccagttaagcgttggaaagatagctacaacgcctaataatatgaatgtaaaattcaaacatgtataaaacgtttgtccactttgttcatacaattcacctagattaatcatagatcacaccccaaacaggtttaatcataactaaattccaagcaatttaccacaccatttttacgctatctcattgctcttagtgtttttactaactaccgatttacaaaaaatgcagtcataattagctaagttgaggtttcataggctactgtatacctaatagcaatttttagccatcctgctatcaagagataacgtacaaagtacctcgtcataaattcgcaatcaggatgttctttaaatctgcccaacaaaaaagtggcgaaccttacttcaccactttttcgtcaatctaatattctgatttatttaatcatgctttttaataattaccagcaatgattaacttcttatttgctgtgacataatgtccgttactcaattgataacgagtcgttaaattatgcttaaccagcttcttaacggtcaaacgaacacccttcttgtagtgcttagctttaccagttaagttagctgacttgtaagtgttaatcccttttttagcaatcacagtaattttctttgattttggaacgcctgcgtaataaactggtacaacatatttgcgactagcagtaatataaccagtcttgccagcagtcttacggccatggtttacatcacgaactttatatctcaaagtaccattactagttcgcttgtaaccagtaacaacaaacattggccggttaatccgtttttgcttagggtaccaagcaattcgtttactcttggtgaagctggtactcttatacaaagcgatcttcttagtagcataaacagcttcacctttaacagcaatgttaggacctactgaagtagaaggtttcgttgtcgtggttggtgtagaactacttgaactagttgttgacgaggaggaagacgaattagttggtacattagtggctggtgtaaggggtgttactggaacagtagtagtaccagtattaccaccggttgaaccaccaccagttccgccgccattggtaactgttaatgtaaaggttgtgtctccataaccatcggcagttagtgtaacgttataagttccaggggtcttagaagcaaattcttgcgttacagtctcacccttattattagttaccttagcaactgttgcactggcaggatcggcattaaaggttgacgccgtaataggtgtattagccgatatagttgcattcttaccattgacattacttgcaaaggtaccaacattgagataaccactgtctgcaccacttgtattccaactagcgtagtacagtggatatacggcaccattttttagcgtgtcgctatttgaaatgtataccggaattttaagcgtaaagtctgcaccggctttcagtgtaccccaaataccaacggcattaactttttgttgatcagtaagcgtaccatctggtttaaagtcatagaaaccagatgccccagcattaaatcttaagccttctggccatccttcggttccagcccaaatatcagtagatggaaccccaagctgcgttggtgtcaacaaatagtctgtacttgttgcactcttaccaattttgaaagctggcccaccatcggaattagtatctgcaaaaattacggcctcattcaaaaagacatcttgagtacttgtattttttattggaatgttgatcgttaaatctttaacgcccttagaaatataagttgtagcacgaccatccttatcatttcccgtacctgcatagacagtatctgcaccatctgctgtaagatacattgcctgttggatttgcggcaaagtagttggactttcaggagtaagtgtctgcgtcatattaccaacgacatttttaacaggactttgaacaccatcagccttagctgtgatttcaaagcttagaggaccccccccccgcaaaattgttactttgtaatccaatggcaccggctaaccctaatgaggttaacagtgtcacaaaaatgattcttgatttcttcatgaaaataccccctataactttagtcactacgaaatagccttcattcttattaagtagtgagatttataacacaccctaagtatatacatgtgtattttgttcgtcaattcacttattctttttctttttaaaattaattatttagttatatacatcttaaatcaattcaattgcaattaggtgattcagatgcctcactggttttaaacacttacccccacttagatgaaagtataaaaaaagaaaccactgaaaaattcagtgatttcctcgcaaattaacgtaaatgctgcaaatgtgccgcaagcatttacacaaatgctatagtaacagcatgtaacgactatttgatgcgtcccccgagagtcgaactcggatcatgaggaccgaaatctcatgtgctatccattacactaaggacgccttacatttattaattatagcgttttttgaatattaatacaaccacaaaatcaacttacatttccgccgctttgttagcttcgtcttctaaataccctaaaagcttatcggtattggtctcaaagtcttgttcaaaagaatcggttaacggttgaatttttttagtcaccctatttttcaaatcaaatacctgaagttcattaccaacaagcttgcctgtgtcataatgaccgtcttccgcgtagtctaaataagcctgaaaagtctcttgaatcgtctggcgcatgacctgctctcttgttaccttggggtcatgtgcctttttaatcgcaaatttatcttcaaactcgcgcatattttccggatattccaatgacattttctccaactcctttaatgattttttgaatcatttcaaaatcaactttgcctactttaataatttccatattatattgtaccacggtcggaaatcgggtttatcacttgctttttttgtcattttagtcgaccattgaaattgtatgattgtcattttttattaagggggtttttaaatttgacacaaacaattacagtagaagaatcacgtcaactggatgccaaaaccattaacgaaataggcatcccttccttagtgttaatggaacgtgccggccttaaaatttatgaaaatatgcttgataataaagacctcgatttaagcaaaattctaatcctcgccggcaccggtaataacggtggcgacgctttagtggttgcccgactttttgccactcacggctatcacgttcatacattaaccgtaggaaatcccgctcatgccagcgatgaccacattgctcaagcaaagatttgtgattactatcaaattccaaaagtctttttagatgaaaaatttgataaatacactacaatagttgatggcttgttcggcagtggcctttcacgtaatgtcggtggggactttgctaccgcaatcgacaaggcaaacgcatcaaccgccaatattcacgctatagatattccatccggcttaaacggcgataccggcaacgttatgggaaccgccatcaaggcagcttctacttcaacaattgcctatccaaaggttggcatggaaaaggatcaagccaaagcatacactggtaaaatttatgttgatgacattggtatctaccgtggcaaccaattcgaaggtgaataattattagcgcctgccactcaataaaatggaaaagaggaaccgcacatgaccagcaaaaaggatcaaggctatttaaacgttcacgacgttgaccccgacatcatcgttgatctcaagtacgcaaccaccgataattttacccatcagattgtttatgatttcgaccaggcaatttccagaatttacaccgttaaaaagcttggaaacgccagtaagattttgaaagatcaaggttaccggcttcgtatctgggatgcttatcgtccaatctacgcacaaaaacggttatttgaagtttaccccgatccaatttgggtagctgagccaaatcccaactttagtcaccaaaaaggtgttacatttgaccttaccttaactgaccaagccggcaataacatggaaatgccgacaccatttgatgattttaccggtctggcaaagcgtagtgaaaagccaaactggtcaacagaagcgcaaaagaactacgatattttaaatcacgcaatgacgcaggccggctttgtcggttacgaaaacgaatggtgggactaccgcgattcgaacgctgacgagttcggtccgcttgaagtagatccaaaagattattaacttatttaggagaaaacaaatggaagttggaatcattggggcaggtccaaggggtatccttgtgacctcccaactatttaatcaatataaatataactctgatcagtcagaaccactttcaattaccttgtttgacccatatggtgtcggcggccgggtttggcgcagtgatcaatgggaagggttaattatgaataccccagctgatcaggtgactttgtttacagatgaatccgttaatatgaccggtcaggttttcgatggcccatgcctgtttgagtgggcgcccagccacgaagcccatgaatatttaacaacacatggttattcaaatcagattattgatgccgccgataatcttggcagtaaagattacgcaccacgagtactgtacggtgcctatatccaatggttctatgatgatttattaaaattagaaccggaagaagttacgacgactgttcatcctgaacaagtgaccgcccttaacacgcagcctgacggaaaggtggttcttcaaacgcctgatcacagctttacttttgataaagtcgtcatggctcttggtcaacaggataattacctaaacgattccgaacaggcactggctcagtatgctgaagataatcatctaagatatctggcaccaactcatccgggagatgctgatctaagcggtattcccgccggtgaagatattattattcgtggccttggcttgagttttaatgattatatttctgagctaacacttggccgtggcggtcaatttatgcataaccacgacggtagtctttcctatcaaccatccggacgcgaaccaagaatcattgccggttcacgtcgtgggattccttattatccaaaagccgttagtgaaaaaggatacggcgaacaggccgaacccgcttttctaaccgatgccaaaatggatgctgcatcagttaacggcaagttaccatatgccaaatttatcgacttattaaaattagatatggcattagtttactatagcctgatgattgatgaacgttatccaagcaaaaacgcaagtcagtttaaaaaagactttatcgcagctgatgacccagaagccgttgttaacgcatttggctttgatgaagaagatcgctttgattgggattacattttgaatccatttaaagacgttcaagctgtcagcacccagaactaccagtcaattattcttaattggctggataacgtcacagttgatgctaataagggttctaagaccgggccattgggctcatcgctagaactactacgtgattttcgaacccaaattcggcaaatgattgctaaagaacgcctatcaaacgttgactatatcaacgattttctcggaaaattcgacagcgataataatttcctatcaatcggcgctcctgcccttcgaagcgaacagctttccgcactcattcgaagtggtattgtggtcattttggcaccgggaatggaagtcaagggtgaaaacggttggtttgtgaccgctgcgcctaaacgaaataccgacaaattcaaatcatcgacattgcttgaggccagagttccgaaaccggatttggatatcagcgccaatccggttttggaaaacttagtggaaaacggacgtgccagaacccgcattctgcaagcggaccaaaaggaagttcggatggcatccgttgatgttgatccaacgactgaccaattactaaataaagccggcaatattgaaaatgcgatctatatttggggactttctttagaagggctcagatacatcacttctgcgagtcctcgtccgggtgttaatgatccggcattacagaccgccgacaaaattgcggcagacgtcctaaatgtgccaagtgctaaaaatgttcaaatgaattaataactgactattttcgcttcgcataactcattaggctacaagaaatggtactctctcaatcttttttgattaagaaggtaccattttttgtactgattattgtcttaaattcccaaggagaacccaactgtgaaagcaagcatcaataaaagaatgatgggtagaacgtgaagccaaaaccgaaaaatactcatcagcattcaactcaccctcatacttaatcagaaataatcagctatgatgcacaattgatttgtagcgatttttagtcgttcgacatcatttttcaactgtcataaatgacttatccggaattcggattaaattaaaccggtcagcctgccgacccgcatgtaatcctattccgttgaaccaattcttcttgtatgtcgttgtgaccgttccaacccatgcgtgttgataacgatcatccaaatgattcagccattccttattccacttgtaagcttcggcctgaacgttcaagttcgatttgccgtaaaccactgttgcacttgtactgtctgtctggtattttcgcccttcaacatagtatgtatatcgttgaatcggcttccggccatttccattattaaccgtaacgtaatcggactgatcggtcttgtaacgaataatcaacggcttgtaagagtaactaacacgaaccgcattcggattaagctttttgacatcctggaaaaatgtcgtataagacatcccccaaaataccaacaaaaagacaaccagttcgccacaagaaatccaaaagttctgccaagtaaatgctttcttttcttgaacgattacttttaggcgtcgactacgcatatcgtgaaccatccaaattaaataaatgagtagaataagccataaagccattccaattaaattccaggtggattccatgtcattcaattccccttttaacaataattatgatttcagtgtacactaatattaaagagagtgcgagagattacggcgtatcgcactgtcatttcgaacacttaaaactaacgaggtgatcccatgtgtaccagtttaactttgcaaactttaaaccatcatgtcctgcttgcccgaacaatggattttccggtccgggcagcttggaaaccagcgcttattaatcaagactattatgaaaccgctttatcgggaaaacgtgccattcgttatccttatatcggcggcggtcgaaccgaggaaaatgaccaaatactggttgccgatggcgtcaataccaaagggcttagttgcgcggaattaatgttccctcttaaagcccattatttggataaaccgatagcagacaagctcaatttaacaccgcaggattttctcccctgggtacttggtgaacacgcctcgcttcaagaagtcaaagctgatttggcgcatatcgccattattggtcaaaactggctggccggcaatgagatctttgcctttcactggattttggctgatcaggcaggtcaaaccttactaatagaaccaaccattaaaggtcttgaagtcatctccgattcaatcggtgttctaaccaactcgccaacctatccggaacatatggcacgttttgccaaatcacttcatactaatgaggatttaactgaactatctcaaaaatcacaacagattgtgatgagccagaagtttcctcgagcaaccaacacacccacaaccagatttttagtcaccgccattaataaacttggtgcccagcccagtcgaacacaattcgaggctcgaaaccgactgtttaatgatttggcgaccgttgcaattccatacaagccatccatgcatcaacaccccaacttcaattatacccactatatttcgattcttgattcaacagatcaaacctattattttagatatcacgattcaaaacaggtcttcagttattctctgagtgacgagttggcgcaacataccaatcaaaacctattcctcatttaaataatgatcaatttgttcttgaacgccttgttcatcgttggttaaatgagtcacgtgttcaactttaaccagtaaatcctgggcagcgtttttcatcgcatagccctcccttgcggcgttgaccatctcaaaatcattaccgttatcgccaaaagcagcaacgtcatcaaatgatagccgccagtcatcaagcagtggttgaataccggtcagcttggtcacaccggcgttcatgacatccaatccgttcatccccgaagacgttgcgctcagtcggccgctaaattgatgattaaactcattttgtcgttcaagtacgccacccgtctcccatgtgatatcaatcttataaattgaatcaaaaaccaatcgcagatctttggcagattgcatattttcgtaaaaatacttggacgctttaaaacgtttggattggcttggcagattgcaatacgttccgtttcggccaaccaggatgatctcggccccgaagaaacttgacgtttttaacatccaatccagtgcctttcggagtaccaaatggtcaataatatcttccgaaacaatgacaccgcgttcgtcaacaaccaacgcgccgttattacaaacgtaagaaattggccctgacacgtgttcaaaggtttttaataaatgttgataatgattgctgctggctgaaacaaaatgcatctgtttttgggctaatcgatccaattcaccttgaaacctgttttcatcgaatgtccccctttcatttaaaaaggttccgtccatatcacttgcaattactttaatcacggcaattctcctgactatcgttatttttaaattacgaatatattatatatttatccaaatcatttacttaattgtgtatccaataaaagctacacccttaattttaaatgtttcactccgtttgtaaaacaattttatatttagtatactgttccttgatgatacaacttatctggggtgcctttaggctgagagaaacccatcgaacctgatctggataataccagcgaagggagcatattccgttgtgcacgaaatggattaagcgtattgatgaatttcgaggctgggacatcttgtccgagcctctttttattgactaaaatcgcttgcgacaggatttttcagttttatttgcaatttttatcttattcatgttattttctcgccttatccgcaactccagtgtagggactatcttgctcttcaaagcaacgttctgcatgtaagggattgatttcaaaaatccaaaatcgggatttcccaaatcgacgccttatattccgggtgttaaccgctttgaatcgcacactttttaggactgctcttcaaagcaacaccactccatataagggatcaatttgaaaaatccaaaatcgggatttcccaaatcgacgccttatattccgggtgttaaccgctttgaatcgcacactatactatttggaggtctttttatggaaaacaagagtcaagcaagcaacaatcagcatcaaagtaaatggacgttacgcaacattattttgatcgccttgattgctattttttgtggcattattttttggggaatcggctttctctatactgcattaacggtcgccctcacgccaattggtgctgcgccatttgccaatgatattttgatggggctttggtgcatggccggtccgcttaccggattcatcatccgaacggctggttcggcctttcttggtgaatttcttggtgctgccgttgaagtcttccttggcggtcaatggggcgccggtgcctttatttccggactggttcagggaattggttccgaacttggttttaccttcaccggctacaaacgttacgactgggtttcactaaatgcttcaatctttacaaccgttgttgtaactttcgcctgggacatgattaaaaacggatacgataaatttgcattaccgcttctgatcggactattcatcactcgttacatctcaacctttattttcggtggcattgtcaccaaaatgatcgttaagctgttggatcgtagtaatgcatttaatctataaacagaggttttagacatgactgacgtatcgattagcgactttacctatcagtaccccaaaagtgagaccaaggtactaaatgatcttaatttaacattcaagcacaatcacttttccctgctttccggaccatccggtagtgggaagtcaacgctcctgtactttattgcggggctgtacccaagatttatcggcaacgatgcgacgggaaccatcaaattcggtgatacaaatattaaggaaattccccgaaaccatgtcagcaaccacgtcgcaatgatgtttcaaaatcccaatcaacaatttgcgatggataccgtcatccacgagcttacctttgttcttgagaatattcaaacccaacctgatcaaatggataaaataatcgatcatgccctcactttttgtgggattgaaaaattaagggatcggatcatcaacaccctttccgggggcgagaagcaacgggttgcactttcctgtattgtcgccatggatgcaccggttattgtattggatgaaccttttgccagtatcgaccctgattccagaattgatttaatccacaaactaaaggaattacaggaaaaacacggcaaaacaattattcttgcagaccatgatttgggaaattaccagggagtcattgatgaattttattatttggatccccagacccatcacattgatttattaaatcaagcggaatcacaacatttctttgataactttgaatccacccaaacaattgataagcagcttgcgttaccaccgaaagatgataagaattcagttatcgaattacgtcatttcaaattggcaccgcacgattctttgctcctacagcttgatcattttaatttctatcgccaaaaaacgactttaattaccggtgccaatggtattggaaaatcaacattatttaacgcactaaccaagttattaccgtatgccggaatgatttcttacgacggaaagaacattaaaaagatcaagccgttaaactatgctaagaacgtcacgctattgtttcaagatgccgaaaaccaatttctaaacgtcacggttaaagaagaactggatctttcgttctcaaaccggtttaaccaagactacactcatgaacaggttgaacaaatgctgacacaattgggcatgcagggtcgcgatgaacaagttgtctattctttaagtgagggacaaaaaaagaaacttcagattgtcgaaatgctgattatgaacccacccgtcctattgttggatgagccatttaaaggattggattacaaatcactgcgattaatgaccgatttcttagaactggccaaaacaaagtatggtcaaactcaaatcatcatttcccatcaattatccggactggaagacttaattgattatcatgcccattttgaaaatcaaaatctgacttaccaggaggttatctaatgaatcctggaatgaaattactcttagttgtcttaatagccttggaaatttcgtttacccaaagtttaattgtcaacgttatcttaattgcgattagttttgtatatgtcatggttaaacggatgaactttaagacattgtttcttcttatattctggccgctttttccggctttgggcctatttgtttcacaatggttgtatggttccgatgggatccactttgcatgggttctttttacacgaatctacgcctacgtctttttaggggcaacattcacgttaacaagcagtatcacggacttggcactgactttggaacaagactttcgcctaccctcaaagtttgcctacggggtgctggcggcctttaacctgatgcccaaaatcagggaagaagtacaaatcatcaaaacatctgccttaatgcgtggagaggtttttcacgtttggtctcccaagctctactttaaggcaattctgtcatccatccaatggtcacagaacttagctgaagcaatgacttcccacggctttgtggaagacgagccacggacccattacagggttatccgcattacagtcttggactgggcaatgtttgccttcttgattattgccgttcaagtcatgttattctttattcgatattagtttttaatagaaattaaaattttctgacataatcaaaacgccccagatttcgcaattcctacttttgcattataattaatgtaatagagagaagtgaaagagggcgttttttatgcgggcaaatcaattcgcatttgcgtttggcatttttgctttaattgttggagccattgttgatctttatggggtgtttactcaattcggaacgattgatagtgctcaggaagtattggtcggcagctttattttgggaatcgggttggcttttctatcgatccccaaccgactggaacgttacattgttcaaggtattatcggaattggcatcttttattatttttatattcaaaacaataacatttggattgccctgattattgcgtttattctggtggccttattggagtatggcttgaaacatcgctaattatgtgttcgtttcacatattattgctataataggaatatagtagctcgagtcttacaatggaggaatttagaatggcagaacaatttagcaccttagcagaagaaattatcaattaccaaaagaagaacgacatgccagacacgcaattagcattcaatttacggattaccgtagaacgcctccacgatattaagtcgatggaatctcaaccgacaccagaggaaaagaagctcattgaagactttgtgcgttaaacgtgcaggaactatttgaaatcctatttcccaacatcgcgatgttaactaaaagaagagaccttttgcaatgtcattttgcaaagggcctctcttttggcttttaatggctggttatttttccggcgctttaaataacgcttgtacctgttcctccaaagttggaacgggcttttgtaatacgtcagccaaatccgttgtgtcttcttccaaagcatgatttcgaattaatttttgaatcatcgtcataatcgcatctacctgatctggtacatactttcttaaattggccataaattcatcatcagaaacgctggcaatctcaaattgtttgccggtcacttttcgaagcacatcagccaactcggcatacgtatgcattggacctgccaattcataaacttcttttggctgttcagtcgttaaaatagtggctgcagcttcggcatataatgcttcgggggcccaaccaaccttgccatcccctgcggaataaacaaatggctcaccattactagcttcttccacaaaattcatctcatcttccagataccaattattgcgaagaaatgaatgtgcaatacccgactttttaatcaaagcctccgtggccttatggtctgctgccaagggtgcttctgtcgtgtctgcatgtggaaagctggtgtatgcaatgaacttaacaccggccgctttagcagcctgaaccacattattgtgttgatcgattcgtgacatcactgcaccgggttgcgatgaaataaacagtagtttatccacacccttcaatgagtcgatcaactgatccggatcttcataggtacccggacgaacctcaacaccgtctttatatatagactttgccttttcaatacttcgagccagagcaatgattgaatcttccggcttaattaacttttgcaaatacgaaatggcgtacttgccaaaatgaccggttgaacctgttacagcatacttcataacttaaaagcctcctaaatcaactatagtttagtcagtacatgccatagattattataaagcaacctgttggtttgtgtttacataagcatgctgaaatcatcaaaaaatgcccattgccaattgaaatcaaaaaagacacttatgcgcacgttactaaaacgctaaagtgactcatcttgatttatcataataactttaattttactgtgccgaatcgtctatatcgctttgcgccacacacttgtttaggactgctccgtcaagcaacattctgcatgtaagggattctttttaaaaattcaaaaccgggatttccaaaaagaacgccttacattccgggtgctaaccgctttgttccgcacacttataataatttcttccaaaatgaccgtttctttttctttgaagttcccgacgttttttcgtggtaacgatccatgccttccttatagggattgctaatcagttggttcaatgaaggtcgcgattttttagcggcttcttcaatcggcaattttcgatgacaatttgggcacgttacctgattttccgttaatttagtcccacaataaggacaaaaagcaaactttctggttggcatctcgattacctcgattgttgcttggtttgattacggtttcgacatttaacggcttccaatgtatcgcgaatccattttggcattttaaacttcttctttgccatgaatgttattcccctcaatcaacttgattttctaacaagaacgctttgaaataatcaaatgccatttctcgaattgactcaataccaatctgctttgttgttgattcagtctgttcatcaacatccagtagttccactgttaataaaccagtcgtcagatttaaattggtcggaaaggccgcaaaattctctttatcggctaactcaaaccgaataatctttctgaacttaatcgactggtaaagaatatgcgttaaaatattatccgtatcatcaaaggcacgttcggcattcagaacaggcaaaacaaagtgcttggcatctttattcaatttaacaaatcgatgaatcagacgaaggtagtccgaatccaataatagttctttaatatcgtcatatcgaatccaaacataaccgccaaaacgaccgttcatgtcaaccaccatcatcaccaactcgtttgcattgccggcaatcacttgaccaacataaaagtattttcgttcatcattagtatcaataatgatagccttatttgtaccacgtaattttccaatagtttctctaaatttatccgtgtcgcgtacacttacatcatcaatatgattctcaggcttaatcattgccaatgtttcttggaccaattgtaattcggttccaccaaattcaataccgtgaatatcgtcaaataagaagtccatcattcgctgcttggagaagtcaaatttgttcaagtttaaaaacgtcaggccatccgcacgaacatccttgaccaatccttcactatatttaagtttgccatcttcaaccgtaataatcaatgagacccgctgttcttcataaagcgttttcacaatccgatcaaataaagaatcactcatttttattggcatatcaaatgaaggattgctcgataagtcattcatttcatcaaatgaaattcgatctttcatgctcgcaagatcataactgtctgtttcaatcgatttaaccgaactaatttttaaataaacttccccatcttgaatgccataatcgttataggtcagcataacaaaatcctgagcacccaaatactggatgacacccgtatatacgatatcgctattcttttggaaggcgtttattaaccgctcatcaatttgagctgaccgcaactgttcatatattgttttcaaaagagacaccttctttcacatccgtagattattcgttatcataattataagcgcttatattcgtgcaatctatgatatggcattgctgacgaaggctcgtagatcatcaccggatttgtgtgcactaagaccaaccaatagtttgattctggccttttgcccatttaatccctggcatagaatcagccccatttttctgagttgaataccgccaccctcataatcataaatatcttgggcaacaccgttataacatctggaaaccaggacgatgggaatgttattatctatgaggcgcttaattgcaggaagcgtttggggcggtagatttcccgcacccaggccttcaataaccaatccattagtagtcgatcggttgattgcctcaaataaatcgccgttcatcccggcatatgcctttattaaataaacgccggcagaaacatgatcaatatcggaaacctcagtttgaatgagttcttgaaaatatttagctttattctgtgtcacaattccaatcggaccaaatgtaggcgttctaaacgttgcgacattagtggtatgggttttggtcacaaaacgagctgtatgaatttcatcattcatcacaacaaggacacctttaccgtaagattcatcagttgccgcaaccaaaattgcatttcgaaagttgtataaaccatcggaaccaatttcatttgacgatcgcatcgctcctgttactacgactggaattgtatttggtaatgtcaaatctaaaaagtaagctgtttcttccagtgtatcggttccgtgagtaatcacgacaccgtcaacgccgtcgttaattgctttcataattcgttgtttaatcagcaacatcacttcaggtgtgacatgaggtgatggtaaattgaatagttcatcggtaatcaggttgatttgaccattcaaaatgacttgttcttctgcgattgggttctcatcatttggaacaacttcgcccttttcgttttgagacattgaaatggtaccaccggtgtgaatcgctaaaattgttttcatagaatttcggcctccaaaatgataatctatactattgtacattataattgtagctgagaaaacataccgacaacacagaaagaagtgagcttatgtcagattctgatagatactataagcctaagaattcaaaagacgcgatgcgccagattgaaatgttgtttaataaatataaagacgccccactaactcaggaattggttgattatcaccagaatctggttaacaggcttaaaaccgatattatgcaggcagccaacgtggaaaacatttcatccagaaccgaaaatcttaactcaatgatcaacgtcatgacccgctggctgcaaatcagactttccggaaaaccctttaacggtcaaatgagtcattttaaatacgttagtgatgaaaccaaaacaacctttaaacgtcacgtccacaaaattaagggtggcggcagtcaccgtgcatcaaggcattaattggcagagctgattaaagaaacaacagccctgtcagactactcacaaggaggctcgaagaattgagcaaaaccattatcgaattacagcacgtctacaaaaaatatgacgactttaccgcacttaaagatattaattttaaactaaaccaaggagaattttacacccttcttggcccttccggttgtggaaagacaaccattcttcaaacaattgcaggatttaccgatgcaacttccggacaagtattatttgacggtcaaaagatcaatgatattccggctaataaacgtcaattaaacactgtttttcaagactacgccctttttccaaatatgaacgtttttgaaaacgtcgcttttggattgatcttgcataaagtcaaaaaagcagaagtggccgaacgggttcatgatgctttgaaattagttcaattggatcaatatgccaatcgggagatttctgaactttccggcggccagaaacagcgaatcgcgatcgccagagcaattgttaatcgcccgaaggttcttctactggacgaaccgctgtccgccttggatgctaaattaagaaaagatatgcagtatgaattgcgtagcctccaacaaaaccttggcatcaccttcctattcgttacccatgatcaggaagaggcactggcaatgagcgatcaaatttttgtcatgaataagggacagattcttcaaaagggtgacccggtcgacatctacgacgaacccatcaaccattttgtggctgattttatcggcgaaagcaatatcattcccggccacatggtccgagattacgaagtctcatttcttggacatacatttgaatgtgcggatgccggcatgcgcccaaacgaacccgttgaggttgtgattcgtccggaagaccttgttatcacaactcctgaaaaaggaaagttacaggttaaggtcagcacccagctgttccgcggtgactactatgaaatactcgcctatgatatgcaggataacgaatggttgattcattccaccaatgcaacaactgacaatgcgattatcgggttaacatttggccctaatgatatgcacgtcatgcgttacaacgaaaccgaagccaagtttaattctcgtttggaaacttacgaagaatagggaggaaaaaacattgaaaaaaagcttcagagcaatgttttacacgccttacatgatgtggctggccttgtttgtaatcgcaccggtgggattgatcgtttattattcgtttttcaacatctcacatcagtttacttttgataattatgccacgttctttcgctccggcacttatttaaccatgacggcaaactcagtgctttacgcctttttaatcacgttgatttctcttctaatcagttatccaatggcattggtcatcagtaaattgaaacatcgtgatctatggatcctactcgtcattttaccaacatggattaacctgctgctaaaagcatacgcctttattggcctactaagccatgacggactggttaacaatttgtttgaattagtcggactgccagctcaacatatgctgtttacagacaccagcttcatcctcgttgcgtcctatatccaaattccgtttatgattttaccaatatataattcattaaccgacattagcgactcttatatcaaagcaagtcatgacctgggcgcaaccaattggcagaccttaaccaaaatcattattcccatgaccatgcccggtattaaatccggcgttcaaatcgtcttcatcccttccttatcactcttcatgctttcaagattgattggtggtaacaagatcattacacttggaactgcggttgaagagcatttcttaacaacgatgaactggggaatgggttccactattggcgtggtcttgatcatctcaatggtagtcgtcatgctgtttaccaacactaaacgaaagagggggcgcaactaatgagcaatcggtcctcaaagcttggaaagatctatattgtcattatctttttgcttttgtacatgcccatcctctaccttattatctattcgtttagtaagggaacgacaatgaccaatttccgcggtttcagcctcacccactatggtgaactgtttcatgacaaacgaatgttggctatttttcttgataccattttaatcgccctgttgtcctcagtcttttctacaattatcggtacactaggtgctttggggatcagtaatgccaaacgggaaagatccaggcaaacattgttatcgttgaataatatcctactggtctctcctgatgtcattatgggtgccagttttctgatcttctttacatccctgaaagtgccattaggattctggtcagttcttttaagtcatattgcatttgaaattcccatcgtcgttttaatggtcctgccaaggctcgatgaaatgagtccctcactgattaacgccgcaaccgatctgggcgcaacttctgggcaggttttaagcagagtggttttgccttttattcaacccggaattattgccggattcttcatggcgattacgtattctttggacgactttgcggtcactttctttgttacaggaaacggctttacgacattgtcggttgagatttactcacgagcccgtcaaggcatcagtttggaaatcaatgccctggccggcattatgtttgtcttttcgttgatcttggttattgtctattatttcatcgaaaaccacaatttggtttcacgccgaaagaaggataaattgggggtggctaaccaatgaaaaagtttataatcgctattgcagttctattggcgatttgtgccggcttgggacttggcagccatgaattgaccaaatcaaccggtgattccggcagtaaagttttgaatctttataattggggagattatatcgacccttcccttctgagtaaattccaaaaagaaaccggttatcatgttaatgttgaaacctttgacagcaatgaagcaatgtacactaaaattaaacagggcggtaccaactatgatttaacagtaccaagtgactatatggttcaaaaaatgaaagcagatcatatgctgattcctttggataaatcaaaattgaccggtatgtctcactatggtgcttcatttatgaataagagttttgatccgggcaaccgttattcaattccctacttttgggggacacttggtattatctacaatgacaaatacatcaagcccggtgaattaactcattgggaccaactctggcactcaaaatatcgaaatgacattatgctcattgattctgcgagagatattatgggattctccctgatttctcaaggccattcagtgaacacaaccaatacgaaagaattgatagcagctaagaataaattgaaccgtctttcaccaaatgttaaggcggtcgttgccgatgagatcaagatgtatatggccgaaggcgaagcacctattgcagttgactggtccggtgaagcgaccgaaatgatgtcacaaaatgctcatttacattacgttgtgccaaccgagggcagtaacatgtggtttgataatttggttattccaaaaactgcgaaacattttaaggcaatctatgctttcttgaactttatgaataagccggaaaatgccgctcaaaatgctaagtatattggttactcaacgcccaatacagatgcttataaacttttgccaaagtctgttcgagacgataaacaattttatccccccaagcgggttcttgataaactggaggtttacagtaacctcagtgcgaagaaagtccaacagtacaatgatctgtatttggaattcaaaatgcatcattaagaatcaatcaactatcatgatttgattggtcattggtagcgaaaagatttacactaaaatatgaggtgaataatagaaatggcaaagcaaaacagaagacgagacatcattgtcgatatgaacgaattcatcgttacatatgcggcaaccttgttagacccgtcacagaatctttcaaaactgatttatgacacgaccaaagatgatattacaaagatggatgatctattcaaagacaatggattcggtcgaaaaaataaattcgtcaatatcggtgagggtttccttcgcgattggaagggcttggatgaagaagaagccaagcagcaagcagatcaattggcaaaggatgccattgattacttgggtaaaaataccgattatttcgaaacatggagaacggattagtgtgcgaaacaaagcggttagcacccggagtataagacgtcgatttgggaaatcccggttttggatttttcaaatcgatctcttatatggagtggtgctgctttgaggagcagtcctagttagtgtgcaaaacaaagcggtttacgttcggagtgtaaggcgttctttttggaaatcccgggtttggatttttaaaaagaatcccttacatgcagaacgttgctttgagaagcagtcctaaccagtgtgcgaaacaaagcggttagcaccaacaaccacataaactaacgaaaccaaaagggtgaccatcaattgattttaatcagttgatgatcgcctttttcatcctatacactcgttaagcaaatctcgctcgttttctgcataactgcgtataatgttatttgattaatcaagtgtttatgattcgaggggggacatacattgaaaaatacatctaattcgacacaatcatcaccttctacgacacaaaagaatggctggtgggttttagtttctattggaacctttgcgttcatgtctaatctggattcaagcatcgtcaatattgcaatgccaattatggctaaagagctacatgtgccgatgaatcaaatcgaatgggtcgtttccgcctatttaattatcttgagtgccctgcttttattttttggaaaactgggcgatctttacgggaaagttaaggttttccgcatcggaacagttgtctttcttgccggttcctttatctccggtcttcaaatcaacttcccggttctattgattggccgagcgatccagggtattggtgccgcaatgaccctttccaatacgtatggtattacaacctcaacgtttggggttaaggaacgtggccgagcaatggggttcgtcgggacatttgtcgcactcggagctattgcgggtcccggcttgggtggcttaattttgtcccagctttcttggggatatattttttgggtcaatctgccatttggtatttttgccattattcttggggcgattgtcatgccaaagtcttatcaaactaccggcaaggggattgactggtttggctttatcaactttgccctactcatattcggactcttcctgggcgttttccttggtcaggaaatcggctatacaaaaccacttccacttattttattcgcgattgccatcgtgactttctggggctttattcacactgaaaagcgtaccaagaatccattaatgcccctttcgatgtttaaaatcaaagcattctcctatggattgggcgcagccgttttaatcttcttatcgaacttctttacggttattattatgccattttacctggaagatgcacgtggtttaactgctggtcaagcaggtgcgttattgatcatcttcccaattgtaatggtttttgccggtccaatcggcggctggtttgccgaccatttctcacaggcaaaggttgcaaccattggtcttgcaatcgttgcgtttgctcaggcattatactattttctaaccctaaacagcccaatatgggtctatgtcattatcaccattgttatggctgtcggaaccggattattccagtcgccaaacagtgatattgtcatgtcggttgtccctaaagaccagttgggaagtgccggaagtttgaatgcgctcgctagaaatatcgggatgatttccggaactgctctgtcaacaagtgccttatttattggcatgagtatcaaagcaggctttcatgtgacaacctacctgccaagtcaaccggaagtctttatctcaggcatgcacattgcctttgcgatttcactaatcattattatcggtgcattaatcctgtcgattctccaaggcagaaacgttaaggcaaccgacttaaaatagatcctattaaaaaacgttgatctcctaatataagaggtcaacgttttttaaaagctagattttgtttttattcacgaatctttgtagcctgccccgcacgttttcgatattgaatccgaatcagtttaataatttccgttacgaccagcacaacaaatccacagattgccggaacaacccaaccgtaatagaaattaattgtagctgtatggaagatgccctgcatgaatggtgcgtaaaccaagaacgcttgtaaggctagtagaattccgataatcccaaaggccatcttattttcaaagaagtgtttggaaatgatcggatacgaattacgaatattgaagagatagaaaattttaccgaagatgataatgttaacagccatggtactgcccagaaccgggttcaatatattcgcatcgacaaacttgtcgaaggtgaatataccaagtgacgaaatcaaaactgacacatagacaatttcaaaaacgtccatcttgcccaaaatccccttagtcacatcacgtggtcctcgcaccatgatcgattcctctgcgggttcgaaaataaatgcgaattgaatggtcaaagcagaaacggtgttgatccaaagcaactgggttggatatagcggtaattcctgtcccataatcatactgatcaaaacaaccagtccctcagcaaaacttgttggtaaaaggaatcgaattgttttttgaatattatcaaacacatgtcgaccttcagagacggcatctacgatagtggtaaagctatccttaaccaataccatatcagcggattctttggcaacgtccgttcctttaattcccatagaaataccgatgttggcttgctttaatgccggtgcatcattaacaccatcgccggtcatcgcaacaattttcgaattaacctgctgtgcacgaacgattcgtaatttatttgcaggtgttgtccgtgcaaaaacattatatcgaccaatttctttacttaattcttcatcggacatcttgtcaatctccggaccggtaatcgcatgaatgctttcatccaaatccagtttcttggcaatcgcggttgccgtatcaggatgatcaccggtaatcatattaaccttgacccctgcccgtcgcaaatgatgaatggccggaatgacttcttcacggggcggatccatgataccaacaatgccacttaattggatgccttgagaaatatcatccatcacgatttcattttcgctgttggaaacatctttccaacccaatgccacaactcgtaatccccgatcggttaacttgttaacctgttcataccaagaatcggaatcaaaatcaggatggcttgacttgaccatatcaaaaatcgttccaggagcacccttaaccattaattcattatgctgcttgtcatcatcaatcaagcgggcgctataacgataagccgaatcaaaaggtaacgtatccagctcgtcaacttcgggagcccgccccattaatttatgaaatagggttgttaaagccccatcggttggttcacccgtcaaacgccactcaccatcagtttgaacaagttcggcatcggtcgttgttccggcaattttaaccaactcaacaaaattttgatcattttgccagtcgactttttgactgtccagtaaaacattacccgaaacgcccttgtcattatccacaaatcctgtacctgttacttgatagtgatgatcatgggtaataacgtccgttaccgtcatttcgtttttggtcagtgtccctgtcttgtccgtatcaacaatatcaaccgctccaagggtttcaacagcaggcaatgttttaacaattgcccctcgtttagtcatgacttgaacaccccgtgccaaaacaacggatgttgatgcgggtaacccctcgggaatcgatccaacaaccatggtgataatggcgatcgttagaacaggtaaactataaatttttgtatataaaccaaggatgaagagtaaaactgcaattacgacgataaaaactgataaattaacgcctaatttatttaaatttttcattaacggcgttacttgagtcttaacattagaaacactttgctgaatactaccgatttcggttctcgaaccggttccaacgacaatccccattccggagccttgtgttaccgctgttgaagcataagccatattggaacgttcggccaacggaacggatgctttatcaatgggatcctcggtcttttcaaccgaattactctcaccagttaacgttgattcctgaattcgtaaattatcagctgaaatcaaccgcatatcagcaggaaccgcatctcccgcttccaaattcaccaaatcaccaacaactaattctcgagccggaacctcaatcttttgaccatcacggacaacgtaattttgactaaccaataattcttttatcttggttaacgcattgtctgcttggatttcttgaaagaatccaataaacgcatttgcaataatcacaatcccgataacagatgaatcagaatagtggcgaagcagaagcgtaatgactgccgcagctatcagtatataaataatactattattaaactgggcaatgaatttaaccagcttgctttgcttcttaactgttaattcattatagccaccttgagctaatcgtttctcggcttcctgctcacctaatccattttcagaattagtcccatattctttaaccaattcctcagtagaatcctgccataagccctgttcgggaggagcctcagtaattttctgttccattcaatgtatcaacctctcttttaataaaattagacgaaccttaaaacaatttagatctactataaaaatattatatgatatttgacggcatacctacaagtaggacatcccgaaacgtgttggatcatctatctttttagactatatcgataaatatcggtttataaaaaaagatcgggcaaaaggctgctttgtctcgatctcttgtgaaacgtcattatttaactaaaacgcgcattagaaatttaactattccttgaacacatctttatttgcctaaatatggattatcaggaactcgaaccaaatcatcagcaaccaatcgttcagcaatctgaaccgtattccatgcagcaccctttagaaggttatcagaaacaacccacatgtgatagctgccttcattttcataatccggtcgaacccgtccgacaaatgtttcccgtttgccttctgcctcaattggttgtggataaatttgatgtgccgtatcatcttgcaaaacaacgcccggtgcatcagccaaggcttttttaatttcatcggtatttgcattgtcatcggctacttcaaagtagaccgtttcaccatgggcaattctgatcggaacccggacacaagtagcggttaccttaatatccttggcatccatatcatccaacataatcttcttggtttcatgaatcattttccattcttcatgagtgtaataaccatcttgctcgaagacatcaatctgtggcaataggttaaaggcttgttggtagtgtttcttatcaccttttgtcggtagaatttttggatcggtcttttcaccgtttaatacctgttgggattcttccatcaattcatttaaagcagattgaccggcacccgaaactgcctgataggttgaaacgatcacctgctttaacccatatttcttataaatcgggttaaggcaaacaaccatttgaattgttgagcagtttggattggagataattcctcgatgattgtacaacgctttttcatttacttctggaataaccaacggaacttccggctccatccgaaaagcactggtattgtcaacacagaccgcaccacgtttaacagcctctggcaaaaatttcttggaaatagaacctccagcagatgccaataccaagtcaacgccttcaaatgattcaggcttagcttcttcaacggtcacatcccggcccttgaatttaagcttttttcctgcagaatgagccgaagcaagcaacttaacactcttaacggggatggttgattgttccaactggctaatcagccgagttccaacggctccagtagcacctaaaattgcaacgttaaattctctcatctcaaaatactcccttattgtagaaactctaattataatataatcatactttaatcttaagcgaatcacaagtgtctttccgacatctttgtggcatctctatttcaccctatccaacagataagcgctcatccgatccattgccaacttaatatcttcgtccgaggccgcatatgacattcgaatatagcgttcaccaccaggtccaaaggctgacccgggaacaacaccgactttggctttttcggcaagatcagtcgcaaattctaccggtgtttcgtttattgtatcaggaatttttgcaaaaatgtaaaaagcgccttgaggcaatgcaatttccattcccatttcttccaaacgcttagcaatgtagtcacggcgcttattatattgttcacgcattggaaccgcatcttccaaaccatttgtcaaagcttccaaagctgcatattgagccggatttgaaggacaggtaacagcaaagccatgcatttttgcagcattagtgacaaaatcttttggtgccgcaaaataaccgattcgatacccggtcatcgcgtgagatttcgaaagaccatttaccacaatggtttgacccggcaaaagctttgcgattgaataatgcttaacgccatacgtcaattcgttataaatttcatcagccaagacaaacatgtggtgctttgaaataatatcagccagggcttgcaattgttcttgggaatattctacaccggtcgggtttgatggatagttcaagacaattgctttgacacgatccccgttttcatccagtgctttttgaagtttttcaggagttaaaacaaagccgtcatccgatgtatcaattgtaatcaattcggcgccggcaacctgaatgattggaaaatacaacgcaaaagccggtgtagggacaatcactttatctccgggattcagcattgatgttaatgccgaaaagatggcttcggttgcaccaactgtcaccacaatctctgtttcgggatcataatcaacaccggtacgattacttaaataacgactgatggcacgtcgtaattcgataatccccttttgaaccgaataatgggatttattatcttcaatacttttaatagccgcctgtttgacatgctccggtacattaaagtccggttcaccaagtgtcaatttaacaattccgggaattgacgaaattttctgatcaaattctcgaatacctgaaggtccgactgccttaatgtgcttattaacaacttctgaaagtcccttatctaactctggcataatatcctccgtctcgcttataaaatattttccaaaccaacaattaacttggttgcttttgccgcggcaggtaccgcaagtttaacaccgttcataaatgagccgcggtcaaacgagtcttggcgaattgtcaatgcttctcccgtgcccccaaacaagacctgctcgtgagcaacataacccggaagcctgaccgaatgaatctttataccatgataatcgccaccacgaacgccttttaacgtttcttcggattttggagccggatgatctccacgaacctcgtcaatcatctgtgcagttgaaagggccgttccagacggcgcatccagcttatcatcatggtgcatttcgataatttcaacatcgggcatgtattgagcagcctcttttgcaaatttcatcagtagaactgctgataacccaaagttgggtgcgatgatccccccaaccttcttttggtctgctaattcccgtaattgttgaatctggtcatctttcatccctgaggtaccgacaaccggatgaatgccatgttcaatcgcgaatttaacattaccaaaaaccgcactcggaattgtaaaatcaatccaaacatctgcatcggtctcaatctcgtccagactactaaataatttgacgttcttattaagacccatgccttgcatatgggcaacatcaatacctggattataggcaccaaccaactcaaaattatcgtcttcattaatcatttgaaccgttttttggcccatcgatcccatgaagccagcaactagaacctttatcatagtaaactccttgtgtaattaaatattgttaatttatcgaacgcaagctgcaaaaaatcagaaacttacattccgaacgccaaccgcttagttttgcacactctccaggtctctgattcccaatctctttgcaaggatggccttttcttcatcgtctaatgacaggattggcaaacggcaatcgccaacatggtatccctgagcgtttaggacagccttaacaggtgatggtgacggataactgaaaagcgctttgatctttgggcttaagaacctcattaggtcacctgctgctttgtagtcgccatcatagagatcatcatacatttgacgaatttccttaccatagatgtgactggcaaccgaaataacaccacggccaccaacgacttttgcaaagagtgcctgagcatcttcacccgtgaaaacgttaaagtcatcatcggtatgctcaacgatatattcgaaatcatccattgacgtacactgctttacaccggcaatattaggattctttgataactcaaccaccgtgtcgtttgccattgtgacaccggttcggcctggaatattgtaaatgatcaacggaaccgacgactgttcagcaaccgctgtaaagtgggcgatcatccctctttgatctggtttgttatagtatggcacaacaaccaacgcgtaatcaataccgggaatgtgactaacttctgaagtgaattgtgcggtttcgtaagtgttattactgcctgtaccggcaataacaacgccgcgaccatttacgatcttagcaaaacgcgtgtacaattcaatcttttcatcatgacttaaggttggtgtttcgccagtcgtaccaccaattacaaagcctttgctaccagtatcaatcaagtgatttgccaacgtctcaagtgcgtcaaagttaatcgtaccgtcatcactaaatggggtaataattgctgtcataatatctgcgttaatcataaaaatccctactttctatattcttagtttcaatagtcttccaattttttataaaaccgattcaccctgtctgaactcaagaaatctaacaatcgaattgacgcctttaggaatcgacgattcttttggattcaaagtagcagcgtgtaatgctgaatcatcttcgacgcccaaccaaaacatcgtgccgggaatttttgataataagtacccgaaatcttcaccggtcattgccggttgagtttcaataaattgtgtttgcggatcctgcttagcaaaattgataaatcgttttgtcaattcatcgttattttctacgggaagatacccaccttggttaaaagcaatgttgacagttgcaccataactggttgccactccattggcgacctgtttgagtcggtcaacaatgtgttcaatcattttctgggtgagaccacgaatagttccttcaattcgggcttgcccggcaatcacatttcgaatggtcccggcatccaacttcccaaatgtaattacaccgccctcaatcgggttaacgcttcgggaaacaattgtttgaacctggttaataaattgagccgccgcaaccaccatgtcgttggcatcctgtggataagccgcatgcccgctttttccaatcaaatcaacattgacttccgttgttcccgcaaatagcgtgcccatgcggcagccaattgctcccgcgggtaagttgggattatcatgcagtccgtaaaattcatccggtctccatttgccggcaaaaacgccctgttcataggcaactttaccgccattctgactttcttctgccggttgaaagaagaacaccatattatcttttggctgatgctcactgaaccagctgagaacgcccaacgcaaccgtcatgtggatatcatggccacatgcatgcatcacaccgggtgttttagaagcaaatggtaaccctgttttttcagtcacgggcaacgcatcgatatcggttcgataaccaatcgtccgcttgggatcacttccgtgaatatacacaagtaatgcggttggtaggtcaggaacctctcggatttcaagatattgctggttaacccccttaatgacagctaacagatattgatgagtctcgaactcatgcatagccaattcaggatgcgcgtgcaggtgcctgcgaatatcaattaagttttccgttgttaattgggccattaaatcacagctttcttaaatcgtcttccaactctgtcttggacttagtcttggaatcgacatccttgattttcttcgccggcataccggcaaccatcgtatatggtgctacatcttcagtcacaaccgcgccggctgccacaacggcaccttcaccaacgtgaacgccttcaatgacaactgcattggcgccgatcagaacattgtcatctatttgaaccggttgggcagaagccggttcgatcacaccggccagtaccgcaccggcaccaatatgtgaatgcttaccaacaattgcacggccacccatcacgacgcccatatcaatcatgctgtctgccccgatttcggccccgatattgataatagcgcccatcataatgacagcattatcgccaattgtgacgtgctctcgaatgacagcccccggctcaatacgggcattgacatttttggcatccagcaatggaacggcggaatttgttgcatcggattcgattttcgtgtctttaatctgatctttatttgccttcaggaaaggctcaacgtccttccaatcaccaaacaaaacggcagtgtgtttctcaacaaacgcttctattgatttgggaatctcaacttttcgaagagcacccttaacataaactttcaccggcgtcttcttctcggcatttccgatatactcaataatttcccgtgcacttagttgttccattgcaataaagtctcccttataagtagtagttttatgatttttatatagttgtctgaattaggactgcttctcaaagcatcaccacgccacgtaagggatcaaattgaaaaatccaaatgcgggattccccaatttgacgccttacgctctgggtgataaccgctttgttccgcacacttggcttaggactgcttctcaaagcaacgttctgcatgtaagagattcatttcaaaaatccaaaaccgggatttccgaaatgaacgtcttacactccgaacgctaaccgctttgttccgcacacttaccttattcaagtggttgatcaagtcgaatcagatcttcaaacgtttctcgacgaatcgccaaattatcttgaccattttcaacaaaaataacggctggtcttggatttcgattataattggaagccatcgcatatccatatgcaccggtagccagcattgccaaaacatctcccggcttggtctgaggcaacgcctgcttttgaattaaaatatcaccggactcacaatacttgccggctacccgtaccgtctctttagccggtgccttgggatcattagccaaaactgcatcatattcagcttgataaagggctggtcgaatattatcgcccatgccaccgtcaaccgtgacatacgagcgaatgcccggaacgtcctttcgactgccgacagtataaagattgtagcctgcaggacctgcaattgaccggcccggttcaatccagacagccggcattggaagtgccaactccccggctcgcttcttaattgctttaacaatcgcatcaacaaacatttccggtgcaatcggatcatcttcttcggtatagcggataccaaacccaccgccgacattaacgacttttgccacatacccgatttccttgtgccactgaccgactgtatcaatcaactttgtggcagccagttcaaatccctttacttcaaaaatctgtgaaccaatatgggcgtgaatgccgagcattgtcatccgttggtcagccaatacttcatccaaggccttacgagcctgaccactttgcagatcaaaaccgaatttgctatctgtctgaccggtttgatcatattcatgagtgtgggcagagacgcctggcgttactcgcaacatcacattaatgtgggcatctttatctttcaaaatctgctttagcaaagcaatttcatggaaattatccaagataataaccccgatttggtgatcaacagccatttccaattcttcaacggacttgttattaccatgaaagctgacatgatccattggaaagcccgctttaatagcggtatataattcgcctcctgaaacaacgtcgatatggacattttcctgattgaccagttggaacatcgcaatgcaggcaaatgctttgcttgcgtaactaaccgcataatccacatgattgtcttcaaacaccttttgaaaatgatggatttgatttctgatggccgatacatcatagacaaccagtggggttttgtattttttgacaagatcaagtgcatctgcaccaccgatttccaaatgtccggcttgattaatctgaatttgactgatatcactactcatttaaatttcctccaactcatcttcaaaaagggtacaaaaaaatctctttgttcagcggctaactaaacaaagagattcagaattttaagtgctctaatattctttatcaattttgtcgtcgttagcgccccgcagctgacgattttcgctgcgacagtccatagcctcttaagctaagtcccagcgcgccaaggtctgcttcccttggtgcttcggcaaccgcccctttcattagcttcaaagttcaagcaggaactccactaattactcttgttggttgcaacctctaatgattatttactaatcagtttataatgcttctcatcatccgtcaaccttttaatgcaaatttgcacaaatcaatttctaacacagcaatgaaagtcgtaaagataaacaaaatgataaatttaagcaactaatgaactaattacaataaacattatacacttttctcgtcatttttcagaaaaaattactcatcaatcactttccaatattatttttttgaaattaacatctttccgtcacatgatgatcttaacgcgtcacagctcagcataacgtttcaaaatgaccagtctccatatctatttgttactattaattttttcacgagactttactagttttcaaaatgtgctaaaattcgacttaacgatttttaactaaatttttaatttatgggaaaacagggagtggacgattgagatgaaagttgttaagtttggtggaagttcgctggcagatgcggcgcagttccaaaaagtgattcaaattatccaagatgatccgcaacgaagggtcgtcgtcacatcagcaccgggaaaaagattcaccggtgacatcaaagtcacagatcttctaatcaaatatgccaatgcaacgttagctgaaaagaagaatgattatgcttccgctatttttgcgcgttaccaggaaatcggaaatggttttggtgttgatcaaaacattttggaagatatccactcaaaactgattgctttgcctaataaggcttatccgaatgacgattacctcatggctgcttttaaggcacacggtgagcgactcaacgcggaattattcgcggcatgtcttaataaacttggcacaaaggcccgctttgtcgacccttcggaagccggtattttactaacagacaatccaaacggtgcctcaatccttgaagaaacctacgctaatttagaccaattgaaatacggtgatgaaaagttggttttccccggtttctttggttttaccaaagatggcaatatcgtgacgtttgcgcgtggtggctccgatatcacagggtcaatcctcgcgcgtggccttcacgcttccctgtacgaaaactttactgatgttgatgctatttatgccgcaaatcccaaaatcgttaaaaatccaatcccgatttctaaaatgacgttccgtgaaatgcgtgagttatcctatgccggcttttccgttttcaacgacgaagccattattcccgccattcaaggacaagtcccgatcaacgttaaaaatacaaataaccctgaacttcccggcacattgattgtgcctgaaaaggacctctcaattaaacgtcccgtaacaggaattaccggttcaaaccgctttgctgctctttatctacaccggtatctgttgaacaaggaagtcggctttacgcttaaaattcttcagatcctttataaatatggtgtttcctatgaacacatgccatcaggaattgatgacctaacgattattttcgatcgcaatcagctcgatgaccagaccatccataagatgtgcaatgatattcaaaacacagttaatccggatgatatggaatggattgacgattatgcgatcattatggttgttggtgaaggaatgcgtgctagaattggaacaatagagaacattattcggccgttggcaactcatcacattgccgttcatatgatcaaccaaggggcttcacgaatctcaattatgttgggaacccgtgaatccgacgccgataatgcgatcaggtatatttacgataatttttttaaatcaggtgaaatggccgctgaagaacttcaagccagccttgattcatcaagcatttaatttatagaacttatgatatggaggcacaattatggtgcaattactaaaagtccatggctcacaaaatcaattctttatcttggatcaaaccgagttgaaaacgaaattaaatcaagaagaattggtggcactcaccaagcagattactgatccggccaaaggacttctcgatggtgccgatggtgttttagtgattgatcattctgatcatgatggcactttaggcagcatgcaggtcattaacacagacggcagtattgcgtcaatgtgcggtaatgggttacgcacagtttcacgctatttgtcagataaataccatcagaattcatttaaagttgaaacaatggacagcgatctggccgtccatcgtgaaaccagccttgcaccaggtgttccaacgtttagtgtggaaatatcaccggttacttttaacaaagaaagcctcccctttgacaatcttgacggtgatactttgattgaccgtgaagtaccggcatttaccaaggggttaaaattcacggcaatcgcagttcccaacccacatctaatcagctttgtcagcgaagaggtcatgaattcggacgctttaggaaaattaggcaaagaactgaatcagccaaatccatattttactgatggtgtaaatgtcagctttgcccaaatcctagaccataatcaattatttgttcggacctatgaacgtggtgtcggttttacaaatgcttgtggaaccggtatgtcggcaactagtcttgctttctgcctcaatcacccagaagtaagcgacttcgaagaaaccatttctgtttataatccggggggcatggttaagacgcgggttcatgatgacgatggctcttatcacatcgatttaattggaaacgccacattcacacacaaggttgaaatcccagaaactgatttacacgcaaatcagttgcaacatgctgagattaccgataccggtgaacaaaaagattatttaaactttgtaaacgacttaaagcaacaggaagcctaatcaaaaacaaaagctcgtaagatccgcagccttaatgatgcggatcttacgagcttttgtttttcaatgatttatcgatttaatccacacactgatttaatgttctgtctgccacactgccttaatcagttgatttgccatcaccctgcagatcaactcaatcaactgatcctgcatatacgctttggcgtcaaagctgaccgattcgccgttaatcgccgttattgtcatgtcatgagcttcaattttgatattatattcggcaaaggttttaataatcgattgcaatttaacctgatccatcattttattggcctcccagtctcaatttcaaccgccactcatcctggcggacttgattgattttcattcgtagatccatcaactgcgaaacggataatagaaagtctttaacctgttcataatgcgtcttacttgaaaaataatgattcgcttttcgctgtgataatttatcaattttcgtttgaagatccttgagatacttttcaacaaactgaatggtattttcacgaatactggccagattagcaatctgctcatctccaggatcctcaatttccaattcctcaaccagctgaaacccgtttagatcttcagaatccgtattcagtaacaaaaagtccccactttcaaccgcactttgatacgtatcaaggtttgttttcgttaaatacccgggtagttgtctgtcagttaatttcaccagtagaacgacatttctggtaatccccgcaccaaacttaatatgaatcacaaaattctttttgcctatgtagttaacattgtccaaaataagctgtggattatttgtaacgacttccccaagtgaaaaataagattgacccttttttctaacaatttgaccaaaaaccggcttcatagtcttcctccgtctaattcattttcaagttgtatcaagatgatttttgaaatacaatgacactcaatgttcattttaacgtataatagattggaacacacgttcaagttagaccagtgaagggaataccatgacagttcatcaaatcggcatccgccagctcgttgagtttttactcaggaccggcgatttaagccctattacatcaagtgaaaatacgcctcaagagggcagtagaatccatcgtaagcttcaaaaaaggcgtcccgacagttatcaatccgaagtcagcctgaaaacctcatttcaatatttagaggacgagtacattgtcgaaggcagggctgacggaattgattatcaggattcaaccgttctaattgaagaaatcaaaacttcggacttggaattccaatcggttccggagtcaaccattcaattatattgggcacaagcaaaagtctacgcttatattttaatggaaaaagatgcgcttgacgacattcgattacaactgacatacgttcaaactcccgacgaaagaatcacgaccaggtttaaatcttacaccaaagatgaagcaacatctttcttcaatgagttggttgccgagtataaagcttggattaaacttcgccgggaattaaatgagcaacgtatcaaatcggctaaagcacttcgtttcccgttcacaaactatcgtccgggccagcatcagcttgctgtcaacgtttataaaacaattatgctggaaaagcatttatttatcgaagctccgaccggaaccggtaaaaccatttctactctctttccggccattaagtcaatgggtgaatcactaattagccgaatcttttattttactgccaaacaaagtacacgtcatgtagctgaaaacaccatctcactcatggccaaaaatggactgacacttaaaagtattaccctgaccgctaaagacaaaataacatttcaagaagaacgggatgtcccacccgaaaagaatccctacatggtaggttactatgatcgggtgcgaccggcaatcaaagatattattttaaatgaaaatcaaatcacgaaacaaacgatcgaaaaatacgccgagaagcacaaggttgatccttttgaatactcactcgatgtcagcctcttttgcgacattattatttgtgactacaattatctgtttgatccccaagtccacttacagcggttcttttccgttccggataaagaaaattgttttctcgttgacgaggttcacaacctagtacagcgctcccgtgaaatgtactcggcagctttgaaactaagtccaattaagccactgatcgacacactctcgaaacaaaaagaagccaataaaaaaatcatcaagaagctggaatcgttaaaacgcgcctttaaaaggtacagtaaagaggctggtgaaactgtaagccgccaaattgcccaaaccgcccccattgataattttaacaagacactcggagatttaattgctgaaatacatgaatggttggcaaatcaaaaaccttccccaaccgttgatctggttgttgactattatctacaatgtcgaagctactatttgatttcccaattctatgacgaaacttaccgtacccgtgtgatcgttgacgaagatcatcatgatattatttttcgacagttctgtatggatcccagtaagcaattgaaagagagcttgagtttaggaagggctgccatacttttctcagccacgcttagtccaatctcttattatcaaagagtgttgggagatgaagcagacagtttgccaatgatttccacctcatcgtttccccagcaaaactgccaggttatcattgccaataatattaatacactctacgcaaatcggggcaagagtattcaaccgatctgtgaaaccatctttactcttgtttctcaaaaaaaagggcattacatgattttctttccgtccatgaattatcttgatgctgttttgtctgaattttcaactatatatccggaaattaagaccgttagacaggaatcgacaatggataattttgccaggcagcaatttttagatgagtttcgccagactccggagcaaaccaaagttggctttgctttgcttggtggtatcttttctgaaggaatcgacttaaagaatgaccaactgattggcgttggaatcgtaagtgttggccttcctgggatgaacgctgaatctgatttaatccgtgattattttgattcaatcaacggtgagggcttttcatttgcatatcagcttccggggtttaataatgtaagtcaagctgcaggaagagtgattcgtaccaacaccgataaaggggttatcgttttaatggatcgtcggtttaatcaaaccagataccgaaaaatcttcccaaaacactgggcaaacatccaagtttcaaataatcccaaacagttggaaaatcagctccaaaacttttggaagcagttccgaaattaagaccaaaggtgtatactagtatcactattcattcattgaattatgccaggagggattcagtttgaaattagcaatgtatgatcataagccaacgtttgtcgcgccacagaataatcaaatttggggtgtgccaatcactgggtatgactcaatcgacgatatcttgaacgattggcagagcttcgaatccaaagtacttatcaatatttcagacaaggccattattaatgacgatcgcgctgagccgcttgatcctaaaaaatttgagcagcccgttacccatccccgtcaattaccggcgctcggctttaactaccttgatcatatggaggagatgtcaactgcccgtccaaaacggccaaacgtttttaataaatttgtcagttctcttgccggtccaacaaatgctattcatttgagtagtgatactgttgactgggaatccgaattggttattgtcatcggtaacggtggccgcaatatcagtcgggaagatgctgaggacgccattgccggctacatggttggtcaggatatttcagatcgcaccttgcaagcaatcgatggtccaagtacccagttcgatctcggaaaatcatatcgtaattattcaccggttggtccttatatctcaacaattgccgatactgacgacattgtttcaaagcagattacgaccaagatcaacggtgaaatcatgcagcaggcaactgttagtcaaatgattttcgatattcaaacattagtctcatatatttcaggtgtcatcgagttatacccgggagacttgatcttcacaggaacaccaagtggtaccggtgtaggaagggatccacaggtattccttaaatcaggagacgtcttcacaagtgaaattgatggcttgggaatgattgaaacgaaggtaaattagagagtgtgaaaaaaagcggttaacttccagaatataagccaaaaacttagatattcccgaacttgggatatttaagtttttggcttatatggccggaagttgcttttttatcacacgtttcagctaaatgacagcatacatcaacaataaccctggatttgggttattgttttattagcttatatggccgggatcagttttttggtgcacgtttcagctggctaaaaatgtccatctgatattcccgaacttgggatatttaagtttttggcttatatggccggaagttgcttttttattacacgtttcggctaaatgacagcatagatcaatcaaatgaggccgaaacaaagtcactttgcttcgacctcttgatttttattgttgacaattaaccttacttttttctcaatacacaaaccggttctggtaccttaacgtccttttggatcattgtcagcttaccagtttgagcatctcgtgtgtacaacgttccgttatcagaattttgattgacacaaatcacaaatgattcatcgtcactgaaattaaagtcgcgtggaaaatcgccttcggttgagatacgttggatcaattgtacattacctttctcatctgaactaaagacggcaattgtattatttcccctattggacacataaacgaatttgccatctttcgaaatccgaattgcagcagcgccgttatgctcggtccagtcttcgggaattgttgatgaaatacttcttagtgttaatttccctgctttttcgtcataatccaaaacagctaaatgactactcagttccccaaccagataagcaacccctttcttttcatcaaaggcgatatgccgaggaccataaccatcttccatttgtaattcactgacaggggttaatttgccactatcatcaagatcataaataaagactttatcaacaccaagatccactgcaactactcgattatcaggtgttaaattaatataatggggatgcgggccatcctgttgttcgggccgaaaacccaatgttcctttatccatgattctatcagcacgggtaatggcaccatcaccggcaatcttgtaagtacaaattgtgccggcgtgataattggccgtaaataccaacttgcgtgtctcatcaacagcaatgtaggctggcgatgtttcttgatcgtgaatcgaggcaatatccgttaatggaaaatcttcagacttgccatcccactccttaaaaccacccgttacattgtcgtctttatctttaaccttggtaatcgcataaatccgcttactgttagattcagcaacatacgtggggtcaattgcatcaccaacaaactgtaaattctgcaatttttgattgtctgtgtccaattcaagctgataaacacctttactgattcgtctggtataagttccaatcaaatatttttctatcaaaagttttgcctccagaatttgtttatgtctacattatgccacagatagaagttaatcaaaatacattatgtaagctttttcacgaaaggatgctcattatggattcatttgaaaaatttcacccggttttaacagcccattacacactggactggttaacacaaactcaagttaaacgcgttgatgatctttttaatcaaccaaactttacaaccgtttctgcagaaaaactaccaaatcaaatcttcgatacggttaaaggcattaatcatgtcatgcaacgtgtgatgaacgccacagaactaacttggggaattaccgattcaaacgatggctcttttaagggaataataacgatttccggattcaatcgcgatgacaaaaccggtattatcgattttacattcgttaaaaatgaagccagaggattaagtgaagtcatcaaacgcgtcgtagaattcgcaaaagatcattttgatttcactaaattagaggtaaacttaaatgctcctgctaccgtaatctcaagtatcctcaaagaaaacagctttgaaccccttgaccgtcaccgttttgaattagacctatcaactgccaactaataaaaaatcagtaaaataatgctcagtttattgatttatttgttaatatagtttagaataattctaaaataagaatcaaagtagcactgggaaccggttaaagttctaaaaacttaccaccttccactaggtattggaggaatcgcgttatggctaccaacacacaacaattggatgtatcattaaaacgacttaaaaagaaagggattcgaataaccccccagcgtgaaattatcttgacctacctgatcggccatcataatcatccttccgttgaaacgattcgagacggcattgacgaaaagctgcctaatttaagtgtcgctaccatctacaacacactcaaactattcgttgataatggcttggttattgagctgcctaataaagatggcggccttcgatatgattttttcggtgtgccccattaccacgcaatttgtgaaaactgtggtaagatttttgatatttttgacgaatcatatcctgatatcgtggcacatgttcagaaagtagccagggaaaaagttggttttaccgttaccggtacacaattagaagtaactggcatctgcccgaaatgtgaaaaaaagctcgcaactagaaagccattatcaaaataatattacaatggataaagtctgatataataggatttaaaccgcttttttattattttgtcaacaactcttaatatgattgacaataagtcgtcaaaagcccgtaatcatgcgttaaatcactgattacgggctttcttgctgcttgaatctactacgctaaatcgtttatattactaagcgtaatcaagtaagaatgtaaatatttgatatatttaaaccagactaaatttaactaaaaaccgaaacatcatccaatcatttaaaagtaatccgatcaaacttctgaagggaaaaattattttgaaaaaaagaaatttaatcaaggcagtttgtgcactttcatttgctgccgtggggattttttcatacggcaacagtgcccatgccgaaagtgtcaacacatatatcgcaaacaacaatattgaccacgctgatgtaacatcatctgtttggggcgggtttccgaaaaatggttaccgccacggtactggtaagcctgaaggggttgtcgtccatgaaaccgcaaacccaagttcaacgatttacaacgaaattgcatacatgaaacgcaactatcgggctgcctttgttcacacatttgttgatgccagtcgaatcatcaacatcgcgaacacagactatctggcttggggtgccggatatccagcaaacgcacggtttgtccagtttgaacaggttcgcgttcatagtaagtcagcctttgcacatgagattgcaaactcagcttactacacggcctatattctggataaatatggtttaacgccaaatgatgccgcctatgatggtaaaggaaccgtttggtctcacaaaggcatctccaagtttttaggaggcacagatcataccgatccaactgcctattactcatcaatgggtaaaacctattttggttcgagttatacatttgcacagttttatcagcttgtaaaaacaacgtacgacaacatttctggctcacacgaaaagaaggcatttgataaagtttcgtatcagtcagccgatgacgaggcgctattaggagataaatataaatcttataagctatataaccatgtaaaaaattcaagggctaatattaagtcatattcatggtcatcagtaggtgcgaccatcggtaagaaagtatatatcgataatatcggcacaaaatcatccggcagtgcctggtatcgtattcgcttctcaactgataacggtgttcaaaaatactgggtatacggtaaggcgttgaacttggattaaacggacaaaaagccaaatcggctattagttcaataggggtcgaacttttcgttccgacctcttttgctttagctaaaattatttgttcttatttagttgccttaaagctgtttttatcatatcggaaccaattttaagaatcacaatttggcatcatttattcactattcagcttgttcagttgacatttgaactttaattatatatgatgaggctactttggaagaccaagtagtgcgactacagagaaagcgttgactgctgaaaaacgcttaagagcacgaatcctatcttctattacgattatgtcttaatcagacacggattttcccgttatgaaatcaaaaagtgtgaagccttgctttgaatgagaatggtaccgccctaattgggtgtctcaattcaaagtaaggctttttgtgtaaaatgaaagaagaaatttaggtggcaaatatgaataatcgaactattaatgcaaatcgaatcgttgttaaagtaggaaccagtagtctcatccacccaagcggtgccattaatttggaaactttcgaccaattagcatacacactcagtgcgctaaataatcagggcaaggaattgattctagtttcgtcaggtgcaattggtgtcggcctgaataaaatgcaccttaaaaaacgaccgacagagatcggtgcccagcaggcattggcagcaattggtcaatcggaactcatgactttatttacccaaagattcaaccattacttaacagacattgcgcaagttctgctcacccatgatatttttgattatcccaaaagcaataaatatgtcatggatacattcaattgtcttctcaacgacaacgtcattccaatcgttaatgaaaatgatacggttgccaccgacgaattggatcacaaaacaacttttggcgataatgaccaactttctgcaatcgttgccagtcatgtcaacgcagacttactgattgttttatcagatattgacggcttttacgatcagaatcctaaaaagtatgtcaacgccaatctaatttccaccgttaatcatattaacgaagaaacattcacagtcgccggtggctccggaagccgctttggaaccggtgggatgcaaacaaaattattggcagcgaaacgaatgctggatgagaaccgccaaatggttttggccaatggcaaggatcccagagttattcttgatattctcgccggtaaacagattggaaccctgttctccaacgattcaacaagcaatcagcatcgtgacttggcaaatctcaatcaaaaataaaaagccaaataacatttagaaatccccactactttaaaatccaaccctgggagggcttaatcatgaatgacactttaattcaaatcggtcaacaagcaaagaaggcggctgtcaaaatgggacagcttgatacgatcactaaaaatcaaattttaggtcaatttgcagaaagtattgttgctcacattcctgaaattctcaccgctaatcaaaaagatttggcaaacgctactgaaatgccaacaaaatttactgatcgattaaaattaaccgaccagcgtattaaggatatggcagaaggcctacgccaagttgccgccctatcggatcccatcggaaatattgaccgtggctggaccaacgaagccggcttattaattgaacaaaaacgtgtcccaataggtgtgattgcgatgatttttgaggcccgccccaatgtcacagtcgacgcatctgctctgacattcaaaagtggcaatgccgttatcctgcgtggaggcaaagaggcgctcaacagcaatttggcactggcagaagtgatgcgtgaagtcttgaaacaaaacgggttggatgagaatattatccagattcttcacgatacaagtcacaaaacagctgatgatctcatgcacctgaatgactatgtggatgttttaattcctcgtggtggcgccggtttaattcagaccgttctaaagaattcgacagtaccggtgatcgaaaccggtgccggtaattgccatatttatgtggatcaatttgcggaagaacaaatggcggttgatattgttgtgaacgctaaagtgcaacggccttctgtctgcaatgccgccgaaaaattattaattcatcaagacgttgccaaaaagttactgcctgccattgcaaaagcgctggaaaaacacggtgttgaactgcgtggtgatcggagaagtcaggagattgtcgggtcaatcaagcccgcaactgaaaccgactggtcaaccgaatacaacgacctgattatggccattaaaattgttgataatgagcaggaagcaatcgatcatatcaaccagtactccaccggacattcagaggttatcatcacagataattaccaaaacagccaaacatttttaaaccaaatcgattcagcttgtgtttatgttaatgcgtcaactcgatttaccgacggcttccaattcggcttcggtgcagaaattggcatcagcactcaaaaactccatgcacgtggcccaatgggattaaatgaactcacgaccactaaatacgttatccgaggaaatggccagattagaaaataagtgtgcggatcaaagtggttagcacccggaatataagacgtcgatttgggaaatcatggggttggatttttcaaatcgatctcttatatggagtggtgctgctttgaggagcagtcctaaataagtgtgcggagctaacctgggataaaccggagtgtaagctgacgggcagtgaattcccgcttttggaatttgatggctgttagcttacatgcaggtttatggttagcgcagcagtcctaaataagtgtgcggagcaaagcgattagcgttcggaatgtaagacgtttatttcgggaatcccgattttggatttttgaaataaatctcttacatgcagaacactgctttgagaagcagtcctagtgtgcggatcaaagcggatagcacccggactgtaagacgttcatttcataaataccgattcacatcaaaaagcgttcaaacggcaatcattatccgtttgaacgcttttaatttatttacccgattcacttttttctttatcctgtattttctttagacggtggctcatcattaacgtcgtccccggaattgtgagtacaacgccaattaatgaaatgataattgcgatgagttcagctgcaaaaaccttgtcatttataatatctccaaacgaataattcaatccatagaaccagataaacagccccattgagctgccaaagaaaccaaagaataatgtatttaccgccgttccaataatttgcttgccgatcacgataccatctaagaataattgactgcttgaaatcttaggatgctgtatcgtaatttcatcaagaccggatgcaatcgcaattgacgcttctgcaattgcccccaaagaactcaggatagcggttgaaatggccaattttgtaaagctgattccgacatacattgataagccctcaagttcctcgctatcctcaagaccaaaaccgccaactctcgcccaatattcaatcggtataataatgacaatcaaaataattagaatcatgacagaagcttgaaaagcggtagttgatgcgttatcacttgcactactccaaaaaattgtgatcgacagcaaaataacactcgccacaatagtgaccgcaatcggtggtaggtgaaaggcaatgagtacaatgctaaagaagagaatgccaaaattaatgaccatgctaagaaaagatgaaattccctgcttaccgccaacgatgatcattagaatcaataaaagagctccaagtgctgttaacgaccccatcagcgttcatcccctttgatcagtagtccggcaaacaaactggataaaataacggttaggacaatgccgattccactaattaagctggaagtcattcctaatgacatattcattgagaatgagtatttccaagtattcccgtttttaagatacagcaatgtcatcggcagcgtctcagccataaaaatgaagaataagacgttaatcaatggccccataattgatttaccaatctgccgaccggaattaaacacttgtagtttactgagttctggacgttcctgtttgagtgtcgctaatgaagcaacaatatccgttgcctcatccatcaccgctcccaatacaccgatcaagacttccgccaaaaataatggtttgggaagttgggtaacgtactgcatcgattcatagtacatccccttctcatgtgtgacgccaaagacaagtaatgtcagtagaatcgtaattgctgtcgcggaaatgaccgcagataaagtaaccaacatttttcgattccaacccatcaccagaaataacgtgattatacagaagataacggccaaaatactaaagattggaatcactgctgcaccattgttatgatgatctatcttgacagcaagccaaaacaatatcgtattgatcacaatactggaaatgacggtaacacctctaaattttaaaataataaacaataggctcaccgctaatgccagcaaaaagataatcggtgtgtcacgctttaaatctttaacggttgcgtggagcttcgggcttgtatgtaaaacaataaacagtttctggttggttcgatattgatggtccattgctccggaattcgaataagcattttggatttttaaatgcttaccggcatactttccattcgtaatatgtcccgataatagttgctgatgatagtaatcaacattatgaaactcatcggacatctttgttaccttaccatttgtcaccttggtgacctgaaaaatcggttcagaatacaaactgtcgtcatgagcagtcagaaaaacggccactagacaaaaaataacaacgattaaaacttgtatccaagtcatcctgctctttaatttaaaagccatggtccacatcttttcgctagaaattttagggctattgtaacattagtcattttgttgtgggaaaccgtgacggaatattaagaaaaatacaagagtcattctaaaattatagctcatcataagcattcaacggacgcatttatgaacacttttataaactcaaaaagccgggacaaggcctgactttgtcccgacagtaaaattatttcaatacaatattagtctcttggataatcaataaccatcacattaactgttgaatgacggacaacgtaagcagttgttgaccccagaattgctcgtgaaatgccgttcacacctgatttacccattacaatcaaagaagccccgtattttgcaggtaaggctttagaaatttgaatcttaggaacccccacaacgaaatgggtttcaacttttgcgccaagcttttccgcttcgtctctggcatcatccagaatttcttcagcccgttcctgaaatgattgcatgacatcttgccccaatgttaccccatattgaacatagcgttgatcacttgctacggaaacgatttgtaacgttgatccgaatttatttgccaatttagctgcttcgctcacagcccgtttagaattatcactaccgtcaacaggaactaaaattgtttcatacataaacagccacctccaattttcattttacaactaaagtttaccatttaattattgcagcaacctctattaagttcgtagaaatccaaattattggaaacgctcacaaagttatttataatgaatgtgatttcactcaccaatctaaggaggaaaatgatgatggatactcaattattaatgaataaagttgcgattatcactggtgccggatcaggaatgggggccgcgatggccaagctgtttgctaaagagggtgcaaaagtagtcgctgccgatttgaatattgataacgctaataaagtcatcaaggatattcagtcagatggctatgaagcagccgcaatcaaagtcaacgttgcagatcgccaagatatttcgtcaatgtttgcatttgccaaagatcattatgaccacgtagacatcttggtcaataacgccggtattatggacaacatggctgcaattggcgacttggaagatgacgaatggcacaaggttatggctgtcaacacagatagtgtgatgtatggtatgcgggaagcaatcagggaatttcttccaaagcacactggtgttattttaaacattgcgtccgtcggtgggacaaacggcgctcgtgccggtgcggcatatacggcatccaaacatgctgttgttggtcttaccaagaatacagcctatatgtatgcaaacgagggtattcgggttaatgctattgcaccgggtggcattcaaaccaatattgcccagacaatgggaaatataaatgagttcggtataaaacgccaaatgaccgggatgcaaacctcacccaagcccggtagtcctgaagaaattgctgacacagcacttttcctagtttccgacaaggcagcctatatcaatggtgctgtgttacccgttgatggcggttggacagcctactaaagtcatcattcaattaaaaaatcttttttatatcgtctaaaaagaggtggacaattgcttttgtccacctcttttctgtttgttattgcactaattgtgcggttaaattgaattctttcgatcaggtatcgaactcactcaatattaagatgtttcacaatttctttattctcttgaagttcctgtcgccgcttctttaatcgctcctgatagttttttaccaaataaacctcttcggcagtttccggtattaacttgggaaactgaacgtcttcaagtgggttggtcacaatcagcgtacaaaatgacataaacgccagcttggtttctttcgtttgtttattatatgcttcaaacttgctaaatacctcaactgcttttttatcggcaccggttacgtatgatgtgcacttactaatatcgccaggagttaaaggtgccagaaattgcgtatggtcataacctgccgtcacaaatgataaatgactcggcaaaaattttacacccgacaggccggcattggcatcaaggatctccaatgttcgcccaccaaattgaatttgattgttgttcatgtccccagggaaaatatagctttcgtgaattgcagctgtttgggcacaggtaattgtttcaacgataataaacgcctccggtcaaatcgattagtttctttattaatatgatacccttttcattagtgtgatggcaacaataacaggtgataaggatcactttgtgaatttaatattacaaatacaagcattttattgttagcgctttctcaaagatgtaaaatgtatctgtacagagaaaataacattttcacttaggaggctcatatcatgaaagcagtacgtatttatggtgaaaaagatattcgtgtggaagatgttgacataccggaaccaaaagatgatcaggtacaattaaaggttaagtattgtggtatttatggtagcgacttacatgcataccttgagggttggggcttgccaactgtgccgtacccattgaccggcaaaacagtaccaattacacttggacatgaattttccggtgaggtcgtaaaggtcggaaaagatgtcgacggactacaagttggtgaccatgttgctgtagagccattgcttgcctgtggaaaatgtgaaaactgtcgtgcaggaaactataatttctgtaaccgagctgtttcaaccgatggcgccggtaacttcttaggattttcagaagatggtggaatggcacaatacgcaaacgttcaaggtgtctttgctcacaaattaccagaagacatgagttttgaattgggcgctttggctgaaccaacagccgttgtttacgaagccgtcaagaagagccacttgcgagaaggtcaaagtgtcgctgttatgggagcaggtccaattggattactccaggcacttttagctaaaattgccggtgcaaacaaagtttatatcgttgatgtttccaaggtccgtttggaaaaagcaaaggagctcggactgaaacatgcacttgaccctactcaggttgatgtcgaaaaagaaatcaaaaaagattttccaaacggtgttgatattacatttgagtgtgccggtgttcaagccacctttgatactgcattgaaggtcacaaaacgaaccggtaccttacaagtagttgcactttatgggaaaccacttacaatgaatatgacagatgatttaattatgcaaggcctcgatatcattacgacgctttgctacaacaattcattccctaatgttttaggaattattgacaatcataaagatttgttcaagaagatcgttacaaagaaagtcagcttggatgatgcattggatcaaggaattaaagccttggcaactgataaatcacaagttaagattttgattgatccggcattataatccggctttccctgaacaattgtagaaatacagaacctcacccttcctctaagcccacttcctggttctgctttggtggaagggcaacagataattattcccttatgaaaaaattcaccgacagctactttgtcggtggatttttttcaatagtgacgttattcttttgataacttcttctccatgttaatatcggttacttcaaatccactttcccgataaacatgaattgcccgcttattactgccaaacacatgcaacgccatattcttaaacccgatttttaaagcctcattaccggccaattttaaagcctgtttgccaaatccctgatcctgatactgcttcaatatttgaagatcgtaaataaacgctgtttccgggttatccgtacttttagcaatccaaataacaccaactttggtttcgttatggtcgatcctataaaaataattgtccggtgttgctataccattgggcagtaaacgctgatattcttcacttgcccgctgaaaggccagttgttcggtccaagtccccgccttaattttttctccggcatagtcggttactgctgtcgacaaataagtatcgtaatctttttgggacatagcatttaatgtaatcatagaatccctccaaatcaatttaatttccaataaagatattataacagtcaaaatgcgtcaatggcctgtcagctttcagatgataaaccgaaaccaggctatccacgcattttttacgtcttttaagcaatgacacttttaatacaatcgataaaatagctcgttaaataacgtttggttaataccgtttctacttacatccccaaaaagattcttaaaaatcccagtgaaataacgccgactaccacggtgaccagcaaattttttgaaataacggcactcaaaaccgtcggtaaagaagctagtaaattagggatattcagcgatggcagctgtcccaaatgttgtataaataaattttcaaaccacaaagctgacatgatcgcaattggaacaaagctcaaaaattcaacaacacccgcggataacttgaatttttttaaaataacaaacggcataattctggatagccaggttgctattccggatcctaaaattgtcaaaaaaacaaaactagaagaaggcatgcttcatcaccaccccaaacgcacaagctaataatgttacaaccagcgttaacagatttgccggaataaaaataatgccgataaaagttgcgactaaaacaaaaccgaccactagcagctgtaatttgaatttgatcgatttatcactaatcagctgcaagtaaagaagtcctataaacatcgaaaccagggcaaaatccaagccgaatttttcagggttactgataaagtttcccaacaaagcgcctaccagagacgcagctgcccacgccaaataagcaaaccagttgaccgtattgaaccaggcaaaattcagttttctgttagtatagttcagtttattcattcccagggcaaagctttcatcggtgaccagcccacctaaaatgatgttctttaacaggctttccttttgaaaataaggtgccaaggttgtactcatcaaaatcattcttgaattaaccaaaaatgccgataaaataatcgacaacattggactatgtgtgacaagcatactgacgatgataaattgcgacgcaccaccatatgtaatcaaagacattaacgtgatcatcagcggactgattcccgaggctttccccacaatgccatatgccaagccaattcctatgtatccaaatacagtcggcagcgtttctttggccgcacttgaaaccgttaactcattattcacgcaacatttcccccattccttaattattgttgaacgagaagaccggattagttgacttctatcccagctattgtttaaaataaaagacgaaagtataatatattaaacattaatggaattttaattcatttttcatcttatgtcaacactggctgggggcttttttaccatggatatcggcgcaattgtcagcacaaatctaagaaaaatccgacttgaaaagggattcagtttaactaaattatcagaactctccggtgttagtaaagggatgctctcacaaatcgagaataacgggaccagtcccaccatcaacacaatctggaagatttgtgccggattaaacgttccttacaccgcattgttagaaggacgtgttgaaacgaccaaaattatcaaaaagtctgcaatcaatgaacaaaaatctgcagatggtcactatcgtatttattgttattatcccgattctccccatcataattttgagctttttcaaatggaattggataaagatgccagttatacctcggtaggccactccaaggtcagtcgggaaggccgttcggaagaatatattatggttctatccggccaattgacactggtcgttggcggtgatcagttaatcctaaacgaaaatgacgcaacccgctttgacccaaccggtaaacacatctaccaaaactccggaaatcaaattttgaaagcaactatcatcaatttttatccggtttgaaaaaagtttcatcaaatttgaaaatgggcttgcactctttcagattttgaaatacaataatgttccctgaagcgcttgactgacttcagaggacattgtttcttcaaccaattcttgaaacggaggcatttttatgactcaacaaagtatggtgacccttcatccttttgtactgaaagtaagaggcaagaaagtattgttcgcacctaattatccggaagatgcccgtagacgctttgttaaacttaagaagcgtgcggataaagatccatttgatacggatgctgaatttgatttggcaattgaagacaaattaaggatcgatgcattgaacagttactatgaagacctcgacgagaaagaagctttccgcgccaaggcaggttgatttaaatcgacaaatttagctaatagactcattcaaaaagtgagggactggacaagccatattttgtccagtcccttttaatgtcccactcttttgtcactaggacttaataaacaacatcattccaaatacgatcaatagaccatatacatatttgatcattaacgcattgtcaatgtggtcagtcaaccaattaccgaatggaatcaccaaaaacagaagtggtgtaacgattgccagtaattcaaatacttccatgctccaaaacccggcaattgcttgactggcaactactaaaataccaacgcacaaaaaatgggcttgaagaatgccacgaagttccataaccggccacttttttaaagtcccgtacacaacaatcgggacaccatgactgttataagcactgcccatgacaccggaaatcaccccggctacataatcaaagaacaatgactgaaacctcggcttatttgtcttttgccgataaattcgaatcaagcaataactgccgtaaaccatcaagaaagcgcttaggatccgcataataatggttttatcaacgtatttaatgagaaaaataccaaccggaacacctaatattgatccaataaccaatcttcgaacaattgcaacatttatatgtacgcgatatcgaattgccccaggtaatgcaacaatcaaccctaaggcaccgatcaaagcaaccgatgtatttaaatcaaaggaaatcagggccaataacggcatcgtcactaaagcttcaccaaatccaaatacagtgcgcaccaaggcgccaaataatgcaattaaaactaccaagaataaaatcatatcgttttctccaaatcaatttatctttagccattattgtcagtatacaggaaacaactaccaagcaagctgttttcagctaaatagtggcagtagtcaaaaaagatcagagcaaaatgactttggccccaatctcttcaaaatattatttttaatggttattttcaaaaagcagatttataacattctctgcctactaaacatttgcttttttgtctttaaaatcctgccaagcttttaacccggcatctgttaacccattaacagagccaccatcacttttaatgagacctgcatcaataagcggacgcggattaccaccgattgcgttatcgcaataatcaacaaagtgactaatcagtgtaccggattcaactcttccggatttaatggcgtttaaaatatcaaaatcagtttgtgacagttccatgattcaatagcccctttctttttcgagtttcattataaacgaaacaggccaagtcggcatcataaacgtcttgattcatcactttctgtgattggcttcccaatccttgatttgagctaatcggcgcttaaatcggccttcattgccctgttctgtcggttcatagtagatatggcctaccagtgagtccggcattgtctgcatcgttgttaatttggctttagactcatgggcatactgatatcccttaccatagccgagatcggacattagtgatgtcggtgcgtttctcaattgcaatggaactggttcattgacagaatgcttcacatcttcggcggccttcaattttgccttataaaccgcatttgatttcggtgccaatgacaaataaatcacagcttctgttaaatgaacatcgcattccggcatcccgataaactgacaggcctgaaagacattaacggcaacgtttaatgcatttgtatccgctaaaccgatatcttcactggcaaatctaaccaaacgtctggcaatgtataaaggatcctcgccaccgttcatcattcgcgataaccagtaaacagcggcatcagcatcactatttcgcattgacttgtggagtgcagaaatcaaattgtagtgttcctcaccacttttgtcatacagaaacgatttagttgccatcagctgatgaagattatcggtagaaaccctaatacggtcaccggacttctcgctattattcacggccatttccaatgtgttcaaagcaattcgggcatctccgttggcaaactcggcaatttgtctgatcgcttccccatcgatttctacatgctgcttggcaaaaccatccggatgaaccaacgcatgcttaataagttggataatgtcagttacttgaagcggttgaaggacaaacaccttacagcgtgacaataaagcggcattgatttcaaatgacggattttcggttgtcgccccgattaacgtaatactgcctttttcaacaaacggtaaaaaagcatcctgctgggccttattaaaccggtgaatttcgtcaacgaagacgattgttttaccacccatgtcccgattggcttcagcgtctttcattaactttcgaatatcgcgaatgccactggtgaccgcgctaaacgtgacaaactttgctttagtttttttggcaatgatttccgccaatgttgttttcccggaaccgggtggcccccaaaaaatcattgacggcaattgatcactctcaatgatttctcgaaggaccttccctttcccaagcaagtgttgctggccggcaaagtctgctagagtctgtggtcggacccggtaggcaagtggttgggtagcaagatcgttcgctgcaaataatgattgctgtttcacagtgacacctccaatacgacaaaactaatgattcacgtttcattatatcactttttagcgaacgttcgttcataaatagctacttgcagagatgtaaaaaaagcccccacgttaacgtgacgacttttatgaaaaaattattttataaaagataatccagtttcaaaattaggcgatcaaatcagctgccatgtggaatgcattggcaagtgaaacgcctttgcttgcaaaccgtttgttaagcaataattgccgaaagtcctcaatggtaacgtgttcggtatccttaatcggcatcccttggccactatatgatccggttgttagggtcacaaccaacccatcccggctgtccaaatgaatgtcgtaatcctcaaaatagtacgagtcatcatagtgacccttcatttctttgtgacttgaaaaataatccttgataaagtcttgaaaggcttcctttgacgtcaatgatttcttccattgctcttcggtttccttagccataaaaagactccctttcttttctctttctcttacaatcaaagaaccgtgaccttcgatatgtaaatgagtctctcttctcatctactaattttcattgtaatcaggttatggtcaattgcaagtgaaaaagtcaataaaaacgttaccagtatgctttttctgaagtttttaacgtttggataaaagtaagcgtttttacccgtaaaacattaacaatgagttataataaaggtggaccggggtaatggcattcagcctttaagggggatgaacatcatgaaattcaaccataatttttacaaggaacctgtcttctggggagctttattcttccttgccatgtttatcacaatgctcattgacaaaatcacaggcatgtacaccgttaactggtggttggctttattaacggttatcttggcaaccggtggcatgctttacgggtttttaaaagggatttatcatcatcatgatgatatgaaaaacggcaaaatgttgtaattactgaattgataatagactagtaaacaatatagaagaggcttttcagcctctttttctcgttccgttagtgaactgaaacgtggcccgaaaaatggctccggccatatatcaactatgctaaagaacagcatacttggtcaagactgtcaccaagccgaaacgtgctccgccaaccataagtctgcatgtaaaggggcttgcatcgaattccaaattcaggaattcaatgcaagcccctttacactccgacttatcccgggttggctccgcactctctaattcttttccaactcatccaacgcgctttccaactgttccttacttgccgcatccaaatccgggtacttcagtggtaattctttcattctgtgatcaataatgtccgaaacacataaacgcgaataccatttatcatcagacgggataacataccatggattctgctttgtagccgtcttcttcaaagcggtttcgtacgcgtctacatagtcatcccaatattggcgttccttaatgtcggcagctgagaatttccagttgtgatccggcatctcaatgcgtcttctaaaacgatttttttgttcgtcttttgacatatgaaggaagaattttaagaccatgaagccattgcgggtcatatagtcttccaagaaattaatatcctggtatcgaccctcaaagaaatcatcatcaacctgctttaattttgtcacaccgccaatatgagcattcaaaatcaattgtgggtgaactttgctgaccaaaacatcttcataataagaacggttaaagataccaataatgccacgtgacggcatatgacgatgaacccgccacaaatagtcatggttcaactcaatcgaagtcggcaccttaaagctggtgacttcacatccctgcggattaaccccgcttaaaatatggcgaatcatactatccttaccagaaccatccattccttgaaaaataattaaaataccaaaccggttttgcgcgtaaagtttcccctgcagatcctgcagcgtcaggatattgctgtcaattcgagccttaatatccgttttactcaaattttcgtcgattgcagcggttggcttcttgcttaatttaaaattactgccaccgttatagcgaaatgatttttcacgatcaaacattttcttattgtccaaaacctaatccctcctcttactatcgatttaaagatagcacaacgaaaagatatccgtacaaatgttgcctaaatacttgaacttttagctaaacgcatgatcacctcaataaaaaaggtgatcaggaaaatcaacatataaattccgcaaataaaatcaacaatatatacgtatggatttttaagaagccactctaatggccaacagataagggcaattgtagtaactatgccagcgtatcgcatcaggaactgaaaccattttgaaaattgttttatattcggcttttttactaacactgttgtgtcctcccttcgttaaaacttaaaacaacatatttagcttgtcaatatcaaccgccatcaagcattagctgactgattagtagcccggcctacacaaaattgttaatacactattaattcttcacgaattaatttttccctaacaatcgctttgaaaacctattctaatgacatatacttatttcaatgaacattagacagggaggaatcagtttgaaaaaattaattgttaaagcaaccgaggctgagggcggagacgctaatcagcctactaatgattctatcgacaagtcattattaaaagatgacctctatcaggccgttaacggcagatgggaaaagacagccaagattcctgccgaccattcttcgacgggtggttttatggatttaaacgataacatcgataaagaattgatgcatgatttggatgatctcaaggccaaaaataaagacagctttgaagcacctttctcagaaatgttaaaattatacgaattggcccaaaactttaaaaaacgggacgcagacggtgctgatccgttaaaaccttatttggaaaaaatcgaaaatatttcaaattttgctgatttaaacggtcagcttgcggactgggttaaaaccggattcccacttccgtttggtttttttgttgaaccggacatgaaaaacacgcaggtcaacgcgctgtttgcaaacagtcccagcctatttctaccggacagaacttattacgaaaacaataaccctgcctacaatcaactcatgcctgttttgactaaaacactgagtcaattactcgtattggctgactatagtagtaatgaggcggacgagattgtggagtcggctaagaagtttgatgctgctattgctccccatgttaagtccgcggaagaatctgccgactatagcaagatgtataatccgcaaaagttctcagagtttgctaaatcaagcagtcattttgatctgaccaaattggcagacgggctgtttggaaaaacacccgagcaaattattgtcactgaacctaaatattttgaaacactcgatgagattgttaatgaagacagctttcaagacatgaagaattggatgttggttggcacgatctattctgcaacaggctacctttcagaggaatttcgacaaacaggatccacatttagtcgggcactttccggtaaaaaagaagcaacgcctcaaaagaagtcggctttctatctggcaaccggtacttttggccaaacaatcggcgactactacgcaaagaaatattttggaccaaaagcaaaagctgatgtcgaacacatggtgcgcaacatgatcagtgtttataaaaaccgccttcaaaataatacttggttgggcgaagacaccagaaagaaagccattgttaaattaaacaagcttggccttcatgttggatatccggatcatattgaccaactcgaatataaatacaaaatcacaccggaaaatgaaggtggcaatctgttcaataacatgacccggattggtcaggttgctttggctgataattatgccaaacttggtcaacccgttgaccgaaccaaatgggaaatgagtgccagcacggttaacgcttactatgacccattcaaaaacctgattgtctttcctgcggctattctgcaagcaccattctatagcttggaccagacttcaagtcaaaactatggcggtatcggtgccgttatggcccacgaaatttcacacgcctttgacaataacggctccttattcgatgagatggggaacctgaacaactggtggaccaaggaagatcatgagtacttcactaaactggctgataaaatgattaaggaatttgatggcattccttttgccggaggtaaggtcaatggtaaattaactgtttcggaaaacattgccgatgcaggtgggctcagttgtgccaacgaagccgcaaagaacgaacaagattataatctttatgacttctttattaattgggcaaaggtatggcgaatgaaggccacaacccaatataaacagttgttactaaacatcgatgttcacgctccagccgaattacgggcaaatgttcaagtcaaaaacctggatgacttttactcaacattcgaagtaaaatcgggagacggcatgtatctcaagccggaagatcgcgtaaaaatttggtagactttctttaaaaaaatgatattattttcaacataacccaaaagcagcagagaagccccgacattatccgtcttggtttctctgctgtttaatttgaccaataaaatatatatccgattagcattatcaggacttctaaccggcagctaataagtatttcgaacccgcttgacgagtttttaaaataatcgcataagcaaatcaagcaactattcagtcctaaaacagttggttcatccgcttataaatgtgacacacggccgctactgctttctcttaatatatgattcaaccaagccgtataaggcctccaaaaacatcccgattaccatcatatacatgaccaccatgctttgaccagtgtataataagattcccattactaagtaaaataaaacaaagaaccattttaaccaaatattatcaaccatcatgaacccacctccttactattcaagaatagttctaacacaagcctatttcaaatgtgacttttagaaaagtatgctatgatgaagttgttcatcatttaacatgatttttaaatatcgttcatttaattttctaatagggacatgagatcatattcatgtacactttctataaatgatatataatataaataaagagaacctgtgaggtgatcatcatgaaattaacagaatatcttcatgatcaattaaaattcttaaatgatcaaatgagttcagcaaaaaaagataaagacgaaaccatgcagtacttggttgattctaaaattacagaagttaaattgattctggaagcactgcaaaagggaatcatcgatgaagcatagtcacgaggttgaggcgaaacgaacgttttgttgacaacctcattttgtttggtctattattagcctcacgattctaatcaactcatttcggttgcagaaatgccactcattgtggtttaatcgactatagtatgaatttattcagtaaataattcttaaggagcaaaacgaatttgattacattaaaatcaccacgtgaaattgaaaaaatggctgaatccggaaaagtcttagctggtgttcatttgggtttaagaaatatgattaagcccggattggacacatgggacattgaagagtttgctcgtaaatatatcaaagatcacaatgcctatccttcagaaatgggctttgaaggctacaaatttgcgacctgcgtctctgttaacgatgaagtagcccatggtatcccacgtaagggccttatccttaaagacggtgatatcgtcaaggttgatttaactgttaataaagacggctttgaaagtgattcctgctggtcatacgctgttggcgacgtttcgccggaaattaaaaatctaatggacgttacccgaaaggcattgtatttgggaattgatcaggcggttatcggcaatcgtctcggtgatattggtggcgctattcaaacctacgtcgaagatgaacatcacatgggcgacgtccgtgagctgatcggccatggtattcaaccaaaaatgcatgaagaaccaaacgttcctgcatatggtgttcctcacagaggtcttcgtttaaaggaaggcatgaccattaccattgaaccaatggttaacactggtacatgggaaattaaagatcgttatgacaaagcagatgattggacatactacgtttctgcagatggtaccccatcggctcaatacgaacacactttggcaattaccaaagatggtccaaaaatcctgacaatccaagatccggatattgatgaaaagtatatttaccataacaattagtttttttgaatgacgaaaagccgggtgcaaaattttatattttgtcccggtttttctataacttggaggctgatattaatgaataataaaagttttaaattcccggacacaaaagcatataactttgtcattgaggcgctaaaggaacgtggcgttacccctgatgatatctcaaggattgcaattaaccttcaaaaaccatttatcccaaacctgtccatggaagaagttcgaaaagacacaaccaacgtcctgcacaaacgggaagtgttaaacaacgctatggtcggcctggaattagatcgtttagcaaccgcggggctcattaaagaaccactcgaaagcatcattatgaatgactccggtgtcttcggtgtggatgaaggcattgcccttaacattgccaacatttacggtacaatcggaatcaccaattacggctacatcgatagagataaaaccggcgtcgtcaaaaaattggacgagtcaaaaagcggcgcgtccaatacatttattgacgatatagtaggtgcgatagcaagcgcggtctcggcaagaattgcgcatagaaataactagtgtgtggaacaaagcggttagtcttcggagcataaggcgttcatttgggaaatcctgcttttggatttttcaaatgaatcccttatgtgcagaaggctgctttgaggaacagtcctaactagtgtgtggagtcagcctggtacaagtcggagtacaaagcaagcggcaggaaattcccggtcttggaatttttgacgattgttttgtatgcaggcttgtggctgacggaacagtcctaatcagtgtgtggaacaaagcggttagtcttcggagcataaggcgttcatttgggaaatcctgcttttggatttttcaaatgaatcccttatgtgcagaaggctgctttgaggaacagtcctaactagtgtgtggagtcagcctggtacaagtcggagtacaaagcaagcggcaggaaattcccggtcttggaatttttgccgattgttttgtatgcagacttgtggctgacggaacagtcctaatcagtgtgtggatcaaaacggttagcatcccttatatggagagatgctgttttgagtagccgttctacttccacccgaaatcactcaaatccatctctcgtttctttataccggaaacaaacggatttccttttacaaagtatcttaatggcttgcttgcccaatccccctggtttgaaacaccgactcggttcgaggtttcgattaccttggggatttttttacgattttgattgatatcgagattaccatctccaaagatctcaaaattcatttttttatcggagatgccaaaagcttccattaatttaccgggcccattcgtcaaatcaaaaccacttttcgatcgattttccaacatgatttctttgccaataaacggctcaaccgcccttatcagaactccttggggaatatctttttgttgggccgcaacatcaagaaggtacctcccatggatcgaatagatgtaaactgtacctggaggaccatatagtggctcattagaagcagttcgccgtcctttaaaagcatgggctgctgaatctttttggcccatgtaggcttcggtttcaacaatccaaccgccaaccactcctttgggtgagttatatgtaagcagcatccccaacatttcctgagcaaccttatctgttgaggcactggcataaaatggatcactggtactcaaattatcacagctttcaaaaattatttaggaggaaatttcaatatggaattaaagcttgaacgaatctatgacaaaccgcaggacttatccggttaccgggtattagtagaccgattatggccacgtggtatttcaaaagttaacgcaaagctggatgaatgggaaaaagagattgccccttcaaaagacctgcgttcctggttctcacatgatcctgcaaagttccccgactttaagaaaaagtacatcgatgaactcaatcataacgagcaaacccaagcctttatctcatctttggccgataaactcaaaacagataacgtcatcctgctttatggcgcaaaagatcgtgaacataatcaagctgtcgttttaaagcagtatcttgacgatcacttagaccaagcctgacgaatattttcaagcgttaattcacgagtgctttgaaaattaatatccgcttcatgaagtatttgaggatcaccaacgccaattgaaacaatcccggcagcattaatcgattcaacaccaacgatgccgtcatcgataccaatgcaggcttcaggaggtaaatgaatcatttcggccgctttagcgaaaacgtcaggagctggcttgttatgtttgatttgcttcaaatcaactatgagtggaaaataattttccaacttcaacttttggatttctttaggtgcattcgccgaagcggacgcgataatcattttgtaattattttgagtcaattcatccagaaaggattgaatgcccggtaaaatgtcacttggattcattttatccagcattgtttgataaatgtcgtttttttgatcagccagtgcttctttttgctgacgggtaaattgatcttttttcccagctgaatcaagtatggcatccaatgaatcaattcggtcacggcccttaatggcttcttccaaatcagatgaccactgaatgcccaattgggctgcaatttctcgccaagattggctatgatatgcccaagaatcagttataataccatttaaatcgaacaatacaccctttatttttgcaaaatcatccattgttatacgcccctttcacccagtcaggtatcaatctctttatatcataaaacgaggggaagaaaatagtctttcatcttctcaccctcgttttataataacagttaatcttataaccgtgttatttaaccgcgttaaaaatccaagtaacaccgtacttatcaactacctgaccgtatttgttaccggacgacttcttttcaaatgtcacaatgactttcacttcttcagatttagcaacctgcttgtaaagattttccaacgcagattccgcatccgaatcatgagcgtcaacctccaacattaaagaaatcaaagaagaaataaccggtttgcctaaaaagctgtctgcagcaaagatttgctgatccagcaccttaaaacttgcctgcaaagttaaattatcgaggttaacgtcagcatttagtgacatttcctcagcctgcttttcagttggtgattcacgagtaacgtctgttgcaccgaatactcgcttataatattcgagcgcatttttagtgttttcaaatgttaagtatggaattaatttcgtattagccattaggtcagcaacccttactattaagatattattattttcgtaaattatgttcaaattttagaataccgttaattacattagttgtcaacgttaacaagtcatgcatgctgttaaaccagctttcgtcaacgtcaacatgctattattttacaccgaaaagagtaaactatcactaaagtcacttgggagggatcgttcaatggaactcgcagtcacaatttttattttaaacgcattatatatttcaattaacacttttagaaccatgctggttgttaaaggccatcaatttttagcacctttagtagcggttggtgaagaattaatttacgttattgccttagcaatcgcgctggatcatatcgatagtccgttaaacgttgcctcatatgccgttggatttggggttggtatttacatcggtatcgtcatcgagaataagattgcattgggatacgttaattttcaggtgacggttcaaattgatccggagaatccggtccatgcacacaatgaagaacttgccgaaaagcttcgcaacttgggatatggggttactgtcagccgcgctgaaggccgctccggtgcccgcttagtccttagtatcctggcaccacgaaaggctgatcgtcgtctcatggaacaaatcaaagaaatttcacctgacgcgttcatcatggttcaagaaccggttcaattatccggggggttctggagtaaagaagttgatcgtcgatatcatggtgcaaataatcactgatctttatgatcatcaaacagcccaagctgctttaggctttcttcaacatcgtgaaccgatttttcaacttcggatgataatttttccggagcctgtttctcaggattaatactcttcgaatccaatctaattttccgcttcttgctttcaatatgatgtgaaggctttggagcggttttttgatccttaggatgtgtaactttaagttttggcagggcgactttatcagtcgatcgtgtttctttaggtgccatttcatccatagtttgattgagtaaatggtcaacaaagacattgccttcattactggcatgcccttttgtccagtgatagcgaatgttggaaaaccgttgaagaagtgcatcgatctgctgccacaattctttattcagcagcggaccgccacttcgtttccaaccacgacgccgccagccagaaagccacccctttgtgactgcatccaacacatatttagaatcagaaacaatgctaaccggctgctcttctaattgatgatctgccaagtaggtcaaggctttcagtagtcccatgatttccatacggttgttggtcgcaccatattcaccacccgtatcggaaacttcctgcttggggtttgcgattaatataagataagcccatgctgccttgtctccctgcttaacgtgctcacccgagcggttgccatgacttctagatccaccatccgtatagacaataatgtcatcaccaaaactcaattcaatcggtcgatttacagcgacagagctttttgactgacgtttcgaactattttgatggccttgaatgctttgtttgccagttaaaaagccctctgcttccgactttgacttaaaacttttatattcagcgcccgagaaaccggaaacctgtttgcttgtttcatcccaagttgtaaagatgccggtctgacggccctttctaacagcgtaatatttcattttctcacctctaaatttcataaattttcagaaaaaaatacttataatatttctatctacttttcaattagataaatctatgcgaaaatagtaagtaaagggggcaaagaccatatgacccgtaccaaagccacattaattacggtcgaagaagcaaaggcacttcttaaagaccgctcagatcaaatcaatgaacgtttccctagacttaaaaaacaagggaaatacattctgcccgattatcgactcacgagaaaacgggaagcctttaaaatccggaagcatacttttttgcaacgacacccacgctcttatgttgcttttgactcagaaaatggacaaacgttgtggatgcataattttccaagcttaaccgaagcaattttctggttagacaccggccttaaaccaaccgatacggataccagtacatcgtataagcagtggaaaacccagcatgaagacgatattaacgtcttaaaagaaattctccgtaaacgttcgcaggaaagaaaagcggctgcagctaagagaaaagaagcaaaaaaggttaaaaaataagtgtgtgaatcaaagcggctagtacccggaatataaggcgtcggttgggaaaatcccgttcttggatttttcaaactgatcccttatatggagtggtactgctttgaggaacagtcctaataagtgtgtgaatcaaggcggttagtcttcggagcataaagcgttcatttggggaatcctgtttttggattcttcaaatgaatcctttaggtgcagaagactgccttgagaagcagtcctaataagtgtgtgaatcaaagcggctagtacccggaatttaagccaatcgatcttatttatagcatcactttaccactaatcaaccattaaccacactaagcttaaccctgaaagcaatgattgttttcaagatcaagcttagtgtgctttttatttaggctttttatttaggctttttatttagtcttttctagaagcaagcctaaatcttcaaatgattatgaacctgctttggttctgtctgtaccaaaatatcaccatgatgaatcgaatatagaatctcggaacgctcattcaatgcattataaaaattatcgttattcataataatacaattagcaggcttgccttcctcaatgccataatgatctgtgatatgcattgcttttgctgcattggttgtgacaaaccggtatgaattcaaaatatcgttataacccattaaatgtcccacgtggattcccatctcaacgggatcaagcatattaccattgcccattggataccagggatccttaagatcatcttcaccaaaagcaacgttaatgccatcctgagataattctttaacccgagtcattccccggcgctttggataactatcaaaacgaccacccagatttgtattgaccagtggattcgcaataaagttaatgtgagacatttttaacaatctaaatagtttataagtgtaagcgtcattgtatgagcccatggccgttgtatgactggcggttaccttgtcacccataccggactccaaggccaaagttgccagagtttcaaggcttcgtgactgagggtcgtcaatttcatcacaatgaacatcaaccaatttgtttttggtttccgctaatttcatcaaaaatttcagcgattttacagcatattcacgagtaaactcaaaatgaggaatcccgccaatggcatccgcacccagttcagcagcttcggtcattaattcctcaccgtgcggaaatgataaaatcccctcttgcggaaaggcaaccagttgcaattccacctggtccttcaattcttcccgaacttcaatcaaagcttttaaagcggttaaatttggatcagtaacatccacgtgactacggacaaactgaatcccattggcgacctgaatttgaatggcctttttagcacgctgcttaacatcagcaatcgacagcgtctttttacgttcactccaaatacgaataccatcaaataacgtaccggtttgattccactccggatcaccggcagtttgcgttgcgtctaaatggacgtgtggatcaacaaacggtggcagtaacagtttatcgctggcatcaatcacccgttctccttcacttgcctgaattgatggcgcaatttttacaaatttcccatcttcaattttaacatcgctggttgcttgagcattttgtatatgaactttttttattaacatttttccattcctcaacttagcatgtatttactcatattatagcctatttaggctataaataagaaggtttccgaaaaatgtgcgataatgtgaatagtcatacatagatcatatatcaagaaatatttttgaagggaagtatcacattgagttggaggggaaggctttctttaccgcaaatcttaacactgggctttttaacgatcatcttagttggaaccgtcctgctttcgttacccgtttcaagtaaagatggcacagcaaccagttacatcaatgctttttttaccgcaacatctgccacctgtgttacgggaatgacggttgtgaatactgcacttcattggagtatttttggtaaaatcgtgattttgattttggttgaaatcggtggtttgggatttatgacctttgccgttctaatgttcatttttatgcggcgaaaagttgatctgacaacccagctgctgacacagcagtcgttaaacctggaaacttttgccaataccagaagtgttgtctttttagtggttcgactttcgctggccattcagcttttaggcgccattttattatttgttgatttttatccgcgttatggattgaaacgcggacttggttacagcattttccactcaatcagtgcattctgtaacgccggctttgacctgttcgataacagtctggtcagatttcaaaacgatccttacatcctatttgttttaacctgcttgatcatttccggatcattgggctttttggtttggaaagacattttgctttaccacaaggatcacttcttgagtcttcatactaaactggcattaaccacttatttgggattaattgtgattagttttgcggtttatttactcacggaaggaaacttcggtgaaaatacccacttaaatgtgtttcagcgtttaatgaatacctattttatgtctgtgacaccgcgaacagcaggtttttacacttatccatacaccaagatttccatgggcggtatgttctttacaatgatcttaatgctcattggtggtacgccggggtcaactgccgggggtattaaaacaactactgtcggcattcttttaattcgagtctgggcaactttgcggggaaaacgggacgcaacctttatgggacgccgattcacaaatgacaacatctcacgttcgctaacgttggtcttcctggtttttgttgtcctctccatcgcaacgcttgtcttgaccatcaccgaaaccgtgccaaaacatttcggaattgaatacattatctttgacgtcgtttcggcatttggtaccaccggcttaacacttggattaacccctcacctgaccattatcggcaaattaatcttcgctgttttaatgtttatgggaagagtcggtgtcttcacggttatgtactcgttactcacatccaaacgtccggaagacgcattcagatatccaaaagaaaatgtgatgattggttaattttgattacaatatccagtcgttcgaaaggattttaatcatgaaaagtaattacgctgtgattggcctgggccttttcggtagcagcattgtcaatacactactcgaaaaccatcaagaagtcctggtcattgataagaaggaagagagtgttgataagttccgagacgttgctacagaggcggtcgttgccgatacgcaaaatgaactggcactccgccaactcggaatcggaaactttgacaatgtttttgtggccatcggaaccgaccttgaggccagtattatgaccacattgatttgtaaagatcttggggtgaaacatttagtctgtaaagcagagaatgcccgtcatgctcaagtattggagaagctgggtgcagacgaaattatccaacctgaacgcgatatgggtgaacggattgcccttcacgtgatggagccaaagattctcaacgatttaaaactaaagggtgaattagcggttgtcgagtttgaattaaccaatgccaaattctttaatcaatctctaaaagaattgaacctaaccaaccgttacaaggtttccgtcattgccatttcgcatgcagacgaagaaggtgccgccattcctaaccagtcaaccgttgtggaacagggagatgtcgtgaccgttattgggacacgaaaagatgtccaaaaatttgaagatatcgctaccaaataagcgaatacaaaggaggccgacaaagataattttgccggcctttttactaactcatttatttcccaaccactataaccactaatagaatagccgctgaaagtaaaattgtctgtccctgaaaatactgagccaaatagccactcaacagtgcaccgataaagaaggatccgataatcgtcacaatatcgccggcttttcgaagcgcttttttatcgccctgagcaacaaaatccaaaacattttccgacagtgttcggacgtttccggtcatcatgagcgatgtgaacggaccattcttcatagtccgaaattcctggagctgagctgctgctgccatcgctagtaatccagttgtcaacagaatcgaaacccggcccgccaggaaactgaccaggacaaagagaataatttcgtatgagagtgtaaccacttttctcctaagtgccagctcgctgggataatgatattgaatgacccgaataatagcaacaccaaccgcaaacatgatcaaagagacaattccctgggttatttcgccatagtctccctgcccaacgcgtaggccggttaagatcaggtttcccgtttgaagcccggcaaacacaccgccatcttctaaatacgtataagcatccagcgcaccggccgccatcgccagcaaagcgccgctcagtaaacgttcgtatacaccaatttctttttctgccatccctcttacctcacgttctaaatattgataccttgatatcataagaatttgtttgagagattgcaattactttagtccaaaaaataaaagcgccgggaataacttttcagtttatcccggtgcttttgttgcattacttagcaggcttttgcttcaagaagtgttgaagatctgctaatgctttgttccgcttgatatctttcttgcggctgattggtcgacggccttgaacgccgtttggatgacaaatacgcatagtaaaactctccttaatattttttccaaattataaaattccaatagactaaattattataatacaaatgaccgtttaaacgcaaatcaattatcagattttcccgattgttcagcatttgtggtatctttgaagtaacaaataaggatttgagatagggtgattattttggcaaatgaatttccacaagcactaacaattgcgggttcggacagtgacggcagtgccggaatgcaggcagatttgcatacattcttcagacgtcatgtatatggaacgtctgtcttaacggcctgtgttgccggtaatagttatggcatccacgattcagtgaatttaccaacaacgtttattgatcaggaatttaaagacctcgccgacgattatcatattcgagcaagtaaaaccggcatgctctccgattccgacttgattcgaacggtcatcaaaaattataaaaaatacgattttggtcctctggtggttgacccggtaatcacaaccaaacatggtaacatgttgttggaacaaagtgcctaccaaacacttcgagacgaattgattccaatggcaacagtcattacacccaatttttttgaagctcagaaattagctgaaatggacattgaaacaagtgttgatatggaaaccgctgcccgtaaattaaaagcactgggcgcaaaaaatattgttttaaagggtagtcaccacgatcccaatcaaaccaaagtgtctgattatattttgcttgaatcaggcaaaagtttttggctaaccggcgatttctttgataccgatcgtaaaaacggtaccggtgacagcctttcagcttgtatcgctgctgagctggcaaagggcaattccgttgaagatgcctgccgggtggctaaaaagtttgtcgatgcagctattaaaagcgagattcaagtcggtcacaaatttggtccgattaaccattgggcaccggcggacgaactgtaatcatttaaatgacttatactaaaacgaaagaacattttttggaggcttgccattttgtcaaaacgatcaattaacttattgttttccatcttacttttttgcagtgcggctgcttatacaatgacgtcaccggcaactgccaacgcaaagtcatcctacaagatagttaagatcaagacttactcaacccgagtgcctttttacgttaaaggatcgggaaacgtctatatgtggaatgcaagccactccaaaaaaattttaaatttaaagaaccatccacgttctcaatggtatcgtgcaaaaagtgtcattctaaagcacggatcttctaaccgggtatactacaaattagtgttaggcggccattacaagttttggcagggctacgtacgccgcagtcaattagccaagggatacggcccaaattatagtggccacgcacgagttggctactacaagctcacacgagcccttcagttaaccggtcggacttatcataacaaagtcgtttcgggttctttgcccaagggtaccatcatcagagctgcaacttacgtcagcaagcaaaaaacatggcttaacatttcattggatggtttaagccatcaaacccggtcaaaactgaattttatgctttatataacttccgatctgctctatgccaacaaagatttaaatccacaggcgccaaactacctgacgcctgtttcggaacccgcatacattatccctgcacctcagcgggataatgatgccaaaacctctccaaattggcgaaccgacctttatcccggtaaaacttccgagtattgggatcaggtgcttcccattctccgattaacgactgacggttacgttgaatactacgcgcatccaacgtttcaaaattcatatctttccagtaacgataatccaacagcctctgaaaagattacccattacgaaacatcgggaaaccagaccacaatttactatgcaaatcacttagatggttttaatgatcaaaaaaccggcagtaacaccgatcagcaatataaacttacgattgaaaatcaaaaaaaggttgtcactgttaacaaacgggatgctaacggcaccatcttctcaacgacgtcatatggtcaatttctgataggcggccggccattccacagcttggattatacagacgattaaccgagtattactcgttatcaatcatcatttacaaacgggtttgattaacagaaaagtgttccacaattgttaggcgaacaagcctactaatcgtggaacacttttttatagcggtttcttcatttaaccggcttaaccgcctaaactgccggcgcttgtataatattttcgattacctaatttataggcactatacacaaatgtttctccgtcagaatcagctgggctgtacttaacatctctctttaaattaatttccgttaagcgatatttttgctgaccggattgatgaaccttcttatccaataagcctttaatatgatggcggtaataaaaatattttttattgccaactatactgattttattaattttggcataggaagtcggcttggatacaaagtgatcattcttgtaatcccgggcataatattccagataaccgtcagtcgttgcaacaacacgatctcctttaccaaagtgataagaacgacttaaaataccataatcctcttccatgctcagattatcgtttacaagtaggcccttcggcatcgaaacctgtgtgagataatctccttcgggttttagcgcgcttctcgtccaattaccgcccggatgtggcttaggccacgtctgcctcgccttataacttagcagtttgaaattaatttgggccatactttttccagcatcggattttggaagaacgttttggacttctgtatacttcatcgctttcacaacggtaccctttttaatcgtgacaggttgatttgtcccgtacatctttatctgaaatgtctgattggccttgtaaaattgatacgttgcgccctgactgccatcggctttgacgactgtgacaaaaaccatactgaataacaatacaatggcactttcaactagaaattcttttaatttactcatttctctcatcccttcctgcgccactcaaatccgaggttgttcttcaacttaataagttccagggaggtgcccgccgcaactacctaaatgccggtttatcaggcattcccatcatactttctacttacggttgcgcaacaccgactagattagtgcgaccttgcaactagctaaatcttgtcatactggcaactttcccccagaataggtttaactattaaaggagtgatgacaatgcttcagttctcgaaacaacttaaaaaatatagggcagctaataatctgtctcaagacgacttggccaaaaagttatttgtttccagacaggcaatctcaaagtgggaacagggagacgcaactcccgatctcaataatcttgttaagttagcagaaatctttaatatcagcttggacacgctggtgcttggcgcttcggaaaccaaatcaacggttgatcaaaaccaatatacttttgatcctacgtcaggtctttataagcgccgctatggccaaatgaatttttgggattttctagcccgattttggtggttaatttttccgataggcggcttcataatggcaatcattgaaacacttaccccgtagtcctaccatttatccgggctccaaattcgtccgtcaatttcctgctgcccctgatcaattcgtttggtttgttcaataatcaaatcctgagccgctttcaaaattgatcgattaatgaaagactgttcattctctgctatctcggcaagctgttgaaccgcccaatcctgcgtatcacccattactattcctcctgatcccgaatcatttttatgtttaacttcaaatcatcaatttgatcctgacgactatcaatcgaatcaataattaaatcaagcaactccctttgttgtgcggttttcccggcctctagttgtttaagacgagtgatcagccacttctcacgtttttcaaggcttaatggcattggcgcgctcaaatattgaagatagccaaccaataattcttgcttctttaaaacgtccagatagccgaattgatcgattataaatgatttcaagtaaaccatccccgccttattggcaaatgcctcaaacggcttcataagctcggaaatcgtgaatcgttcccgacccccggcctgaaaatccgccagtgaatcgcccagcgtgatcacgagacccaattccttatttttaagccagtgttttgcgacaataaactttctggtaaacacgtcatccatgtattgttttaagctcgctggtgacgtgtaccaatacatcggaaattgaaaaataatccggtcaaatgcccgcaatcgtttttgttcatcgacaatgtttatttgggttgcggaatacaagtcatcaatagagcgccatgtgacattatccaaataatcagcactggttttcaaaaaagtctgggtagcggatgctgtagcttttggatgtgaaactaaaaccaacgttttcattgtgatcaccttactttccattcgtattgttacctgctattgtatgctatatcagtaggactaacaaaggggattttaaaatggcaacttatacaattcacacaacttaccgtaacattggtgcacagacgatgaatcaagctggcgatcatcaatttatcgcggatgaacccactattttccgcggtacggatgctggcccaaatccggttcaatatttattaggagccgttggtgcctgtcttggtgccagtgctgcttcactggtcaatagaccgaaatcaaccattaaaatcaaaaaattcgatgttcttgtgactggtgaaaccgaacgatttgcggataaatcatcccgggtttcaaaaattaacgttaaattaacttgcgaaacgaacctgaatcaggaagaaaatcgaaaattcatcgaagataccatccatttatgcacggttcataacacattaaaagatgcagtcgagtttacatttgatatcaattaagaaaaagttaacagtaagattacaaaaagtgttagcactcacagatgtgaagtgctaattttttattttattttttggtatatgtgttaagatcgcctatatgtaggcgttctctatcaaaaattaatcaagcaaattcttgtactgataacaatttcatgatattatatagttgttcgtaaggggaacagatattcttatagacgaacagctcaattagaaaactaaatagtaaataatcggaggcatgcatatgaataacgatatttttgatgacatttttaacgacccgttcttcaagcaacaattaccaaatatgtcgggtcaacaacaaatgcgacagcaacccgttcaagtgcaggaacgcagacctcaaaataaaacgaccttattagaccaatatggaaccgacctaaccaaaatggctaaagatggcaagcttgaccccgtcattggtcgggataaagaaattgaacaaatggaagaagttttgagcagacgaaccaagaataatccagtattaatcggtgaagccggcgtcggcaaaacagctgtcgttgagggtctcgctcaaaagattgttgatggtgacgtttccgagaaactgcttaacaagcggattatctctgtagatgttgtttcactggttcagggaaccggcattcgtggccaatttgaggaacgaatgaaaaagttgattgatgaagtttcaaagaataaagatgtgatcctgtttattgatgaaattcatcaaatcatcggtgccggatcaaccggtgaaggcgataaaatggatgccggaaacattctgaaacctaaattggcacgtggcgactttcaactcatcggtgcgaccaccagtaacgaatatcgtgatattgaaaaagaccaggcacttgcccgtcgattccagccaatcatggttaacgaaccaagcgaacaagatacactgacaatcattaagggactaaagccaaagtatgaaagattccatcacgttcgttataccgacgacgccctaaaagccgctgtgtcattcagtaaccgttacattcaggatcgaatgaatccggataaggcgatcgatttaatcgatcaagccggtgctaaagttgcgatgggctcatcaattacaaaggacaagtcaactttgcagcaagaggctgaaaagcttgaaaagtccaaaaaggatgcttcatctaatgaagaatacgaaaaagctgccgggcttcgcgataagctcgacaaagtagaagctcaaatcaaagccattgataatggcactaaagtagaagtacccgaagttactgcagacgttattaaaaaagttgttgaacgtattacaggcgtccctgttactgacgttaataaaaaccaggtcagtcaactcaacagtctgaacaaagatctcaaaaaagaggttatcggtcagaacaaagcaattgatgcaatctcggcagccatcaaacgtagccgggttggctttacagagggcaatcggccaatcggcagtttcctgtttgttggccctaccggagttggtaagactcaaacggcaaaggcgcttgccaaagaactatttggaacaaccaaagccatgtttcgttatgacatgtctgaatatatggataagattagtgcttccaaactaatcggttcggctcccggctatgtgggttatgaggaaggcggtcgattaacggaacaagtccgtcgtcatccttatagtttgatcctgctcgacgaaatcgagaaggcccatcccgatgttctgaacctgttactgcaaatcttggatgatggccgcctatccgatgcacagggccgaaccgttgacttcagcaacacagtcatcatcatgaccagtaatgccggtcaagaaaatagcagtgataaaaaggatgtcattgatcgcttgaagccttacttcaagcttgagtttttgaatcgaattgatgatattattcaattcaattcattaacaaaggctgatttgcttcaaattcttgatctcatgctcaatgacttggatcaattggtaaacaaatcacgtggtatccacttcaccataacggatgatgctaagaaccaactggttaatatgggatacagcaaggaacttggtgcacgtccaatgcacagagttatcactaaggaaattaccgataaattaactaatagtttcctggctcacccagaagagaaaaactttacggtcaacgcaaaagataatcaaatcgaggtcacccctactaccggtaaagaagcaacgatcagtaagtaatgtttccggtcgaaatccaagttaatccgttgacatataccagcgatattggtatattatagtcaatgtgtttcaggagtcgattttcaaaggtacttgttttatagttttatgaaataacttccttggaatcagttcaactagatacattaaaatttatgatgcgcaaaaagcgcaaggaggtttcatatattatgaaacaaggtactgttaaatggttcaacgctgataaaggttatggcttcattactactgacgatggtgacgtatttgttcacttctcagctatcaacaaa

SEQ ID NO: 440 - DNA, 5316 bp, Unknown
  Metagenome-assembled genome
gatcccacttatctaacggcacattgattaagcctgcaccaccgtcaatcataattttattagcacttaaagtcgccgtccttttgttcccgtcccaaaagatttgttggcgcatattatgatacatgacagtcaatgctttatcagtaatcgtcgttcgtggatcagccaagattttttgtaaaaaggattgttcttgtttttcgttaattaaaggtggttcaaaaaagtcttcactacctaatggatgtaagctgattgcttgtatgtgttcaatccgagtcttttagtttccatagtaagattaacggtcagaataactccgatagttgaaaaaaggttacaagcatcatagacaatgtaaaagatatccacctacccacgattaaagataaatacgtggctattatagttatcccaatgtcaatacatctctttttgttccttttcattaaagcatttgcccttataacgtcaacatcatcagagagcaaatcttttaatgtactaccgtaaagttcacaaagtaaaattaaactctgaatatcaggaattgttttcccattttcccagtgagaaacagtttgacgggaaacatggcttgtcggcaatctgtgaaccaaattttggcgattagctactttagttggcaaaacggcacccaagagtctaagaacgctattaagcacccgtagcgggtgtggatttattttacagatacatgagtgaaggttgctcagcaaacgcgcagcagcgcgcaaacgagctcaaaaagggggacccgttatcgataaattcaatgctcatagcgataaaaaacatcggttcagcgccggttaatccaaaacaatggtgctggtttggataggtcctagaactaaatctatttggtttggcatcgagggcgacaagcgcaaagctattagcgatcacctaacgaccattttctcaaacaataatgcccaaatgtgccgtaaaggtggactccaaagttatggttttgacacaaatcctcaagtccagtttcccgtgtttactaggccatgtgaagatgcgccgacaaccgctattagacaagggtgcgcttttaccccccccattgtgcgataactaacagctttaaacgcatcatccagcataaaggcgacaacaaatttactgagttttagggcataccaactaagcctaattagagctgatcttggttattaggcataggcaggggtattagaattttcaggatagtttgctgggtcataatgcaattcctgaaggaatttatcaccgcattcttcaaaatagtttttcagggaaaccatgatgtacttctcaaccccgaccggattagccgtttttttgttggcggtgaatagaatgcggcgcaagttttcagctagactgtcgcgcatgtcggtgttttgttcgagtgacaaagcgaggcaaatatccttcacttcacgatgattcttgtagacggcttttttagctttatagattaggccgccgtaattgtatagtttatcagcattgccaaaggagagggccttcataatcgagacggcttgttctggtaatcccccctggtggatgagttgatcggcaatgatattgattgccatatcgttaagcactggttgctggctggttttcggttgttttgaagttggctggccgttagtttcccctggttgtggagtgttagctacgggttggggtcctgactttggtgagcttgtgaaaatcgcgctatttagtccattttgtgtattatctgtattaattgttttatatgtcaaagtatgattaaaagtctgatttggtagaaattttttccagcccccccagcaaaattttctaggggtgtaccagaatggggaacttgctgtggcaaaccgtggaatgaaaatgcggtaagtagaattggttggcgtgttgtagcgagtaatccactgttcatcggctaattcggccatgtagttagcgactgtccggacagaaacgttgatatcccgagccatctgctcattggagtagatgataaaaaacgcttttttatctttgtcaaaataatcaaggggccgtttaatggatgattccatgcgatcatataaatgattgatgatggagcacttggttgggttaaagccctttttttcaaaaaagttaaattggcgaataaattgtttagttcccttgatggtatgcatgattaagatctcctatcaaaaaagagcgacaaggttactttccttgcagctcttttttaactgattaatcatcatggatcatgattaaatcgggattcctaaggggtatgtatagaaatcgtcatcaaaatatggtatacttttgttgttgaaatgccgggtgtgtctaacacccacaaaacaatacgaaaagtattctcaatatttttgactgaacgttaaaaaggtcgtgcaagaagggaaggttcttgtgtggctgcatgaatggtaaggcaataccatgcacgcaacgttctctttttttatctttatttttatgggttcgcaactttgcgttccctttttttatttacaagcatattgtacctgacgccagttggtgtgtaaagcctaaattaagcgttattggtgtctataaacattcgcaaaagttcacttgtgtaacaagtaaataatatttacaagtaaactttatttacaagtaaattttatttacttgtaaatggatgactgcctatatccgctactatatagcttttccatatatcgtaaataatatttacaagtaaactttatttacaagtaaattttatttacatgtaaataaatataaactttcctttgaaaaagttgtaattggccaaaatatttttttgtatacagttgaaaacacaacttcgaaaatgtatactcttgctaaggagatgattgtatgagtgcagacgtatttgttgtagggaattttaagggcggcgttggtaagacgaaaaccgtgactatgctttcctatatatcagcggtaaacaaacacaggagaactttagtggttgatttggacccacaggccaatgctaccagtatattagcgaaaacaggtaatataacagatattagcaagaatattaccgatggttttacgaacggtgatcttactaatcagatcactccgattattcctaatcttgatttaattgcgtctaatacacaatttagtcgtttacccaaaatgttattacagtcttttcctgacgatgataaaagacaggttacatatctgagacaattgttaaaaccattgcgagaacaatatgaagccatctacctagatgtgccaccaaccattagcgatttttcggataatgcaatgatggcatcagactactgtattataattttacaaacgcaggaactgagctttgatggtgcaaaaacttacattaactacatgcaatatctgattgataattacggagccgaattggacattgttggaatactgccgtgcatgttacgtgctggtgggcgtgttgataagaaagtactttcagatgcacgccaagagtttgggaataacgtcttgaatacaatagttacttatcaagaacgacttaaagcatatgatgctgaaggtatatcaatgggtaaaatttatactggtcagaacgatcagtgggatcaacgtgcacataaagtgttcgaaaatgttttagacgagattgatcttcataaattagcactacaagaggaagaaggttaaaaaatggacgatagtcaaaagaaaaaattgccacaaattaagccggtactcgagcatcctcaatcttctcttaaaagtaagactgttaatattaaagggcaaaacagttttgggccaattactggtatgcagactcaatcaaagcaacccgacaaaaagaaaaaaaaagctatgacagtacaacgtgtttctaaagaaagcgttgagaaactacgtgttttgtcgtattttcttccaccagaggaggcccatgaaaagaaaactttcgattctcttcttaaccgtttaattcagacatacactgaaacgtccatgaataatcgacaaaaagatatgtataatactctacttgaaaaagagcgagagcagtaaatttagccagcacaaccgatacttttttgtgctttatgttatacaagtaaataatatttacaagtaaactgaatttacttgtaaatattatttacttgtataacatatgctaggtttccttgaaggataaatttatgatctattgttatctacagtgacttcgatccaatctatctgttcattgtttgttaatatcaagagatccgatcagtagctatcaataacttgatccgtttctaattagtcaaagtaaaattagcgatcctatggattgaagtcaatatttgagacaggttttaagagacattcagaaccgcgtttaccttccacagctcaaataaatcattaatcgtgattaataacttatttgaaccctggaaagcattaaatcaggcggccatttggctcgtaagtgttgcgatttcaacttgtaagggggtctggtagcccagtgaactatgaattctcttcctattgtagaaagcatgcacatattcaaaaggacgcagcggcagtttcataattctcaaagacccactggataaacacattcctttttgagggaagctgaagagtttccattggcattatcgtacggacaccccttacggctgtagagtggcggatatgtatctgttaacgttgttgaaatcatcctggttactgtgaccttaatcctgtgtgataatcaggtccccagtatagttcgatttttaaccgcgctttccagggtctttaaactaaatagtatccatcttttttgagaacgaatagccgataatcgtcgtgggtgcagtccatgatggttgataagtaacaccagccattacgcttcgtttgaatataggtcatatcagcggtccatttttgatttaaaccagtggtcggaaatcctgcttaagcaagtgtggacgctgttcacacttggttttggaagccgaagccgctttccatttattgacgtaacggagtggatatccagttccttcatgagccgggaaatccgtctgggactgcaccgagctgcagtggttgaagttccagattcaattcatggtggatcttcataacaccgtatcgctgcttaattccgcaaagatccgcagaatccgttgtttaacccatcttcggcccgcgttttgaaggtttgggggatctaacgataaaatgtttactgagctctgggtgtgagggtggaag

SEQ ID NO: 441 - DNA, 12300 bp, Unknown
  Metagenome-assembled genome
gtgaattaactatatcaaaaagggggttctttttctgcacttaatgggtgaaaataaaaaatcgctgttaagtttggtggttccggacttaacagcgataaagaaacttagtaagaataatttgggtaatactgaacattataatttttatatccatgcagggaactatctggatgttcactatccatccacccatcattgggaaacaaattattcaagtcattataagtgtatccagtatacttcgtagccttaacttgattatcagcagttgatccacttgtttccaaatacataatattgcttattttgtggatcggaatcaaataagcatcatatatagttttaccattaagcgaatttattttattataaattgcgtaaaccggaatttgttttcccttgaaatgataattaaacacgtaatgtttagtttgaggattgatcattacttgaatatttgaaagatcatttagatcatcacctgactgattagcaacgttataggtatcaattaagtcagaatgcactaacgcgtattttataacatcatttccattggttagtcctgttggaataacagtaggtaaccaaggagaaccattactccgatgataaatgataccaccgcctattaatagtgaaagaattcctaaaagaattaatggcttgctaattggctttatcaaagctataagtatcatgaatatccctattattatgaatatccacatcccaattgttattatgagatgaatcaaaattacacttccatcctatttcttggcttctattttatgcattaacatcatattagacgatccttcatcgacgtagacacgctccccctttgtataaagcctattagtttcaaaattaggattatacataaaaaaacaattcgaattttttcttttagaggcaacataatgaataaagccagtttttctattccatgttattgatttatttgtctcataatcatccgtataataaatgtcatgacgatttttaattttcataacgatatacttgtgcccataaaggtgatgttcccaaaggcccacataacgcgttgaaagtgtggtagttctaaaaccatacttcaaatttttggctttaacattattggaattgacaataaataatgcaaatactgagaatacgaatagcattgatacaaatatttttttcaatatgaatcttccccttcttacaattttctgatttttttacaatctaccattaataatttcaagcccgaaatttaatgaggtttcaataaaatctattttaaacggtgatggtgatatagtaatattcccaactctttgatagtagcttaaattatttgatcaaaagcaagataactaaacagtttctaaggaaatttatttaacaaatagttaaagacatgtttctgtttgtcgtggatgatttagtctgttagccttaatttaatgaataatggtacgcgtcaacaaccgtaagaccgttatcaacgactttaaatcaattcacctggctgccaaccgcgatgataccaaggtgtatatccgtttactttaatctttccatgacgttttacaaatattgttgttccccaggcccacttaaccatcgtacctttacttctaccactataagaacgaattttatatttttcatgacctaaggacttgtatttgagatgtttatacgtcagaccaggcattccttgatcatcactcagcattttattggaagaaatgtgaaaatatccccactggctaacctgttttcgatgataaatccagtttcctctaagcactttaggcgttcctttgtgccatgtagcggcatcagctgttgtggacaagctagcaattccaactgttaacccagctaataaccccccgctaagttttaatgatttatacatgttcgggctcctcttatctattaattttttcttttacttagaagtactttgcagttcgatgatatttcaaaccatgtacatagatgtgtccacttttatagcgaaacttgatcgtatatgcgccagcggacttatctatagcaggaaattggcgaatttgatagttatgatggcctaaatacttataactggcacccacattaccaccatctccgtgaccattattgacgaagtgcatatccgatcttgtcatccaaatataattcactttattactcgtaccccaaaacccgcgtaatttttttggcgttcccttatgccagtttgttgcctggactggggtaacaactaagccactcattcctaaacttgcaattagtaaaaacgaggtgataaacttatgagctttcatacaaaattcctccttgattacttagctaaaaaatactaatttatttaacttgcaggtcttccaatccgtttctattaattaatacccttatattgatatttagtattaaaatctgacatagaaagatcatcaactaagtttatcggtagaccctatagaatttatgagcatttaaggatagtttaacaaacatttttccttctgaatacttccagattgttgtacgtgaacctgatccccacactgcatattgatgaccaatccaattttgatgaatcaattgagtgatatgagcgattcgtgttccatggtgatagatacttaaagatttagccgttaccttaaaataatatccgcgaccatgccaattgccacgaattacttttggagaattaactaatatacctggttgtgcgtgagctgctggtgttaaataaatatttcctaaagcaaaaccggcagctaaaacaagtactgtgcttttaatattagaattaggcaatgttttccctcccgaaactatagtactgctaataatcataacctacgctgaatcgttcatagttaagaatcaaatgttctcttgaaaattaagtcagttagtccaagttaataggacagttatgctgacattgttaatatggtagattgtaaaattaatccgacgctgttcggacaaaaaagatcagcttcccttaaaatggtgtttaccacaaacccatcttttaggagctgatcttttgtctagtataacctattctgaacgaattaaaatcgaaaccttttgtgaactaggcctgtccaatatccaaatgtaagcactaaataattggacgtattcaaaaaggcattcgagcatgttattcttcagataactgatagggtccctgtcaagtgcaccgatgaaaaacaaaaatctcagaagttctatttagacgttttatgcggcttgattccgaagttccttcggagtcaggccgttattttttacagttcttcgttttgtcgcaaagtaagtcaaacctgcttggatgtattctgctaactcttctaaggtttcaaaatgctctggacattggtccagccactcggtcttaaactgcgcccaaaatgattccatcaccgcattatcgcttggtgtcccaggtctggacatactttgtccggttgatttgtcgcgtaggtaatttctaaattcctttgaggtataggcggagcctcggtctgaatgaactaagggcttggcatctggaaagcttgcataagcctggttaaatgcttccttggcagctactgtcgtttgcgtcttactcaacgaactgcctaagatttcatggctatataggtcaataacaccacacagccaaatactcatttcatcgtgcttgccataggtcacaaaagttgaatcagttgcccatacttcattgatacccttgcgttcaaaatcaccgtctaaggtgttttccgcaatataatccgcttgagttttatgatagccaggtcgtttcttacgaataactgatatcatacctgattgacgcatcaatctatagattcgcttgtgatttaccttaggcagtccttggcattccaaccatacattgatagccgctgtcatacttttggtaccacgggtccggttactttgctcaaattcaactttaatttgcgataaaatcaattcattgagttttgcaggatctggatttgtggcacgaccgccactacaccagtaaaagtaggcacgtctgctgacaccggctgcttgaatgattcggttgagtgaaatttgtttagggttcttaatctcttcaaatgccagctttgactctgtcaccaattcgtcactaagttcttgaatggcctgataaatatcttcctgtctggcttttgctaatggcgatctctcctttcgatttctcgtactttttttgccaaagcttcccgaatctcatcatcttcaagctttgctttaagcagcctattttcgattttgagacgttgaacttctgttaattctttttcaggaaccttgcgtcctcgtctgtcttttagaccgtcagggccattctctcgatattttttcagccaactatagacttgttggtaggaggccttaaatttacggactgcgcctagatagtctgaattgtgtttcaataaccattcaacgatgttaattttttcttcgaacttaaaggatcttgctttttgggagttctttccagtcattagggcacctctctggcctgttgctttgagtttgtttccctcattatactggaaaatccaatcggacaaggtctgtgagctctttatgccatactttaaggcacaagccctgacactgatatcatgttcaaagtaatacgtaacgacttcaatcttaaactctgcagagtaatgtttgttcttatgactggaccgtaaggcttcttcaccgcctgctaaataagtttttcgccaaaaaccaactgttcctttatataaatcaagttcttgagaaactgatagaatagtccgccctttttcaatctcagttattgcccacaacattgtctccagatcatatttccttttcctaggcattaaaaatccctccagatcacacctgagaattttttgtttttctctggtgctctctagagggatagtatcctaacacaatcgaatgcctttttaagtttttacagttaagctgcacagctttgctgtactgctttagcccatggtaaataagcctctaactcctcgtcagttggggaatctcctaaccgaggcaagtaggtgaacagatagactaagtattttttgaaatctaaatgattggcaatggccgtttcgaataggcctaggaagagggcgttagccttagctccgcgctggccggtactaaaaagccaattcttacgaccaatgaccgaagttttgatactccgttcggcaatgttattactaatggccaccccaggatcatttaaaaagacctctagttgttcacgctgattcaccatgtaggtataagcgcgtcccaacttagacttgttgataggggtagtttcactcattagctgccatatgctatcgacaattggcttggactctcgttgtcgaatctctaacaactgttgtggtgaaaagccctgagcttttcgttcgatcgcaaatagttgatcgaactttttgacaaatttgcggccaagactcctttggctctcaattccattagtgccatccacaaattttcgtcgtccatgcgcccaacagccagcccgccgaatccctggcggaatgtgattgtaacccgcatagccatcgcagacaagagttccgttgaagccttcgtaaatcgcccgggccactttttcacttcgagatgggtcataatgaaaatggataatcgaagtagccgcgttagcggcagatcgcatttcccatagaaatgactttgaggttgccgactttcctggttctcgtaaaacttgaattggcgtttcatcgccatgcaaatatggttgctgcttaagcttcctgaaaagcaactgatcgactaaagcaaccctctccgatccaaaaatcacccaattgcttaaggtggcttcggataccgatagtcccaatccctttaaacgttgtcgttgacgataaagtggcaaggctaattcatatttattggcaataattgttgcgactaaatcttttgaagccaaactatgggccatgaatgattgtggaccgttgccgaaacaaattggtcgccatcgtaattgacgtcctctgaacaatgttggcatttgccaacttcctgataccgacgaactatgtatgcttgagctggttggagatgaaatttgtctccaatcaaccgtttaaatatctgataggcattgccacaattatggcaattatgttcggctaattcaatcagttcttcctttatcgggaggtttttcgtgattttcgctttttgactttgccttttctttttacgaactgtgacaatttcgatttgttctccagttgactctgggtcttcgaaaacaccattactggcgtcatcaaatagagaggtttgaccatcgtcaatcgatttttcactcgaatgaccatataatttgttgcgaagatattttacctgctcagttaaaatttgattctgccgaataagctcttcaatttgagcttgttgactggcattaatctttttaagctcctcaataatatccattggtctcaccacctcggttggttttcaatgatcatatcatgaagtttgaatcttgcctataccttttagaaaggttgacagagcgagactttcaataaatattgcctggtctaacacgatgaaccgatggttcaatcgtcagcccggttagtaaccatttgagttgctgatttgttaattgccggacttccactgcggttcttggccattgtaaatgtcctgattcataacgtttgtaaagtaatacaaagccgtcaccttcccaatagatagctttaaatctgtctttccgtgttccacaaaataggaacaatgcgggtgaaaatggatttaagtcgaattgatcttggataattgttgctaacccatcaatttctttgcgtaaatctgttttgccgcaaaccaaatagactttatctaattcggtaaagttgagtaatttaggcacccgccatcagctcctttagaatgatcttcaatatttctggctgggaattattaaagatacttaattttttattattgacggttaattgacaagccggttgaattttattgggatcatcaatctttgtaatttgtaacttttcagtgggtactggcacaatggtcttttccataaagaatcacctcatacttaattaataattctatggtactcaaaaagacgtctacgaagtagacgtccagttatttagtgcttacaaggttaatgcaacaattcctaatataattgactttcttaatttcatgctcgttaccctcgttatctaaagtatgagtgccagaatgaattcattgagatcttatgaggactgaaataatgcagtgaatttgaatcaccgtaagcgttgctatatcggaatttatagaagtgatttccgagatacttccattttgtaacatgaacggatttctcaccagaaaaatggatataatgccgatagatttttactccatagtttggattagctgttgcataccaatgtccgcgcaatcgataggggattgcagaagtatgccaggatgaagcatctatggtggttggaaatgtgatgctcataattccacccaaagataatgcggtaacacctaacataattgaatttctaattttcattatgattttcccctctataagcccaataattgttttttcttcgcatcgaattcttcctgagtgattgttccgtcatcaagaagctttttgaacttagcaatttcatcagcggtatcagtagcctgtgcttgagattcttttggccccatattgttttctacaaatgtttttaacttttccatatctttgttattagatcccccacggaaaacaacattattggctttgttgtaagcaccatgtgcgaatcctggcagggcaccgagtccaccggttgtttgattgccagcagcagtgatgaagttgatttggccagcagtaacaccggcttttttgaagtcaactccaataatatttgttaatggaattgtttgatctccattttgcccacggttggcaaaacttcgaattccttttcgtgtaataacgactttagcatcatctgcggtaatgattacgtgttctggaatgtgaatttctactttgatagtcatgattaaatcccccgtttaatttttatctgtttggtcagcaaatggattgtacatgtttttgacttttgcattacgtatttttaaccctttttcttttctccgcttaaattctattctaataaattcagcggttgtatgaaccagctccttaatcgcattcttaaactcatcactttcattcatcggttgaacccacataattcgttgtcgttccagatctgttgaaatgtttccgaagaaatattgattaaatcctgacttcacctcattttcaccaatcccagaattaatatatattttgggcttgagggtggatggaaatttgaagtttaacgttccatataaagattgaatcgctagcggcaagtaataacttcgtaaagccgtgtattcttttaaggtagtaaaatctaaatcattttctggaagcccgactttccacatccaatagctgacgtcatccgcatcaaatggggcctcaatcagtaacttataaaggagtaaatctcgtgaatctaagtctttgggatcaatgagagcacgcatatacttgatttttttgaattttgcataggcatacagagtgtcactaaaaaggtatccgccaagttcgacataatccagagtgtaaacgatgaattcaaaccaatgaaaagccacatccaaatttttcaaaaccatgtggcgttccattccttgataaagtaaccagggatattggaactcttcgccagcatgcgggttgctaagccactctagataatgataacgttgttttggtgtaaaactactatacgtattgaacaaatccaattgacctcggaatgactccggcgtgcctggttctaactcatcagtttcaaataacgcggacagttcatcgtgtgcttcaatatagccatgaacttgctttgcagcagaaggtgggaagtactcgaaatttttatgaggtccattcgctatccacaatatttttttagtcgactctggaatgtttgcgtacagcttttcaaaaaccggattgggttgatcattatcaagctttagtttcgaccgttcttcatgataaatttgtaggtcaaaatcatccattttaacttttccggaccttgtgtaaggatcatccattattaactgttttggatctgaataaatatcgtcgtctgcttctgtatctacttctgaaatgttcgaatttgagtctggcgatgctttaggatcaacttgcgcatccgatgtgatctcaggcttttttacaggttttggaacatcagaagccgctttttgcttagtaaccaaagtggcttgaacatagttcctagacggctctttttttggagacactttcgaaacatgttgctttggttttgtgcctttattggaaacaaaataatatattaaaaacccaatcccagcgacaagtagtatttgccacccaaaagtagaaataatcgcgataaaaaataatattacaagaagcccagcacaccccattcaatcacttccccccatgacaacttagtctaattcatccaccggtgagccatattggtgcatcagatcagcgtagctttccggcccatagccgttttcttcaatatacagcaaacccaccaacccacttgcaaattcgtttgcttgatactcacatttgaatcggggtcgtgccataaagggcaacgtagccatcggctaatttttgccaagccacttgatagtaagctccatttccagtaatttcttttaaatacttgtaggctcctttagtctgcaaaaccggtaattcactcccaatgactgttaattcgttatccatttcatgatctcctttgctttgctaatctcacccgttgtttgggtttacttttagggttgtaaaagtgaacctaaatgacgggttcaccaaccggaacgtagtgcagggcggtaggcaggttctaatcaaaatcaaaacttaatttatggccgtcaagctttaacttggcgtcaaacgactttccctttttgctcttgaaaccctttagtttgctggtttcccctttggtgaccagtgctttgatcgcggtcttcccgagggtcttactgctccatttcttgggcagggtaaagtcttcgccttgcttaggctttacaatataaaacttctgtttatttaaaacggtcgcttgcggtgtttctaagaagacctcggcggacttttgtgcttgctgttggtgattgatttgttgcttaatggctgaattgccggttaattgtgtggggacatcagcaattaacttcgccacaaacttcttaatctggctcaaaaagttatctggggtacgttcttcggtactgatttgctgtaacgcttgctcccatttcgctgtcatctctgggctagttaacaagggttcgagttcgaccgctttacataaagttgttcccgcttcactgacgtggagtttgttcttttcagtaaccaaatagccgcgtttttttaacacttccagcacattggcccgggtcgcacttgtcccaatgccttgcacatctttgagaatcgcctgggcttcttcgtcatcaagcgttttgccggctgtcttcattgccgtaatcagggtaccttcggtaaagggtaccggtggtgtcgtttctttttgcggtatttgcaggttggcttggacttgatcgccaggctgaacgaggggtaaagttgctgcttctggctggtcggctttgtgatcatcaaataaagctttccacccttggttagttggtaccttaccggttgctttaaaattagcgtccccaacttgggtaataatggtggtttcctcgtattcgtacggatcagcaaacatcgctaacgtcgttcttaaaaccaaatcatagacctgttgctgtaatttaggtaaggcagctaattgatctttagtcgggacgactttagtcatgataatggcgtagtgttcttcaacttttttcccattgacataacgctggtttggtgtggtattggttaaagagacttgcgtagagactaaccccagatacttcgtcagattagccactaaataatcaaattcttcatcagtgatataagcacaatcggttcggggatagctaaggaatttagcttcgtataaactctgaatggccgctaaggtttggctggcactggcatgataccgtttattcatggcactttggagactagatagcgagaatagttggggactagcacgctttttgccttgcttttggacgtccttgataaaaccgtcctgtgagcctttctgaacgtgtttagcctgcatgaatgtcattagccctgtttcgtctttaaatcgctgataggggtctaattttgcgacgaatttttgctgattagttaaaatttccgcatttagttcaaaatagggtttcggcttaaaggttttgtttacctggtctctttgataggccatacacaagactggcagctatacgtaactaatcgagcacgctctacgtaccaaatttttctcaatataaaatacattatgggctaccattcataccaattaaccagtcgctaattttgtgattacaagtgcatgcccccatcttcatgccggttccgggtttgatgttgccgctgctttttcgtcattgcccactcggtctcctttagcccacgtagttgctgctttcttagatagtccgtatttttcgcatataaaatggtcattaaggcttcgtccaaaatattagtcaggtagtttttcgggctagttgggtaataattaatggcctgatagtccttaacttgagcttgcttatattgatcaaaccgtgttgtctgttgtttcaaacgggcttgcaccatttcaatttgtttgtgatccaacttaggatcttggccacattcgccgataaacagttgccgggtgccatcatgttttaagacccgttgtaatcggtggttctgaatatcttttaattcaattttacctaacaggtaattcaaaccagcttggtgttgctgactagtaaagactaccggtggctgctgttgcaattgactaagatcatcggcgcttaatggctttaattctgggtcatagtaaaccacagcggtatagatttgctccttatcaa

SEQ ID NO: 442 - DNA, 59959 bp, Unknown
  Metagenome-assembled genome
tcttgggacatcgtttttacttctttctatctgaattattggctaattcaatagtagggcgatgccctatttatatgcaaaaaaagattgataccttacggtatcaaccccaaaaattttagacccgattttttgtagcaaaggggtggtcgtatgatcaggattaaaaacgcaacctatattgccagcttaattaattcatttgttggattggaagtggaaacacatcgaataaatacagacggtgggttaagtacccacccatatccaagcggattgttagacgaaaagaagcatcattttataaaaaatgattttttggaaacgcaatctgagctcattacaccaccggaagaaaatacgcatcgtggattgacatatctgggagcttatcatcaagcactaagaagcgagttagcaagtagtgaatatttgtggccatatagtatgcctcctaagctgcgatcggatcatgccgatattgaaattgcccaaaccgatcatgataattacgtctatcgacaaaaggttgcccaaatcagaaagattgaacggacagctgaaaccggtgttcatgtaaacattggattaacaccagcagcgattcatcaggtaggaattccccccacccaagacgagatagacaacctgtatttacaagcagccatcgggtttatgaactatcgttggcttttaacctacttgtttggtgcgacgccgtttgcgtttgataactatttttcaaaaaccgctaatatgcctgcacaagctgttcgttctttgcgaaattctcacttcgggtttgggaatgggtttctagcaagttaccgaagtgtttctgaatatgtaaccgatattgaagacgcggttcgtgaccacgaaattatagctgaaagagaatattatgggacggtgcggctaaagagaacgcctcacttaaaggacttactggcagacgggattctttacactgaattacgaatttatgatttggatccctttgaaccaatggggatttctgaagatgcagttaatattattcgactaatgtttgcgtactttgccggtaatcagccgtttaatctggatgaatctgatcatgaaattagcgcagctgttaagaaaaacgatacggttgccttggagaatccgttgacggttactcaattccatgatcaagcggtttctttcattgaaaagctgagcgcgtttagccaaatgattagcttaccatttaatgctgaggagttatgtttaagaatgcttgaaagaattgataatcctttgttaacaccgagtgcaaggttagtaacttggtcaaataacgatgcccagcaattatttgacaaattactgttaatggctaagggttatcagaatgatttcttggatcacccactctatgggtatgaggatcgatcacttaaagaacaaaaacgaaagattcagcaattgaaaatgggtaaacaattagtgttaaaaaataactaaaaacgtgaacttctatcaatggtcaaaaaacggtatgatagaggctcacgtttttagttatcactaagtgaaaatcattttaaaagttgttcagagcgtgcagcctcacgtacgactcttctcagcaacctttttacttcgttcaacaaaatctttaaacaatttttttgaatcttcatagtgtttgaagatattttccggatgccattgcacggcaagaatttgatcactcttaattgattcgacactttcaatgacttggtcgtcggcacgtgccgtcacctttagataaggtgcgacatctttgattgcctggtgatgacgagagttaacatatggccgggcaccaatcaacttataaagcttgctggtaggatcaacggtaatatggtgtgaaggcatgttaccgggtgcttcttgagaatgctttaaagttgcatgaaggtcttgggaaaggtcttgatagagtgtgccacccaaaccaacgttgatcagctgcaagccacgacagatacccataatggctttgccagcggtaacagattgttttaacaactcaatttcaaaaagatctcgttttaaataggttgctcccaacttttgaaaaggttcttcaccatagaaagttgggtcaacgtccgcgccccctaggaaacagacaccatcaaacagcgtcatgtagtcgcgaacatcttctggattcacactagggaaaatgacaggcacaccacctgatttaacaatggcttcaatcgctggccttggtgcgaaagccgcgtttcgttcgttaataatattggttgcttcagcgagtgtatcagctggtaatgcgattcttgggcgcaaaataatccctccttgggttgtgataatagttgttttaatatagtagttttgcatttttatagacgaccattattgtactttaaaaagaaaagatttagttataatttgactttataggaactttttggtagttaccgttgacccttatctttatccggttcccagctaccttgaaaaagttcatgcttcaaatcattcgctgaaatttttctattggtttcaaatcccttgaatggtctaattgattgtaaagccgatgcctgataatgttttgcacggcgcaacgcgtagtcggtcagggaattatttttgatatgtgtaatcatctttgcactaggcgttgataatggattttccacccgatcctgtaaatcttcaatttcttcctgatactcagggccaagttgaattttatcggcatacatctccaagcgttgtaaaaaggcccttgcacttgcctgatacttggaaatatcgtttggatgttcttcggaaacttcctcgttcattttatcagctcgttcaacaactgcattgacctgatccggtttgagagcgggtgacataatgaagtaactggccattaaacgaaagaaccgtaatgtgttcgtacgaatgccaacagaactgcttggatccagatcaagcatgcgtaattccaaatattgaacaccggttttcggtaattctttgaggtttgtatttcccttaaaccggacagccccgtgaaactcataatcagaaattagtttcccatcagagacgccttgttcgattctattaacatattgctggatatttgtgtaatcacccgtaaatttgttgccaaatccatgagaactttggcggatacttctgataggtgcttttggaccctgtcctttatcaaagtaattggcttcagcaattggactggcaccaaataagtatgtgatcacccagcgatatctaagaaatccttgcgcaatttttgcgtataagtaattttgtaggtccaattcggaatcaaattggtcgtgcattcgatcgtaaacgagattaaagacgtggggatcgatactaaggttaatgtgtgcgccacaaggggttccttcagagaagccgtggcgtttcaaccattccttaaggtaggcttctttttttggccccatcttggctagtggaatccggctcttgtcttttggtaaccgtggtggcatagatagtggccataataattcacctggagaaagggctgttcgtaaggcattgttgatgccgtataaataatgcattgcatcaagcgcgtgagcggcaggtggtgtgacaacctcggacattgtttccaagaaatcatttgtaatccatgggttgattttttcatctcccgctccggcaggatagggttcttggctaagttctcctgtttcatccactcgttgcatttcgatttccaaacccattgtaaagtcggaggtttttgcgacggcttcattatcgaaaataaattgtccaatttcactgaacataattgccacctccaaaaaaattctaataattagaaaataatgataattgatgacaaaatactaacactatcataatgaaacttcaacggtagtgccttgtcattgagattgtcgtcgggctaattcaataaagaaatacctgtcacctgattttggaattaacaattaagttaaaaaagaaggcatgaagccggggctcaaattattttgtcccgctttcgtgtccttctgaaaagtagatatgtgtcgtaaaattggtatcatcttatagcattggcttttgccaaaagtgtttaaagaagttgccgtcctctttttcaggtttttgaataatctttaccttggatgactgaccctgattgtctacttgttgtttttctgcctgatccttgtcgaaatagtcaggatctaattggccgcgttcattactttgaggtgcccttgtaagtgttgcgacagcggatggtgtgctgatctgctgctgcaattcggttacttgtctttcaaccttttgagtccgctgttcggcaactaattgcaaacgctgagattgatcaaggagacgtgttaacgtttcgatttgcgtttgttgggcctttacccgatcattcaatgattcgagtaagtcgttttctgtagcactgcgattagtctgtctcggttgcgatgctgtttgggcatttgccggttcggtttgtcgaatcgcgctttcaacggcatttttcgcttcttgatcgaagtaaagcgtttggccctttttaaacgcctctgttaagccaagccttgaaatcgttcggtagacccgcattttattcacgctgagttcatcagcgatctgtttcattgtccaaccctgtttttcctgttcactcaattgaatcaccaccgttatgttatgtatcgttacgttattgctttcaaccccttattatacattaaaatcaaagtaaacaacaattaattataacaggacggttacggtctcgtgagcaacatcagtaagtggaaatattgttgttaactgttgtgaaagatcggccataagtattagtcatcgttgttgcgggagatggccttttgcccaacaatatcagggatttgtgctatcattgtttctgtctaattaatttctaatgtaagaggtgaatccgatgagcatctttgttaaattgagttggtattttaagcaggaatggaaaacctatatggttggggtgtgcggtttgatattgactgcgttattagcaattattccaccaagaattattggtgttttagtagatgctattcacagcggcaaactcgccgccaacaatctgatgattttgttaattgtactggccgttgtggcaattgcacaatatggaagtcgctatatgtggcggacggctatttggggtgaagctgccaaacttgagaaagttctcagaaatcgtttgttttggcattatactcaaatggatcaggccttttttcaaaaatatcgaactggggatttaatggctcatgcaaccaatgatttatcagcgattcaacgagttgccggcggtggcattcttcaatttgctgattctatgattactggtggaacaacgttgatcgccatggttagtttgattgattggcgactcacaattattgcgattgtgccatttccgttgttggctgttatggcgcgatatatgggatcaaaaattcatatagcttttcgtgattcgcaagcagcattttcacggttgaataacaaggcagaagaaagtattacaggaatcaaagtgatcaaagggctgggtcagcagaaagaagatatggcggattttgataaccaagttgcccaaacaatcaatattaatcggcgggttaaccgacttgattcattgtttgatccgatgacaacaatgatcatttctttatcatatgtcattacgattgtgtacggcggctatttggtgacaaccggtcagatcacgattggatcattagtgtcgtttgtttcttatttagccatgatgatctggccgatgtttgccgttggtatgctatttaacacacttgaacgtgggaatgccagttatgatcgggtcatggatttattgaagcaacaaagtaaggttattgatgaccctgatggcgcaaatcagtctccgaaaggtgaaattaagtatgatgtgcaacagtttgcttatccaggagatgatcgacttgccttacaacagattaattttgaagtgccggctggaaaaacagttgggttggtagggaaagtcggttccggaaagagtacgattcttcgtttgattttgcggcagttcgataattataaaggatcaattaaatttggcggcattgatatccgacactacaaaatggacgcgttaattccggcaatcgggtatgtaccgcaggatacatttttattttcagattcaattcgcgaaaatatccgctttgcaaggcctcaagccagtcaaaaacaagtcgagttggcagcccaaaagagcgatttatttgatcaaattaaaggaatgccggatggctacgatacagcggtcggcgaagagggcatttctctttccggtggtcagagacagcgacttgcaattgccagggccttactaattaaccctgaacttttgattttggatgacgcattgtcagctgttgatgccgaaacggaaacccaaattcttgataatttacgttctgaaagaaaagaaaagacgaccattatttctgctcatagactgagttctgttatgaatgctgatgagatcctggttattaatgatggccgaattgcggagcggggaactcacgatgaactaatgacgctcgggggttggtatcatgatatgtttgaacgtcaagaattggaaaccaaggtgaaaggagggcaaaataatggctagttcgaagcgtcagtcagcatggtcggaaagcatccctgttaaagaacagattcatattattggtcgtttgtttcactatgctgcaccatataaatggtacttttatttttccgttttctttgcgattgcggtttctgttgttaatattttgttgccgaggatcattcagacttttatggattcacatttagtggttggtcatccggattttaaagtcatgtggttttttgccggcctttacttctttgggatgatcatgaaagcaatcatgcagtttgcacaaacctatctgtacgaaatgggtgccgaatatatgcttgaaaatactaggcgacagttgttttcaaagctgcatcgattaggaatgcgctattttgaccaaaccccaagcggctcgattctttcacgattaacaaatgatacaatggccttttcaaacttctgggcattgttcagtagtttggtggtcacaatttcagcgatgatttcttcgttcattgcaatgctgcttgctgacacgacgattgcactttggctgcttatatttatgccgtttttagcagttaccgtttggtactatcagcggtatagcacacgtgtataccgacgaatgcgcgagcggcttagtctgttaaatgctaaattagctgaaggtattaccgggatcagtgtgattcagcagtttcgacaggaaaaacgggtgaaccatgaatttaacgatacaaatgatcagtattttaatacgcgacgtgcaatgattcgaattaactcgttattgttaaacccgattattaatttattttatgctttgggaagtgttctggtcttaggtatgtttggtgttcgcggtttacatggttatgtggccgccggtgtcatttatgcatttgtcacttatcttgataatttttataacccgatgtctaatatgatggatcgtttgtcagactttcaggatggtgtagttgccggttcgcgagtgcttcgaattatggacgatcaaacgatggagcctcaacagcattcggttgaaggggcaacgatcgctcaggggaagattgaatttcgtcatgtgacgtttgcctacgatggtcaaaacccggtactccatgatatctcttttgttgccgaaccggggcaaaccatagcgctggttggtgaaaccggaagtgggaaaacttctattattaacattttgatgcggttttacgagtttggcagtggtgaaatcttgattgatgatcgtgatattcgggattatacgattaaagaactgcgagagaaaatggggttagtcctccaagagccctttatgttttacgggacggtttcgtccaatattcgaatgtttaatgagcatattacggatgaagaagttcgcaaagccgctcactttgttcaagcagatcagtttattgaagcacttcccgatcagtatgaggcgcgagtgattgaacgtggggccagttattcaagtggtcagcgacagttgatttcttttgcgagaacgctggtaacggatcctaaaattttaatcctggatgaggcaactgccaatatcgacactgaaactgagcaggttattcaaaagggactggcaaaacttcaggaaggccgaacaacgatcgcaattgcccatcggctatcaactattcagaacgcagatctcatactggttctggaaaagggtcgaattgtagaacgaggaacaaatgatgagttgctgaaaaaacgtgggtattactatgatatgatcaaactgcaaaattcagcgcatctggattaagaaaagatcagtaaataaaaaaagcggaaaccaccaaatgtggtttccgctttttgtgatgataaacaatcattggatttcaatttgactgttcttgtcgttacttttagcagcttttggcaaaacaatgtttaaaacgccattttcaacctgagctgaaatatgatcacgatcgacactaggaagttcgtaagtcctggacataacaccgtgactacgttcactggcaataacccgaccttgttcgtccttcttttcggaagcatgagtttggtcaatatttaatgctaaatcgccatcattgtaagccaagtgaatgttcttcttatcaattccaggaacgtcaaccttaaccatataatcctgatcagtttctttaatatcagtcttaagggcacccatatttactgagtcgttttcccattcagttggactgaagaagcgacgtgctaaacgatcaaagaatggatccactgcaaaacgattcatcatttcatttgccataataccaatctcccttttaaaagttattggattatgaagcgtttcaatcggtgaaatgaaacttctctcattcccccaattaatgttaattgagttagcgtttttattttttaaatagaattagttgatttcgatatgaccatcctgatcatgactttcagtaacttttggcaatgtcacatttaaaacaccatcgtctaccgatgcagcaatgtggtcgcggtcaacaccgggcaatgtgtagctgcgtgacatgacaccatgactacgttcactggcaataactcgaccgttctcatctttttgttcagatgaatgatcttggttaatgtttagtgacaatgtatcgttttgataggccagatggatatcttgcttatcaacgcctggtacatcgatctttaaagtataatccttatcggtttctttaatgtcagtctttaaattgccaaagtttgcataatcattatcataattacttgggctaaagaagtgacgtgccatacgatcaaagaatgggtcaacatcgaaacgattcattaagtcatttgccataactaccaatctccttatatacaaaattttatgatcggtaaaagttgacggaacactatttttttcttttttggttcccctttacctttcatcttctataataatcagtttgaacaagaatgctagtaattagcactctcgtgtttagagtgctaattatcataaaatctttcatcttatttgtaagacaatagcgaaccgttgctggaacggtatactataaatgaagactttttaagatcactatttgaattgcaatttgaggtgttgtctacgtgaaaagatcagatactaaaattaagctcggcggaacacttaagtcacttatgatgacgacgccggttgataaaataacgatagatatgctgacacagaaagcagatttaacccgcaatactttttactaccactttgaagatatttattcgcttttggaatgggtctataaacaagatttgctatcaaatattaatgcctatactaagattgaagattggaaggtggcttatcggttgattctcaattatattgaagataataaaacgttttgtatgaatacgtttcattctgttgcgcgtgatttgttggaaaattttctttattcggttgcaagtgatttggttggtaaggttattattcattcggatcgaaatgtttctaaaaaattaaccgagtcaatccaggacttctatggatgggcattggtgatgcaagttgttcaatggctttccaatgatttgaaagaatcaaaagcagatgtgattcaacgagcatcaattatgctaactgggggtatcgataatgcaattcgaaacggtcagcgagtgaaaggatttgggcaaatgagttgaattgaccattttaattttagagaaacaactttagaatgagagtataacgtaacagcttacaaggttaccagataatctataaactattgattggaagtgtcacaatgaaacataaagaattattgatttttgggcttggactaaccgtggccagtttatattttttgaaatcaattggttggtttgaggatgattcccacttatatgatgagtatgaagccaaatagtatatgtataaaatgagttgaaattgatcggatttatcagggaggttttatgatgacaaagaataaagcgattatgattggtgccggtcttgcaaatatggctgcagcagtgtacttgatccaagaaggtcattggaatggtaatcaaattaccttctattcgttagatgatcacggatcaaatgatggttctgctgctaatgatgctgctgatgaatattggaataaaaatcatccgttggaaaacaccaaggggtttgtcgctcgaggcggacggatgcttaattatcgaacatatgttgatttaatggacttgttaagcagagtcccgtcagctactgagcccgggatgactgcagctgaagataccagagattttgatgctcatcatcggacctttgacaaggcccgtttgatggagggtggtaaaggtattctaaatgctggaaaacttggattaaataacaaagaccgtcttaaactgacagaattaatcttgatgccggattctaaagaggaaaaactcgacaatgtaaccattgccgactattttcaagatgatccgcatatgtttgaaacacatttttggtatatgtgggaaacaacgtttgcttttcgaactcaaagttcggctcaagagttgcgccgttatatgcacatgatgatttatgagttcacacagattgaacatttagtaggtgttaatcggacgcgttataatcaatttgaaagtatgatgctgcccttaatcaattatttgaaagatcagagcgtcaatataattttaaatcgacgagtgacggattttgattttaaggatacaccgatgcaggatgaaattacggtcacggggttaaccatgaccaatactgaaaccaacgaagaggaacatgttgacgttgatgacgatacagccgttatctttacaaatggctcaatcactgactctgcgactcttggagattacaatacaccagctgcggagaatatggattacggggctgcagcgagtctttggaaaaaggcaactgcccgtttctataatttgggaaatccagacaagttctttaacgatcgaaatgccagtgaatggtccagttttactttaacgacaagtaatcatgttttgttaaatgaaatcacccgaatcactactcaagtaccaggtaatgcacttaattcgttcttatctacttcgccgattacgtcactggggcataaggacgttaatatgtcgattgttgtccatcaccaaccgcattttacaacgcaaaaaccaaatgagtccgttatttggggatatttcctttatcctcggcgccgcggtgaatttgtccaaaaagaatatattaaaatgacgggtaaagaaatggctgaggaattgattggtcaattatcaaaagttgatcccggccccggtaatattatggataagaaacaggagattcttgacagtattatcaattgcattccggtttatatgccctatgcatctgcgttgtttaataatcgggccaagtcggatcgaccaaaagtgattccacagcattcaactaatttagcgtttaccggtgagtttgttgaacagccatatcaaatggttttcacggaacaaagtgcggttcgttccggtgaaattgctgcctatcactttgccggtgttccaatggcaaaattagttaaaaacaagcgttatgatcgagatccaaagacgttggcaaaagcaacaaagaaaatgtttgaataatgtttgaggagcacaataagcaataacagttggagaaagcattcaaattcagtgaataaatttgaatgctttttgtattaataaaaattaacagaggggatgacaatgtgacaactaacggattgtgatgaaatcatctctaggcatagaaaaataaatccaaaaatggtattctataaattagttatagtttgcgttacacttaaaacacactttatgtctccatattaaagaagggaattcttatgacgcattttgacaaacaattcaaacgactttttttggcaatagccgctttaatcttattcataccactatttggcagttcggttgcaaatagtctctttagtgatggtcagggaatggctagtgctgcgaagaaatcggataaatttgatgtaaacaaggttgttaaggcgacggttgtttattccaagcatgtaccaattttaaaggtaaccgttaagccgactattacaaatgcgtttgcaaaaaaagatcaattgaagtttgaatttgacaagaaaaatgttgatttgaagaatatgcaggcaagtgttgaaaaaaacctgccttttaaacatacaaccaaaaaagatactgcccttctattaacgtttgaaaaggatgttaagtctggtacatataagcaagcgtatgctattccaaccaagaagctttctaaaatcactaagattaaagccacttataatggacaaaagattaaaataaccaataataagatcaagtctggtaaatatgctcaaaaacaagctgatacggcgtccaagaaagatcaaagcgattttaaaaataaatcaacaagtacgaccaataagtccagagatagtcagtcagcagataacaattccagtaatcacacaacaggtgctcgggaaaatagttatccagttaaagctggcgctgtaagtgatactcaaagtaccgttgctccacaggcaagtggacagtacagtaacgatcggtcggcaacttcgacgtctcaagaagcgtatggtcataccacaacgattagtcattatggggatgcaactgccaatacaagtaataattacgcctcaaatggttctcaaaagacaaattggaccgctacaacttctcaaaccaataataaagactatggtcggggaacaggatcatcttctgctaacgttacctatcgtccggtttcatataatagtggcgtaaataggtcaggtaacggtgtatcgaacaaaaatacaagccgccataacgataaaaaagcagcaagatctaatagtcaaaagtcctcgaagtcaactgtgaagacaaagaaaactgaaaccggtaaaaagacgacgagtgacaaaactaaggcttctgacagtaagaaaacaactaataaagatagtaatgataatcagaaaacctcaaacaaaaacaacaagagcgattcaactgtaaataaagcaggtgattcttcccaaaagaatgatgatggcgcatcaaataataatgcttcccaatcatctaatactaactcaaatgcagacagtaacgatcaaacaacgccaacctcgccaacaactgataataaccaaacgcctgctgtaggtgaggacaatacgaattctcaggaatcttcaacggtagatagcagtggaaatactgataatactcaaaatggatctcagacaacaagcgatagtcattcggcaacgacgactaatactaatgcaacttcaacaagttctgatgatggtagtagtaaccaaacacaagcatcatcgacaaccaatgatcagcagagtacacaggatcaaagcgcaactcaaacaatgacagcttcaacaacaggaacggcgactgcaggtagtaatagtgttagtacagctgtggcagcataaacataaattaatataaaatttttgagccataaggatccctttctatcaagcagatagaactagggggtactgtgacacagtaagctaaattgcattgaaatgacaagacaagcactagtattcaggtttattaaagtcatcaaaaaattgacgcattaaaattctgccaaaacagcaggcttattaaatttaccttttttgctttattatggattgatatgatagttatccatagccatagtagttttgataacggttctatttaaaggatggtttacgactttgcgctcatagttgatcataagcgtattaattaattgttaatatgggatggggcttaaaaatcgcaattttaatgatgcgtaagtaagcttaaagttcatcattatttagaacaaagctataaaataattgaggcggtttttaaacagcttgacttttaatatgaacatgaacagattacaacagtacgagttcctttttgcatagagaggtcattaaaaaggaaggcattgtgtggccttcaaagtgtggactaagatagatttaaaactaaaatagggatgtgttggggaaagcttaaagttgccgccggcttgttcactatattaaacgcaagactgtgggaagcactctcaataatttttaaatcggaaacctatcacgaactggttcgcgaacttgtgggatcaaaatgaaaataattttcatacagtttcttgagtatagtgcactcaagaaatgagtgtaaaaaaagaatccacaattttttgtgaactcttagggattacccgataatgtttaagttgaggatttaacggtatgttttttcaggaatgtttttaactaacttattgaatatcaataaatcagcagcatcagttatcgttttctgaacgggtcgctgcttccaacctaataatttttgcgcggactgggttgtatggctatactttcgttttagcatcggcaccagcggacgtaatgaaggtgaaaactttgaagcaaggacagtaacccaatttggcagataggtgaatttaagttgtagccttggatactgtttttgatagatttgcgcgatttctgccatcgttagtttttggtcagctgccagaaatcgatggccgattgcgacatctttttctaatgcaagacggtgtaaggttgccaaatcgcgaacatcgctgatttccatcggcacttttggaatcattcgttcaccgtttagcaattttaataagatctcatcagaacttaagcgatctggtgaaagaatggggccaaaaactgcaccgggtaaaattgttgttaattgtagttgattgtcctttgcatattgccaagcagctctttcggcctcaattttggagattctatacgcatccaattctggatttttaatgtctgaccaaaagttttcgtcaattgtcttttcaccaacgcttatagatggtgttgaggcggcctctgaacttgtcatgataattcgtttgatatgattatcttttgcggcttttaaaacggtaagcgtaccgccctttgctaccttgaccatctcttccactgattcagtaccgtgaccaagaggtgaagcaacgtgaatcacgccatctgcccctttcattccctcatcccaaccattatcatttgtcagatcagctttaaagaaagataaattctttgaaagtgctgttggttgaagtagcatgattccctgaccaatttcttctgccctagaagtgtctcgtaatgatgcacgaactttataatcatgagtgagtagttctctgatgatccagccagcaacaaagccggaaccaccggtaacaacgattgtcttcatcttcagattcccctttagtcctgatattagacaaaatatacttctttttgtataatttgtcaataaagatggtagatgagaggaattgaaaaatggtggataggaaaatagagcttgtcgacaaattaaaccacattatgacagcaaatggatttaatactttgtcaatgaatgaattggcaaagcgtgcaaatgttagccgtgcaaagctatatatctattttaaaaataaacaggaaattgtcactgctgttgttgatcgccatttaaaatttattaatcagcaacttcacgaagattttaaatcgacagttactgattatgtgcggattaaactgaatcaattattacttattggtgcgcagtcaccgatttttagaactgaactaaaacaatattttcctgagctatctattaagctggaacaggcatatcatacctttaaatcatcttttttatcagttatggttaagcttcaaaatgaaaatattatcatccagcaaatcgattttgaaaacttgtttattcaggatgagttgatgattcacgctgcgttaagccacgccatagacaataaatttaatttagaaaaagctcaaaaactacttgggaattatttagaaattgaaatccggggcacggttaacgatcaatcattggtcgcaaatgcctttttaagcaatcaagaacttttgaaaataatttggcaggaattaaacgatacttattttagcgtaatttcctattaaaaaagtcaatcgctaaagtttaacgattgacgaaagggtaacaattataattaattaactaggcttgtaacaacattcccaaggaatagtgaataatcatggtaataataccaacaagcacatttcgaatcatagcggtttttacaagaccgtttcccaaacgagcgctcataaacccagttaatgcaactgaaaaacaaacggcaaggatggtggcctgccactgataggcaacgggtgtgaccgtcattgctactaatggaaagatgcctcctgcagctgcagagaataaggaagaaaatgctgcgtcccatggattcatataatggcctagttgaagatcatacttaatattaacgatagtttccaagggtttcttcttcataagatcatctgcaatcttgtcagccgtttgttttgtgacgccttgatcgacgtaataatcggaaacagtttgcagttgttgcttatagttggtttttaaaagttctttctcttttctgacaacggattgttcggtatctttttgggtacttacagaggcatattcaccggaagccattgaaaacgcacaggctagaagatcggaaagtcctgcaatgaaaatagtgaattgatttgtagtagcaacagcaacactaaacaggacgccgacaaccgtcaggataccatcattggatcctaagacaccggctcttaaggagtttagtttttcatccatcgtttgagatggcttttctttcttttttgaacgaatactcatcatttttctcttcccccgataaaatggtatcaagattacgaaccgattaaggttccgataatataagtgactgtcatagtcaaaatccccgaaacaacgtttctaaacatacctcgattggtgttagagtttccaagctttgcagcggtaaaccctgtgattgctaaggcaatgataaccgcaatggcagttgcaataattctgattgacttaggaaacattgtgattgccacaagtggtaaaatagatcctgtcggaaaggaaatcattgaggcaattgcagctgagagtgggttcgtaaactcaccaacgttaaagccgtatttttgtcgaaccgatgtttttaatggatcgcgtgtcatcatttctttagttgcttgttctgcaagatcggtagaaataccgtctgacacgagcttctgacggacagcgccatattcatgatcatatgattttgcgagtgcatttttttgctgattaatggcatttctttgtgaatccttctgggtgtttacagaaacaaattcccccatagccattgaaacggttccggctaacattccagaaattccggaaataaaaattgcaaagttatttgacgtagcacctgcaacaccgataacaattccggcaactgacacgatgccatcattggctcccattacagcggctcgcatgacgtttattttctgtgctaaagtttttttcttggcgttttgtgccatggttacaccggctttctaatttataatgattattatctgatatcgattattattgtatctcaattcattacaaatgtaaattaaattaccggattaatatagataaaattatttcggcacaccttaattttaacttagatttccataaatacatagtctatctataaaaactttaccaaattagttatttttgagtttcaaacggtatctatatttaaggaggcaacgtctatgtcatcagcaaccaacccaataattgagcaattgttagctcaccgaagtatccgacaatttaaggataaaaccttaacaaatcaccagattcatgagctgattgaggctgcccagcatgcttctacgagcactttttctcaacagtattcgattatcagcgtaacggatcagcggatactgagtgaatttgcagagatcaccgggcatccatggttacttaaaagcagtcattattttgtgatgattgcagaccaatatcgtaatctccaaattgccaggaaagcaaatgctgatccgtttgttctgcacacaactgataaatttttagcggcagtttttgatgcatccattgcaaccgaaaatgtgatggttgcagcagaaagtatggggcttggtgcgaccattatgggtagtattttaaatgattcaaaaagagtaattgaccttttagggcttccggaattaacgtttccattattgggaattgcgattggataccctgcagatcagccggaattaaagcccagattgcctcaagaagaagttcattttgttaatcaatatcagttacgaagtgataaaacacagttaaagcaatacgatcaattactttcggattattatcgaagtagaggttctaacaacagggtggaaactttcagccatcatattgtttccgaattgggaatcgggcatcacgttagagctgatttattgagtaatattaagtctcaaggctttttgattagccaagcggaagattaaaatctgcgcagaagctatatgataaaataatgagaataacagttgactttttttgcaattaactttacatttattagtaattggttgacagttttttacttcaacattgacgagaagagtaaatcgaaaacctgatataaagcgaccattaatagtgaaagaatgggttaggttgattgaaagtgcactctgagttggagatagggattaaccctaaaattttataaattctaatgaaggtgtgtggggacgatacagtccttaaacacaaagtagggtggaaccacgttgaaaacgtccctgttattttggctaatccaagatagcagggatttttacatttaatttttaaaatgctgttgattaatatggtaacttttttgatcgaattaagacgggagatgatttttaatgagttgggctattatccagcaaagtttgccaatgtttggtaaaggctttgttttgacgttatggctatcttttgttggcattatcggctcaattattgttggcttgatttgtagtttgtttcaatactttaaggtgcctattcttcaccaaattgcctcagtgtatgttgaaatatctcgtaatacaccactcttgattcagttattctttttatattacgcttttccggttattggaattaaatttggtgccgaattatgcggtattattggtttgatctttttaggtggtagttatatggctgagggattcacgggtggtttcaatggcgtttccaagggccaagtggaatcgggaaaagcaatcggactgagtcgttggcaattggcaaaatacgttgtctttccccagggattttcattaagcgtaccggcaatggctgcaaatatcatctttttgatcaaagagacctcaatctttacagtgattgcaatccctgaattgactaatacggctttggatttaatcgggatgtattatcgatcaaatgagtatttattggtcttggtgattgggtatgccatcattttggtgccgttgtcaattgtgttaacgttactggaaaagagggttcgttatggcgcattcgggaattagtgtattgctcgagggaacaaactttatgcggcttcttggcggactttgggtaaccgttaagattgcagcggttgcattaattgcgggtattattctaggtatcgccttaggtgttttgagaacgtttaagaatcgtccgttaaggattgtgttaagactttacctagagtttttccgagttgttccaaccgttgttttgctgtttttattctattatattttgccaaagcagatgaactttaatttgccggctgatcaacttgcaactttggtatttgcactttgggttggagcagagatgagtgatattgtacgtggcgctctgatttcagttcccaagcatcagattgaatccggcaaagcgataggcttaagtcgatttcagctatattggtacgttttgattccgcaatcgattaatttggaaattccggcaacaattaatttagctactcgggttataaaaacgacttcaatcctgctattaatttcggttatggatgtcattaatattggtcagcagattattgaggccaataatcatacttatccgaccggtgtcttttgggtttatggattaatattcctgttctacttcctgattgattatccgttgtcgtggtgggcaaagcgattagagaagaagagattggagcgggaaaatggctgaaaaagtgttgcaggttgagcatttggaaaagtcttaccaaaagaaacatgtgttacatgatattaacttttctgtggcgcagggagaggttgttacgctgcttggcccgtccggttcgggtaaaagtaccctgattcggtgcctgaacggtctggagatatatcaaaaaggaacgattacatttgaagggcaaaaaatcattccaactgagaaaaactggcaacaaattcgtcaaaaaatcggaatggtttttcaaagctatgacttatttccaaacttaacggtcatggacaatattttgctcggccctacaaaggttcaaaaaaaggataaagtaacagctcgctctgaagccttatcgcttttaaagagtgtggagctagatgattatgccaatgcctaccccagagaattatctggtgggcaaaagcagcgggtagcgattgtcagagcattggcacttcacccggattttatgttgtttgatgaagtaactgcgtcactcgatcccgagatggttcgtggtgtattgacaattattgaaaatttagcaaatcgagataatatgacgatgattgtggtcacccatgaaatgaattttgccaaacaaattgctgatagggtgctcttcttgcaagatggcaggattttggagcaaacgccatccgagcaattttttacagcacctcaaacggatcgggcaaaagcgtttttagatagtatggatttttaactgagtgatatcttgaggaggaaacttataatgaaaaagcattggttaacgaagttgattgcggttgtcagtgtgttggcaactttgcttctggttttgtctggttgtggcaatagtaaaaagagttccagtaacaatccgagttcagtttcgcaaattaagaaaaagggaacaattcgggtggccgtatttggcgatttaccaccatatggttgggtcaataaagatggtaaacgggttggatacgatgttaaattagctcaccaggttgctaaggacttgggcgtaaaagtaaaatttgttcaggttaatgccaacaaccgagttgacgcattgaattcaaacaaagtcgatcttgttttagctaattttacggtaacgcctgagcgtaaacaggttgtgagttttgcaaaaccctacatgaaagtttctgttggcgttgtttcacctaagaataagccgatcactaaagttagtcagttgcaaaataagaatgtcattgtgactaaaggaacaacggctgaaaattacttcacttcaaaacagccaaatgtcaagttgctaaagtttgattccaagacacaacaatttaacgcattgaagaatggccgtggtgttgcacttgcagatgataattcatatctttatgcatggtccaagagtaactctaagtataccgttggcattaagagtattggacctaaatcgtacattgcaccggctgtaaagaaggggaacaagtcacttcttaattggacaaataaagaaattaccaagctgactaagaaaagtttctttgttagtgactacaatactgatttaaagccttattttggtaaagaagttaaaccatcggatattgtattgccgacaaaataaatgagacggctaataaatgaatgaagcgagaacttgatcgcctgagtttccgattgggttctcgctttttgtggaaacacaagttattgcgagctactaagaattcggaatattaaaataattttaatgttgacagataatttctaatatgttttaatagattcaacatcaaacaggaaaggaatttttactatgacgaaacttgttcaacaacttaatgcctattattacggctatgcttggtttagatagcgcccgtgtagatgcgggcgcctacgcgttcgcgtctaacagcaaagccgttattggttgttgccagctagacgccagagtctagctggataggataattcttttacgcgagtagaaaattagccagctggattctcaaatccaactggcttttttaatactttgggatggagagtgacattatgatgaatacaatgacaaaatcgaacaaacggaggctttcaatcagcctttacttaaactaccttgttcatggaattgggttgattattttaactcagaatatgcaggctcttggaaatttctggaaagtaccaattgcaactgtctcctacgtgatttcaggaattggaatcggtaaattaatcgcatattttttatttggttacctatcggatcgatttggccgccgtcaattggttttaaccggaaccttaagctatatggttttctttatcgggatcccatttactcataatattgcgattgcatatgtatttgctattattgccggagttgctaattcggcacttgattcgggcacatacccgacctttgttgaaatgggcggtagttccagcgcttcaaacgtgtttattaaagcttttatgtcactcggtgagtttatcctgccattggcaattgcgatgcttgaagctaagagcttatggtttggctggtcatttatcgggacgttgcttgtgcttgttgccaacctgtttattcttcgaggtgcaaagttccccgagatgaatcatgctgatgaagcttttatcgaaaatcacgagaatacatcgaaattaagaaaaattattgcaacagtttcactcgcaatttatggctatacgacaatggctattatgattttatttactcagtggattagtatgtttgcgacaaataatcttggttatagttcattggtttctcacggattgttatccctttatagtattggttcaattagtggtgtgattttcaactttattcttctgaaaatgaaagtgtcggaaactaaattactggttgcgatgaacgcgctctcgctacttgcaatttttgttgtcagtcattcggccactgtcctggtcacctttatcgctgcgtttgcatttggttttactgcagcaggtggggttatgcaggttgccttgaacgttttgttgaagatgtttccaaaacataagggtattattacgggtacctacttcacttttggaagtattgcgacttttacaattccaattgtgactgggtggttgtcaaaaacaaatattcagttagtgatgaactttgatgtgatgattgaattagtcggtactatattagttgttcttgctgcagtttcgttgagttctggcagtgtactttcaagcattcgccatatggtaacagggttactgcacgtgcgaacatcaacgatttccagtgatcaaacaaaagataactaaaaatgacgtataaaataatggaggctgcgacaaaaataatttgtccagccttttttaatatcatcacgactattattgaaaaaaatgtgaaaaagaaagcaacattctgccatgaaatcgaattatcccactatctctactcaaaacatagttggataaaccaattcactctgaaagttaattgcctcttgttccactcttattttttacaatcagttcaaagtggccatgccttttctgacagcttccaccgttagttgaccaggtgcagatgcctctgcaacggttgcaaatgaaagtgttgatccaaagagcggaccggttaccctgctaaccttacccaaatttcccatagacattgtaataatgggaatttcaagttcgcggtttgctttttcggtagcgtttaataaagttaaaacatctttggaagtatgtggcataacagcaatcttaccgatatcggcatttctttcctgcattcgttttaactttgaaatgatctcagtttcatcaggcgttgattgaaaatcgtgattacttaagattactgggatattttgatggtgagctaaattaatcaaaaaatcaaccgtggctttattgcgatttaattcaatatcgagcatatcagttagccgattttctaaaagccatcgataggtagagaagtactctgcatcttcaaggcttgagacaccgccttcatgagcggtcctaaaggtcgttaaaagtggtgtattcccaataagtgactgaatatggtcgacggtgtctagatagttctcatgatcaagtacatcgcgatcatagtcaatacgccattctatgacgtctggatggtgattaagtgcttgtttgacttgactaataatgtcagtactaattttaccggtaatcgggacagcgatattcgttttaccggattcaaatgttgtatgttttacttgaacaattttcccagccattatagaaatctccttacatttttattgaattaagtttagcaagacaatgggataaacacaatttaaaataatggttaattctattaaaccggctaatttagtagtattcttaagtcgaatatgatggatgaacagggtgatcattaaactgtttggaggcgattctgatatgggaaaattagcaactagtgttagtatttccggcggtatgatcggctttatgctactcaccggtattgtcatgtttttaattccgattggaacttattggggattgaaaaggcattataaactggtttcaacaccagtatgggttgggattgcagtttttattgttgcagtaatgattttggaacgaatccttcacatgattattcttcaaccgtctgcggatggttctatcgctttggcaactcatcatccatacatgtacgttgcctatggcgccttggtggctggtatttttgaagaaacaggacgttttttcggctttcgttatctcaaaaaacgggtttccggctttggaacagcgattgcatacgggattggtcatggcggcattgaaatgattttaatcgggacgatgggaatggttaaccttgttgttatgagtgtggcaattaattcgcgaaacgctgcagttttatctaaattaccaagtgggacgattcattctctgattagtcatgcaggtgctgcgactactagttctttttttgaacgaattgccgcctttattattcaaatcttattatccattattgtatgggcctcggttaattatgtgggaaagatttggttatatcctttggctattggcctacatgcgttaattgatacgcctgcagcaatgtttcaggctggcataatatctaacgaattaactgttgagattgttttatggatttctgtcttggcaatgggcgtatttgtgtatctatatattggtaagttgcggaaaagtcgtgtcactactagttaattaagctaataaattaaagtaaataaaagactgtcatttatatttcaaaattgtttaagaagataagcaattttgaatcgttaatcaatgacagtctttttatctgaattagaaaccgcggaaatcgtttctgccaaagtattgtaaattggctaatagcggtttttcatttaattgctccaaagtaacaaacgtgtaaccgcgcttttttaaagaacggataatttgaggaacggcggctaccgacgttgcgtgaatatcatgcatcaaaatgatagaaccgttggttgttgtggaaagtacgtggtcaactgttttagcagtattgaggtaagaccaatctctggaatcaacggaccaacgaacgattggacgatcgtacaaattaccaatccgtgaattaacagcgccatatggtggtcggatataatatggaatggtgccagttgctttataaatagccgcatcggttagtgaaatttgtcgaagtgctttggcattggtcagatcggttaactgtggatggctccaagaatgatttccgatttgatcaccatatttcaggaccagtcggctaatatttggatatttaataacgctgctgccaacttcaaagaaagttgccggtaccttgtatttttttaaggtttttagcaaccttggcgttaaagttggatccgggccatcatcgaatgtgagtgcaacaacctttttggcggttttcggtttaacaaagtcgtatttagctggcatataacggtttaaaatgatgccggtgagtttgctgagtggaatagcaacattctttacgccatagttatttttggtcaaatgaattgttaagtgttcattgtcgagtgtaaaatttttcgcggttaatcgttttggcagtggtaaataaaccagttgctgaacttgcttacctgttagtttatgagtttcagccaatgttgttcgggtcaattgtcggatagtgcctaaacgtttcgtactattgttcgttatgtcaccgtacgttagtcgtttcgttgtgctggtagtctttgttgctttagtcggcgttgatgctgcaaagacaggttgattagcaatagctgctaatgtgaagccaaataatgcagcaacacccagccgccgaactaatgaatattttcgaatcataaaaatccccccaatatggataactgatgtttctaaatccagtttcatttttacatttcggttatgagatgtcaacgagaacggaagctgaatcgaaaatcgggatggaaaaatggataaataataaattgatagttaatggttgacaaaatgatattttcggaataaagtaccgttaacattaaaaacagataaaaaaatacttagaaaagttgaggagtcgattttaagaaatcctaagagagtgtcactatctgggaagacatgatttcttaatgattcaaagtcaacttcgagtattgtaattcgtaagagttatgcgggtgcgcccattacagcgtcaacgttataccgttaatccggtcgtacgtgagagacgaaatttatttcgtaagtaaggtggtaccgcgtaaaagcgtcctttcagaagactatttctgattgggcgctttttttattggatttaagtatcacgtaggcaatgattttactactaaaaagaaaacactaagagcagttaattgataagcgattttggaactgaaaggaagatttattatgacaacgactaactatgtgaatgcagcaatttataatcataatcaacagaaattcattttcaaccaacacatgattgtggatgaaaatactggaaaaattattgaagcgggtaacgggcgtacaacccgacaagtttgtgatgacgttgtcgatcttaatggcagatttgtgatgccgggtattatgaacgcacacacccatataaccgatatgccaacctattggtggcataacggtgaggagaaacgtcatccggactcccgcgaggtttgcacaatgtttgcgattcgaaatatgcaggatgccctttcacatggcattacatatatgcgtaacgtaggtgcagaatttgatatagatgttgaaatcaagaaaatgcaggaaaaaggttggattaaaggaccaaaaatcatgacctctggtcgagcattttcaattacaggtgggcatgattctgaaagtacttatgaggttgacggtattgatgaggttagaaaaggcgttcgtcaggctttgaagaacggtgttgataacattaaaatgatggttaccggtggtgttctaaagaatggtgagacaccggatgatattcagtttactttggaagaggcacggactgctgtatctgaggcacatcataaaggcaaaacagctgctgcacatgcgcagggaaatgccggaattaaagaggcggtggctgccggttttgatacgattgagcacgcttttgatattgacgatgaggccatcacaatgatgaaagaacacgggactatcattgttccaacgatgaacgccatgtttgcaatctataaatatggtcggggtgtcgttccggactgggcacgtgaaaaggtcattttgaatatcaaaaaacattttatgagtattgctaaagctgcaaaagccggcatccctattgcaatggggacggatgccggtacaccgtttaatggttttcaaaacgagagtgcctatgaaatgcagctttatgtcgaaaaagctgcaatgacaccagctcaagccattgatgccgcgactattaattgtgcaaaggcaatgcatattgatcaggaatatgggcagattgctgctggaaactatgcagactttcttgtcatgaatgaaaatccgatagatgatatcagtgtggttggccatgataaagacgtttatcaaaatggaaagagagttcatgctcaagaagtggttaatgagctaaaagccacccagaaaattaaaaaaatatccgcagcaatttagcgacaagtcgcgattaaaaagagatgagagaattattagggttgacggaacttccctaatgtggtttaataatgacaatctaatgagaggaattgatattaatgacaaagcatatatctcatgtaaatactttttattttggctatgcctactttatgtagtgtccgcagcgatgcggacgcaattcacgcgttcgcgtctgagtggtgcagagtcaatgctttgttgttgaccgctagacgcaaaagtctggctgggtcaactaccaattctttacgagtttagtaaaccggctggatatcattctagccggtttttttcttgaaaaaaatacgaggtgggataaatgttgacgaaaacagatccagcgtggaacagttcaaaggaattgaccgaggccagaaaacagatcaatcaacttgatgaatcaattgtggcgttattggcgaaacggtttgaaacagctgccaggattggcagtatcaaagagaagcaagggctaccggtttttgatccgactcgtgaagaagccgtacttgaaagggtcacatcatttgatcctaatagagataccagacaatatctctggaacatttatcgatcgattatggaaaataccaggcaatttgaacacgattcaaaagaaaagcctaaaaaatagggggaaaatacattgcttaactacttaaccgcaggagaatctcacgggccacaattaacaggaataattgaaggcgttccttccggcctacgtttggatattgatgaaattaatgaacagttaaagaaacgtcaaggcggatatgggcgaggcaatcgccaaaaaatcgagcatgatcaggtcacggttgttggcggcgttcggcacgggatcaccttgggatcgccaattgccctggtcgttaataaccgtgaccacgctcattggaatgagatcatgaatccaacaagtccagaaacatcggaaaatacattacgaaaagtggaacgaccacgccccggtcacgcggatttagtcggtgggatgaaatatcgtcaccatgatctaagaaatgtgcttgaacgttcgtcagctcgtgaaacggccattcgagtagctgtaggatctgtttgcaaacaactattaaagcaagccggtattcagattaccggttatgttgaacaaattgggccgatttccacggatgataaaccggaattaaatgtttctaaaattgaatcagagattaatcataatgatttgcgaattatcgatcagtccaaagtagagcagattcatgaattgattgataagaccagaaaagacggtgatacgcttggcggcatcattcgagtagtcgctacaaatgttccggccggacttggcagctatattagttgggataccaaactagacggtaaattggctgctgcggttatgggagttaacgcgatgaagggcgttgaaattggtgatggttttaaagcagctaccagttatggcagtcaggtaatggatgagattgactggagtaaagaagatgggttttccagggaaacggatcatcttggcggctttgagggtggtatgactaacgggatgcctattattgtaaaagcagctatgaagccgattccaaccctgtataaaccactacagagtgtcgatattaataccaaagaaattaaaaaagccaatgttgaacgttcggatacaacggcaattgttccagcatcaattgtgattgaaagtgttgttgcaattgagctggcaaaggcattgacggacaaatttgatggtgataatgttcagcgaatgcaggaacaaattgctgcgtacagaaatgaattaaaaaatttctaggagggaagctaatgaaagagctatcagataaactcaaaaccgggctgcatggtgaattgtcggttcccggcgataagagtatttctcatcggggaattatgtttggcgctgtcagtgaaggccggacgaccttacaccatttcttaactgccgaggattgcttatctactttaaaagctttccaacagcttggtgtatcaattaaacgcgatggtgaaacggttgtaattgagggtgtcggccttcatggattaaaacaatcgggtaaacctttagatatggggaattccggtacaacaacccggttaattatgggattattggctggacaaaattttgattcgactttatttggggatgattcattatcaaagcgccctatgaagcgggtaagcgaaccgctagccgaaatgggtgctgacatttgtgtgacggatgggcatttgccggcaagaattcatgggcagaagttgcatgcaattgattatcagttgaaggttgccagtgctcaggtgaagagtgcgttgattctggcggctatccaggctgatcaaccttctacgttgattgaaaaattacctactcgaaatcatacggaaaaaatgttaaatgcgtttggcgccaatattcaaacaatggccgataacgtcactattaaggtcaatccacaaccgaaactaacaggaatcgatttaacggttcccggagatatgtcttcggcagctttcttcctggttgcagctactttagttcctaattcaaaattgacattgaagaatgttggggttaatgaaacgcgaaccggtttgctgtcaatcttaaaacgaatgggtggcaaggtgatcgaacgccatcgtaatgattccggtgaaccaactgcagacttggttgtttccagcgctgaattaaaaccaattgaaattggtgcggaagaaattccggccgttattgatgaattaccgttggtcgctttgttggctgcaaaagcaaatggcatcagtaagattaccggtgccggcgaactacgtgttaaagaaacagatcggattgcggctgttgttcaggagttttctaagctgggaattgccatccgtgaattaccagacggctttgtgattgacggtgccaagccttggcgcgttgaaaagaccaaattggatagtcacggagatcatcgaatcgggatgacacttgccatcgcatcattattgttggatgagcagcttcagcttaatggtgcagagagtgttaatatttcatatcctgagttttttgatgatttggcaagcgttacaaatattgaaagttattcataaattgaggtggaaaagtcatgacaacagtgctgattagtggattggggttaattggcagctcaattgcaagggtgattaaacaagaaaattcggaaattgaaatcatcggtagtgatcctgatgatgaatccgcccagtttttacttgatcatcacttgattgatgaccgacaagtgtttacaaatgcggttcctttagcagactttatcattttagccggaccggtttccgtaattattagacagatcaatgaattgataaccttaccgctgaaaccggatgtatttgtaacggatgttggtagtaccaaagaagcaattatggatgccgccaaacctttaataagtgaaggtgttaattttgtcggggggcatccaatggctggatcggacaaatcgggaagtcgatccggaaggctggatttgtttgatcaagcagtttattttgtcgttggtgggacaacagccaatcccaaattggtgcagtttcagaatcttttaagtgctgctcatcttcgttggcaagtgatttccgcgtcgttacatgatcagctggtcagtgagataagccacgttccccatgtcatcgcggtgacactggttaacacgattgccgacgaccttagtcgtaatccggatgcacttaaagctgcggcagggggctttcgagataccactcgaattgctgcttcagatccaactatgtggacagccattatgatgagcaatgcggaattgatcaatcacgagctatccaaatttcaacaacatctgtctcagtttcaaacagcacttgaagcacgtgacgaagaagagattaaaaatatttttaagaacgcacaatctgtcagaaaatcattagatgaaaggaaatgacaattaatgaaagcaattttagttggatttatgggaagtggtaaaaccaccgttggtcgattgctcgcaaaccaaattcaggtaccttatcatgacttggacgatgtgatcgttcataatgccggcaagtcgattcagcaaatatttgacgatcagggcgaggatacatttagaatgttggagcacgatgccttgatgaactcgcttggagatgagggaatattgggaacaggtggcgggacacctattcaacccgctaattttgaactgttgcttcagacgactgtccccgttgtattattggatgttcttcccgaaacgatttgggcccgtctaaggggtgatagtggtcgtccactagctaaaaagttagggttggctggtttgattgatttaaagcatgaacgggatgacaaatataatcaggtgagtgacatccgtattgcgacggatagcttaacgcctgaacaagtcgttgagaaaattatgcaggaactttcagtattgaaatagtaagttattaacgagagagtggtgtcattatgattgacggtcatacaaaactttatggattattggcgcacccggctgctcatagtttgtcgcccttaatacataacacaagctttaaagttacaggaattaatggtgtttatttggcttttgacgtcatgcctaatgagctgcaaacatctgttgatgcaattaggacaatggcaattggtggtgtgaacctatcaatgcccttaaaaacaactgtgattccgttacttgatgagattacatcaagggccgaacggctaaatgcggtcaatacggttattaatcgggatggtaagctggtcggcgatacaacagatggacaaggctttattgatgcgctgaagtatcagaatgttagtgttgaggataaaacgctgactgttttgggtgcaggtggtgcaggcagatcgattattgccgctgctgttgaagccggtgctgccaaaatcaatgtgtttaaaagacaaaatcagacttttaagtcacgaaaagaacaactggaaagctggtccagcgtgatttcagtaatcccttacgaggatgatgacgcaatgcaggagtcagttgcgtcaagtcagattgtcagtaattcaacgaatattggcatgagtcaagataatcatttaccgattagccaagcggtgttggccagattaacaccgcatcatgttgtaacggatgccatttattttccgcttgaaacgccctttgtaaaggctgcgaaagatagaggatgccaaacatttaatggcattggtatgttggtacaccaggcagcaggatccttctttgaatggactgggcaaaaaatgccggttaacgacgttattagtgccgtaaatcaagaaattgttaaaagagagcacgattaagtgtttactaaaaaataattaacaactattctccccgccactaactatttggtggtatatttaatctattcactaggtaaatagaattgatgacattaggggagcccaccggctgagacgtgattaatatgcgaaccctttgaacctgatctggttaaatccagcgtaggaaaactgtcggcttgggaccctccttctgttgtcgttatgctcgaaacggacggaggatttttattatgaatcgatcggctacatataaaatgattttaacagcattattatctgccttaggagttgttggcggtagtatgtttgaattcacgatcggggttgctaaagttgcgccgatgcagcatcttattaatttgatttccggtgtgcttgttggaccatggtgggccattacacaagcttttatcacctcattgattagaaacattttgggaacaggtacggtactcgcatttcctggcagtatgatcggcgctttttgtgttggctggctctttcagaaaaccaggaatctgtttgtggccgcctgtggcgaattagttggaaccggcattattggtgctattgttgcctatccggttgcaaaatggcttatgggcgcaaatggcgcgctttggttgtttgttccgagctttttcctaagtgctctggtaggtgttatgataggctatgtgatcttgctaagcatgtggaaacaaattatttctccacaattaaagaagctcgataaaaagtagttaggctttgaagatggcagggattaaagcgatcattatgagatagaaaaacgtactcgtcgaaatttaatcggcgagtacgtttttgggcttcggatttatttttaatgctcagcaacttcgtctggatgtttcttttcaaaacgatattcaaagtagaagtagcctgtaattaataagtagcagatagctggtacgatgaatgataattgcattgaaccgctgaaatcggaaaccaatccttgaatggcagggatgattgcgccaccaattaaggacattacaatgattgccccagccgtttcagtatatttcttttctgttacggcatcgagtgtatgagtgtaaatggttggccattctggaccaaagaagaaactggtcataatggcagcatagacagcagtcatatttggaacggtaaatgtaatgattaatgatagtgttccgagaagggagtaagtggttaaaacgcctgtgatcgaaaacttgctcatgaatatgtttgcgattagttttccaacaaaccaggcgatataactataaatcataaatgttgaagcggcactatcggagattttatcatttagattcaatgccaaacggatcgtgaatgaccacactgtcgtttgaagtcctgcgtaaataaattgagttagaacgcccttcttgaagcgagcattcccccaaaggtatttgatcgtttctgccaggctcggtttttcttcctgggcttccataccttcttcagctggttctgcagtggcttttgcgcgtggcatgggtgataatgcaaagataataagcataatgatcaaaacagctaaaatgtatttataagggcgaagagttagctgcagcatttgttcaccgtaggcaattcttgccgcaccatgcatagtgctcattttttcagaaagattgccaacgctgccgaaaatgaggtacttgccgagaagaattccggcaatatctcccaatggaaccaaagtttgtgagaagttcaagcgcattgtagcgtattttttcggtccaagcattgaactgtaagtatcacaggaagtttccaaaaaactcaaaccaattgcgattgcaaaaatcgcaaccaagaacatggagtatgtagcgactcttgatgcagggaagaagagggcacacccaagaatgtaaaaaataaggccggtcataatggcaaacttgtaactttgtttcttaatgattaatgatgctggaatcgcaattaggaaatagcctccataaaatgcgctttgtacgaatgcggttgcggcatcgtttaacataaaaacagttttgaattgcgtgattaagatgtcatttagactggctgccgcaccccaaagcggaaagatcattgaaaccagtaggaattgaaaaatgggtgttttactgagataaccgtctgatagttgagtccaactatgggtctttttagctgacgtaagttccatgttaattaaatcctcctaataaattgcttaataaaacgttttactttcaaaagttagaatgtaacgcccgattccagaataatattcgaaaagggagtcatttcacctgtacggacaaaagcgtgggttcttgccaagtctttttttaattgagtatggggcacatattcgatcgcaacatttggcaaagtgtttttaatctcagaaagttgctcggggttttgagttttaatttcttctgccaagtaaatcttttgcacttcaagttcagttaaaatattttttaaaacttgttgaaagctcggcaagtccttggataatgctaagtcgatttttttagttcccatcggaaccggcattccggcatcgccaatgcttagccaatccatatggcccatgttggcaatcactgttgatagttctgagttaatgacatctgttttcttcatgatcaaattctcctttaaagctttaacgatttaataaaaggttttacctaaaaatttcataattgaatattaacatgttctgcaagggctttcaagagaatcttttgtaaaaggataaaaaaacgacacaaacattgcttaaattcccaagcaatcaacgttgtgtcaattagtaaaaatttatttatatgggttaaaagtttcgcgatatttaatttttcctggaataatatttctaacagtccagtttcgcttaaggttggttaaagacttggcatgtaaaatggcttgaaaaccgagttcggtttttggaatccagatactggaaagagatggtgtcagaaaggaggaaaattctaaatcgtcaaagctcattacagctaagtcttttccgggcatcagatgatattttgaaagggcacgcataacaccaatagcaaaagggtcggaccaaactaaaattgcggagagccgctggccatgctctgaaattaaaccttcagcaacagccattgcagatcctgtatcaggttcgatttctttataaatttccggcttttgatggagtgatgtccatttcttataggcttttgtgcgggcatcaggaactttcccgacgatcctgccatcaagagcgacttgatttcgggcacaaccaatgaatgcgatatctcctttggtatgtgcgttaagttgatccaacgcgtctatggttagttcagaaaggttggtgtcgacgatatctaccaagccgtgataataaccgccaccatcaacaataaccacattggaattatagtgttttattttttttacagcgtcttctgtcactgttcctatgatgataacagcatctgatttgatcagcttttgaggatcaaaaccgtcttgaatacgaatgacattgttaagatcgatattttccctttctgcggcttcatacataccgcggcgaacgaaacgccaatactcatcgtgggtttcttcctcaagactcatagttgttagtaaagtaaattctagtgttttttttgaatctttagaatcgctatcatactcgtatcccaaactgtccgcaatggccttgattttttgcttggttgatttagcaacaaatttacttttgtcagagcttaaagcacgggaaacggtgccggcagagacacccgctgctttagaaatatctttaatagttgccattctattacctccattagaaaacaatttatgtatattgctcaaaactaaactaaaattttagtaaaaaataatcgaaattaatttagaatttttttgcccgagcaattattttttattttgaatgacccaaagtctaattatgcaaaaaagaggaaaaaggggcgtaaaacaaaggacttgtcttaagaaactgtataataaataatgcaacaaagttaaaaataatgcaactatattaaataatcaagaaaggagactaaatactttaataaaatcgtttgacatttacactgtaaacgtttacattcaaattagcaattattttatttaatcttatctttatggaggcatcctttatggcaagtaatactggtgaaactactggccgcaaaattacgtcacggttgtcgtactcatttggtgcgttcggccatgatatgttctatgcgaccctgtctacttattttatgatttttattacttctcatctatttgataaaaatagtagtgcaagtaatgacaaaatgatcttcttcattacatttattattggttctctgcgatttgttgaattgttaattgatcctttcattgggaatgcaattgataataccaatactaaatggggtcattttaagccctggattttagctggtgggactatcggttcgatagccttggctattttattcagtaacatgtttggattgaatgtttcaaacccggttttatacttggtgatttttgcatttctgtacattacaatggatattttctattcatttaaagatgttggtttttggtcaatgattcctgcgatttcatttgattctgccgagcgtgagagaacagcaacatttgctcgtgtgggctcaaatattggggcaaatatcgttggtgttattgtcatgcccctagttgtcttcttctcaattaacaagaatcatggtcaaggtgatttaagaggctggtttatgtttgccgctaccatcgctttgatttcctggctatcggccgttgttgttgcattgggtactaaagaaaatgattcattactccgaaagaataccgaaaaaactcgtttaagagatgtctttaaagtattggcacgtaatgatcaattgatgtggctttccttgacttacggtctttatacagcaggtattcaaattacgaacgcttgtcagctttattatttcacgtatatcatgggaaaacccggtcaatattcgtggctaatgggattaaatatggttgtcggaattgtagctgtcttacttttcccaccattggctcaaaagtttagtcgtcgaaatgtattcttctactgcattggcttaatgctactcgcgatgttgatctttgcttttgcaggttcttcattaatcctggttttgatcgccgcagtgatgttctatatcccacaaccattgattttcttggttgtcttaatgattatcagtgattcagttgaatatggacaattaaaattcggacaccgtgatgaatcactgacattggctgttcgtccattacttgataaattaggcggggccgtttcaaactgggttgttggagctgctgctgttcttgccggaatgactgctggtgccacagctggtagtatcactaaccagggtcaccttgttttcaaactgttcatgtttggtgttccagcattactaatgttgaccggaacatttatcttctttaaaaagattactttggatgaaaaagagcacgccaagattgttgatgagcttgagaaaacttggcacgagcatttggaaacaaacggtgaagaatcgatgcaggatatcgaaaagaaagttgctgcaacgacgacttcatatcagtcacctattaccggaacactgatttccctttcagatgtttctgatgagaacttcgcttcaggtaatatgggtaaaggatttgctgttaagccaacggatggtaaagtctttgcaccatttgacggtgttgttgaagcaacgttcccaactcgtcatgcgattggtttgcgttcggatgatggtattctgacactgattcacatcggaattggcactgttaagatggaaggtaccggatttgttcagtatgtagataagggacaacgtgtcaaacagggtcaagagttgattgaattctggcaacctgctattaagaaagccggttacgatgatactgtcatggttgtaattactaattacaaagacattaaagcgttcaattacatcaaagatactggcgatgttactcatggtgaggagattttaaacttatcgaacccaaatgagaaaaaagattaaatgtcctaattagatataatcgttcataacgtgacagcaatcccttgaaccctgtttgttaataacaggtttgggggattgtttttattattttaaataaaatcagtgatacaatgacttattaatttgatctaagatggtgacatcttatctatcttttatgcaaattgtagcttaatcattttaggattaaaatgaaattggattgaagcaggttcgatatttggatgcgattgacgagtaaaagaaacgattatgaccgtttcttatgatgaaattatgagaaggtgttagtgatgatcaaattttttctaaagttggtgattggcattcttctggttttcagtaccactcagctaactttttcaagtcgtttagctatgtttttaacagtagcaataattaatattgttgcgttgattttattaagttctgccattgctgatgtcattaagagctatattaagaaaaagaaactatgaaaaatggtcaggggaaacctgatagtcggtttagcaaagaaaaaccagtcagggatgatctgaaatgaaacgttgctgccatgtgacagtgacgtttttattttgtttaaaatacagtcatccattttgtaatcttgataaaagttgtactatggaaaggaagcttaaaaatgaaaagaggggaatgctgtgtcaaaacgcgatgttttgatcgtaacgtgcgcgttactgttatcaaatgcaatgggtggacttgataatacgatcatcaatactgcattgcctgcaattatttccgatcttcatggaattgaattgatcggctggattgtggccgtgtttctcttgggaacagctgttagcacaccgctgtggagtaaactcggtgaacatattggcaacaagaagagttatcagttggcggcatccttctttgtgattggatcattcttacaagggatgtcaccaaatattattttcttaatatgtgcacgaactttgatggggattggaaacggtggtatgatttcgctgccgtatattatttatgctcgaatgtattccaatcctcgcaaacgtatgcaagttcttggatttgtttccgctagttatagcatggccactatcattgggccgttagttggtggatatattgttgatacctttagctggcattgggttttttatttaaatgttccgattgggcttatttcgattttctttgttcaaatgtattatcgaatggaggagcaaaagcatcaaaccagccctgttgattatgccggggctgcgttaatgacagttgggctggtcgcactgttaaccgggatcgaatttatcggtactgttaactggttgattgttgcgggtttaattgggtttgcggttatcgttttgatcatcatgtttcggaatgaagatcgagttacagatccgattattccaagcaggctgtttaggaatcggccattaatgattgattttgccttgtttacacttatttggggtgcttttatcggtttcttgatttatagtccgatgtgggcgcaaggactgcttggaacaagtgcgcttataggtggtgctactcaaatccccggatcagtcactgactttttaggatcagggacagtggcaccgatgaggcggtttttaactcctcaaagggtagttgcagttggtattctgacgttaattatatcgtttgcactattagtttttgccggtgttaaaacgccttattggattttactgattgctggtgcctttgaaggcttcggtaatggggcctgctttaatgaattgcaaatcaaagttcaacaggatgcggacatgcaggatgttccaatcgcaacttcttttagtttcttaattagaatgttgagtcaaacctttacggcttctatttttggcattattcttaaccatgctttgaagaatggtgtcattcagtccggtggccgaattacgatgcaaatgatgaataaattgagcgatgcgacaaacattggcggtttgcctcaaaatctcattccacaaatgagggctattttgtttaacggcctacataacattatggttttatcacttggcttaatgttgatttcactcgctattaacgtttgggcacaaaagcttgaacatgaaaaatatcagttgaaaaattctgaagctgctcaaacaaccgaaaactaactaaagtataagaaaagcaggattcgcaaacccgacaaatcgggtttgcaaatcctgcttttttaatgtttttgttttgattattttttggttgtgtctagagattgatctttaaaggttgatagggaaacatttgcggttgataagccgtcattgctgcccgattcggctttgaaactaaccttatcaccctctgaaataaactcgtaaattggtttgaatcctttggcagaggtatccagttgataaacctggttattgtctttcaaaataaacattaatttattatcggttgttctgacaattctgttgatggttcctgaaatcgttttgccacttggctgtgcaactgtcacgcccgttttagcctcaagccgttggttaaataatgcgagtgtactttgtgcatcatcaccaattgcataagtaccgctttggttattaccatcagcaagcaggtaaacaaacttcataaaggaattattatctcgatcaagcattgaaacaacccaggttggatcaccattaatccgataaagtaatggcaatgtaccacgataattctgtgggttaatgtcctgttgtgcatatgagatagctcgttcaggtgtcataacgtttccatgctctctgtaatagtgaagtgtattggttcgggcatctacgaacgcgtaacccaagattgaactttgatgggcattaacactggtcataccagtaaagtagtatacacgacccttataggcataaggcgttaggtgatcgccaccctcggtaccagccttggttggctgcataacaccactatgaccaccaaaacttgtcgcattccaaaagcctcggcgatagcggccaaataagtttacttcttgagacaccaattcaggtgacactgcaatatcgacaaactttggcacattatttggagaatatacgttgactttacctgtaattgtatttaatacagcaactttatagtgcttgtaatcataatttctgtttaaatatgaaattggttttgcgagcgttcgaacgtagtatggcgtccctttgtcatcaatttccaattgagaagttgaaccaaccattgaatatcccaaactatgggcactgattcggcgatcagcatcactattgaagtaggcacttggcgtatatttcattggccggctgacaaactttggatcggcgttcttatctgttgcatcggttctaaagtatcccgggacctttagataatggatatagcgccagaagccaccggagaattcaaccggggcaacataaaccatctttttacggtacatctggacacgcatatggttcaaatcatagacgtttgaatttttaaaactgttcaaggagttgttcatatcggtggaaacggtttgtggtgcattaacaaccggggtttccgaactgtttttaataaccggcattggcgcattctttgtatcgtcattaatgtcggttttaattgattccacagctggtcgaggattcattttggtgaccaattgtgtcacgcttcccaggataataaagacaataacagcaagcacaattccgacggctagctttcccaaccatccaaacgctcccgtgaatctggaaatagtttgaccgataataccatcactactctgtccggaacgagctggtgtggtgtcaccaccaaaaacgaagcgtttcaaaacagcgacaacgatcagcccaccgatcagccacattagccagccgtcaattagcgatggataggcaagatcaggcaaactgaagtaggtattgatgtagcttacaacaaaaagtatgatgaccgcgatcgttgaccaaatccgccctcgacggtttgcaataatcatcagccagatatatggaatgattagccctgatatttcgaccagggtaatgagtgcaaaataactcagcattaagtttaactcccttcaaaagtaaacgatttctttcttccattatacatggaagttctcagacaatccggtattcatcaaaatagttagtcgccgagttccttaatttgatgctatcaaagaataacaagtgcctttgagtccaggtgaagtctcgacaaccggtctgattcacccggtcaggaaactaacattcgaaaaatgtgctgcgaccaaagttaaggtatcgataatttcaataattgaaaggccttggtggattgattttgaaatgcatttcacaaaattgtcacgaaggtcaattgacatataaaaatcgttagtaaaagcgtcaaattttgtgtactgacgaacaagactatgcggattgtcaacgaattcgatcatactaccagaagccaagtgagtattggagatttgatcgtaactttatgatatcagtgacgattgcattttttatgaggggatcctttcttgattgtgatttacgaaaataataacgcaaaagcatcatgacattttttgtaaaggatatgtcttattgaatttgaattatgagaataaaaatgagaagaattgtatttcggcttttaaaaaaggacattctaaaaaacattgagcttacttttgggtaatttgagaacgacgcatatcaatataatcgaagataaataaggaacagaatatttaacaataagccgatatgactgatacatagccaattaagaggccgctaattcataatggtatctaaaagacatgttgacattatcgcgttaccgtgtttatattagaataatttcatttttatcattttattctcattcaattgtaaaaaataaggaatcgaggttttgtttatggattcatctgttgataagccagcaaataagctgaccgttaaagattatgtatatttggtttctgccggtgtctctaacgccgttttggttatgctgggaattggattattaacgcaatcaattgccaattttgttcactggccacaactacatcaagtcggtgccattgcacaatggttactggcaccggccttcggtgccgccgttgcctcacagttaaagactaacacattggtattattcagttctatgatttctgcaactgttggggcaaatgccgtttatttcattgcaaatggtgttcacgctgctaccgcaacgggtaaccaaatgtttcaagcagctcaaaccggtatttttacaactggacagccaattagtgcggttgctgcagggctggttgctgctttagtaggaaaatacttaactggtaaaacacctttggatatgatgcttgtacctttagctgcaacacttgtgggctcaattgtcggtcttggccttgccagtgtcacaacgcctgccttaaattggctgagtgcttttattgccgagtctatgaaggtgaacccattgcttgggtcaatgtgtgtttcacttgcctggtcaatctttttgatgacaccagcttcgtcagcagcactagccgttgctgttatgcttgatccgctgtctgcaggggcagcattaattgggacgactgcccagtttgttggctttacggttatctcatggcgacaaaacgatattggtacaaacattgcccagggtgtcattacgcctaaagtacagtttcctaatctgttagcgaatccaaggctggcgttgccgtcaatgattgcagcagttgttgcggcaccgattgcgacgttgttctttggatttaaagtaccatttacattaggtggtttgggattgaactcacttattgccccaattacactggcttcaaccagtatgcctatgttggttgcatacttggtaatgggcgtcgttgttccggctatcatttcaattgttatttaccgtgttcttcttggtcttaaatgggttaaggatgaacaattacatttggaaattgtctaattgatacattgaatttttcaaaaaaatcagtcagggaatctttgaggaatctctgactgatttttttgtgattatttcacagtaccattaattgcccgaatttcatcgatgattttaagtaaatcatctgcggcttgtttatagtcggcaattttatcgccatattgttgattgaagccttcgagaccaccagcagcgaatgcatactcataatcataaactttttcatatgcagcagcaaaacgagccaataactcatgttgaccaccgtctaattgtaaggatatttggacaactcgaaagtctgtatagcccatttcaaactgaactgcccatgcacgaataaagtcgtgttgtgcttcaatatgggcatagtggtgctgtgtattccaagttaaccgatctaatgattttttaacatccaacatgataaaatcctcccttaagataattcccctagaagtatcaataaacgaataacaatttttaaactcattatccacctacattcaactctttttgataagaaacagcaattaatatgactgctttttcaaagttcataaataatgatcaatctgttgttggaaaatgattcctaaataaagatagttcagtgaatgaaaaaagctttctaacgggtttctagtaaaataactggtgaaaatttactagtaaaaactttgtattgtgtttcacaactagccgtcatataattttggagatgaataaaagttaacgaattcacaaaaatgatggaggctatacaacatgtcaaaaaaagttgctttggttactggtgccggtcaaggaatcggtgagggaattgcacgtcaattagctgacgatgggtttgctgttgcactttcaggtcgtcatttggataaagttcagcgggttgccgatgatattgaaaagaatggtggacaagcatatgcaattgaagcagatgtccaataccgcgatcaggtttttgattcagtgaaaaaaacggttgagcatttcgatcatttggatgtttttgttaataatgccggaattgctcatgttgcccagatttgcaatactaaagaagaggaccttgataaattacttgatatcaatgttaagggaacattcttcggcattcaggcagctgcagcccaatttcgtaaacaggaaacacctggtaagattattaacgcttcatcaattgccggtcacgaaggttttgaattgttgggtgcatattcggcaaccaagtttgctattcgtggattaacgcaggcggctgctaaggaattggcacgttataaaattacagttaatgcctattgcccaggcattgttttaacaccaatgtgggatcaaattgatgaagaaatgggtcaggttaaccatgtagccaaaggtgagtctttgaagcaatatctatctggaattgcgttgggacgtggtgaggaacctgaggatgttgccaatcttgtttcgttcttggcaagtgataaagccaattacattactggtcaagcaattatggttgacggcggcattaaatacgtataataaagatcattttacggttggaatgggattgagacaaaagtattgtttgtccaatcccttttttatggttacgctaatgtttgccgtataataatcagtgagatattaaaattgacaattgaaagagatggcttattaatggcagaagttaatccatttattaaagatgcagttgtgcagtttcaaaccggcgcactctcattaaaacagattgaggcaatcttcaatgtgttgccgtttgatattgattttattgatgtaaatgatcggtttaaatggttttctaataaacccaaccgtgagcatgcacggtctacctctcagctacaggatacgcttcagcaacttcatccggggacggctgcagcccgtgctcaagcggttattgattcattcaaaaggggagagaagcaacatgttgagatcccgttgaatgtggatggaaaattaattgatattaattattatgctgtgcgggataacaagggtgaatatcttggcacgattgaatatacagggacaattaatcatctcaaggagctgattgatcagggcgcctggaagcaggatgtcacgacaggtgcgtcaaaggatggagaaactgactcatcaggaaaaggtgatgccgtttcgggagcttctcgaaatgaaaaagctcattcagagaagaaaagtgatgcaacaaccgggccatcacgtttaagtatgaaggatgatcgttggattccctaatttgatattgataacctaaatttataaaaaacaagcgaaccagacgaggataagctcttttgtctggttcgcttgttttttatcttatgacctaatatctatttaatgagctgtggttgaaagatgcccataactgtatcctgagccgtaaatactggaatttcatgacttaaagcattggcaaccaattgtttttcatcatcagtttcatcttgggagcttaatgcaaaggcaagcttatctggccatggcatatctttttcataaacctgaacatcgaaatcactgtggtctagtttgtttacaagttcctgatcgtcagcgtcggcttttgaaatgaggacggtaccttcaaccgtatccgtattaatatggtaactatcaaataaggcgttgtggagagcttcctgtaacgtttcgccgctaccgatgtcttcaccggttgacttcatttctggactaagcgccgttggagcaccgggtaacttggcgaaagagaacaccggtgctttaacgtaaaccttcgtaggctccggatataatccgggtgtcagtccaatttcagcaagtgatttaccaagaattaattgtgttgctaattgtgccaagtgcattttggtaatcttgctcatgaacggtacggttcgagaagcccgagggttgacttcaatgacataaacatcgttagcacaaataaattggatattcatcataccaaccgcatggaccttcttgccgatcttggttgcgatcgagacaatcttttccttttgttcgtcggttaagtgctgtggtggatacatggcaattgagtcgcctgaatgaataccggaaccttcgagatgttccataatccccggaacgaagacgtctttaccatcacttaagatatcgacttcacattcggttcctggaatatattgatcgattaggattggttggccggcgcttgctttaagggctggaaccaaatattcatcgagttcttcaccattatgaacaacggccatcccttttccgccaagaacgaagctgggacgaacgagaaccggataaccaagcttgtttgcaattgcgtgagcttcatgcccattcattgcggtgtctccttggggatgggcaatattttggtcaatgagtaaatcttcaaaatcatgacgattttctgtttcctcaataccgtgcatggaggtcccaagaatttgaaccccgtgtttagtcaattcctcagtcaaattaatagcggtttgaccaccaaactcaacaataactcccataggtttttccaagttgataacgttcatgacactgtcgatatccaatggttcaaaatagagtttgtcggaaattgaaaagtcggttgaaacggtttccgggttgttgttaataataatggcattttttccggctgcctgaatagctttaacacagtggacagtggcataatcgaattcaaccccttggccgattcgaatcgggccggcaccaataaccagtatgctgtttccgattggctggctttcattttcagttccaatagtgctgtagaaataaggtgtttcactttcgaactcagctgcacaagtatcaaccatcttatagaccaaatgttgatcggccattttatcgagtttttcaagttcgtgatccgttgcgtgatgaacggctttgatcatggtattattaaagcccattttacgagctttcagaaccatatcggagctcaacaagccatctgtaagttgttgttgcattttgataatgttttcaagctttgaaagaaaataaagatcgattttagttgaacgatgaatctgttcgattgttgcacccttcccaatggctgcaaacaattcgaataaacgataatcagttggcgttttaattttttcgatcaaatcgccaagtgacatttgacgagtgtagtcagggataagatcacactgagcctgcttgtccaactctaatgattgaacggctttgagaagtgactcctcaatggtaccgccgattgccatcacctcaccggttgctttcatttgagttcccagtttgcgatcggcgtttgtgaatttatcaaacgcaaagcgtggaatttttgcgacaacgtaatccagtgcaggttcaaacatggcataggttgtttgagtaatcggattgatgatttcatcaagattcaaaccaaccgcaattttggcggcgattttagcaatcggataaccggttgctttagaagctaatgcagaagaacgactcacacgcgggttcacttcaatcacgtagtagttttcgctggttggatcctgtgccagctgaacgttacagcccccttcgatttttaaagcgttcacgatagtcaatgaagcgtcacgtaagcgttgatattccttatctgtgagagtctgggttggcgcgaagacaattgagtcgccagtatgaacaccgactggatcgaagttttccataccagtgacgatgattgagctgccatggtggtcacgcataacttcaaattcaatttctttataaccggcgatgcttttttcaaccaagcattcagttgatggagacattgttaagccacggtttaaaatggtcttcatttcgtcatcgttatgagcaatgccgccaccggtaccgcctagtgtgtaagctggtcggataataaccgggtagtcaatttcatgtgcaaaatcaagaccgtcctctaaattgtagacggtttttgaatctggaattggttgatgaagttctttcatcaaatccttgaattgttcacggtcttcggcttggttgatggtgtgtaagcttgtacccaataattcgattccaagtttatccaagataccgtccttagctaactcaacagccaagttaaggcctgtttgaccacccagggtaggcagaatcgcatcaggatgttctttttcaagaatcttcttcaaactcggaaccgttaatgggtcaaggtagactttatctgcaatctcattatcagtcataattgttgctggatttgagttaaccaagataacggaataaccttcttcgcgcaaactcaaacatgcttggctaccggcataatcgaattctgcggcttgaccgatcacgattggaccggaaccaataatcaaaacttttttaatatcttctctctttggcattaatgaacccctccattgacatgcattaaatcgatgaacttatcaaataatggttttgcgtcgtgtggtcccggtgcagcttccggatggtattgcactgagaaaatcggtcttccgggatagcgcagtccttcacacgtcttatcgttaacctcaagtgcggtcacttcaagaggcgttgacttaactgaatcaatatcaactgcatacccgtgattttgagaagtcatataaatgtcaccagtgattaaatctttaacaggatggttactgccacgatgaccgaatgtcatcttgtaagtagtagcaccattcgcaagcgcgagtaactgatgtcccaaacaaataccgaagattggatattgttcctgaagtttttgaataactgggagaaaatctgaataatctgttggatcgccaggaccgttggataagagaattcctgtaggatgaagttctgagatgtcttcaaatgttgattcgggtgtaacaaccgtaacatcaatttcaggacgttgtaatgaccttacgatgttagatttaacaccgaagtcaataacgacaacgtgttcattctctttaccgtccgtaacagaacgagttgctgatttaacaatggcggattgatgagccatttcagcctccttagcgttaacaggttggtttgttaaactagctttcattgttccatattgacgaataatcttggttagctgccgagtgtcaataccgctgattgctggaactttttgttgcttcagaaatgcgtctaatgagataacactttgatagtgatagacttcatcagtcatttcacgaacaacaactgctgaagcttgaaccttgtctgactgactggtgccaagtgagacaccgtaattaccaatcagtggatacgtaaatgtaatgatttgatttttataagacggatccgtcaagttttcttgataacctgtcatgttggttgtgaaaactaattcgccttcaatttcggcgcctaagtctccgcaggcttccccaacaaagacatctccattctctagagttagatattttttcatttccgaacctcctagttttgttcctaacatgcaagcggtatgagcagctaacgcttttgatacataaagatagaagcttttaaaggaattgtcaagtcgttttatgcaaaaaaaagccatatatggatttttatgaagaaatattttttcttatgaatatatattaaaatgaaagaaagcttgtaaatggcgttatatatacataagaaaatgaccgatattcaatttcttgtcattcttggataaataaacattttcaaaaacttttttaaaaataagcttgtgttttcttcaaaaatgtcatatgattttaacaacgaattgaaagacctttaatattaaccccgtgaggttaagaaggaatcggtgaacctaagtctaacttgggagaaactacaacctctttacccaacggcggtaaagaggttttttaatgcaaatatgttgactgtaacgacgatttaattgtttccgtgagagcaaaacgtctaaattagtgatttcactccactaaagggcgctttgcgaacacggcaaggcgcttaactttttaggaggaattcactatgatgcaaatcaccaaacccgtaagttttgaaaatgttgttagtatggaagacctttcagctgaagacgtgatgtcatttattcatgaggccattgaatttaagcagggcaagcaagttgaattggcccggccggtatatgccgcaaacctgttttttgaaagcagcacacggacccataccagcttcgaaatggcagaacgcaagcttggccttcaggttttgaacttcgacccatcaaacagttcacttaagaaaggtgaatcaatgggcgacacagttaagactttccaagcaattggtgctgacgttgtagctattcgtgacaaaaagaatgaatattacaaggacttgattgaagatcccaacgttcatttgggaattgccaatggtggcgatggttcgggacaacatccatcacaatcattacttgatatgatgacaatttatgaagagtttggtcattttgaaggattaaacgttgctatcgttggtgacttgactcattcccgcgttgctcgttcaaatatggaagttttgacaaaattaggggcccacgttttcttcggcggccctaaggaatggtatacagaagacttccagaagtatggtgaatggatgcctatcgatgacttggtatcacgaatggatgttatgatgtttctccgggttcaacacgaacgaattgccgtggacaaaaacggcagtttctctgcagaacgttatcataaggtttatggtttaactcatgcacgtgaacaaagaatgccggaacattcaattatcatgcatccggctcctgttaaccgaggcgtagaaattgctgatgagttggttgaatgtgataaatcccgtatcttccgtcagatggaaaacggtgtcttcgtccgaatggccattatgaccagcatgctccgttatcgcggacttgtaaaaagcgaatactaaaaaacgacttcctatattaatgaagtaaattaacataacctcataagcgaagggattttgacataaaatgaaacgtgtaattgcaaatggccgggttcttgacggcagcaaacttgttcagcgggatatcctaattgaagatggattaattaaagcaattgaacctgatatcaagattgatgatgttaatgaagttattgatgctaaaaatcactttgtgagcgcgggtttagttgatgtccatgttcattatcggcaaccagggcaggaagacaaggaaactatcaagaccggaagtcaagcagcggcacatggtggttttaccacagtttgtgcaatgcctaacctgacaccggcaccggatagtcccaaacatcttgaagatatcatggcgttaaatcgaaaagacggggtcgttcatattaaacaatatgcgacgattacgactaatcgtgaagacgatgaattggttgatttctctgctctcaagcaagatggcgcatttgcatttagtaacgatggaaatggtattcaaaaaagcagtacgatgtatgaagccatgcaacaggcggctgaattggatatggccattgttgaacacgttcaagatgatgagttgagttatggtggcgttttgaacgatggtgctgctaaacgattgcatgttaaagcaatgccttgggtgagtgaaacggcgcaagctgccagggacgttgtgttggcacaggcaacgggtgttcattatcacatctgtcatgcatcctcaaagcacacggttgccttgattagagaggcaaaaagggccggtattaatgtgactgccgaagtaacgccacatcatttattattatcggatgaggatattaaagaagacaattcatactataaaatgaatccaccattgcgcggtgaagatgatcgacaggctttaatcgaaggcttgcttgacggcacgattgatatgattgccacggatcatgcaccccataccaaggcggataaggacaaatcgattgcaactgcagccttcggcattaccggtagtgaaacagctttcagcacgctttatacagcgtttgttaagactggccgctttacgcttgagcaactgattaattggatggcaaagaagccggcagcggtatttaaaatgaaggcagctggtaatcttgaaattggaaagccggcagatattgcggtattcgatttggacgaaccacatgttattaaggaaagtgagtatctttcaaaagggaagaactcacctttcaccggcgctacagtgtttggtgatacggttatgacgctggtagatggaaaagttgtttataagaaataatgatagttgggtttacttaaaaacgggttttaagaaagcctcattagataagcatcaaacaattaaatgtctataaaaagcaaaaaaggttctgtagtgcaaaccgagagtttaaaagtctcggttcacactacagaacctttcattttagaaacagcatgtaataactgactgcggataactgcctgcgcagtattgacttttccgtccttaatccagttcagaacccgttttaaaggaactaagtgactatttacaaattcatccgcatcaaaatgtttttgaacgcgtttcgttggatcaaatttaatgagcataagatctgcaaattgatccatgaagccctctgatgacgtaattcgtgtcatcttggcaacggattcggctacgtagccggtttcttcctgcagttcacgtttggcggcctgttcactggtttcaccagggttaacaatgccagccggtactgatacggaatcactgttaacaccagcacgatattcgcttgtcatcaaaatttcttcatcttcggtcatggccaagatcgtaatagtgggggctgttttaatgagatcacgttcaacctctagcccatcaggggtttgaatatgcaactgatcaactgagaaaacccgaccggaataaacggtctttttcttgagaatttttccaggacgatgccatgtttcaaacatttttctacctccaagtactgactatattgatcatatcataattgtgggtaagaaataatgataccgaaatagactgagctcaagcccatcagcaataaaaccatcaaacaactaataaccaaagacaattcatgtgatttcgttattaacattgctagtttgtacttaactaatacctggagttaaatccaagaggataattctcaaataattaataacaattttttgcaaaattctgtgcttatttgcaataatataattcaatttttgtcaaaaaacgaagcgataaatttatttaaggttaagtacccagcaggtataccagacaatctttgatcagatttctcggagcgttcagcaactcgacaatcactgaaatcaattgattgcctaattttaaaaatgaattccatgaagcttatttgagttacgctttttagagattaacgagattgagatggtgaaaacaaataaatttgccgatttaaaaagattatcgaaagaacaaacgtaaacccggtatacagacgattctaactaacgtttattaggtatgaataatacaggttatttatttttgtgttgtcccttttccttggctgggcgaaagaagatcgctaaggtcatgctgaaagtaataagtaggatcagtgtgaactcccctgctgcagctccaaaagttccaatgacattattaggatttaaagatttttgaaaattaaaattaagaaccattgagaacacgtttatcaacaaaagtatagtaaaagagatgatggataaaactaatttccgattttttttaaaggaatcccaatttgaataatgagaaaagaaaacaagtatattaataattaggcttaaggggattattgatgcgtgaaatccaaaaggcctgaacatatgaatgtaggacaaaattaaaaataaaaagtttaagttatagcaaacccacagaatatttccgtctttttttgtctgtttaccttggtcatcgaaatgttcaattactttgttatcgttttttaataagtcatcaattttaatttcgaaaatttcacttaatcgaatcatagctcgaaaatctggaaagttgcgcccgttttcccaatttgaaattaactttctggaaacaaacattttttcggctaattgtttttgagttaagtttttttctttgcgatattgttttattttttttgatagttcagtcataattattaccttcataatcaataattttgtgtcatgaaattttgaacatataattttgctcttcattatgcaaactttaaccgaaaaccgataacttcaaaactcataaatcgctttctatttgtctaagtagtgtagcaaaacctttgatattggtgtctaaggattctggctaaagaaaaacaaaattatgcgatatagtattgtcaacatcaaatgggaggaataaataataattatgttaaaaaactcgtcaccaccaaacttctattttaattagattaatttagttaggcagtttagtttttcataatgtatgaagtttctaattttagagattgaaataaaaaggagaaggatcatgaaagacaattttaagaatttaaatagttataagaaactcgatgttaactcacttaactgaaacttgaaagtatgaagacagactgatcccttggtatcacagggcatattttaattaatttaaccatttagcttgctgttaacagcgaaactaaccgtttcggcaaaaatgtgaagaactgattcatcatctgaatatttggcgctagtcttggcagaaacttcatgataataatcgtttttacacgaatttagaagaccattaccattgttgagacaaactcaaatctggcatggcttagttcattataaagaataaaaatttccccaatggtgcgctcatcatgattttgccgtttcctgccaagctaattaggttcataagtcataatgacaatttgactaaatggccacaaagaccgttcataatttttgaacttggtgatttgtcggagcccgcaagtattgacttggccccccatcacattaaagaattatcaagttgccatcttcgggcgttagtttgaactgatctcttgtggcggaaggcctaacggagtcgttgcagtactaggagtcatcgtgacgggcacgattagccacaaataccaagcgaagctggaattttggttccgacgtggactcgaccaagcagctgtaccacttgattagagctgcttgggttgatattttgaaggactgccaggacgctttggcataaatgctctaactgaattggccgtccgcgaatatgaagtaaatttgctggaccgtgtaaagcatgcccacgccgttaaatcccaactggttaattcatagaaacattttggtgagctataccagctattcaataacaccatagtcagcctagaacgccatttgcgagggttgcttacaagttgcattgaaccgagggtcattttgtgcctgtgccttggcgcgagtctccggcagaattgttcgttgatctgttgttttagatgattttccaagggacgtttgtggcttcttggaaggacattaatgcaaagttgatcggtacgaagtaattttggccgttcactcaacccaaagtttaaagcccggtatccctttaatatatacactgtttgtcatggtcaaagactcgcgctagtaattcggtttgggttggcgtactcacgaaagcatggtatcacacaatgatcactgctacccgccgccggcggtcaataaacggttcggaaatgcttgattaaaatgactcccaactgacat

SEQ ID NO: 443 - DNA, 75039 bp, Unknown
  Metagenome-assembled genome
gagctttactgtatctatgagattgggtgtttgaccacgcttgtacaggatcggtaaagagcgttgaaagcggaaccgctatttcggtggaggcattggtgggtactaccctcgctgtgtgagccctaacacccgcgccatcctcgcgtggcggtagacattgtcctgtaggcagttttggactttgtcggtcgcctcccaacgtaacggaggcgccaaaggttccctcaaatggtttggaatcatcgacgattgtaaggcagaagggagcttgactggctgggaccgacagggtcagcaggtacgaaagtcgggcttagtgttccggttggtttttccgtatggaagtgcatcgctcacggatcaactaccctgtggataacagtcttatctccccaaagagttccacatcgacggggaggtttggtccctcgatgtcggcgcactcgctcctggggctgtagtcggtcccaaggttgggctgttcgcccgattaaagcggtaacgcgagctgggttcataaacgtctgagccgttcggtccctatcctgtcgcgggcgaggaaatttgagagggagctgtccttagtgaacgagaagtacccggtatggacataccgctggtgtaccattgcgccgccaggcgcaccgctgggtagctatttatggatgatattaaacctgaaagcatctacgttgaaactcgcctcaaattagaatttcccattcctattggaagtgacccctaagatgatcaggtaagataggttggaagtggaagtgcagcgatgcatcggagcggaccaatcactaatcggtcgaggactttaaccagtagaactgagtgtttgaatgcagaaaattaatattagctagtttttttgaagagaacgaggttttctttcatgaaaagattgaaaatagtgtggtggcgatagccagaaggatacacctgttcccatgccgaacacagtcgttaagcttctgcacgccaagagtagttgggggatcgccccctgcaagggtaggacgttgccacgcaaattagaccttcgatagttatttactatcgaaggtctttgttatatattgagaaagtgaaactatttggaaaaaggtgaaatcatgaagcgttataaatcgtatcgtctgactttgggatggcaaatccttattggtctggtattgggaatcgtatttggcattattttttataaaaatcaagttgcaattacaacgatgcaaaatattgggacaatgtttatcagtcttattcaaatgattgttttaccaattgtggtttcttgcttaacagtaggaattgctagtataggagacattaagaagttggggagagtgggcctgaaaaccttaatttattttgaattaatgacaacggtcgctattgctttgggaatgattgttgcaaatgtcctgcatcctggtacgatgattgatattcattcacttcacggatccgatattagtcagtatatggcaaccgctaaatcggcaaaacatactggactttgggatacactattaggcattattcctaccaatatttttagttcattggcaagtggtaatatgatgccagttattttcttctccgttttctttgggcttggtatagctgctattggtgaaaaaggaaagatcttaattgattttcttcaagctgttcaagaagtgatgtttaaagtgactaattgggttatgcatgcagcaccagttggtgtttgtgctttgatcggggttgcattagccgaaatggggataagtgcgctaataccactcggttattttgtgattattacatacttaacgatgattatttttgtgctagtcgtgatgggtattgtggccagactctttaaatttcgaatttctgacttgcttagagttattaaaaatgaaattgtacttgcgttttcaacggctagttcagaagcggtattaccaaaaatgattgaaaaaatggataaatttgggacaaatcaagggattgtttcttttgttattcctaccggttacacattcaacttagacggttcggctatttatcaatctctggccgcgttgttcttagcacaggcatatggtatacatctatccattgggcaacaagtgacacttctggttgtccttatgatcacctctaaaggaatggctggggttcctggtgcatcctttgtcgtgctgttggcaaccatctcaacgattggtgtaccgatgagtggattaacgttcattgccggcattgatcgaattgttgatatgggacgaacagctgttaatgtcgttggtaattcacttgcgacagttgttattggaaaatcggaaaacgaatttgatgaacagaaatcagaaaattatatttcacagttcaagcggcctaatcctaaagctgaacgtttgaattgagctaatgaagatgcaaaaaaagccaccaacgaatttacgttggtggctttataattttattatccagtaagatagcagtcatttttcaagaattagcttccgccggattcttggaggttgtcccctcgtaattactattattaccgtatttatgtgttggcaatatatcacgattaatgtcattctccccaaatagtttcctaaaaggtgaagcgtttttcggccgcgttcagccgatcggacacaagtacgtcagtacctaaatgtccaaaaccactgagaaattgtgttaatcgaattcccaaaagtgttgaaatacctaaacaaacgagaacgagaattttcttgtgacacatgtggcattaaagccttagaatcaagaaataatacgtttagatatgtcaaattttgctttctttgggaaaatcgattgtaacaatttctcgttgggattccttagaatctaatccgcgagagagatactatcacaaccggtcttcccttggtagactggtgtttcgtcgctccaggatctataaattcagttgtcataaatctcacctcttaaactcattttttagaatgaaaagtgtccagtcgctgaacgactggacacctaaataaagctttagccagtcgttgagctttagcactatgtgatgtagttattcaataacagctacgttagttcaagccttactttgactagaacagctgactcattggcgtttttcgacgtttctgagcagtagcatttttcacataggagcctcacctaacagcttctattcgattttcattccaactagtatactatcatacacctctcagcaatgcaagaattaactacatgtgcatgccgggaatgtttaaatcttctttcttaacgcctctttcttttgcgaaagcggtcattaacgtatccatatccattaacttgtaagtctttggatgatcaggatcataaacctcaaattgtgccatcatgccgccatcttcatgttcaaggatatggcaatggttcataaagacacccagtttatcgaaccaaacttttaatcgaacggtttcacccgggttaacaccaactgtatcttttaatccatgttcatttggatagggttcatgaccatttctggaaacaattctaaattgagttgcgtgcatatgataaggatgaatcatcccacccgttttatcattggtgttgctgacgtcccagtattcaacgctgccaacctgttgtttgtcatcaattcgctgcatatcaaactttttaccattaatttcaacttcttcatccattccggccataacaacttgatggatttttgtatttggtgtgacgtctggatcaggaatgtttactaggtgatctggcagtgttgtatcgtcttttgcaaactgatgaattctaaaacgaacaagtggcacatcgtcagaatacaatgtgacttcatcaccgggtttgtatccgctaaaatcaacgataatttccgctctttccgcacaagttaacatcaaatgggtaaaatcgacgggttccggtaagacaccaccatcagaagcaatttgggtgaattttaaatcatcactaaaatgtaaccgccattcacgtctattagcgccatccaaaatacgtaaacggagccgttgagttgtgacatcgaaatatggattaattgtcccattgatcattggggtcggtccctgaatgccatccggatcataatccgccatataatcgagttgattatttttatggaaattgcggtcttgaagaaccaagggaatgtcgttaacaccatagtttcttgggaatggcagctggctttcggtttggtcttgaacaatcacggtagtggctaatcctttccagacatgttgagcggtcgctggacacggatgtgcgtgtaaccataaagttgcggctacttggttacacttaaaattaatttgagtactctctcccggataaacgggtgcatgacagccaccgtctgtgattggtcctggtacattcagaccatgccaatggaaggttgttaattcaggtaattcgttttttaatgtaatgtgaatatttttaccatccttaaaaacaattgtttgacctaatatgctggcattatatccccatgttttggtttttgcgcctggcaataactgggtttcgccagtttgggcaatcaccgtataatacatatcggtatctgtctctttatcgggtttcaataacgccgggatcctcaacttttcctgtggggtatcaggctccttgaggggcacataaccaccatcatgagtattaaatgcaggttcgtcgaagaaataatcggtataaacttttctatctgccatgctattcgcatcctttgttattttagatccatctccatcatactactttggttgatcattgaagacggaaatgtggcataatggaataaaaggaggtgctatcgtggcagaaacagttactatcgataaattgaatgagacagcaacaatgaaggcaattaaagatttcgttgatttttatttaccacgtttgaagaaaaataatttggagattctttccatgtataaagtagattattatctggctgacattaaccacttcattttcgaaaatcgatcgtttactcctgaggagcttcgtgatgagctttataaggaatgcggcggtgacctcaaacacgtcatttcagtgatcaatcctgagtattacgacaacggaaatttgatttccggtacttgggaagaatggtatcaagacaagtttaataaagttcccgttagagactagtcatctaaatatacttttattgagcgatttgctatgttgaaggtaacgactaattcttttatttcgattaatggtgaggagggatcttcatggctaaggaaaaaagcaatcattcaaaggaaacaaaggctgaacccaaattaaggtttaaaaccaaaactaatttggatgttcatcagatgctgattaataaatcggttctttctataaaggtacctactatcgttgctcgtaaacaggcacaggggttactggataaagccattgatgatggagtgactccctactacttgaagaaagaaacgttggatcgactacgcggtacccattacgaatagatagtagtgacgtgtctgacataaaaaagactgaaggtaaaagcagactgcttttactttcagtctttttacgacttagatgaatcttaaacaaccttaattaaagaacgtgatattatgaaattaatctttacaggattaataaacgtttttattggagggcaatttgaaaatacttaaaaagatttttagttgggtgttcccaattgcgatgggattgttaatcggttttgctgttcgccaatactttgtgagtgccagttttattaaagggacttcaatgcagccgaacttacagaatgctgaagtggtgggcgttttcaaaacattaccaattcgtcgaaacgctgtcattatttttaacgctcacggcgaggatccagaggccaaggcaagcactgattattacgtcaaacgagtgattggtcttcccggtgataccgtcagcagcaataatggtacgatctacgtcaataatcaaccgctaaatcaaagctatattagtcaatatcagcgaagtaccgggacgggtaattggaatcttcaaagtttgtcaacacattggacgaaagatcaaaattccgtgaaagttcctcgaaacaaatattttgtactcggtgatcatcgttctgtttcaaacgacagtcgatactggggctttgttgacaaagacaaggtactaggcgttgttaagactgttccattcgacaagaatgccggtaaagtgaatcattcgactgactcactcgctggttcaaactaatttttgacgctgtcaatataaaaaccaagttcgattaagctatcaaatgagtttttccatcgctagtttgatgctcattaatcgaacttggtttttattatcttagaaagaaaagtgtggtttattctacgaacattttttagaagtaatcaaagtaatacgtctcacaagttagtatgcctgttctcttagactttcttgaagtaattttacgccagtatgcaaatcggtatcagacgtattttcctgtggtgcatgactgataccgtcaatactcggaacaaaaatcatagtcgtcttagttactttactcatgatttcgctgtcatgaccagctcccgaagcaagtgtttgataactaataccaaggttctttgccaattgcttatttctggtcagcatgccgttatcaagttgtgtggggtggtcagctacccaccggtttacagtaatcgacacgggtgaatttgaagctttttgtgcttcatctcttagcctgttttcaaaaagattcaaagtggtatcactgacatgacgggtatcaatactaaatattactttcccaggaataacatttgatgtatttggccagacatggcattcgccaactgtgaatgtgagctgtggactgatttctgccgcaatagctttaaggtggctaattaaaacaattgcgatttgaagagcatcgtggcggtcggtcatcggtgttgtccccgcatgattggcgatgccgtttactgttacggtaaagcgtcgttgaccaacaattgaggttaccaagccgatttgacagtgtgactcaatcagacgaggcccttgttcaatatgaagttctgtaaatgttgaggggatattgggcaaccccatttcatcagccgcttcttttaacttagaaacggctttttggcgagctgtgtcaaaagcgatgccggattgatccttaattccagttacgttttggatccttgcatagtgttttgaaccggaaaacgttgctggaaaacgactgccttcttcctcactgaatgagatgaggcgtaatgtcttcttgggttgaccaaatgtacgaacgaggttcagaatggcttgaagaccgccaacaacgccatataggccatcatatggcccaccatgagcaaccgtatccatgtgtgatcccgtcgcaataatagtgtcaggcgattgtgaaccaatgacatccaaatagacagtgccgtaggtatcaacggttatagtcatttcagcctgattgccccaagaaataagctgcttttgtcccttaacccaattaggcgagtataccaaacggttttgaccaacttcatttttagagaattgattaatagtcgtcaaacggttgtttaattggtcagttttgattggcattttttcaccttctatttagcagtgctgacaccggctaatggtgatgaagcaactgcgccgtgttcgataacccggccgggctttgcgagataggcttttcggccggcttcgattgccaatttgaaggcctccgccataagtgggatattaccggcggttgccatcgacgtgttggccatgactgctgaaacacccatttccattgcttctgcggcttggctcggtcgaccaattccggcatctacaataaccggaacatcaatttcatctaccaggatttgaataaggtcctttgttgaaaggcctttattcgttccaatcggagcagctaacggcatgatggtggctgctccggcatcaactaattgtcgagctgcgtttaagtccggcaatatataaggcatcacaatgaagccctcctttgccagaacttcggttgccttcagggtttcgtaattatccggcatcaagtattttttatcaggtacgacttcaactttgataaagttgctgccacttaattcgcgggcaattcgtgccgttcgaatagcttcttcagcggttgtcgaaccggaagtattaggtaaaatagtgatattttcgggaataaaattcaaaatattttctgatcctgttgtgttccggcgaagtgccatcgtaatgatttgagcttttgcattgttaatggccgaatcaatcaagtcataagaatattttcccgaaccaagaataaaacgggacgtaaatttatgaccgccgataactaattcatctttgtcttgaatggatgctgacataataatagtcctccctaaatttctgtttgtcctaaaattaaacgtgtaatcatattagcttcatgtcctgcgcatatcatgacccgaggtgccattagaccttcggcacctttggttgtgccatcaccggcaatgtaaagattagggcggggatgcttggtggtaatggtatttgaactgtgaatcccggccatcccggttcccataactaatggcttgtcgggataaaactcggatgcagcatccaacaacatggcttttgcagccggattgtcgaatgcttcacagataatatcggcactttcaaataagtctttgacattatcgtgggtaaccttaacctgagccgtttgaatatcaataaatggattgaattcctgtaaattttgcttcattgcaacaactttcggcatatcaacctggcttaatttgaattgttgacgatttaaattgctcaattcaacgaagtcaaaatcaattaattttaaatgaccgacaccaattctggttaatgcgatggcgatatttgaaccaagtccacctgaaccggcaattgtgacatgagcagcagctaatttatcggttgagtctttaacatttcgttctttcatgccatcataaacatctttgtaacgctgtccctgaacttctgcttccatttttgcgtttcctcctctagccgccaccaacgaatgagattagttcgactttgtcgccggactcaagcttgatcttatcgaattgcgctcggtgaacaatgtcgccgtttcgctcaacgacgatattttcaattggtgcgtttcgctttttgagaaagtcaatgacggtttgaccggcaacgtcttcttcttgaccattaactgtcaccataataaaagcccctttcttcgtgattgctcgaaggaaggggaccaagattggcggacttggaatccaaacaggttttaacagaaaaagaaaaaagatcttcttttctgttaaaagaagatctcggaatccaaatttaaaatcaattttccggttcgctcttccttcgacagtacaaactgcatcaggttcgatgggtattatctcagcctttacgaacgtggtaataaatgatcttaatcatttacttagacacgttcaggcaccccagacgaaatatttaattaagcttattagctcatgtattatttatagcggtttcatggataaaagtcaagtgtgcggagcaaagcggatagcacccggagtataagacggcgatttgggaaatcccgggtttggatttttcaaatcgatctcttatatgaagtggtgctgctttgaggagcagtcctagtcaagtgtgtggagcaaagcggaaaatgttttgagtcactttaaaaatgtttacgaaaccatggataacaacaatcattaagttgcaaatgatgattaagttaggtagacttttttcgaacatataaataaagcatacacaaaagtaaatttggaggaatcatccatgaaagtgacaaaccggccattgtacttggtaaccgaccatacaaatttaaatgatgaagattttttacaacaaattgatcttgcctgcgaatccggcgtcagtttattgcaattacgcgaaaaaaatcgatcaagccgtgatatttatgagtgggctgtcaaggtaaaagatattgcagatcggcatcgagtaccattaatgattgacgatcgtttggatattgcgcaagctgttgatgcagcaggggttcatttagggcaaagcgatttaccggttgaaattgcccggcggattttggggaacaaaaaaatcattggcgcaacgacaaaaacacttaaacaggctaagcttgctgaagaacaaggggcagattatttaggtgtaggggctatctttccaacccaaacccatgtaaagacggttcataccagtatcgagacattgggaaaaattaaggaagctgttaatattccggtttatgcaattggtgggttaaaggctcacaatattcaagcaattgaaccggcacatgtggacggggttgcagttgtttcagccattatgcaggccaaaaatgcaaaggcggcaactagagaattattggatgctgttgaggatgccattggataggttttagaagaaagtggaacagatagacttcagatgtctaaattaagtatcaaaaaaggatgccggataatttatccgacatcctttttaagctagtgatcaaataaagatcattttgcacggtttattgttctttgtaccaagtgtaatggaaactgcctgggcgatcaacacgttcataagtgtgagcaccgaagtagtcacgttgtgcttgtaagaggtttgcaggaacaacttctgaacgatatgaatcgtagtatgaaacagctgcagcaagtgatggaaccggtacaccggccttagtagccaaagcaaccacgtcacgagctgattcttgatacttcttagcgatatcaataaagtatgggtcaagaagtaagttttgaagatcagggttcttatcataagcatcggtaatgttttgtaagaagcgggcacgaataatgcatccggctctccaaatcttagccatttcgccaagtttaatgttccacttgtagctgtctgaagcggccttcaattgagcaaagccctgagcgtaactcattactttaccaaagtagagtgcttcacggactttttcaacaatttcttttttgtcgaaatcaacgtcacccttaggcttaggaagtactttagaagctgcaacacgttctttcttgatcattgagatgaagcgggcataaacggcttcagtaataactgattgatcaacgccaacttcaagagcatcttgtgaactccacttaccggtacctttattggcaccacggtcgagaatcatatcaacgattggtttggtcttgtcatcaccaatatcatctttatgagtcaaaatatcagtggtgatttcaattagataactgtcaagttcacctttattccattctttaaagatgccagctaaatcatcaactgaataaccggcaaggtttcttaaaatattgtaactttcatcgattaactcttcatcaccatattcgataccgttgtggaccatcttaacatagtgaccggcaccattagggccaatatatgtgacacatggttcgccatcggcaggtgctttggcagcgatttgcttaagaattggttcaactaaatcataagcttctttttgaccgccgggcattaatgatggaccttggagggcaccaagttcaccaccggaaacacccattccgataaagttgatacctgatttatcaagacgggcatttcgagccatcgtatcatggaagtttgtgttaccaccatcgataaggacatcgcccttgtcgaggagtgggagtaattcatcaataacagcgtcagttggtttaccagctttaaccattaaaatgattctacgaggagtttccagagatttaacgaagtcttcaactgaataacttggaagcagcttcttgtctccgtggtcttttataacagcttctgttttagctccggtacggttgaagattccaactgtgtaaccgcggctttcgatgttaagggcaaggtttttacccataacggccataccaacaacaccgatgtttgctttttgatcagacatttaaaaccatccttttctattaagaattactacgatactacacagttagtttaccattgcacaagcagaaagtgaaataaaatatcgttagaataggcaatatccatattttaatgataagtttgtgaaaaaagacagtcgaaaatcattaagcgttttcataattctaaactattttttatgaacacccgtaagcaacgcggatttatgatgaaaattaggttacaagccacggcagacaagttgaaatcattttcataaattggtaatttttttcaagcctgttagaacgaaaaaaagacctgaacaggaatgtccagatcttttcgtaaaatcatttaattactgattcaatttatagatccattctctgtgatctcgagctaatagttcatcagctgagaccggacccattgaaccgggaatgtagttagggaacattggttgttgaatatcccaaacacgacgaatttggtcaacaaacttccatgcgctagctacttccggccagctggcaaagtttgtgccatctcctttaagaacatcatgaattaaacgttcgtaaggctgtggtgtttccttcgttcgttttgaatcttcgaggaattccaagttaaccggctcagtatggaatccttgttcgctatttttagcattgacaactaatgagaatccttgagttggttcaatataaatggttaaaacgttagcgttgagtaaggcctttccactttgagggaaggagaaaatatcaaccaacggctttttgaagacaacatcaacccgtgtgaatttgtcggcaagtttcttacctgttctgatatagaacggggtacctgaccaacgatagttatcaaataaaagttttccggcaacaaaggtttcggtgtttgaatcctttggcacgccatcttcatcacgataagctttgctttcaccaacggcgccgtattgaccacgaacaaagttggttgatgcttcggcaacgttgtaaacacgaagactacgtaaggccttaactttttcagcacgaatatcagtatctttaaatgcaaccggttgctccatcgcaagtaaactaacaatctgcataatatggttttgaaccatatctcttaaagcgcctgagttgtcataataaccggcacgttcctcaacacccagcttttcagcaagtgttacctgaacgttatcgatataacgattgttccaaagggcttcgaaaatggtgttaccaaagcggatagcttcgatattttgaatcatttctttacctaaataatggtcgattcggaagatttgatcttcttcaaaagcattacttagttcgtcatttaattcttttgcagattcaaagtctctaccaaatggtttttcaatgaccaggcggttgaagccgctgttgttggagagtaatccttgagtcttgatatttttagcaactgttccaaagaaattgggtgccattgaaatgtaaaagacacgatttccttccaatttatactttttatccagttcatcggccttatcttttaagacagaatagtgagataagtcagttacgtcatgggtaacaaagtagaaatggctggcaaagtcagcaatcatttttttattactggattctttttcgacagattttgtaaccatatcccgatacttagcatcatccaccttatatcgtgatgagccaattacagcaaaatgatcacggatgtttcctttttcgaaaagtttaaacatagctggataaagttttcgaacggcaagatcgccgtttgccccgaatagcatgatcaatgaacgtctttcagttggcaattttttcactcctatcaaattaactaagcaaaattcggtatattgtctataccacttcgctaacattatataacacaactgccggcaacgaaagggaattaacaatgtaaatgataaaaatttacagaataggtcttttcattttgaaaaagatttacaaagtgaaaaatgaccagatttagccagcttgtgagaaacaaaaaattgatttctttttttaaactacctattattataacttgaaaaagtgataggtttcctgtttcttaagaatcctctaaatacagatctaaacagcggtttttttttcggtttcgcttataatgtagtttgcaaattaaacattagggagtaacaagtaaatgaagaaaatcaagtttatcgcgttcattgctgttcttgcgtcattctttttaggagttagtttaaaagcatctgctagttctccatcgctttcggtcaataacgtttacacaacgtcatcaagtgtaaccggaactgcaaccaaaggtgtttcgatcattgttcgtaactcaaataagaatactatcgcaacttcaacagctgataatcaaactggtaaattcagtgctgatttacacacaaacctaaaggcaaaccaaaagctttatgtttatgcccgtaaatcatcaacatcgtatttttaccggattgtcactgttaagacacctcagacgacaacgacgactactagttcaagcaataccagctcaagcagttcttcaaaagcaactgcttcaaccagcgcttccagtaaattaacgattaacgaaccaactggtaagtggtattcaggtaataacaatggttatcgtgtcgtgacaacattcaaccaatcaactggtttgaatcaagcgttgtacaagaatggtaaattccaaaagaaattgatcaactacgcaaactataaagtaacgacttatagcaagtcattctggaaaattacttatcgtgaacgtggaagcaaaacgactcaaacgttctatttgagatttactgataacacacactttatcattgttaacaaggctaataagggtcttaaagttaaatatggtaatgcaccttatcactattacaaatttgtgcttgtaaataataaataagaatgaccgcttaaatgggaagttgaaacaaattaatttgtttcaacttttttttgcgtctgtaaaatgacccatattttaaagataattaaaaccagatttaaaaaatcacttggctttccaattgctgaaacactaagaggtgtgagagaatgggagaggagatttttatatcaacagaggggagggataatgtgccaaaaagaagtgaaattcggtttagttctgttattttatattcattaatcctgaatgcgggtgctgcatttatgtggcccctggtaacggtttacatgcataattaccttcataaatcgttaacactggccggaatgactattttggtaatgtcggtatttatgatgattggaaattaccttgggggttatttatttgaccgttggtcgccctacaaggcagcaattatcagtgttgtcatttcaatgtcggcaattatcgggctggtcttctttcatggttggccaatgttttcaatcctgctgctatttgtaggattcggggatggtgcctgtatgacactattgaattcttatgcggctagtattaagacacggtcaacacgagcaatttttaatgtcttgtatattggtcaaaacgtggggatcgttattggaaccttaatggttggattcctattgtcccatggtgtgacaaccgtttttattgttgccgccattttttactttattttgttagtgattaccttgatcgatttcaatgttgtggtgcagcgacgagctcccggaaaaaagattcaacccggggcaccacatgagaccaatgttggttcgatgatcctggcaatctgcggagttgttttgggggtgtatctatcatacgcactctgggaaagtgtcatttctgttcacatgacgaaccttcatattccatttgagaactatagtcttttgtggacgttgaacgggttgatgattgtctttgggcaaccgttcgttaaccggattggtgagcattttaagttaagtacgcaaacttacattggggtctttatctttgcgatttcgtttatcggccttatttttgccaagcaatattatgcgtttatcatcgtcatggttgtgacaaccattggcgaaatgattggttttccgggtattccggcttggattgatagtttatcaacaccgcaacagcggggaaagtttcaagggatgtataatttgtttatgtcctttggaagggcacttggtccactaatcggtggtgtctttttagattttgcaccttatggcgtgcttttctcgtttgctgccggaattatcattgtgttcctagttattttaatgattttgaatcataggcgaaataggattaatcaacagtttaattgataaagtaatattctaaaaagaagcgactcgattattttcgagccgcttccttttagtacttgttgagttaaccttttgctaacagcttataaattcgttcaacgtcacggccggttccacgcagttcataatctgccaagaaaggcacattaaattgagacgcataccgtttggcagttaagcaatattgctcattaaagtttttattgccactgccgacaatgccgtgacacagcgaagcatttttgccataggcaatgtattcgccaagtgtattagtcattaactctttaacaccattgtcaataccgttgccgccatctaaataagtcggaacaaaagcgaaaaatgggtcgctttcatcttcaaaatcagattgatcgctgatttctttgctgataacaagtgggttgcttgaatcctgatcatgcatccccactgcatatttggtcaaatctttgatgaaagaacgggtatttccttcaattgagataaataaaattttgatgggtgtcattaagccactctcctcgtatataaagacataataaaatcatacataatatactgtaaccactatcattcaactaatcaagcggtttctggcccgttgaaggttgtttgttgacagcgtgtgctgctcggtttttcttttttggcagtactagtcgaaaacctacggaaagcattgccagaatcataattaaccagctgataatggaaatccatttactgatttgaagcccgggcgtcgtgtaaacaagtttgatttgatgattaccggcaggcagcgttgcaccaatgaaacctttattgacgacaaacgtgtttgtgggtttcccatcgatttgtaacttccaaccgctggaatatggaattgaagtgaccaaagtgccgttagaaccattgtgagactgtcccgttacctgattatctgagacctttaagtgattaaggccggttcttttaagcttttgaatttggttatcgtaagatttattgaacggcatggcaattaatttaacagatttaaatttaatgtttttaaccaggttgaaatcgagtttaatctgttttcgtgatttggttgagtaaccaagatttaataccatgttgtcaatttgtcggtaatttgaaagattgtcattgtcgtattgcgcgtagccgttgtgaaaaacgttggtaaaagcatcaaaattataaccaccaaatgtgggtgttaataaactgtgtcgggcaacgtttaacttgccgagtctggagtaaagtttgttttgaagtaaaaacgtattggcagcccagttattatggtcggcaattgacccatcggtttggttaataccggtaaggaccaaatataattcagcattctttgtttgcttgggcttattaacttttagagaatactgaagcggtttgccggtgacatcggttgtcatcttcctaagaccgttgcgattctcgtactgattattttcataaatcattctgttggtggccagtaaatcttttgtcttttgaagattggctccgagactcacctgagcgtgcggctgttcaataacctgtttttgatctttatcgcctaaaatgcccagacggtaagccgttagttttttgcctgagtcaataaacgaggatcgatcgacttggacttgatactttaagtttttacttgctgattgataagtaagtgggctgttattattcttagggctaacaactgcgccttgagtcataacacgttcacggttgaccgggtccagatgattataggcattggtcgaaaatgtcctaaattgtgtgtaggccaacggcagtgcgttatttgttttataaataaccgtgccgtccatgttttcgatagcaggaaccgcattaactctggcttgagcttggaaaacttttggctgaccgttggcgttttttatgatgtgataaccatatggaaccatcggtggctttttggtattggcctttgcaaaaatgtattgcacacctattaggttattaaaggctgttcggtaatctccctgtgcaatgggggtattcattgaaaattgactgttgccaaccgaacgtgagaactttcccaggtagccgttttgaagggtgaggtacacggacgtattattaattccactgttaattgacaggtcggtattggtatttgtatagttggctaaattttggagatgctcgttgtaatggtatcttggcgccatggatgtccggaagaagccgggttgtttcttaatgtattgttgtgcgccattatagtaatctttgctgaaccgggttgctaaaccgcggtttaattgctgaatagccaagttgcttgcattcggactgtaaataccgataatatttgaagcaatattgagcataaagaggcataaaataaggctgacttttacccacggcttccatttgaaagtgaaaatgaccagtagggcaatgactgtcaaaaataaatacccatatgaaatggcatcgtgtgcttttaagttgaggataaacccattggtcgcccagacaaggataaccaaaacaatacctgaagcagtcaaccaggcgatatcatttttggtcagttgatccaagttatcaatgagcgccattgttgccaaaccaaagattatattggcaagcaggaaccaccggttggatggcgttgagatggcgttcatgatggcaccgaaagcgggaatgagaatgccgataagtgcaatgatcaagccgacgttttgccaaaaatattttttaaaatgcctaagtgtataaacaacacctagaaaagataggctggtgataccaatgaccaaccaaaaattcatggcgcgacctgttggaaggatggcacttggcatttttagataatattcgggtgggaaaagaaccattccattggcaaatgcttgatggatacgggttgatttagttgcaaaaagagcagtcggtaagaaaacaatggccgacataccaagtcccaaaataactgaaatggccattttaccaagtgactttagaaaatgaaagtcagcagcttttcggcggctcagtaccctgataatgagataaataaacgtgccgattgccaaaatccaagcgaaataaaagttggcaaatagcgttaagaagacggctaaagcaagtggaatccaagatttattcagtataatacgatcgattccataacaaagtaacgggaagaaaattaatggcaggatgaaaaagggatggtgcaagcctgtggatagcgcatagccattaaacgcgtaggccaaggcaccgatgacacgacttatctttttaaacttatacgttgaggtgtaaagcataaaagacagacccgaggcatacattcttaaaaaaatcagaaattcaaatgccatttcgatatgatttttaggaaataaaatgaccaggtagttgaatagatcgccgattacatagtatgaaagattggtcagctgatcagacccgagactgatcccccagctccagtgtgtgaatccacgactgggatcggaaagaaacgttgcaatcatgtgccgaagttggaccaaaatcgggtaatgctgcgcaaatccatccaattcccagaccatcgatcggccagtcataagtaagctgccggcaatgatgccggtcagcacagtaaataacaccgagtatgtaagccaggccggtgtttttcgccatagctttgtcaattttaaatcctcctagaagatatcttcgtcattgtaaaaattaaaaacaaccccgatatacaaagagactgtctgcaaaacaaattgtcttgtaccagtctcttgagttttttaattaatccgatttgccatcattgtcatcatcttttgtaggtgtgattggcttgtgtttagtgacttcaaaccaattgataaatgagttttccaaatcaacaatcttgaaatcaaaattttcaaatgaaatctcatcgccgactttaacatcgggatagttatcctgaaaatatccggccagtgtcacagcatctgaactcgtgaattcagggaagtctgcatcaaagtaacgttcaaagtcatgtgttgtcaattttccgctaacttgataagtgccattaggctgtttaaacacatattcggtaaaggaaggatcaatttcatcacgaacggtcccgaacaattcctcgtaaatatccttgtcggtaataataccagatgtaccgccatactcatcaacaacaacaacgattggtgttcttttttcaatcatttggtgtagaacatccgtaatgggcgtcatttcgggagttgtcgagatgtctcttagtaagcgatcaattctaatgcttgaatcgacttgagattgtcgaattaaatcatagttgtaaacatatccgagaattttatctttatcgttattggcgacaaccggaattcgactgaatttcttttgcaaataaacttggatagcttgtttgacattggttgtaatatcaatcacaaccaattgtgttcgatcaatcataatatcttttgcgactttatcatttagttggaaggcccgtctcatataaagataatcattttgttcaagcgcaccgcttttaacggcattttttgataagcttaaaatttctgcttgagaaaatgattcggcattttcattggcaaacggtaatcccagcatcttaacgataccgtttgcggaaacatttaataaccagacaaacggataaaaaatgatgtgaaaataatgaagtggtgttgagacaaagttcaatactctcattggcatatcaatactgatattctttggaacaatttcggttaggacaacttccaagtatgtcagaataataattcctaaaactgcaccgattgcatgggccgttgcagggttgattggcgaattatgaatttccatgacgtcaaccaaaattgttacaacaaaagattcaccgatatagccaagaatgatacctgccaaactaacaccaacttgagttgttgataggtattcattcaaattggttaccatatgaatttcccgattaagcttggttatctttttacccttggtaattttttgatcttttagattcttttttctttcttccagtgcactcactcttgattgaacaagagcaaattcacttgcaacgaagaaagctgcaaagaagaacgtcactataataatcaataaattggtcattaactggctatcgcccaaaattctattcctcatttcaaaatatatttaatataatcctattgattggtactgaaaagactacctctaattatacgcttatacaagtctttttttaagaggatttcctatttgaatccattatgacagattcccgatctattataaaaaaattggtgctttttcttaattttggctgctaacagtgctacgcttaaagtagacagaaataaggggatgtatcttatggctcagaaagctaaggaaagtgcaaaggaaaaaaaggcggacgaggaagagaaacccgaaaaagattttaactatccggataatgaaattaaaaaggctgtcgatttgattaaacaaaaaggctatgtcaccaagctcgattttaaagaaatggatgatgatgattgggcaaagggattttcaaaagaggtcgataaagtctttcaaaaaagtgatgaagatccatacatctactacgaaaaatttgatttcgtaggtggagatattgactccattatttggaatatggatgttattaagacacgtgatgctgcactacaaaagttggcagatttattgaaagaaagaattgaataaagctaccaggtgagtgtgcagttaataagacattaaataatttcatcaaaacgatccaacaatgatgttcagtatcattgttggatcgttttgatgttgatcggatgaatagttggatgacaacaataatctatcagatgccccgatcaaaattaaaccaacactaaagatcgttccaactaaaagaatcaggtttagtcggaacgatctttattctatccgatacagttttattttttaaactgtttatattgttttcccaattcataaaccaattcgggttcgttacccgttcgctgatttcggttcattacatccagcatggacatttcatcgtcacttaattcaaaatttaaatccgcattttgagcaattcgttcgggattttgcgattttggaatgactgaaatgcctcgttggatatcccagcgtaaaataatttgagcaggcgtttttccatggtgaaccgccattttaccgatcattggattatccaggacggcacctcttcccagagggctccaagcttgagtgacaatagattgtttcttgtcaaacttaatgagtggtgcctgattaaggtaaggatgggtttcaatttggttaactaccggcatttcatcggcctgcgttttgagcagctccaactgtgaacgagtaaagttgctgacgccgattgatctggccttcccctgcttctttaattcctcaaaggcttcccatgtttcaaagaacttgtcggcgattggccaatgaacaagtaataggtctacataatccgttcctaattgctgtagggaaaagtcggtactattaatagtcaaatcatggccttgattcatttcggtcactttatcaataataaagacatcttgtctggggacactcaagttgcggatcgcatcgcccagcattttttcgtttcgataatattgggcagtgtcaaacatacggtagccgttttcatatgcagattggattgtttgattcattaaatccggctttgcgattttataagttccaaagcctaaaaccggcatttgattgccgtcatttaattgataagtcgacttatcgggttcaaacataaaattcctccttgtaataatcgttatggcttaattttagcatatttcctacctataataatgtaagcgcttgataaaatgataaaataaagatgatcggggtgattttcctaaatccctacggcaatttaaaattttttaaacttcttttgaatccatacaaataaatgtgcttttcggatattattttgtacaattaacgtagagtgaggtgtttaacttggcagatgttaaaatttcagaagtaacccctgagcagggcctctcttctgctcaggttgagcaccaagtcaagagtgggtacaaaaatttgggagagcaatctcttacccgaagcgttaaggaaatccttagggacaacacatttacgctatttaatctgattaacgttgttcttggtgcgctggttttttatacgggaagttacaagaacctgctatttttggggattgctttctttaatactattattggaataattcaggaaattcgctcaaaacggcaagttgataagatggtgttattggcagaaggcaagtcaactgttattagaaatggagagccggtcgacatttatccggaagacattgttcttggcgatgtcttggctttgaaccggggtgaccaaattcctgttgatggtgttgtgatgcagtcacgtgggatggaagttgatgaatcaccaattacaggtgaatcacagactatatcgaaagcggttaacggcaaattaacttccggtacttatctggtgggtggttccgggaagatgttggtgacaaaggttggtgcgcagacctttgttaatcacatgtccaacgaagccaaagaaggaaaagatacctccagtattttactgaatacaattaatcgtattattaaggttttaacttacgtcattattccgctgggtttaattttgttcatcgcaaaattatttggcggaaacgatattaaccgagcaattcttggaacggttgcggcaatgattgggatgattccagaaggactcgttcttttaacctcaatgacgttagcggtgtctgccatgcatttggccaggaaaaagacactggttcgggatcttcctgcgattgaaacattggcgagagtcgacgtgatttgtttggataaaaccggaacgattaccagtggtgatttaaaatttgaaaaagccattccgttgatgaccggtatagaaacggcggagttggaaaagattgtcgccggcattacttatggtaccggtgataccaacgaaacagcaaatgccattaaaaatgccattgaggatccgaatatggccgcttcgacgattgtaccgttttcatcgcagcgtaaatggagcggtgtcgaatttacaaatggccgtgaatacgtcttcggcgcaccacaatttatttttcatcagttggatgctgacactaaaaatcaaattcaagaatatgccaaaaaaggatttcgagttttggctgttgccaaggttgatttgcttgatgccgaaaagcctttggggaatccccggatgattggcctgattttgatttcagatgtgatcaggccgaatgcggttaatacgttccaatattttagaaatcaggatgttacgattaaggtgatttccggagatgatccaacaacggtttcgacgattgctaagaacgcgggtattcaaaatgcaggccacagcattgatatgtcaactgttagtgataacgatgattttggacaacttgtgactgaaaatactgtttttggacgggttacaccggatcaaaagaagcggttgattagtgcccttcaagaaaaaaagcatactgttgcaatgaccggagatggggttaatgatttgctggcattacgacaggctgattgtggtattgcaatggcttcgggaagtgagagtaccaaaagtatcgctgatttcgtgctgattaattctaatttcgacgcgatgattgatgtgttgaatgaaggtcgccgagtgattaacaatattgagcgggttgcttccatgtacctgattaaaaccatgtattccgttgcgttgtcgttaatctttgttttcttggcaatgcagtatccgtttgagcctattcaattaacgccaattacgtctttaatggtaggtatcccatcattctttctagcgttggaacccaacttcagtcggattaccaaccaatttatgcgtcaggttctaatcgtgtcggctccggctgcggtgtgtgtggttggttatattatggtgattgaaatcgtgggccgattctttggactgcattatgaattcacatcaaccttatgtgtccttctgaccggagcaatttgctggttggcactggttctggtctcacggccttggaatcgattgaaatttgggatggatattcttgtgttggcggcatttctggcaatcatcgttttctttaatgacgtcttttcgcttgtatcattctttaataaagatatatggttgtatgctgtgccgctaattgcgacggcatacccactttatatctttatgcagggtgtgattgccaaagtattggatcgcagggaagttcgaaaaagagaacgggcggccaataaacaaaattataaatagggctgaatacattaaaaaagtagaattggattggcgatttgtcaatccttttttattaacctatttcatctagttttaatgactagataatgtggtataattgtttatagggagtgatgacaatgccatccattaacgaagagtacgacttatatgaaaaatgggaagataaattaaagacagttgaactaccgctttgggcagaattacctaaatttgaactatatatggatcaagtgaccgctttggtaaatgaaacgttggggccaattggcgtagacagcgtcacgccggcaatgattaataactatgttaagcataaagctattatggcaccggttaaaaagaagtatcaaaccatgcagattgcagatgtcatcttaattagcttactaaagccggcattttcattggaaacgattcgccatggaatcgatcaggtaacggctaatatttatccgcaacaagcttatgataactttattaagcgactcatgttctcgtttaaaaatatgtctaatcgaaatgggcaggcgttagaggaaaaaaatttaaatgacaaattaatgcaggtagcagttaatgtcataattgatcggttacagtctgaaacattattaaagatcattgaaaagccattgacgaaaatcagcaagtagtgaaaacattcacatataaataatggaaccgttttcatgaaagaagcatccatccagtgggtgctttttttcgtccttagctgctgttaaagggatgtaactggatgaaagaacttttgtgatttagtaaacaaaagtatttacttttaaaaaaatcgtggtatagttatttttgtgaaatagataacaaagaatttttcggaaagaattttcacggaggctaactaatgattgagaataaagtaaaagaactcaagacgacaaaaccagaaaaaaccaatgttgacgatatgattaacaagttagtttcaaaagcccaaaaagctctcgaaatcatggattcatttgatcaagaaaaagtagaccacattacccatgaaatggtaatggccggtcaagataaacatatggatttggcactcatggccgctgaagaaaccggtcggggagtcgctgaagataaagccataaaaaatatgtatgcaaccgaagaaatctggcatagcattcgcgaccataagacggtcggtgttatcaaagacgatagggaacgccagctgatcacagttgccgaacctcttggggttcttgccggaattacaccggttaccaacccaacttcaacaactttgttcaaatcgattattgcaatgaaaacccgaaacccgattatctttagcttccatccacaagcaatgaagtcatccgttgcagctgcaaaaactgttcgtgatgctgcaattgcggccggtgccccagaaggtgccattcagtggatcgaggaaccaagtatcgaagcaaccaacaaattaatcaataaccctggtgtagcaagcacacttgctaccggtggtccgggaatggttaaggctgcttattcaaccggcaaacctgctttaggtgttggtcccggtaatggtcctgtttatattgaaagaacggctaatattcttcgagccgttaacgatattgttctttcaaagacatttgataatggtatgatttgtgcaactgagaacagcgccattattgataacgaaatttatgatgatgtgaaagaaaacttcattaaaaacggtgtcttcttcgttaccaaaaaagaccagccaaaattggctgaagcaatgtttgaccctaagcgtgggggtgttcgtggcccaatcgccggtaaatccgcaaaaggaattgccaaattggcagggattaaagtcccggataacaccaaggttttagcagctgaaatgaccggtatcggaccaaagtacccgttatccggcgaaaagctgagcccggtaatcagtgtttataaggccaaaagccatgaagatgccttttcaattgctgaacaactcttaaactatggtggtttggggcatacagctgctattcagacaactgatgacgatattgcgcttaaattcggcattaagatgaaggctgcccgagtccttgttaacacaccgggaggctttggcggtattggaaacctctataatgaaatgacaccatctctaacgttgggaaccggttcatggggtgcaaattcaatttctcataacgttaccgattacgacttattaaacattaaaacgatcgcaaagagacgaaataatatgcaatgggttaaattaccacgggtatactttgaaaagacatcaattcgatatctcgatgatatgccaggcatcaataaagtgtttattgtgacaacgcctggaatggtagaacatggatatgtagatacagttttggatgaattaaagcgtcgtccaaatgaaattgaatactcacttttctcagatgttgagcctgatccaacaactgatacagttgaaaaaggtgttgctcagatgcgttcatttaaacctgataccatcattgccttaggtggtggttcgccgcttgatgccgctaagaacatgtggttattctatgaagatccgacaaccagtttctttggtgcaaaacagaaatttattgatatcagaaagcgggcttaccgcttcaataaaccacgtaaggcccaaatgattgctattccaacaacttcagggacaggatcagaagtaacgccattcgctgttatcactgattccaagactcacgttaagtatccattggctgattatgcgttgacacctgatgttgcaattgtcgatcctcagtttgttcaaaccgttccaaaggggactgttgctgcatctgggcttgatacactctgccatggtattgaatcatttgtttcagtaatggcatcggattatacacgaccattgtcattgcaagcaatcaagttagtttttgaaaatctgactaactcctataatggtgatgagcatgcgcgtgaagaaatgcacaatgctgcaacactagcagggatggcctttggtaatgccttcttgggaattacccactctgttgcccacaagcttggtggagaattcggcttaactcacggaattgcgattgcaatcacattgccacacgttatccgtttcaatgccaagttaccggaaaaaattgccgtatggcctaagtatgaatatttccgtgctaacaaggattacgctgaaattgcccgttatgttggtattcaaggaaagactgacgaggacttggtagaaggccttgttcaaaagattatcgacttggctcattcggttggcgttacccttagcttaaaagcatggggtgttgacaaagataagtttgatgctgccgttgatcgtctgtcagtacttgcatatgaggatcaatgtacaactgccaaccctaaggaaccattaattgctgatttgaaacagatcatgatggatgattacgatggaaaaggtgttgagaagtaaagcacatctagaacggttaactcatgaaagttaatttttaagaactattaaataaccgctgatcactttttaaatgatcggtggttatttttttgaaaaatatgactataatgtaaaagtatagaaataagtgatacaagtgtgcggaacaaagcggttagcacccagagtataaggcgtcggtttgggaaatccgggagttggatttttcaaattgatcccttatatggcgtggtgctgctttgagaagcgatcctagtatagactaaataatgagggaaataatcatgatacgagaattgcgcagaattcaagaatttgtgagagaagaattagggtatgaaacatccggccatgattatacgcatattacgcgggtagtcagtttagccaggactatcctaaagggtgagcaggcagatgaacaattggtgttggtagccgcttacctgcatgacgtgagtgatgataaggtgactaccaaccctaaggctaaacgggaagcaatgatcaataaattaagagaaattggctatgatcagatttttatcgacaaagtttttgacattattgacaacatgtcctttagcgcaaatctgaaaaccaagcataaattgtcaattgaaggccaaatcgttcaagatgcggatcgcttggatgctattggcgcaatcggcattgccaggaccttttatttcggcggccactttggtgaagtgatgtataatccccatataatgccacgaaccggtatggataagtctgaatatcgcaaacgaagcacagtgattaatcacttctatgagaagctgttaaatcttaaagatcaaatgaatacgccaactgctaagaaacttgccgagcatcggcaacaggtgatgcttgattttcttcatgagtttatggatgagtggaacgggcaggcttaaatcaatttgaaaactaaatttaagacagctgaaattaataaattaaaagttgaaatcacagtgattacttttatagcctgatacagagcggcaaagacagttgttccgattggtataagcgataggacaatggttaaacttatcagcaacaaaatggtcgtggctaatccttgaatcgagttgcgataatcggatgaacttagatcaaacccaccgatacagatattggctgtcaataaaataaatagtagcattggtccccactgaaaggctggaacagccgttatcgaaagcggttggtacgttaaagtgacgagccgattataaatattgggtaacaaccaccttgctaaaaataaaatagttgtgcagcagccaaaaatcggtgcaacgccaataaagagattgccaatggtttgataaagatttctgggttgccatgtatggttgacataaccaagcgacgggttgtctatcgttggtcgtctgattaaacgaacggtttttattttatgaccaaataccaaagcgacaattaagtggcttgcttcgtgaatgatgacacccaaaaagccgaaaatcagttgaccgttaataccaaatcttttggcaataacggctttggtgttccggttaatcattgcaagcaggaaaataaaaagaaacggtactccgattaggaatccgagtaccgtggcgatgttaatcatgattgtttttagcatggtgttatttttccttcaaatcggcaaagcttccgtgaaccaattgacgcatttgttccgcatcaactttgacagaacgaccgatttggccggaagagacaatgatttctcccattttctgggcctcttggtcaatataaatgggatatttgaatttttcccaaataccaataggagtgttggcaccgtgttggtaccccgttgttttcaataactcttttaaagggaccatcgtgacctttttgttgccggatgcttttgctaatttcttttcgtcaagatgttcatcaaccggtacaacgccgacgacgggaccggtagtttttccggtcagaaccaatgttttaaatatttggtgttcatcttgatctaaatggtcgacactgatttgttcaacatcgccttcttgatgggttggaaaggtcatttgttcaaacggaattttgtttttatctagaatctgttcaacgagtgttttatgaactttgttgcgtttcttttttgacatttacgacacctcacgaacattttatcacatcatatccggtaattccgtctgaatttgtaataaatatctggtatactttataaataatgttaacgaacgatttgatgaattaaggagacggcatggctgatttagtgtatcaaaacatcatgaaagatttaaagaatcgaatcaaaaagaatgagttcgattccaagcgcttaccagatgaacgcagtttaagcgaatcttatggtgttagccgcagctcagttaagcgggctttaaacgttctggcaaatcagggcatcatttttaaaaaacgcggttcgggaacctttattaatccactgtaccaaaagaaccgatcaatttttcaatatgaagggtctaatctaggggtaaccgacagttttaaaagtgatggtaagattcctaagattaaactgttggattttaacgttatcccggctgataaggaattacaaacagaattattcttggatccaggcgattttgtttatgaaattaagcgtttgcgaacttttgaagacaaaccctttatgattgaactggggtacattccaattaaagtggtgccggatttaaaccaagagcgtgtcgaaggatcaatctttaattattttgaagatacaaccggtaaatcggttactaaatcatttatgacaataacaaccgagccttcaaacaaaggtgaccaaaagctgcttaacttgaagccggttgaacccgttggtgtgatggaaggtatcttctttttagatgacggcacaccgtttgaggtttcaaatatgaggctgcattataaatatttaaattataatacgtttgttgatttgaacgaaaatcgataaaacaaacaatgagactgagacaaagtaattttgtccagtctcttttgattttatcacgattattaccgagcaaaaatgtgcaaaaaagtcaacttcctgctgtgtgatagggttgcctttattaagcggatgagccggttatatttttgtaaaaaatttgttacaaatccgacattttagtggactattgtttttatatcactcataatggcaaataagtataggattttaaacgatttaaattggaccgtatcaatttacaaaaaggttgactatcataaaaaatagtgtagtattaatggtgtaaattgatcaggctaattgatgaattttacgaacattctatacagtagctttgttgttaaatcttagaaggagtgttaattaatgacagtagattacgattccaaagaatatttggatcttctagacaagtactggcgtgccgcaaattacctttcagtaggtcagttatacttgcgtgacaatccattgctcaagcgtcctttgaagtcagatgatgtaaagatcaagccaattggtcactggggtactatcgtttcccaaaacttcatctacgctcaattgaaccgtgccatcaacaaatatgatttgaacatgttctatattgaaggttcaggtcacggtggacaagttatggtttccaactcataccttgacggtagttattcagatatttatccaaatatctcacaagacgaaaatggtatgaagaaattgttcaagcaattctcatttccaggtggagttgcttcacatgccgcaccagagactccaggttcaatccatgaaggtggagaacttggatactcactttcacatggtaccggtgctatcttggataacccagatgtaatcgctgctgttgaaattggtgatggtgaatcagaaaccggtcctttggccgcatcatggttctcagacaagtttatcaacccaattactgatggtgctgtattgcctatcattaacatgaacggtttcaagatttccaaccctactatcctttcacggatgagtgatgcagacttaactgattacttcaaaggtatgggctgggaagcacactttgttgaagctactgctgatactgatcatgcaaaagttgaagtagaatttgctaagacattggatactgttattgaaaagatcaagtccattcaaaagaatgctcgtgaaaacgaaacacctgacaatgttaaattgccagtatggccaatgatcatcttccgttcacctaaaggctggactggtcctaagaaggatctcgatggtaaccctatcgaaggttcattccgtgctcaccaagttccaattcctgttgatgcaaatgacatggaacatgccgatgaacttgttgactggttgaagtcatataagcctgaagagttatttgatgaaaacggtactttgaagcctgaacttcgtgcacttgcacctaagggcgaacaacgcatgtcagttaacccaatcacaaacggtggtatcaagccagaaccattgaagcttcctaacgttcgtgactttgaagttaagtttgacaagcgtggtactgaacaaaagcaagatatgatcgaatggtccaagtggttggatgcagttgctaagttgaacccaacaactttccgtggcttcggtcctgatgaaaccaagtcaaaccgtctttacagtttgcttgatgatggtaagcgtcaatggatggaagatattcatgaaccttatgatgaagatcttgcaaaccatggtcgtgttattgactcacaactttcagaacaccaagcagaaggttggcttgaaggttatgtcttaactggtcgtcatggattctttgctacttacgaatcatttggacgtgttgtggattcaatgttaactcaacacttcaagtggttacgtaaagcttcagaacaatactggagaaagcaatacccatcattgaactttgttgatacttcaacagtattccagcaagatcataatggttatacccaccaagatccaggtctgttaactcatttagctgagaagaagcctgaattcatccgtgagtatttgccagccgatgctaacgaattgttagccgttggtgattcagcattcagaacttacgaaaagattaacttgattgtgacatccaagcacccacgtcgtcagtggtactcaatggatgaagcacaagacttggttaagaacggtcttggttacattgactgggcttcaactgatcaaggtcaagaacctgatgttgtctttgctgctgcaggtagcgaacctaacttggaagccttggctgctatctcaatcttgaacaaggaattcccagagttgaagattcgctttatcaacgttgttgatattttgaagcttaactcacctaagaaggaccctcgtggcttaagcgacgaagacttcgataacttgttcactactgacaagcctgtcatctttgcatggcatggtttcgaagatatgatcaaggatatcttcttcgatcgtcataaccacaacctgtacgttcatggttaccgtgaaaacggtgatatcactacaccatttgatatgcgtgtattgaacgaattggatcgtttccacttagctgctgatgctattcgtcatattccagcatacgccgttaagggtggttacttcatccaacgtatgaacaacatcgttgacaagcataaccgttacatccgtgaggttggtactgaccttccagaagtaacatcatggaactgggaaccacttaacaagtaatctagttaaatagtaattactaaaatcccaaaagaggacggaaaactttaagttttccgtcctctttgctatacatagttatcaacaaacactaatgctttagtttaaatgtaccggctttttcaaaaagtcgtccaatttgaagcagtaaatcttcgcgtcccttttttgccataaattggattccgagtggaagcccgttattgccaacgtatgtcggtaaactaattgcgggctgaccactgatatttgctaattgagtaaaaggtgaaatggttagtgccggtagccactgatcccagatgatttgtaagcgttcattaggttcaaattcccttatgtttatcagcttttccatattttgatcagaaacaagctgttggtcaacttggggtgcttgaaaagccgtcgttggcgttaaataaaggtcatattgatcactaaaagtatccattgtggctgcaacctgatcccaaaacgccagtgcctgactgtaggcgacagctgagactgattccccggctacatttaatgcccatgtaagtggctcaacattatcatgaatagtttggctgtcgagatccatatttgcgaacatcgtggccgtttcaccggcattcatcgtgtagtaagtttgcattaattgaatgccatcaattggcgcgtcagcttcaataatgtcgtaaccggctttttctaagaaatcaacggcattactaacggctctttttgcttcgttagaaatgggagtgttgaccggagatttagttgaaaaggcaattttaagatttttagggagctcatttaatgtgctttcaaaatcatgttccggcaaggggacctgaaagggtgcagacatttggacaaccgataaggcatccaataatttggctgtatcttgaatatctttagtgattgcaaaattaattgatgcaccttgccatccccgccactcgtcgggaccagtaggaacacgaccgcgagtgggctttaatccgattgtgccagagaaggaggatgggattcgaatggaaccacccccgtcgttcccagctgcaatagggagccagccatccccgaccgcagcagcagagcctccggaagagccaccgggctgataatcggtattccacggattatgggcattaccatagagcttggagtcggtaatgtttttaaatccaaattccggtgcatttgtttcaccaaccggaattaatcctgctgacaacaatccctttacgaaattattagtttcgggggcaatgtaatctcgtaataattgagagcttcctgaatcaatttcgcctttaaaggattgaccgagcccctttaaaagaattgggataccggcaaagggctgcccgtcatctttaaaatgagtgaccatttgtcgggcgcgctcgggccacaggtgcgtaacagcgtttagccgcggattttgttcttcaattgtgtctaataattgctggagcaggtctgctcgggaaatttgatgattatgaatcaaatttgtcaactgggtagcagagttggttgctagtagattatttaccattggtgaaacctccttataaatgacatccgtatagattaagtataagagaccttgctgataattgcaggtagtatggacaactaatcggcttgttcatgtcaaaagtgacaatttgaaatcgtcaaaatgtgccggtaaaggggcggtgatttcaatgacctgttcactgaaggggagcggaattttaagcttccatgaatgcagcaacaagaatgggtgcttatcatcaggattgtatagcggatcaccaactagcggatggccaattgcggctaaatgaacacggatctggtgagttcgaccggtttccagttgaactgccaacagtgaatagccgtcctccttctgaagaacagtataatgtgtcagggattttgcaggatggctcccatctatcatgcgttttcgtttatcattaggatcgagtccgattggaaagtctatgataccttgggaatcaatgtcagttcccactacccatgccaaataggtacgtttaatgtttttagccgcaatctttgcgactagagttggtacgaccgccggatttttagcaaataaaatagcaccacttgtttcctgatccaagcgatgaaccatgtagggaagcatcccctttgtcttaagataagccgccaaatgattaatagttgcaccaacttcgccgggttgatttggatgggtcttattgccccggcgcttattgataacgattaaattggcatcttcatagaggatttttaacgtggctgctgaatcgggcagtacttgtgggaagggatgctgaaaatcagaaggaataaaggttaacgaaatgtgatcatgaaaatgaacaggaaaattaactggtaagtatcgattgttgaccaaaattcgttcatcagaacgcaaactaaaaaccaagtgtttcggcaacaaccagtaatgatgaagaagatagcgtaacggtttgccatccattgtttgaggaacagtcgtcttaaaaagccattgagtgttcattgaatcagtccttattttacaataaaagagaatcggacttgcggtatattaagctgtacctggtccggttccctttttaaattatattcttatcattttggctgctttggatcgttttttgagcgcacaattaaaacatcacatagagcagttcgtgttacgtaacttgtaacggatccgataatcaatctttcaaccgcgctgagaccggttgagccgattacaatgacatcagtatggtgatcatgcggaaattcacgtgagataatcggtttgggattaccaaaccgaatgtgaatatcaacatctttaacacccgcagccaatgctttttgtttcatttctttgagcttatcttcagtattttcagttagtttgaaaaccacgtcaccgcttacagcactaccgtatgtttgattaaattgattaacctccagaatatttaaaatatccaggtgggcatcatttgccaatgcaacggcaattgcgcgattgagcactgaactcgtaacggccgaaccgtctactggtactaggacattcttgtaattttggtcttccatgtgatcaccccgtcatcgatttgttcttaccttaactataacattctcaagccggcttgtaatcaataatcatttggttgatagcacggattgtcacttgtgattgtaatcgcttacctgaggtgctaacattatcttgtgaaagaaaaaatgaaaagaggctattctcgttatgtattactacgtcatgaagtccaacgatattcgtcgcaacttagctacagagcaatatttgatgaatgaaattaattttgatgaaccgttgttactgttttatattgaaggtccatgtattattgtaggaagaaaccagaatacgcttgaagaaatcaacaagaagtatgttgatgaacacggtattgtcgttacccgtcgactttccggtggtggtgctgtttatcaagacttgggaaacctttgctttagttttgtggtagacagtgacagcgaagaatttggtgattttaagtcctttgtccaaccggttgttgatgcattgcatgatatgggggctacttctgcggaagtcagcggtcgaaatgatattttggtcgatggcaagaagttctctggaaatgcgatgtacactaagggcggtaagacattttcacacggtactttgatgctggacgttgatttatcagtgattcctaatgccttgaccgttcctgaggataaaattaaatctaagggaattaaatcagttcgatcacgggtaaccaatttaaagccatatttggcacctgaatatcaaaacctaacgactcccgagttccgtgaccgtttgttaaaggaactcttccatgttgaagatttgaatcaaatcaaagataaggaatatcatttaactgatgaagataaaaagggcattgataagatttttgatgatgtctataataactggaactgggtttatggtaattctcccgagtttaccgttaagaagcgtcaacatttcacaaatggtaccatcgacgctcgtttccaagttgatgacggaaaaatttcaaacgtcacattttttggcgatttctttggaccaagggatacaaacgaacttgccgacaagctgaaaggtgttcgtttcgaacgggcagatgtttcaaatgcgcttaaagatgttgacttgaatcaatacttcacgggtattccggaagaagatttcctggatatgcttttctaaagcttgcaaatacgttaaactaacattgatagtatagaagataaattctacaatacgagtttatctttttttgttggaattattggaggatatagttgaaaaacgaagagaaaaaagtcatttattgggcagttatttcattagttttctttttactggtcaattggttaatgactcttgattttatgcgacttgatcgacgggttttactttctgaggcagttagggtaacgatcattgcaggtgtgttttatcttgcaacgattttattagcttatttgaaagtgaaaatcagttactatttaatggcggtcgttgttgctatttatacagtcggctttgttggaatgctggcaacaatgtttacggggagcagcgctaatataattgttaaattagtgatggcggcattgagtgcatttggcattatcgtgaacttttattggtttatattagcctttaagctacgtgccattttccaacgggaatcattggaaaaacgacttaatcagaataaacaattaaagaaataggtgaaagaatttgaatagagatgtaacaagtttcattgctgatgtgacggacgaaaaggtcgaacataaaacagtcaatattaaattggctgatttggtggcaaaacctgatgagacaatggcaccaatttatgaatttgttgaggaacaattgaatcttggtaagcttggttatggtgaggttcaggttgatgacgcagacgtgaacattagattggaaacaaacctcattaatttaccactgcaagatattaagcgaattgataaaatgatttctgatgaagatacattacctgtcaacgtttatttggttatgagctctccatatgtaaatgtttccagtttgcgtatcgatgaagttgcttctgcggatgagttcatcgaagacatggatcattatttaccaatgatgaatacgtggttggctgatcatttggcggccgttcaggaaaatatgaagacacaagccgaaaaagaagcagatgagaagaaggaaaaagcaaagaagcctgctgcaaaggctagaaagactgctcagaagaagtaggtttgtgtttgccgggtaaatgtggcataatggcattatgcgatgagtcgagaaagatcacgcagttttatactgttcgcgcaagcggctaggtgatgtttttagatacggggcacattttaagcacggatttgtggtgtctgacttcagaggattgtggagtccaagaagtctattcatactttgtatgagtaccgtaaaaaaggtcaactgagaaatcagttggccttttttgtatcttaattaatgtttaatactagttttccaacaacatgtccagattcactttctagatgcatcttacggacgttttcaactgtgaaaggtaaattttcagcaacccggacaactagttttcctgatccgaacatgtcagcgagttttgccattatttttttatccggatgggcattaattttatcaaaataaacaccatattgattgcctaaagcttttgcctgatcggttgtttcaacaattgaaatcagtcggccaccaggccttacaactttaaaagctgctttttgattgtcaccaccaagggtatcaaagactaggtcaatattggacaaacgagttgaaaaatcgtctttgttataatcaatgacttcatcggcaccaaggcttttaacatagtcggcattcttactgcttgttgttgtcacaacgtgcgcaccggcgtttttggctaactggattgccattaagccgacaccaccggaaccggcgagaatcagaactgtttgatcagcttttagttgtccagcatcaaaaatggcctcccaagctgttgtcccagctaatcccaagccagctgcttcctcaaatgacaggttttcaggcttatgagcggtctgatccgcgtttattgcgtagtattgcgcataggtaccacggttgctgggtgtgccataaccgatcacttcatcattaactttaaacccggagacttctttgccgaccttaacgacggttcctgccatttcctgtcctaaaacaattgggaaatcaaaagggtagcgactttgacgcaagcccattctggtcttccaatcgatggggttgacaccaatactttgaacttttactaataagtcattatttttaattgacggtatatcgatttgttgctcagttagttgattttcatcaccataagcattaattacaattgcatccattttttctgtgtttgtcattttctcacctctcacttatggtatcacgagaagaaacgcttagaaacagatagttatctgaaaatggaatgagtaactattaaaattgtgtacaactcaattgacaaagactgatatgcgtgtatgatttatagtagtggaggtgttgaaatgaaattaacaattactgatcgtgcatcggataaacttaacaaaaaagtaccccatgatagccgtttactcttaagcttcgatgatggggttggaccgttttcaaaagtgggtgtttgctcactggatacgagctttgatattattgctgtcgataatgaagctaagacgccggattatgaggctgtcttgcatactaatcaaggtgattggagatttaagggttattccaacatttatttagataatgatatgaaattagacgttaaaaacaatcaactcgtgttatccggcgaaagcggtattttagatggaagcgttgcaattaaggatttaaccaaacagaacgtcgcatttaaaaattaattaaataacaaatgaaatgacacgcttttgattataaaaggagttggagcaaaacttaaccttgttccaactccttttcggccatcatgacggttactaagaaataggtacttgaaagtcgtttttggatacttaaactgattaccagaacattcctggatccacaataaacgactaagtcacatggcttttgaaattcaactgttatgcgtccagctcgtttgtctgccggcaatattgacattaagtttggtttaagcttcctctgctaaactaacgtcactctataagaaataaggcagagaatgcttaaactgggggactttgctaagaatggttcagaatgcaacaaaaaaacaatgggttaagtttttcattaacgagctggttagttttacggctttgtttgccattttaggcggcatcatctatttatcttttaaagattcaattgataaaaatattaactcaggattgtacggccaaaaaacagagattctgcgaagtcagcggaaatcgtcaaccggtggggatagtatccatccttatcgagcacgatctacgcctccacccacaaataatgcaacctttcggacaaatgcgctgatctttagcagcagtgggcggattgagaacgcaggaatgattggacagggtgctttcagcgcttttcagggaataaagcttgttaagaaaaatatcaataaagttaaaggtttggtcattacgacgcagtttgggaccaaacagtcgaatcattattttatgacattactgataaaagtaccgcatacgaatacgaacaccacttattcggggaaatatgtattgattctgcagaatatcgatgcagaccttctggcggtcgaaagttttaaaagatcattatttatcacactattgattttctgggcattggcaattgcgattgcatatgttttatccaggctaagtatgaggccaatcctgatttcatggaagaagcaacgtgaattcagtgccgacgcggcccatgagttgagaacgcctattactgttattcaaaatcaaatggaatacttattgacgaaacctaaaaagaggattctggatgaagcttcaagtatttcgactaccttggatgaggttgggcaaatgcagacgttaattaagcgattgttgatgctgtcacgcggggatgccaatatcattcaaattcagcgtcaatcggttgatttaaaggaatggtcaagacgaatttttaatatttatcaaccacttgctgaaagccggcacaaaacgttgagaagcgatgttctcgtgtctggtgaagtggtttttgatcctgatctgatgcgtcaggcccttgttattattttggacaacgcacttaaatatacgcccgaaggaggcgtgattgaggtgctgattaaaaagcagcatggaaagttgattatctctgtaagtgatacaggtacgggcattagtgataaagataagacccaaatttttgaaagattttaccgagtcgacgaatcgagaaatagtaaaacgggtggtaatggtttagggttggcaatcgctaaatttattgtgcagcagcatcatggaaaaattgacgttcgggataatcatcctcgtggcaccatttttcaaatgatgattccaattttaaagtaattaggcatgtgttttgaagtagcactagtcgacaataaaacgagtgattaggataaaaattgattttattccaatcactcgttttattgtttttagaaattatgaaaagcattttcaattctcttatatggcatcaaccaaatcatcatgaccaggaaggttcctatcataccaaattcgtgccatacaaaagaaagcaggaagacaatgatgaaggcacctaatgtgatgaggcttttaggttcgtgttttaacgatcccactaaaacgtcattatgtttatcggcatgtagtaatgcaacccttaaaaaattccatgccaggttaatacagataaaaagtagtgtataaagttgtgatccaaaaagactgtttggatcatcgtttacgattgaagtggcaaacgggataaatgataagaaaaataccaaaagtgtatttgcccagataacgtttccgttaattctttttaccacttgaaacatgtgatgatggtttccccatacaatggcgagtaggaagaacgaaattgcgtaggtgagtaattcctgacgcatttcccatagtccctcccacgagtatcgacgaggtgtttgtaattccaagaccaacaccgtcataatgattggaatgatggcatctgtaaaagcttccaggcggcctttccccatgaatgattcccccttaatatatcatttaattagcccaataacgttagcataagtcttcatattcagcatacaatagatgagtcctaaattgatttttgatgctcaaaaagttaaaatggaataataattctaatgaattgttaatattatttggaggctaattttatgtcattaggttcaagaattttccagcgtgaaaatttggatcgttatcttgaaaccgataaaaagtttattaaaacaatgtcggcacttgatctgatttcattaggaattggtgccgttatcggtaccggtatttttattcttccgggaactgtggccgctaccaaagcgggtcccggcattattctgtcattcatttttgccgcagttgtttgttcaacatcagcgatgtgttatgccgaatttgcatcggcacttccagtcgccggaagtgcctactcgtacggtaacctggtttttggcgagattatcggttgggttcttggctgggccttgattttggaatatgtactggccgttgcggcagtctccagtgcctggggggcttacttccaatcatttttaaagggatttcacattaattttccaacagccatttccggaccatttaacccatctgcgggaacatatggaaatgttattgccattattattgtactattgatttcttggatgttgagccacggtatgagatcttcggtacgggtaaacaatgttatcgtatttgttaagatcggcattatcttactatttattgttgtcggactattctacgttaagccatcaaattggcatccgtttttaccatatggttggagtagcagtaaaggtggtgtctttggcggggcagccgcggtattctttgcttatttgggttttgatgcggtatccagttcggctgccgaggttaaaaatcccaagaagaatatgccaatcggtattatcggaactttaatcgttgcaacaattttatatgttggtgtgtcaattgtgctgacaggaatggtttcgtataccaagttaaatgtagccgatccggttgcctttgcacttcaatttgttaatttgaattgggtggccggaattatttcaatcggagcattggctgggatgtttacaatgatggtgacgatgatttatagttcatcccgattgatttattcgattggccgtgatggcttattgccccaatttctgggcaagcttaataaacatggaaatccgggtaatagtttattaattgtgaccattattattgcgattatgggtggttttattccacttgaccaattgaccaatttggttaatatcggaacgttgattgctttcttgtttgtgtcatttggtatcattccgttaaggcgcaacaaagaaattcaaaataatcatggttaccaagttcccggttatcctgtatttccaattgtatcggcactgctttgcctatatatgctgacaaaacttccgacagaaacctgggttgcatcgggaatctggtttgtgatcggattaatcttatacttcagctatggcattagacatagtaagattaataaggatcgagaagtttaagcctgtgccataaaagtaaaggagtctctgagtagtgaatcagtctactcagggacttttttaatatgctgccgagaagtattcaaataagagaatggcaatcgttatcaaacaaattgatccagatacaagtaagtaacgggtaaaatgctgaaaatccagttgccggaaatgccagtggctctctgcaacaacaccgataaaagcaccaaataacgcaatgagcaggcaaagtaagaggttaatgatcaattaattttctcctttatctataaaaggtgagctggtgatgaaagatacgccaaatcaggatgatactcagccagacagccaaaatagctattgttgcgatgataaacaaagatgtatatgattgtaattcaatcaccaaaccgccaaaaagtggtcccaatgcgcgacctgcggaggaccatgcgttaataagtccctggtactttccttttgcctcaacgggagtcagggcgttaaccaaggcaggaatagtcgggaaagtagatgcctcaccaattgttaaaataatcattgatatgacaaagaagggataacttttggcaaagatgagcataacaaatgaaaggacaatcattgaaacaccaaaaagaatctgaacaatcagattttcgtgatctcgggcaagccagttgataaaaagctggatgacaacaatcaaaccggcattgattgtccaaagaaaagagtagtttctaagcggaatacccaaggtggtcatgtagacagataagtttgagacccactgctgatacatcgtccaaataatcagtaatgagatgaaaaaggttgttaaaacaatggcgtttggtcgtggaagggattgtttggaccagtttgtttttacaccatctccaattttcttgcgttggacagaagctgctggtttatatttagttgaaacaacaagtaaaaagaatagaaataaacttgttgcaacgacaaagagcaacgtgacactaatgctgtaaaggtagccaaccagcgaagtaccaataacaacgcctagattttgggcaaaatacagcatgttaaagacgtaacggctatcgaccgttttaatactggttccaattgaattgacgattgtgagattccatccagaagccagaccgttaaagaagagtagaaagccgaatacgggccagccatgaaagaaaatcagtgcaataagcgtcactgtagtcgcaataacgccgccaactatcaggtgataaggattcttcctgtcgtataggtaaccgcctatatagcttcccaagacgcttgccagcgagttgaataataggacaatgccaaccgttgttaacgaaacacccaagcgattatgcaaataaacactggtgagcggccaaataaagctcattccgacactacttaaaagtgcaccggttactagccatttaaggctgattgttttcatattttcacctccgtttaaaaaaagttctactaaccagtttatcaaaaatccaagtggttagttagtttaatcattaaggtaagcgttatcattttacagtgctgtttgatggacttccatttgtaaataacataagattaagttgtaaatgcgtcaggagctgcagaaataattgttattttgtgcagcttatcaatgtatggaattggtttaagataactggagggattttaatatggctgtagatggatcactttatcatactgaaattgttaacgaacatggattggtaggtcaaagttatgttcatggtaatgaaggtttggcactgggtgtcagcagttcattattaaacagtccgggaacaaaccctgaacaattcattggtttcgcgttaagtacctgttttaacgctacaattggtatcgtagaacgtcagcacaaacttgaacctgatagtattattcataccggtgttgatattgtgaaggatacggttggctataagtttattgtccgttgtcagattttctttaacaaattggataatcaacagggacaacagatggttgatgaagcattaaatcagtgtccggttgctaaattattaaaggcaaatgaaaatgtcacttttgaagttgttgataaattcagtttttaaactttaatcgatattaatgccaagataacattaaaagcggaaactcagatttttctgaattcccgcttttaatgttataagactaatagattaatcatcgtatgataagtcggttgggtgtgaaaagcccacgacatgccaccaaggtgcataaacctgttccgtcacaacaccacgattttgtgagtcaatcatgcgaccgttgcctatatacatgccaacatgggaaatacttgacttgcttgagccgaagtataccaaatcacctttttgaatatttttctttgaaaccttttttgtaccgttatattgtgcttgtgcagttcttggtaatgattttccgatagattttttataaacatatttagtaaaccctgagcaatcaaagtgggttggaccaacggcaccataaacataactggtacccaaatgctttttggcttccttgtagactgttgaataatgcggttcgtctgtgctatcggcatttgcttcttgtgcaaatgaaaaagcggtaactgcgaaactgaacaatgcaacgattaacaaaaatggttttaaagctgatttgatatttctatgactgtgagacacgacaataattcccttctatttgcaatatttatgatttaatctgagacaaatgctttgttggcagttacgaagtttccgtttgttaattgaaacctgtaagcaccgctgttcgaacgagtaatagctttaaccggaaggctttttccggaagccagcttagttattcgactttgaaaattagcatctttatactcgtaaatgtgacgagtagttgtaattgtttggtctgctggaaccgacgtataatacgttggttttgccgtatcagcggatgttgctttaaaccaagagtcaacaactgaagaattgatggctttgcttaaatcgacgtttccactaatgccgctgacacgtcctttggatgtatactgccaaagatcggcggaagcggttggcttcttagaataattggcaatccatgaaccatcgaattttgaataattaattttgtgaacggcaacatagttatcatatgagtaataaattaacggtttgttggttaattttctcatttggcttaaccatgcgttgacgtaggactgttcggagcctttgccttttctgtgctcgttgtctaatacatagaatctggcactggcattggaacgattataaaagtctttcgcttctttttttgcatcggcaacgctgctgaattctgcgtatccgtactgaccaaatggaatgccgtactttttagcacctgaagcgttgatgttacgtttcgagtcgatccgaaaatcggcatcaccggtatcaccatgttgcacccggataatggcatatttcagatccttggatgccttgctccaattaatatttccctgatattgagaaacatcggcaatttttgttttgcttgcacttacggaagtgcaaatagtgaaagctgccagggcacccataaacaggccggctatttttttaaaattaagagtcatcgaatagtcctcctttaaaactacaaggaatagtataagagaagaatgctacataacagtctcaagattgtttcataaatattaaacatcaatttcacactttcttcacacctattggttattgatataacgcgaaccaatggcaatgttcggaaactaaaatgagaaaaagaaggtttctttttctcgttaatcaccggaaaaacagtaaaaaagcaatcgaaaaccaaaaaattaggccgaatattacaagttaaggtggttaagcgtaatatttgaaccaaattaataattgttggtaaaaaaatacttatttttgcgtatataaaatttgagtaggttatactaagtaggattttggtttaaaaaagggaagataagtgtattaaataaaaaagtgatatttggagagattataagttatgttaaagggaactcgaaaacatcctcgcatgaggtatgacatcatttcaatcttactgcctattattgtagtgagtcttttatttacaatcatcagtattgcaccctttggatccagaaatttattgattagcgatctttcgacacaatacctacagttttttgccgaattaaggcggcaattaatacatctttcattttccagctactcgtttctgatctcgattggtgacagcctaatacctgtctatgcgtattacttgttaagcccgcttaatttgattgtgattttctttgatccgtctcaattacctattgcaattgatttgattatttgggcaaagatcatactttgcagcatttcaatgagtacctttttgggccataaatatcaacggtatgattttatggcgatttgtggtggcttggcttatgggctatgcggttttgtttcgatgtatttctatgacctgatgtggttggattccctaatacttctgccaattatgatttatgggcttgaaaagctttataagcaaaacaaggtctggctttatgtcttcggattaactgcaattattatgactaactactacatgggttatattatttgtatattcagcatgatttattttgtttatttgatgactaaaaatcaaccaaacaagatgacatttaccttatatttaaaaagtcaggtgaataagattggacgtttcctgtggtattcggtgctttccggcatgctggctgcggtagttctgattccaaccgcaatttcaatgatgtccactgggaaaaaggatatccatttccggaattttattctgaagggaacatttgggccaagctttactgttaatctaggatttggtggaaatgattttgcaggtcggctgtttcataatccgagtatgtttacaggatcagtctttattattcttggcatagtgtactttttctctaaagcggtttccagtcgggataaacaagcttctgcatttttacttggcagcatccttttgggaatgtggctgcttccgttaaatacaatttggcaccttttccagcgcccggctgggtttccgtttcgaatggtctttctgtttagttttgcattgattatggttgcatatgagggttatttgaaagggatttttaaggaaaccagagtcgtggtattctcggctgttgcactcggcgtggcgatttcagttggttatatctgggcaaacatctttggcaaaagactaacccaatttgaattttcaacgccacagctttctgttaataatttcatttatgtattagctatggggttcttgattctaacagtcgtggcaattgtatcgttaaccaaccgcaaaccttcaagcagggttgttttatcggggattttgatttttgaattaatgatgaacttctttgttgcaacgatggacgcaccattcgtcaatcaacagcaatttgaaaagcggtaccaacaatccgagcaggcaattcaccatgttcgtcagttgaaattgacacaaaacaaattttatcggctgttgatcatggatcagccgtatcgaaatatttatcaagttccctatagtggatacaatgattcgttactctttgaaaatcatggcattagttcatatagttcgacattaaattcccatacgcatcatgtgttggccagccttggcttttcaagccgcaatattcgacgaattgatatgctgggcggttcggtcattaccaatcatttatttggcattaaatattattatgttattggaaagcactcacagaaattacttgtgagaaaaaacgcagctcaacttggatttatgacgaataatcaaattcaacatgtaacatataaacgtgatcagatctttaacaatcttaatgctttggttcaggctgaggctgggaacaagggtcgatacctctaccggccgaccattactaaatataaacaggcagtcgtacgcagtaactaccattatgaaatgcagctccaagccaatacaagtggtccgcactacatttatattcctaaagtcaggttataccatgtggctatttgggtaaatggtgccaagctttccaatacctatagtgggcttgggacagaaatgattccgattggttatttactaaagggtcaaacggctactattcgggttcaatctaccaagcctttgcctgtggtaccgaaaattgcaatgggaattgatttgaaggaatttgaatcagttgtcgcacaatctaaaaatcatcagtttgagttaagggatgcaagggacattaacaaacatggtggacattttcgggggacagttcaagtttctaaaagggatcggacattgctaatgagtttcccgtatgataagggatggaagctttcggtcgatgggaaacctcataaagtgattaaagttgcagatggactagtaggagccgaactgtcacctggtaaacaccatttggcatttaactaccacatcagaggattgggagttgggatgttaattagtatcttagggatggcattattggctatttcggaatggtggcggaaaaagcgggtaaactttgtaaaacatttacattaattcataaaaaaatttacattgttattatgctgaaatatcatttataaatattgatttgtgggcttcaacgatcttttttaaaatgaatttacacaattatcgaaaattatgaaaaaaatttacgcataacacttgcgaaaattcttttcagattatataataattctcgtaaagggtaataagaaactagtatattagacgaaagaggtacgattacttatgcaaattggtatgattggtctcggaaaaatgggtcttaatcttgttaagaacatgatccgtaacggaaacgaagttgttgcgtttgatttaaatgaagataacatcaaacttgctcaagaagccggggcaacaccagcttcaagcaatgaagatcttgtcaacaaattggatgcacctcgcactgtttggattatggttccagctggtaagccaacggattcaactgttcaagcacttgttggcttgctttcaaagggtgactacttaattgatggtggtaactcattctatgaagattcaattcgtcatgggaaaatcgctgaagaaaagggtgttaacttcttcgactgcggtacttcaggcggtaaaaatggtgccttgaacggtggtaactttatgattggtggtaccagtgccgaagcattcgaacatttgaaaccattatttgaaggtatttcacaaaaagatggttatctttacaccggcaaaccaggctcaggtcactatttgaagatggttcataacggtatcgaatacggtatgatggaagctatcggtgaaggctacgatgttttggatcacagtccttatgactatgataacgaagctgttgccaaagtttgggtaaatggttcagttattcgtggctggctcatggaattagctcaagaagcctttgctaaagatgctaacctggatgagatcagcggtaaaatgttctcatcaggcgaaggaaagtggactgttcaagaagccctcaagcaaggtattccggttccggttattactgactcattatttgcacgtaaccgttcaatggaacaagatacctttaccggtaaagttgtttcagcattgcgtcacggatttggtggccatgcaatggatatgaaaaagtaatgatctaaaataaaaaatagattttaagtagggctgagacaaaagtaattttgtcttggctctttttaatgtcaccacgattactatcgagcaaaagctgacttttgtcttagcttcattttggggtcatcaaaagtgttaatccaaaaaggattgtattatatgttagcgtttacacaaaaaagcctttatactagctttattattagtgtgattggagataccacaatgcttgatgccatattaaataaattaatgaagacaacgccggttgaaaaagaacagttaaaaagttttgaagttcatgatgacatcccaatcgatgcttttgatcctgctttatcagagaaagaccatgcaccggttttgaacgaccattttttcaggaataagcgaatatacgtgagtaagcataatcgttatgcgccttatccggaacattctcacacattctttgagatcaattatatgcttcgggggtcctgtgatgaggttgtggatggtgagaaggttcatctggataccggggatattcttttaatggatattggcagtcgccattcgatcgggtaccttgggacaaatgatttgcttattaatattctttttcgtgatcgggatattaacttggaattattgaatggattaagaagtagtcaaagtgttttttatgaatttctattggatcggaagcttggtggaagaggggatattcatcacttgttgttttctcatgcccaagttgatgaagttcaggatacgttagatcgaattattgatgagtactatctccaaagacagttcgcagatacgatgattagtggctatatgtcaatactaattgcccaattagtccgaaattaccatgttaaggttaaaaagccggcttcaaaatcacagcaactagttttggaaattttgcaagatattgatagtgattttcaaacggtatcccttgaaaaattggccgttaaatataaatataatcgtaattatcttagcaacgtattcaaacgagaaaccggaacgaccttttcagaaactctgaataagcagcgaatgttaaatgctcatatactcctgacttcgaccgcattgccggtttccgaagtgatgaaacgggttggaattcgcaacaaagcctttttttacaggaaatacatgggctattatcagaaaacgcctggaagtaatcgatgaagatttatgtccaactaatcaagcagcagtttaatggtcaagtattgagacctgtaaactgctgtttttgtgtattaactaattatttaaaagtaatatgtcagtgatgaaaatgaggcgatatttatgttaaacaaatttttggctatttagaagaatgccatgcttgacagttgatataacaatgttttacttagtacgagaaaactaaagtaaaacattaaagtaataatccactttttactaaaattgaatatatttgtgaaatcaagctcatatttacttaccaatagtatcaaatctacatattttattttgacagtcttaaaatacgatttaattgtaacccctggcacggtaggcgttccttatggatatgtaaaggagaggcaaaatgttggaaacggtttcttgtcctttttaatttcacaagttatccttaaaaggcaatgatatatcagataacaagttggaggtgctatgaatcatttgatgtttccttataatcaaataaaagattggagataaaagaaatgcagaaacaaaacagagtttatacaccacgtaaaataaccatttggcgtggtataggctatggcattgttgattttgttggtggtggctcaatgacaatcattggggcatggatgctgttcttctatacatcgtattgtaatcttacggctgttgaaggggcttcaattattggtgcagccagagtagctgatgcaatatgtagcttattgatggggagtctaactgataacttctataaaactaagctggggcaacgatttggccgtcgtcatttctttctgctaattgggtcgccactgatgctgctgtacattacactttggattgccgggatgaattattggtattattttgcaacgtacatggtctttgaggttatctcaagtgccatgatgattccgtatgaaacacttccaaacgaaatgacagatgattataatcagcggacaaaattatcttcggccagaatgttcatttcggcaggtgcgaccttccttgcaacctttattcccggacaactatttgctattttaggacaacatagtccgatgcctttcttagtaaacggtacgttattcgctattatttttgccatcggagtttatgtttgttacgcagtcacttgggaaaaaccggttacagaagaaatgaaaaaggaactggaaaaggattctgttaatcatggttctgtgtttcaacgaatttggggtttgcttaaagactatggatcgacgttacggattaagagctttagaaagcatttgctgatctacctgttttctttcacgggtaaggatacattcaatacggtctttgcttatttctgtatttattgtctgggactttccgcaaccgtagcggctaacatgctgtcgttatccctgatcggcttattggtcacaatcgtagcaggttttggcatggttaaatttgggccgaagtttttgtatgaggttggctatgggttaatgctgttaatgctggttggatattatttgattttccaacttcatattacttcccatacgatcttgttactcttcttcgtgtcattgttttatcaaatcggccgagcaaccttggagtttacgccttggaatgtttttccgtttattcccgatttagacgaaattgtgacgaagcgtcgccgagccggtatttttgccgcagtgatgagttttactcggaaatcaacggtggcagtagcaacaattgcagtcggctttgtacttgatggcagtggttttacgaaaaatgcagctactcaatctttagctactcagcatgcaattgcaaacattttgttatttggaaccggtggcttggtgcttattgcactgctggtggctttgacattcaaacttgataaacgtactcatcaaattgttctccaggaaatcgtccgtttgagaaatggcggccaaaagaaagatgttaaaccagaggttgctgagacggtgaaagaattgaccggggtatcttatgacgatgtttggccggaagatgatttggaaaggaataaataaatggttgatacagatcaaaaattactaatgccgacacatttaaacgtcaatttattatcgtttgcatataacgttgaacagtcaccggtttttagctggtgggaccatagtcgtctttccaacagctatcaaacagcctttcaaattgtcgtttcaaaacggttgcatgaattagccaatcaaacgtatttgtttaacagtggttgggtagcagttaccaataatacagctgttaagttggcacaattgtcttctttgctgcaggcaggagaattgtattattggcaggttcgaataaaagataatcatggaaacatcagtgacttttcggaacccaataaatttatttgtgatgataaattaaatgaaagcccaaaaggaatatggtcatcgaagacgtcaaccgttgatcaggagctgcctaaattagggaacgttgcttttattcgcagtccccaaataacattgaattcagctgaaattgatactgcagtgataaccgctttctctagagggaacgaacctctttttgcacagggctttgatttgtttatgaatggcagaagtgttggtgtcggatctgcacgcccgcaggcagattatgacggatccgatcaaacaggcatttattataacaagtatgatgtaaccgaatttattaaaaatggtaaaaatgtaatcagttctctggcaaccgccagttcgatgaggaaggcattttggtgtcaacttgatgtttatcgaacggatggaacaaagaaacgagtgattgtcactgacagtagttggaaggctttggatggcagtagtgcctttggcgactttggtgtgaaaatgcggagcctgtacttcggacaggtttctgagaacgtggatatgcgatactacccccagaattggacgaccgtcaatttccaggatgacggttgggataacgcctgggttaatccaaatgtcatggtaaataccagcgaacgactggtaccatatagaagcgaaaacacacttcgaattgactctcatcaaccaactaaaaaaattagtaaacttggaccgcaaaactatctgattgatttgggaaaagaaattattggcggcgtaatcgttcatttagacagtcaattgttacaacgggtgaccgttttgatgggtgaacagttaaaagatgatggccatgtccgtcaccacttggcgtgtggacctgattatgttgagaattggacgctggttcaaggtgagaattcatttacaacattacagatgaaaaattatcgatatattgagctggttggttttaaaggggacttaaagcttaatgatattaacggttgggcaatggaacaggcgttttctgaaaccgaaagttcatttgaaagtgataatgacctgctgaatcgtgaatatgagttatccaaatattcgattaaggcaactaatcaggatgttttcgttgattcccaagcccgtgagcgtcgaccgtatgaaggagatttgcttgttaacggcaacaccagttatgttgtctcatctcattactcattaggcagacattcattggattacctcattgataatccgacttggccagaagattataaattgttcaatgttgaaatggcgtggctggattatttgtatacaggaaacgatgagttgcttcatgatcgttacgatgatttaaaagttaaattcaaccgggggaaaggtgccgatagttttgacggtgcggcgcatgatttcatgggaacactgcgaaacggtaaaggcattgacaactttgacgaacaggttggcttagtaaccaatgatggcctgattgattggccgattcgcgagcgggatggctttgtagaaggagaatataatacaccctttaatgccatctactttgggacttatcgaatgatgagcaaaattgccaaagtcaccaatcatccaaacgatgtccggttttacgaacaacgtgcaaatcggattaaacagcagttaatcgacaaactatatgatccacaaaccggtagattttatgattctttaaataaggatttgtcggtaaataaacacacatctcatcatgcttccgcctatgctttatgttatggcgtgtacgatggccagaatatggcagataaaatcagtaaatttgttgccaacgatggtgaatttattgggagtgtttactttatttactttatgttgaagggattaattgattccggacatgcaaatgacgcgatcacattgttaaccaatgatgataatcgaaaagataagaaaacatttgctgctattttggatcaattaaatgcaacgattgcacctgaggcatggagcaatgcttataaaccgaatttaacactgtcccatccttggggtgccacccccggtttaaccattgttcaggggattatgggtattaatccgattaaaccaggttttgaaacatttcggattaaaatccgtcctggaaacctttcttatcttcgagtgactacaccatcttcccggggcattatcaaagcaaaatataaacgggaaaaccgacatgttcaaatcaacgttgatatcccaatgaatacagaagctgttattgatttggaaaagggtagccagaccgttgtgatccaagatatcgatgggaatcagctgagtggtgacctgtctaccgaaaatagggttactttatcatcaggaaaataccaaatttcatatgagttgttaaggtcaaaacagctccacgtttaataaaaaggagaagaacttatgaaaaaatatgggcgctattggaacctaactatagctgcagggttgggatcaatgcttggatcaggtattattgttggattggcaagtacaattacagtttggcagcttggattacacttaactaatggtcaggtgggcgttatttccggtgctttgacgtttgcaatcgcatttggatcaatcttcggcagtcgttttgctgataaagtcggtattgttggaatctttgactgggttaactttctgtatgcgcttggcgccggagtctgtgtctttgcgaacggctactggatgttactgatcggaacggttatctgtggtatcgcctcagggacagacttgccggtttcattaacggtgatctcaagggatgcaccaaaccaggaaatggcttcacaaatggtggcatcaacccagatcttttggcaagccggtcaatttgtttcaaccggtgctgccttcgttgtttcaacgatgagtgtcacgggtggtcgaattgttttcggattctttgccatcgttgcgttaattctttgggtttggcgtaccctttccaaagggattaaagtactgcataaagaagctgcagaaagattggctcagcgtgaaagtaagcaggaagaaaaagttaaggtttctatgacacaggttcttttcaagagtccccgacgtaaagtttacatgaaattatttgctgctatttctatttactatattttctggaatttcgtagcgaatacatttgggcagtttacgacatttatgttcgttaaagcaggggcttcccagacgctttctactgggattggcttgggacttcacattgctgcactgtttattttgggattatatgtaaccattgcaggttctgccaaacgaaacacatggtttgcgattggggttgtctttgcactggtagcaatggctggattagcggtctttggtagtgaatcaattgccctaatcgttgcatttatgctgatttggggtgttggtagcatgctttccggagaagcaatttacaaggtttggacacaggaatcattccctgaagaaattcgggcaagcattcaagggtttattaatggcgtttcaagatttctttgtggcctacttgccatggtgacaccacttcttgtattgccaacaacgattaaaatgacaatgtggggatttgttggaattgttctggtattcggtattgccggattctgtatgatccatttcgaaaagaaatatcatatgcttaaagatgatgataaaactggtgagacgacaaagaaggattcaaatgtcactgcaacaccaaataattaatcaaagaataacgataagaaatgctttttaagcttaaaaagagatgttacccataaatgagtgacatctcttttactgtatctttagttttttgaagtttcttcataattcttaaaataatccggataagcattcaagactttttgtttttccagaagcatcaaatgaagatgttgtgtgaccaaaaatgtgaggtcatcgatattttgatttaacacggcatcgaagattcgttgatgctgatcaagcagggtgctccagttaagttcgctttcttttaaccgtaatctgcggaaacgattaagttgggtattattgatttgcaaccattgccaaacggtatctttatgaacaattttataaaattcatgatgaaagtcctgatccagatcaaaaaaattatcgggttcattgttcatggctgttttggtttgtgcccttaaattatcttctagaacattctttgcattatcggtcattttaacggcggcatccaccatgatactgggttcaatacagtttcgaacaaagcgggcatccttggcatctgccatatcaattcgggtgatgtaggtaccgctctgaggtatcacttcaataaggccctcacgttcaattcggataatcgcctctctgacgggcgttcttccaagatcaagttccgaagaaattgtcttttcggaaatcttttgtccagggatgtagtcaaaatgaatgattctatatttaatttcgttgtaagcatcgcttcgcatgttatccatcataggtttttgctccttttcatacgagtttaatagtagcataaacttgttcaaaagttaacgtaaagtattgtaaaaactagggtattgacaatctgatatatcagaatataatgatattgaaaacggattcagtagacttgtgtatcagtttcgaaatattttgttgaaaacgctgatccgagactattttaggaggatttgttcatggtaaaaattactgacaattacttaactgataaaaaagcatttaccgatgccggcattaaggtcccgagttacgacatcactcaaaagaccggtgccactcgctgggttcactttggtggcggcaacttgtttagggcctttcacgcggcaattgctgatcgtttgcttgaatccggtgatttggatgccggggtggtggttgctgaaacccatgatccagacgttgtcgaaggtgtttataagcaatataatgatcgaattttacgagtgatcactcacgaagatggcaaattcgagaaggaactctttgcctcggttgccgactcattgttctttgcagccgatcatcaggcagaatgggataaattattcaagatttttgaaaatccggctttacagttagcaaccttctcaattaccgaaaagggttataacctttgggataccgaaggcaatttattaccggctattcaggatgatatcaagaatggtcccaaggcacccaaaaacaacatggccagcttaacggctttgatgtttgcccgttttaaggctggcaaatatccaatggcccttttaagtaccgataacttctcccaaaatggcgaacggcttcaaaagagtgtgctgactattgcggatggttgggctaagaatggtttggtaccggctgaatttgtcgactatttaaaggatgatcaaaccattagttttccactttcaatgattgatcggatcacaccaaatccctctgacacggtttcggatcaattgaaaaaggacggttttgaagattatcaaattcttcatacgcctggtcataccaatattgcagcttttaccaataccgaggagacgcattatttggtcgttgaagacgattttccgaatggccgtccggctttggacaaggccggtgttattctaactgatcgggatacggtgaatgatgcggatgaaatgaaggtgacgacctgcttgaacccattgcatactgccttggccgttaatggtagtttacttggctttaactcaatcgctaaagaggtcagtgatcctgacatgctgaacctgatcaagcaaatcggctacgttgagggattgccggttgttaccgatccaaaagtgatcaacccaaagaagtttatcgaccaattggttaacaaacgtttgccgaatccatatattccggatatgccacaacgaattgcttccgatacgtcacagaagttggctgttcgttatggggtgaccatccaacattacattgatgatcctaagcgtcaaccggctgatctgaactttattccattggttttggctacttggtgccgttacttgatggccgttgatgatcaaggcaagacctttacaccaagtccggatcctttgttgagtgagttgcagccaaaagtgagtgatatcaaactgggcgacaagacagatgtgcatgcacatttgaaggatattttgtctaataagtccatctttggtcatgatctgtatgccattggtttgggtgaaaaagtagaagcttactttgcctcacaaatcagtggtaccggtgccgttcgtaagacattggcagaagcattggcaaaatacgcaaaaaacgtcgactagaagataagggagacttggattttgactttattaaatgatgactttttattaacgaccccaatggctaaaaaattgtttcatgatcatgcatctaaaatgccgatcattgattttcattgtcatttggatccaaaagagatctatgaaaacaaaaattatgaaaatattactcaaatttggatttatcagaatggattcggtgatcattacaaatggcgtttaatgcgggccaacggtgttcctgaaagactcataaccggagacggtgaggattatgacaaatttatggcgtgggccggtactattgaaaaggcaatcggaaatccattgtatgaatggacccatttggaactccgccgtttcttcggtattgacgatgtctttaatcgtaagagtgcaccggcaatctggaaaaaagcaaatgatatattgaaatcggatgattttaagccgcgtagcttaattagaaactctcatgttcaagttgtctgcacaacggatgatcctgcatcggatttgaaatatcacaagcttttaaagcaggaagaatcgcaaaatggctttaaagttttaccggctatgcgcccagacaaggcttttaacttgactgccgacagttataacgattatttgaaacagctttctgaggtttccggtgttgatattacatcattcgatacattagtcgctgccctcaagcaacgcttcgaatacttcagaagcctcggtggacgtttgtccgatcatgggctgaacttctttcattttgtgccggcaagcaaaggcgaaatggatgccattattgaaaaggcacgtgataatcaaccattaacggataaagaagttaaccagtatcaaacaatgctggttgaatcactgatgaaacttaacaaagaattcggctggacaatgcaatttcatatgaatgctactcgaaatgcaaacaaaccaatgtttaagcaatatggtccggatggcggttttgattctatgggtacccaagctgatcttggacaggaattcatgaagttgttgattaatatgcagaccaaaaatgacattccgcgcgctattttctattcattgaaccctaatgactggatgcaattggctaccggtatgggtgattttcaacaggatggtgttcaaaagcttcagttaggagcagcttggtggtttaatgacacctttgatgggatgaaacgccagttgaccattatggctgaacaaagcctactgcccaactttgtcggtatgctgacggattcgcggagcttcctttcttatccacgtcatgaatatttccgacgggttctttgcaacgtgatcggtgaatgggcagctcgtgggcaggtacctgaagatgaagattatttgggtaaaattgttgaagacatttcttataacaatgcacacgatcaattcggcttctttgatcaggactaggagctgagagtatgcagacgattaagaatgactattttactgccgatatcaatgagcatggtgcacaattgacgcatttgattaatcgatcagagagttttgattatatctggaataacgatttatggcccaaacacgccccgattctctttcctgcaattggacgttcaaatgatgatgcttatttggttgccggccaaaaatacgagatgcctcaacatggttttgccggggacgcggattttgaagtcgttgataaaacgactgaccaggtttcgttattattggttgcaaatgaagccacaaaggcctattatccattcgttttcaagcttcgggtaacttttagtctcagtgaaacgggattggctgttcattttaatgttaagaatgacggtgttgaagacttgtcatactcactggggtaccatcctgcattcaatgttcccattaacggagaaggggcatttgatgattatcgtttagctattcagcctgtcaatcatcagctggagacttatgaaattgtcaaaaagccgaatccatatcgttccgggaacatagaggtattacccaactatgcaaacggtgttgtgaaacttgaccaccagatgtttgaaaagggacttttgattattaagagcacgggcatcaagtctgttaaactttattcggaaactgacacatcacattctgtaacggttgacgtgtcggattttgagcatgtcacactctggaccaaagagggggcaaacgcaccatttctgtgtattgaaccctttaacggattaccggatgtctacggtgatttggttgaacttggcgaaaaagaaggaaaccatcataccagtgccggtttaacgtccagttatagcgtcaaggtggacttaaagtaggcttcttgaagactttaaaaagattttgacatcctaatcataaagaactagtatatcagtgtaagcaaataataaattttcaaaggagaacttgagatggaatataacatcgcggttgttaactcaagcagttttggacaagtatttaaagagcattggcaggaacttgaaaagattggaaatgtgaaacgtttcatgctgccaaccgatattgacggaaagtcattagctgaaaagcttcatggttataacgttattattgcaagtgtgacaccattctttaataaagatttctttgataacaaagatgaaaccttattaatttcccgtcacggaattggttttaacaatgttgacgttaaagaagccaagaaacacgggactcaggtcacaatcgtgccacaattagttgaacgaaattcggttgccgaaaatgaactggcaaacttgatggcattggttcgccaagttgtcccttcatcagaacgtgaacgtgccggccgttatcaggaccgtgcccaatttatgggaaatgaattcagtggtaaaacgtttggtgttatcggttgtggcaatattggcagtcgagtagccgaacttttcagtattttcggcggtccggtgttggttaatgatccggatccacatgttaccagtgaatggctaaccaacaataacgtagaacgcgttgacttggaaacactattaaagcgatgtgattatatttcattgaatgcttctttggatgataacagctaccacttgcttaacgctgaaacaatcaagaaccttaagaagggtgcttatatctgtaataacggccgcggtgcgttgattgaagaaaaagcaattagtgatgcgattgaaagtggtcaactgtcgggctatgctgcggacgcaatggaagttgaaccggtaaaggaagaccatccattcttaaagaatgatcgcattcttttgaccccacatacttcagcatacacatatgaatgtctgcatggaatgggtgaaaagtgtgttggagatgttaaagacatcgttgccggcaaacgaccggttcgagaattgacccatacgttagacgactaatccttgttttgagaagattgcatggcctgaagttaacccagatcatgcaatctttttttgtagagaagttgccacgaaccggctcttcccagacaaataaataatgggagaatatgtgagatccaatcggattatttccgcatacagacggtaatgaaagcgctattgacaaactgatatatttgatttaagctactggtatattagttatcgtgagaacggagattttaattatggattatattattggaattgacgtgggaaccaccagtacgaaagcattgctttacgataccgatggcagaatctacgcaaaagcaaataagggatacacactttatcaagatacaccggatatggcagaggaagatccggatgaaatttttaacgcaacgctgtccgctattcaggaagttgtgtcacaatctcagcttaccgatggcaaggttgtcgctatttcgtggtcggctcaacaacatagtctgattgcattggatgagaactataagccgttaatgcgaacaatgacatgggcagataaccgtgccgaaagatacgctgctgaatataaacaaaatggtcgcggtatggagatctataagcggaccgggttgccaatacacccgatggggccattttacaaattactttggcttaaaaatgaaaaaccggatctttataaaaaagcagcttactgggtaggcattaaagaatatattatctggcgttataccggcactttaaaggaagaggtatcgatggctgctgccaccggacttttgaacatgaaaacagcccagtgggacgacgtggcactgaaagaaaccggcgttaagaagagtcagttgcctgaattagttaatattacgaataaatttcgcgggattcattctgaatatgctaaagtaatgggcattgatgacgatgtttactttgtcatgggcgcgacggacggcgcattatcaacgatcggggtcggcgctattgataccggtgtccttgcgatcaacatcggaacctcggctgccgtgcggacgtttgttgaccaacctcgaattgacccaaaagcaaggctttattgttacccaattatgaaagggaagtatttggtcggtggcccaattaataatggcggtatcattttaaactgggcacatgattccctattcggcgccgagcaggaagccgcaaagctcctggatatcgattcctatgatatgctttcgaaaattgcggcgaccgttcctgccggggcggatggattgatctttcatccctatctaggtggtgaacgggcaccactgtgggatgccaacgcccgcggatcgttcttcggccttaatcggaaacatacccgggcccatatgattcgagccgtgatggaaggcattatgtataatctctattctgtttcgttggcgttgaaagaagtttctggagaacccaaagctgttttggctgccggagggtttgcccgttcaaagctttggacccaaatgatggccgatatttttgaaaatgacattacgattccggaatcgtatgaaagcggcagcctggcagccatgttcctagctaaaatggcgttgggcatggaagatgatttagccgatattaaaaagtaccttggcaaagagcatcgttatcagccaaatgaagaaacatttgaacgttatcgtaaattgattccgatttatattcgcctaagccgtgatttctcaactgagtataaggatattgcggattatcaacgggaatttactaacgataaataaggctggcgtggttcgaatcaatgcttaacggacattaatcaggaacgattaggctgttatcgaaaaagattatgcaaattgaatggtattgcatttggcgtaataaaagcaggtgactgaaatcgaaattgatttcggtcacctgcttttaatgatatatcaataaagatgcttatcggtttaatgatgcttcaaacacttccgcaagggttgcgttaatatcagcgaacttcttattcatgactaatcggcgaaagtcggaaaaggaaatgttttccgtttgtcttaagggaatagcagcggcagcaatattgaggcaggtggttgtcgttaaagccaacttattatgtctgttcaagcgaacacggtagctttcaaaatattcgcgggtttcataagaaccctccagttgtttgtgatcggaaaagaaatgcttgagaaagctttcaaaagcgtcgtctgatgataaagattccttaaaagctgagtattgcataaataaatacctccttaggtacggtcaatagtgattaataaatgaaccaatcagtctctctcaacattcattttacaacatttagatcgatatgcaaacgtgaaaattcgataaaaacgctatctaacacgatttattcgaacctgatcgtctatgtctgacctgttttgaacaaggtggtttagttagataacaagctaagctataagtctttgggcggatggttcacatacatcattttttgatgttaagaacgctgacagacgtgcaagaagacgattgattgcttgtgaatttaaataaattacaaaaaagtgttaacgtgtgcatttttatatggtatagttgtaagcgttaacaaggacaacgaaatgagtcgtttagcctgctaacgaacgaaggcctcgttataaaaatgttaccgttaaaatgtttgtctaatatggaggtgtatcatggaaaccactgatgcaaaagctgtcgttaacgatggcaagacaaagaatcacgatgatgagttaatgaacgattcatcaaagcgaatcccaacgcaccaaaaaatagcttatggtttcggtgattttggaaatggctttatgtttgaccttggtcaatcctacttaaccaagttttggattgatggtgttggtatcggtgccggtgtggtagcgggaatcttcgcgtttaccaagatctttgatgcttttatggatccgattgccggctcggtcgttgataatcgtaagaagattggtaaacggggtaagttccgaccgtttatgatggtttcagcaattattctcggtgttttgactgttgtaacctttaccatgcctgatgggttgtcaatgaatcaaaaaatcatatatgcgtatgcggcatatatgatttgggggctggtatattcctttaccaatgatccttatggttcactggcatccgtcatgtcacggaatacacaggaccgcagttttatggcaaccactcgtcaaatcgggtcggttggcgcacagttcatagctggggttgcgtttattccgttaactgtcatgattggcggaagcaatcaacggcttggctatttctggtcagctgcaatctttgctgcaattggggttttaatgtttggcatttgctatttaggtactaaagaaaatgttcacgtgaacagaagtaagacggctcaaaaggaaggcttcaaagattactttaaagtcatctttaaaaacgggcccctgggtgccttgattttgatgacattatttacaatttctgccatgaataccaataatcaaatgatggtcttttacgcagaatataatttaggtaatattgcgcttcagcccgttattaacgctattatgatgggatgttcaattgccggggtctttatgattccaacactcacaaaacattttggtcaaaaaaggaccgcaatgtggagcttcgcgattggcgcagcggctaaccttttgaactttgttcttcccgatcacgttgttgtttttgtcattctggtgacagtcggatacacagcattggcgattccaaacgggattacgtgggcgatggtttcaaacgctattgactatggtgaatggcgttccggtgttcgtaaagaaggtatcacgtatgcggcattcaacttttccagaaagattgcccaatcaattgccgcgttagtttctgcgggggtacttgcattgaccggctatgttgcaaatgcccatcaaactgccggtgctcttcggggaatcaaagccgccatgactttatatcccggcgtttgcctggtcttggccgcggttgttatcggtttcttgtataaactggatggtgagcgttttggcaagattgccaatgacttggatcatggtcgttgggaaggcggcaagattggtgataaataggatttgagctttttaaaacagtattaaaatatggaggaattaatgatgaatttaaatcaattattagatgatgttaaagaaattttggcagctgatggcaattacgatcagttgagtaacaaagacatttataccccttccattcaggttgatcgtcgaaatgtttacttcattctccatcaaactgattctgaaggtatcattcaaaagagtctggtagtctacgaaaatcgtttgacagccggtgactttgacgctgaagattcattgaccgatgttgactcaacattattagttggtgaattaaacgaaaagaataatgatgcattggcaaaacgtttccaatggatgcgaccaacttctcgtcgtaattacaaatacacatttggcttgggtgaccgattgggaaatgcatcaaatgcacatttgcgtttgttcaaaggccgcggtattatgccggttttggcacaacaatcgattcgtgaactggttttaatgcatcgaaccaataccgatgtttttcaatccgcatcgtgggcagtctttgaagagggctttacttatggttggggtgctgatggcgatcacgttaagaccccatatgaagttgactatgccgtcaaaatcggctgctcaatgattacgcttgactgcaccgaagaaattaataatgacattgttaatctaaaagatgacgagttggacaaacgatttaacacacttgatcctgatcaaatcagctatttcaatgatacgtatttgaacaagacgtttgacttgggaaatggccgctcggttaaattcacgaagcatgatgttgaagaatctgtgttgactttctatgacgcaatcctgtttgcggcaggtatttacaagaagtttgttgtgccttacaacttggattttgaaatttcgatggatgaaacgccttatcaaacaacaaatccaaatcacttcttctttgctaatgaattgcatcgtcgcggtattacaccgacaacaatggcacctcgtttctatggtgaattccagaaggcgattgattacattggtgataccaagcgcttcgaacgtgaatatgttatccatgaagccatcgccgaacattttggctacaagctgagcattcactcaggttctgataaattatcggtttacgaaattattggccgcgtttccaagcagcacggttggcatgtgaagaccgccgggactaactggctggaggcattgagagtcattgcccacaaagatcctaaattcatgttggaattatacaaattctcatacgagaaccttgatgatgttaaagctttctatgtgttcaatgcccaaaccgatggcactgctccgaagccggaaagtatcacgacagaaaatgtgatggacttgttggacaatgatgatgcacgtcaggttttgcacacaatgtatgggtcgatcatgaatctgaaacataattaccattatgtttatcgtgacaaactttggaatattttactcaagaaccaagcactttatgacaagtatttgaacattcatattgccgaacatctggacttgcttcaaggaattgttaagacaaagcaggaagctcaagagaagaatgagccaaagaccgatatttcgaaagaaacgattcaagaacttcaggaaactgctaaaaattaagggaggttcaaatcggctatgagtttactagacaacgatttcttactgggtaacgagactgccaaaaccttatttcatgattatgcgtctaaaatgccaatcattgattttcattgtcatttgaatccagaagaaatttatgaaaataaaaattatcccaatatcacgcggatttggcttaacgagggcacctatggcgatcattacaaatggcgtttaatgcgggcaaacggtgttgatgaaagctatattacgggtgatggcgatgaatataagaagttcgttgaatgggctaaaaccattgaaaattcatatggtaatccattgtacgaatggactcacttggaattacgccgcttcttccatattgatgaagaatttacccaggaattcgctccaaaaatttgggacaagacaaatcaattacttcaaactgatgcctttaagccgcgaaatctgattaagaactcaaatgtacaggttgtctgcacaacggatgatccggcttcggacttgaaatatcataaactgctcaagaaagaagaggcccaaagcggtttcaagacattgcctgcaatgagacctgataaactcattcaaattgatcgggatggcttcggcgagtacttgaagaccttgagtgatgtttcaaatgttgatattaatagctttgcggatattatcaaggctcttcatcaacggtttgaatttttcaatgatatgggtggccggctttcggatcattcattgctgacttatcattttaatgaggccagtgaagatgagctgaatgcgattgtccgaaaaggggttgccaatgactcacttagtcaaaccgaaattgacaagtacctgacaatgttattggaaaacctgatggctttaaataccgaatttaattggaccatgcaatttcatatcaattccagtcgggacctgaatcgaccaatgtttgacaaaatcggtcccgataccggttatgatgcggtaggtacccaagcggatattgtggctcacataacgaagctttatactaaaatgcaggatacaaatcaggttcccaagacgatcttctattcattgaacagtaatgactggatgcaattggcaaccatgatgggctgtttccaaggtgggaccgttcagaaacttcaactgggtgccggatggtggttcaacgacactgctgaagggatggatgatcagttaagaatcttcgcccaggaaagcctgctgccacactttgtcggtatgctgacggattcaagaagcttcctgtcttatccgcgccatgagtacttcagacgggtactatgcaatttctacggcaagctggcggagcagggtcgtgtacctgataatattgagaagttgggtaaaattgttcaggacatctcatataacaatgctaaaaactattttggctttttggattaggtttcaagttgcctgtctgtgaaacaagcgttgcaaaaagagcatgagttaaaagttggccttgatctccaatctgatagactaagcttaaaaggcacccggagatacgaaggatactatccctctagagagcaccagagaaaaacaaaaaattctcaggtgtgatctggagggatttttaatgcctaggaaaaggaaatatgatctggagacaatgttgtgggcaatagctgagatt

SEQ ID NO: 444 - DNA, 397526 bp, Unknown
  Metagenome-assembled genome
gttcttcacatttttgccgaaacggttagtttcgctgttaacagcaagctaaatggttaaattaattaaaatatgccctgtgataccaagggatcagtctgtcttcatactttcaagtttcagttaggaattaattaatattattatgggggcaatgagtatgagaaaacgtcatttttttaaaattttaagttggggtctttttcccctccttcttgcattatttagtttgagttctttaggatatacagtaaatgcggatagctcatccattccagcaatctataacggaactgatacctattctaagagtcatcagtccttaacaaacgatgatggtcttgcacttggagctcgtttcaacatggacggtaccaattctatgtacacgggtgacaaggtttcaaatagctggtattttccaaccgctatatttaatctcaatgcctataaagacaatagcgatggaaccagtaatttaaccgagcaggttcaaattaataacacaacaagtagtaacaaacagattaacattcaagttattttacctaagccaatttttggcggatcttacacaaatcatccaataatccaatatgcaaaggctcaggctacaactccgattagcaatagtgatggtctgacaactacttattacgctgacaattcaacacttacggatacatcatccgctaccgattgggcaaatgccaataatgtcattatttccggcacattaaaagcaggcagcaattatgaattaaccctaccgttaaaattgacaaatgcttcaacagttgatgcttataatattggaaatgccttcgaatctgatgttataaacgactcaaatgtttatggtatatatggcaggtttgccaagggtgaagccttaagtgactatgccggcgttggtaaaccatatggggttgttcttaaggttcccggcactaaaaatgcggatggcgttcaaacctactcgtatccacaagcaaccgacgttcaattgcaaatgcctgacgttacacttaacaccgacacctcagatgttaacaacggcttttttaatgacggactggcttatttatacactgggtcaagttacaccattcacttcaaaaatatgaaagctaagaatggcgaaaatctaattgactatctgtatgagcatggatatgccatgccttatcctggtaattacgacgaagataataatattaaaactgaattcacttatacaatcggtacttctccatcgactgtttctcccacatatccagccggaaccccagtatataatactggactaggtatgcaggttgtcaaaattatcgatgttaagaaccttgattataatgatacaatcaatttaccagttggcagcaaatggaacgcctatgataacgtttcaatttggaatcctgatacgacttatcaggccaatacaattgataagtctaagattaatcttcaaatcacttcatcagatggcaagttaacagccaaccatgatctggataccaatcaggctggcacttaccatgttaaatatacctttggccatacgtatccaaatggtaataagcgaacgatttccaagaccattaccgttaacgttggaagccagagcagcggttcgacgacaacgtcatccagttcaagttcagcaaccacttccagttccagtgcaaccaacaccagttcaagttccagctctacacctacgacaagtacaaatccttcaaccagcgaacagccaacttcgtcaagtaaaattgctgttaaaggtgaggctgtttacgcaattaagggcattcgattgtataaatcagttgactttaaggcaaacaaacgtgttaccacctttccaaaggccaagcgggttaaccgtccagagttcattgtaaagggctatgcttacggtcaaaatggtaagttgcgttaccgcgtacaacaatataacccatatacacaaaagtacgttaagggcaggaaaggctatattacagccagctcaaagtacgtccaaccagcctactatgtttcggttccaaagagtaggaaggttactgttattaataagaacggtgtgaatacttataagaaagccagtctcgcaaccaaagcggctcactataagaacaaggccgttctaaaagttaagaagatcgtcaagtataaattagcaacccgatatcaattaacgaatggacactacgtcacagctaacaagaagtttgtgattcaaaagtaatttattgagaattatttttttacgagtcaatcagtaccaagactcattgccctattcaggacgttcaaccagtacacacaaaaaagtcattccactcattctaagtttggaatggcttttttagtgaagcaaagcgttaatcgtcccacccaaatattaagtgttttcagcagcggcaccacttgatacgatacgtttaaggtgatagtaatgacagctcaagttcatttctgtttggatgaaaatgataaaaaagaattcaaagaagttccgaaaaagatggccttacaccaacagaagcctattgcatttttgcaaaaaaacgattgaagtcaatagcatgccatttgaggttttccagcccaatcaacacttaaaggacacaattaacagtcagaattatgctaaacttagtaatcctgaaaaagaattgaaatggttaaataactaatccaactaccactatcggttgctggtagatagattaatatttcaagtattttctatctaattattcaacctccaaaaaatcaaaagattacatactcaattaatttaaacatggacgctgcttcttacagtcctcacatcaccgacacaatagccaggaacccacaggtaacgacaaacaacgatacaatcagttttgccgtccatttccaccaagttgttaagctgacgtgcgataatgcgagtgcgcccatcaaaatggcggaggttggcgttatggccgtaatcaatcctgatgatgcttgaaatgcggacacaaccacactgccttcaacgtgggaaaagactgccaacgatcccatgatgcccatcgttgccgcagcgagtcccgagcttgacggtatcagaaccgagagaacgcagaaaaagacaaacgcgaggatcgcaaagaccggctttggcaacccactcaaactggtttcacccaaatgaagaatggtcccggtaatcatcccgctgttcataatcgcttgaataccacgggcaacagcaacaataatggcaacgtttaataaatcagccatcccattcataaaggcattgatgaactggccttccttcatgtgactaacgaacatgatcacgatcgacataagcaggaacaataacgtaatttcgttaaaataccaatttcccaacgagacaatgtctttccccaatattgtccctaagaacgcattgccggtaatccacgaattgaaacggtcaaagaaattccagctcttattaatgctggtccatggcaccaatccaacaatcataatgacaaatgtcaggcagaacacccacagaacatgcttctgatttttagtcaatggtttgggcgcactggttcgatccgcaaccgaaaaacgtttcatgtcttcctgacgctgactatagaccagtgatttagtgggatcctttttcaccttttccgcatagtgaatcacaaaccaaatggccatcgccgtgacgattaccagtagaatcactctggaaaacagtccgacacccggtgaaattttaataattcccgaggccactccggtcgcaaacggattaacggtcgaagccaaatcgccgacccgcgtacttaacagaataatccccacggctaccagtgaatcatagccgacacccatcataatcgggatcaacagtgggaaaaacgccatcgtttcctctcccattccgtaagtggacccaccaacggaaaagagaatcattaaaataataatcagccgtttttcgtgaccggtatatcggtgaacgatggctcgaatcccatcatccagtgccccggtctgattaacgacacccagaaagccaccaatcacaaggataaagatggatatttcaattgcgccggtcgtctgtttattaccaatcatcccgataatcggcgccatcaagacatcccacagtccctgggtatgactggcaaccgttcgatacgtcccactgatcaacgtgccatccggcgttgtcgaatacgttccggctggaataaaccaggtcagtatcgcaataaagacggtcagtccaaaaagaattgtgaacgcagacggcatcttaaaacgatgcttcttcatttgatccgactcattcatttgatatgccccctttactgattaaaaaattcctgtgccaactgtttataaaagtcaaccgactggtgatagacatccacatcaacgtattcgttgctttgatgagacgtgtcgtttccaggtcccagaagggcaatactgaaatcacctttggcatgtagaaattcggagccgtcactggcacctgactgaccactggcaaccagcggcttgtcgaacatctcgtcgtgaactttcttaatcagtttgataaatggcgagttggcatcccccggcatggcttcttcaggaaaactataggcgatgcttaaatcatatccggacttcttatttaatttgttaaccagcccctccagcgcatcaaaaatcactttgttcgggtattccggaattgttcgaatgttgcctttgataaccgctttggcaggcacactgttgatttgttcgccaccattaaagagactttgaacatgcgtcaatttgcctaagaccggatcaactttatcgaatttagccatgaccggtttgacctcattggcaaaatcgattaagtggtcaatcgcgttaatccctttttcgggttgggaactgtgagcccccttaccgatagacgtcacaatataatcaacaatgcctttggacgtaaaaccgacttcacccatactgtctccgggttcggcaatcatcatgccgtccacaccatcaacgtagccttctttagtcagttgagcagcaccgtattcaccggtctcttcaccaaccgtcgcaaaaagtttgattttgccgggtaccgcatcattttccagcatatcaagcatggcaataatgacggcagccaggccgctcttcatgtcggtcgcaccacgaccatatagtttgccatccttgataacggctttaaacggatcgctatcccaagcttctaaatctcccggatctacaacatcctcatgaccggaaaaaccgagaattctgtctccttttccaattgtgacaaccagactatcacggcccggcgcatacgtgacccgttcaatttgaacccctttatccttgtatggttcaaacaatgacgcaatataatccgccacctctgcttcgtgatcgttaactgatcgaatcgaaatcagttttgaaagaatctcaatttgtcgttgcttattcatcatcaataacctccccagaatttgtttggctgatcatcgccttaccctttaaaagatgatcggccctgacggttttaaaccgcatggtaacacaatagcattttgtgtaagcgattacaacattgatttaataggatttttatgatttaaaatcctgacgattaatctcaaaaattgaccactttcaattgtgcaggatacggattacaaaccgttattgaatctattgtaggccattaatcacaatccaaccgataaatatgggtcagacattcattttgtttattcaacttttttcgccacttcggctcataaaatacaacaagtgaactgacaatgaaatgctcgccaacacatgccaaatcgtgcctcatggtatcattctattaaagaggcatgatcccatgcttgaaaatcaaatcgtatctaaaccagaatcaatttttatcaacggaggattcaatgatgacctatctatattacgcattgctgacttttaatccggaaggccaagtcgaagtcacctttcctgatctgggattcgctgctgcaacctttggcaatgatgttcctgatgcgctccacatggctcatgatgcacttgaaggttatttattaacttcagaagactacaatgacaagcttcctgatacatccgatccacgaacgattgaacacggcaaagatcagtttttagttccaatcgaggttaataccaccattgcccgagaacgtgaagatgaggaaaaagaacggcttcatttggccaaagccgtgtataaaagcaaatcacctatcttaaccaatccaaaagatatcgaaaagtatctatcagaagacgataacaaaaaccatcctcaataattgcaggatggcttttgttcaacttgattaaattcatatttaaagttctttcgaaattagtgactaacagcattctatgatcaataaaagcagagtctgctgcttccgaataattaattcaaaaagatgtattgtgccaaaaatatgtcaaataacgattaaaaacaatttttgacatgttttaaattacggctaaaagtgtttaaatttaaatacttttagctgtaaattaaaacactcactgccttcatagcctggttataccccaagcttttctttcaacgcctcagtcgccacttttgaaacattaatatcattttcttttgccaaatcacttagatactttggcacagtgatcgtttttcgtattgtctttcggttttgtctaagccatttcgtcatatcaactgaaatatagacaacttgctgccctgtctctagtttccattcacgtggatcttgtggtttgggataatgtggcatatcttggatcattgttgcaattgcatcttctgcccaataagcagcatcagctatagaatcaccctgtgtcaccatccctttaatattaggtgaggtaactacaaaataatgcccatcgtcctgatactctgtaataattacaggatatattaaacgttttttcataacttagtaaaggtatgccaaagcaaggctctatctgagccctgcttctttaagaattgctaactcggtaccttttttgagctcacctgtatgaaacggaatttctgttgttcgcccatcaggatgccgataacggcggtgtccaccctttcctctatcaggaatgcgtctaaaacctgccttaagtaatttcttctccatttttcttggagtaattggcacaccttgtccctccttcctatacgtatattatacatataggaaaagtggttgtacatactttatacatataataatctactagaaaagaaaaaaatatcctattcttctagcagccctgtcacaaccccaattaaccgaaaatcagtatcatcctgaatcttgacttgtgcttcgtcttgattaaagggcatcaaccaagcaccctcggacgttttctcataccgtcttatataatactttccatcaacctttgccagaacaatctgaccattttcagcctttgtcgcagccgttataaaaacaatctgttgatcgtgaaaattaggcagcatcgaagaaccgattattttaaccgcgaagtcaaagtttggctttccagctttttgaggccgattcaccgactcttcctcatccgtaatagccaaatccgttttttcaagtttcaatatggttaccggctgttcgatcggtgtttgactgtcttcggattctgtctcttgcagcttaagaattcgctggtacactttccgttgacgatcgggcgtcagttttgaatacattgataagaagctctcgggccggcttttaggttcattagccttacctaactcccgataaagtaaatccgttacatcaacctcaaaaagtgccgcaactttttcaataattgccaactttggggtatattttccggattcccattcactcacagaagccacactttttcgcccaagtcggcgggcaagcgttgtttggctgagatgatactttttcctgagatagcgtaaattttcagcgaacactctaaagtcacacccttttatgctacttgaaatgtacaaccaagtacctcctaatactcggaattccaaacgtttgaaaacagtcattatcaggcaatctgtgttgatcaatttaattatcagatgaattgccacccacctatttgacgaaccaccaaataagtagcaacgccagaatgccatatacgatagcagcctcaatcttttcttttctcgtattcttatgcatctttgccacaatgtgcaaatgtttcccgtcatatagtctcatctaaacaatccccttcaagttattactaatttaatttttatgatacccctccggatatgtataaaagatgtcttaagtatactgctgtttattcaaaatttaatgcatattttccgtataaccaagaaaaatcgaaaaaatccttcgcatgatgatcgaattaatcaaaaagcctgtttttttgaccttttgcaagatcaatactatatttacggtatcatttaagcccatttgataccgtaaaggaggaaatgatcctgaaaacgttcaattatcagaatttaaacaatctacagttatctggtccgatggtcgataaacttaaccaaatatacgagttccgatgaaggttgtctgttcttcaacaagaattaaagcccctctcacgtcgggaaattagtgctttggtccctcagtatagcgatgtcaccattaaacgagccttaatcaatctgcagaaaaccaggcagattaagttaatcggtctggggagagcctctaaatatattcttcaaaatccttaattaaatcggtcattaagcgttcagtaatactggacgtttttcctttctaagcgatagaaccgtataaagatatcctaaatggactacaggttatttaaaagctaacggctattttttaattttgcttagttgtcttcgtcaatttcaagtgtttaaaatctcatcaatcataattaggacatttccctaattgcaatccaaaatccccagacctacaataacaacaattaataaaagtattttgtacttttttattagattaattaaagtaaaaggtacttttataaaatgatccattaaccctaaaaggaagtgcgttatgcgaaaagtgattattatcggtgccggtcttgccggctgttatcttgcaactcaattgcagaacacctgtgacgtcaccatcgtcactaagaaaagtatccaggacagtaactccatgctggcccagggtgggattgctgcatcccttgaccccggtgactctccggcccaacatgcggccgataccctcgctgccggtcaataccacaacaaacctgcagccgttaaccaactggttgcgaccggtccaaaattgattcaacacctcatccaagacgggatggcgtttgatcgccaatcaaacggccaactggatttcggcttggaaggcgcccacagtcatcaccggattctccacgccaacggggatcgcaccggcgcagcactgaccagcttcgtccaaggggaaatccaccaggtccattggaaaccatactcaaccgccatcgacttacaggttcaagataacgtctgtgtgggcgttattattcgaaatgacaaaaaccaagcattagaaacgcttaccagtgatgccgtcgtccttgcaaccggcggcttgggaaacttattcccattgaccaccaacaaccaaaccatcaccggagacggcattgccattgcggccagagccggggccgctatttcagacatggccttcgtgcaatttcacccgaccttactatcactgcacggaaaatgctacggcctcatcaccgaagccattcgtggcagtggcgctatcctggtcgatgaaaataaccaccgcattatggcaaacgtccccaagaaggatctggcaccccgagacgttgttgcccgccacttgaaagcctggcaggagcaaggccaccaattatttcttgatatctcggccattctcgatttcacaacccgcttccccggcgtcaccgaaaatctggataaccatcacgtgcctttcagaaccactcaccggattccgattcaacccggtgcccactttgtcatgggtggcatcaccaccgatctgtccgcccaaacgtcaatcccccacctatttgccatcggtgaagttgcctgcaacggcgttcacggtgccaaccggctggccagcaattcgcttctggactgcctggtcagtgctaaaaaggcggccgaggccattcaaaagattgatgctgttacgattatcccccaagatacaccggctgctccacaacccaaaccacttttgccaagcctaaccgatcttcagcaaaacgcctggcaaaacctgggcgttgtccggaccaaagccggcttaaccgcttttcaaaattggttatctcaattcaactatcaagaattacagccaagtcaactgaacgcaaccgatttggcgattaccaacctctgcctttgcgcttccctgattgacaaagctgccctggcagaacccaagagtctcggtgcccactacattcaagaaacgacagtcaagacccaagccggttaaatcatttagtcatcagaccgttatttttcaatcatgtcaagattctcaaaccatttcgaaaggactacgcaactcaatgctgaatttaaaagaaaaaattgcttttaatcactattacgatgaagcaccggaagatcaaatcgccaggatcaaaaggatcaaagcagactttggctccgacttaatgatggtcgcacaccattatcaaaaagacgaaatcgtggcgtttgccgatgcccgtggcgattcactcaagctggcccaaattgctgctcaaaaccacactgccaaaaaaatcgtcttttgtggtgttcactttatggccgaaaccgccgacatcctaaccaccgatcagcaacaggtcgttctcccggatcccatggccggctgttcaatggccgatatggccaatccgtttcaactcaccaaagcctggcagaccctcaccgatcgatacggggattccattataccggtcacttacgtgaattcttcagctgccatcaaagcctttgtcggtcaaaaaggcggcgtggcaatcacctcaagtaacgctaaaaagattatgacctgggcattaaaacaggctaaacatctcttattcttgccggatcaacaccttggtcgaaatatctcacttgacctcggcatcaaacccgaagaaatcggcttatggcatgcccaacaggacttcttggaagccgatcaaccggacaaactacgggtaattttatggaacggatactgttccgttcaccagcaattcagtgtcgacaacgttaagcggcttcgccaaaaatacccggacgtcaaaattatcgtccatcccgaatgcgcccatgaggtcaccgctgccgctgattttgtcggctcaacatcagccttgatcaattacgttgatcaggcgccaaccaatgccaggattgccatcggcaccgacaacaatcttgtcggccgtctaaaggctaaatacgcaaccaagcaggtcatgtttttaaatccatattcctgtgcctgtattttaatgaatcgcatcgacctgccccatttggcctggacaatggatcaactggctgccggaaaaaccggtcacgtcataaccgttgatccgcaaactgcttattgggccaaaaaagcgctggacaaaatgttacagctcagtctttagaaatggaggaatctgaatgatatattttgatcacgttgccactaccccaatgagtaccgaagcattgaacacctatcgggaagtggccgaaaacttttttgctaatagcgaaagcctgcatcaggcgggaaacgctgccggtcagctggttcaggaatcgaaggctaaaattgccgacctgcttcacgtgccggtggaaggactgatcttcaccagcggcggtacccaaagcaaccagctcggtattcgctgtttggccaccggcagttcaaaaaaagaaattcttgttagtcccttggaacattcgtctgtctaccaaatcctgaattacctggctgatacgatggactatcggattaaatttctaccggtcgatcaaaagggtcacatcacgccaaccattttgcaaaaagccatcaccgatcaaaccggattgatcgtgattcaggccgtcaatgccattacaggaattgtccaggacattcaagcactcaaacaattggccagcgccgcccacatcccccttttcgtggatgccgtccagggattagccaaaattcccttggaccttagtggtttggccggcttcagtgccagcgcccacaaattcaacggtccaaaaagctgtggtctgctttacctatcaccgcaagtcatgacaaaggcgccttacaaatacgtgtttcagcaaaacggctttttgcccggcaccctcgccgttcccgaaattgtgagtgccaccgttgcgcttacaaatgcatgggatgccatggctgataacttaacccacgttggtcaattaaagaagcagctcctatcactattagcgccaaccattcgccccgttgcctcctggtcggaatatccgggcgtctgtggtcttattctgccccgtactcccggtcaaagtgccgctaccagcatgggccaacagggtttttgcttctcaaccgtcagtgcctgcagcattaaagacccccgccccgaccggacattggtatctttaggattaacaccggaacaaaccaaccgctacatccgcgtttcctttgggccaagcaaccagccacaagaagtcgcttcatttgcagatgcacttaaccgaacctacagctaatcattaaaaccagtcactgtttatcagtaccaaaaaccggagccgcttcattgagttccggttttttagtgcggtatcacttcaactgttggacaggtaattggcagttctccttatagtctacttaaaatcaaatctaatgagtcagaaatgataaaacgttccaagcaaaatttaaaattaacatactaatgacatgtcggccaattctaacccttcgaaaacgctgctgtatcaagttatatagaaatagtttgcttttaatttgtttttaatttaaaatgagtaacgttaataaatcttacatgtcgaagggacgtgcatcacaatgaaattgaaatcattagtgaagattggtggggtggccattctttcagcacttgtgctcgcaggttgtggaagtaaatcatcacaatccggttccaaagcacaaacgctgaattggatgctgccagccaatatttccacaatggatgcttcaaaaatgacggacttatattcgtcacagatcgaaaacgatacgaatgagggcctgcttcgaatgggcaacagcaaagtttcacccggtgttgccaagaactatacgatctccaaggacggtaagacttggacgtttaatctccgtcattccaaatggaacgatggcaaacccgttaccgccaaagatttcgtttactcatggcgtcgaactgtgacacctaagaccgcttctcaatatgcttacatttttgcgaacatcgaaaatgccaacaagatcaacgccggcaagatgtcaccaactaaattgggtgttgaagcaaagggtaactacaagctggttgttcatttgatcaagccacaaagcttcttcaaatttatggtggcacaaagctactatttcccagaagaacaatcggttgttgaaaagtatggttcaagttacggcaccaattcaaccaaaaacggctataacggcccatttgttctcaaaggctggaccggtaccaacgatacaatgaagcttgttaagaacaagagctattggaacgccaaaaacgttaagcttcaaacgatgaacgttcaggttatcaaggatccgtcaaccgcccttaacagttaccaaagcggcaaactcgacttcacgacactgaacagtacccaggttaaacagtataagaacgacaaggactacaagtcttataaagaagcttctacccaatacctggaaatgaacgagaaacgcctgccgatgttcaagaacaaagatatccgaaaggccttctcattaattatcaatcgaaatcaattagttaataaagtattggccgatgggtcgcaactgccaaaaggctatgttcctgccggcatgaacaagaagaatggcaaggactttgcggatgaagcctacgtcaaagacgccgttacaaataacgatgccgaagccaaacagctatgggccaagggattaaaagaagttggcaagaagtccgtttctttgacattaatgtcggatgacgatgatacgtcaaagaagatcactgaatttgttcaaagccaattgaccaaattacccggattaaagattaccaaccaaaacattccatttaagacccgcctctcacgttcacaaaacggtcaatttgatatcgtcatttcccgttggatcgctgattatcctgatccaagcaacttcctcgatctcttcacatcaaccaacacttacaacaatggtaagtggaagaacgctcaatacgatgccctgatcaagaagtcggaaaatcaggatgccaacaacgaaaccgctcgttggaacgatatgattaaagccgaaaagattttgatgaatgatcaaggaattgtgccattaacccaacagggacaatcagcattgatgaagtccaaagttaaaggtgttcaattcttcccaaccgcaccacaatgggattggagcaaggcttctattaaataatccgattctaacaacttaacaatcaatattaaaaggcaacggtcacttcttaattgaagttaaccgttgcctttttgatttaaaacgagtcaaaaataaaagccgtcccgctaactttgacaacattgaatcagtatagtcaattccaccttaaggatttcacttaaatgccagataatttctccggagattctttgtgacggcagctgattttcaaacaaaaataaccgcaaacccatttggcccaacgtgcgtcataattgtcgggctggttaaacgattgacgatttccaagtctgggcgctttttctttaagactgcctcaatcctatccgtatccgcatggctatcaacgtaggacagtccgacacgggtgatttgaggatgattgataatgtctgctgttacctgatcgatcatcttttgcatccccttttcaccgcgcgacttatgaagaaccttcagttcgccgttcggcatccccaattccagcttgagtttgattaacgttgacacaaaaccgatagcccgattggcacgaccgcccttcaccaagtagtccaagctattgacaaagcaggttaatgtaattttgttcatgtatgctttaagctccgccatgatcgttgccaagtcatgctcagtttgaatgagttcggcggccttcaagacaacgaacgctaatccacgatcggttaggccactgtccaagacggcaacctgtgccggcacctgttcggctgccatctgggcagtttggactgtcccactcaacaccgagccgatatggattgacaagatttggtcatttggtttggcaattctttgatacgtttccacaaactgacccaaagatggctgactggtcttgggaaactgccggtcttctctcaggcgccgtgaaaattctgcccgactgacatcgaccccatcctgataatgctgcccttccaaagttaccgctaacggcacaaccataatatggttatcttcgatttctttgtccgttaactgagcggttgaatccgtcacaatatggatcattggctatcacctcttctgtcaattataaccatttatgctctgttatgcgtcgtaaaataaaggaggtattgtcacttacaaagcttaagatagtggcaaattcatccaaaacaaaaaagtcgtcgtcaaaggtgggaagctgcagacgacgacttatagttagttgatgctttctatttaataccgctaaacgaaggtatgtcatatttttgaagatggtcttggcggttaagcaattccatcatgatcatttctcagatctattttaatttaacatgatacaaacgggccatcttgggctttgaaaagactaactgaagattgttgccgttcagtgcataagaagtctgatgatcctcgcttggataaatctgttcgatcgattcaacgctaccatactgactcaaatcaagttgatggccttcttcgtcactaacaccgcgccaaactgccaggtaaagctcgtggttgccttttaagccgtaactaaaccatgggtcatccagttgacttaagccttccggccaaatcggcagcatggtcggaatcttgtcgcgatagctcttatagattttaatgccttcagcaaccagttccagtcgatggccagttactttatttaagagaccgctttgatggattcgtagcagcatggcgttcaccatgttaaagattacttcttcatcatcgcccttttgcaacggataggaccaaatcgcacattgttcgggtgtgacaaccgaagccccaactgcagcaatattaccgtttcgcacataatccgtctgatcggtcattgattggatactgtgacgctgcagcatagcataatcgtgacgcatgccgccactgccacaattttcaatgacgagatccggataacgtttaaagacatcatccaaccagttaaggtaagcccgattatgtttcaataaaccatcaccggcactgttcgaatccaagtccgtaccgattccggtcgtaatgttgtaatccatcttaatatagccgacaccgtactgcttaaccagtcgatcaaccacttcatccgcaaattgacgaactgccggattcgtaaaatcaagatggtagcggtctgcatcgattacccgcttaccgtgacgcataaagaaccaatcatccggcaatttatccgccaatggcgacttgataccaatcacttcaagttccaaccatagtccgggtgtcataccctggtcacgaatatactgaatcaacttttcgattccgcccgggaaacgctcctcggaaggctgccattcaccaacactgtcccaccaataacccggggcataccaaccacagtcaatgacaaaatattcacagccgacctttttagcggcatcgattaacggtatttctttagcagttgtcggatctcctgaaagaccattcatataatcattaaagataacggccagcttttggtcatcctcgtttgatcgacgaatgtttcgtcgataggtggtcatggcatcaagagcggtttcaacatcacctttcacttggccaaaagcgacttgggcagttgtaaaactttggccgaccgttagatttttccaccaatgattatccaattcttccggaccggataaccgaagtgccaataaattaccgcggccaatatctgtcaattcataatgccaggcaccattattttcaatctgccaaacagccgcctgattcgttctggtattgaccagaatcccgttgggtgaatattcagaacaggaccaggaagaattattggtgatgctgatccgcttggtagatgcctgctttttctcaccatcaacccaataatccaagccggcgtcttttagcgagtcggccttccactgcgcttcggcggtccaatcattgttgggaatataaacaacgttgtcttctgaatagttaccgcctaaatcatctgcttggttaacgccacttatcgcaaacgaagagacatattcaatgcccagatcctcatttccgatattcttgaggctgacccagctacgtaccaccggtgtattttgataaagttgataaaagttggtcacttcaagctgtctattttcaccttcttgaaccaccttcaataatttgccggcccggttttcttcaattgtatgacgaacataagtcaaatcacgccccgggttcgtatccacaaagctcaatcccttgtgatgaaaattacgcccggtaatctgtacttccgttagtgtcatgtgctgctttaattcagcatcgacttttgataaatcattggtgccaaccgttgtcaaaatgattttatgattgtccagaatttcaaatcctaatttggctgaatctgtttcgacattaaatgacgacacatcgctcaactcccttatagttgtttatgatccgtttatttaatttatattcttattgtaatcggtttcaatttctttagaaatggtatatattatagaaaaggtgttgatttgtaactatttatcctcacatttagtgtcattttatcactattctatcagtagctaccgtttaaaccattttttgacagaaaggaggaacagtatgctttcagtaacatgctttgatatcagtgctccggtccttcacatttcttccggtaaattcaccgccgctaagaattggatgcataaacacatgtatcatgacgggaattttgaaattattattgtgatcaagggcacgctctatatgcaagtcgataacgatcactaccaactgaattccggtgacgtttttgcactgccgccgtaccatcatttgcatggttacaagccttccccggaagatactcaatacttttggttccatttctttatgaaaccaaatgggttaaaaacaatcgatgtcgagcaggacagaggcaaaataacggcactatttaatagtgacacagctgtcctacccctgatttttaacctttcaaccgttgaaaaggaatttgttcttgccaaccagattttagacgtttcagccagcaactactttacatccctctccgttgattatttgctcacggaaatgattattcaactttcagaagactattatcaaaaaatcattggtccctctccttcagagcacgctgcacgtgtcgagaccattaagaactggattcgagccaacctttccgaatcccttcgagtcggtgacgttgcggacgcatttgcgctcaatccgcattatctggttcgcatttttaaagaacaatcaaacgaaaccgtcattcaatacatcaataaactcaagatggaagaagcaaaggagttgttggttcgaactaacatggccattaagcaaattgccggcatggctttcttctcggacgaaaagcggttcatgaaggcgtttaaaaaatataccaatctgacaccgtcagaatttcgccgtgcctatacccaacagtttcttgacagcagcaacttcgatcccgaggtaccgattaccaagaacacagaagactaccgaagacgattcgaataatcaggcaatcaccataaacggcttggattaaggaggttatcccgtgaataatcgcaaaaaaggcggaaattttttagtcatattactgattatcatcgttgtcgatgctttatttattggctattcaatgattaaaaagcacaatcaaaagaacagccaggcttcgaccattcaaacaaccgttattatgaacgctccggcacccactataaaatcaatagtgatgtcataatgacttcaatagttaacacaaaaaggatgaatcctaaggtaaattgccttggattcatccttttttgtgttaatcaagtcattttttaacaattattcacgtgtcttggaaagctcatttgtaatctcggattccatattttcatatctttgatatagaaaggcaggaataatcgccaaaccatacatcaaaatggtaacccaattaaaggaaatcccaatcccggtcaacgcatgcgccgattgggcatggtttgcaatgtaaccaaaggcggacatgataccgccgttcatagcaccggcaagacccattcccattgacatacagaatgctgaaccaatggtggttaagatacctgcagcgttaacaccgtttttccactcaccataatcaacagccgagccaagcattgcaaacggcattgatacggcaattcctgaaccaacgttggcaatgagccaaccggcagttgcgccaaccgcactcaaaccggagaacataatcacaaattgtcccaaaacggcaatgattagacccattccccagatgtggctcttggacataaccttattcaaaagcggaattgaaataacgcccagcacctgaataatggcaattgagttaaagaacgtaaccaatcctttgttgtggaagtagtacgtgaaatagtaaaccatggactgttggcggccttgctgagcaacccagaacagaaagttgccggcaacgataataaaccacggccagtttttattcatagcatggatacttcttctcaacgttacacgttgactatttggtacgacaacccgttcccgaacgtgaccaaacgagaacagcgtaccggacaggtttaaaatggcaaaaatcacgacaaaaatccggaatcccttaatatcattgccaccgccaaagaaggcaaccaatggcagcgtcagcgaatttacaacgaaaacgcccaggtttgacccgaccattcgccatgaattcagcttaacccgttgtgtgggatgggacgtgatcaatggcaaaatggttgtaatcggtgcgttaatacccaaataaaggacaccgtaaatcatatacacaatgccacaatatagggcttttgccgacgcactaagatccggtgcccagaatagcagaatgccacttgcagcatacggaatcgccagccacaagaaatacggtcgggcctttccgaatttagaatgcgtcatatcgataaagtttccccaaactggcgccccaatcgcatcgactacccgtgcaagcaacagaatgacacccgttgaagcagccgaaattgccgcaacatcggtaaagaaatacattaaataactattgacaattgtggcaaccaattgccccgagaaatccaaattcgcatagcttagcttttcaagcacaccaaccttttctttggttgatcctgctggataactggtgactttatgagtcatcttctcatccataaccatcactcctcgtattttttagttaattgatgttttaatcaaataaacatcgtgtgatccaatttgaattgtctgtttggttgaaagcgtcacatcttgatccagccaaacattgtaccctttcagtggtaaatcgaaactcgagatctgagaaccggtcaatgttaattcatcatccgaaacattaaaaattgcatgatactcactatctgaactggcagcgtaccagataatcatttttttatcccgatagatctgatatttttcagttatccggtcatccatctttagaagctcacgattggtcagcaatctacttgtccaatcatccaaatcaggtaattctccacccataatcaatggtgattgcatcaaagaccaaagcgtcatcatagtcttttgctctgccttggtaaatcgagtctgacgattgccaccgggtccgtcaacggagcggatgccaatgtgacccagcggtaacatatcacaatcaggccagttgccggggcgagacattgatgaccatttttctgcccggtcaaacatgtttagcagcagcgaccactcatcccagaaatcgtcggtaatccgccacatattcgcggtgtgctgaaagaaagccccgttttcaaccggagcaggtcccggcgacaatgaaagcaccatgtcacgaccagtcttatcaattgcttttcttaatgcctcaacctctttcttgtgggtaccattgtaaataaccgaatttgcaatgtcatcgcatttgataaaatcaacgccccaagaagcataaagtgccatgagagaatcgtagtagccttgtccttccggcatatcgacgttgacgccatacatatcggaattccacggacaaatgttgtttagagcgatgtccctggctgtcttgtcagttcctttaatcggtgaagccttatgaactgcctgacggggaatcccacgcatgatatgaataccgaacttcagtccaagatgatgaacatagtccgccagcggtttgaaaccgctaccattcgtagccgatggaaatcgttttggatcaggcaggagccgtgagtaatcatccataaccaatggtgcaaagtcatggtacttagatgagtcggcactcggttcataccattgaatgtcaaccgttatatactgccagccaaactgctttaagtgttgactcatataatcagcattccgcttgacttcgtcttcacgaaccgaagcgccataaccatcccagctgttccagccctttggtggtactttcgcaaattgtctaaatttttctatcattatttttaatccctttccgatcatttccgattaaatccactgcaatcatctcttgatgacatccctttattcaagtcgatcactcagttaatggcccttattggcttaaccttgttcacagttattatattagagatcaaagaaagcgatttaaacgtcattaaaagtatatttagtgactaaatgtaactaggacttgtacattaggtgtcaaaaagtaatatctatcctttttcctcttgattcagtaccagaaacctatttgtttagtatcttttcccaacttgcactatgatggacatatcattaatttgaattgtgagggaatgatcatcatgggattattaggaccaaagttaaatattcacgaaaaacgcaagctatttatcctgtcttttttagcaaaagatacaggtcaacccggtcaacagcgattgaaaatgctctttgaatcagccaagaaagccaagtatgctgacacagatattttaaaggagcttgaaaacttggacgctattcatgatgtcatgctgaatatcgaagtctaccaaacctttccacgaaaatactttaccgtttcgctgcagggagacgagtggctaaccagccgcggaaaagtttatctggatcaactggagcatccaaaaaataaacacggtgccgtggttgatccagaggatggacatcggccattatccgggtttgtgaacggaaccgtttccgaagatggtcaagtcgtgttcagtgactaatcaataaaagccatacaaaccaagaagtattcagtaggaaagagtccatctattttgaagagaagaaaccaattcatcatcgctgcactaagcagcttgctatttctaagtatcggcctaacttccaaagcaaaaaccgtgtccaacactcatcaagttgttgtcaacattgcatttaagccaacaagtgagactaatctaaccaattatgtttatagtacggttgatcccaattcgatcaactatcatcactatctaacgccaaaacaatttgcgcaaaaatttggtgaaccaaatgcctatctctcaatgtttaaagaatatctacacaaacgtcatataaagactgccgtttatcgcggaaaccttgctttaaaacttcgtggtacccaaaacaatatggatcgggcatttcacgccaattatcatccaagaaaagggacaccttcaagaacgacttaccgactgccagctaagttgtccaaacaagttgtagcggttataggcctttatacaggaaagcccacttcaaaaaggaccgcccattcaaaaaccgctttaacagccgctttaggtcataaaccgaatacagcccttcttcccgatgccttttcgaagaaatacggccctttaaaatttgcaactcactatcagctaaccagtctttacgataacgggcttgaaggtcaaggacagcgtatcggcattatcagtgatagtattgttcacaatcaggatttaaaaatctattgggcacaaaacggcatccatgacaatccaaaccgaattcaccgtatctatacaattgataatcgaaaagcaatgcaaaaagaatccaaaatcggtggaactattcccaaaacagaggctgcccttgatgttgaatctgcaagctctgtggcacccaaagccgatatcgatatctacagtggctattccaataataatttgaccagccttccaagcgcttattacacatcgtttatgcaggcgatttctaatgaccttgatcatcaaatttctaccagttattctccagcgatagagtctcttggcggttgggatgatcatagtgcaacccttgccaactacaaccatgcgctaaatttactgcttgagcaggcagcaaccgaaggcattaccgtttttcaagctagtggcgattcaggaccatatgcgatgggcggactaaaagaacaacattccttttctacatccccctatcaagtaattgttggtggaacaactttaccatacacacagaagatccatcacaaaacgattacagttaccaaggaacgggcattaggcgatattgaccatccatccgaacccgtctttggcggtttttacgagatcctaaaaggaattttccatgggagtggcggtggcttttccgcattaaacccaacaccacgctaccaacagggtatcccaggcgtaaacaccttcagagcgattaccttgttaaattaccgtccccaaacccatctttacaccattaatcctcatccaaagattttgacaggtacgcatactggccgaaatttaccggatgtctctggaaatgcggacaagcaaaccggatacgccacctatttttccagtgacatgtctaccggatcggattcaaaaggtaagcccattttgaaaaaatattggcttatcggtggtggtaccagttatacctctcctcaaatggcggcagctaacgctatcatgaacagcggccggacgacgtcaatcggtttctggaatccacaaatttataaatttgcacaacaaacagatacaccattcaatcccttaaacgacgccaataataacaataatctattctatacaggtcaaccaggaaccttatataatcaagcaaccggacttggtacaattaacttcgacaaactttatcaagatttcaataaccaagacgcaagtcaatagttaacagacaaataagcggccaacactcaagctcggaaacaatttttcgagcttttttagtctcaatttcgataccattttgtgaatgacgttgtttttaaacaaaagaagtgaaactaagggccggtttaatggcctttggtttcacttcttttgttgatgattcagtcaaaggtgttttaaaacttttcaaaaaaataattgacaatttataccgattacgatatcttaattaaatcaggttagttactagaataattaactagcaaggtacaacattcaatcatctggaggaacactatgttattagaaggtatcaagaagagaggattaaccagctttgacatcaaaattctcggcattacgttgatgtttattgatcacatccatgagatgttttcggcagctggtgttccgacctgggtcgatatgttcggtcggccggtcgcaaccatttttatgtttttaagtgtcgagggctttacacacacccataataaaaagcgatatttgctacgcttattaatcggcttttggatgatgggtatcggtaatttcgttgttggtcattttttcagtgttggcaatttggtcctgatcaacaacatttttggcgatctgtttataggtgtcctgaccatgtatggcattcaaatgctcgcagacggcttcaaaaaccatcaattgtccaaggcgtcattcggtttctttctcattatgcttcccttagtactgggtgtacttcttctaacattcatgcagggaaaaatggctgattacacaacctatctgatgttagctgcgccgacgcccttttctgctgaaaactcctttttcctttatctgggaccggtattgtatctggttagaaaacatcgcagttggcaaatgattgccattgcctgttttgcacttttatcaaccgggttcaactttaccaacctgctctcaaatatgcagtggatgatggtattttccattattccgctctcattctataatggtcagctcggcaagagcatgaaaggctttttctacggtttttacccacttcacatctgggggctttacattctggcctcactgttgggcgttggaaaataatttaacgacaaagctttacaactattatatgagctaaaaacaggtactattatccatcatcaaagaaaggctatgacattgaaaagaaaacactttatgattgcagttttaagcggcttgagctttctggcaatgggacacggactgacggcaaatgcaaaatccgataatgcccctacgattgccaatgtcgtttttaaaccaacaaacgaaaccaacctaacaaattatgtttacgacaccgttgatccaagctcgcaatactttcatcattatctgagccccgatgaatttgcccaaaaatttggccaatccaatcggtatgtagccgcctttaaaacgtatttaaaaaaatatcacgtcaatgcggatgtttacggcggaaatttgtcattgaaagtgtccggtacccgaaataacgtcaaccgcgcctttaatgcgacatatgtgacggaaaaagggactcacaaatcaaggaccacctacaaattaccggcacatttatccaatcacgtattaaccgtcatgggtctctatcaatccaagccgactgtcaacaaaccggttaatcgtcaatcacacagcaagaaagcattgactcaacttcggtcctcttccgtcagcagtcccacccaaaccgacgacaccaaaccggacacaaccctttccggagatcgtttttcaaaaaaatacggggcattaaagttcgccaagcagtatcaattaactgccctctatgacaaaggtctcaaaggacagggccaacgcatcggcattatttccagcggagatttccacaatagcgatttaacaacctactggaagcaagccggcgtaaacaatgatttaagtcacattcacaaaatctataccgttgatagccgaaaagatgtccaaaaacggttggattttgccgtaaacggggcacaaatagaagccacactggatgttcaggccgcaagttcggttgctcccaaagccgatatcgacttctacatcggtgacagtaccgatgatctcaccaatgcgccaaccgcccactacatgtcatttatgcaggcaatttcagacaatattgatcaacagctttcaaccagcttcgcaccaaccgccgaagtccagagtcgttggcatgattacagtgcaacaatggcccaatataaccacgcatttaatttaatgctggaacaggcagccgcccagggcatcaccgttttcagagctagtggggacaacggtcctcgcgatgacgtgacgcttgccaaagaaaatcacgctttttcaacatcaccctaccaggttattgttggtggaacgactctaccttacacaaaaaccattaatcataaagtggtcaccgttgccaaagaatgtgcctggggcagcaacatcactgccactccggctcaaattgaagccggtaagattggaggcagtggcggtggcttttccgccctaaacccaacaccaagataccagcaaggcatctccggtgttaacacgtttagagccattgagcttttaaagattcagcgtaaaagccacaaatataccattagtaagcaccccaaaatcattaccggtattaataacggccgtaacctacccgatgtggcaggaaatgccgacatccaaaccggatatgcgctttatttctccggtaatcaagtgaggtttaaacaaaataaacttcactcggttctcaaaaaagtttggatgatggacggcggaaccagctacacttctccacaaatggcggctaacgctgtcatgaacagtggccgaacaacttccatcggcttttggaacccccaaatctacaaatttgctcagcaagccgactcgccttttaccgttttagacggaacgaacaatcacaacctttattacaccggtcaacccggcaaactctataatcaggcaaccggtctgggcaccattaattttgataagctatctcgaaagtttgatcaagaaaccaacgataaataatccctcaaaaacgatctcgtacattttctgtaccggaccgttttttggttcaagcggtagccctgctttaatattggcctaacattaaatgtccaagaacatcaaataactttacaggttacaagactgctataattgattacgaataagattatttacagaaaagagtgagtatattgaggggaaaacaccttatcatcgcaactttaagcggttttctggttctgggggccagtttgaccgctaacgccaagaccaagaaaaccgataaccggccgaccgttgctaacgtggcgttaaagcccagccatgaaaccgacctaaccaactacgtctatgacacggttgatccaaattctgccaattttcacaagtatttaacaccaagtgagtttgcacaaaagtttggccagtcaaccagttatatcacagcgtttaagaagtatttgaccaagtatcacgtgaaggcctcggcttattcgggcaacctgtccataaaagttaccgggacaaaatccaatgtcaacaaggcattcaaagccaagtatgtgaaccgtgacaagaccagttaccgcttacccggacgcttgtccaagcaagtagtcgccgtcatcggtgtctatacacccaatccaaaggcagccaagaaaaaagcagctaaaaagacaaccaagaaacaatcgtcaaaggaaaagtcagcttatacaaaatcactttcaagtaacgttgacgtccctacaagtggtaccaaacccgataccgcactttccggtaacgccttctccaagaaatacggtccggctaaatttgcgaaccgctaccaactaaacagcctttataaccagggtttggaaggtcagggacagcgtatcggacttgttgtccacaccgattttagaaacagcagcgtcaaaaagtattggcaacaggttggtgtcaatacagacaccgggcgtcttcacagaattgccgttgccggaaagcaaaagaatgtgacagctctttcgaactcacagtttaatatggctcaagtcgaaacaacactggacgttgaatcggcaagttcggttgctcccaaagccgatattgacgtttatattgatttggcaccaagcggtgcaaccttaaattcttctgcccactacactgcttttatgcaagcaatttctaacaacgcagataaccaaatcagcactagtttctcacctggtgatgaagccaaaaatggttgggacgataaaagtgccaaccttgttcaatacaatcacgcattcaatctgatgttggaacaggctgccgcacaaggtattaccgtttttcgagccggtggcgaccacggtccttatgatgaagcacaagctgctcagacaaacgccgtatcaacatccccttatcaggtcttggttggcggcacaactttgccatacaccagaattatccataataaactcatcaaagttaaccaggaacgcgcttggggcgatacttacagtgccagtcccgctcaactacaaaagggctttttccccggtggcggtgccggtggcttctcaacattaaacccaacacctcgttaccaggcaggggttcccggtgtcaacaccttccgtgccatccagcttttgaagtacgttggcaagggactgtttaccgttaacaagaatccgaaagtgatcactggggttagccacggccgaaacttcccggacgtttccggaaatgccgatccacaaaccgggtatgcgacctacattaatggcacccagccgactaagaaaggcaaaaaagttgttcgagtgccttatcaaatttgggtgatcggtggcggtaccagctacacaacaccacaaatggccggcgcaagtgccgttatgaatagcggccggtcaactcgaatcggcttttggaatccccaaatttacaaattcgcccaggaaaccgatagtccgttcaacgtcttggctgacacaacgagtaataatctttattacactggtcaacccggcaagctctataatcaggccagcgggcttggaaccattaactttgcaaagctaaatgccaagttcaatagtgaaggcactgctaattaagccaatatccgaaaaacaagtgaatatgatttaaatggggttgggaaatcgagaagttgattttccaacctcgttttatcgattgaaccaaaatcacaaaacacatctggcgtattcaataaatgagactgttataattaaactagattattttaggaaaagagtgattattttgaggggaaaacaacttattattgcgaccttaagcggtttcctggttctggggactggttttaccgctaatgccaaggccaagaaagcagacaatcgatcaactgttgttaacgttgcttttaaagcgtccaacgaaaacgacttaaccaattacgtttatgatacggttgatccaaattcagccaactatcataagtatctgtcaccaagtgaatttgctcaaaaattcggtcaatccgatagctatctatcatcatttagaagctatttaaatcgatatcatctaagcacttacgcttatcccggcaatctttccctaaagattcggggaaccaaagctaatgtcaataaagcttttaaagctaaatatgtcaaagaaaagggtcatgaatcaaaaacgacctataaactgccaggtaagctgtccaagcaagtggttgcagtaattggtgtttacgcaccaaaacccaagaccaaaaaagcagccaagaaaacacctgccaaaaagaaatcggcaaaaaaagcagcttatatcccgtcaattttaaaaagcgctgatgttcccgtcagcgataacaagccgaacaccaatgtcaccggcaatgcgttttccaaaaaatacggtgcccttaagtttgccgaccgttaccaattaaacaacctttacgataagggacttcaaggacagggccaacggatcggaattatttcacatgctgattttcggattggtgatatcaagacgtactgggaacagaccggggttaatacagataccagccgaattcatcgaatctatacagttggtggtgaaaaggccgttcaaaaaatttcgggcaggctgatgacacccggtcaactggaagcctctttggacgttcaatcggccagttcggttgcgccaaaagcaaacattgacgtttatattgccgaaccaagcaatgatgcgacaacaacgccttctgcccactacacggcatttatgtcggctatttcggataatgatgataaacaaatcagtaccagcttcggtccaagtgtcgaaaccaattccgaatggccggatcacagttcaaccttaaaacaatataatcatgcttataacctcatgctggaacaagctgctgctcaaggcatttccgtcttccgagccagtggtgattacggacgaagcgaatcgccaaccggtaaagaaaatcacgttgtttcaacctcaccttatcaagtgattgttggtggcacaacgttaccgtacactaagattcttcacaacaaactcatcaaggtggccaaggaacgtgcttggggcgatacctacagcgttagtcccgccgaaattaaagcgggggtcttcccaggcagtggcggcggtttctcagctttgaatccaacaccacgctatcaattgggtgttcccggtgtaaataccttcagagccattgaagccttgaagtatgtcggtaatggccgctacaccatcaacaagaatcccaaagtcattaccggaaccggtcactcgagaaatctgccggatgtcgctggaaacgccgatacccagaccggatatgcaacctacttctctggaaatcaggcttctataaagggcaagagcctttcgattaaaccagccaaaatttggatggtcggtggcggaaccagctacacctcaccacaaatggctgccgcaaatgccgttatgaacggtgatcgcagcacgccaatcggtttctggaacccacagatttacaagtttgctcaacaacccgacacaccgttcaacgtattggatgacgcaaataataacaataatctgtactacaccggccaaccgggaaccctgtacaatcaagcaaccggacttggcacgattaatttcgagaaactatatcaaaaattcaataatgaaagtcccagcaactagtcacccttttcattaaaaaccagctaaagtcgttatcaagataaatggtgacggcttttttgctacctccggatagtcaacaggctagaaaaactgactattccgcagttaattttcactttgtttctgattttaagcttgagttaagccggcgcctatatgatatagacaatcaaataagaggttaacacatccagagagttgcgacttcaagtatcaatactaattgaaagaagtgatgccacccataaatgagtcattaaataattgccctccaataatacgatttcttaacaaatttcatgattaccccttcaaataaaaaaagacatctccccctcaaagatgccgtcctccaaaaagagctgcagtgcgcagctcttttttagggtcaaaaaaaagacatctcccaaaggaaatgcctttatttattaagttaactaatcattataggtatgggttaacaacatacatatcaagaatggtctttacccattgacgatagatagtcataccgatgtaaccatcagcattggcacttgaattttcattcttagtgtcaccagcagacttagtgtacaacgctgaatcatcaacagtgtaacctaagcgaaccgtgtcgccatagtggacgttacttggaatactatcagtatccaagttgaacttcatgtaaacaccagtcaatgaatcaacgttatcaagccatccacctgcaagacgaggtaggatagttggtgtaatcttcatgtaaacttggttgaagccgtcattcttcaaagcagctttcaaagtgtttgaaggaataacatccttcttgtcgcccattacagtacgatcacggttgaacgtgttaacggcattgttccagttaacgttaccgttccatagaggaatcgtccattgtgcatgagcaacttgcttaccaccagtagcttgactgtaaccttcaatattgaaagtactgtcaatagtagtttgggtagtaccaactgatacgtaaggagctgatgatgaagttgaagaaataggtgcagcagtgcttgatgatgaagcagtagctggtgtaccaaccttcttagcttcggcagctttagcggctgcagctgctgatgcggctgcggctagagatgctttgttttcagcagcctttttagcagctgctttcttcttggcagctgccttcttcttagcagcagccttctttttagcagctgcttttgctttcttagatgttgccttcttagcatgggcctttgcaacagctgttgtttctgttttagcagaagcagtagttgctggttgagctgcaaatgcagcgccagaaagacctaagacggcagcactaagtaatgtaactttcttaagtgctttgttcataattacccctccaaattaataaaaatattccctgaacggctcttattatataacatatccggtgaaaaacacaaagattattcaacctttttcaagattgtttgtcaatgttaactgccctttggaaaacaagtaatcgaaatccattgcctaacaatgcatactttatattaatagtgcgcctgttaatagtatatacagttgctatagatacgctttgaccgtgattattcacgacatcaaaagaccagaataaacgacatttatcccagccaccttgttgtaatcatccaacgactattcatcctttaatcacccagttctgctaagaataagcttgcttgacctaagtgagccccattctgactgattcctaccttattttagcactcgtgatccgagcggaaaaggccttataatcatcatccgacaaagttaatttccctcgccaataagcaatgccttcaatagccacccctacaaaaatgctaaacaaccaaagactaaaaatcatgataagttccatagatcaacaaccctttcttaagtgacatgacaagttagtttcaagtccgttcaatcatctatttcagtaaaaaacgttgttatgctttcattcttttatttttaaccattttcgcccgatcggctaacggacaaccgacgtctgcgcattcatgacagctccccttggatcccttcttgagaaaacggacgtaaaacgcgaaacctaccaatccgaataaaataatggcgacaataagtgtgcccataagaccgactccttccaaatcgtgacgttttgtgttgaacttttttaacgactaagcactaacattaatacctaaatccggtcgttcacgcttaatgaacaacccatagaccaccactcccaatgcaagaattgcaacggtcaggccaaccggtgagaagttggcagaaaagacctgcgaactctgataaatgatggtagcgaccatataagcaaccagcgtttgataaccaacagcccgccaagtccaaccggcatccccaaactctttgtacattgtgccgattgccgcaaaacacggggcacacaataagttgaatgccaggaacgcatatccggccatcggtgaataggttgagcgaagggcgtctacaaaaccggcattactgccaccaaaggtaatatgcagcgtaccaacacaattttccttagcaatcaggcctgcgatcacagccaccgttgcgtgccaatctccaaatccgagtggtgcaaaaaccggtgccaaaaatgatcccagggcttgcaggatactgtgattttgatcgaccatctgcagcctaaagttaaagctttgaagaaaccagatcacaacgcatgacaggaagataatcgtgccggccttcataataaaggcgtgggcccggaaccaaacgctttgaagtgtattcgtcaattttggaaaatgataagccggcaattccatgacaaaaggtgccggtgcgccacgaaacaactttgtctttttcaagaaaatccctgaacaaaccactgtcagcatccccaggaaataagcggaaggtgccacccagctgttgtgagggaaaaaggtcccgctaatcagcgcaatgacagttagcttggccgagcatggcatgaaagtggttaacataatcgtcattcggcgatccttttcactttcaatcgttcgagtcgccataatccccggtacaccgcaaccggttgcgattagcatggggataaaggattttccggataaattaaaacggtgaaagatccgatccatcacaaaggcgattcgtgccatgtaaccacaatcttcaagaatgcccaaacatagaaacaacatcatcacttgcggcaggaaaccaagtactgacccgatcccaccgataatgccgtcaacaatcaatcctttcaaccaggctgctactcccatggcattcaaaagacttgtcgtcacgttgggaatccaagcgccaaacaaggtgtcattgacccagtcactgccgatcgtaccgatcgtttgaatagagaggtagtaaaccgcccacatgacaaggacaaagatcggcagtgccagccaacgattagtgacgattcgatcaactctgtcactcatcgacatcttaaagtcatctgtatcgacaacacacatttcaatgattttagcgataaaatcatatctggcattcacgacaatgctgtcgctgttgtcgtcaaagattttttcagttgctttgatagtggcttcaatttcccgttgttgtttatctgtaaatgacattgcccggctaaccgcttcatcccgttcaaaaactttaatggcgtaccatcgtaattcgttgtccggcaattgacccgtcaattgatcctgaatcattgatagtgcggactccaatcgtggatcatattccgggtaggcgtattgatgatcttccgcatccttttcccgaattttttcagttaattgatccaggttctgcttcttcaacgcactgatactgaccaccggtacatccaatatgtatgctaattttttgaggttgatccgccgatgatgctgcttcttcaaaatgtccatcatgtttagaatcaatagtaacggaataccggtttccattaattgcagggttaaataaagattacgttccaggttggttgaatcaacgacatccaaaatttcactcggaagatcatcaagcagatactttcgggtgatcaattcttcggaactatatggtgacagggaataaatgccgggcaggtcctgaacaatcatgctcttatcggacttaagctggccgctctttcgttctacggttacgcccggccaattacctatatgttgattggaaccggttagcgcgttaaataatgtggttttaccactgttgggatttccaaccaatgcaagcgaagacatttccattcattacacctcctcgattaaaacgcaactggcatcacgtttccgcaaactcaatttatatcctcgaaccatcaattcgatcggatcgccaagcggcgcaatttggttgactttaatcatggtgttattagttaatcccatgtccaataatctgcgacgtaaggcccgatcaccaaccatctttcgaacgattccactcttgcctattttcaagtcggacaatgagtgcagcttgtcaccggctttttccttaatatcccgtacgacgattcgttcggcaatatccaaactgatggccaggcgctgaccctgaaaataaatcatcatgccgcttgaatccgtcgaaagagagatcaccgtgaccttcttaccagaaatcatccccatttcagataatcggcgaacaattgccttgtcacccaagacattcataataatgtattcacccctgtgtttggcttctgataatgcttccatagttgatcactcttttcaatttataattttggaatatttaaatatgtagagatctttcgttttcctaccactaaatacattattgtggtatatgtgataaacaaatattaaatgtaaaaacaaaaaatgtcaatacgataagaaaaatgagtgttgttctaattatttggtgataatgattctaaaaattcggacagctaacgaccgcgtgttaatcgattatattcaagaaatatcctgaaaacggttgaaattaaactttttttctcgtatactcagtgtcaagcgagtaaccattttaatggtactctaataagtattagtcattttattcgtaagtcttcgagtgcagcgggactgtaaatgaaaatactgcatgacaaagtagtcggctgacatgggccggctacttttttattttctgaaccgcttttaacgtcttcgcctaacaagttgtatcaaaaacgctgtttggaaaatgagactcatttccaaacagcgttttactatcgagcccttattcttaggctgattctttagccgaatctttcttaaccggttcttttcttgatttcaaatatcttatcaaaaccacagcaagtgccaatccggaaattgctgttgcaatccagaagacattgtagaatgcctgaacaaatttatcaccaactgccggcgtaattcgggtaacgcccggcaactggaagaatagtgccgatgatgcaaagctgattccgattgtcattcccaacgtccgggcaaaggaattaaacgatccggcaattccagagagctttttatcaaccatccccattgtcaacgcgttatttggtgacaggaagatggcaatgcccataccgttcaaaacaatcggcggaataatcttcatcatatccaaatgatccgggaaaaacgcataaccgacttgtgaaaacatcaaaattgccaagccgataaccgtcatcaactcccggttgattttatccgccagaacgccggcaaagggtgtagtaattagcatcatgaccgattggagcataatgaccagcccactggcgaacggactcataccgttgtaactctgcagatagaatggtaacaaaatgtttgatatggcattaaccagcatcactaaactcaacgcaaaaatcgatgtcatgaagcctttgtttcgaagaacctcaggtgcaatccacggcagatttgatttatcatcctgaatgaacgagtaaaccgtgattgcgccaccgacaatgaagaaagcaagccccatcagtaagtgatcacgcccactttgaaagaatgacccacttaagaagaacaaaataatgccaattgtgaataagttttgccctgtccaattggcgcccttggttacttctttaatgtgtgcccaggattctttgggaattggcagaaatttaaagcccagccaaaggactaaaatacctaacggaatattaatccagtaaatccatcgccagctcgaaacggaaataataaaaccaccgattccgggtccggaaatcgacccaaccgaaataaacatggaaatcatcgccaaagcttcagcccgtttattatccggaaaatattgcgtcacaatccccattgaattagccataatcatagccgcgccaatcgcctgaattacccggccaatcaaaatggtgataaaatccggcgcaaaccccgtaattgtcgatccaattaaaaaggcaataccgccggctaaaaagacggcgttctttgataagatgtcgccaatatggccaaacattaccaataatatggccgttgtaatcagcccgatttggacaatccaagttgcggcgctactcgaaatattcattgaaatggcaatctttggaattgccaaatttgtgctggaacctgacagagatgtcaaaaatgaaaacatccccaggacaccaataatagatagatttttcccccgactatcagccatcattcttccccctttgactcattgatgcgatcgatcgtatcttttaaaaaagcgctatcagtattttcactaacatttataacactaatataggaaaagtttgaggatatcgacttggaaaagtcgtcacaaaaaaagatcaaggccattttctccttgatctttttaatcgactgattctaacacttaccactttatccaatcttggttataatgaccctttacaatccaaatatagcctcttttttgctgcagatacggtgccttaacaacccagccaaaagttgtatcgttttccgcttggaccttggaatcctccaacaacaccattttttggtttgtccgtgaattttccggattaacctgataaacatagaccggatatttaatgtgaataagacgaggcttgtaccaatatgatgaataatatccgggtaacgtgcttgcatgcgatgacggtaccgtgacaagtccggcaaacaacagtaatccaacagtgacgataaatagaaatttcctaaacatttcacatcaccccacttctatctccaccctgataatagcgcggcaattgcacaatcctgtaaatttgatgtaaaggttgtgtaaaaagataatcgcctattttaccaacttattttacccatcattaaccagcaaaagccacgtcacaaataggtcatttcgattgtcgcagccacacaccacatgctaaactatcattataaagatgacattttaacgccagatgccactatgacttccagaaacggaggagttcaatgacaccagaagacttatttagtcagtttcaaggattactcgatgcaggctaccttgaacaagcccggacttttttgcaggaaaatgctgaaggactcggcgatcatctgaccaacgccactgatatgctggcagattttgacgtttccagtgtgaccgatcacgtccaaaatttcggtgaagaaacaacctcaaaagtagccgaatcacttgaaggcctgaaagaccaagtagatgcatccggttggttggataaaattataggtatttttaaaaattaatgatcaaaaaaatcgtcattagtttcctcctatccgaggcaactaatgacgatttttatttcacgagttatttttttcgagtttccgaatcaacttccggtgtcaatgattgatcgcgttgacttgtcgttaattgtttatttaatgcttcataggatcccagtttggggcctgtgaaatgatgtcttgcataaacaacaaaatcaataatcaagacaatcaggacggccacaaaaattttacctgtcgcatagtgtaacaccatgttagacgttagctgaacatcagttggcgaaaagatcatgagtaagatcaaaaagacaatccaaccacaagcaatcgagctgactgcaatactccagctaccaaggctccagggaccatcatcctttttagtccaaatgtggagaacacgtgcccttaatttcaaagcaatcggtaccagatacgatccataaagaccaatgacactcattgtaccgatagctgcgtaaacaccatcagaggttccgaatagaaatgacagcgtgacaatcagccaaatggcaatcgtcggggtgtgaaatttactggaaattttcttgagttgatttgaaaatggcaagccgccatcccgactaaatgcataaaccattcgggatgatgaggttaccgccgagcagccacagaaccacatcgcaattgtgaccaaccaaaccattgcacttcccagtcgtgaaccagctgcctgttcgattgcaacgatgaaagcattgttaccggcatcggcaaccgccgttgggtttttaatcgaaacagtcaccagtgataatagcaggaatccaaaaataccggaaattgcaactgaaagataaacgccccacggtgcttgaatacgtggattcattgtttcttcactggtatgcgcagaggcatcataaccggtcaatgtccattgagcctgcagcagtccgatcaggaaagcaccccagtacggcattgactgggaagttgccgttgaaaaggtatggaataaataagtaccactgtgttgggggccaagcaccgccaatacgccaataattaaaaagacaccaaccacgtgataaatggcagaaatcgaatttaatttcgatacaatgttaatgcctacatgattcaaaatggcatggctgccaaggatcactgcgtacgtcagcagaaacatcggtttacttggatgggtgaaaagaagatttgaagcaaaaatagcacaaccataatcgattccggcaacgattgtcacctgtccgataacattcagccaacctgtaaaccatccccaagtcgatccacccaaaatggacgcccaatggtaaatcgcgcctgatgtcggaatggccgaggttagttcagccattgcggcagccacgaacaggacaaagaacgtgacaatcggccagccaatccccatcatcgccggaccaccgttgctaaacccgtaaccataataagaaacggcgccggtcaaaatcgaaataattgaaaacgaaacggcaaaatttgaaaagccgcccatatcacgaattaattcctgtttatagccaaacgactttgagatttgaaacaggcttccagactgcagtttccactttctaaccgaatctgttgcttttaccagaattgccaacatcgttatgatggtgacaaaaatgacgattaatccaaaaataatcattttatgcccatcctccctaaaatagataccatttcgttcgtttatgtgttacattatatgacatagattagaaatagcaagctattttttaatcaaataagatcaatctatcattttattaataatttatgtcataacttttgacataaaagaagggaatgacattatgccggagaccattcaaacggtaggaatcgacatcggaacaaccacaacatctctggtgttggcacagctttcaattcaaaatactgaagccttctccagtttgcctcacgttcagatcgttgataaacaaatcaattatcgaagtccggttatctttacacctttaattgacgcaaagaggatcaatcaggaggcacttcaggcattcgttgcccatcagtatcaaatcgccaagattaataaggccgatctgaaaatgggtgccattatcatgacgggagaaaccgctcgtaagcaaaatgccaggcgcactcttcaatcattaagccagtttgccggtaattttgtttgtgcgactgcaggtccaaggctggaaagcttcattgccggtaagggtgcaaatcaaacactgctgaaaagacatcccgaaataccggttattaatctggatataggcggtggaaccaccaacatggcttacttcaaaaatggtgactgcatggataccgcctgctttgatatcggcggtcggcttatccgggttaacgatcatcgtcaaattacatacattgcgcccaagcttcaaaagatcatttcaagcctggcactccccattcacctgggagacactgtaaccccggccatccttcagccattaattgacgaaatggtgcgggccttggttaagatggtcggcggtactcagccggcgcctttctacaatcttcttcaaacagacccactgaaccatcctgttaatcaagacgccctgatcacattttcaggtggcgtttccgattgtttcttttcaaaattacccacaaatccattcaaatatggtgacattggcatcctgcttggacacgccattaagacctcggcattctttaaggctaaacatatcggtcatcccacagagactatcggggcaaccgttatcggagcaggctcgcaaaccgttaccgtaagtggcagtacgatccgctattcgagtaatgcccttcccttaagaaacgtgcccgtgatcagccttgatcaatcgaaggttaccgatattaatccggttattgaagacaagctcatgctatacgacctgcccgaattagccgcaatcggaattgctctgcaacacgtcggcgccaactttcaagcaatcaccaagcaggccgccgatctggcatcagggttgaccaacttgattcgcatgaaagttcccctggttattttaatggagaaaaatgtggccctgttcttcggcaattgttttcgcgaacatattcccaaagattacccactggtctgcttagatgccgtttcgaccaaagacggcgactacatcgatatcggtcgaccggttgcaaacggtcaggcgcttcccctcatcatcaaaacattggcatttaattgaatggagtgatcaaaatgattctaaaaacaattctttccggcaaacattatcaattcaaatccgtcaaggacgtcatggcaaaagcaaatgaagagaaatccggtgacaccctcgcaggtatcgctgcccacaacatgcaggaacgagtcgccgcaaaagtcgttttgtcacagctgactctaaatgatgtgtatgaacatcccgctgttgactacgatcatgatgaagtcacccgaatgattatcgatgatttggacccattggttttcagacaaataaaaggctggacattcgaacaacttcgggaatggttattggcaacgacaacaaccaatgacatgattcactacctctcacaagggttaacctccgagatgattgccggagtatgcaagctcatgacaaaccttgatttgattaccgctgctaaaaaaatgattaatgaaaagaccgccaatacaaccattggccgacccggaactttctcatcacgtttacagcccaatcatcctacagacaatcttcgtggcattatggcctcgacaatggaggggttaagtatggggatcggggatgccgtcattggattaaacccggttaatgataccgtctccggcgtaaccgccattctcaatactttcaatgaatttgtgacccgctggcaggtaccaacccaaacttgtgtcttggctcacgtcactacccagatgcaggccattgaaaaaggtgctccggccggtctgatttttcaatccatcgccggctcgcaaaaggccaacactgcttttggaattgatcagcacttgatcgcccaagccaaccagttgggaaaacaagcgctgcacaacaaggggcaaaacgtgatgtattttgaaaccggtcaaggatccgaattatcatccgatgccaatttcggtgccgaccaagtcacaatggaagctcgctgctacgggtttgcccgtcattttgatccatttattgtcaacaccgtggttggtttcattggaccggaatatctgtacgatgccaagcaggttaccagagccggtctggaagaccatttcatgggcaaactcagtggcttggcaatgggatgtgatgtttgttataccaaccacatgaaagccgatcaaaatgatattgaaaatctggcgttgcttctggcaaatgccggttgtacttatatcatgggtgttccccaagcagacgatgtcatgctcaattaccaatcaaccggttttcaagaaactgcaactatcagggagctgctgaatcttcacccgattcccgaatttgaggcttggatggaaaaaatcggcattagtcaaaatggccgcttaaccagcaaagccggggacgcctcaatttttatggaaaaggagccgatgtaaatgaaagtacttaaaacccaaaatcaattactcacaccaccacaagttcaaccgcttcctgtcaacgccgataacgagttgatcgatattcgttcaatccatttaaacacgcaattaatggttgaccatccagcaaatagagatgcctacctctcattaaaggaagctactcccgcaagacttggtatgggccgggcagggttgcgctacaaaacccgttctgttttacgcttaagagccgatcatgcggctgcccaggattctgtgtgggcggatgtcccatccgagtttattcaatcaatgaacatgctgccgttgcaatcccagtgtcaagatgagaccgaatacctcacccgccccgatcacggtcgtcaattatcgacagctgctgcagccaaagttactcaactcatcgacaagggcccatccgttttactcgctgtcggtgatggattaagctccgaggccattacggcaaacgtcggtgatgtcatcccagccattaagcagggattgaagcttcatgatatttcgatcaacacgattccctttattcgattttcaagggtcgctgttgaagaccaactgggagagctgacccatgcaaaagttgtctgcctcttaattggggaacgtcccggattggtaacaccaaagtcaatgagtgcctacatcgcttatcagccaactgtcggaatggctgaagccagacgaacagtcatttcaaatatccatcccggtggcattcctgctgtcgaagcgggcgcctatattgcggaaacaatttggaatatgctgacacttaagaaatccggattggatttgaaagaagccttaaaaaattagatctaaaaagctccctatcatcaaccacctcaagggatggctgatgatagggagcttttctttagttaaacgattcttttttcgcatccaacgccttatcagtcacaatacaggtttcgtacagccaattcattaatgtttcaccatggccggtattataataaccattcagcaggcgataaaaagccgtcatgtgctcgtcatcaatgattaagagtccggcgccgttctgaattaaaatataattcgcagatagaagagcggtccgcttattgccatcccaatacaactggctatgcataatataaagcatcacctttaaggctttccaggttgcggattgatcggccatcattatttcggtaagatcagccattacctgatcgtaaaccgggatcatcgggatgtaatccgttccgccaattttaactttgcccgttcgcagcattccccaagcaaccgactcaccctttgcgaccaagccgttaatggcatgactgaccgccaaagaatagggtttgctgtttctaatcattaattcgaccgcactttgcagttgtcgaataatcttcgtgtcccttgttgaaagaccataaacatcagatcctaaaataatcgtttcagtttcccgaattgttgccttgttatcctcaaatctggaagccgaatacactaagcgaatcatttctttaatcgctaacttttgattttcgagttgcgttaattttgttttgtccgcaaaattcattctccgatttctccctcaatttaatcatgcagctctaatagcggtttcgcaaatagaaacacaatctaaatcataagtggtactgtccgtttctgtctactaaaatccaccatttttaaatcattattatcaacttggttaagtcacattcgatctttgcagcggtgtataaagttctcgaaaagtttcctttcttccggcatcgtttcaaatagaaattccggatgccactgtactccgatcacttgatcatccgttttggattcaatcgcttcaataaccgtatccggtgcccgccccacgacatttagttcaggacccgactctttaattgcctgatggtgatgcgaattaacataaggattggcaccaacaatgcccgcaacttgacttcccttatcaatttccacatggtgactcggataaataatcggggcatcctgatgatgcttgatataagcctgcttattctgactggaaatgtcctgatataatgagccgcccaacgcaacagcaataatctgcatgccacggcaaaacccaaaaattgccttgttggacttatacgcttctcgacaaacagctaattcaaactgatctttctttaacgatgtcccatgaatctggtcaatcggctcctcgccaaacaaggtcgggtcaatatccggtccgccaataaacataaacccatcacaacgactgacaacgtgtttcgccaagcgtcgatcattattaggaggcagtatgacaggcagtccccctgccctaataattgcctgagcgacagcagcatctacgtaatctctaaatccaagttctgttaacccggtattagccggaatcccaattaacggtttcaatagccccaccctctcagagaattaatacacaacaaagcaccactgcatattaagggatcaactcgaaaaatcaacgccttatattccggatgctaaccgttttgatccgcacactgttttaggactgcttcgctaaccataaacctgcatgtaagctaacagccatcaaattccaaaagcgggaattcgctgcctgtcaacttacactccggcttataccgggttagctccgcacactgttctaggactgctactcaaagcaatgttctgcatgtaagggattcatttcaaaaatccaaaaccgggatttccaaaatgaacgccttacactccgaacattaaccactttgatccgcacactgttctaggactgctactcaaagcaatgttctgcatgtaagggattcatttcaaaaatccaaaaccaggattttcaaaatgaacgccttacactccgaacattaaccgctttgatccgcacactttaaatttattctagcctcatttaattccggcatcaatcgtaacattggcatgtcatcccggataaataggcaaattatatcaccctcacttgatatagatttcaaaagtcgtcccattactttttaatcaatgtaaattgattaactatttcaaaactattatttcttttatcacaataatataactttcatctttttatgttacaaatatgtttcaaatgacacgttattttaccagcttcaaattcttaagaagtctttaagactactattgcagctcttaaagcccatttcttcttagtgatcaaaacgccaaatttgtaacaagcttgttacaaatcgagcgtggaaaaatgttatggtataggtgtcttaataaagtcttaagaaattcggggagatgatttttgatgagtataaagaaacaagtagccctaggtttgttttcaatggctagtgtctttaccttgagccaagtcgccgcgaacgccgatactaaggtcacagtaaaatcaggcgataccttatataaaatcgccacaaaataccacacgaccgttagtacaatcgcaaaagcaaatcatttaaaggacgcaaatacaattgttaccggaacccaaatcacgattccgggtaagtcaactgctgcatcaagttcaacatcatcaaattcgggtgctaaaaaatacacgacggggaaaacctatactgggaagaataagcaaacaaccagtacatatgtgagtccgagttcaaataaacaaacaagcactacgaaatcattaagcaaaacagcttccagttcgaccaccatcaagtcaaccaagactgctaaatcatcaacagcactgaaagcaaatgcaacaaccgatacgacagccactcctgatactaattcaggcactgttgacggtgtgacaaccttagctcaaaagttgaccactcaaaacattccatatcaatggggtggcacaactaccaagggctttgattgttccgggtttgttcagtatgtttacaagcaaaatggcgtttctttaccaagaacagctgaagcacaagcagaatctactacaaatgaatccgtatcaaacgcacagccaggtgaccttttgttctggggaagcaaaggcggcgtttatcacagcgctatttacctgggcaataatcaatacgctaacgcaccggaacccggcaagacagttcaagtacaaactatttcacagtactttgcacccagctttgcaggttcggtcaatgcttaattaattgatgaccattataaaaagccacttatcgttttaaagacgataggtggttttctcattttataaagtcaaaaaatccgatcaaagtcgagcactaatgtggtgactttgatcggcgctttttgactgtctttattaatcaagctaatgtagaaatggtctgccttgcgaaagaattaacccaacaataccaacgacgatacagaagcaaagtgcccaccagatcaaaccggcatgaaacttattctcctgcttacgggcaaacgcaatttcaataaacgcaatcaggcccaatgccaaaataactttgatggtactcagtatcggattgtattgccaagttcccaacaacagaatgacgccactgataatggcgatcaaatataaaacgcgtgccgtcattgcccacaccgttactttatgagattttgcgatcaaaccaagtacaaccacgattgttaatacaaaccaagtcactaaatgaatccataaccataacatcgattcaattcccccaatatttaatgtaatgtgtctatcctatgctttttagtgcgatttgtttaggtagaaacaccttcttcattataacaatatacaaaaataagcgcccgacaacgtcacaggttatcgggtgctcaccaagtcaaccgttaatttcatatagaacttaccaactcccgttctcgagaagagcctcgaacacatcgaatcattatatgtcgtcacttctggcaaatttgggggaatttgtaattaagaagcagctactgcagttgcctgacccttctcgcgttgcaatttcttctgcaacttctttaatctttgtcgcggtttaaggccagtaactaattgtccaaaaacagtcatctctaattgtttacttaataccataaaatcaaccctcccttatacaaacgaaataagttgaaaataaacacggacaggatcagttactgcctgagctatttctagctgaaagatgattaagatctcacctttcaacttttattgtaaaaatttatgcttaaaattcaaccatttttttcaaattttatcatgaaaaattagttatcatttttcgccaatcagttaatagtcattaagcttataatgacgactgtcagaagcggtttattcactaattaagtcattcatcagtattgaaacatcataacattaaagttctttaatgacgttatatcccctttaacctatttgacaaaccatgcctttctgaaaatataatagacctattgaggggaataataacaagacatcttcagaattgattgcttaaggagcgtgattttcatgtattttgttatcgaccaaaccccaaatggaacctttcagtttttcatcaaatctgcagatcacgaaacgatcgcaatgagcaaagcttttgacacaaagctggccgctcaaaaagccgtttctatcatcatgaatgggcatctcagcccgaaatcccatatagaagaccttgtttaatagcccaagtgacatgactatagggaatgcttcaaagacatgtttcaattaaattcttaaaagataacgatagaaaggttgaggcaaatccagcttcagcctttttcttttccaaaataagagaagggcgagctttttaacacgttttgattaaagacttggtaaaatggaagcgaagactcgaaatcgttatgtgggggcattaacgtgaaaaaatacaacatcgcttacaacatggccatcatgatacttgccattatctcaattgcattaaccatactggatttttgcaatacaattagcttgactagtgacccttggaacgtcatcaacgatggtattttaattattttcacaattgattatttcacgagattagcctacgcaaagaataagtctgaatttttcattcacaacatttttgatttactggcaatcatcccactatactcagcgtttagcttctttcgattctccagagtcttccgcattttccgattgctcaaactgcttcgtttcattcgcatgatcggtatcattggcaaacttcaaaagtcatttcatacttttttgaaaaccaacggctttatttacctgctttggatcagcctggcaatcctctttatttgctcatcaatgtatgcgcttgccgaacatgtctcttgggggcaggcactttggtgggccattgcgactgcaacgaccgttggttatggtgatatttcgcctcatacattaatggggaaaattgccgcggtccttctaatgtttgtcggaatcggctttattggtatgctgacaagtacgatcacctcatttttcgcaggtcaggacaaaagccaatatagagatttaaaggtccgtttgactaaaatcgagcagcaaaatgaagagttaaagaatagtttggatgacttaaaaaagaaaataaaataagccaagatacaattgaagcccctcacgttttccgccgcgagaggctccttgcaatgttttacaactcaaccattatatcatgtgtgacatggtatgtgagcatattgtcttaattacttttataaactgctctagatactaaccgctttgatccgcacactgttttaggactgctcctcaaagcaacgttctatatgcaagagattcagttcaaaaatccaaaatcgggatttccaaactgaacgtcttacactccgaacgttaaccgctttgatccgcacactgttttaggactgttcctcaaagcagcaccactccatataagagatcaatttgaaaaatccaaaaccaggattccccaaatcgacgtcttatattccgggtgctaaccgctttgatccgcacactacttttttcctcccttatgcaatcttgattttggttcacttgccatcattttcgtgaagacatcggttagcgtttcactttgatcttcaaatttcttatttaaaatcaattgccgaaattcttcgatcgatagatgttcaacatccttaaacggcaaagaagatgcaggttggttcaaccccgtctttaaagtaacaaccagcccttccttactatccagggtgactgtgtagtattcataatagctgggtgtttcgtaatttccggtcaattccttattttcctgaaaatacttagtcatataacttttaaactcttctggagactttaacgctgccttccactcatttccattaattgatgccataaaaattccttctttctaccaccattggtaaaattcaacaaatatactaaaacaaagaagtgcctagtcaaacgggttgctcggcataaacacctaaacttattataaccagactttggtaaaaatggaatggaagcgcttaacttttccaattatttttaatattttagtaaaatcgtctaaaagtatcaaaaaaagcatcccatcaattatgagatgcttccctttgtctatctattttgctaatcttgctctagtgtagtccgcaaatccggcaacatgatactcaacaccggacaacttaggattaaccaaatgatcttcttttacataatacagcggaatgacgccggtcaacttctgcagtcgcttttcagcttgtctgagatcccgccaataatcggtttggttatcagcttttttagcactggcaaccagcctatcataagttttatcactaaaatgacctggattcatcgtattattagttgtcaaaatacccaaataattaattggatccgcaaaatccgccaaccaataccattgacttaactgccactgaccattagtccgtcgattttgataagccttatcaggtaaattactgatgttgacttttacgttaggcaggttttgattaatttgcccctgcacaaactgagcaacattacgagtcacatcctgatcgtcaccgataattgataatttaagtgtcccggaaatcttagcttcttttcgaccttgattccataaacgctttgccttttgaaggttcggttcaacactggtgctggtttcttgactgaaatccctgccggtaataggatcaaccgatgtttttggactgacaaaactacttgcaggttcggaaccatccgaaagcacttttttagttagttcatttcgattgatcacaagtgagattgcctctcgaagtttctgattggccaaaggctcaccactcttttggttaacctgcaaataatatgtccacgctttcggtacccgcttgagatctttattcttttgcagactcttagcagttacaccggaaattgtagcatcgtccaatttgtcggattgaaataaattatgtgcagtattagggtccttgaccgtcttgtaattgatgcgatccagcttgattgccttcttatcccaataataaggattgcgaaccagttgataactatcattagtgcccgtccatttggtaatcttaaacgcaccatttgaaaccgtatttttcgcattggtgccatatttcttagctccgactttagtcacaaacgacttatcctgcggcataaatacaggcattgcaaccaatttattgaaataggtcattggatgatccaaagtaatctcgagcgttctgtcaccggttgccctaatccccaaagtcttatacgatttcttattagccataatagcatccgcatttttaataccactgaaaatgtacgtataaaccggattattagccggattcattgcccgtttccatgcaaactcgaaatcttcagccttcacaggatcgccgttactccacttagcattttttcggatatgaaaaacgtacttcttcccattattggtcggtttaacaagttttgttgccattgcaggtgccggttgatcattactattcaaccgatacaagccttccgaaatgttggtcaacgtattgaactcaggtaaagtcgcctgatttgtattgtccaacgttgtaagctcggatgtctgcattaagttaagtgtccgtttatttgactgactttgagtgccacatcctgataacacagccacagttacgaaggttgccaacccagccaacaacaatttgatttttttcacgatttatcccctcaattcattcgaaatccaatcggcccgataaaacttctatccctcaaatttcatcaaacacgcttaatttcaatcggaactgcatgttttaaagtctcatgaactgtacattccttaatgacttgattaataaaagtatgctgatcctgttcattcaaattagtttcagcatgtatcgtgacctgaattttggtcactgctgatcggccatcttgatacttggtcgtttcaccagccgtttttacctcaaatttattaattttgatttccggctgtcgtctaacaatatcatttgcagtaatggccatacaagagctaaccgccgacaataaatattgcactggatttggaccggcatctgtgccaccaccggcaaccggctcatcaaccagaaaatggtgaatgccggtttgcgtgtccacttgggcaccaactttgcgtaatttcgcattaacgatatattttcccataggaaacctccataaaaattctaattccttttagtaagcataccaaaataccagcgatgactcaaaacaaatcatcactggtatttttaattgatcttacttatccgccttttcgttcttctcgtcacgcggatcttgaatatgattatcttttagatactttttaaacggtctgactaaatggtacgtgtgaacatcatttgccgtaaatcgactaacatgacgcaaatcatcagctgccttcacagcagcctctcccgtcactgtttgctcacggactaccagcaccggtcgccagccaaatttggtctcaacaactgccactcggcccaactcgggaaaaccgtcaacaagttctgacccttcattacctgtctttttgccgattttccagaaaaattcatggtcggttgccaacgtacgcttgccatcttcttccagtcgaatgtgcaatccgccgatcactcgacgcacttgttccttcgactctttcgatttctttggatgctgctggttactctgtttctctgaaattgtcttcttatcagccataatctctaattcctttgccttcattctttttcttagaattgtaagcaaactcaatcatctcaatttgctttacacactacattttaatgatactatcatcgatttacaatttccaattacaaatgattacaaaagccgtaatatgcggtttcgggtgatagctgctttgctccgcacactttttaggactgctccgtcaaccacaaacctgcatataagccaactgagctcaaattccaaaaccgggaatttaatccgagtcaccttatactccggtttatcccaggttggctctgcacacttctctaggactgctcctcaaagcatcgttctgcatgtaagggatccctttcaaaaatccaaacccgggatttccgaaaagaacgccttacactccaaacgataaccgctttgctccgcacacttattcatagctcaagctttctattggatccaatcttgctgcctttcctgctggtgccaaagcagccagtaacgaaatgacaattgagattatcagtccgaagagaatattaccagtagagatttgcattatctgataattaatgccggattcggcaatgtggttggcaattgcagccagtccttctgccaaagcaattgcaagtaccgacgagaacaggccaatgaagaaagcttcagagaagaacagatttcgaatactaccctttgacgtccccaacgcacgtaaaataccgatttctttggttctttcagaaacactgatgtaaagaacaacaataatcatgattgctgataccaacaaggagatgccggcaatcgttgccaatacattaaccgctaaattaatataggtattcaacgtgtcaacaaaaccaccaacaccggtaatcatatattgtgccttattcttactgtttttaaaggccttaatcttattttgaaccggcttaacattttctacactgccagttacttcaagtgttaagaaatttggtttaatactaatattttttgacccataaatcgacttcattgtttgataagtaacggaagtagacccggtattggcttttgcaaccccactcactttcaatgttttacttaaagtcaccggtcgtttctgcttatttaacgtattttgatagaaagtaatcttcttaccgattagagaatagggatgctttttatttagctttgcagcaatttccttggtcagcaggatttcattacccttgggcgcatccccccttgtgatgctcttcttcaaaattgtcgggttaaacgtctgcatgaacgaaatagcagctgtctgtttacctaatcgcaactgactgccaccttgcacgtaaaacccgttctgaacatttttaacgtgcttaatcttctcgagtcggttcttatcctttgtctgcatattactcttgttgacgtctgtattatcactgctgacattcttggtaatctgcaacgcattcggatttacctgcgagtatatttcgtgattaatatatccttggacaccatttcccagtccaagcatgacaatcacactaaaaatcccaatcgctgctccgataataatcagaatatttcgtttcaaattgtatcgcatattttccagtgccatttttaaggttgcaccgaattttagagtatgcgtcgttaactcattttcattgccagctttatacggttccttaatctgcttatcttcactgattttaccgtccgttagtcgcacaattcgggtaccaaaatccgcgacagtctgtgaatgggtaactgtgatcaccaatttaccgtccgtagcaatctgatctagcagttcaagaatttcctgtgtgttttgactgtccaaagcccccgttggttcatcagcaataatgatttcagggtcggaagccaacgcacgggcaattgcgacccgttgtttttggccacccgaaagctggtttggaaattttttaacatgttccttcagcccaacctgttccaacaattgatgggcacgttcttcctgctgcttacgactcaaggttgtcatttcaagagacaccattacattttgaagaactgtcaaatggctgattaaattaaagttttgaaaaataaaaccgattgtttgtcgtcgataggcatccaattgtttgttagtgtcatgtcgcaatgaattaccattcaggacaacatcaccggtgtaattactgtccaacccaccgataatattcatcaaggtagttttcccaccacctgattcaccaagaattgaaacaaactccccttgttcaaatgaaaggttcagtcccttaagtaccgggaactcttcactgccaaggtagtacgatttcttaatatcatgtaattccagataagccatattttcctccgttcttctaaatcgggagatacgtatactcgatgtattgtaccgcgaatacataagtttgggaatagtggtcactgaattttatgatgtcattgttagacgcattaacaactgataagggatccatttcaaaaatccaagcccgggattttcgaaatcgacgccttacactccgggtgctaaccggttagctccgcacacttcttaggactgctcctctaagcaacgttctgcatgtaagggatccctttcaaaaatccaaaccctggattttcgaaatcaacgccttacactccgggtgctaaccggttagctccgcacacttcttaggactgctcctctaaccagcaccactccatataagagatcgatttcaaaaatccaggcccgggattttcgaaatcaacgtcttatactccgggtgctaaccggttagctccgcacacttcttaccattgcatccgtcaccaatttcaattgttggtatacggcagttggatcaaagtaatacattttattttccggcaactgaacaacatggcccgctttgactgccggtaggctcttccacaccggattcgattttagatccgaaattgcctgcttattcgttgattttccactcgttgtatttgtaaagaacagccagtctgccgaatacttcttcaacgactccaaggaaatctgctgaaagcctgcaccttggtcaatcttttgaatagaagcaggcagtttaaatccaagcccggtaaccaacgcttgaccgccacgtccccatttcgcaccatctacaaataatttaccgttctgcatatcataaataccgattgacgttttagtcggattgattcccgctttttttaatcgctgtgactgcttatcggattcgcttttaaatttggcaatccaactccgagcctgcttttgtcggttcagaacctgaccgaacttagttgccgttttttcaatattacccgtcgtgccgtagggaatatacacaaccggtgcaatctttttcaatgacttcacatctgactcattggacgtcacgatcaaatcaggcttcaacttcagcaccgcttccggcttcatcgttaacccaagattcgtgatgccttttttctgagactttgttatatatgggctcgcaaaatcaatggccgttgcacccacaacgtggccgcccaacgacaatacatcccctgtataaacattagtcacaatccgttttggatcggtaggaatttttacttttccggaagcagtccgaatgaccctggtactgcttgccgaccccttattggcagacttgcccgaattttcctttccacaacccgccaaaaataaaagtgccatcatggcaacagccaacaccttaagatatgtatgtttctttttcatcattaatcaaccctttctgaaaataacaagtaaataaaatacggcatggtaaccgctgaaacgactaatccaaccggcaacgctgtttttccaaacgcattggttgccacaaactgagccagcatcataatacagcagccgagtaaccaactggtcggcaataaataagtcacccgctgccctactaattttctggcaatattgggtgccattaaaccaacaaaactaatggccccgccaactaaaaccgccccggttgcacataaaatggcaacgcccatcaacacattaccggccatcttaacgttcacaccaatgccataagcaccacgactccccaacgttaacccattaagtgccgggaccattaagataaccagaataatcaaaccaataccaaacaataattggatcgttaaaaatggcatgcccagattccaaaaactgccattcaaccaaaccaatactttatcaaaatcaaactggttcatttccaattcaagcatcaaaataataccattcaaaactgccgttaaggctactcctgccaataaaattttaattgcggattgttgccgaccaaccaacatgagtaatccggaactggtaagtccaccaataagtgctgccagcaacaaccaggaagacattaaatgaaggccaactgcagccgatacaaacatggcaatcacaacaccaaggctcgcaccggcgttaatgccaaggatactggaatctgccaacgaattatgcgtcaggatttgcagaatcaaaccgctaacagccaactcaccacccgtgataatcgatgccaataagccggggaaccgtagctgccaaacaacaaaattagtggtgaaatcccgactgagtccaaacaaagatttcatgacctcaacgacatttaatttaatgtctccaaatgacaaaactgccaataaaagcccaatccaaatggtgcaaagaatcataaaagtcagtactaaccgtatccttcttgtcatttcactaccttctttttaaaggccaccaatataaacaaaacgatcccaccgacaatggcacttagggccgataacggtaattcaacagaactgaccgctgctttggaaatcaaatcggcaaacagcataaaaatgccgccgcacagtgcaatcggaaaaacgttggctttgaatgaaccgggatgaacaaaattgaccatttggggcacgcccaccccgacaaacccgatgttgccacctacagctacggaactaccggcagctaatacgattaaagcaattgcgatccccattaattttttaaaagaaagtcccagtccaacggttgtttgatggtcaagccccaacagcgtaaattcggtccgaaagaaaaagacactgcccaccaccacaatcgcaaccagaaccaataagccgacctgttcataattggcaccgctaaaaccaccagccagaataactcgaaattgttgagtgttgttggtcataaaactgactgccatcgatatgctactgagaaaacctgaaaaaatagtgccgccaagtagtaatcgaagtgggctgaatccctttttgtttaaggaaagcccgataacaaccaagaacgccaataatgcacctataagcgccagccaaaaagcattaagaactgtcaatgcaagtccggctaattctcccgcaatcaaagccaaatttgcaccggcattaacaccaatgattgacggatcagccaagggattatgtgaaattgtttgcagcaacaaaccgccagtcgccagtaaaatgccaaccagcattgcggccaacactcttggaatgcggacatcccacagaatttgtgtggctaattttgaggtaggccgccaaaattctgatataccataccactttggaccgcccaaagtatccagcagaaccgcaaaccccaacgccagcagcaggcaaccggttaacactctttttttatgaaagatcatgatggcattgccagcgtatggcaattcatgatttgtgggcagccatgatcatgaagaatatcaccatcaactttaaacacatcagctaaaatggcctttgttataacgtcaatcggtctgccggttgcctttacatgaccatcaaccagacaaaccaatcggtgacagtaacgggcagcttcatttaaatcatgtaacacaataatgattgttttccggaacttggcatttagttcctgtaacagatttaaaatctcaagttgatttgtcagatccaagtatgtagtcggttcgtcaagcatcaagatacggctgtcttgagcaagtgtcatggcaatcaatgcccgctgctgctgaccgcctgaaagactggtcagcagttcatccgcctttgaggtcatgtgaactgcctgaattgcgtcattaatagcttttcgatctgtttgtgacagatggtggaagccacgttgccgacaatagcgtccataagaaaccaattcaaaaacagtaatcccatccggaataactgttcgctgcggtaaacaggcaatctgttgtgcgcgttggcgagcactgaaccttgaaatcggctttccgcttaaagtcaccgttcctgaaattggcgactcgaaaccattcaacacattaaataaagtcgacttgccgcttccgtttggaccgattagtccggtaatctgaccctgagcaattgaaatgtcctgatgatcaatcacgactttatgtccataccctgctgttaaatcttttgctgccaaactatctgtcatcttttcagcccctatattttagaacgacatcattatgataatgattctaatttattaaaaagtaagaggggatccgacaaaataaagctttgccaaatccccccagaaatcaatacgctaagtatacttgcggattattaccattgtcaatatattttttaatacaattagaataaaattcataatgtttttacttgtttctgttattaaaaaggctcttacaacgttttcattaccgttgcaagagcctttttaaaatattccattactatcagatgtctgatttaatcattaagttcggaaattcagtgtttaatttaatggtgctgttgattgcattaactcaggtggccataatgccaacaagtagccataaccatcttggtcaaacgttaagctttcaaactcacgttttgaatcaaatgcttgatagtgaatatcatcagcagtgaagttactatcccggactttttcagccggaatagacgttaaaatatcatcggaaacaaagtaaacccgatcattctgtgggttataactcatcccttggttggtgttaccaccacggtttccaaccatgttttgtgaagcttggaaagagacaccgttttcatctaaacgaccatagaacaagatatatcccttgccatatttacgaccccagtatgcattaccactcttatcaaacgcaagtgtatgcaactgaaggttggcactgtcgccgtgatacatcttgaagttatattcacgaattgggttcaacgtattcggatccatttcaagaaccgtgttgttatcatcacgtgtcttcaaatcggttaacgtgttatcttcagcaagataaatgtgtttgttttgtgggttgaaagccaatgtctgaccatgacctatgtcaacctctggagacaactgtgcggtttgagcgatatcaacatacttaaacatctcaggattttgtgccttaaccgcatcaacctgactttgataagtgttgatctggttttgaatggatgtgatcttcttgttgtagttggcaaccttcttcttatgcatctgatatgacttcatccattgtgccatcttagcagttgcctgtttaacaaccttcttggccttttgcttggaagcataagaatacttggcagatttcacaattttttgattcttagatttcttatttttccagtaataataccatttttgcgcattattctggtagttattctgattattctgccaagatttattctggttaagcgtattggttaacgtcttaatctgatcaaatgaccctttcatttgattgtacgcatcttcgtattcctggttatgtgccgttccatccgttgtgtaagggttaaagtaatcaaatgcttgccacaaagctaaaggatcgttgttgacaccgagctgctgcagcttagccatattaaacttaacgattgccccttggtttgtattggtaccattcgattcaacgaagtaaacgtttccgctatcatccatagtgacactttggaagttaccgtgttgcaggttggaaacgttaaaaccatctggtaagaaccatttggtcttaaatgtatttgattgcgaactacctgaaattgttgaataggagttagcatagttatagcctgatggatcaagatcatacttcgcgtatttcttcgacgtattcccctgaggcgtatcattattaactgtgttaagagcctcttcgtcataatcttttaacacgttaccggcattaacttgtttgattgagccagccgagccgggtgcatcgataacgtcagcattggcgttagcagcgattccgaatattccggcggacgcaaataagagagctgtcattacagcaaacttaaaatgtcccttcattacatatccccaccttaatttgtaaaataaaaaatacatgactcacattcatttataacgatttatcagaaaaagtacaaggcttatgccctcgttttcactgaaactcaataaatgtaacgagcaagtaactatagtgtaacatttctgaagaaaagagtgcgacagaaaacgattagctcccagaatataagcgatcaaatcgaatattctgggtttgaatattggatttgattgcttatatggccgggagctgttttttggcgcacgtttcggctaggtaacagtgatcaactaatattctggacttgaatattggatttatttacttatatggcagggagctgttttttggcgcacgtttcggctaggtaacagtatcagtggcctacttctctcctttcaaggaaaccgcaatatttctactaagaagcaccaattgcatgaattcggtaaaggtataattatttggatcaaactttccatgttcaaccgtatgtctggagtatggcattgtctgtaaatgataggagttaaaatcaaagaatttgtataaccccgacaaaacatccaattcattcaactcaagtagccggccaaactgcttatgccgatccgttttgatttgctcgtttatccgtttaatctcatttagagacggattatagttccaggtagccgttcgcgactgaccatatttttgaacggttaccatttctagaattgaaaacagcaaattaaacaaaacgatgtaattatcgtgtgcttggtaaatcagtcgtttaacaattttaatttgtttggcatgaccattatccaaagaagccgccaaatcatccaggttttgattaagtaagttgtgggaatcccgaatcaaggtatcgacaaacacttgattcagctcatgatcatcaagctttaagagcctgtcgatgcgctcagagttcaatggcatctggtcaatccatgtccaatgaagcttggcaatccgttcaaaaaattctttgtgggccggatatttatcttcaagctgcttaccattttcacttgcctgtcgaaaactatctaccaaccattcaggaccgttaaaatcaattgacttaccatgagactgcaccttaaacctgtgctggttgccgtttaattttgtgttggcaataattttccccggcttactgttatcaatttgttgctgtatcttacgaaattgtgcggagaggctccgcgttgattgagtcgtcatccttttcactgccaatcatcgagatttattactttcatcatacggtaccccggtgactttagcaaaggaattacttttcgaagacagcccgcattctcgtaacggttcgcctaatgtcgttgctttgggcaatcatggaaataacagacgcaccagccactcctgtttgtggcaattcagaaatgttttcctcggtaatcccaccaattgcaacgacaggcaaccggctggactgaaccagcttctttaaaccggctatcccaatcaccggatcggcatctgcttttgaaccagttggatacacaggaccacttcctatgtaactaataccctcggtttcattggcaatggcaacctgctcttttgtatcacaggaaagcccaacaaacattgttgtgccgacttgttgaatcactttcgttacccgctcgtctttttggccaacatgaataccgtcagccgctgtttcaagtgccaaatcaacatcgtcatccacgataaacggaattttgtaggtttcgcaaagcttccgaagtgtatgcgccatatcaacctttttctcttccgagagagatccggcgcctttttcacgatactgaaacgcggtaatgcctgactgtaaagcttgagtaagtacctctggtaacgtcagatttgactttttaatatcttgtgtgccggcaataaaatacgcccgtaacataccgactttaaatgccattgccatcagtcgtcaccctctttgtcaatcttggcccagtgattcagcggcccatgaccgtgtcctacctgaatgccgtttgcaatagtagcctgaacatatttcttaccggtgcgaatagccgtttcaacatcgctccccttcgctagttcagctgtgatacatgaagagagtgtatctcctgttccatgcgtccgcttagtgtcgacccttggtgaactgacccaaaaggaatgaccggtttcaagcaaaataaaatcagaggattcttttgattcaacctggtgaccgcccttaatcaacacgtttttaacacccatgctttgaagctttttagcggcctgaatcatttgatcatgatcattgattttcatgccggccaattcttctgcttccggcaggttgggcgttaaaatatcagccaacggcaatagcttttcacggacagtgctaatggcatcctctgatagtaaacgtgcaccacccttggcaatcatgaccggatcaaccgttaacggccccaaatcatacttttttaaattttcgacaactgcttcaacagtcggcacatcagccagcataccggtcttgcatgcccggatttttaagtcatccgctactgatgcaaattgctcatcaatcattttctttggcattgccataaagtcctgaacgccaattgtattttgcgcagtaaccgcgactaccacagccgccgagaagacatgacgttcctgcattgtcttaatgtctgccataacgccggcgccaccgccactgtcagttcctgcaatcgtaagagcttgaaccgtttcgttaaccatttttatttctcctttgcttatccattcttcactggttaaagatgtgattactcaaagtttgcatacttttcaaccgttttcgtatcgattaaatgcaactcgtcaattaattgtggtccaaatgaaccggcaagcggcttgtccattgctttagcaacaacttcacccgcaacatcaaaaaccacaacggctgtttgggcggcttcaaagtaatcatcttcaactcctacaaaacagccaattgtacttgaaagcatatcaccggatccaacatgcaatttgaataaatcagattcattgaacactttaaccaccgcatcaccatttgtaatgatatcggttttcccactttcaacaactgtgcaattgtatttattcgccaactttttagcaatttcaaccaaatccccggcaccttcaccggcatcaatccccttagcgttccattcaacacctgccaaggcagcaatttcgccagcattgcctcgaataacgtttacctgcttttgagcaagcagctcgttacaccgttccaaacggtattgcacagcaccaacggctacgggatcaaccacgattggcttatgatattggttggcaaacgtcattaccgtatcaatttgagtgagctgctgctcggtaaatgcacccagattaattgtgaccgagttggccattttaaccattgcttcggcctcatttttctcttcagacataattggcgaagcccccagtgcattaataccgtttgcaacgtcctgaacggtcacaaaattagagatgttaaaagcaattggatttttttctcgtagtgtatttaataaatcaattttcattatatttctccttaaaataaaataggaccgcgacaattcatcattgcctgcagtccaaagttgttcacgtatagagttgaattaagtgatggcagaatactaggcaaccatcttaaacgtgccccatctcaaaaataccttaaaatttcggatggttcacaccctcactgtcactttccctacgcaagcattgtcttacaggttccaagggaccagaccgaacagatccatctcaaccgcttctggcggcacccctagtgttgtgcttaatttaagaataattgatatcgctttcctagtcaataaggacaagaaaaaagaggatccagcaaggcttgaatttgccacatccccgaattcttcccctcagaaagaaattcacatttttcctttacatatctaacatcatcattttcacatataatgaagcgctttgcaaataaataacgtacaaatttaattattttttggggctgattccgggtgctaaccggttagatccgcacactatcttaggactgctccatcagccacaaacctgcatacaaaacaatcgccacaaaattccaggaacgggaatttcctgccgcttgctttgtaccccggcttgtcccaggctgactccgcacactgtctaggactgctcctcaaagcagcatcattcctcataagggatcaaattgaaaaatccaagttcgggatttcccaatttgacgccttatgctccagatgctaaccgctttgttccgcacacttaccttaggactgctcctctaaccagcaccactccatataagagatcgatttccaaaatccaaacccgggatttcccaattgacgctttatgctccggatgctaaccgctttgttccgcacacttattaggactgctcctcaaagcaacgttctgcatgtaagggatccatttcaaaaatccaaaccccagatttccgaaatgaacgccttacactccgaacgttaaccgctttgatccgcacactacctattaaacgccgtctgtttattcaagaccttttgggcatatttactaagtgcggtcagtaacgaatcgaaacatttatccggtaatacttttctcatgaatagtatcggcttggcgcctgcccctcccgcataacgtgttttcggtcgccttgaaaaagccgccctgtcaaccatcctggcaactaccctgggctcagaggcaaacttataggacagggagaaaaagtctgctgatagacgtgccagcttttcataaggcccctcagctgccttttcaaccatttttccggtagcggtatctttccacgaagacttaacagcaccgggttcaatcacgacaacatctataccaaacggcttcaactcaagccttaaggcatcactaataccctcaatggcaaatttggagcctacataccaacttccaagtaaattgtaaattttaccatcgatcgaagaaatattcacaattcgaccgctcttttgctttcgcataaatggtaaaacagcctgaatcattttcatcgcggcaaacacatttactttgaactcgtactcgccttcagccaaatcaacttcttctgccgggccaaaaacgcccaacccggcattattaaccaaaacatcaattctaccggtttccttggcaatttgattaacaacccgatccacttcctcataatccgttacatcaagatgacgcgtgtgaattcccaagtcatccaattcgttcatttggtagacttttcttgatacggcataaacttccatcccgtttcggtgcagattttttgcaatctgcttgccaattccggatgaagcgccggttacaatggcaacttttcggctcataagcaatcccgtccttccattatctgaatccgagtaacgttgagtgatcaactttctaatgctttaattatatcaccgttgcatgcttttcccatcacacgaagccttccgctaacccgaaaaatatgatattatttgtcccaatttacaagccaaggggcaattcacaatggcgttaatcaaatgatgatccatgatacttgtcgcgtagtcaattttccagtacgattaacgctgtagttgttagtcaaacactaggaggctttacaaatgtcattaactgatacgtataccctttcaaacggggttaaaatccctcaagtaggttttggtacctggcagtctgcaaacggcgacgaggcctatcacgccgttttagccgcattaaatgccggctatcgccacatcgataccgctgctgcctatggcaacgaagaaagcgtcggtcaggccattattgatagtggtgtcagccgcgaagaccttttcgtcacgaccaaattatggaatgccgatcatggctacgaggctaccaaagaagcattcggccgttcactcgaaaaattacgtttggattatgttgacctttatctgatccattggccaaatccaatcgactttcgtcaaaattggcagcaagcaaacaccgactcatggcgggccatggaagaattttatgcaaacggtactgccaaagcgatcggtgtttccaatttccgtgaaaaacacttggatgcgttgctggaaacagccaaagtaaagccaatggtcaaccagttgtttatcaatccgtcggacatgcagccaggcgtcgttaactacaacaataaccatgacattttaaccgaagcatacagtccactcgggaccggtggtatttttaagattcccgaattggcaccgattggccgaaaatacggcaaaactcccgctcaggttgttttgcgctggtcacttcaacacggattcctaccgctgccaaaatcggttcacgaaaagtacatcaaggaaaatgccgatatctttgattttaatttatccaatattgatatgaaaacgatcgatgggtttcacggcaaggccggtttggcaatcgatccggataccgcaacctggtaatcgtcatttttaataatagccttaaataatcaaccgttacgaaaacccgattccccattcacatcgaatgaaaagaatcgggctttttgtttttattaataacctcaataaagcacaagcaggtgcgaaagccccctactgtgtgctatgatacttaataactatagatataaggaaggtttcatgtatactaacaaaccacaagttcacgttgaacaaggtgaacaattaaaattaacaattaaacggctgggcatcaacggtgagggaatcggctattatgaacataagctggtcttcgtgccgggtgcacttcctactgaaaaagtcgttgttgaagtcactgaagatttaaacaattttattcgagcagacttaatcgaaattctaagaaaaagtgaagatcgtgttcagccagtcgatgattatgccaatgaagtcggcggttttgaattagaaaatctggcatatccaaaacaacttgaatttaaacgtgatgtcattaaagactcactggaaaaatacaagccagcaggctatcgaaaatacaaattgttaccgacaatcgggatggatgatccaatccactatcgaaacaaggccacttttcaaatcagaaacgatggtcaaaaggtgattgccggattgtacaagcatcgcagtcacactgtagttgatttaaagacgtccgctttacagtacccgctcacgatgaaagtcatgcgtgccgttgttgagatgatcgacgacttgggaattccggtttatgatgaagaaaaaaacgccggcattatcaaaacggtcgttgttcgtgccgccactgcaactgatgaagcccaggtcacattcattacgcagagcaaaaaattacttaaaaagcatcaattgcttgaacgcattgatcacgatctgccagaagttgtatcggtcatgcagaacgttaatccaggtaaaacatccctggtttggggtgaagaaaccattcatttggccggcaaggataaaattaccgaggttctaaacaatttatctttcgatctatccgcaagggcctttctacaagtcaatcctgaaatgacagctgtcctttatcaagaggcttttaaagcattggagctctctggtaaggagaaattagtcgatgcctattccggggttggtacaattggtctctcggttgcccgtcaggttcgtgaagttcgtggcatggacaccattaaagatgccgttgatgatgcaaatgccaacgccattaagaatgggattgtcaatgcactttatgaagtcggtgaagctgagaagctactgcccctttggattgaagatggttggaacccaaccgcaatgattgttgatccgccacgaaccggattggcagattctctaattgataccattctggatattacgcctaaaaagttcgtgtatatttcatgtaatccttcgactttggcgcgagatctagtaaaattaactcggaagtataatgtcgaatacattcaatctgttgatttaatgccgcaaacatcacgatgcgaatgtgttgtcaaatttaaaaagaaataaccttttgaaacaccattaagaagggagactaccatgcaaaatccattcgggaatggtaataatgataacaatgacaataacgataatgacccacggaatttaattccaatcccgcctaactttgcgacggtcgttaacaaagaaaccggtcagatcaggattgcaaaggttggcctttcattcacggcactcttcttccaaatcctggtaccggtctttcgatccgattggtataatttcttctgtatgctgggcgttgaagtcattgtcggtatgggattatcaatgtatctggttcaaccgctcagcattaccttttataccggtgaatattttctcggcgttatctggatgcttatttacaacatgatgtactttaaacatctgtttaagctggggtatgcgcctgcagatcagcgttcaaaagaattgctaatcagtgcccgctatcttaaggataaaagtgacaatcaaaattaaaaaaatgacgtctagtcgtatgattcaatacgactgcacgtcatttttttattttcgaggtcttaagaaaaatagtttgtgctttttctttggcttttctacggcaattccctccttaaccaactgttgtcgttcctgcacacgcttctcatcaatattcggtgtttctccctgctttacttctgccttgggaacccctgccggaattcgatatgggaatacccaaagtgccgtcacaaagaagcgaccaatcaacccgatgatcggcacaaagaaaacgccaataaaaattaacacgttaatcacatctgaatagagagaccgacgatcatgccgaagcacccgagccaatttcgaatccggccggtgaatcttcaataactccctcaccagaatttcaaacgaaacactccacattgtgaaaataaagacgtaggccaaattaggcacaacatcgaaaggatgctgtccaacccagattgtcactgccggggacaacgttaaccaaaacagccaaaatatatttgcccaaacaactttatcgttaacataatccgttaactggaacagacgatgatgagccacccagataacagctacgaatccaaacgacacaacataggcaaagaatatcagtcgaactttccacaacgattgccacgttggcgcgtccggaatttgaattgtcagtactaacagcgtcaacacaattgaaacaaccccatcagtaaacgcttcaagtcgagactttgacatttgtttacgcttcccctcattaaaataacatttgacagtcaactatccctatcaagaaaagtatactcgaaaacaagtcaaatgttatcccaccacactttctctcaatttttatacttagaacatctaccagcccgttacaatcatcggatttctcactattcggttgaagcatatgccaaatcaaaattttcggcatacaaaaacagcagccaaataatcgaaatattcggctgctgcttttatgagatggagcaagatcaaacgcacattccaccatacgctttaaatctttgttaatttatatgcccttgtggcatcaattgctgctttccatcctctatacaagcgatttcgtcgattctcatccattttcggttcgaattgtcgtcccggttctgccaatgcttttacttcatcgatatctttccagtatccgaccgctagtccggccaaaattgccgcaccaaatgccgtcgtattttcatcagcggctcgttgaatcggaatatttaggatatcagcttgaaattgcatcaggtaactgtttcgagaagcaccaccatctgctttcagagccggaatgtgcatgtgggtatcttcttccatcgtttgaataatgtccttagtaccatatgcaattgattgtagggttgcctttacaaaatcatccttggtcgtgccacgggtcagtccaaagacagatccccggacatcctgttcccagtatggtgcccccaagccgttaaacgccggaataacataaacttcgtcgtcatcggttgaattcattgctgcctgccgagattccgggacattatcgattaatttaaggctgtctgccagccaactcaaggccgttccggctgaaaagattgatccttcaagcgcataggttactttcccgccaatgttataagcgatggtggtcaataggttatcatccgaaagttcaggcttggttcctgtgttcatcataataaaagcaccgtcaccataagtatttttaatcatcccgggatcaaatgccaattggccgatcaaagccgccgactggtcaccggcaattccggcaatcggcacttcaataccgtagaattgataatttttagtggtgccataaaattcacttgatgttttaacggttggtaaaattgcccgcggaatattcaacagtctgagaatatcgtcatcccaacgcagtgcatgaatattgaacaacatggtacgactggcattactataatccgttacgtgatattcgccaccggacaatttccaaaccaaccagctgtcaacggttccaaaaagtaattcacctttttcagcccgttgctgggcaccttcgacgtgatccaaaatccatcgaaccttggtagctgaaaaataagaatcgataattaatcccgtctttttgtgaatcaaattcgagtagccgtcattttttaattttcgtgccagggatgccgtttgcttggattgccaaccaattgcattataaatcggttcaccagtctctttatcccaaatcaatgttgtttcacgttgattaacaataccgattccggagatatcttccggatgaataccggcatcaataaaagctgatgaaataacattaagcacagatgtccaaatttcatttggatcagtttcaacccagccattatgtggaataatctgtttaactggcttgaatgcctcaatcacctttcgaccattatggtcaaaaatcattgctcttgtacttgtcgtaccttgatcaattgaaagtacatattttggtctatcagtaagcatctaattccctccgatcgtcggaaacgatttcattattatgaaagaatagtaccataaatcgcaccgaattaactgtttgacaatctcattcccctaacaaaaaagcacattatgaactataccataatgtactacttagttcaaattgcctagtaattaatgattataaagaatcagagaactagaccaattatcgttttacatcaacgtgaatatcatcaccgccgtcgtttagcttctcgtcataactaaagttagcgtcggtaaagtaatgcttgatctctttattaacttcttcaagcggtcgatgatcaccatcttggcgattaatcacaatttcgtattcctttttatcatcatcggtgttaacaaatttatagattacatcgacagtgttcaaaatctcttggattaattggcgttcagtcatctccatgtccatttcacctcacttgtatcactatatctccactttagcgctaattgggaaaaagtgatagtaaaagttgcaagattagaattttatttgaataattgtatttacattagtgtcaatactgaactatacttgaggttatcaatcgaggtggaaatgatgacaattgcgtcaaaaaatttttcaaacgaattaattaatgcttataaaagtcaaaaattggttatgctggtaaccgacagcggccatatcacaggaaccgttgcagcagttaaagacgacctggcttatattaatcagccggtcaaaggagtaactgccatcaatttaaatgacgttaaaaaggtgcaggaactgaattaaccgatttaaaacttaacaaccgattattgtgaccaataagaaataccctttctccaagcaactcaacgttgtctcagtgaaagggtattattattggcattatttgccattaacggtcgcatccttattcgatctcaattatgcttctcatatagaatctgctcaaacttttttcgtaagccttccgtcaataagataatattctttggctgtcgataaacccccaggtcaaagcaaaatcttagcggtacgcccatattataatcttcttcaaaagcagcgactcttttagggtcaacatggtcaacggtccccattaaaatcgccattgccttgactttatgtgcatcccaattgttttgatcctgatgaatatccaacaattgtttagtgctaactgaatcaagtgctttgactaacgtatcggcattgctgatcttgtgctggacacctagaaagacgaaataccttcgcataacaggaataactgaagaaaaaaagacgttagtggccgcaatccttttaggaaataactccaacaggactttcctcaccaatttagcagtataacgtcgcggttcccgcaactcgtatttataggctaaaccaacaaatgcctgtgtaacgtacaacgcagctaccttttccggtttggtcaacttttgaaatgaacgggtggttttaaagcgaccaacccaaaggcgatttttttcgagatttctctctgcttcgacttctgaatacgctttttccacaagatcaccttcttactctaaatgttaacatgattaactacgtaaatgaatcaattagacccggactatttccaaacccaagggattattatacaataaatcgtactgaaacttttgaggagattttaaaacaaaatggctaaaattcaagattttaatcaacggtttaattacctatgcctttccattgtgattaattcagcaggaaatgcattggcaatttcaacaaatttaggaagtgccgtatggacggcttcagcggttaacctttccaaatgggttaacattccgcttggcacaacccttttcctatatgggattgttgtcacaatcgttaatcaactgatgatcgggtcatttgatcgtcgccgttttgtttccaacctactatatacagttccctttagttacctggttcaattttctcaatggattttcgattcgttgggcgtgcccacctatagcttttggctgaggcttatcctggacatgattggcctgttctgtgttgccatggccgtctcaatgtattcacgggccaacctcatcatgcatccaaatgatgatatggcatacattatcaggtttaaatacatttccggaagcgcggtaacatcgcagtggctcagctatattccaccggttattatctcaacattagcttatctttttacaggaaaagtatttgcgatcggttttggtactgcctttgcattaatcttccaaggcgccatgatgaagtggtccgacacccatgcgtttccaaaactgaagcaccatgttgatctttgacaaacgtttgattaacgaatcatcactgctatttagccgaaacgtgcattaagaagcagactcccgccatataagagacgcccaacaattattcaaaaccggaataattgttgggcgtctcttatactctggaatttaaccgcttcttaatgcactctgtcttttataaacctcgcaatctccttaaacgtcttttttgtttcaggcaacttaaaccacaacgtataatcatgaaaaccatctttaaaggtcgttacttctacagatgctttatcagcttgcttaagtgcctggataaattttaaattaatcggtgtcaataattcattttcgccataaaagatttgaattgatccgatattcagattttggggatcaaatacgtcaaaccagttatcctgattcaaaccaacttcaaattgctgtccgatttggcgaagcacacttaatgatagcatcacatcttcgctttctttggcggaaatctccggatccttaagctgcatatccagccaaggagaaatgaatgacgttccagctattttagttggattttttattaatagctgtagtgcaatcgcggcacccgccgaatcagccacaataaatgttggcagctctgttgaataaacaatatccaaggcttcttgggccgattctaatatttcagttgacgaatgattgggtaataacggaaaatcaacaatttgtaccaagctgttggattcgatagcaattttagtaatcatttccagttgatcagtgttcattggcactgtaaaggcccctccgtggaaatacatgatctgattatccggattatcggtaggcgttagtgtgactgtttgaccatgattcatctgataaatttttatatctttacttttatccgtaaagatagtggctttttgattaggatgaaggaaactatgattaacagccactttataattttcttttttaaactttttgagcagtctttttgccataaaactcattgtaagcacttcctaaaaatagtttttatgtaataaatgtgatatatcacataaatgtccatatatgtttcctaaaaaaatcgagaaattcacaaaatcttcacaaaattttcactatttggaaacaactcatctatatagttatagctgttgcatgaggttaaagaaatcactcatgccgcaataaattaaatccccctttaatttaatttattacttttgtattcatattcttcccctagaatataggtatcaggataagacatccccgtgtcttatctttttgtttacatagaaataagtgtgcggatcaaagtggttagcattcggagcataaggcgttcttttcgggaatcccggggttggatttttgaaaagaatcccttatgtgcagaatgctgctttgaggagcagtcctaagatagtgtgcggatcaaagcggttagtacccggaatataaggcgtcgatttgggaaatcccgcttttggatttttcaaatcgatcccttatatggagtggtactgctttgaggagcagtcctaaaacagtgtgcggagctaacccgggacaacccggagtgtaagctgacaggcagcgaatccccgctcttgggatttgatggctgttagtttacatgcaggtttgtggttagcggagcagtcctaagccaatgtaagcgtatcacgttccgacatattcttgccactttttgctaaaaatcaacttcttttgaacaaagtcaattaaatgccaaacttttaaagtcttagaagagttgatacatcaagtctttcattgatcttcacactttcttcacattttgagcataatttcgttacaaatttatagtacattatagacagtaaagagatgtcaaagagcccaataattatttccacataaaatgaatttcaggttgttttggcttcactttcatttccccctcaaattaataaagatattagcaaggaaaaggtgcccccacaccttttctttttttgtctttaaatttcacagtctttagcacctttaagtttaaaatttcaagtcgttttaaatggtcttttcaaattcttaaaaacattgatgaagaaatcacaaaatattcacaatttcgtccttttttggttaaatttatcctgtatattaaaagcatgaagaagagatagttaatatttcttctccccccaataggtgataaattaacccccattaatttgttacttttcatattcatattcccctcagaatattgatactacgaagtcaaggccccccagccttggctttttatattgcctaaatcacactcgggtattatctcgcctttttcagataccttaattcgtgatagagtgaaagagcaattaatcttaataaagaagtgaccactttgacctttaaagcaaaataccaatcacgttttaaaaaacactatcaaaacatgattcgtgcaaatcgctattccgaaaaagaattcaaagcaattgaaacggtactcctgagcggccaacatcccgatcaacggtatgatgaccacgtcattaaaagtcgcaagccgcaacgcgccctatttattaaaggcaattggctgttaatatacgactacgaaaacgacaccgttcgctttttggatacaggcaggcacggcgatatttaaaaaacgtctcagttatttccttaaattaggaaatcagctgaaacgcttttttgcctatacatataatacttttaaatcacccagactcacccgaccattcaaatacacggttggactgtccggatttccggttttggtttgagcttcaacaccacccaaatacggatcaatattattaacgatattccaatcatgaggtaccgtaatatcgatgtcgcacatatagccatcaatattaataatggccgagtccccttgaatgttaactttgtcaaaataaatattaacatcagccattgacgcgtgaatatcggcctgcttgaaattttgactttcaatgtaccggttggtatcccccatctcggcattgatatggatataggaatcattatccgtgccggtactatcgataaaatttggcgtatgccattcattatcctgatcaaaccaatgctgccacttcttccagcgctgcttatggatcaccggtcttaagatcagtgagagcccaatactgatcagtaatgcaatccccaagatcgtccaaggtaccaaatgggtaatcccaagtgggccggcatacaacatcaccaaaaatgccaacgaaaagacgcttccaaaaacattcaggctgagtacacacgatcctaaaataatcgccaaaataatggtgacgatgaacgtcatcgcactaatatggaaatttaaccatcctatttccactgatagccatcccaaagctgccaataagaataccaacccggcaatccaacgttgcctaaccgcttttctcatattgttaccttcttctctctaatttatcttttaaaaccttataatatcgtctggaaacataaacttgttttgacgaattttgaaagcgaaccacaatgctcgagaccgaccgggtcaatgcatatacttgatttgaattaatgattgccgatttagagattctcacaaactgccctgttagcagatcttccagttcgtacaatcgataacggatcacatactcatcatctcgggtgtgcgcgtgaacctggcgtccatccgtttcaaaaaagaggatgtcatttacatcgagataatattccgaagttccttttaaaaaaacgagtggtttaatctgcccatacagattttgaatggattgatacaggctctccgtttcagcatcgtaccgaggcgcctttatcacaatttctttattttttaaatcaccgtcgatttccactcgaactttcattttgacatcccttcttcttacaatttattacaccattataagcaattcatgtaaatacaagttgtttaagtggttattttgcgtgtctaagtggtcatattgatggtcacaatgaaaaatgaccatcaaaaaaggaagccggtcaagctcaatttaaccagcttccaaaaaatgacatattttgaaaataattgtccgatttttagtgaattccaaattcaaaccacgaatgattattttcaccctgatcaacttcaaacgtatattgatgtccggtattaaaccgtccggaatccaatccccatgcaacattaattgctgaatggaaaagtttgaaatggtcgcccttcttgacagtataggttgcaaccttgtaactgttcacttggggatcgatgtttcgaattttaaagaccttgattgttttatttagtgttacccaatgagactcattccaatatggatttgctggactgtagatactcattgcctgacttgtaaccgggaccaaaacgattaatccaaaagtcgctatcagcatcgtaatgcttacaaatgtcttattcattttaattgcctccaaacagtgaacgtgttggcacagttaatgccaagtcagtgcacgattctcaatcacctttattttagagcaatttaaagtgaattgatattgaatgatttcacaaaaaaccagttagaaattgtcgacgcaatttttaaccggatctggtattaagctcatttatttcatataaactgaccaggtaatcaaccatttgagaagacagtgaaaccgcttatctaggcaaacaagtaaactttactctcatatggtcttaatgtcgttccctgatcatcgtcataattactaatcagcattttggcagccttttgttggtcataatctcgggtaacggtttggtcagtgaagttactcataatcaacaatgtttttccctcataatgacggcggtatgcataaacctgatcatcttttggatccaactcttcaaaagtcccatacttaatcacatcagtctgatgacgaagttgaatcaacttttgataatggtagaagacagattctttatccttcaaagcatcctcggcgttaatttccttataatttggatttaacgcataccaaggcgttcctttcgtaaagccggcattttgagaagcatcccattgcattggtgttctggcgttatcacgggacatgtttgccaaatactttagcatcgttggtccatcaatcattttatcctgttcaaccaattctcgataaatgttaatcgactcaagatcttcatattgatcaatactggtaaagtgaccatttgtcattccaagttcttcgccctcatagacgtatggtgtcccctgcatcatgtgcaacgttgtgcccagcattttagccgcacggacccgatacttaggatcatcattactgaatcgtgaaaccgctcgaggctgatcatggttattccagtaaaggctattccatcctttaccatccagagctttttgccaacgattcaaggcaaccttcaattccggcagtttaaccggctgatcattccacttacccaaacgcacatcgggattagggctcaggttaacatgctggaattggaagaccatgttcagttcattactttcaagtccagtgtatttgatcgcatcttccggtgttgacccgggcatttccccaacggtcatcacatcataatgtgagaggacttcatcattcatttgatgcagaaactcatttaaccgaggtccatcagctacaaagtcaagggtggttccggcagttggaacgccagccacatccggcaacccggcaggcttggaaatcagattgataacatccattctgaagccgtcaacgcctttatccagccaaaaacgttcaatatcaaataccgcctgtcgtacttccggattttcccaattaaggtccggttgacccggagcaaaaagatgtaaataatactgtccgcgttctggcacataggtccaagcagaaccactgaatgcctcgcgccaattatttggttcgtgaccatcaaccggatcacgccaaatataaaagtcagaatatttgttatcctttgatttcttgctttcctggaaccattcatgctgatcagacgtatgattaacaaccagatccattaataatttcataccatgcttatgtgttgcagccagaagtgtatcaaagtccttcatggtcccgtattccggattaatcgcacgataatcagcaatatcgtagccattatccttatttggtgatttataaattggatttaaccaaatgacatctgcccctaattggtgaatataatcaagccgctttgtaattcccggcaagtcaccaatcccgtcgttattactatcctgaaagctcattgggtaaacttgataaacaactgcattttgccaccatttgtgtgtcataaatatcctcctaaaattactgtgttaatgattattttacaaaatatgttcaactaaattaatcaaacttcgaatggattaaacgaacagagaatgttgccaatattaatgaaataccacctaccaagaacatgccgggcatcgaatggtcaaccaacggaaagatccaaaaactggcaattgatgcgacaatctgcggtaaacaaatactgcagttaaataatccaagataagagccctcatgcttgccgtttaaggcttctgtcagcaatgaaaacggctgtgtattcatgacaagataagtgatcccaattaagacaaacggaatgattaatagatatttgctgtgaataaagaatattgagatgaatccaattgccccagcagccaatccaaactgataccagaactttcgatgacttggcttggtacgtgattgaaccaaaagcccccacaaaacggctgcaaccgattggatacatgtcagaacgccgaaccagtttccggccgcctgatacccaatcgatgaaggattactggtatgccatacattaagtgaaatggcacccgttgcgtaagtccacgaatataaaatggcaaaccatgtaaagaactgaacaactgaaatttcccaaaaaatctttggtgcgtccttcaacaattgtaaaagaccaggttgatcatccttttgattaacgtcaatgccatgataagccgcgtacttttccggattatattcatgaactttgataatcgtcaaagcagatgtaatcagcaaaacgcccgctgccatatagaatgcaattctaaccgtcaaaggaacttctcccttggcagcaacattgggaatgccgataaaggccaaaacaaatggaattaaagcggcaaccacgccacccaggtttgaaaacgattgttgccatgaccaggccagatccttttggtcttcgttaaccatgtcgccaataaccatcttgaatggctgcatacaaacattagacgttagatccataaataaggttgcaacggccgcaaaccatagcgcagctgccgacccgtacccgaatccaaatgatccggcattaggaagcaaaatcaagacaatcgctgcagcaggtgcaccgattagaagatagggcatccgtctgccaaaccggttccatgttcgatccgaatacttaccaatcaatggttggatcaccatcccagcgagtggcggtaggataaagaagaaccccaacttattcggatccgttccaatcgtttgaaaaattcttcccaattgggattgctgtaaagcaaatgccatattaacgccaaagaagccaaacgtcattgcaaaaatagttgttttgctcaataacggtaaatgattgctgactttcgatacagctttttgcgtgacggtttggtcatcagtattagaagcaattttcattattaaacttccccctttaacttgattcaatcagttataaatgcacaaacaggttatagaataaaatcaaacagtacttatcgaagcgtaagaataatgtataattgagctataaatcataaatggggatgaaagtctattgagagcaaaaatttcagacatcgcaaagattgccggtctatcaaccgcttctatttcacgagttctgaataaccaaggcggttatagtaaagaaacggctaagcgcgtcatgaaaatcgcaaatgacctaggttattttaaagatcgttccgcatcggaccttgctcgtcgaagcaataacacgattggcgttatttacactgactttgaaacgaacttcaatgacctcgttatcaaaaacattatgatcgaagccaagaaacgtcatctggatgttattttaatgattgcccaacagaacgaccccgacggcctgactaaaattgttcgggatatgattgaacgacgcgtttttgccgtccagtttatttccacacatccaagtccccaaatcattcaaatgcttaatcgagctgccattttcccacaggtcattggtgatgcaaccgatcataccgtctcttacgtttcttcggatgacgcggccatcggctacaaggcaacaacctacttaattgaaaagggccatcgacgtattggatttgtcagccccaatgtcatgacagattacgtcagtcatttgcgcttttcgggctaccggaaagccttaaaagaacatggtatttcttttaagccagactggatgtttgaagaaacttacagttatcaaaccggcatccatgctacggcacattatcaaaagtatggtgatatcgatgccgttatcggtgtcagtgatgaagtttcttggggacttttgaacggtttttatgacctgaacgttaacgttcccggtgacattgcactcatcagcattgacggaacggcgttatgtttgcaaacccgtcccagattaacaagtgtcacccaagattttgctttaatgggaaaaactgccattaaacagttggcccccaaaaaagcagatcctcatagaatcacaactgtcacaatcccattcagaattgatatccgtgaaacatcttagcaatggcaaacagcaagcttattgtttctgctctcaacaatcaatcattccaccctcttttaaagtatttcccctagagtaagtttttacgtaagcgcttacgtaaaattattgtatgcccattttaaaatttgtcaaccgccatgccttaattattcgacgtgcaaaaaaatcagtttaactattaaaattgcctagaccgattgctctttcagttaatcaaatggatactgcattcgcaaacatcactgaaaacaatatacctataacatggtatcacctagtcaatcggccacactcagaattgctccaaatatcggtttccagaaaccggtttgcaacaggtgtcatcaaattcatcacccaaataatgtataccaaaagaagagcagccggacaaaatcaatttttgtccagttgctcttcttttatatcatttcaatttttagtcccgtttaatcacggcatcagcctatttggcgacgccatacataacctcaacaaatttagtctaatccgactcttgcaaagatttcatccgcatgacgaatatgataatgataatcaaatgcatcggcaatttgatcttcgtttaatgcatccgtaatctttttatttccttcaaccaagtcacggaattgaatgcccttatcccaagactgcttggttaacggttgaaccaaatcataagcctgttcacgtgtcattcctgaatcaatcagtttcaacatcacccgctgactgtaaatcaaaccataggttaaacccatgttactcttcattctttcagggaaaaccgttagtctttcaataatccgcgagaaacgatgtaacatgtaatccaacaaaatcaatgtatccggaataataatccgttcagcagaagaatgggaaatatcccgttcatgccacagtggcacatcttcatacgccgtgatcatgtgcccccgaacaactctggcaagaccacaaatattttcagatccgattggattctttttatggggcattgcagatgaccccttctgaccggcatcaaaatgttcttcaacttcatgaatttccgaacgttgtaaaccacggatttcagttgcaaactcttccaaactggtggcaatcaaagccaaagttgaaatatagtcggcatgaaggtcacgcggtaaaatttggctcgtaatttcttgtgcatgaatgccaagcgaatcgcacacatattgctcaacaaacggtggcacattggcaaacgtcccaacagcacctgaaatctgccctgcttcaacttccttggaaacggccgcaaatcgacgcttgtttcggttcatttcagaataccaacgggccaacttcaagccaaaagttgtcggttctgcctgaacgccatgtgttcggccaatcataaccgtgtctttgtactttttcgcctgtttggcaatgacatcgataaaatgatcgatatcttttttgataatttcatttgcctgtttgaatcggacaccataagcggtatccaccacatcggtactggtaacaccataatgaacccattttttctcggggccgagagattccgatacatcccgggtaaatgccacaatatcatggtgggttacggcttcaatctcagcaattcgctttgaatcaaatttagcgttcttcttaattttctcaacgtcttctactggaatcttgcccagctttgaccatgcttcatcaatggcaatttcaactttcagccatgcagcatactggttatcaagtgaccaaatctgtttcatctctggtaaagaatatctatctatcataatggttcctttccacataaatattaacacgttaataataccatatcgttcatgttttgactacattctatataatacggaaagcttttgttcgcatttaagcctaaagtcgaacgttgaacgttttaacgattaaaatcattaacattttagttgacattcccgtgcaacttggtagaattaaaaatgctgggttgattcccggcaataaaatttagaggtgttcatatgtcatctattgtgattgttggaagccaatggggagacgagggaaaaggtaagattaccgacttcttcggccaaaatgccgatattaccgcacgctatcaaggcggcgataatgctgggcataccattgtattgaatggcaaaagctatcatttacagttgatcccatcaggtatttttgatcaggaaaaatacagtgtaattggtaacggtgttgttgtgaacccgaaatccctaatcagtgaaattgatcagctaaaaaaagacggaatcagtactgagaatcttcggatttcaaatcgggcacacgtcatcatgccataccatatcctattagacggtctgcaggaaaagaagaaggattccaaaattggaacaaccaataagggaatcggccctgcatacatggataaatacgaacgaatcggaatcaggattgcagatttaatcgataaagacagctttgaagaaaaacttcgcagcaatttaaagattaaaaatgaacttttgactaagatttacgatgccgagccattggatttcgatacaatctttaatgaatataacgcatatgcagatcgcatccgcccatacgtcattgatgcttcctatttaatcaacaacgcattagatgaaaataagaatgttttattcgagggtgctcaaggcgttatgttggatgtggaccacggaacctatccgtttgtcacatcatccaaccctagtgccagtggtgctgcagttggaacaggaattggccctaaccgaattgacaacgtcatcggtgtctgcaaagcctacacatcacgtgttggcgaaggtccttttccaactgaattaaaagacgctaccggcgatcacattcgtgaggtcgggcatgagtatggtgttgtcacaaaacgtccacgtcgaatcggttggtttgacagtgtcgttctccggcactcagcccgcgtatccggattcacccacttatcattgaattgtcttgatattttaacgggaatcaagacattaaaaatctgtgtcgcttataaattagacggcaaggaaattgatgattaccctgcaacactaaaagaactcaataaatgcgaagcagtctatgaagaactgccaggttgggaagaagacatcactcaagcaaagacgttggaagatcttcctgaaaacgcccgcaactatttggaaagaatctcagaattagttcatgtaccacttgctaccttctcggttggcccggatcgcgagcagacaaacgttgtagaaaaagtttggactaattaatagaaaataaaattcaacatgtcagacacatctgggaacttcttgtgtctaacatcaatcaccccgctcatatttcggaggtaaacaataatggaagtttttgattacgaagatattcaattgatccccaacaaatgtattattaagagccgtagcgatgcagatacatcgattaaattcggtcccaaaacattcaagattccagtggttccagcaaacatggaaacggttattaatgatgatttggcaatctggcttgctgaaaacggttatttctacattatgcaccgtttccaaccggaaaagcgtgaaggctttattgaaatgatgcacgctaaagatctatacgcttcaatcagcgttggtattaaagatgatgaatacaaattcattgatgaattagctgaacacaataataagcctgagtacattaccattgacgttgctcatggtcactcggactttgtcatcaaaatgattcactatatcaaagaaaagctaccggatagtttcctgattgccggaaacctcggaacgccagaagccgtacgtgaaatcgaaaacgccggtgctgacgcaaccaaaattgggattggacccggtaaagcctgcatcaccaagctaaaaaccggttttggtaccggtggctggcaacttgccgccttacgcctatgctcaaaggccgctagaaaaccaatgattgccgatggtggtattcgatttaacggcgacatcgcgaaatcagttcgttttggtgcttcaatggtcatgatcggctcactattagcaggtcacgaagaatcacctggtaatgttattagcatcgacggtaaaaaatacaaacaatattggggatcagcttccgaaaagcaaaaaggtgcctaccgcaacgttgagggccgccaaatgttggttccttatcgtggtgaaatctccgacacattgtttgaaatgcagcaagacctccaatcatcaatttcatacgcgggtggaaaagaattaaaagatatccgcacagttgattatgtagtggttaaaaattcgatcttaaacggagactagtctccgtttcaaacagttaaatcacaaaagaaaaagcttgcttatgtaagcttttttttatctattttagtaaatttttcttgacttcaagttaactcgaagttctacaatgagtcttgtaatcaattcaaataacagttaaggagaaatttgaatatgaactatcgacaacttggtaaacaaggcattcgtgttagtgaaattgcactcggcagttggatgacggatgtcagtgacagcgataagcaagacttggccgctcaaagcattaagctcgcttatgaaagcggtgttaacttttttgattgtgctgacgcatacagcggtggtgcagccgaaaggttcctcggaaaaacgctcaaacaatttccaagaaaagaaattgttttatccagtaaagtctatttcccaacaggttccggcatcaatgaccgtggcctatccagaaaacacatcatggaatctgtcgatcaatcattaaccaatcttcaaaccgattatttagacctgtatttctgccaccgattcgacccaaacaccccacttgaggaaacgctgacagcattaagtgacctggttaaccagggtaaaatcctctattatggtgtcagtgagtggcgtcccgttcaaatcctggaagcccaattagtcattcaacgactcggcctgcacccaatgtcagttgttcaacctcaatataatatgtttgatcgttatattgagcatgaactattggatgtttgcggtaagtttggtcttggagtcgttccgttctcaccactttcccaaggacttttaaccggtaagtatcgtaagggccacaagattccagcaggttcccgggccacttaccaggaccaaattcaggcattattaaccgatgataacctggataaagttgaaacactcattaagatggccgatgaattaaatactgacttggcgaccttctcacttgcatgggctttacgtgattcccgcatcagcagtttgattaccggtgccagcaagccttcccaacttcaaaataatttaaaggcaattgatttaacgatccctgatgatgacttcaaacgaattgacaatctgtttcattttaaaaaattcgaacgaaaaatcgtctaatcaattattcatcaaaaaagcgctattcaagacaattcatttgtcacggatagcactttttttaattcatctatcaccttacactccgggtactaaccgctttgttccacacacttgtttaggactgctcctcaaagcagtaccactccatgtaagagatcaattcaaaaaatccaaaaccgggattttccaaattgacgtcttacactccgggtactaaccgctttgttccacacacttgttaattatattgacaaaagcataagaacagttaacattagtacaaagaaagcttccattttttctgatttggtgtaaactaacgggtgtttgttaattatttttttcgcactttggaaactcgaaaggggcattactattgttaaaaatcgctaagggacgaatttcctatcttgcagtccttggggctgtcttttttatggctatccaagtgatcgccaacctaaatctccccagcctaacttcagatatcgttaataacggtgttgctaccggtaatattagctatatctggcaagtcggcttcaaaatggttggtttttcattgctcagtattgcagcagccgtctgcaatgtttttttagctgcaacaacgtcccagaaactcgggaaaaatcttagaagtgatatttatcgcaaggttatcaatttctcaaatgatgaatacgatcaaattgaaacttcttcgcttattacccgaacgactaatgacgtggttcaaattcaaaacgtcggtatcatcatgttgagaatgatgttgatggcaccgatcatgttaattggtgccagtttcctggcatacacaaaagatcaccaattaacaaccgttttcttggttgttctaccaatcatggcactttttattggttttctactatattttgctgtgccgatgtttcgagccatgcagaccaaaaccgataagatcaaccgaatcttccgtgagggactaaccggcgtccgggttatccgcgcctttcggcaagatcaatttgaacagaatcgtttcgaagatgccaacaaagactacacacaaaacgcaatcaacgtcaacgttttaatggcactcgcgtttccggttatgacgatgatcatgagtggtaccaacatcgccattatctggtttggtgccaaattaatcggtgcccagtcaatgcaggttggtaatttaatagctttcatgacatacgcgatgcaaattctcatgagctttatgatgatgtcaatggtcttcattttcattccacgggctcaagcatcagccaaacgtattcaagaagttctaaacctgcattcatctcttaaagttcaagatcatccagttgacgtagatgtcaaagcacctaaacataccttaaaattcgatcatgtcacctaccgttaccgaaatgccgagctgcccgctttaaccgatattgacttcgaagctaaaagtggtcaaacggtcgccatcatcggtggaaccggctctgggaaaacatctttaattaatttgattccccgattttatgacgtcgaatccggtcaggttgaactggacggtgtcaacgttaatcatatggcacttgataagcttcatgaagcagtgtcattggttcctcaaaaggcaacccttttcaccggaacgcttcgggacaacatgcgatatggtaaggatgacgcaacagacgatgacatttggcatgctttggagattgccagggcaaaagatttcgtaaaagcctaccctgaaggtcttgatttgcatgtcgaacaaggtggcggcaacttttccggcggtcaacgtcagcgattggcaattgccagggcactggttaaacaatccgccgtctatatttttgatgattcattttcagcactcgatttcaaaaccgatgcagacttgcgggctgctttgcgaaaagacacccatatccaacaaagtatcaccgtgatcgttgcgcaacgaatcgcaacggttgccgatgccgatcttattttggtactggacaatggcaagctggtcggcaaaggcacacacgatgaccttcggaagacaaacaaagtctatcaagaaattatcaagtctcaaatcagagaggaggataaataatggcccaaaaagacgaatccaacacttcatcgcaaccaactcgtgggcccggtggcggtcatggtcccggtggtccacgtggcgttgttgaaaagccaaagaatttctggaaaacaacagctcgcctcatgcattacatgtccgaccggattgtcggcttgattctggttctgatttttgcgattaccagtgttatcttccaaattagaacacctaagattcttggtcaggcaaccacggaaatttataagggcgtcatgaaaggatctgcgcagcaaaaggccgggtttaacattggcaatctgccgatcaattttgataaaattgttcacattattattatcgttgccttgatgtacctggcttccgcaatctttagttatctgcagcaatttatcatgacgctgatttctcagaaaactgtttatcgattgcgaaaacaaatgaaacaaaaaatgcgccttgttcctattaaatactacgatacccacagtaatggtgatattatgagtcgggccgtaaacgatatggataatatcgccagtacccttcagcaaagccttactcaagcagtcaccagtttggtaaccttcattgggacactctggatgatgttttcaatcagttggaaattaacgctgattgcttttgtcaccattccattaagtattgtggtcgtcggcattgtcgcaccaaagtctcaaaaatactttgcggcacaacaaaagagtcttggactgcttaataaccaggtcgaggaaaattatgccggacaattagttctcaaaagtttcaataaagaaaaagacaccattgataaatttgaagaacaaaatgacaagtattatcaatcagcttggaaagcccagttcatttcaggcatcatcatgccccttatgatctttatgaacaacatcggctatgtttttgtcgccattatcggtggtatccaggttgccaacggcagtattacacttggtaatgttcaagcattcctccaatataccaaccaattttcccaaccgatctctcagttggctaacttaatgaatacgattcagtcaacgattgcttctgctgaacgggtatttgatgtcattgatgaagaagaaatgaaaaacactcatcaaaaccgtccggttgagaagggaacagataacattgtgtccttggaacacgttcaatttggttatgaagaaagcgaccttttactaaccgattacaacctgcaggttaaacaaggccaacaggtcgccattgtcggaccgacaggtgcaggcaagacaaccatcattaaccttttggagcgcttctacgatgtctcaggcggctcaattcgcctcaagggtgttgacaccagggatattgaccgggaaaaattaagatctcattttgcaatggttcttcaggatacttggctgtttaccggtaccatctatgacaacattaaatacggacgtgaagatgccacacacgacgacatcattgaagccgcaaaagctgcccacgtcgacgaatttgtcagaaaattaccggatggttacgacaccgttttaaacgaagcagcttcaaatatctctcaaggacaacgtcaactggttacgattgcccgtgcttttgtcgccaacccggaaatccttatcctagatgaagcaaccagctctgtcgatacgcgaaccgaggtccaaattcagcatgcaatgagcgaattgttaaagaatcgaaccagttttgtggtcgcccatcgactttcaacgattcaaaatgctgacaacattattgtcatgaaccacggctcagttgttgaaaccggaacccacaatgaattattggcaaagaacggtttctacgccgatctgtataacagtcaattttcagacaacgtgtcatttaactaggaaggagacaacaacgtgaaaaaaatatttggacttggttttgcggctgttcttctaaccttagggcttgctggctgcggccgaccaagcttatcagttaaccatcatcaactgcaacctgatgggcttggcgcagttattaaaggccaaagtcgtcatcaaaccatcgactatcgaattgataatggcaagaagcgaaccgaaaagacacacaatggcagctttgcactgacgattcccagcaaggcaactaatcaaaaagttgttttatctgcagatgacacccatcaaactgtcaaaatcgaaaaagctgatccactaataacctattcctcccttcagtcaacatataatcaggcaataactgcaaccgctctttcaaaagctgatcagaaaaaagcaatggttctgcaaaaacaaggtgcaaaactaaagcaacagcaacaagccattgaaaaggctgttgctgccgctaagaaaaagcttgcttccggtgacgccagcgctgccggtgacttgaaaacgcaggcagccaaagggaatgctttaaaagcccaggcagccaacctgcaagccacaggtacagaagtcactcaagcgatgaaaaaggccaagaatcgggttaaagatcaattgctccctactcaatcaccaaatggtatccacaatttaatcgagacaaaagatgtgacgattcggaccaatacagatcagaatcaagttgttggaattgcgctaatggttcccgtctccgccatgaagaataaaaccgatgccaagaaatttgcgatttcattctctgttttagcaaacagtaccggtgctgatgccaagaaattaatgaaagatttcaagaaacaaacgaaatcaagtaaaaccagtaagactaccaataaggcacttcgatcaaatggtgtcgattttcgaattggttattcaacaaccacactttatatctacatcaccaagcagtaagtgaacttaaacttaacagtgacaagcggccgggacaattattatcccgaccgctttttatcgtaacgcctcatcaacccaaactgagcatgccaagattgattctaattttcataacagacaaaaaaagatccatcacatttgtgatagaccattttcatttaatttaaatcacttgtctggtactttttattttagtaccagccgtttgcctgccagaatgacttggcagctgaccatgaaccgtaacgatttgctacgtattgattagcaaccttttcctgattggcagctgaatagtcaccgttaaggtaagatgcacttaattgatacttaccaacatattggccatttcgtgctgaatatgaaccgcctgattcgtgggatgcaatccaagattttgctgaattgctgtcagttgcacccgtattggcagatgctgaataagttgagcctgcattattagtagttgcagcgttactttgagtagttgattgagttgcttgtttgtattgtggctggctgtaagaagcagtctgagaagtcgattgcgtggttgaagatgcttgactaccatctggaatattaatcttttcaccagcaataatcacactggaattactcaaattatttgcctgattgattgcctcgactgagacattatatttttgtgatagtccccatactgtatctccggattgaatagtaacaactgttgctgctgatgcatatgaaaatcctgcgaaaaataatccaacggctgctgctgaggttgcgagaatcatagataatacttttttcaaaattacacactcctatagaatacttgtgtctgtgactagaatttgctgacctcatcgatcaacaatgcatagtctatcccattggtgtgacaaacaaataacaccagtattaagcttcacgtgaagtgtgtaaatcatgtaacggtatagtaatttttgttaaacacttatttatggaagttgcgctcaaacagtcatacaaaagtcattacggcactttttttaagagcacgaatatttcaattcacttgtttttcaatagtaaataactgttttttctccaattttttaaaagaataatccaaaataacccatttttaacaatatttcattaaaaaaatggccctttcagaccatttcgggtgaacttattgttcagctcgtcgaaccccataaaattcttcaggataataaatcttgccacttcgcttaaacagcccgccatcggtcaatggcttgatcaaattagcattaatattgatcggcatagttgagaaaatgttaaagttctctgcggcaacatatcctaaatcataaaagaaatcggtattatcaatcgcactaactgctggataccctgcaagttgtgcgcgattttcaagctcatacaccattgcttgaccgacaccttgatcccgatactgttttggtacactcacttcgacgattgatacaatccggtgagaatggtttgaagagcgaatcgtcacgggaatcatcaatgcatgcccaataacttggtgatcatgatccttggcaacaacctcaaactcagattgataatcactataagtgcgtagtcgatctaccatatcaacttcgtcaccgtcagtattggtttcctgatttgtataactttcggcaataatggctctgatatctgagtattcttctctttgggctgtttcaattgaaaatttcacgactaatctccactctttctatataatgtaactaactattaaacttgttaaactcaaaatgatgcctaacatgaaaagttgtcagttcatggcaacttttatacactaatatcagtataaaggataacagtattaaaaaacaatgagaaagttggtttattatgtctacaaaagtaaaattttcgcttattagtctaattggttatcttatattcgcaacagcagctttcacccttggatttctcgatccaaatcgaatcggacttcaatggagtattttttggtatattgctgctgctttaattacttattatctatggtttaagaatgttgtttataaacgagtgatgtattatgcccgccaattgaaattgacaaaaaatgatttgcaaaaatttcttcctaatctaaaaaagagtcaggatatccctgacccacaacgaaaaaattatttcgcaccaatttttaattttcctttgcaaggactggatgtgctggataaagaattagctaaagaagctaaagaaaaagggattaagccttttaaataaagaggccttatactccgggtgctaatcgctttgttccgcacactgttctaggactgctcctcaaagcaatgttctgcatgtaagggattcttttcaaaaatccaaatccgggattcccgaaaagaacgccttacactccgaacattaatcgctttgttccgcacactgttctttaatcttcttattaaaatagttggctaatttttcttttggataaacgcccgagaccttttcggttgctttaccatctttaaagatgaccaaactgggtacgcttaggacatgatactgctcagcaacatcctggttgccatccacgttcattcgcccaaaatgaatttgatcgccgtattctttttccaagtcagccaaaatgggatccaagattttgcagggaccacaccatggtgcccaaaaatcgattaccgttagtttattattggtttcagattgaaggttattcttcgttatctccacgctcatcagatttctttcgatcctttcgtacataatgaatgattaacgtaataatcacagcagcaatgacaataacaccaaatagcggcgctggaatctcgatatcaatcattgggattgacaacaacagcttcaaagcaataatgccaatcagaacgtaagccatcggttgcaattcgggaattttgctcattaatttcatgataacctcagcaacgccccgcattgctaaaatcccgatcatcccaccaattaaaacaatgaccggattaggcgaaatagctaaagaggccaataccgaatcaacagagaacaccacatccatgaattcaatttggagaaccactgaccaaaatagtgaaatgcggtgtttcttttgattagccagttttttagttcgaacaacttttgtttttcggaaaaaggaataaaccagataaatcagatacaaagatccaataactttaatttcccaaaaatggatcaggtaggttccaagcccaatgatcaggaatctgaacaagtaggcgccccacagtccgtagaacagcgatttttcccgctgaactttcgtaggtaaagcttgtgtttgtgcggctaataccactgcattatccactgaaagcaaacattcaatggtcaccaatgataagatgatcaaccaatcacttccactggtaataaccgtactccaattatgtgcatcaaaaaacgggccgtataagtttaaaacccaatccaacaatttggcaattcctcctcatttttcaagctctcagctcattaaatgatgagcctcaatactctccgcttcatagattatattattttttgggtaacggcaatagccaacttcaaattaattgtcattgagcgctttcaaatcataacgtcccaatttatatttcacaattagacgattcaatttctgggcataatgtggatcagtcgcatacccattcttctgtaataatcgcgttgtcttccgatagctaagaagattcttctgtctaacaaattttcgatgaaccaactgattatgatccataatagctgcctgtaaattcggatactttcgaaacctggctaacacgctaattgtctttcctttttcaacttcatgagtgtaaaacgtcatcgattgcccctgataactccctttaataccaaacggattcttcgctaatttataaagttcagacgttccatattgagactccaggattgcttgagcaatgacaacgctggggagaacaacccgatttttctcaaaattaatgactgccggagtcgaaattttgtttataaatttgtttctttgcttaatcgtgatgtgtctctgattggattgcgtcactctgggaatctgagtttcattttcaagatgcctgtgatttctcacaataactccggtcaaaataaccgtaaccgtcactaacaataaaagaaaggcccaccaaatttttttgcgcaactgctgctcatctcactttgattagtcattttttagcttagggtgctaaccgctttgactcacacacttatttctctaaagtccactcgatcatccacctggaagaagattggttccgtttgacgaattaagtcgtcagtcagttgaattttaataaccgattttgcgtggtatggctgatagtagtagtttcggctttcacagcataccgcagcccgataaacagaatacgtcggctgatgagccgaactctttggcacattaacagaatccaacaaatgccaacaattatcaaaggcttcgatttcattttcgggtaaatcaatccgctcttttaaataggccgcccttataaaccgtgagcccggtgtatatgaaccgggtggtgttgatttgccggaaacatttcccgttgtaacccgtggtgtatttaaaggaacagtctggcttttaaaagcatccgtaaagtccacatacttttccaatttattaatttgtcggtcaaaatgattactgtttgtcagtacaccaagcgggttttcaataacttcaatcgggtgtgtgaccggttcaatcacaacaatccgcccggttggatcacaagccgcgaaatgcagttcactatgaccgtatttcatcaaactatgtttgtcggccatcaactcaatttcatctatatgatcaattatatcttgaacagatttgtaattggataataggtaaaaagaaagttcaaatggtgctaaatgaattctaccttcggttggctcttccaccaactgactgccatttgtaaacgtcaatttttgaacggccaacccaaactcattcaccccgtctgatgcatcaattcggcgatcgtgtctgccgccggaaccaagcaacgcatatttagtcacatattcatggtcatcaaaaaccgaatgccaatgatattgacgcgggcaaaacattggtcgagcgcccaatcgcggccagtccattgttctggctaagacatgtgtcccatccatttggccaatttgtaaaatgctagtacacatcgaaaaaatctcctattcgttatatatttggtataaattgcacccagtctgccatttgctatcgcaacgcgtctcataaaatggtaaaattttattaactgggaaattaatcccggatatttttgagtacatatacaggggacagttaaatgaaagttacaatttctaaactacacaagaatcgggtattcacgctgttagtatggctgataattgtctttattgcaatcatttccgctccaagcataactaacaccttacaatcatacagccagccaacttttagtgctaaatcacagcctgaacaggcagctaagcttcgtaatcaatggggttatcagctaggaaattcggccactattaatattgtctatgaaaaccctggcggaaaattaaccaccaagcaaaagaacactattcaaacaaccgctgacaaacttaaagaacatcaatctttttacagcatcaaacgaattgtaacacccgatacaaacgtgtccggtcaagcccaaatgctttcaaaagacggttcaacccaagtcgtctcacttgatatcgatgctaaaaatgatttacgaattttaaccagtgaattaaccaatcaagtaaaagtcaacggattaaaatcctacgttaccagtccggaaattattcgggacgttaataatcaaaaaaccgctcaaatcacaaatttgattctcatcacgctgtttattgcatctattttgattgttggcatttattttcgtgctgttcttgcatcagtcatttcatttatcgttctatttacgtcatttgtaacttcctatagcctttcactgaatttagcaaagcatttcaattgggctttttcacaatacgtccccctggaaattggccttgcaacattggttttgggaactatttggaatatctatatctatcgtaaacttaaaagtgtcctggctgtccagcgggaagccagggctgccactaaacaaacaattcaggggttacgttttccaatcattatggttggtggtaccctgacaattttatttgctctatgcggctttattaattttaatgaaatccagtcattgtgggcactcgcagtgacctatcccgttttggttctggcagtaaccacactaaatgccgtatttactgctgcattaggagaaagtattttttggccgtctagtacgccaaaagctgccatgaagtcccattattggaaaaccgccactgaattttcgctttggcagccaattgccggctttttgatcgtcctatacattaccttgccatttatttatttttatcataacagtttgaatttctccccaataaccaatctaacggaaactaatcaagccgttaaaggtgctcacgtccttcaagcacactttaatgagggaaaaccaacacctgttactgtctatctaaaatccaaacagcctctgaataatgaaaaagacctacaaagccttgatcagctgaccaccaaattacaacatacccagggcgtaaaaaatgtttattcattaactcaacccggtggtatgccaattgataaatattatgtttcaaatcagcttgaatcaatcggtttaagttccaaggaagccacggggcaattatcccaagcttccgacagcctccagtccaacacttccaagcttgacctaaactcattgaaacgtcaggttaaacaactgtcatcaatggtctccaagagtaatcaaattgtccaagacagcagtaacttggcttcgcaggtaaatagtgctgcagccaattcaagtgtctcggttcaacggggtgcgtcaaagcgtgtccgccaatatcagcagcagatcaatcagttaaaccaatcccttcaatctgtctcttctggcattagccaactggcaaccgaaggaaaggtcattcaaaattacggacaaaacagctacaataatttacaagcctatagtcaacaaatcagtcagattaagcagcaactcaaaaaggttaatcagcaagtcacatcttcgacctcccagctcaatggcatttatgactacctgaacggccttcaaaagtccggcggtgccaatgtctactacattacaaaggctcaactggctgacaccgattttcaacagacactattaaactacgctggtaagaataagaagttgacaatgttacaggtcgtcttcaaaaatgcaccttccagtaaatcaaatatccaccaggttaatcggctgaagcaacagatcaaccttcaattaaggggaacatccctttctaacgcaacagttgcaatgaccggtgaaccagttactcaatcaattattcaatctaaaatgactcaccactttgcgtcactattagccattctggtattaggtattctgcttgctgtctttattctgagtcgcgctattcttcagccgctttactggaccgtcgcatttgtcatgtcagctttaacgggattccaactaacttatttaacaatgcattttgtcgccagtgttaaacagttcgactggcaagtcccagtgatcaccgcaactattttagctgcttttggtgcctggcagatcattgcgctggggttatcctatcgatacacggaattatcattgcttgattggattcgcccgacaatggctagttatggacagattgtccgttatattttgctggttgtcgttgcattggcaattgcactcacttttggcgcatccctggcaatgatcgaaattgctttaattgtcatctacacagcatgcgtcttttatctggttctgccaatgattgtatcttctctgggaaaactggctgtcacattgccgaacaaaaagaatattttaaaaaacaaatagtgatttgaactaagttaatgctgaatgatctcgaaaaattgttcacaaattgtaacattactcgactcaaggcttgaaatacttagtaaaattacagtaaattgcttcgaatttaactagattacctcaaaacgtctgaattatttcagacgtttttaatttgtccggataactagattgccgccagagtaacagtctcagctgcaaagggcaaccgattgtacacaatgtttcatcacgacattttccttaactgcattgaaaattgtttgtcacagtcctgcaacaaattattggtaggattatatttgtaaattgatagggagttgttaaaaattatgaaagtacataaacaaatcgttttagttctagttgcattcttcacattattaactgcaggtttcacaactgctcaagctgcaaaagctgatgatccatcttattcaacactttatagcgttgcaaagcaaaatcttggtaagccatatgtatggggtgctactggtccttcatcatttgattgttcaggatttacaagttacgtttataaaaaaggtgcaggcgtttcacttccaagaactgcccaagctcaatacaatgccgaaaagaaagtttcttacagcaatcttgaaaaaggtgacttggtattcttcggtggcagtgccgtttcaatttcacacgttggcctctacgttggtaatggaaaaatgatcgatgctcaaaaccgaggtgtcatcactgaaaatgtcaaagcaccatggtggcattatgtcggtggcgttcatgttactgaccttgatgactaatcattcaataccaaacatattattcaattaaaattttaaacacataataacaacttaatatctatttcaaaagaaagaccggcataaaagatgctggcctttctttttggcttattgccaattcaaccttgtcattgcttacccttaactactaaaatagattcaaacatcatttttagcgaggaatttaaccatggaagaaacgactcaagttaccgatattggtgattatctaaaattgtttgcgtgtacggctgttatgttacaaaccatccttatgtttgttctaacgactatcccttccgcaactaatcaaattggtattggtatgacatacaacttaatcaagtttacggcaccggcctttatatttggcatcctatacacgactgcccgcaaaacaatcgcaactcctatcacctacagacattacttaaaacaacaatggcacagtttatttattccgactattctatggacgaccatttatctatttatcacgccggaacttcaacagggacatcattatcacaatattagttcgcttatttggcaatttattaacagtaatgctgctcctcatctttggtacaacacaatgatgctgcagtttattcttttaatgccgttaatgtggctgataggccgctggtgcggttcgaattcacgtcgcggctcacttactgctattgtatcaatcgctggttatttgctttggatctcgttttatgacactgaagttttccacggtccgcacatgatgaattggtacctgctggatcgcctcttcttaagtttttttatctatggtgtgttaggtgttctggcatggcaataccgaaaaacagtgaacaggttttttcgggcatggtggccaatcgtttgccttatctttctgggaagcttctactggatcaaccatgaattatttgaattcggtcttcccgttaaattaacgaatgccccttactataaaccatcaatgattctttatgacttgtctgtcatcagcttgatttcaaccttgggaatctttcaaattgataatcactcaactattaataaagtcattcatattctggccgaatttgcctataaagccttcttatcgaatgttttttggtcttacctgctctggtatgtattcggcaaaaatctggttattaatcacctgcttatcggggcacttgtcttatatacgggcacttggttactatcgtttggatccgcctttgccattcacttgtgttggcaaaaattttgcctatatactcgatcttataatccccgtacaataaattaagcgtggtcaagattttctcttgaaccacgcctttatactatcctttgtaatttggtttaaccgcttagtttcgcacactctttttcatattcacgtgcttaataccgacttccataaatgggtcgccatattgcttgaatcccagcgtttcatacagtccctttgccgtttcctgtgcaccaagataaaaattagtttcacctttatattttggatcattcaggatggcttccagcaactgtttggcaaatcctttatgacgatacatctttaatgtagcaaccctttgaatatgcacaccctcaccggtcacagtggctctggcagttgccaccggccgatgttggtcgtaagctacataatgagttgcatcaccgtccgtcccatcaaattcaagtgtttcatcaattccctgctctttaacaaagaccgattttcgaattgcttgggcatcttggtaaacccggtttaattgattagttttctttacttctaccattttctccactcatattaagactgcacattataatccgtaacagtgacatcatccccgtcaaactgtagcttggtcaagctaccattggccggtcgttccgtaacgtcaaactgtccatcaccgaatcgttcaactaaacttaacaaggtatttccatggctgattaacaaaacgttgtcgccatctttaatcgttggattgttcttaattaatgccaatccctggtcaagacgctgccaatattcttcattattctcagcctgatggaacggatctgcttcttttaaatagtctttggcttttccaatcgaatatttttcaacaattgatttaaatgttggaagcccatgtggcgcacctgccagataccaagcctgatccatatcattaccttcaaaatagccatagaactcctcacggaaaaatggtgaggttgtaggttgcttaacatccgatgcaacattacgtttcaaaatctcttttgttgtttcctctgctcgtgtcgtatcactgcaatatgcggcaacaaatttaacattcctcagtttctcacccgtatcgacagcgttttgaatacccttcttggttaatggtgagttactccaaccttgaagtttattatagatattaaaataggtttgcccatgacgaaccatatacaaagtaaatttagtcatgcttacacatcctttgcctttgataccctaagtataacaatttatcagttaaacgaggatagaattttgttgaaggtgatacagcgtacttgatgcgggactgctcctctaagctgtaccgctttgatacgcacactatcttaggactgctcctctaagcagcaccactccatataagggatcaattcgaaaaatccaaatgcaggattcccccaattgacgccttatactccgggtgctaaccgctttgatacgcacactatcttaaatctttaactttccgccaaattattctccccacccttttttctttacatttatctgatactataaaacaagtatgtattatcgaaggagccgcgtcttgaaatatgttaattcaatccttgcaaaatgcagtacccgcaaaggatttctcttattacttgtcatttgtttctgggtaaagacgatgtttgcctactttgtcgatttccgactgggcatcaccaatccctttcaattttttattgttctcatcaatccactggcaactactggactgctactgggaatcgccctttattttaagaaaagtcgtattttctacccggttgccattattatttcaatcttaaatacggttttactgtatttaaacgttatctattttcgggaattcaccgactttatgaccgtcagcaccatgaccggctattctaaagtcaatcagggactaagtggcagttccttagccctcacaaatttccatgactttatttactggattgatctagttgtaattattattttaatggtcactaaaaaaatcaaaatcgatcatcgtccgcttaatcgtcgcatcggtttggcggtcacttcattttcattgttattttttgcagtcaatctctcacttggagaaatggatcgtccccaacttttaacccgaacgttcgaccgtacctatattgttaagtaccttggcttggatgcttttacagtttatgacggcattaagtcccagcacaccaatgatttacgggcaacagctactaaatcggagttgggagacgtcttgaagttcacccgtgctcactatgcaaagcctaataaaaagtactacggtattgcaaaggggaaaaacgtgattattcttcatctggaaagtttccaacagttcctcattggtaaaaaggttaatggtcaagaagtaacaccgttcctaaataaactttacaagagtcaatcctcctattcatttagaaacttcttccaccaagtcggccaaggcaagacctccgatgccgaaaacatgctcgaaacaagcacttatggccttcctcagggatcattgtttgctcagctcggcagtgataacacattccaagccgcaccggcaattttgaaacaacgacgagattacacaagcgccgtctttcatggaaatgttgccagcttctggaaccgaaacaatgtgtataaagaaatgggttatcaatatttcttcgatgccagctattacgacacatcgggtgaccgttcaatgggctacggcttaaaggataaattattgtttagagattctgttaaatatctccagaatctacagcagcctttttatgcaaaatatattactgttaccaatcacttcccttatgatttggataaagaagatacgcgatttaagaccaccaataccggagacgatgtcgttgacaattactttgtgactgcgcattatcttgatcaatcaattcacgaattttacagatatctcaaaaagacaggattgctaaaacattccttaatcttgctttatggcgatcattacggcatctctgattctgaaaataaaaacctggcaaaggctttgggaaagaaccctgatgattgggacgactatgataatgctcagctgcagcgagtgccactgatcattaacattcccgggatgaaacatggatatgtctccaataagtatgccggtgaaattgatgttttaccaactttaatgcacttgctgggtattagtacaaaacgctatgtccaatttggcacggatgttttctccaaacaccatgatcaagttgtagcattcagaaaccaagattgggttagccctgcatttacttctgtcagtggtgatatttattcaaataaaaccgggcaattgttgaaattgactaagcggcagcaaaagcaggttgataaggacaaggaacgtgtcgacaaagagttatccttatcagattcattaaacgaaaagaatttgttgcgtttctatcatccgaagggatttgaaactgttgatccacgtaaatacaattacgccaacggttatcaaaaggaaaaattaatagctaagaaacgcggcaagaaatcaacaagcctttattcagaacagggaaataccttcaaagactacttcacagacgcaccggaaatccatcataaatcaactgattccaaccgaatcaagattacgaacccggatgcaagtaataatgatagtagcaggtaaaaaagtgtgcggagctaagcggttagtacccggaatataaggcgtcaatttgggaaatcccgaatttggatttttcaagttgatcccttatatggagtggtactgctttgagtagcagtcctagaaaaagtgtgcggatcaaagcggttaacgttcgaagtgtaaggcgttcatttcggaaatcccggggttggatttttgaaatggatcccttgaacgttgctttgagtagcagccctaagatagtgtgcgaagctaagcggttagtacccggaatataaggcgtcaatttgggaaatcccgaatttggatttttcaagttgatcccttatatggagcggtactgcttagaggagcagtcctaagatagtgtgcgaatccaagcacttagtactcacagtaatgataatcctaaacaaacggggatgaggtatcgtgaaaaaacagaaccaacaaactgagtggggcagaattctactgtacaacattttagttgtactgttagcactggcttcatttgcacttgttgttttggcagttaccaacatcattactttaaaacatggtgtttatcgcatcattttctcattaatttggattttcttcttaattgattacctgattcgttttaagctcgcaaagtcaaaaaaagattttttaatttcaaacttatttgatttaattgcgttaattccttcacatccaatatttgcacttttccgaatagcaagaatatttaccattgtccgcgaatataatctgctgtggaaattgggatggaccggaaagtttactaatggccttcaccgcttcctttatgatactgggttcatttacctgttttcgattagtttggtgatcctgatcggcagctctttggtgtttgcctcgtttgagcatgtttcacttcaagaagccctatggtgggcaattacaactgcgacaacggttggttatggtgatgaaacgcctcatactgcaggtggaaagatcgttgcttcacttctaatgcttggcggaatcggttttcttggtttattaacctcaacaattaccggattcttcactaatcaagacgctgaagacgaacgggataaatctttaaaacacctcaccaggcaggttgaacatctgtcaaaacaagtcacacaaatgcaaaaaacattgcaggagcaaactggtcagcctaagccgatagtaaaaaagaaaaaacgaaaatgacttaaaattgttcaaaatcaacttatgatctttagacgcacattggtctgaataataatgccgatttggccaacgcaaaacaaaggaccgttagaaaggaaatttcctcattctaacggtcctttttgttaataataatccacgtcaaacatcgatttacgatttatgcattgccgtactatgcaatggtccccttctatccggataaagtgcctgcataattgcattcactgcaaccggtgcttcaccaaaagctgtcgaaatcagtggttccttgccttcatacttggaaacatccccaatcgcaaatacattttccaaatttgtttgaccattcggccgaacgttaatcgtgccccgcttgatttcgggatgaacctcccatgcatttagcgcatcatcctgcgcaataaatccataattaacaacaattttatcaactgtcaactcggtaaactcttcagacttcattttctttgccttaataacgacttgtccattatcagttttggtgagttgtttaatcaagtaaggtgtcacggtttcgattgatgacgcctttaattgatcaacactgtgttccatcgcccggaatttatcccgtctatgcaacagaaacactttttttgcgacttgttccaatagtaacgcttcatcaattgccgagtcaccgcccccggctactaaaattgtttgatttttgaattggttcaggtttttgacactgtaaaataaatgttgcccttcaaaatcagcactgttctcaacagccagtttacggggattaaaagcccccaccccagtcgcaataataatcgctttggtgaatgtcgtttcctgatttgtgatgagttgataaccgttagtcgtttttttgatatcattaacggtctgattcaatttaacgtccgtctcaaccgttttaagctgttcttcaagttgttcaaccaagttccttgccttgatcatagggtagccagcaacgtctaagatcgtcttctccgggtataatgcactggcttggccaccaagttcggttaggctttcaataagttgcactttagcattcctaaggccagcgtaaaacccggcaaacattcccgccgggcctcctccaataatggtaatatcataagttgcattatctgaaaccatttgtttacttcctcctaataccgtcaggttaattcaatccacaacacccaaccgggctgtgccctttcacttctactaacgcttttttgaattatttttctctggttttcgtttctttgtttttttcgcttttggaatgatgatacgctgcccttgtaatgttttcacttcacgtagtccagcatcaatcattatatatattaagaaccaacccacaaccacgtcaagaatttcctgcataatcgagacgttcaatcctgtatttggaatgtcccaatcccaaaatgtgtgcagaatgacagtgattaaaaagaatacgtagaatttaggatttgtaaagaaatcccgaatcgtaaacggctttttccgagctttccctaaaataattgcaccgcccataatggccgcccaaattgtatgggttccaactgcttgaaaacttctcgtcaaaatcgtcatcaatccatactgactaacatagcccgaactttcaaacaccgaaaaacctgcaccaacggccgctccaattaaaacaccattaaatatgtaattcagtttgtatgagttgataaagagaatcacaaccacgcattttgcaagttcttcaacgacaccaacaatcagtgcggattcaatactgacatcggttcgaatcggcagcatcagataaaatgtcattgttaccagcaatgaaagaatcccccccaccaaaaaagtcgtcagaacttgaagaaccgatatgttttgataaacgttaatctcaaaaaacatcatcattaacgaaaaaggtaccgccaaagatccaataaagatcaaaccaggaattgccttattgcttttaaaaagaaacagtaataacatcaacattgcaaaactgactgccaacacaaagaaaattctggaaaagaaccacggctttaccggtcgactggaaacctttcgtagacttggtgttgtcgatcgggtgcccacaataaacaaccgatctgcttcatccttactatgtttttgaaaaacttcagaaaacattcgtgacagatgaatctccaccgggctttcgttttccttgcctccaagtcgtttggcgatgctgtcgtctaaattatcaaggttgtcgtaatttcgtcgcacacctgtccagatcaacgagaaaaagtttcgacctatttttttattttcaaatttcatctaaaatacatctttcctataagtattactatttagcgtaacttacgatgataatagattcaagttacgtgctaaaattattctcaataacttgtttcacgatacgcagtggcggctgtaacccacgaacaaaaaacgctctgtggttggtcaatcgaactgataaaaattcagggtgatcccaagtcaaaaattgagttatagtccgttttcggttatgattaagtaaagggttttcatccttgatattacaacattatggaggtagttttaatggcccagaaaaaaatgattcttgatcttgataccggtatcgacgatgcaatggcaattgcctacgcagttgcggatccggatgttgatttaatcggtatcattggttcatatggaaacgtatacgttgaagacggcgttcaaaattcacttaaaattcttgaattacttggtgctactgacgttccggtctatcagggactttcacattcatcagaaagtgaccactttgacagaatgcctgtcagtgctcaaattcacggtgaaaacggtattggcgatgttgacctgccggatccttcccgcaagcctgaaacaggcgacgcaatcgacttctttattgatgctgtcaagaaatacggtaaggacctaatccttgtgccgaccggtccacttaccaatttagatgctgctattaaaaaggcacccgaaattacaaaagaaatcggcaacattactttaatgggtggtgcggttaccgttccgggaaatgtaaccaatgtcgctgaagcaaatattcagcaagatgcatcagctgccaacaacgttttccgcaaggccccacttacccaagttggtctcgacgtcactttaagaaccctgttaactaaaaaagaaacgcaacagtggcgtgacctgggtactaaatcaggtgaagccttcgccgatattgtagattattatattaaagcatatgaagtcacaagccctgatcttcacggttgtgcgcttcatgatccatttgcggttggcgttgcgattaatcccgactttgttcaaacaatcagtttaaacatgtacgtcacaaccgatgaaaagtattacggtcgaacaacaggtgatcctgcccgcttgtctgatccaaatccaaatgttaaagttgcggtcaacgctgatgtagatgcttacttaaatgcatttatgactcacttaaccggattattcagtaaacactaatttaaagtaggttctacacttaaaacgactgccatcgtcataacgattggcagtcgttttttgattaactataggtgaccacgcaacaatggctgcttcgcttttatcgaatggagaaaaagcttttcaaataattccccacaccattatcgtcattattaccggcaatcacactactaattgcccgaacttcgtctgtcccgttcttcatagcaactccgatttgagcatgggcgatcattccgagatcattttgagaatctccaaaggccataaggttggaaaagttccagccaaaatgtttaagtaacgcttttaacccaaccgtcttatccatcttcggtgctaagaattccataatctgcggctgtgaccgaacgatatgatattgcttactaattcgaaccggcaggtcattactgaaatcatcaagtaaatccggcttgtcacacacaattcccttggaatacaaatcattttcatccaaatctgcaaaacttctggaaacaaattcgatgtttcctttaaattgttgttggtacattgacggtttcaaatcagaaatcgaatagacacgttcaaaattcagaatatccagcggtgcataaacttcacgtgcaaatttatgtaacgattcaaaatccgctttggccatccccctcttaaataattcctttttgtcgttgttatgaacaaccaatgccccgttgaaagtgatcgtgtaatcatcttcaccagttaaccccaattgttcaatatacggccaaattgcattaattggtctaccggtacaaaggaccaccttaataccattatcatgaatctgtttcaatatattctcattagttttggaaatgtttttgtcacttgtcagcaacgtcccatccaaatccaacgcaaccattttaatcactgctagagttccccctctgatagtaataacgacgtttattctaaagaaactaaataggaaaaacaaccctttgacaatatcttacacagaacttttcataaatgctagatcaattacaaaattgttccggataatttatttaataattatattaatcagccaagtatgcacctaatttgattacatttccaatgtaatttcacaaacaaaaaaagaagttggggtaatatttacctcaacttctaaatttatccgtataacttaactgttattatttaaactagctgatttgtgattcaagttcccgaagctcagcttcacgaacacttctaggaagaaatcttctgatctcttcttcattaaaaccaacctctagtcgatgatcatcaaaaataattggtcgtttaatcaaatccgggtacttaaccaataaatcaattagctgagataccgaaagattatccatatctatatttaacttcttatagacattagatctggtggaaatgatatcttcacttccattttcggttaaacgtaagatttgctttacttcatcggcgttcagaggattggaattgatgtttctttccttaaaggcgatgttgtggctctttaaccatgcacgtgctttcctacttgatgcactactttgtgcgacatatagatttaacattacaatcccccctagtttgtaacagaaatgaaacctaaatacatccttcacgtaatatattaacacagtgaaaccttttgtcaataccgttacttactttttgtaaacaaatttgtgaaatttcgaaaccctctttcagcaccttttccgttataataagtttattgaaacaaactgggggattgaattatggaagctttttatttagtcgcactgttaattgttgcgacaattatttccaatatggtttacactgtttttccaaagataccgctcaccttttaccaaattgcttgcgggttcttactcacattacttcctatttttagggattatacactataccccgaatttttcatggttggtatcattgcgccactcatgttcaatgatggtcgcaatacagatgtctcacatcttggaaatgcttttcaccacattatgtcaatggccgtctacttggcaattctaacagccgtgattatcggtactttcgcacacacaatgatggctatcatcccgctgagtctctgttttgccttagcagcaattgtgacaccaaccgactcgctggcgttttcatccatcaccgagggtgtttcacttccggaaaatgtgtcgactgttcttgaaagcgaatcactgttcaatgatgcatctggtatcgttgtgttcaatttagccctctcatcttttctaacaggccaattttctttttcaaaaggattaattaattttattatcagcttttttggtggtctcatcatcgggttaattgccggcttggcctttgttaaactgcaaaccttccttgttaataaatctatggatacatccagcgtcattgttcctttcagcttaatgacgccatttgcaatatatctcatttcagagcacttgggctgctccggtatcttagcggttgttgcggcaggaatcgtctatggcttaaaccagagtcgcctaaagctgacaacgaccaatgtccgtttggtaacaggtgccacctggtcgattgtcagtaatttgctaaatggcattgtctttgtgctactgggtgtcacgctaccgaccgtcatttcaaacatcattcccttatcatctactttaacaattgagctggcaggccttgcatttgctatctacctcttaatgggaattgtccgattcctttgggcaaagctcaactttatcaggctcaaccgagaccagccctcaacaatgaaagaagcttttctaattgccattggcggcgttcatggaacaattacactttccatggctctttcattaccactaaccctctcagggcacgctttcccttatcgaaatgaaatcatatttgtcgcaaccattgtcatcctcctcagcttagtagttccggcatttatattgccaaatatgctgccccgaaaaaaagatgacgaccaatcctctttcaatcattatcgtactgaaatggtcaactacagcatttcgcaagttaaggtccaggaaagtgttcccctagcagatagaaattatgttattgatatgcttgcgagccaaaagcagggcggaaatattgataaaacacagatcaacgacattatgaaccagactcacaaggttgaaattgatgcaatcacaggtttactaacggccggtaaaatccctcaaaatgtcgcaaaccaaatttcccgacgaatgatgatgacacccggtcaacgtggcggctttctcactaaacttcaatttctattccgtgttcgctttccgaacaaaaggacccgcaaaatcaagcgaaatatgcagtctgtcgcatcaagattcagcccggaattaaatcaaaaactattcgacaaaaaggtagcgatcaggaaaatcgttgaagacactgtttaccaacatgttaataaattccttgatgatattgaaaacgaaacaaatgcaccgtcaattgcatttgttaggaatggctataactttcgtcatgccagaatcgactcatcagacagctcggatgatttaagaaatcaactgttgattcaagcatttcaatacgagtattcctacgttgcctcggcatttcgagataaggagatctcccgaaccatctccgatcagttgaatcaaagcgttacgacagaccaaatggtctatatggaacagggataaggcaacgcttgaaaccgtgcactaagaagcagatcccggccgcacaagtctttaaatcaaatagtcaaacccggactatctgatttaaagacttgtactctggaatctaaccgcttcttagtgcactcttatcccattaatctgacgtttacaaagtactgtcaattgattatacttgacggtatacattgactttgcaggtgaaaataatgaaaattaccctcttagcgaccagtgatacacatggctttattgaacccactaattatgtggattcaaatgcaaacaagccttttggtctagaaaaagcaagttcgacaattaaacgatatattaaccaacatcaagatgaaaaagtcatcctgattgataacggggattttcttcaaggttcgcccatggccgattacgttgccaagcgagctgatgaagtcgacaaagcatcatttatcaacgcttacaaccaagttggttatcagattggcagtattggcaaccatgagtttgactatggtttggactacctcaattttgtgatgaaccattccggtaggcaatttgtttgtgcaaacatcgtggatcatgataatgaaccgctgctaaccaatccatataccattttaactatttccggtgttaaaatcggattcctcggactaacaaccacaagcacgaaaaaatggaagaatgttaatgacttaaacgacttcaacctgatctccgaattatctgcgtgcaaacgctatttacctgaactaagagaaaaggccgatgtcgtcattgttgtttatcacggtggatttgagcgggaccataccggtaactggaatgacatcaatcccggtgagaatcgcggatatgatattttaaagaatatcaaaggcattgacggttttatttccgggcatcagcatcgtaaaattgccagtgaactttttaaagtgccgattattcaacccggatcccgtggtgaatttgttggaaagatttcttttgatttatcaaactcaaccaaaaagatcacgcgtcacagttcagaattattgagcgttgcagatagtgaaccggatcaagaaatcgccaaacaaatcgcacctctgtcagcacatctacaacattggcttgataaacccctttcccatattgagggggatttgacttttaacgatcctttccatgcccgaattaaagaatctgccttcatcgaatttattcaaaaaattcaaatgagcaaaatgggaaccgatatttctgccactgctctgtataataatgaagcacatggttttgaaagccccatcaccatgagaaatatcattacaaattacgtttacccaaacacactggtcaaatcaaaaatttccggcgccgatctccgggcagcattggaagtaaccgctaaatattttgatgttaagcatggtgaggtagtcgttaacgagcaatttatgtttcctaaagaacgtttttataattacgatatgtatgaaggaattgaatatacgctaaatatcgctaatcctgtggggcaccgcgtaaccaaactaaaatatcacggcaaagatattacagacgatcaggtcttattcgttaccttaaaccgttacagagcaaatggcggtggtcactatcctatgtatacaaaagacaaaatcgttgcttcctgtgacatgacaatcagccaaattattttagaatatttacaagaacatcccgtagtaaaagcgactaataatcataactttaaaattgaagcaaggaaataaatagtttcgtgtttgctattatttgtttcatatagatcccaattataaggacatataataaaatccggtattgaatatgattgtttgaatcatattcaataccggattttattagtctattacaacactgatttttaaactatttttcttaattaatttcaagcattacttttagcctttttaggcttatgattttttccatcatttgctcgatgcgcttttttcttctcaacgccaacaaaagccactgccttgaaatcacgaattgaagtcactttaatttttcccggatatgtgagctcgtcttcgatttcatctttaacctgattagccaactctgcattttgttgatcatttacttttcttggatcaaccataattcgaatttcacggccggcttgaatggcataactttctcgaacaccacgcttgctgcttgcaattctttcaagactctttaggcggttaacatactcttcaacagactcacttctggcacctggacgaccacctgaaattgaatctccggcagcaaccaagtgagcaattggtgtggtaacatcaacatctccatgatgagaagcaattgaattaataacttgtggatcttcttcaaaagtttccgcaatcttaacacccaactcaacatgggtgccatcaacttcacggtcaattgccttaccaatatcatgcagtaggcctgcccgtttggccaatttaacgtttaatccaagttcagctgctaataaaccggcaatatccgctacttccacggaatgattcaacacgttttgaccgtaacttgttcgatattttaatcgaccaataatcttaattagatctggatgcatccatccgatatgcaatgaactgacagtttgctcccccgtctttcggatatcattcatcacatccgtttgagctgcttgaacctgatgttcaattgactgcacattaatttgctttgaaactgtcaaattggtaatcgccattttagcaatttcacgtctgattggatcagctgtaaccacatggagtaaagacccatcatccgggtcaaataccaagtccacacccgttaaggtttcaatataacgaatattttgaccatcccggccaaccagcttctgcttcgtactgttatcataaatttgaactgtgtgttccgtatgctctcgcggcatatcaaccggtccacgttgaatggcgtcaacagccatgattttggcaattttaggtgcatttacagctgcctcatcctgttgataacgcaattcaatatctttttcgcgcattaaatcctggctcagttgatcaaagatttggtctttagcttgcgcgcttgttaaatcgccgcgcttctcaagtgtttcaacgcgctcttttgacaaatcaacagcttgttttttaagatcggcaatcgattgttttaattccgataactcattatttcgttttgaaagatcctgatgaacttgatcaagcctcgtcgcagtttgtgtcagcccgttctcacgctggttgattctgatctggcgggtcgcattatccgcctggtaactgtcaagttcctcttcaattgattctttataatcagaagtctgccgatcggaagcttcgtttatcttttcagtttccttttgtgctttaactctggcacgatccagcagtttacttgcttcttggtgtgcttttgcaatctcagcagcataccgttttttctgaagcgaaacaccactgatcacgccgataatacaggcaataatgcctagaatgacatagatcaagaccaaacctcccttctaaaatagttctatagttagtctaacatattctttaatctatttgagataacgttctaaaaacttcttaacggtatccgtataaagttttggatggttttgataagatctggcatgaccctttcctggcacaatcaacagttcttttggccccttatctgctttatagagtgggtataccatgcgggtaggaacaaagtggtcatgagcgccatgaataaataacatcggtcgtcgattcttcttaacctgattcaaagcacttgcctctttaaacgtataaccgttcttaaccctgttaatcgcactcacaataccaaccaacggaaatttcggtaggttatacaattgttttgcctgataggaaatttcgctatacacatccgtataaccacaatcctcaatgtaggcttcaacttgtttgggaacatctttaacgccacttaccatcattgttgtcgcaccacccatactggtaccaaaaacaacaattctggaatctgccccctttcttgtgatgacctttttaatccatttaacataatccaaacgatccggccaaccataaccgatataattcccctggctgtcgccatgcccacgggcatccggtagcaatacattatatcctaagttatgaaacatataggcgtattgaaacatctgatctttatttcccataaacccatgcgcaacgacagccgttttattagtcggcttatcagccgcaatatagttggcatcaagctttaaatgccgtgttgccgatagttcatgccaacgctgtttatgaacgctttgataccattggtgagccggatacagaggactgtccggcttgattttttgtgatttacttaaaaatgacttaggtgcgggaaccactgcaactttataaaaataaagaccggcaccaaataatcccgcagcaacaaccgtcacgagagaggcacaggcaattatgatttttgttcgttttttcattttataaacgaccaccattgatttagtttgattatttaagataagaccgtgcaggactccgaatgctaaccgctttgctccgcacacttatacaaaatgcagtataataataagtaatgaataggacggtgataataatgtttccagaacgacttagagcactgcggcgtggaaaacacctgacacttccgcaattagcccaactacttaacgaacagtttccaacagatgaggagcatcagaacacaccttcacaaattggaaactgggaacgcggtgtcagaactccttcatacgtagaggttcagaaattagcctcatttttcaatgtcacgatggattatttaaccggcctcactgaaaatagtacttatgatttggcacgactgttcatctcggataaatctcttcaattcaatggacaaaatttggattcatcggatcgatatgaaatctatcaattaatttccggatacattcacggtaaaacaggtcgaacccaaccgcctgcaccaacgatgaaacaagaagagttggatttagggatggataaaagtaatcattaaaggactattcttttatttaccgatcattaaaaatacaccgataaaagtcgaaatcgtaaatccagcccacgcaaatgcacaaaatgcaatttgcgctttatttttttgaataattgcaaaaattagtcctattaacaggatcacccaaatggtgaatattttttgagcaaaagtcactgtttaatcaaccctcgaatcttaaatatgactaggagacaatatgctaacaaataaacaaaaaaagaaacttttaaaaaatcgtaaacatcaagtttccccagaatccgactacatttcacaaatgaagcggtatcgcgagttgttttccgattttcccgatgtcaagtttttaattaataatgtactcgaaagtgaccaccttatcaagtctaaattactacctcaggaactgccggaattacttctccccgaagacattcaagatcagatttttaaagcaatcaatcaacgcttcgatcgggatgatccggaaggcgataagctttggaaccagttaagcgatgcattgccaaaattagataaagccctccgctcctatcgtgactatttggaagaacaatacggtatgtgggcatatatctcagggccattcgttaagagcttagccgcttacattgatcacgaagctgtcttggaaatcatggccggcaacggctacatctcaaagggtcttcaggatcttaacgtcaaggcctatccaactgacagccttgagtggctttccgaaaatcaaaccggtaagcatcaagttacgcagatcgaaaaactagatgccgtttcggcaattgaaaaatatcaggacaaggttaaatacgttataatgagttgggctccggataaagaatcagtcgatctcgacgttcttaacgcgatacgaaaagccgaccacgatcttaaattgatcgtcatcggcgaaagaaacggtgcaacagattctaaagctttctggcagcaggctcacattatcgaaccggaggccgccaagaagttaaacgcccaccacaaaccatttgacctcattaaagatcaggtttacctagttgactaagacgtggtaatggcagctttttaattaatggttcctttgcaaggggttctttctcaaacttgagaagggactcttttgcatccgcaccaccccggtattcgcctatttcgccgttagaccgaatgacacgatgacaagggataacaattaagaatggatttttggcaacggcactggcaaccgctcggatcgcccttggcctaccaattgtttcggccaattgcttataagtaaccgtctcaccataaggaatttggcgaagcgcatccaatacctgtaattcgagttcattatgaatttcgctaaaatccagcggtatatcgaaagtcttccgctttttatcaaagtattctttgaactcatcaagataaattccggtaattgtttcattgtacataaactgatattgatatcgattgttaggatagaaatcaaagatttcagaaatatgccgatgcggactggaaacaaaattcaagcccttgtcagtcacggtaaaataaaatgtctgatgattaatttcaatgctttcccaataaatttttttcatagataaaatctccaaaataactcattaatggtattgtaacacagagcctgtcaatgcaagttccaaacgcaaattaccacttttcttgactgctgcctgtcactcagccacaatgaagctaaatacccgaaaggaaagaccattgatgcaaaataaacaaccttcgtcatcagcgcagcaggtttcaagcttacgctacgatttaagtgaaattcgaatcaataaaactgttaatgagctgattcatatgggccatgatgttcgagacaaagtaccttttgaaaaactggcacagtttagacaagtaaacagagatgtggtatcagggattgagcatgttgagagcaaattgatctcggaactactcccacttcgccataagcggttagctgcatcccccttttcattttttagaggaacagatgaactaatggcttatgacctgtcaaatcaagaatcatcaaacattccggtcgtcatttcaggtgacgcacacattggtaattttggcttttatgcctcaccggaaagaaagctgcttttcgacctcaatgattttgatgagtccacaattggagcgtgggactgggatattcgcagattgttagtcagcgttattctggcaggcgaacaacttggactttcccatgacaaaatttcaagcattgaaaaagcagccgttgaaacctaccaggaaatccttagtcaatgttttgatgatcacagtgcattggaacgttactatttttctactgaagttgaaagcttcctgaaagccgaagcagatggcaattcgttgccaaagctctgggaaaagattaaaaatagtgccgtctcgcgtgattcagaaaaagtggttaagaaatttaccaccattgatactcaaggtcaccttgttttccgcgaaaatccacctaaaaccgtccacgtttcaaaaaagcgttacggccaaattgtggaccatctccagaaataccttcaaaccgtcagtcctgatgttgcggttcttctttcacaattccatattagcgatattgtgagacacagcgtcggtgtcggcagctttggtacccgctgctatttagttttactaactgccattgacggcagccaccttgttttacaaattaaagaagcactacagacccgtcggtttcaagggttcgatgtcacaaccaaatatagtcaaagcggcccggacaacggtgaaagaatcattacctgccaacaggtattacagcgggcatccgatcctttcctaggcttttaccataatgaagacaccggcagaagtttttatgtacgtcagttttgggatatgaaagaatctgttaatctcgaaaaaatggatgaagaagatttcgctaattatgctaagatttgtgctctgttgcttgcccggggacacgcacaaagtccaactgccggcatcatccatggttatataggtaaaaagaaaaaattagcaaatagtttggtcacttggtcaaatgattatgccaagcaggttcataaggactaccaactatttaaagaagcctttgataccggaaagttagcaagggaggaagcaaatgcataaggttgttttccatattgatgaagctgagaaatggtcccatacaatgggaaatattaaaaacttacttgattacggcaatagtgagggtgaagattatcaagtgacggttttggtcaatggtgatggcattatgggatatttaatgacgaccggtcgaaaagccgttaaaaacctcggtaaagaatttgttcggtttcacgcttgcaaaaacgcgatgaaaagccacggtattgcagcaaaagatctgccggacaacgttgagattgttccggcaggtgtcgctgatttgattgcattacaggaacagggttattcatatattaagccgtaagatctgcttttcacgcgacacgtcaagcaatcgatttctacatcatatcgaggccgggttacaaaccatccttattctcaacatctgatttgtaatcacaattatgaccaaattaaaacgtggcacaaaagtaacgccatgctcttaagctctggcgttatttttgtgccacgttttgtgatttttttggttaaagcattcaaaagtcgctcatattaattatttttacgacatttccaattcatcagttttaaagtatcaatgtttaaccaaccaatttttcgacaccatggtgaatttcttccggtcgattaataatggcacttgcatgtgctgctgaaagttccggtacatcgccgaagccatatgttacccccagggtcttaacatggttctcgtagcccccaagcatgtctgtatttcgatcaccgatcatcacactgttggttttatttgcaccggtttcttttaatgcataggccaaaattgctgatttggtaattcgcgttctttcatcactggttgcgccaaattctccgtcaaaataccgtcccagttcaaagtggtcattaattcgattgatcatgacttccggtttggccgatgcaatgtgtaaatggtacccggcaccttttaaagcatctaattcttctaaaatgccagggtaaattttcaattgaaaaataccgtcatcttgataatattcctgataatatttaagtgcattaaaaacgtcatcctcagaaagatcaggataaaactttcgaattgacgaaatgagtgctgggccaataaattttctatattgatcatccgttagttcaggcagatgcatcttctcaataaaatacttgattgatttaacaattccgcgttctgaatccgcaatcgtaccgtcaaaatcaaagaataaatgtttcattaatttatctcgctttcacataaggttatattccactatcttaccgggaataagaaaaaatgcaagcacctgaagaaatcatgaagtcgtaatgtcactcaacgacagcaaaagactgggacaaacaccttgccccagcctttttgttgcaaactatcacaactctaaaatgtaatctttccaaccatcaatccataaattgtgtagatggctgcaatgacaataatgatagcaactgtcatttcaattggaccaaatactttatctgccttattatcccgtttttgaaggatccaataaacaggaatcccggcagcaaacaacaatgacatcagtaacaagaaattggtgccggcggcaaataacaaccagcatgcgtaaatacttgagatgattccgattgtaatgttcttaccccgaccactgccatggtcttcattcacggagtattttaactgatagaaagccgagaatgcgtaaggaatcaaaatcgcagcacttgaaaccgaatagaagaagttataagccgatgctgtgattaaatagctgaacataaagatctctacacagatattagtcactgttaatgacgtaattggtgcaccatttttgttttccttagcaaacaatttaggaaatgtcccttccttggctgcttcgtatggtagttgtccagcaaacatcgtccaagacaaccacgcaccgacaactgaaataatcaacccaaggttaacaaccatcgcgccccacttaccgacaatactttgaagcaaatcggccattgcgggttgtgtcagatgcgatagtccggcacggctcataacaccaaacgatagcaatgttaccaacatataaatcaaaataaccgtaataattcctaaaacggttgctttaccaacatcggaacgttttcgggcacgtcctgaaaagacaaccgccccttcaattccaatgaagacccaaacagttaccaacatcgtgctcttggcttgtttcatcacgtcggcaaattggaatttgccacttggtgtaaaccaaaagtcaccggtaaacatgttcagtttaaaagcaaacaatacaataatcaaaaacaggaagattggaatcaacttcgcaatcgtaataatcgtgttaacaaatgaagctgattcgattcctcgtaaaatcataaagtggcaggcccacaaaataaatgaggccgcaacaatcgaccaaatattttgaccattaccaaaaaccggtaagaaataagctacggcactcatcaatagtgtggcataaccaacattaccaagccatgcggacagccagtaaccccaagctgaattaaagcccatatacttaccaaatccagcctcggcataactataaacaccagcatccagatccggtcgtttcattgttaagttttggaaggttaatgccagcataaccattccgatcgctgtaataacccatccaatgataatagctccggcaccagcgccgacagccatatcatgcattaaattaaatactcccccaccgataattgatccaacaaccagaccaatcagttcgagtaagcctaatttaccatcatgctctttcatattgtcactcactccctagtacaaaataaattctgatgcttccctggtatcaaataaattgcaaaaccagtgcagtcagtgacttggcttggtatacattggctggagatattccgattgactctatacacttaaaattttgaaatacttccgactgtactgtaccttaccttccgcaaccagctgctgcaccatcaaactggttgtttcccttgttgtaccacttaccttagacaattcaattaatgtcattggatatggaattaataccgttccatcatcctgcttgtcaccaatctgttgcccaagaaaccaaatcgcattccaaacccgacatttggcactagttgtgaccatccgttgaagctgcgtttcagtcgtattaataattgagctcatctcacgaatagcattaaccatcatttcgggattttcccgcaataacgtctcataaagtgtcatcggaataacagcaagcttcacttctgtcatcgtttcaacgctatacgcataattttcgtcttcaaataacccaatatatgggaatcctttgtttgaccgaatataaagatagagctgttcatccccgttctcgtcccaatgaaacgatttggcgaccccactgataagaaaatagtagtttcttctgggatccccctgatcaaacagaacttgccctctgtgaaaagtcttgatcgtcatcgctgagattacacgatccaagtcttcatcgctcagagggctgaattctggatggcgcttcattttgtttcgatataattggtaatcacctttattgttcaatatcatcgtttttccactccaaaaatggttagataattatcttgtcaataaaagtgtaacgcaattaatgattttgtacatcaaacgtatcggaataatacttgtgggttacatatacaagtatcctgtatattatgattgtgatttgtaagtgctttgatccacacacttattagggctccgctaaccagcaccacgccatataagggatcaattcgaaaaatccaaaatcaggatttcccaaatcgacgccttatattccgggtgctaaccggttagctccgcacacttatttatgcctgttgcctcaccttttttgtgatgacggttccagacccttcgttaacaaatccctcaatattgtccaaggcagtcacaactgcttcgtttccagttgcttttacgaaatcaatcgcagcttgaacttttggcaacatgcttccaggagcaaactgcttttcgccgatatacgtttcaagatcggttaccgaaacgtgttccaacttcttttggtttggcttattgaagttcacatagatattcggtacggctgttagaataatcaaagcgtcggcaccaactaattcggccaatttttcactggcaaaatctttatcgataaccgcttctcgacctaataactgattcccgtcagcgacaaccggaatcccgccaccaccaactgaaattggtacaattcctgcatctaccaacgtattaactgcgtctgtttcgacaacaccgattggttttggtgaaggaacaacccgtcggtagccacgacctgagtcttctacaaacgtaaaattaggattttccttcttggccagatctgcttcattctttgacatgaatgggccaattggctttgttggattggtgaatgccggatcatccgcactgacttcaacctgagtcaccacagtggcaaccgttttattcaagcctttttctttcaatacctgattcatggcattttgcatccagtaaccaatgcttccctgggtcattgcaacagctgtatccaatggcattgccgggttttcctcggtactaccggcagcctgctgcaataataaattaccaacttgtgggccattaccgtgtgaaataatcaattgatccccgttctcgataaatttcaccaaatgttttgcggtatccatcaatgcttgttgttgtgcagcggccgaagcatcctttgaaaggatggcatttccaccgagtgcaactacgattttacgtcccatgtctttccctcctgtttcagttaaaaatataggttttttaaataagaaaggccggggacagactattcgtgtttgtcgccgaccctctctttcttggtttgttatccttctataattaagtttgtttctaaactctaggaatgaataggttacccaaggttgctgccatcattgccttgattgagtgcattctgttttctgcttcctcaaattgacgggcatatttactggtgaagacttcatcagtaacttccatttctgtaataccgtacttttctttgatttctttaccgtattgagtatcagtattatggaatgctggtaagcagtgcatgaaaattaattggtcgtcaggcgtacctgtcttcttcatagcttccatgttaacttggtaaggtgttaattccttaacacgttcttcccagttgctttcacccatagatacccatacatcggtgtaaacaacgttggatcccttaagtccctcatcaaggtcatcggtaatcacaagtttggcaccagatttttcagcgaagcccttagcaatgttttgagtttcctctgttgggaataaggcctttggtgcaacaatatgaatgttaacacccaggatagcaccggtaaccaacaatgaattggcaacgttattgcggccgtcacccatgaatgttaaagtcaagccttgaagtttgccaaagttttccttaacagtcatgaagtcagccaacatttgagttggatgccattcatcggttaaaccgttccaaacaggaacaccactatctctagctaagatttcagcatcactttgcttgaatccacggaattcaattccatcaaacatgctgccaagcactttagcagtatctgatgtactttcctttttacccagttgaatatcgttttgacccaaatactctggatgagcacctaaatcaatagaagcagttgtgaatgccgaacgagttcgagttgatgacttttcaaacaatagggcaatgttttttccttccaaataatggtgaggaatgcctgcttttttcaaagctttcaagtgtaaaccgaaatcaattaaatattccagttctgcagcggaaaagtctttttcagcaaggacgctgcggccttgaaatacgttttgtctaaaatcttttgtcatatcgaattctccttgatgtgatttttgggtactaactttgtttaaagctattttaggactgctccatcaaccataaacctgcatacaagtcaacttggctcaaattccaaaaacaggaatttaatccaagccggcttgtactccggtttatcccgggttgatttcgcacactttcttaggactgctccgctaagcaacgttttacatataagggataaatcttaaaaatccaaatacgggatttccaagattcacgccttatattccaaacgttaaccgcttagctccgcacactacttcttaagatcttcacggacgattgggcagctcatgcaacgtggacccccacggccccgagataattcacttgaaataacctcaagtacttttaatccgtgttttcttaataattcattagatacatagtttctgttatacgtaacaacaacgcctggtgcaatggccaatgtgttggaaccatcattccattgttcacgaccggcaataattggatcaccgttaccagttggaatcaagtcaaggtcgtccaaattaagggcagtcttcaaaactttcttcaagtcagtatcgtgttgaaggtttaattcgccttcattcttacctggtgtaattgtccaagtatcaatttgaccacctttgccaagaatacctggatgaactgtgaattgatcatagttgatcattgtgaacacagtatccaaatgcatcatcgcatggttatgaggaatcttgatagcaatcactgtatcgtactgaccatctttaaagaggttcttggcgatatcttgaatagcatctgcagaagttcgttgtgaaactccgattgccataacgtgattgtttaatactaattcatctccaccttcaattctggtggtgtggttacggtcacgccatacatggatgcccttgttagcgaatcgtggatgatatttaataattgtttcattaaataatgattcacgttgacgagcagcgaatgtcatatgattaatacttaaaccatccccgatacatgccgaagggtcacgcgtgaagtataagttaggcattggatccatataaaattcgtagtcttgattttcagcacaacttacgagatcctttggtacaaaatcaagttcgttctttcgaacgccttccataatcttaacaaccatgtcttggttattcatgctgccaagatattctttcaatgcatcatgaatgctgcctgctgcatatcctgattctgtcaacatttgctctaagaagtgattacgtacttcttcgccaccagcatccaaagcttcagccgatagtttttccaagtacaatacctcaacaccgttatcacgaagtgtgtcagcaaaataatcatgttctttttgagcaatcggtaaatatggaatgtcatcgaataataatcgaggcatcatttcaggtgtaaagttttcgatttccctaccgggtcgtttcaacaatacagtctttagcttaccgatttctgagtagttatgaattggacttgtcatttgtgtaacctccattcttcccttgaatacatacctaatgataaaccgttttgtaaacgctatcgtataatttcatgcattgaaaatgtcgattttttagcaaaattagcatgctttttttaagccatgaatattattaagcatttagctaattattcgcttcacaaacggaattttatggttttttatacaaactaaaatgattaaatgagaaagtaaaagtttgattaaaattacccataccctataatatcacactttcttcatatatttcatattttcttctaatttaaaacggaataaatatttttttggtttgcaaaatattcatacttttttcaaataaaatacatacttttaaacggcttaataacaaaagtgcttgctatgaaagcggttaccgaggtttgttgcttctttccaattggattttcatacattaaacgcattattaggctaatcaaaaacggggagaaccaattccccccgtttttggtttatctattatgttaataattgaaactgttttgttctgcacactcttaggactgctccaaatgactgattcctgccatacaagaaactaaatccaacatctcaaaaccggggatattgaatttagctccttgtactccggaatcaaaacgtctttttccgcacactgggttaggactgctcctcaaagcagtaccacttcatataagggatctatttgaaaaatccaaacccgggatttcccaaatcgacgccttatactccgggtactaaccgctttgcttcgcacactttcttaggactgctcctcaaagcaacattctgcatgtaagggattcttttcaaaaatccaaatccgggatttccgaaaagaacgccttacactccgaatgctaaccgctttgctccgcacactggattaggactgctccgtcagccacaagcctgcatacaaaacaagcgccacaaaatttcaaaaacgggaatttcctgccgcttgctttgtactccggcttgtcccaggctgacttcgcacactttaaattaatccaccgttgttatcagcaaatccggatttgaatgtttcagaaacaagttcttaatattttcagctgatttgactgatgggcaaaacgtcacgatcgtatcatacccagccaaggtccccgcaacatcatccatgtgcaggtcgtcaatcacggccgcaagtggattcgcataactcggttgcgtatgaataacattgataaattcgatttgccggacttcggttaccgttccattaatcatgcggtacatccgttccagttcattttgatttcccgatttaaaaatcatatatctggaattgccggaactatcaggctgcttcacaatttgcatttcacggatatcccgtgagagtgttgcctgtgtaacgttaataccagacagttttagcttttccattaattcttcttgggttgtaattgtatactgattgataatttgttcgattttagcctgccgcacgtcttttttcatgattttaccttccctattgaaaataagttgcttaaatatccataaattctcaagttaattgcataactacatcataacaaatcataatacaaagtgcgcggtttggctataaagaaataaccatcattatttatactaatatttacaaacttccttgacatgctggggagtaacccgaactttcttgccgtaaacgtaaacttcgcaagctttaccacttgtcagctcaacatggacctcgttttgataaatcgtaaataaacactcattgttatgaagccgaagcttaaatttaatcgaattccaagccgaaggtaattttggctccaagctgaaatgttccgcgttattaacaacgccggcaaaaccataaacgacaccctgccatgctgctcccaaactaccggcatgaatgccattctgggtgttatgatgcaaatccagcaagtctgtctttacggcttgcgagaagaaatcataagattgctccttttttccggcacgtgatgctgcaatggcgtacatagcttttgacaagcttgaatcgtgggtcgtgatcggttcataaaagtcgtagtcggcaattaactgttccttggtattcccctttggaaacaggatatcagccataattgtatctgcctgcttgttgacttgataacggtaaagcattaagggatgataatgaagcagtaacgggaacaagctctgatcgatctgatcaaggtgcattggcggcagctgttcgaaatcctgaaactgcaatttaacgttcttttccttatcatatggaagatacattaaatcagccgcctgcttcattctgtcaatttccttatcggaaacattcaatcgactcgtcacatcggttgccttaaacttttcagcatacttaattgccaagcgcaggttgaattgagccatcacattagtatagtagttattatcaaccaatgcactgtactcgtcagggccggtcaccttgttaatgacaaaaacgtgctttccatcaagctccgtaaaattaccatactgcatccaaaaacgggcagtttccaaaataatttcaaatccatattttttaagaaaatcatcatcaccggtaatcgtatagtactgttctattgcaaaggcaatatcagcgttgatatgaaattgtgccatcccagctaaccaatatgagctcgattcgtacccgttaatggtccgccaagcatacattgcccccttaggcagaccgaattcactcgcttgttgctttgcaatattttaggtgtgatatcgaaacatcaaaagctttttagcgatttgcggttgtgtgtatgtgaaaaaagccagcatgaacatttcggtatcccagaagaagtgaccaccatagccatttccagtcagtccctttgcagggatactggtgttctcatcacgacctgccgattgattcagttcgaaaaggttaaaccgcaagcacagttgaatctgtggatcaccatcgatcttaacatcactatgaagccaaaaagtctgccaaacttgagcggaagccattaattccgactgaaacgatgtccctcgaatataattatccaatgccgaaagatactgatcagcgtatacccttgcgttcactaaaggatgaatatcgccaatagcaaataagaactcaaagtttttctcgctgccttttttggcgtgatacttgcttcgatagccatactgattgttttcatctttgaaatagtcgattttaggatctggagccacattttcgttagcctgaaacgtcaaaatgatcccttgctgacttcgaaaagtggtaatcaaataactcggctgaccattatcagggataaagtccaactgcatctcaccaatgctctggcttacccgaacatcctcattctgctgatgtgtagcctgattcacataattgtgcagtttaataatctcaacgtcttcatcaaagtttgtcgggataatcgaatagcgtatcccatatacatttagtttgcttaaactggaaaaactttcgactaccagattaaagtttcggttctcaggtgttgtgattgaaaacatttcatgcagcagccccgtttgcatatccaggtttttatcaatattatccaccgtaaaatgatcgatagctgaatcctcatcggctactttaattctgatatatcttggatcaaatacccgattaataatttgatcattttcaggatatccggtatatttttcgccataactaacgtcgttgtaatcgaaaaaaccattaataaataatcccggcgacccaatataatccaggttatttccttgaagcggattagaatcacggacgccaaaatgaccattacccacattatagatagtttccaaaaataacggttccttactacgtaagttttgcaaatgaatttgaaattccggagattgttcaatcctcataagcaccgttcctcctgcataaaataattgacttaattttaccattctacataaagatttcactttttgtttgcaaaaaattcatatttttatgttagtacattatagtaatcattttaagatgttaagtttcattaaatctacacgggcagttgcaattattactttactagcttattacaacttggtatactttttattgactttccactatgatttaataagtcgataagtcattatgcatgcatctgcctatcaaatgacatataatcaatatgtaaataaaggctggtagcgtataaagatgaaaggtccttaaaggagaaaatattatgaatagcaaattactttcgtttcttgaagaaattaaggctcagggtaacatgtcaaaggcagctcaagcattatttgttacacaaccctatatcagtcgggtaataaaaaatgccgaggttaattttggagtcagattgattgaccgatcatctcatccgattcaattaacctatgcaggtgagaaattattatcttaccttcaagaagaaaatcgtctccgcgctaatttggacagagagatgacacatctttcagaatttaagtacggtcacttgaccattgcatcaaacgacatcttgtctaatgatatttatgaacccatcttgattagattctctcacaaatatccaaaaattcatgcacaagtgattcgcatgaacagtagagatgctgaaaagcgccttttgtcaggatccttggacttttttgttggtcaacccctttcaaatccaaaggttgaatatcaaccagtggcaaaaattccgcttgtcttcattattccggaatcttcttcattattccaagcaggtaaatatgaagtcgattatcaaagccttgattttagcaagttatccggtgaaccgtttattggtatcccacaacaagactattatcaacgagctgttaacaattatctcagtgatctaagtgtctctcctgaatatagcttggaagttcctgatattcatttggcagccaaccttgctattaacgcactgggtgtcacaatcgcacctgaaatgttcattgccgacccgtttgtcagcgacgaccaaaagaagaaacttaatgttgtccgtattccttccgatgctttaactgctgattttggaattacgtacatgaagaccaaacaaacttccgaacctattaatgatttattggaaatcatttctcaggtggtcgaagaatatacacccggtcgataatcaataaaaattcaacatttatgattaagggacacgctgttttgcaagatgcaaatagcgtgttctttttttattttctgactatgtaaccggttaaccccacgaagtatcctcctttgtcattaattattatcttcctgattttaataacaatctccacaaattccgtcacataaaattcatatttatgtaacattattgacatagtgtgttattcagagtaccctaacaatgattaggaaggagtcatgatcaatcacgtcaaggctttggggaaaattggcaatttaaattcaatcaaagagttgttcattttttgcactatcctcagagatttgttcgatacatagcgtgcatctcactgaaggaatttgagggaacattattctgaaaggtgactatgacacttaatcaggggtgattaagtgcgggggagatttttcacaggaagggtatgagtaatttgaagaagaaaaaaatattattggcaggtctcaccggtcttgccgtctttttaatgttgacaccatcagcttctgcagcttcaaagaagaagagtgcgggcagtgatccttatggcatcaacaagatcctaaagaaactaatggcaaagaaaaaagtttctccaaaacaacatgttcagctggacatttttttgaagccacagaaccaaagtcagcttactgatgagatttataacgtcaatacgccaggtaaaccgaatttcaagcaattttacacgccatcaagttttcgggcaaaatttggtcagcctgctaaagttaccggccaatataaaccatacttggccaaatatcatttgaagagtcatgttttcagtaacggattgatcattaaggtttcaggatccgctaagaacatcaacaaggctttctctacaaacctcgaaactgcaaaataccataataatccagtccaattttccagtaaaaagccaaaaatgcctgctgaattggcagacaatgtcttgacggttttaggaattaccaacttaaataccagggctggagggttggctaaaaagaacaaaacgaaagtcaaaaagcccgaaaagaaatatgcaccaagcaaattttcagacagataccaacttcagccgctttatgataaggggtatgaaggccagggacaaaccgttggaatcatctcatttgccggcttcaagaaatctgatgtcacccacttctggaaaagtgagggtgttaacagcaatcctaatcgaattactatcaagaagatttcaagcccgtccagccagcctaccaacgatgcattgtctcaagtagaaacaacggttgatgcccagcaagccggagcaattgcacctaaagccaacgtccgtgtttaccactcgaatttcagtgatgtcggcatggtgaatgtatttgcaaccgcctttgatgaaaataaagccggttccctttcattaagttggggaattaatgagtacatgacgcattatctgaagaataataaaatgctgacacccgtttatggacaagtcatgaatatcgtgatggcgcaaggcgcccttcaaggggtttcgacattcgttgcttctggagatagtggtgcacttggacaagggatcggcggtaaaatcggtcctatcagcattccaaactatagtacttatgcctttttcccggcagacaatccatgggttaccacaactgggggaacgacattgcctttcagtaaaaagatcaaaaaaggcatcaaagtctccgttgataaagaacgtgcctggggtggcgattacatgttcaacgcctacgccaagggtcgtcatgatctattgaataacattaaattatattcatacgcaatggccggcggtggcggtggcatcagccacctttacaacacgcctcaataccaggaaggcgttcccggtgttaatacctttaacgcccgtcaatacgtctcaaatctgatgcagccgcgaatgaaccctgttctggtgagcgggacagattatggtcgaaactaccctgatgtatccgcgaacgctgatccattgaccggatatgatctttatgataaagcactgggtggctggcaggttaccggtggtaccagctttgtcgcaccacaattcaatggtgcaactgcagtcatgaacagtggtaagggtcaacgaatgggcctttggaacacccagatttaccaattggcccaggataaagataagaatccatttacagtaatggacagtaccaccaataattccaatctttattacacaggtcagcccggaaaaatttataatcaagcaaccgggttgggaacggttaactttgaaaagctatatgacagttatcaataatttaaccatctaaaagttaaacaaaagaaccagctggacgccgagaaatctcagtgtctagctggttctttattttgctttattttattcttccactttatctttcaaaccggtatggttgagaagaacatttaaaataacggctgtaaagctgccgacaaccattccgttactcatgataacctgaacggttgctggtaagtattgaaataaattgggttgagtcgttaccccgagaccaaggccaactgaaactgcaatgatcagtaagtttttgttgttaagatcaattttggacaacattttaattccctgtgcccctaccatgccgaacataacgagcattgcaccaccaagaacagacgcaggaattagcgttgcaatcgcaccaaattttggaattaatcccaaaagcattaggaagaaggctgaataataaatcggtgccagcttcttgatgcccgataattcaacaatgccaacgttctgtgaaaaagttgagtatggaaaggtattgaatacaccgccaaggattgcggcaattccttctgaacgatagccatgttccaagtcacggtcttcgagtttacgcccggtaatttcacttaacgcaaaataaacaccggtcgattcaatcatacaagtcaaagcagccaggattaaggttgcaatcgacgaccattcaaacttgggtgcggcaaagtaaaagaattgtggtaattgtgcccaatgtgcctgaccgacggattcaaacccgactgtccccattgccaatgccgttagcgtaccaaccaaaatcccaattaaaatagcaatttgctttagaaacccacgtccccaaatgttcaaaacaataataatcagggccgtaaagaatcctaagaataaatgggttggatcaccaaaggctttagcagtcgagtcaccaccacccaggttttgaaaggcaaccggcatcaacgtaaacccgattaatgtgatcagtgagccggttacaactggtggaaagtatttacgcatatgagcaaatggcttagccgcaatgataataaataaaccggcacaaataatgccaccatacatataaccaagcccgaaattttttccaatcgactgaagtggtgccacatactcaaccgcacatcccaaaacaaccggcaatccaatccctgtaatcggtgttcgtctgatttgaagcagtgttgcaaccccacacatgaaaatatccatggaaacaaggtaggtcatctgtgttgcgttaaactttaacgcgccaccaatcaacaatggtaccaaaatatcgccagagtacattgcaagtaaatgttgaaaccctaaaattgcattacggataggtgttttcttatccgaaacagaaacattattcatcatgctctcccttttcattcgtgtttaaagtgataacgtcatgttaccatgaaactctgacaataacaacgccatttccgaataataacgctgacatactctaatatcaagacaaataacgaataattttacctttttctacttaaagacaagtcatctggatactaaaaaagcagttaaccggagaataccgattaactactgttctaatctcattcagaaataaccttgttgtttgatctttttagtaccaaccatatgcttgccaatgatgcttggcactgacccaactgccataacgagctttaacgtaacggtcagcagtcttttcttgattagctttcgaataatcaccatgtaaatatgatgagcttaattggtaacagccaacataacgaccattacgggcagaatatgagccccgtgattcgtgataggcaatccactttttagcggcaaggtttgcctttgatagatttgatttataagttgctgaagtactggttgtttgtgcgtttgcgatttcttgggttgcggctacttggaatgtcccaaacattgtaagtgccatcattaacgtaacgatagatttctttaaattcataatataactatttccctccgtaattaatcaacgactatgaatatacactgtcggatttacacgaaggtgtctagaaaattacaagcgtgttaaaacaaaagcgattttagtaatatttaagacagaataccgtaacaacggacaaagacgcccttcattttgtaatgaaaggcgtcaaattttagctaaaaaagattgaatataaacgctttccaagcatttgcatcgcatttatctgcttttgttgcgtgccattcttgaattttattgtgcctctctgccaaactgttataaaattatcattagactatattaacggggagtgattctttggaaccgcattttaacaaaataaccaaagcgggctatcaaaaaattaaagatgaaatcaaccagctcgaaaatgaccggcccattaaaatcaaaagtttggctgacgcacgagcgcttggcgatttgtcagaaaatgccgaatatagtgccgcaaaacgtgatcttcgtcatttggaaagccggcttcgctttttacgtaaagaattacaatattcaaagatttacacgccatccgacaacgacaatgtagaagtgggcaaatatgtcaccttcgaatttctcgatgacaagtcaaccgaaacctatcaaattgtcggcactcccgaagtggatattgacaatggaaaaatttctattgcatccccaatcggtgctgcccttttgaatcatcatactggtgaaatcgtcacaattcaggcgcccaacctcacctatcaggttaaaatcaaggaaattaaagtctaggagaaatctatgtcgcaatatgtcagtgttatttataccgccgttattttatttccattcttggcaatcctgatcacacttccaattctgttagttaattatcaccgctatggtgcccttcccaaatggaacatctttatgctctatacatttgtgttttatatcatgtgtgcttattttttgatcatcctgcccttacccactcaaagtttcgttaatcaattaaaaacacccacacacaacttcattccatttacttttatcatagaattttttaaatacaatccattttccttctttcatcccggaacctggttagcagcgctaaaggcgccaaccgttattcaaccggcatttaatatttttttaaccattccattcggtttttatctccactactattttcgtcgaaactggaagcaaacttttttgatgagtttctgcctctctttgtttttcgaagtgactcaatacacaggtctttatggtatctattcccgtccctatcgcttattcgacgttgatgatttaattctaaacacaaccggtgggcttcttggcttttggatagccggttggctcggaaaagttctgccatccagagaaagtgttcaatcccacacgctttcacatagtcacagtgtctccgccgttcgccgattgaccgcgttggcaatcgacctgatattaatgtcaatattaagttcactgattgcgttgattattcaacgtcatgactgggtagaaacgtttatggcctggtttatccttgtcattatccccgaagtcttttttcaacgttcattcggcatgcagcttgtccgaattcgagtgactaacaaattcggtaatcaagccaaatggtatcaggttattttgagaaatgtcatttcttatggtgtaatcggcggcaccttttgggccgactcttccttattaaatttaacaggcaccgcaccactgtcacaactctcaatgattcattggggtattgtggtcacctccttagtccttttgttcatcttggtggacctcctaatcgattcgtttgccagccggcatcgcctattttttgagcatctcagcgggacagataccaaggctaaaacggatcatttattcagctgataattaattcaagaaagttgccataacccctagtcgatttaagcatcattcactataatggaataaaaacgttgcctattatttgactgaaaagaggtttcataatggtcaaagaaagcacaaacgagttaatctatcctattattctgcatcatgaagaaatcggctacagtgtcgaaattccggatatcaatggtgcctggaccgaaggaattacaaaacaacaggcccttgacaaggcaagaaatcttatcggaacgaccttggttgatcagcctcggctcccaacgccaacaccattagacaatattattgttttatcaaaaagcggcgatatcaaaacaaccgtcacaattgatttggctttttatcaacaactcatgtcaggtaagggttcacaagagaataataatgccttttaattagatactcattgttaccaaaggggactcaatcaaaaaattgattgagtcccctttgtgaattcttgcttgttgcctaattattacacaacctattttaactactagaatttcagatagccttcgtgcccctggcttagcaattctacaggttgtccctttgcctgtagtcgcttaacccgcttttcaccccatacagacattgtaaccaacaaatcgcgtaatgttttcccttcatcagacaaataatattcaaccttgggaggtacctgattatagacttttcggacaataatctcgtcttcttccaattcccttaattgctgggtcaacatcttttgagtaatagttggaatacgacggcgaagttcaccggttctaagagggccatttccaagatggcataaaatgatcggcttccacttaccgccgataacatccaaagacgcttcaacaccaatatgataaattttttccatcgttaaactccttataatccttgataggtcccattaggcacttttaagtaactatatgactttttagtgcgtacttgttcaactttccgtaacccgtatactagcatatatagtttagaaagcccagtagaaatttggaggaaatcattttatgacaaagcaaccatttttatcaccgtttaaattcaataatggtttagaaatcaaaaatcatatcgtcatgtcaccaatgaccacaatgaccagtttttataatggtatgatcaccactgacgaactcaattactatgcaactcgtgccggtggtcccggaatgatgataacgggtgttgccaacgttagcgatagcggcaagggattcgaaggagaattatcggttgcccacgacgacatgctccccgggctaaccaatctggcgagtgtgattcatcaagacggcacaaaggccatcctgcaaatctttcacgcaggccgcaaatcaaatagtgccattcttcgcggtgaaaagccggttagtgccagtgcaattgcggccacttatccggctaattccgagacgccacgggcattaacgactgacgagattcttcaacttatttctgatttcggtgaagccacaaggcgagctatcaagaccggctttgacggcattgagcttcacggtgccaacacgtatctgctgcaacaattttattctgaaaatgccaatcaacgaaccgatgactgggggggttcaagagaaaaacggctgaagttcccactcgctgtgattgaaaccgtcaatgaaatcgttaaaaactatgcagataagccctttttagtcggctatcgactttcaccggaagaaatcgaaacaccggggattcgtttgaaagattccctcttctttgttgatcaaattaaagataaagttgattatcttcacctttcaatggggagttacaagcgaacttcgttaaatgatccaagtaacaagcaatcattaatttctcaatttgctgaacatactcatggcatcattccgcttatcgggatcggatctgtgacaacccccgaagacgttaatgctgcgatggccgatggtgctgatttggttgctattgggcgaacctttattcgggaaccacagtgggttcaaaaggtggctcacaatgatctaaaaagtatccggacacaaatcagtccgtcagatatggatgagttagcaattccaccggttatgcaaacgtatttgagagagtccttttattctgttatgcagtttactgatgatcccgaacttcatcaggattatcaaaattcgctggcaccgatggaagggtttgagaaaaaactttagttattttgctgaaacatgaaggctaggaactacgcgaactcgacgtggttcttagcctttttttgaccaaaattacaaagcaatcccttctgcgttgtatactttaatcaactaaaaaagaaacattggcgatttacattctaactaagaggacaaaaagccaaaaataatattcataaattcaacttggcggttcggctattttggctgattccgtatattgtgggaatagttattggaaccgtcatgtaaatcaaaaaattttcattattaaattgcttcaagaaaggaattatttcatgggaaaaaggcattcaacttttgcgatgatcatcttgattatcggcgtgtttatgtcggctttggataacggcattattgccagtgcgctttcgacaatcaattattcatttcaagtcagtgaggttcaaggaacgtggggaattacaggctacacgctgggaatggcaatttccaccccgattattggcaagctggccgataaatttggtcgacgaaaactattcctgattgaaattagtatctttgcgcttggatcattgctggtagcgctgagtccgtcattcattctctttttagctgccagattaattcagtcagttggtggcggtgggatttttattattgcctccagtcacgtattatcgacatatccgaaagacaagcagggtggcctgcttggtgcactgggtgcggttaatggaattgcttcggtagtgggtccgaatcttggaagtttgattttaaatatgaccggccgctggaattggctcttcttaattaatctgccgattgcattattcgtgattattagcggctatttggttattccggagacaaaagccagcagcatcaaaacaatcgattttaaagggttggttctattaagcctgggtattttaagctttatgttggcaatcactaacctgcaaagcaatgctttagttggaagcttgttgagaatccaggtatggggcttgattggtttaggcattattctgtttatcatgtttattcgagttgaaaagcgggtttcagatcaggtggatccttttctgccttaccagttattacgcagccaaggatttgttttaacactattaatgggcattttgtccggagctttaatcggaatctttgtcttcatcccaagtttcgttgaacagcgttatggcatttcagctgataatagtgggatttggatgagtggtatcggattgggttcggtcgttggtgcagcggttggcgggtcgttgacttctaaatttggctcaaccaaaacaattgttatctccggatctttatcgacagtcggatttgccctaattgcttatttaagtcccaatccgctttggtttatcttgtcttcaacaattgccgggattggttttgggatgttaatgggagcgccattatccgtattgatagccgaagttgccagtaaaaaggacaatggtgttgcccttgggactttgtccgttagtcggcaagtcggtattacaattgcccccattatttacgcaacgattattcaaagcggattcagcagcattcaaatgaacacgtccattgaacagtattaccgcggtcttcagcgaatgaccggtagtaatcgatatcaacttttaagggctttttacgcgacagctcagcaagcttaccaacagatgttttggctggcaattatcgcttcgatggtcattacgttgatcggttggtatttgatgaggcggcagcataggttattgaactcatgatgtttttgatattaattttaaaaaggatcctaagacaaaacttcacttacttgccttaagatccctttttaattttcaggtgattataataaaaagataatgtcacatccaaacattgaactactgtagcgtatacatccgctgcaatttcccaatcagagaaattcttcatggtttaggctaacccatggctttgggatatgatgatagtaagattttaatttatggaggtctttcaatgacagatatatatgatgatcaatccttttttgaagcttacagtcaaatgccccgctcaaaatacggcctaagtgcagcgggcgaatggcacgaactgcgcaaactctttccggactttacaggaaagaccgttttagaccttggttgcggctatggttggcactgtcgttatgcagccgatcatggtgccaaagaagtcgttggtatcgatgcatccggtaagatgattgacaaggcacaagacatgaccactcagcccaacattcattatcatattatggacatgatggcaatcgaccagcttgaagctaaattcgatgttatcatcagttcgctggctatccactatatcaaagattacggtgcattaatcgaaaaaattcataacgctttaaatgttcacggtcagttgatcatgagtgtcgaacaccccattttcacagctgaaggacacgaagaatggatgatggactcaaatggccgtcccaaatactggccggtcgatcactacttcgatcaaagtaaacgaaccacggattttctcgggttccctgttcaaaaatatcatcgaacagtggccacctatttaaataccctgctcaatcacgattttacattaaatcaaatcaacgaacccactccaactaatgaaatgctggctaaaagtcaagaaatgcgtgatgaattaagacggccaatgatgctcatcatttcagcaaatcggacccattgatctgtatcgataatgattaggcggcgtccagttgctcattgtttcgatcaggtctcattttgatcaccagtttcttgattcctgaaagcacaaatgttggaactgcagaaatgagtatgataccaaggtacattggcatggttaacggtgccgtccccatcacattattgaagaatgggataagggtcgccaaaattgatgacgttgccgcaaagccaacagccagcgttaacctggagttgctaaacggactgcgatcaaaaagtgttttagcacttctggcatcataaacgtgccatagttggccaaataccaatgttaaaaacgcaatcgtctgactttgtgcaaccgagtatccctgagaagctgcccaaataaatgctaagaagaccagtccgcccataacggatccccgaagcaataccctggtcagcatgccatttgccaaaatggattgccgtgtatttcgtggcttctgtttcatcaaatcagcttccggtttgtcgtaacccaaggcaaaagatggtaacgaatcactaatcatgttaacccataataccattaaagcggttagtgtcggcgtcacttccgagacctcaccgattggggaggtaattaagaaaacacccaataaaagtgacaacacttccgcaacgttggtcgttaattcatgccgcataaaatttaaaatattcgaaaaaattgttcgaccgaatttaaccgatttttcaattgttgtaaactgatcatccagtaaaatcagatcagcagcatctttggtgacttccgttccgttgattcccatcgcaataccaatgtctgctgctttcaatgccggtgcgtcattaatgccgtccccggtcattgcgacaacttgttgatgcgcttgaagcgtcctgatgatgcgttgcttatgcgcaggggttactcgcgcataaacccgggtatccaacgcaagtttgcttaactgttcatcggtcattttttctaattcccgaccagtgatgactcttgcatcttcccgtttgataatgcccaactgtttggcaattgctttagccgtttctgcatgatctcccgtaatcatcacaacattaaccgatgcatcggaaagattcttaatggatgctttcacttcttctcttggcggatcaataatgccaaccaagccaacaaaacatagatctttctccaattcgtctgcggaagcattcagagcttgatcttttgtcacttttctctgcgtgagcgcaatggttctcagggcatccccagcaaaatccagaactgtctgctgaatctcttcttcaacagtttcatctttttttacgataccattcattaaaaccgactttgttcttaaagcaacaacgtccggcgcacctttcgtcaaactgtaatagtcgttattttctttaatcacgaccgtcatcatcttccgagtactgtcaaatggtaacactcgaataatatcaacatcatgaccggcttggttttccaacaaagcgtctcgtttaatcccttgtttagcacccagcacaaccaatgacacatcggtcggattcccgaacggtcgccaattttgcttttcgtcgggtttgatttcagcctcgttattcaaaaccgctacttcgagtaatcggagaaaatctttccggcttccgggctctccgtttgttttaataaaatcgccaaccggtgtatacccctttccttcaacctggtaaacctgtccattagtcagaaaacgggtaacggtcatttcgttcttggtcaaggttccagttttgtcagacgcaatataagttgttgccccaagtgtttccacactgctcaatgatttaatcaaccccttattatctgctaacattttggcaccaatggtcaagacgattgaaagcaccaccggcatggcatccggaatcgaagccaccgcaatcgcaattgccgtggatgatgttccggccaaatctccaactgaaatagcaccgttatccatcaatgatttaacaagatcaaacccgattgtcagtagaataatcatccctgccaacaacatcaattttttacttaagctatgaaccgattgttcaataggtgtctttgtttcaccaatatcctgcatcaaatcggaaattcgtcccagttctgtattcatcccggtttcaacaatgacgccgatgccattaccgttaacgaccattgaaccggaataccccatgttggttcgatccccgagttcggtgtcctcaggtaattgaacgattgtcttactaatggcttcagactcgccggttaaatgggcctcgtctacttgtaattcggacaccttgacccagcgtaggtctccttcaataaaatcaccggacttaacagtcacaacatctccgggaactaattgatcggcagctatcgattcccacgaaccgtttctcagcacgctcatatggtgctgtcgcatgctggacaaggcagccaacgacttttgagccgatcgggtttgatggaaggtcaagccaccattaattaaaacaataatcaaaatagcagcggcttcatacacagaagccattgcatgagcgtgatcccccgtcacattaaaatcataaactgcacttgcaagcgccagaacagtggcgaccagcaaaataataattaaaggttccttgaaacttcttaagaaaagcttccatcctggatcattttcttttgtcctcagttgattagggccaaattccgccagtcgtttctggacctgtctatccgttagtccattcattcggctggtgcttaacgctttaaagattgcgtcaccacttttatcataccatttcatcacatttctccttatcgttttgattagtaaaaattaatataatataatcatagtgtaacaaaaatcagtcgcaaatatgtgaattttgtgtgaacaaataatgtcttaaatataaattaataagcaaaaagcaaacctaaaagattatcttaagtttgcttcttgcttattttttaactttggatttagtgaatcggtaatatagataacaggtagccataacagccgcaatcaccagcagcacaatcagccactgatctatcatctctagcagttttgtccatgcatgaccggcataatggcccgttaaaattaaaacggtattccagataaaagtccccaatagcgtcaatcctgaaaatttagccaaagggtaggccgtcattcccgctggaattgaaaccagactcctgacaaccggaatacaacgaccaactaaaattgcccaaccaccacgtttattaaaataatgacccgctttttcgatatcagtcggtttaagtcgcaacatgcgaccgatttttccggacaccaacttttccatctgggcaacactaagcaaccgccccactccgtacaaagccaacgcaccgatataggcaccaattgtcgctgctataatcgatccccaaatagttagatgattggttaatgttaaataaccggtaaagacaagaaccagttcagatggaattggtggaaatatattttcaaatgcaattaggaatgcaactgccaaatagccatattgattgattaattcagtaatggttgtttcgctcaattaattgcctcgtttcttattcaatgtgctgagctgatcggaacaagtccacttgcccttcaaaaatcgatcatgataacctgttttatggatcagtaccaaaagtatatcatatcccggtcaactaaaaatacttagacaatttaagtttctttaaatacagcgactgggcaaccgatagaaaaatccaaacccgggatttccgaaaagaacgccttacactccgaatgctaaccgctttgttccacacgctttttttaggactgctcctcaaagcagtaccactccatataagggatctatttgaaaaatccaaacccgggatttcccaaatcgacgccttatcttccgggtactaaccgctttgttccgcacacttattttttattctctttcactcccccttatctttggcttataattaaaatgtaccaataaaggaggtttttacatttatgaaaactgttaagataggcggcactcactttgaaacatctgccgtagcacttggtattatgcgaatggccggtatggacaccgcagacgcggccaaaacactacaagccgcaaacgaagccgggattaactacattgattccgccgacatttatggtgaaggtggatcggaaaaaacatttaaagaagccttgaaagcctcaggaatttcaagggataacctatacatccaatccaagggtggcattattcttgatcccaagagaagtcatgatggtcttgtctttggcgcacgatatgatttttcaaaacaacacattattgatgctgtcgatgggattttgcaacgaatgggaatcgattacctggattcattcctattacatcgtccggatccattgatggaagcagacgacattgcagatgctttcgacacattgcaacgagaaggaaaagtacgacacttcggtgtatcgaactttaatccacaacaggttgaaatggttcaatcatggatcagtcaacgtctcctcattaatcaacttcaattcaatgtcgttcattccggcatgataaagggcggcatgcacgtcaacatgatcgatgacgcaagtattgaccatgacggtggtatcttagaatatagtcgccgcaagcacatgaccattcaagcatggtcaccatttaattatggcttgtttgccggtatgtacattaatgatccaaagtatccaaagctaaacaagaaattggaagaactcggaaacaaatacggtgtttctaaaaacgcaattgctacagcttggattcttcgacatcctgcacatgttcaagtattgttgggcacaatgaaccctgaacacatcaaagacagcgcatcaggtgccgacatcaacttgacgaagcaggaatggtatgatctgtacttcgcagcgggaaatgatttgccataaaaaaatacaagtgtgcggagcaaagcataccaaaatcaaataatatcatatccactcagcggttacgtatctgttgccgctgagtttttaatgacaggaagaattaaaatatgagtaaacgcagaagaaagaaacgccggtcaaactccctactgagtttaatcgtgaccttgattgttttggtcggtgcgtggtattttaccggtggtcagccgagtaatttaaccgatttatttaatcaagccacccaaacagtcacaaattcaactaaaaacgttgcttcaaatgataagttggctgatttgacttaccattccggcgaatcgagtttcgtctatgttaaccataacaaggccaaacttgatcctcaaaagtggcaggtcaataaagtcatttattcaaatttggattctcttaaccggactagtaccggtaaccttgcttacctggaatcccgtaatctggcatctgatgacaatcgggtccgtcaatacgttgaaccaaccgcttggcatcaaaaatttgtagatcggcagccaatcattaaccgtggtcacttaattgcctattcaatttcaaagggcattaatcaaaatggtcactataacccaagtgacacttccggagatcaaaacaatcccaagaacctgttcacccaaacagccttttccaatcagcggattcaaactatttatgaacaaaaaatccgctctgctctaagggatggcaagcgcgtggttttctttgccaagccaatttttagagacaaagaattaatggccaggggcattcatcttgaggcaatcagtaccgatcgttcacttgattttaacgtctatctgttcaacgttcagcctaatgtcaaatttgattatgcaaccggtcgatcaaccattgatcgaactatgaaagtaccagaaccataaaaatgaacgattcggataacacccattcgaatcgctcatttttttacttctcactttagtaattcattttgccaactgcgataacattcacaatttttcagccaaattatgccgttggctcatcacaaaacatgataaaatacaaccaatgatatcagtttacttaaaaaggagaaaaaacatggtttctattacccagacaatgcatcagcaagctgctccactgtggcaggaaagctttgaccaccctttcattaaagaactggctgctggatcattaccgactgacactttccgttactacttaaaacaggatcgctattatctagaaaactttggcgacctgcatcagcaaattgcagatcatctatccgatgcatccattaaacaattcctttacgatggcgctcagggtcttcacgatgacgaggcaactatccgcagggaattctttcaggaattatcgattacgaccgatgaaataaaagcaaccccaatcgctcctaatgcctacaattatgtttcccatatgtatcatgaattaaacgaggggtcaccggcacgagcagcggccgctttattgccatgctactggctatataacgagataggcaaaaaattggttaaaaatggctcaccagtcaaaatatatcaacaatttatcaatacctacgatagcaatggcttcaccgatgccacaaatcaaatgatcaacattgttgacaagctgggggagcaagctgatcccgatgagaaacaaaagatgaataccgcctttattcgtagcagttactatgagttgcatttctggggaatggcttacaatcaccaaaaatgggcataaagtggtgaactacttggtcaaaaatgtcagatcatttttgggcaactattctggacatcatcgacaaacaagcagataatgaccctgaaagtttggttaatacccgttttctcaccctaaggagacgatcatcatgaatgaaggccaggaagaattcttagatttctttattgcaagaacacttaaggataaaagggacgaagctgaacaagtactcattcaagcttttagtgaacaggagcataagaaactgactactgcaaatctaactgatctacaaaatacgttgtttccattggtcaaacccgagaattatgatgaggtagaagccgccatgaagcatttcgcaaacagtctgtgaccttttataaattaaaaatgggcatcataaaacgaggttagacattttaccgtcctagcctcgttttttgctttattagattaggctgggatggcatgtgtgccgatgctaaatgttaagcagcaccactccctataagagatcaattcaaaaaatccaaactcgggatttcccaaatcgacgtcttatactccgggtgctaaccgcttagctccgcacactgcttttaatgaatccctaattccagctttgcctctcttgacatcttgtcaattgaccacgccggctcgaaaacaacgttgatataaacgtctttaacctcatcgaatccggttaattcttcacgaatggcttcgtttaaataatcggttaacggacatcccgcaatcgtcaacgtcatcgttaatgtacataatccttcatcatctaattcaacaccataaatcaagcctaaattaacgatatcaatacccaattccggatcaatgacattctctaaaacatccatcgctttttctttaaatggccgattgtcaatttcactcatagcgtggcctcctcgttattttttcttttggatgctgatactttgcttcacacactgttttaggactgctccaaaagactgattcctgccatacaagaaactaaatccaatatcccaaaaccggggatattgaattcagctccttgtactccggaaccaaaacgtctttttccgcacacttattttaggactgctcctcaaagcagtaccactccatataagggatcgatttgaaaaatccaaacccgggatttcccaaatcgacgccttatcttccgggtactaaccgctttgatacgcacactatccaattgacccttccatttcgaaactaattagtcggttcaattcaaccgcgtattccattggtaattcctttgtaaagggctccacaaagctcataatgatcatttcagtagctttttgttcggaaattccacgagacattaaataataaagctgctcttcagaaattttagaaactttagcttcatgttccatcgacacattatcgtttaaaatctcgttatatggaatcgtatcactggttgattgatcatccataataatcgtatcacactcaacgtgggcaaaagaaccatccgagtgccgaccaaatttgattttgccacggtaatcaactgcgccaccgtctttagaaattgactttgaaataactgaagacgacgtattcggtgcgttatgaatcatttgggcaccggtatcggaatcaatattcttgccggcaaccgcaatcgacagcattgtgccacgagcaccctcaccgtttaaataaacagatgggtatttcattgtgatttttgaacccaggttgccatcaacccattccataattgcattatccagagcctgagcccgcttggtttccaaactataaacgttatttgaccagttctgaatagtcgtatatcgacaataagcatttggcaacacattgacttcaacaacggccgcatgcaaactgtcgctcttgtatgtaggcgcagtacatccctcaacatattccaaatgtgcaccttcatccacaataatcaaggtacgttcaaattgaccggacttctcagcgttaattcggaaataggattgaatcggcgttgtgaccgtcacaccttttggtacgtaaataaacgtcccaccggaccaaacagccgaatttaacgcagcgtatttattattcgttggtttgacaagtttgccaaaccattttttaaaaagatccgggtacttttttaaagccgtatcggtatcggtaaaaataatccccagtttatcgaactgctcttccatcttgtggtaaaccacttctgattcatactgagcagacgatccagccaaatattttcgttcggcctgaggaacccccaaacggtcaaaagttgttttgatatcctgtggcacatcatcccagtcacgatactgtttatcagttgcccgttggaaaaacttcatatgttccaaatcaagaccggttaaatcaggaccaaagccgggctcagacattttcaaataagcatgataggcctttaaccgataatcaagcatccactttggttcatccttggcttttgaaatttctcgaaccgtatcttccgttaaacccagtccggttgaataaacgggcttgacattgtcatgaaaaccaaattcataatctttatcatcaagtacttctgaaacatcagtcacttgccccactcccttcctcgttcaacacttcatccattgcgtgccacgctaaagccgcacacttaattctggtaggaaattccgcaaccgtgccaacaatcgcggcatctcccaataattcctcatcttcatcatcaatctcatcgccactaatcagcttggaaaatgccaaaatcaattttctggcggtcttaacatccttgccgattagaaccgtcgtcattaaactggcggaagcttgggaaatcgtacatccggatccatcaaaggcaacatcattaatttgaccgtctttaacaacaactgatactttaatgacgtccccacaggttggatttttcaaacgcttctcaccggttggatccgccaattcacctttatgtctcggaaattgagcgtgatcgataatcactgttttataaagttcgttcagctttgccaatcccatttgcgaaaaactcctttacttcgttcaacccgtcaagcaaacggtcggcttcttcctttgtgttatagaaatagaagctggcccgacaagttgcctcacagcttaaatattccattaacggttgggcgcaatgatgacctgctcgaacggcaatcccatccatatccagaccggttgcgacatcatgagggtgtaagcctttcaggttaaatgacagaaccccagtatgtttggctggatcatgcggaccataaaccgtaatgccatcgatttgaagtaatttgggtaatgtatagtccacgatttcctgttcataagcggatatattatccattcccaagttattcaaataatcaattgcgctgcccagtgcaatcgcgccactgatattgggcgtgccggcttcaaacttccatggcgattccttccagtcagctgcctgttcatgaacttcattgatcatttcgccgccgaattgggcaggtgccatttggtcaagaatttccggcttaccgtataaaatcccaatcccggttggtgccaacatcttatgacctgaaaaggcatagaaatcaacatccaaatcctgaacatccacttttagatgaggagttgactgcgcaccatctgcaatcatataagcgccatgctgatgagctaatttggttagggctttaattgggttgataacccccataacgttggacgcatgagcaattgaaacgatcttagtcttatcggttatcttctttttggcatctgccatgtcaagttcaccatcagcagttaacccgatgtattttaacgttgcgtgctgattcttagcaacctgctgccaaggaaccacattactgtggtgctccaattccgaaatgacaatctcatcacctccattgacgacactgttgccaaaacttgaggcaatccaatttaatccttcggtcgtcgaacgggtgtaaatcactgattttcgactcttggcattaataaaagctgcaactttgtcccgggcagcttcgaattcttccgttgcccgctccgctaatgtatgaaccccacgatgaacattggcattgtcatgttcatagtaatgaattaaggcgttcaatacactgaccggtttttgcgtcgttgcggcattgtccagataaaccagttgctcgccgtttactttttgatcaaggatcgggaaatccgatcttgaattattcagtcccttgctcatttgaaagcttcctttccatcatctctaccatttgttccctaacgtctgcaactggaatatctcgtaagacaacacccagaaagcctcgaacaaccagtcttttggccacttttttggacaagccgcgactcatcaagtaatacagctgctttttattaatttgaccgacactggccgcatgaccggcaatgacgtcattttcatcaatcagcaaaatcgggttggcatctccgtgtgcttttggtgataacatcaacacgcgattctcctgttgggcttttgcgccgtgcgcaccgtgaataattttgccgacaccgttaaaaatcagggttgaactatccagcaaaacgccccgttgtaaaatgttgccttccgagtggcgaccataattagtgacctgcgtatcaagcccctgcacctgttttccggttgacagcgccaccgtctgcatctcagtgtgtgacccgtctcccattaagtcggagtcgaaatcggcaaccgtatgaccatcattcaggacacccattgtccaatcgattctggcactgctttccaagtaaccccggcggttatagtaggcataggtgtttttggccaatgtatccaaagcggaaaactttacataactggaatcctcggcaataatctctaccgtgacatgggccggattagtctgttcaccaatcgttgatactcgttgtagaacagaaaaatgactgtttgcgccggctacaatcagtgtatgattaacaaaactttctttaacccggctgtcttgaacggccatgagatttatcggatctttgatatcgacattgtccggcacatatagaaaagtgccaccgttcattaacgcagcgttaacagctgtcagtcggttctctttgtatttaacggctttttgaaatagatattttgatagtgtctcactgtgatcgcggattgccgttttcatatcggttaaaataatgccctttgactttaaatcgtcactaagatcatttttgattgtttttttaccaacgctgacaaagtggtaattttcagtcgggtccaataatgaagtaacgtcacctgttggctgttcctctgtctccgtaaaatcaagtagtggccaggaatggtagtccaccttatcaaacaccggcaatgttaatttatctacctgtttccaggcttcatcccgcaaatttgtcaaccactccggttcattatcaaatctggcttgtttcaaaagtgcaggattgagttttcgggcttttgttgaaagcatgctacttcccccctccgacactaacatcatcatcaaccaggttcacatctaagcccaattcatctttcaaaccggcgtaaccttctgcttcaagtttttctgccaaactggcgtcaccggttttgacaatccgaccatccatcatgacgtgaacttgatcgggatgaatataattcagtaatcgttgatagtgggtaatcattaaagtcccaaaatccgggctttccatatgattgacacccttggcaaccacttgcagtgcatcgatatccaatccagaatcaatttcatccagaatcgcaaatttaggctgaatcatcatcaattgtaaaatttcatttcgtttcttttcaccaccggaaaagccttcgttcaaataacgttcggtcatttcatccgacatgttaaggactttcaaattctcatcaagcttctttaaaaattttcgaatgggtaacggtttttctctggttgcgttaacagctgtccgcataaattccaaatttgtaattcctttaatctcgaccgggtactgcattgccaggaacaaccctgcccgagcacgttcgtcgaccttcttatttaaaatactttctccatctaaagtaatgtctccttgagtaacgtgataattcggatttcccatgatcgtttcagacagagtcgatttcccggttccgttcggtcccatgatcgcgtgagtttcacccgtgttaatcaccaagttgacacctttcaaaatttcttgtcgtttcttggtctcctcatcttcaactgcgacgtgaagatcagttacttttaaagttgccatatcgcgattctcccttccataacgtctgctttgatttaattaataccgcttgaaatatgtatttttacatacatttggaatatttatagaaacagctttcccataaatatgtatcattaaaattagattaaattataaacgctaagaccccctttttgcaataccaaacttaatattcgtttagaatttaaatttttcgcttattggaataataacaaaatggtcaacttaaattcaccatttcacataatttatgtataataggtagaatctcggttttttattacactatgcaaaaaaacattgtaattttataattattagaatactatgagaactacacaattggtatggacaatctgagtttaaattattaaggtaggtggtttcatggatagcttaaaggatgacggcaagttaatgtactcacccaagtttgagcacgcagcctgtggaatgggctttatcactcaagtggatggccatccgagtcatgagattgtggaaaaggctttgaccatgttacaaagaatgaatcatcgtggtggtaccggggccgaacccgataccggtgacggtgccgggatacttatggcactgccggacgcgttcttccgtgatcaaatggcgaaatacgaattaacgttaccgaaatctggtgactacgcggtcgctcaacttttcttaccacatgacgcgcaggagaaagcttcaatgttacaagcagttaccagtcaaattgacgaagccgggtttccggttttgtggacacgtaacgtgccgtttgtttatgaaaattgcggtccggcagcccaacaatcgatgccgggatttgtgcaggttatcttacagcgtccggtcgatatcaacctgggacaggactttgaagaccatctctatgttttaagacggcagctcgaaaaaacttttgaccgtcagtcgatgtacatttgctccttatcgagccgcacaattgtttacaagggaatgctacatgcttatcaggtcagcctcttttatccggatcttcacgatccacaaatgaagagtgcaatctgtttgatccattcccgtttctcaaccaatacatttccaagctgggatcgagcccagcctttccgtttcctggctcataacggtgaaatcaacacgttaaagggcgccgaaaactggatgaccagtcacggaatcgagatttatgatgaggacgattccgactcggctaaattggaaaattgcatggagtacttatatcgccatggccgatcgatcccacaatcattaatgatgatggtaccggaagcatggggaagcggcacagagatgtcagatgaacaacgggcatttgatgaatataatgccacgttcatggcaccttgggacggtcctgccgccctatgttttacagatggcattcaagtcggtgcttttcttgaccgaaatggcttacgaccatcccgattcaccttaacaaaagacaaccaactcgtggttgcatcggaatccggcgttgtcgatgttgatccaagtgacatcgttgacaaaggaatcctggctccggctgaaatgattctggtcgataccagtaccggaagaatttccaagactgatgaactgaagcgtgactgcgcagaggctcatccttaccagcaatggctcaatgcaaatcgtttgacactcgctaatttgccagaagttaaacctgaagcaagtatttcaaaagatagtttaaaaaagctttggcttcgaaacggatacacccatgaggttattcaaacagcacttattccaatggctcaaaacggtggtgaacccgttgttgcaatgggatttgattccccattagccgttttgagcaaaaagccacagtcgctttttacctatttcaagcagtccttcgcacaagtgaccaatccgccaattgatccattacgtgaaaaagtggttattggcacatttggttttcttggacgtgatggtgactgcacgaaagattccgctgaaaactgtcataaattaaaaattgacagcccgattcttaacgatcaggaatatgccaaaatcctcagcttggacttacctgctttaaaagtggctaaattgtccctggcttacgatctggcggacacccccgatcgattggcacatgtccttaaggatttgtttacccaagctgaaaatgcaattgacagcggcgctacaatcttggtgttaagtgatcggccggttgccgataatcaaatgacaatcccggttcttttggccgtttccggcttacacaattatttggttcgccaaggaaaaggtacggcggcctcaatcgttgttgacactgccgaagcgtgtgaaattcaccacttcgcctgtctggtcggctacggtgctgccgcaatccatccgtatggtgcctttgcaaccttacgtgaaagaggccttgagaatcatttggaagattactgtcatgcatcaaccaagggcattatcaagattatgagtcgaatgggaatctcaacaactgccggctatcagggtgcccaattatttgaagcggtcggattatccgatgcggtggttgaacaatactttacgggaaccccaacccgaattggcggcatcagcctcaaccaaattgaaaatgagtattatcgaaaatataaattaacgttcagcaatcactccgttgatgatttaccatccgggggcagcttccaatacaaggtggatggcgaagaacatctttacaatccaaccagtatttaccagttccagaaagccgttcgaacgggtgattaccaggaatatcaaaaatacacagccgaaatgaacaaggaagccaaggagaatccggttaccctgcgttcaatgtggaatattgagacaaatgataacaaaccggtcccactaagtgaagttgaacctgtcagttccatcgttaagcgtttcaaatccggtgcgatgagtttcggtgccctttccgaagaagcacatgaaaccattgcgattgctatgaacaaattaggtgccagaagcaactccggcgaaggtggcgaaagtcgcaaccgattccacgtgggtgccgacggtcttgatcgaaacagtaagatcaaacaggtatcaactgccagattcggtgtcaataccgaatacctgatgagtgccgaagaaattcagattaaaatggctcaaggtgcaaagcccggtgaaggtggccaattaccggccggcaaggcctatccgtgggtcgcaagtatccggggatcgattgccggtgtgcaactaatctcaccaccgcctcatcatgatatttattccatcgaggatttggcacagttaatctatgatttaaagcaggttaacccttatgccaaaattaacgtaaagttggtatcttcaaccggtgtcggcacaatcgctgccggtgttgttaaggccggagccaacacggttgttatctccgggtatgacggtggtaccggtgcggctccccgaaactccactcgggattgcggtcttccttgggaaatgggcctggccgatgcccaccagacattggcattaaacaaattacgtcaacgaacaactttggaagttgatggtaaattattaaccggccgcgacattgccattgccattatgttgggcgcagaagaatttagttttgcaaccttaacaatggtctcaatcggctgtgtcatgatgcgaaagtgtaatttaaatacatgtccagttgggatcaccactcagaaccccgaactccggaaactatattccggtcgtcctgaacatgttattaatatgatgcacttcctggctgaagatttacgggaacaaatggctgctttgggctatcgaacagttgaccaaatggttgggcacggtgaacacctaaagccgcgttacgtgccatcaggcaagtccaaaactttaaattacgaccgaatgctaaacaagacgatcacgattgatcgtaagaaggaaaatccattcaagccgaagtatgactggccggatttggatcgtttcgcagaaaccagtttgaagaatcagaattcaaccactatcaatctaccaatcaataacgttgaccgggcggttggcacccgactcggcggttggattggggctcattttggtaactatggtttgaaaccgggccaactacggtttaattaccacggaaccgccggccaaagtttcggtgcctttatcactcagggacttgaaatcaaactggttggtgaagccaatgattacgttggtaaaggcttatccggcggccgtttgatcgttgctgcccctcaccaagccaaagaactttacactcactcaccaattgtcggcaacgttgcctgctttggtgcaaccggcggtgaggcctacttcaatggtcgtgccggtgaacgcttctgtgtccgaaactccggtgccaatgttgttgtagaaggtgttggtaataacggctgtgagtatatgaccggtggggtagccgtcattcttggacggacaggccggaactttgcggccggcatgtccggtggtgtcgcttacgtttatgattggacacacaactttgaaaaaaactgcaaccgggacttggttgacctctatcatctggatgaagccggtgatgacagcattcttcaagaactcctaaagaaacacgttcaatacaccgattcggaaaccgctcgaaagattcttgataactgggaagttgaaaagcacacctttgtcaaggtttaccctcgtgattatcacaagatgcgcaagctgattcgtgaatacacgaaaccgggaatttcagaagaaaaagtgattgaaaaagccttttatacggctacgagtcaagattaggaggaattcaaaatggcagatccaagaggatttttaaaatatcccagaaaagataatcccatgcgcccaatcatgcagcgtgttaaagactttaacgcaatggaacttgacttaagcgacgcagatcgtcgagaacaggctgcccgttgtatgaattgtgggattccattttgtcaccatggtgttttctttggtggcggccgagcggtcagcggttgcccaaacgataatctcattcccgaatggaatgaccttgtttatcgtgatcaggaccggcgggcatttgaacggctaagccggacaaatatgctgccggatatgactgggcgggtttgtcccgcaccctgcgaggtttcctgtgtacaggcattaaacggaccgggaattaccattcgaaataatgagaaattcattattgaacaagcctttaaaaatggctgggttgttgattccggtaaaccacttcgtcggaccggcaaaaagattgccgttatcggtagtggtcccgccggcatttcagctgcatggcgactaaatcagttgggtcattctgtgacactgtttgaacgtgacgaccgttttggcggatttctgatgtatggtattccaaacatgaaattaccaaaggaagtcgttcagcgccgaatcaataccctatctcaagtcggcattgatctggttcccaatacagaagtcggcaaagacatttcggcggaagaactcaaaaaagaatttgaccgggttgtgatttgtaccggtgcccgacaagcacgtgacctgaatgttaaagggcgggatctttccggtatttatcaggcagctgactttctaaaaattgccactaaagaagtcctgaaggatggcactaaagccaataaccgcctaaagggcaagcatgtcttaatccttggcggtggtgatacgggtaatgattgtattggaacggcaattcgccaaggatgcgccggcattacgcagttggaaattacgcctgcccttcctaaagaacgaacgtcaaaaaatcaatggcccgaatggccgatggttttaaagaccggttatggtcaaaaagaagccaaggcactctttggcaacgttacggaatattcagcaacagcaactgctttctttggtgaaaatggccaagttaaagaagcagaaatcagtcaggtagatcattttaagccgattgccggtaccgaaaagcgaatcaaagccgatgttgttgtgttggcaatgggctttaccggtgcagagcaatggctgtttgaccaatttggcattactaagaaaaatgacaattacaccacaaatgacaaccaaatctacgttgccggtgattgccgccgcggtccaagtctcgttatttggggcattcatgaaggccgtttatgtgcagaaaaaatcgatgcgtcattgcaaaccttagcaagcgcaaaactatagcacaaaaaaataaggtctacatttctcaactggattggaaatgtagaccttatttttatttgccggcacttttttcaactagatcatcaacctaatgtgtgccggaatttcttgatttgtaccatgtttcagctgctacatgccaatcgcccgttcgttgaataatcttttggtactttttcggcatttgtccatagccgatttttaaaagcggattgacatactgctcaacgaagttcccgtttttcttagaacctttatcttctcgatacaccatcaacgaatccagtaaatgaggtaatgtttcaattttggcatcatccacctgataaaagtgcaatctgccctttacgggaaatggtttgaccaagttctcgacacttacatgccacgaatagctgccatgacttttattatcagataccgcatcaatcttaataattgccaatgcatatccatttggcaatccccagccaaaatcggttactgatggtgtcgctgtactgacaagaagaaaggttgagacttttcccggaagccaggttcgatattcaattgttttatcgcccattatgatttcccaagcatagggttccctcatggataaagctttcaagcacgtcccctcccttcagattaacgatattttttcaattcaattggcagttctgtcgcaattgcgtctacaaagtcctgatcatgatcaatcaacagcatggttggcttaacctttaaaattaatttttgtatctgacgtctggtgatgacatccaaataattcaaaggttcatcccaaatataaaaattagcaggttcacacaatgatctggctaacgagacctttcgtttttgtcccatgctgagttctgacaaatcttcggtgaatgccgatcgctcaaatcccagctttttcaacatattcagcaataccggcaactcgacgtcatggtgttttgcatatgcttcaattgatcctgaaagggtttcaaattcctgtgtcaaatatgatactttgaccgttctactaaatgacaagctgccacgtgcaatcaaccgtttttcaccaagaatcgctttgatcattgtggtctttccaaatccgtttggcccttccaaaaccaatcgctggccctttgttagatcgaacgtaatcggttcattcagaatgttatgattccgttgaacctgaaaatcgttcaatagtaaaatatgatcctgatggggctgcttgtaattcaatgttaaaggcgccacatcatcaatgttccttaacaacgacttcttttcatcaatcgctgattccgttcgtttaagggttgatttggatcttttcatcacttttgctgctttatgacccaagaagcctttatcaaggttgacattggattgcccgccataagcttttttagatttcttattctcggcatttcctgcccactgttttacctgactggcagtcgcactcaagcgtttaatttcagtttgcagatgtgccctctcatttttctcactcagattctcacgatcaaattcgcgttgccacgtatcataattaccgtcaaataattgaatctttgcccggtcaatagatagcacatgatcgatgacctgatcaataaaataacgatcatggctgacaacaataaatccccgttttgactttaaatagttcgcaacaacttggcgaccggcaatatccaaatgattggttggctcatcaatgagttgaaaagtctctttatcggtaaacatggccgccaataatgccttggtctgttcacccgggcttaaagttgaaaactgccggcttagtagatcgtcagtcaatcccaattgatccatttccagttgaattttccaaacctctgattcgtttaaccccgaaacagccagtaggacatccacaacgtttttcgtggaatcggtaatcggttgcggaaaataattaaaacgcagattagattggatttctccatgatagggatattttcccaacaataagtttaaaaaggtcgttttgccgcggccgtttcgaccaatcaatcccagtttccaactttcatcaatgctgagactgaattggtcaaaaatatggttgaccatgccatcatatcgaaacgataaattcttaatttgaatagttcccataactcacacgctccctaaatgtaatggcgtatgtctgtttaattttaaaaataaaacccgttgcaataatctgcagacgggttttgtcgtacttattcaagtcgtggatgcaaaaattcagatttaatgatccaaatgatccagacattgacagtcattacaaatcgcacagacttaccccctgtataaaacagtcggctttaatttctgattaacgatttgcaaatttcaatgtcctgtcacatccctttttagtatgtatttatcatagcgtacacagacttatttttcaaggcaacacgtttagaaagccttttcaatgagatcaacaagtgttcacaagttgtgaacataactaaaaatttgttcattttttattattaatactggtgacattcccatgtaacatcggtataatgaagttgtagggaaacgcaggcagtttgttgctacgcttcaacaatattccttgatccaacacggttagaagcagttttagtccgcttcttatccgcctccaaattgcttgcagtttttcattaaatgtagggggagcgatcttatggatgaaaacttaaaaatcacgttaattggtttgttaactttgataatcggcacgatctttgcttcgattgttgccagtttcggtgtaacaactgtgttacctggtttgctatcattcttaatcgcagcggcattggtatttctcggatttcgatttaccgatcatcatcaccttgcttcaagacactaagtaagcgtgcaagctaatcaaaagaggtacaattccgagtggaattgtacctcttttgattagacgccattttcattccaaaaaattataaaaaccgtcttggtatccctgataatacgccatagcattgctaactgcttcatgtacaaacccatagatttccggtactaaaaataaggttagcacgataatgcccaatataattgtaggcttagagaacgcccgatttaactgacgccaattaattgtaaataaaagtgcaataaaggtcacgaataacggaaactctacccagttccaaacatcggccactccaatatgaagcacttgaagcaatacatagatactaattgcaaaaccaaacgcccatagtagtatttttgtaaccgggcgcattttatcatttcttgaaagtttatccatcagcttatcgtctcctttaattaaatcatctaatgaaattttaaacaggtcactaatcgcaacgacatttgcaaagcttggcaatgcgacttcctgttcccatttagaaatagattgacgagaaatacttaatttttcagccaattcggcttgtgaccagtgacgtttttccctttgtacctgtaatacttttccaattttcacgattactcacctcaacgatacgatcattatgccaacttttaattttagtatacccaccggttcaattattgaacagcaccatctggttgcatcaactcgttcgacaaaaaaatgcaaaccagaaaagacggtttgcgattagtttgcgatccctgtaatgcttaatcttaaagatacttactgccttctttaaccgccaattttgacaactcatgagcagcaataaaagtcttgacccattccggattatatttactataatttctcagcgaccagccaatcgccttttgaataaaaaattcttcagtattaatatcgtattcaattgctttagtcagtagttctttatcaagtgtttccttctcgagcaattgaagcgtaattgcaatccgcctcatccaaaaattttcatgttggtaaaaaagattaaatacccgccttttttcttccgggtgcaatcgaacaaattgaccgaatgtctttcgccatgaatccacggtatcccaccacgactttttttgaatataggctgttaatctgtcaatatcagaaaatgtcagccgtttcacgttaacatgtgcaatatcaattgctacgtattgatactcccgttcgtcccgttgataaagcgccgtgatcgttgaaaacactcgcgctatcggccatttttttgaggcagtcacaatttcttttgactgggcttttctatccggtgtttttaatcctaagaaccgatattgattgcgcatatacttttccatataaggttgattttgaagattaccaatcatttgaaacattccgtgtcctccgcgtttctagatgtataagtatagtatacttgttttgtaggtatcgtaagggggaatggcaaatgttcatacataaagtaaatgaaacgattgctttgaaactgcccgaaaagcaggacgccaacagcctgcttgaaatcgtcaataccaaccgagctgaatttggccgctggttgccttgggcaaaagaaatattttcaattaatgatgaaagagccttcattaaggatggtcttcagagaatggccgccggcacattttggtttgctattattttatatcaggatgaaattgccggcgttcttgatctccatcaaatcaatcacgaaaatcgtcgttgccaaattggctactggttggcgggacgttttcaaggaaagggtattatgaccgcttccgttcgagaagtcgaagcaattgcttttcacgatttgaatatgaatcgcattgaaattatggctgatgaacataatcaaaaaagccgcaacgttgcagaacgtcgagactttcatttagatggcatcttaaaacaatacgctttttataacgaccaattcagagatatggccttatactcgaaactcaggcaataaattgccggccttattccttactcaggacattactccaagcccgggtgaggatttttttatctacaaaatctgtgttgggaatcttaaaggcattaatcgttttagtgcctaaataaagcaaccgctgttcgacgcctatgtcatcaccatcaaccgtaatgacattataagcggtcccatcggtcacaaaatgttcatgtggattggcacaattgatatggtaagccgtcgaatcagcaaccacattcaaaatgccgtctaccacatagctgttagcaaaatgaacatgaccggaaaagatcgctttaacataagtatggtcgataacgttcaacagatcatccccattttgtaagatactgtagcgcatttgctgcaatggcgggccatatagcggatggtgcatgaaaatgattcccggcctttgatattcctgtaactggtttttcaaccaatgtaattgggtttgatccaaatacccctgctcaatatcaccgcatttggtatccagaaaataacactccagcccctctaacgattcatgatagtaataacgagtagctacccgtttcttacctaaaaagcctttataaaattgatcggttcgatcatgattacccaaaataactttgatcggggccatcaaacgttcctgctcctgatccagcatgtgatgaaaatctgcataagcctcggcatctccctcatggatcaggtcaccactgatcacaatcaggtcgggatcaacgttgctattgtaaatatcatcaaaaacggtgcgcaatttttcttcaggatcaaggcgttgatgattggcaggttttgcgcccgccggtgttaaatgagtatcagaaatctgaacaattttacactgaaccattatcatcactccaatacatagtttgattgagcatccaacacattctgattggtatttgggtcgaacaacagcattgccgattcatcaagcgttgcacaagcagttccagtcgcattcttaggccattggttgaccactgctttaataaacttttcgccaaatgctttacaggttaactgcttgtacctaccataatccacgattgtttgaacttcaaccggaaaactgccagatacctgttcatcatgtagatgaacattttcaggtcgaatccctaataaatacgattgatcctcatccaaattggcccggatgtttttcccgggtctcgaaatgaccgtgccatccacgccggttagttgatgattcgaaaagttcacgggaagaatattgatttgtggcgtcccgacaaattgtgcaacaaacaggtttgttggatgtcgatacagattatccggggtgtcaatcatctgaatctttccatcattaatgaccgcaatccgatctcccaaagccatggcttcctgctgatcatgtgtgacgtaaatgattgtttgcccattttctgcgtgtaactgtagtaattgatcccgtgccttctctcttaattgaacatcaatattcgagagcggttcatccagtaaaaagatgttgctcttcttggccattccccgtcccagtgccacccgttgcttttgaccgccggatagttgagccggataacgatctttataatcacttaaatttaacgaagctaaaattgtagataaccgttgttggcgggttttcttcggtacttttcgtacccgcagcgcatattccaaattttgataaacagtcatgttcgggtacaaggcatagtcttgaaaaaccatggcaatgtttcgctggcgacttgtcatagcagccgagtcatgaccattaattaaaatgtgaccaccggtaggattttcaagacccgcaatcattcttagtgtggttgacttgccgcaaccggaaggtccgaggaaaaccaaaaattcccccggtctaaccgaaagattcatttcattaataacgttggtctttttgttataacttttcgaaacgtcctttaattcaactgaaaaaccgtttgtttccatatacttcgcctcacttcaatcccgaattgctgatactgctcaaaatataacgttgaaacacaatgtaaatcaatagtggcggcacaatcatgataactgccaatgccatagccaacggaaagtttgtcccaccttcactggaaatataattttgaagggctaatggtaacgtaaaactacttttatctttcaaaatcaacgtcggccaaacatattcattccagctgttaataaagaagatcgcacccacactaataatattgggctttaatagtggcacaatgatattgcagaatatccgccggtccggaataccatctactttagctgattcggttaaggatttaggaaccctttccatggcttttaaaaataacatgatcccggttgcatcacacatttgtggaagtgccacaccaagaacgttattcaacaaattcattttggaaatcaccaaatagtttggaatcatcaccgttgtaaacggcacaaaaattgttgcaacaaataagaagtaaaccacacgtttacctttaaaatgaaaattcagaaacccgtaggctgccagcagtccggttaacacctttcccaaagtaacaagtgttgccattaggaaggtgttgccaaccatcctcaatatgttgatttgtttatccaacgttcgataattacttaaggtaggatgggaaggaatcaactgtaggattgaatggtaggattcctgtaacgttttaaacgaattggaaatcataaaaagaacgggcacgatgacacatagacaaatgagaagtaacaaaacatgccatccaatatgccttcgctcactcaacatcccgattcctcccctcaacaaacttgatttcaacaaataacagcaccaaaaagatcataaaggtaacagttgccaaagcagaggcacttccagttttgtaaagcacaaatgcatttaaataggtgtgatataaaatgttggacgatccgtaatatggaccgccttgtgtaatcacgttaagtggtgtaaaaacatactgcagtccttgaacaatcgttaaaatcaatacataaatagcgacaccacggttcatcggtaacacaatattccaaatgacccgccattttggtaccccgtccagtgccgcagcatctaaaatgttgcggggaaccgcccccaaaccggttaatagcaagataaaattgtatccaaaaaccttccagtttgtaatcagacagatcacaataattgccattgatcccgaattggtccactgcggtaacttcattccaaaatttcgtagcatcaaagctgccgggccggacaccggattcagaatccatgaaaatagcatggctcccactaccagagaaaacaggcttggaataaagaataatactttataggcgcctttcattttgccaataaagaaattgacaattaatgagattaaatatggaaaaataaagttcagaatcaacaggagtatgatatagattaccgtgtttaacatgactttctgattggttggatccgtaaagacgctaatgtagttttggaggcccacaaattcctttgtcggtgcaatcaaattccaattaaaaaagctgagataaaatgtgtaaccaatcggaatcacaataaatacaaacaacaaaagtgccgatggcaacaaatacatcagtggctttagccgataccgaaaacggccggtaatttccggccctgagcgacttgcgattttattttgaacctgtgaactattgttgatcattaatcttctcctgagttgacttaagcgttgaactgacgctgcttcccgacagaatcttatcacgtgcatcaatcatatcctgttcagcctgaagcccattcttagggaatgaggtccagggaacggcgttgggtaattcatcaacagccggtttgatcatcgggttggctgccaggtaggtcttgaattgactggaatccaaagccgtctttgtcggtggcaggtaaccggttcctttatcccaggttaacaatgaatcattttggtacataaacttttcaaatgtccaagcggccttttgctgatcagtcttttgggcagtgattgacagcatcgagccaccaaccggaacggttagtttatgcgctttaaaggttggagctgtttgagcagaagctttaaaactgacactctgcttaatatgtgaggcttgggcaaccgttgtaaatgccatggctacctttccattaacaaagtcatccatcccttgattccagggcgtatgaatggccgtcttatcttttacgaccatatcctgataaagttggtaagcctgttcaccctggctgctggcaaaggctgctttaccactggcatccttaatctgagcaccattgctcagcatcatcgcttgctgggcccaggtatcggcaggttcttgaatatagacgccatatttaccactcttttgtttaatggtcttggcagcctttgaaacaccctcccaagtgcttagatcacttttcttaatcccgtatttggcaagcatactatcattcgtataaagaatgggtgtactgagtgaataaggtaaaccaaccagctttcctttagcatttttcgcaaatgaaagtgcctgatttgaaaagttcttcgtaattgtatctttatttttatcgaacttttgagcagcatccgttggcgtcatatacttaaaattatctgaaaagtagttggtaaaggcccaaccaatttgaacgatatccggcaccttcccggatgcttgggcagactgtaaattctgcattaacccttgatacatattgggattgtatttggccgtcactttgatcgtcttatgcgtatcattaaacttcttgaccaatttatctaccgaagcacccccaagtgtctgagcattgacatgccagtatgtaatatgggtcactttatgagcggctgatttggaacaaccggcaaataaaagtgcaaccgacataatagaaattaacccgacaaaccgtttcacgacgtgtttgaaattcatgatgaaccctcctcttcttaatacctcaaagataacaagtcagtgtaaaaaataaggcatcttaatgtatcaaaaaagtaaaagtgtgcgaaaaaagacggtttgatcccagagtacaaggagctaaattcaatattcctgtttttggaatgttgaatttagctccttgtatggcagggatcagtcttttgaagcagtcctaagaagtgtgcggaacaaagcggttagtacccggaatataaggcgtcgatttgggaaatcccgggtttggatttttcaaatcgatcccttatatggagtggtactgctttgaggagcagtcctaagaaagtgtgcggagcaaagcggttagcattcgaagtgtaaggcgttcttttcggaaatcccggggttggatttttggaaagaatcccttacatgtagaatgctgctttgaggagcagtcctaataaagtgtgcggagctaacctgggacaagccggagtgtaagttggcaggcagtaaattcccgcccttggaatttgatggctgtcagcttacatgcaggcttgtggttagcgaagcagtcctaatcagtgtgcggaatcaacccatggcaagccaaaaccactccaaacaaaaaagcgcaaagacatcaaaattctgtcctcacacttttaggtgatattcaattaaagatgtttaaaaatttgattaaccactctcgctagaccactgataagattccccaggaagtcaccgattttcgaaaaaagcgatcgatgtttaaccgtttctttgacgatagttttaggtgcccgaacactttgtgttgccagcatcgggaccgtcgcagtactgttcccgacttttacaagaacgttgccaacggttgagccctttttaaccggcaatttttgagtcgttggttcatatgaatcgctaatagacggtttggatgattcagtcttccatatggtcgcccttgaatcctgaggtgacgcggaaacttttctatttccaatcgtaaagatattctgatgaatcaaatgcgtttctgttgtatagttcttttcaattgctctcaccaatttttccatcgatgaaaaaatggtgttgctgtcaatgatcgttgcaatcagatgacgtcctttatgccaaaaagacacggtcaggcataaaccggcagtatctgtgaagccggtctttaaaccgtcaacatgctcgctcttcttatagaaagcgtcccccttcaacagtctgttgctgttcaccagaacctgattgccaaccttcatcgagggcttcctactccacttggtaattgaaggaaattcgcccaaaacttttgcggcaacggttgaaatagctttggcactcaccatattctgagcttttttgccggttcccggaacttgaagtttgtaggttgttaaatcggtgttatcaagaccggaactgctgacaaaatgagcatcaatcccccacttttgagcctgccgattcatcaggttaataaacttggtattactgccgccggccaccaactctccaagagcaattgccgatgaattggaagatgcaattaaagctgcctgataaagttgtttaaccgtatattgctttgatcttttaattttaaaagtacccagttcataacttttgctcatcttgataagcggcttgctgacagggactttttgattccaagacaattgatgctgatcaattgcctttttggttaggtacagtgtcattaatttggataaactggcaattggtcgtctctgatcactgtttttttgatacagcatctggccggattttgcgtccattacgtaaatttctttggcttcgaatttatactttagtttcttactttttgcttgagctgttgctgacggtactaatgctgcaataacacaggtcaataccaaaataacagccatcaatttagttaatcgggaagtgcctcgcacgataaaagttacctccattaatttcttaatctgaattatcataccgctttatgtgaaaaataaaagtccttcgtattgattctttacctaaaatttacccagagttcacactctcttcataaattaacatatacgcaaaagaagtcatacttttgataacaaaactcaaaaatgtgacttcttgcctgtaaatttttggaggcaattttaactaatcttgttttaaacactacggcattaacttcatacccatttcgtcaatatgccgacgaacaacctgctcttttgcccgcatctgataagtggcactatgaataatgctgttgccgcgatttaccttgttataaagcggcacatcgtagaatagaaatttatgggaagccatcatatagtcggcggtaaacaataaatcctctgccaaatccaaagattcatcaaaacgaatatgattatcgcgaataattgacatcttgaaccctttattccaggtatagccaccaatgccatcgccgcgatagttaattgaatcataggctcttcgtttggtaacctcttcaaacccgggctgacgattataaccgcctccacgccaaccccaattaaacccaacaatcactaaatccgtttttggatctgaaaagcccgacacaataacttccaaataagtcggatccagcaagtcatcgccatccacaaagacgattatatcgccctttgcattgtcaatcgcataattacgggccttggagaccccctcatgttctttaaagaaatggggtttgatacgatcgtcctgttctgcaaattttgcgatgacttcggccgtatgatcggttgaggcatcgtcaaccagtaggatttcaaagttttgataggtttgtttaaagacactgttcaacgttttttcaaggtatgagcctaaattatatgcagggattgaaattgttactaacggtgcatgatttgccatgataaagtccctccgttcgctaatccgcttacttttgaggtcagtttatcctcgaattagggcttggtcaaacaaatcgactccaattaatttgttggttatcgtctttgattatgatgatcgtgctggttattttgatgatcccatttcatggcatctccggcagacatattaagtttctcctgaatttgactcgagaaatcctgccaagcctgcttttgggcatctggctgatttccgattgacctggtctttcgccgatagtcgtgggctaaccggcgaaaggttcgctgctgacttggtgttagttcgataaaagctttacgctcttgagttcccaaatctccaacatcactaaactcttcattatccgaggcatgccgaataaacgagcgaacgggaataatgatgaataagatcagagaaaacttcggaaaaaagtaaccaataacgattaaaatcaaatatgatatccaggattcaagaaaagcagtgccataaataacattgtataacttccgcatatcatctttatcagtgtacttatcatggataattgtctttacaattcgccgaaacaagaccgaaatgacaaggtccaataccccgtacatgaccaccgtcattgaattggtatcaatggccattaaccgggtaaacgttggaataagcgacacaaagaacatcagcgccaagtcaccaaccacaacaccatttgaaatcttttcgacttcattaaaaatcactgcgtgctgataccacaaattggcaataaagcaaaaactaaccgcgtaaataccaattgccgcaaataaactccggtagtccaaaacaccattattaatttgaatgggcaactccaggaccatcaccgtaatcaaaatagcaatgattgcatcgacaaaaacgtcaagtcgcccctttaatttttccttcataaacgtcaactacttctccattttcaaaatataaaccagtatagtccaaatcaaccggtattgctagagagtcaatgacgcgttatcaacacgtcaaaaaaagccagacaaaaattcactttttgtccagcttcttaatttaatttattgtatcgactacaaagtgggctcccgaccgtcaaaatgacaacactttgcagacattctaatcaacttaatttattcgtgttctgcgtgatcctttgacttggcactgttttgaccatagtaagcgttggcaccgtgcttacgataataatgcttgtccaaaagatattgtggtacgtggatttcgtcacgagtcaattgcaaagcatggtagctgatttcagctgaaacttccaatactttggcattgtatactgacttatccggtgttggtccccatgagaagggtccgtgttgactaactaacacggctggtacagcatccgggtcaatcccgcgtttttcaaattcgtcaacgatgactttaccagtattcaattcgtaagcatccttgatttgttcctcattcaaagccggtgcacatggaatatcaccatagaaagtatcggcatgtgtcgtactgacagctggaatatccattttagctgcggcaaaggaaacaccccaaggtgaatgcgtgtgggtaattccaccgatattaggaaaatgattgtacaaataagtgtgggttggtgtatcacttgatggattcatgtcgccttcaacgactttaccgtccaagtcaaccactaccatatcggatggtttcatcttatcgtattcaactccggatggtttgataacgaataaacccttgtcccgatcaattccggaaacgtttccccaggtaaaggtcacaaggcccaacttgggaagctgcatatttgcttcataaacttcttgtttaagatcttctagcattgtctgatttcacctttcaattacttcattttcattgacttaacggcttcactttcaacaggtaaagcagctttgtaattatcgataaatttgtcgtatccttgaacacttgctggttccggataaagagtggctttggttgaatccttgaatacccggttagccaggtagtcttccaaagattcgccattttttcggttgatgcagaagagtgctaatactgccattccccatggaccaccttcaccggcattttccataacagatatcggtgtgtttaatgcatcagccaagacttgttgtgcaacaaccggtgtcttgaaaataccaccttgggcaaccaaaacatttgtcttaatgtgctcttcacgcaataagatatccatcccaatctttaatggcgcaaaagctgaatagatttgggttttaatgaagttagccaggtttaatttagcatccggtttacgaacaaataatggtcgtccttcaggcatcttagtaatgttttcacctgaaagataagcaaagttaaccaaaccaccggcatcctgatcacccttaacagattctgcaaacaatgttccgtaaagatcatcgggtttaagctgaagcccaagcgctttggcaaattcaccaaacaagccgacccaagcattgatatctgatgagctgttgttggtatgaaccatggcaacaggtgcaccatcaggcgttgtcaccatatcgatatcacggtgaacggctctcattggtcgatcaagcacaaccattgagaatgctgaagttccggcagaaatgttaccagttcgtttcttaacactgttggttgaaaccataccagtaccggcatccccttctggaggtgcaatcaatgaaccggcttcaagttgaccgctttgatccaataatttggcaccttcagcgttcaattcaccggcttttttgccagctggtaaaacctgtggcaaaatgtcagtcaagttccatgggtattgttgaacttccggtagactgttaaacttatcaatcatacccttttcataataggtcgtctgttcgtcaattggaaagacacccgaagcatcaccaacgccaagaacacgttcgcctgaaagtttccatgtcacataaccggcaagcgttgtcaggaaatcaatgtttttaacatggtcttccttgttgagaattgcctgatataaatgtgcaatactccagcgttccggaatgttaaagttaaatagtttggttaaagattcagcagcttggccggtaatattatttcgccaagttctgaatggtaccaacagttcgccattcttatcaaaggccatgtaaccgtgcatcatggcactaacgccgattgacccgatcttcttaaggtcaacgccatacttatcatgaacttctaaggctaatgttgcgtagctggtttgaatcccatcccaaatcttttcgatcgggtaagtccaaatgccattgtccagttcgttttcccaaagataatcgcctgaagcaattgtttggaaatcgctcgttaccaggacttccttaattcgggttgatcctagttcgatacccaacgagatgtttccgcttacaatttcgtctcgtactcgactttcgtccattgttttatcctccagagttgctcgttattaaattacatttactgcttaattgtagaatattcgtacggataaatcaatggtatttgttatttgtagaataaattggcactgaattctcagaataacagatggataactcatttatgtgctttattaaaagatagttaactccctcgaatacggggaatagtgctattatccaatcacaaaacggttaaacaatcttttttgttttgatgttatctttctcttggtatatagttaaattgcggaacaaaagcaatgatatcattgatcattatctttgttggtctttaaaagacaccgcttaaaaatcaaataaccttgtggtctggggtgctttaatcggctgagagatacccatggaacctgatgcagttaatactgtcgaaggaagaccgttttagtcaaaccatcatctgttaatatctgactaaaagtccactttaaactgaagtgggcttttttatcgtcaaagccgattctcctccttagttttcaaggttaaaaagaaagaggtattctattttgacaacatttacaaatcagattcacgaacttgcaaagcccctatggcttcgaagtgcccatcacccatttatcaagcaattgacttcgggagatttaccactctcaacgtttcgttattatttattgcaggatcgctactatttaagtgaattcggcaaattgcacgataagattgctgatcaactaacagacaaaacggccattcagtttctccgtgatggtgccgaaggattgaaaaatggcgaaattgcggttcgaaagggattctttacccaattaaacatctcaaaagaagaaatcgctttaaccccgattgcgcctactgcttataattacgttaaccatatgtatgccgccctgtatcaaggtacccctcaacgagcaattgcggcattacttccctgttactggctttacaacgaaatcggtcaagcattgattaggcagggatcaccagtcggcctctatcagcaatggattgaaacctatgacagtgatggttacacagacagcgttaataaaatgattcagttgaccaatcgagctgctgagcaagtagatgacgctgaaagacaagaaatgacgaccgcttttattcgaagcagtgcatacgaactgggttactggggaatgtcgcttcgacatgaaaattgggattcactttaaaacggcgtcaggtaagagagaattcaagtttcaggtttcaaatcaaccttttcttataccgtttaacaagaaaataaggacatcaaaaggggctgccggatcaaaattatttttgattcaacaccccctcttatataccgaaacctatagtctcaaacaatgtctgtcaatcgatcctggtctactatttcaaccagcgaagcggtcattttgatcaccccatcagcaatgagttgcttaaacgtacggctgattgtttcaggagttgtcccaatgaaagtagcgatgtcttttttcttaagtggcagtttaaaacttgattcgtgcaaagaagcactggtttccaacaaatatttggcaagctgacctgcaacatcggatgtcgatgaaaccgtcttttcttcttgaaggttattaatttgttggctcatcgtcgttagtaaattaacagctaactgcggactgctttttaataaagattgaaagacatcctgatcaatttggcaaacgttggaatcaaccaatgcagttgccgtaacatttcgctgatcatgactaaaaagagctgcttcaccatcaaaatctcccggctgcatcactttcaaaagttgttccttcccactctcggatatctgagaaagtttgacctgtccgtgctccaaaatcataaagtgtcccacctgatcaccagcaaggtaaataatcgttcccttgggatattggtgttgaacaaccaagcctgctaccgcctttttttcatcaagtggtaatgatttaaaaatcggtaccaggttaacacaatccagtgcatgttcagtatgcatttttaatcacctcatttttcagtcaaaagatgtcccaaccaatttttagttggtgtatccggcgctgtactcatatcaaatggcattggtttaaaaacactttgaactttctgccaatcaattccttttccattttcagtcattaaatttttagaaagatccgcaacctgctcaagattgatctgttgcatcagttgagggttatttcccaaagtcgataacagaatgttcgcagccagttgtctggcaacaagttgttcaaattcttcggttgtgagtgtatcagtcaacaaaatccgctgttttaaagggaccgcgggaatttcccgttttaaaaatcgttgatactttgaccagtttctgacaactgcccgatagaactggtatggcactcgcacattaattttttttaacgtattaacagccagtgcttttattgaccaatttttatctttaggtgcatgatctacccattcgatcagaaaacgttgcatggtttccttatccgtcccaatcattttggctttcattgtcaacccgtagcgaacaaaaatgaacttaccaaactgcttctcggtaatcgttctatccgacttttcctggcgggccctttttatttcttttatctgtcgaagcttactggacttggcaaatttaccttgttttaccattattatcacctataccgcaatctattgttttggataacattaattatattataataggatataacagaacaatcactaacgccaattcagaaagaaagactgcccttggaatcgcaacaacatgcaacaaaaactcaaaaatggctcatcggaattttactggtcattctccttgcctttgtcggcagttacttatatttaaatcattattatagccggtcagccacaacaaatcgtttcgtaaccgccatcgaacagaatgattctaaaacagtgtcgtctttaatccgtacggatgatccggattttaaagtcactccccattcggttcagcctctaatggcctattatcaaaatcatccgaatcagcgggccaaattaaaaagacggatggcggcaaccggtgtcgtaaacggcgtcttggactttgtggataccggccatcactttttcatttttgaaaagtacctactcgaagtaaaaccgattttcccaacgattaacgccaatcaagataacactcaggttaaaattaacaatcaaatagtcgccaaaagtttgaacaaaaacgtcacgcgcacgtttggtccttatattcccgggcgctacaacattgtcatgacttcaaataatcatgaaaaaacgaaaatggttagtcgtacatttgagtggatagacccatcaccacaatcattacacgttcaggaaaattttaaatagtcgattcatttcttacgtaatttctccaatatttttttaagaaaactttataaaattttagcctgttcccttgaggctattgggaaaagctagtattctaaattcacaagcaaaggaggaattatccataatgggactactcgatcatcaattctcatataaaaatgaaccgtcgtttacagaaaaaacaaactcggaaattcccgaattaaaccacgcaaatgttaatttaccttatcctgatcttcaaaaattacttaataaaatatcaatccttcaagatcagattgctagtttacaacaggaaactcaaactaataaagtcacttctctgaaacaattagattcaactattacaatcgatcaactctgggattatctacaatcgcataacgacttaaaaaaagaccttctaaaaaaagttaatgtcgcacaagctttcccagtgagattacatctctccggcgccaacattggtaccaaatacgttaatgaagaaattgttcgtcgttatggtttatccgatggcgatttagccaatgccaactttgaggatagtaaaattaccgttaacgtcattaaacataacggtcatactttagacgatgccggcatcaaattttatactggggaaattgtcgacagaaacggtcatttggaagttgataatccaaccggtgatggtaatatcagcggaactgccgcttttgaaatgggggctttgccatatgtgccgacacacgaagaaattgacaagtatgatcttaaagtcggtcaaattgtcgatgttagctggtatgccagcaaccccggtaccataaagattgtctggattcatccggaagaagccgctgacagccaagctgagtccaaaccggaaaagccaaagaaaccaaccggtaatacccccaaaccatggacacccaactatgccgaaataaaaccaatcgtttccggaaaaactgtcctattggtcggtgacagtgtttatacagaaaatctccgaagagtaacggatgcttatgatgccaccttaacggaagttgattcaatcgatcgggaacgttttgaagcaatggttgaaagtgcggatatgctgattattgcactacattatgtcagccatcgcgattcgaatctcgcagtcgaccttgctaaggcacacggactaacctacgctacttttaatcaacacgcaaagattcctttcgaaatcgcacttagaactgcagcacaacgatatgaagcagctcaagttaatgcagaggaataattttaataccttattaattgtcggttacgaaaagataatcagttgtcatgctctaaaattaactttaaagtagttgaaccattgaccgtatatctgccactagctcaactacaaagaaagagtgggtcacttggataatgaaagcctaactatccaactgacccactctttctttcaaatcgagtttccttttcactacattactgcttcactataccatattgaaccatatccatataacctttgacctcatcaattatttctgtcatatcctctattcggtttaaccccggatgcttttcaaaataatcctgaatacgttttgaaatttcttgaatcgtaatagataaataatgctttaccgttacttcatcaagttcgggccgtaaagtcaatttatcaacgattgtatctacaatgatattttgcgtctgctctgcccatttgttaaatgttgaaaacacttcatttctgagcttttcaggaacattgacatcatgtgcatacacccttgttaacagagcaaattcatttggataccgatgtgataactcggttttatatttagtcgctcgaataatcatactgactaaatcatcagaatcggtccaaacattaaaatccacaaccgagatcagtgtgtccatcgcctgatggaccgctgctacatataacttcttcttgctatcaaaatatctaaaaacagatccctttgacacacctgccgattcagctattttatcagtacttgcccgaaaactgtcagttccaaaagccttaacagctgctgcaagaatggccttttccttttgcggatctcttggtagtctctttcccattattaacctcccttgaaatcagcctactgttacgtcatttgatgatgttaactctcaatgtccctatgattgtacccaatgaaaccaatcacaatcatcacaaatgcaataccgagcatccacgttaccggtgcgacatcaatgtgtgccaacggtacttttctgaaccagtaaaatggcgatagtttcattgcccaggctggtaaatcaatcagtctgccaaagtaggaaatcacaaacgccccaccaagtgcaatccaaacaacagcccgccattttggcataatgccgattaacgcaaccagaattccggtaaagagcgccaacgttggcaacattgctatgaatagtcgccagaaatatttaaatgctaatggatgctttaagactgagtttccggctcccattgctgccatcaaagctacaaataaaataataacagacagaacaaatccgtaaaccatgtaggttgctaataatttagatcgactttcaggctttgtattaatcatctgtaaatatccccgacgttcctccgtgtagagatgattaatgaccattgcaccccccacaaccgccaggacgctgaaaatcacgcctaagataccaacaaacgaaaggatttggttctgctccaaatgccgaacaccgctttgaccaagaacttggcgaacaaccggcgaatcatttacaattttactaatgctattgaacactgatccatagctggcgcctaaaactgccataccgacaatccagaaaaggctaattgctttctgattccaaaacaataatgttccagagccacgaagaaatcgactcgtgcgtttaccaccacggacttgaataattccagtatcaatatctcgattgccattcaagatgacggcagcggcaaaaccgacgactcccaacatcagtagtaacccaaccggcagccaattatttttcgtgtaaatatcagctttctcaatccacccaaacggtgagaaccaagtgtaatccggatttgaaacatcagtcatcattcgtaccaaatacgttatcccaaagaacgcataattataaatggcaacattgtgactatcagcaaccaattgtgcaaaaataagtgagatcaatccaaaacttaggccaaccgcacctaacgttactgcaaataaccaattgccgtttccatcacttccgggcatgtttgccaccatcattccggcacccgtaacaatcacaaatgcaccgttggcaatcactaattccaaaccggctgcagcaaggggcgccagtcggccaacaggatgaccgcccaaaaccatttcagtaaggccggattcttcctgaccacgcgtcgcaccaaccgaaagtgaaaaattgaagatcaccataaagatgccccaaaagaccatcatttcagatgcaaaaataatggcagtgtttaaatgagccgtcgtcattgggccaaatagcgacaccattgcttgggacttcaacgtctctgcaatagttgaaatttgcttgggtgtaccataaatcccctcgaactttgcagctacagcgacaaacattcctgccaaaacaaccagccatatcgtcatttttagccaatcacgttttaaattagcttttagcaaagccaatgtttgagcatattgtgtcatattaatcgccacctttttgctcgtcggcagactgataataacgtaggaaaaggtcttccagcgttggcggtgttgttttcagctgtacaattgtttttgctgaaagcaagtccataacatttccaatctggtccgaatctacactgaattcagcagttgttttggatgcatcattgaactttaattgatagacacccccggctttctgtaactcgtcaagcggcttcttcgttcgaacggcaactgtattacgagttagatgttgcattgattccaacgaaccagcttcaatcacgtttccttcacgaataatggcaattgtgtcacacatcttttcaacttctgaaagaatatggcttgaaagcaggacacttttgcccgcctttttaagttcggcaacgtgttgctgaaagatcacttcatttaacgggtccagtcccgaagtcggttcatcaaaaatatataatgaaacatcggttgaaaatgcagctaccagtgcgaccttttgtcggtttccttttgaataggttcgattcttcttactggtatccaatttaaattctttaatgagttgatctgttctagccgtatgcttttgtccggacatatgcaacaataggtcaattgtctgtccaccggtcaaattaggccaaaggtaaacatcccccggtacataggacaaattcttatgaatggcaaccgagtctttccaaacatctttgccgaagacagttgctgagccacccgtagctttaatcagacccagaataacccgaatcgttgtagactttccagcaccgtttggtccgataaaacctaacacttcgcccttatgaagctgtaaattaacgttccttaatgcttggaatttcccaaaggatttctttaaatttttcgtttctaaaacaagttcatcattcatagctaacacctctcatacttaagaacaagccctattctttctttcgcccttagtatatatagtaatgactgcccagtcaataaccatgcagtcattattaaaatcaatatttttggtcagtaaatcaacctgatgttaaaggatttacaagcatcatagtcagacgggttattgaaccaagtcatgataattgttaatctattactaatgactaaataacgacacggggtgattcagttgaccacttggaatctgttcaaaaaaattaattattacaaagatgtctcgacaacttttcgttgcctctatattctccttatcttcttaacagtggcttccttttttagatatgtcggggagcttgccggcctttttcaaagaagtcaaacgattatttcactcttaatgcgcacactctcgtttgaacgaatcccacttatggcaactctagctgcatgtggatcagccaaaagatcagcttattcgacaaatagcaaagcacatcaactatcacgaaataaaacgggaacttttaaccttagtctaagaacgaaatcgaatacattcttttttattgtccatcattcgtttatcttaattattggtaattttttaatcagccttatcttttacccaggcccattttttcaagacccgcttttgttgtctattcggtcactggcttggtcactaccaaccattatcgtattcacactcattctcagtcccggcgttcaaactggcttctccaaacattaaaaagcctccagaaagattcaaaaaccgtttccgaatcttcctgaaggaatatttttttattcatattttacatagcgagtttttaacagattaacgttaatccaagttctacccaaaacaccttattttaaatcagtcggtggcaattactttctagtatctggccattggtcgatgccattggcaacctttccatttggattatgccactgaaagtcatcataccaaaggccacgttttccttgatcaagctcgttgattttttgaacatcttcatcacttaatgaaaaatcaaagatttggctgttttgaatgatccgcttttcgtgggtagatttaacaaccgtgacaatgtcacgttgccattcccagcgcaagatgatttgagcggctgaacggtcatactttttagccaacgcatcaatgaccggattggtcaaagactcaccgccgccaagtggtgaccacgctgtcatttcaatatcgtgactttgatcaaaggccaagatttcacgttcctggttagttggattgaattccatttggttaacagccggtatgatttcggcttcttcaagcaatttttccattcggtcattatcaaaattagaaacaccaatggcccgaaccttgccctcacgatacaatttttccattgcgtgataactttcaatataagtcttatctaccggccaatgcatcaggtaaagatcaacataatccagtcccaaatcttttagttggttttcaaatgccttagaaacctgatcataatctccctgttcaccattataaagcttagttgtcacaaagaggtcggaacgctttaatcctgcctgtcccaaaccaagtttaatgccggcaccggttccctgctcattaccatactgtcgtgcagtatcaattgccaagtagccattcttgattgcggccgcaaccgaatcacgagacgtccggttatcggtcttccaaactcctaaaccaaatcgcggcattttaacgccgttattcaaggtaattgttgagtgtaatccgtccattgtgaaacatctccaatcattttgtgaaccacttaaatcgtaacatatcaattaatgtgataccaaatcagaagatggagcaacgcataaaattaagaaaaaagccttaaagaatcacttgaagcgactaaaatcaagcaacttttaaagctcatcataccctaatttaattctgatgaaaatagcagcgatgttaattgatccgcactgatacccatgattggcgctatatcaagctgattcttaataattcttgaaattgtcttttgatcaaagacagcaccaattaaagccgcttcaaagctatccctatccaagttactgaaaaagtcaccagataaccgaacatcttttaattgatgattgctgagcgtataactgatctgtgccaagccgccacctttaaagtaacgtttgccggtatgttcaaaacgattgccctgcccataaataaaatcaggatttgcaaaacgttgggttgcaatcgccgaaatcctgtcttcgtcttggtcagtcagctgatatttttgatattgtccagccgctaaaaacgcttctaataaacgctctctgaactccgaagccgaccaaagtggctgttgctccttcaaattaacggttcgctgatgaacggaagcaatccgctttgcctttagcttaaccggatcgaccctcaacgcatgcgccatggtatccaaatctgagtcaaacaacaaactgccatgatgcagcttgtatccgggcgtcacatactgagcgctcccggaaacctttcgtccgtcgacaaccaagtcgtttcgactatctgtttcagctttgatgccaatctgattcaaagccgctttaataagtgtcaatccggctgaaaagtcaatttccgagtgttcatctggataaatcaacgtaaactgataaccgccctgatccgtataaatcgtcccaccgccagaatagcgtctaacaacgtgtaccccgtgttttttaatataatcaagatttaattcagccgcagcgtcctgatatttaccaagcatcaccgttggcgtcgtggaccacagcataaacaccggttctttaaaatgcttttcactcatcagataatattccaacgcaaaattatgataaacgtcagtcgacgtcacgggtaaataaatcattttccgtaaactgcctccaactcttctttggctttataagagcttcgaacaagtggggaacttgcgacaaatctgaatccgcgtttcctggcttcacgataataagttgcgtaacgtttcattggaacccattcacgcaatcggtaatttttagggcccggttgaacatattgaccaattgttaaaaagtccacatcgatcgctctcaagtcgtccattagctgataaacttcctcatcagtttcaccaaggccaagcatgatccctgtcttgacaaaggtcgtctttggcgcatgctgtttgacatatttcaaaactttaagtgaggtatcataagtagcacggtgccgaacctttggcgtaattgagcgcaccgtttccatattatggttgaaaacatccggtttggccgcaatcactttatccaaacaatcctcatgtccttgaaaatccggtgtcaatacttcaatcgtggtatccgggtttaatctcctgatttcattgattgtcttaacaaactggtcggcaccaagatccggcaggtcatctcgatcaacactggtaacaaccacgtggcttaatcccaatcgcttggtagcctcggcgacccggtatggttccattaaatcaacaggctttgggtgaccatggggaatatcgcagaatcgacaggcccgggtacagttagggcctaaaatgataaacgaagccgtcccgctcccaaagcattcgcccaaattgggacaattagcttccgcacaaaccgtgttcagtttcaaaccggacaataattgattcatttggtcaactttcttttgatcatacgtcacttttaaccaatccggcttctttggtgcttctttcttttccatttgtgatttcccctttagctatccgaaacttcgattgtcgcaactagatctccaaccttggtcgtatcacccgtcgcaaccttctgttcctttaagacaccattttcttcactttcaacctgactaatcactttatccgtctcaacctcaaataggatatcgccctgcttaaccgcttctccgggtttcttgatccactcaccgaaaaagtaatcgtcagactttgggcttaattttggcatatgaacttcttttaacattttggccaccccttaagaataattggattcttggcatcaatataacatcgttcatcaaattgtgaaatagcgctttcaacaaattagggaaaacccttaattgcctattaacagtagggtttattgcatatattttttatttaaattgtgaataattcaattttaagcatcgttataaaaaaggcgcccgaatattccatcctatgcctttttaacgtccaaaaggtcaaaggggctcagatacctggtcttcatgataatggttgaaatttctttgggcgtctcgggattaccttctgtaagccaaaccttaatgatgctcattaatcccgaaacaataatttcccgagcaaaattatcagggattttagtcggcccggtttgccctttcacctcagccaactgcctatcaattagtcgacccaataattttctgatttttacctcaagttgggaatccccgcccggacccaataacgctcgggacatgttaaattcttgattgagataatcaacgaccgtttcaaccgccgcacagacgtggggtgtcccttcagaaacgtcctgatagccgattttctcatccgaatgatccaacactaatttttcaatatgagttaatatctgatcttcaaaatcgcttaccatcgctgttttatcacgataatgcgtgtaaaacgtgctgcggttaatccttgcaaatttagtaatatcgctcacagtcatcgcttttattccttttgtttctgtcagataaataaaagccgatttaatcttgcgttccgtattgacgactttttgatttgatgacatgtaatcccccccaatggtgcatcaaatattatcttaagcgacttcagaagctaaatcaatcacgtaggggttagtatgctgactgacttcaccccatcaatttaagggcccagtaaggacacaccaaaagggtcaaagcagattttgccttgacccttcgtaagcttaataataaatccttatttaaacgacacaccaattaattaatggaactgcatcccgccatcaacaataattgtctggccggtaatataattagagtctttaccagcaaggaatgagacagcagctgcaacatcttcgggctctgataatcgtttcaaagcaatatcttttgcgaatgtttgcatgccccactcatcgtccttaccggcattcttaccaacttgatgtgcaatatcaaacatcatcggtgtcttaacaatacctggtgcataagcattggccgtaatcccttcttcagccaaatcacgagcaagcacttgagtgatcccacgaacggcaaatttggttcctgaataaagggccaggttaggattcccgacaacaccggcttgtgaagttgcattgataatcttaccaccgtgtcctaatttcttgaaggcttggtgagcggcctgagcaccccagagaacgccaccaacgttaacgccgtatacgagtcgaaactgatccggtgtaatggtgtccagaggtgtggttggtccaaggcctgcattattgacaattacgtcaaagccgcccaatttatccacagtttcatcaacagccgaaaagacagaatcacgatctgcaacatctaccttaacgccaatggcctgactgccatccggcgataatttagcggctaccttatttgcattatcgatattcaaatccgcaactgctaccttaaatccatcttcgtgtaaccgtgttgcaattgcttcaccgattccttgaccgccgcctgtaacaaacgctactttttctgccataataaacgcctccgttttcatttttgtatccgcttacagtatacttccaatgaaattgattcacaatgaaaagggcctttttttcataaagaatcatgtgacatttgtcatccctattcatgacaatccttactacaagccaaatagccatcaatatatactatgactgtagataggaaaaagaagtgacctatatgacaaatgctgtttcgttaacaaacttattcgttgcatctactataaaaacagataaaagaaagaggcgggcaacatgacagctgctattcaattaaaaaacttatcctttgcataccctaataagcgggtacttgatcatctgaatttgcaaattcaatcaggcgaaatctttgggttggtcggtccaaacggtgccggaaagaccaccctgctcaatctcatccagggcatcttaagctcccacaatcataccattaccgttttggacagccaaccgggaagcaccatcgttaaagaaaaggtggctacaatgtttcaagatgatttacaaattaacaatgtcacagtaagagagttcattaagttatttgcggcacaagcaacccatcccaagaatcccgaaacggtcataaaggaacttggccttacagatattcaaaatcaactcatgaataaactatccggtggtcaacgtcgaaaagtcagttttgccagtgccattgtgtcaaatccgcaactcttatttttagatgaaccaaccgtgggtatggatgcagaaactcggcaaaatttttggcgctatattgaaaagttgcgtcagcaaaacgtcactattgtcattaccagccactatcttgaggaaattcaaaaagtggctgacagaatcgccattttacaagacgggcaattccgttacgttggtacttggcagacacttcaaagccaccatgataatggtcaattcaatttcaacacacagctggaacgatcattgttcacacatttaccagccgttgaatctgccactcaaaccgacgccaatatgaccttaatcagtaacgataccgatttaacgttgaaggcgctgttgccttttatcgatcagctgcatgacatcacgattacgcgtgaatcattggagtcaatctttttggaaatgacaaataagggggatcattaagatgaaaacattgggatatcaaatcagctttaatgcaaaacgcgtttttttacgaaacttcaactatttatttttcaccatcttaatgccaattggcttctatatcctattcacaaaggttctgatttcgggaaccactgctcaggaattggtttttgccaagcaataccttggcagtatgatcgtgtacagtgtcttgattaacgccatgtttgggctgggacaaattatgcagaacgaccgtcagcacaaactgctctcggcattatcactcacacctagaggcaccaagtactactatatttcaatcggtattatcatgtcgctggtcaacatgctggccattattttaatgcagcttgtcgcaaaactaacgtggcatatcaatctctctttaggtgaatccattactgttattgtcattgctgttcttggtacgctgccaatcatgggggttggcgttctttcctcatttgccaaaacaccccaattaaccagtattattgcaaatttaactgtctttccgttagccgtcatcagtggcttgtggtggccaatctcgatgatgccgaattgggttcagaccatcggtaaagccacaccgacttacctcaccagtaaaatgatcaatcttgcgatcaataatcaatccctaccaattcatgatattatgggaatagtcatttggaccgtcatcatattagtactaatttttgtactgattaaattggttcaaaagagtggagaactgaaaaatgatcaagggactgcggtctaatttaaaaacctattggtactcgtatatttggctaatctttttgatagaagacatttcagataaaattcctcccaaaacgtcaaacgattggttttggattggaatgacctttctttttctgattgcttacgtgatcacttcagcctcccaaaaataccaaatagccggtatggtagctgagacgctgatcggaatgatctttacattttttgataataacttctggatcctgatttttccgggatggcaaatttcatccattttagcttacgcgccaaaacgttactttaggcttttcgcgactgtttattatgcgacatttattggcgaaatgattaatttgaaaattctgaatcctgtgaaccttgatttgtggtcatttattttacctgccgtctcaccaatctttgcttatagcttgtccaggtccatgaagcacatgcaggaccttgcccgtaccaaccaacgtttgcaatcagtcattaaacgcggcgaacgtgaacgaatcgccagggacctgcacgatacacttggtcaatccttttcaatgattaccgttaagtcccaacttgctaaaaaactactcgagaaacagccggaaaaggtccctgcagaactcgatgatattattgataccagtcgtcaaaaccttcaattggtcagaaatattgttaataatcttcgccaagaaatgattgacgagtcaatgatcaagcaacaaaagaatcttcaagaagcccagatcaaccttcaaacagaaggcgaacaggatgccaataaatggccgactgctattcaaattaaagtaacgccaatcctgcaagaggcgattaccaatgtcattcgtcatagtcgagcgactttggtgctgatttctttcagtcgaccagacaacgattcctatcaagttacaattcaagacaacggccatggcattaactatagtcgcgaggggtctcatggcgtatcagggatgcaggaacgcgttcaagccgatggtggccaattcaatatccaatcaaacaaaatcgggacacttgtttccgcccaatggtcaaaggaggccgagataaaatgattaccttgtatttagcagaagatcaaagtatgttgagttcagcacttgcacagcttctgaacttggaagacgatctcaaagtcctcggtaccagtggtgatggtcaaacagcttggctggatattaatcgattaaaaccggatattgccattttggatattgaaatgccaaaagctaccggactggatgttgccgatgacatcctggcagcccatttagcaactaaagtcattattttaacgacttttgctcaaaaggcttattttgcgcgagcggtaaaagccaaagtcagcggttatcttttgaaagatagtccaagcgatgacttggtaacagccatccgaaatgtcatggccggccaaacaatctacgatccagaattagttcgcaatatggttaacgcggcggataaccctttgagtgatcaggaaatggtcgtcctaaagtccgccgctgatggtgatacgactaaagaaattgctgaaaagcttttcttatctaatggtaccgtccgtaattatctttcagctattttcagtaaactcggcgttcacaatcgcttagaagcggttaatatggctaagaacaacaaatggttctgagaattttgacagccaatcttactgaaaaataaaaaataatgctcattatatatccaaaagaaggtctcaacaattaatgactcgattgttgagaccctctttaactatcaaactattatcgtttaaactttataatgggattcatatcattaaatgataatatgattgtcgaagttctgatagtcgttttacgtcaatcagattacatactcatctgattttctacatattcacggtacaatggtaactccgctaccaactgtttatgagtgccgtgaccgctgacgtgacccttttctataaagtagatttgatcggcatccacaatcgtactcaaacggtgtgcaatgaccaaagtggttcgattatgcatcagtttttccaacgctttttgaaccatcatttccgattccgaatccaagctggcagttgcttcatccagcatcagaattttaggatcacgtaagaatgcccgggcaatcgccaaacgttggcgttgaccaccggagactttaacaccccgctcaccaacctgggtatccagcccatccggcatcgcctcaacaaattccttagcgtatgccatttcaagaacgtgccacaactgctcatccgaatactgaccgctgagaccataggttaaattgtaacgaatcgttccagccataatagcagcatcttgactaaccaacccgatctgttcccgccagtccgtcaagttaaccgattcaagattctggttgcctattttgattgtgccgccagttggttgataaaaacgttcaagcagactaaagatcgttgatttaccaccgcctgaaggtccggcaaaggccacaatcgaatttggcttagcttcaaacgaaaccttatttaacacagatttaccgtcctcataagcaaaatcaactttgttcatacttaacgtttgaccttgtgcatcaacagggtgcccatcaacctgattctcctcggatgtgccaagtaattcttgaatccggtcagtcgatccactggctttggcagttgctgaaaggaattgcccgagggtcgcaaacggaccaaccatttgaaccaaatacatcagaaatgagaacagtgtccccatatccatcgtaccttgggctaccctgctggcaccataggccaacatcgctacaaccatccccatcatcaccattgtcatcaatggtcctgcgacggaatcataaatcgcctcttttaacccgatttgataaagctttgaaatgcggttatgaccggattgccgctcgactgcttcggcatttgatgatttaacaagccgaacttcgcttaaaatctcgcttgccgagccattaaaatcagccagggcatcctgacgggcatgcgcaatctttcgagatttgtttgccacaggcagaattgccaaaataaccaacggaacggcaataaacatcatgatggtcattttccagtccataaccagcattagaataaatgcgcccaccagttgaagaagtgacgttgccatattcggcaaagaattggcaagcaaatccttcacttgagtagaatcatttaccaatcgcgaggtaatctcaccggatttggtttcatcgtaatagttgaccggcaataccaataatttctgccatagcttccctcgaagcttataaacaacgttttcaccgaagaagcccaatatcgcaccagaaaaggcactaatcaacgcactcgccacaaaaagcagaatcacgccgatgaccaattgcgtgttgagatgatgacccaactggttgatcaaatctttggcaaactttggcacagctaattgcattcccgtggcaatcattcccagcaaaagccctacacccaattgccaatacttgggcttgatttgcgcaatcagccgcagaaaccctttaattttgaattttgatttgttctttggcctggtgggtcgctgcataacctgttccataatcttaccccctaatcccggttccgattaaatccgccaaatggaaagtcacgatttaatccgtccatattgtggtgccaatcatgagccattctcataaaatccgcaaaatttttgggctctgaccaattttccggcattttttgttccagatcggtaatcaatttactcaataatttgcgaagttgctgctgttcatcgtccgtcagtgacgagaaaagcgactcggatagttgatccgtgaactgccgagaatcatcaatcatgttttgtccctttgctgttaatgaaatcaacatcacccgtttatcatccggggattcatgccgttcgattaagccggcggcctctaatttacttaccatcgcactgaccgaacttggtcgaatgtccaacgcttcaacaatgtcagtattcgttaatgctttcttttccgccagttcatgaagaacgcgcaactgatttggattcttttgtggatcctgggaacggccaaattgaacgcttttaattgcggcagacatgaaagcacgttgttgaaacaaacggccaaaaagatttaaaagttcctgagaattgtaagtcattttgttcactttccttaatctcattatttagttagtctctttctgattaaactaacaaagtgaattatagatagttagttagtctttgtcaaccaaaactaacattttttgaaaataaaaatcagcttggtagaaaggaccaaactgattgttttataaatcattttcaagtgctttctaatacagatgatacctcaaattgttacagtaaaatgatccttaaccatgtacgtcatcaaccacgacaaggccagaaacgctgccactatcacatatggaacatgatagttcatatccaacaaggcacccgacataatcggtccaatgatgttaccaacacttgttagtgacatattaacaccgttaatcaaaccttgtcccgtcgcacttgccttcgttaaaagggttgtgattgccggtcgaatgagatcatatgatgtgaagacgatcaaagttgcaataatcacctcaagtttactatgggcgagaataatccaaaccgttccggcggctgccaagaagaaacagtatctggttaatcgcttctccgttagccaggtcaccaaacggtcgaataaaagtgcctgaaacatcagtgataataagccattcaacgttaataccaaggcaatattgccgatcgtaaatccgaatacctcattgacatacaaactgtaaatactctcaaagccaactaatccaaatgatgatatcagaatcaataggaacaggattttcataggaccgccgaatagccgtttggtttgttcccaagttgcacgacttggccccttcgaaattggtgggacaatattatcctttgcaatactttcgatttctttttcactcggtaacatggtttgtagcgaaatcatactgagtagccctaagacagctgcacaccaaaacggtgttttataatcgattttagcgaggaagccaccaatacccgggcctaaaatcaagccaccactaaaagctgccgaaagcaggccgatcactctggcccgttgccttggcgtcgttaagtccgctgccaaagcgttggttgtcggcacgaccattgcagctgacaagccaccgattgtccgtgaaatatcaaacatccacaaccaatttgttgccgcaaatagaatttcagaaatcatatatagccctaatccccagaccaaaacaggctttcggccaattcgatcggaaatctgaccaacaattggggaagcaatcaattgcgcaaaggcaaatagtgaattcataatacccatatcggttgccgacagatgaagttcatttttaataaacggcatcaccggaaaaatcagactcatcccgatacaaaccaaaaaatttccaaaaatcagcacaataatggcgttccttacttttactgacaattaatcatcccctttttaaagtcgtagaccgcataaaggatagtataacgccattcttctcggcatgtctacacaaaagaacaataataacataataagaattggatttttcaatagctattctgtacacttcacgtaagggcaatacatattaagaggagtgatttattttgacagaaggaacccatttaccagaaaagattaaaaacgtttggcggatctccgccttcatcaactttgccgtcctactcatcattgcaatcggctgttacatcgcattcatttttttcaattggcaatggttgttttggccgggaataggctttggtgcaattgcaatcattgatctcatatttgagctgatattggtttcgtaccgttatgccttttggcgctataacctaaccgccgatgccgttgaattacaatccggctacattttcaaaaagcttgtttcaattccaatcgcacgtgtgcaggacgtcaccctttcagctggacctattcttcaatcacaaaagctacaaacagttcaaattacaactgcctcaacctcacacaaaattgatgggctggaaccacaaacagccgagcaattacgccgccaaatcatgcaattggccgtggaggtgaaagaaaatgacgtctgaagcgccaaagcaacatctaaacccattttctttattttactatgcttacaaaggcattcttaactggggaatttttgcccttatcgcccttccgtctcaacgaaccaacttctgggtcgtcattggaacactattgagcctggttattattgtcggattactgaaatttttctttttcacctttcaaatcggcggcgatatgataaccattaattccggcatctttgttaaacgtcacacgcacatcccctacggtcggattcagacaatccaacgcagtcaatggttctttttgaaaccactgcatttggaacaattaaaaattgagacggccggtcacgaaagtcatcgtcctgaagtcacgttaccggtcgtttccgaaagcgttcgtgaagaaatcgatcgtaaacgcttagcagttaagggaagttcaacaactccggacttaacaacagatcaatcagcgaaacccacagttgattcttcaacaccattagcggccactcaccattacgaaataaatcctcatgatcttaatgtatttgctttgacttcatttggtatcctgccgttaatggggatcttagctgctctttatggcaaaattcaggagtacatcccccaacgtctcgtcaacacggtcaccaaggaaatcatctcgcaatctatcctgattatcagcgggattgtcttattaattgtcatcattgcggtggtaggatcctatctttcactcgttcaaaaatattataaattcaccttaacttccgaatcaaaccaattaaaaacctaccagggcctgtttcaaagaaaatctgtcaccatccctatcaaccgcatccaagcccttagggttaaacaaaacgttctccgacagtgggccaaaatttcaactgttcaggcgttagccgcttcttcggcaggagacgatgataagggcaacgacatgatgattttaccggttatcaaaactcacgacgttttcaaccaattaaagccctttgtgagttgggcgccggatcagtttatttcacttgaaagattgccaagacaaaattatttttattttattcgaaatgccattctttggacactgattccaattgccggctgcatttatttctttagactctggggcgcattcagtctgcttttattgatcatctcattcttcctgggttggtactcatcaagtaataccggctggcaactccatggcgatcagttgatcatgcaatccggttggcttttcacaagaaccgaattcattattcccaaaaagaatgtccagtccttcagtcttaaccaatccatttggatgtcacataaaaaactggcacacctgcgagtaaatgttcggcacggaaatcataacgaacaagtcgaaatccgctacgtaccattcaaagatgccgaaaagatttttaactggttacgcatcaggaactgattgattaacccgtttttcactcctataatgaacctagcgtcacgttttcacaatgtttttaagtatcaaaggaacagttgaaaacacatttctaatcaattaggaggctaattttttatgaaagacttacatcttggcgacagaacggttccggcaatcggccttggtacctggcatatgggagattctgcagcaacccgttcaacagaaatcaaagcaatccaagccggtatcgatgccggcgcaaacgtcattgatactgcggaaatgtacggcaacggccgcagtgaaaatctggttggtgaagccattgccaatattaatcgtgatcacttattcttaattgacaaggttcttccttccaacgcctccgctgatagaatggaacaccgcttggatatcagtttgaagctgctcggtaccgactacgtggacctctacctctatcactggcgaggcgccgttccattaagtgaaaccgttgaaacactccaattaatgcagaaaaagggtaaaatcaagcactggggcgtttccaattttgacctcccagatatgaaagagttgcttgatttgccgggtggcgatcaggtagccgcaaacgaagacctttataatctcggcagtcgcggtatcgaatacagccttcttccctggcagcgtcagcagggcattcctttgattgcctacacaccggtagccgctggtgacgaacgcggtcaattaatcaatcattcagccgttaaagaagttgccgaagtgcatcacgcaacaccatggcagattttgctggcttgggcaattcgcgacggcagtacacttgccattcctcaatcaggtgatcctaaacacgctgttgacaacgtgaaagccggtttaatcacactttctgatgatgatctggcaaaacttgatacccagtttccaaagccgaccagtaaacaacccttagatatccgataaattttataaaacaagtcaaacaacgctgaagcagaaaagttcttgctccaacgttgtttgactatcacgataatacagctgaaaatttgcttcaaaacgtgctaccgataatcattgattctgaacaagaccgtatcaaaaagaacaaattccaaccttttttaatattctgaaaaaatccacgcccttttcctatcaaatttccacaataagaccgataatagaggttaagaataaaaccgtgaagggatgattaacatggctggtacaattgatgattcacgttacttctggaaagctcgtgccaatgacggcaactttaggatcggcttaagtgatgccgctcgtgaagagttcggcgaaatttcctcagtcacattctcaacatccgataaagaaattcgtgatgggcatgatttcttgacgcttgagagccccaataccgttagcgacacaaccgttcttcattctccggaaagtggagaagtcgttaggtttcatacagaactactttatcagcccgacctgatcaatagtgccgatcgaaataaaaactggattgtggaagtatactagaaacatcgtgtgccaacaaagcacaaggtcggtttttgtcacgcattttagtgatattactgaaacttgaaagtatgaagacagactgatcccttggtatcacagggcatattttaattaatttaaccatttagcttgctgttaacagcgaaactaaccgtttcggcaaaaatgtgaatatctgattcatcatctgaataatttggctcttcttgcataaacttcatgattaataatcgtttttaacgaatttagaagccataacagtgcttgaacaactcaatatctcggcatggcttcgttcttataagaataaaatccccaatggtgcgatcatcctgatttggccgttcctgccaagctaataaggtcatagtcatcatgacattgctaatggccacaaagcccgtcataatttgaacttgtgatttgtcgaccgcaagtattgcttggcactttaaagtaattctcaattgccatcttcgggcgtatagttgcaatgatcctcttgtggctgaaggcctaactggagttctttgccatactaggtagtcatcttgacgggcccgatatagccacaaataccaagcgaagcttgacttttgttccgacgtgcgcttcgacaaagcagcgtattgataagcttgcttggttgatattttgaggccctgctagtcgcttgtataaggctttaactgaatatttgccgtccgcgatattgatgtaaattttgctggacagtttaagcatggccaacgccgtttaaatcccacttgttattcatagaacattttgggagctgtaccagctatcaaataaacatagtcagctagaacgccattggcgaggcgaggctgcaagttgcaatgaaacgaggttcattttttgctgtgcttgcgacgtctccggccagcaattgttcgttgatcggttgttttagctgatttccaaggatcgttttgtggcttcgtggaagacattaaggcaaggttgatcggtagaatgtattggcgtcactccaacccaaattaaagcccgtatcccttaatatataacgtgttggtcatggtcaaagactgcgctcagtaattcgtttgggtggcttactcacgcgaaaaaagaagagtgtatcgtcaatgagtcactgctaacccgccgccggcggtcaataacggtcgtaaatgcttgattaatatggactcgccaacttgacaaatcaagcgttggccattgatccggccatcgtttcaaatttttgacggtgcgactggtaaaggtagttgtttcagggctcgataaacagcgtctcaggaactttgtcgtgagcagccattcaatgactctcatcaagctgatttctgaatgccggcgatatttcaccaacttgggagtttagatagacgcaatgagggaagtaaattgatgaacaatcattgtgaagctctgtttctgtattttttttttgtcttataatatttcagactgtagagtctcgagtctcctttgtatcttggttttggtcgactaaagtatacaacgcaggagagcttgcgtttatttttttgccaaaaaagccaataaccacacgcctttggcgtgattattagctttcaagtttcagtgatattattttatttttataaaaacgagggactgaatcaaattcacttttgactcagtccctcgttttaattttttcatttaataacaacttttgtcccataaggaatatttctatacatccaataagcatcggcaaccgttaagcgaacacacccatgagatgccggcgttcctaatttttcagcttgggaagggatatattgcccagtcttggtcactggcacactatggaaaaggtaaacgccatgatccaaccatgatacccagtagttggcaccttcacccgaggccgcattataaaatgatttaccacgttgggcttgaatgtgaaaggtccctttgggtgttggcgatgaggcctccccagttgaacagtacatcttataaatcacctgaccattgccatgcaaataaacacgttgatttttggtactgacgtatatccaaaggtttgactcgttttttaaatttggatatggccgactttccgatgggtcatgccaattaaccgttgacccgatcgctttatactttgcataggttgtttttcttgaaccaaaaccagccaataacgccaaaccaatcactgcagtaattgccagtgttgaaaaaatcattaaaaatcgtttcatattctattaaggccccatttatgtactaattagatcaactaaaatcacattcttaactatagttcctgaggccgacgatatcaactcctatcaaaacatccctttctttctctaaaattttgggaaatgctatacttaactacgaaaacggttacttaattgaaaggagacgtgctaaattgcgatatgtagatctttctaccggtacgcagtacatgggaaatccaacgatgtttgaaagtgtttcccggtatttaatgacaaacgatcaatttacggatacgttgttcgaatggtctcggcctcttaaagcatcggttgttatcggtgccaaccaaaatgtgtattccgaactgaatttggattatatcaaacaaaatcatattcaaatcacccgccgagccggtggcggtggtgctgtttacgttgattccggcaatctgacgtatgcttttgtggacactgatgacgggactaactatatgaactttaaaaagtatgctacccctatcatcaacgttttaaaaaagctgggtgttaacgcagccttaaccggacgaaacgacctcaccgtcgatggtaagaaattttccggaatggcagcttttaaaatcggcaatcgcttttattgtggcggtaccttgatgattgatgtcaatttggacgctgccgataaagcactaaatccgccgaaatctaaattggcttccaagggggttaagtcggttcacagccgggtaacaaatattcgcccttatttctccgccaagtatcaagatatttcaattaacgacataacagaaataattttaaaagaaatttttaaaacagataccattaaagaaattccaactcacgtcatgaccgaaattgactggcaaaaagtcaacgacatcaccggtcatgactatcaggatgaaacttggacaatgggaaaacgttatcacgatgataatttccattccaatcattatgaaggtgtcggtaacgttgaaatcagcttttcagttaatgacggcattgtttcacatgccaaactttttggcgatttcaataaggccaatggcaatctaaaagaaattgaagataaaatagccggcgtcccatttgaaaaagataatcttgaagaagcttttagtcacacccatttggcagacaatatcggaaacctgacacctgcgcaaatggcagatttgatggtcaatccggtttatcaacagaaacaacaggaaggatgattaacatggcaaacccaattgatgattcaaactatttatggcgggaagaaacttcagaaggacatacccgtattggacttaacgacgaagccagaaaccaaatcggtcaaatctcgtacgcgtcattccctaaaaatctaaacgaggttaaggtcggcgaagaattcttttcgtttgagggcgctaaagcagtagaagatatacactcccctcaatcgggtaaagttgctcgtgttaataccgaattgcttgaccatcccgattatttaaatgatgcggataaagagaaaaactggattatagaattatattaatcgaacaaataaaagaggctgtggacggtcatatcaagtccacagcctcttttgttgtttaatcgccaaattggtattttaaaaaacgttaaacatcattgcgcttctattctccaaaccagttattggatgacattaacagtcgctgttttatttccaaaaacagtttgagtcaccacgtcggtgttcatattcaatgatgccttagcaccggctggcgttgacaatactttaaactgcttgaagtgcttaactttgtccaaagcattcttggttaatttaaacccaaaggtgccggccggcttggctttggcagtttgtaaggtcgctcctttatcggtcaagaccgtcaacgaagcattttgagaagtctttccggtgaggacatttttcttcaacttaaattgattaacgctcaatctgtttgccggtaactgttgcaacttggctcctttattaattgtataaaggagggtatcgctagtcacatatttcggaaagtaaaattgattgtttttatatgtgaccttcataacagcctcattgccccaatttacaaaatcattgaccgtataatttgattgggcagacaaccattcaggaatggacatgcccgagctgacaaccaacacattgccacccttattagcagctttcttagcgatagaggtcaattcagtgtccatccgtgagataacctgactggctgattcggcttttaggctggccggtaatgttgaatcgctatactttccgccatcaatggtttccgcatcatgataagcatcttgaagtgccggccaaaagtctttaccaagtgcctgctgtgctttgccaaagtcctgcggtccagtgtaggttcctgcaggccgtaccaacggcatcgtaattttattgacgtcgtcatatttttgaccttcaaaactaccgtaaccaccctcacgcaaattaggcgtccaagtcacattgaccttaccattgccggatgagtcaagtgcataatgagctgttttaaacgttctcatattatcagccgaatatgcagcactaaaatgtaagccatataatccatagcctaattgatgtgcaacttgaaccccggtatccgttaatgggctatcagcccacccctggccacgcccattaatgttaaacatcgtttgcccgtggcgtgtcaaataaatctcaacaggcttcgatgccgctgaagcttcctgctgattagctgtgccccagaaaaacaagcctgacaaaacggtcgttacaacaataagtgattttctcatatagagtcccccagaacaagtaatggtacccgaccattacgaaataatataatgatagtcaataatcgcccaatgcgcttattaaaccgatttaattatatcattttgtgttagcgctttcatcattaaaactattctttcttttagaatggaaacatttttaacagttgatcacaatgataaaccagaagcgttatataatatcaggagaataaacatttactacttatcaaggagcgtatatatcaatgaaactatcaatccccgttattgctcagcgcccagaactcccaaccggctgcgagattactgccaccacaatgatgcttcaatatgcaggtgccgttgttgacaaagttcagctggcacatgaaatgccctaccatccgactgaccccaatcagggatttgttggtaatccattcactgatgatggtgatagtatttacccatctgcactcacagatttagtgacaacctatgcaggaaatgctgtcaatttgagcggtcaaccattggtcgatctaaaacagtatttaagtgcaaccggtcaccccattgtcatatgggtcggtgaatttgacgggtttcacacccacgccttactaatgacgggatttaacaactcagcaatttattttaacgattgttggacgaaaaagcaggactcattgcctgaagatgcgttctataaaatctggcacaacaaacaacaaatggctttaagctattaaaaacaaggagttgaggcaaaatgattttgcctcaactccttgttttattaataaccaatcataattaatgattatatctttgtctaattaataatatgttgcaacctgatacatttttttcacaaaatctttcggtgttaaaccaagtggatcttgattttcgaagacaatggccatgtggtaattaccagtagttgcgaaatatcccgaatgataaccctgaccaccaaacgaaccgttattgtacttcacaccattttgggtaacatacataccaccggaataaaccgttccatagcttaacaactgttgatattgcttagccgttaagacggaaccgttttgcaatcctaagataaacttgtaataatcactcggtgtcgtgagcatattgcccgctccgggaattgcagagagtcttgggagtgaaaccgattgtggactggtataatccgttgttgcctttcgagaatagcttaatgcaatcgaggacgtatcaatattattactatcaacaacctttgtatttttcatgccaagtttattaataattcttgtctttaggtttgaaacatagctctgctttgttgccttggcaataatgcctgccaataaaacgtaattaacatcgctataatcataggtcatcttgcccgttgactctaaacgtttcaacatgcttgtataggcctgattttcagtcatcaccttagccggtgtcgtatcattattatccagaccggatgacattgacagcatctgctgaatcgtaatattgctgctgccttttacctgcggataataacgacttaatttcgtcccggcagacaagttgccactacttatcaattgttggataattgcgcccgtcattgccttttggagggatgctaaaggatatagtaccgtgccgtcactactattcgcagttttctttgctgcattggcgaatccattattcacagtgacagtgtgcttactgcctgctgaagccaatatagcacttccactgacatcatactgtttcatagtggccgctgctatttgagaaaaactaacgggtttgagtcccttaacattcatccaaccaatattttgattgaaataccttaattttgcataggtgccggtcttggttgtcttggtctgcatcactcttacatagtcattagggtatttatttccattgctatccgccgttcttgtgcttgaactggtaaaataaggtccaaaacgatagattgaatacgcattagaacgcttaacaatttgtgcatcatatcgtttattgcttgtttttaatatcggattatatccgtccatcagcccatgaattgcaatcgaaccggcaaatagcatcccacagaaaaagaatagtatcattcttaccctttttgtcgtttgaatcaaacttgtcaccgtccatcgtttctataaccatcataatcaaaatctgaaccagcctgttgccatcctttggaatagaaactcttgtcgatcctgtagtgaggtgccttttgctttttagtcaaaaacggattaatttcctgatccatcttcagccatccccgccatcccggatgaatggtatctgtcataaagtaattcacatttccatcttgacttaaatcatcgatatgattaaagccttgagagcgcaattgataagttatcttttgatcaaattgcttcaacatctctgaagacaatccagtatatttttgccatctttgattaaccggtggaataataaataacacatttgtatgatctttagcaaactgatttagtactaattgaaagtcgccgtattccggcgatttcaagaaactcatattagattgaaatcccttcaaagctttcacgtgatgctttaagcggcgattccaaaagcgattcccaatctgaaacctattagagtttgtatgttgttcacctaattggccagccaacttatccaactgctgaaaatgataagtctttggtagttctgccgcattattagcaatttttttcgcattattaaccgggattctaaacctggaataaatctgatcctcattcaacaataccctatgacgatagttaacataaagcatttgaaaggatgttggtttaagccctgcagcaattcttgccaaggtcccggaaataattttatcagagtcaccggaaggcatctgtagtaatcggtaagcagcgtaacgatccattttagatcccttttcctgctgaatccaggtcgttgtttgaagcggtgaataataaaaagaaaaggcatttgggtcttcacccattggcacaaaccactgtggtgaaacaaaaaagactgctttcttatttttcatttgttgattaattgactgcatgacgaaaaattgggtgagggactgactccctctggctccaagaagaaatggacgatacgatcggtgatacttagtagctaaaaccgatggatgaaatgggtcaaaccgcgaccattcagaagaaccaaaaaacggtacataattgttttccaatgcgctgcgctttattaactggcccttcaatattaaaggcgacaaggaagcggcggcgttcctctgaactttgggactgacatagctgaattttatccatgttggtgataaaaacacagcaaacatcagtaaagccgcaaataaaattggcccaaagatttcaaaaagacgcttttttactttcatttcaattcttcaacctttgcaataatttttgaaggcgtatcccactccgatcgattaaattctgaaattggtgcattaacacccaatttatcctggagatccaataacaactgaacagtccccatagaatccaataatgcactatcatacaaattttcgtccaaccttgttgaaaaatcttcaccagttaagtcatttaaaattgaaagaacagtttcttttacatcatccataatagtcaacccctcaatataatttaatttttgtactcattaaaacttacttggtccaaaaaacaacgtgttaagaaaacctgagaaaatcaagaatgtgaagcaaacaaaattaaatgtaataaagattgcaaatagttctgtaaacttattatgtggaatcttatcttgatgcttcttcttataacgaagccaagtatcatttaccactaatgcacatccatgaagtaacccataaagaatatagaaccatgtttcaccatgccaaaatcccataattaacatgttgatgatatagcagacatttgcggttgtaattctacttttgaagaccttgtgcttcatcataaagaagactaaccgcataaaaatatagtcacggaaccaaaacgataaagtcatatgccaacgattccaaaaatccttaatgtttttagatttaaacggatgattgaaattcataggcgttttaatgcccattaagtaactgatccctaccgcaaataaactgtagcctgcgaagtcaaagaacaagtccatactatacgtgtacatatagccaacaatataccatgaaaagccatgggccatcatggcaccaaactgcatttgaggcatcaatacagagccaaaatagtatgccaaaacaaacttgtaaagaaaaccaagaaagatatatcggacacctgtttgaaccaagtcgagataatctttctgtgcaggaacagcctcatagtcacttacaaaccgccggtaccgatcaattggccctgacgaaattgttggaaagaataatagaaactgaccaaagataatcggatggtactcctttataaagccgtccctagtctccataattgtctgaacgactttaaacgtaatatatgaaatacccaaaaaaccgataatggactgtttacccgactgaatagcgggtgttactttgacaacaaccaatggcagaattgccaagatgaccgatagaacaaacacccatcccttattgggcgaatctttccgacgtctgtaatgaaaataagcggataccagtaaaacctgataaacaaaataacaaattaatgcaattccggtccgccagttgggaccaccaaacgtcaaaatcaggaagaacagtgataccaatgtctgataccatcgaaaccggtgtccataaagcaagccaatcattaacggtatcaacgctacggctaaccaaataaaatacgttggatttccataaggaatataccatctcattttgagttaacctcgttaatgactgatttaatgtcaaccttcccattagggcttaatggcaaagattttctatatataattttttgaggaatcatatatgacatcattgaattttttaaatcacttttgattgctgccgttaaatccagctcattattaaagtgattttcatttggcacaatatatgcaatcaacattgatacctgatgctgtgcattatattttggaacaaccacactttgtttaacgtacttctgtttatcaaccaaaatagccacatcttcaagttcaaccctgtaaccatttatcttaacttgaaaatcttttcgaccataatattgaatcaggccatcttggcgaacggtagcgacatcccctgttttatacgccggttgatcatttagtgttgaaaaaacacgtttcgttttttccggattattaatataccccttggaaacacttgaaccgtaaatttcaagttctccttgtttcccgtcactaacaacatgaccgtcatcatcaatgattctgatatgcataccgtttttaacatagccaattggcaagcggtcaaatttctgaatgacctcatccgtgatttcaatttgggtcatagccacagtcgcttcagtgggaccataagtgttaaaaacatgggccttaggaaactttttctttagcattttggctgtccttgccgttaactcctctccacaaaagaggaaatcggttaaagccggatagttttctgcgttaaaagtcggctccaacaagcaaatgttcataaatgacggtgtcgaaacccaaacattaatcggcagtgttggtaacgttgtaaaaagaaccaaaaaattatctgtcattttcttagataagacgtgtaatgtcccacctttaaacaacgtcggatacagactcataacagataaatcgaacgaataagcaggttgttgcagcatctgtaagtcatccggcaactgaaaatcattgcctaccatccaatctacaaaactcattaagttatgatagctgatttcaacgcccttaggcacaccggtcgttccagacgtaaaaataatatagaaagtttgatctccttcgacaggatgtgtcacttgatagtcttcccgctccaagaaaatgttgccaagttcctttttggtgattaccggtacagtcccaaggctgacaggtagatcctcaactgccactacagcaaccggctttgcgatagaatttatcaataccagccgctcatccggcgaatcaacatctacagggatataagaatggccggttttcacaatcgcaataaatgttgcgatcatttcaaagcttttcccaccaaaaaccataatcggttgattagcaggtagcttcatggcatcaatgtgttttgccagagcatctgaatagtgctttaaatctaaataagtgtttgtttgattgttgtaatgataaacaacttcatcccttttagtttcggcatatgaatcaaccatgtcgattaaattcttttgcatcctcactcaccccgttaaaagtcattgtaaataaattttgcttgattgattccgctataatcgtatagataaaagagaaccatcataatcgcaaagtaaaataaagtcgttaaaacaaattttacaactggcctctgaatccactctagtaaagccatgcaaactctccccctttaaaaaagtcaacactacattaaaataggttggttaaattatgcgttctacaatcttaaaataatgaactaattcagctccccattcatcaccctgttaaagagttgaactgacaaattttgaatagaagctgccggtcgataattattgcttaaaaggacgacgccatttttcccatcccgagattccaagatagacgattcatatccataaccaatgccgtgcgaccggatgccatttgtttgattgtagacaccacctccataagttgacgagctacctggtgtatgtaaaattctgacatttgatagtgaaatcacttttccctgtaaaagacgatgctcagctttgaaaagttcgaaagcggtcatgtaaacctgccccgtacccaattcgttattcattgaagcctgagtttcattaaagggccgtcgatagttttgactgaactgatccgctttttgatagcgataacccgttgttttataaagcgttaaaggctgatcctgaacaaatccggtcccctttagattcatgggctttataaacgtttgttcaaaatacttcttataagtctctccggtcaaacgggaaataataccagataatagaacataattaaccggctggtactgccatttaccaaactcagacgttttacttgataaatgtttaacggcaaatgccacaacctgtttctcgtttaacaacctggtcgacccaacctctttcattgacaatcccgaatccatatcaagcatattgcgaatctggatatgggttgcatttgaaattgtcgggtagaaatgtgctaaaggcgtctttaatgataattttctttcttgcacaagtttcatcacacatgccgccgttaaagacttttgtattgacaaaatttggaattcagaattggttctatttttgattctatccgcgtaattcgcatatccaaatgcacgccgatataagaatcggtcgttcttaataatcaaagccgaccccacaaaatgatttttcttcaaatacatcgtgatatcgttggtttgtgtatcagcatgatcaccagaccctttagcctgaaacttaaccgtctctttttgtttatttttggaacgactggcattttttttgctggaagaacggtttccttctgagcggtttatctcagcctggcgtgcgttttgcgcgtctaaatgctgtttaatagctaaggcgccgccaataacgataaccactaatagtaaaaacccgtatgcccaacgacgtccccatttcatgtgtgcacccccttcctcaaatctatttcaaactttgtgtaccatcatactaattggtaaataatcatctttgttagccaaggaacgcagttttaacgtcctgttcgaaaactgctcctctaaatttcttacatagcctcaagattactacaaaaagccactcgaacaagtaaaactttcttgacatgtggtttacatcccttgtcccccaattaattgagttttcgcggtcttcgcacaaattcttacttagttgccacttaggtttccgattagcccagatagccaaatcaggttaggtgattaaaaccgacattaagtgtctaattttttcccgtctatctcctttacacttatttgaacccattatattctgcgtgattctaataacaattaaaatgctccaatatttccttctctttgataaacctttagtatcttttgcattccgttaatatttgttgcctaaataagcatttttttacagtaagatataaccacaaagtattgattgttacaaataggtcaacgactctttttcacccaacaaataaaagacacccaataacgttgtaaataacgacattggatgcccattgcgacttgcttaagttaatcactgaaaataacgatcttcattaataccattagttaatcgttgccaaaatgacaggacgatcaaacatcaactaagtacttgagcaagcagcttttttaaattggctgaatcttggtcaacaactgtcttcatatttttaaaccgtttagaatacgaaggatgataaagcggaaagatttttcgaatgttatcggtcaatttaaaggtatcggttgatttatcgaggtattgaattggctgctcaatcaattgcccatgcagatccccgattttggctttattgccaagtaaacgctgaaggctggcattacccattggaatcatcaatagatccttaaaatgagtcatctcaaaatcaaacatcggtgcccactgtttcacttctgtgttgttaggccgccggtcgcgcttacgcccagtcttgccaatcgaaaacggtcgggcactgacaacccctgtaatgtagatatcctcacgagttaagcccaacgaagccagccaacggtcgagttcttttccggatggaccttgaaatggatgtcctaatttaacctctttatctcccggtgcttcacctaaaagcaatactttgggatgatagccaccttctccggcgacaaacccctccaagtgtggattttcttccgactttttctttccccactcaatccattcgggggttaacacggtgtgaagttgcatgtgcacgtacctctttcttggttattgtcgcactttcaaaatacaggttgactactgataatttatcatcaaatcgattaaccctgtccatccttaaaagctggatacagtgtcattccaccatcgataaacaaggtaattcctgtcacatagcttgattcatcggaagccaaccaggctgcgccggccgcgacttcttcgggtttgccgattcgattcatcggcaccattgaaaccgtttgatcaagttgtgccttatcagcaaatttcttcgcatttatcggtgtattgattgcaccgggaccaatggcgttaacacgaatcccctctttagcatattccattgcgattgtttgagtaaacagcttcacgccacccttagctgcagcgtaactggcaaaggtaggccatggaatctgctcatgtactgatgaaacgttaatgatattgccctttttatttttttctttgaagtaattcagtgcggtttttgcccctaaaaagacccccgtttcgttgattgaaataaccttattccaatcctccaaagatagttcgtgtgtcggtgacttgatttccataccggcattattgacccaaacatcgagatcgccaaacttatccaacgccgcacgtaataattcctgattgccgttttcagtggaaacatcggctttgacaattgtggcttgaccaccgttgtcggccacctcttccgctaccttttgagcaccggcttcatcgctattgtaattgatgacaaccgacatatgttcctgaccaaacctgttggcaatcgcattgccgattccctttgagccaccggtgatgacagcaactttgttttttaaatctgtgtacatttgtttcctcccccggaagttaatttaaggttcaaaccagcttcatcttttaaaacaaaatattgttacaaattaatgttaatctgacaacgctgggaattcaagcacgagtgttggtatgttgggagaaagagcgcatatgaagttggtccgatttaaaatattaatattttcgtgttttttattttaataaataccattaattttttggaggtcgcttgggaacagcgtaagttgggagaagtaaaaactataaaagatggcacacatgattcgccacgatatgttccaaaaggatatccccttgtcacctctaaaaacttaaacgattctgggctaaacttgtcagatgtgtcatacatatctgaatctgactttgattcaattaataaacgatctaaggtaaatgttggagatattatttttggaatgataggtacaattggtaatccagtattgttggacgaatcgaattttgccatcaaaaatgttgctttattaaaaaatgatggaccaattcagaatcattggttaatacagtatttgaaatctgatgttttcaatcgattgacttctgagaaaactgctggtaatacacaaaagttcatcggcttaaatgttatacgtaatttaattattgatacgcctagcattcatgagcaagttataattggatctttcttgaaattaactgactccattatcgctgccaatcagggtaagcgtttacaaattaaaaacgcccttttatcttgtcaggcgttattcttgacacgttttacactaaactagctaaatgtttcataactttgtcattatcttggttctccaactcttgaataatatgcaaataagtctgttgcgtggtgttcatattagaatgtcccagtctacgggcaacagaggcaatgctaacacccgcatacaacaaaagtgatgcgtgggtatgcctaagaccatgaacagaaataattggaatgccggatttcttgcatagtctttccagataatgattaatcgtatcgttatatacttttgaccttacaaatatcggtttatcttccgataattctttcgttaactgagaaaactgaatgaccgtttgccaatccaattgaatttttctcatagacgagaaattcttggttggcgcaaacccagcctgtctcgatttgtaatcccaagtcttattaatattcaacgtttgtctggcaaagtcgaaatcatttggcgtaacagccagcgcttcagaaaatcgtaagccggttttagtaatgagtaaaataaaataatcccagttcacacctgcatctaaagacaaactgtctaacattaattgaacttcatgttgattcaaaaattttgttttgtgtggtcccggcttcttcccctttataattgcttttcgagtaggatcacgttcgaggatgtcctcctccaaggcatcaatcaaagaacttttaatatgtcgatgaaagtccataacggtttgtctttcatgagtttccgcataatcattaagcaatttctggtaagtcaatcttgatagttcacacatcctcaaatccggtgctagagaaacaatttgtcggtaagtcatttcatatttgcggtaagtgacttcccggacagcatcttttttgtataggttcatccaatcctgaaaatatcggtgtaacttaatatcgctagccatgatattacctccataaataaattagaggacacttcatttgcagaagccccctctatatttattaaacaggcaatagaccataaaaagccaatttaaactctataattccaaagcacgcatcagtgtgaccatcgacctaatatgtaaccatcatcgaagctgctatcgtcactgcctcctgaagttggtgtgttgtgcaaccatcgaattaatttgataattaaccagaggaccaccggcgtaagtatgactgcccaaatatcgtcccaactaataccaggcttcatcgttttaacgttggcaacatgcttattaataaacggcgaaaagcggttgaagtattgataagcaatattcttattaactatcttcgtcgataatcctcggtgaagctgccaattttggaaatcagatgtagctccatctaaatcttcactcttgattaatttaatttgcgttcccttaccaggataagcaactaaaagtgagacatgcatctcccatgcctgcgctttcgagtcgacttccgtttcccaatcataatcaccattctttggtgttgcctttttagcaatcttggctaaaagatcctcacccaaattatcaatgtccgaaggccgccgatttaatgtataaatccaaatttgtggtttgttaccctcgtgctgccattggtgattttgttggataatctgttgcttttgagaaggttttaaaagattcaattgatcatgaatcatatccttttccgaataagtggcagcatgagcagtactactattaatgaggaatagtgaaattgccatacatagaaaaatcaaaattcgactggttattttcatatacagacgcttctttcaaatataatagcgttttttcaattcacgagaatgttattcaatacaattccaaaaatgaacccgattttaacacgcttgggaacagcgtaagttgaaaaatataacttcaaaaattggtagtggcaaaactccgctcggaggtaaaaaggagtatgaacagaagaatggtgtattattcttacgatctcaaaatataaataataatagaattgatttgaacaatgttgcctatatatcctctaaaacagatgaagagatgatcagttcatctataaattataacgatgtccttttaaacataactggagcttccattgggcgaagtgctgtttataggttggtgcgccatgcaaatgttaatcagcatgtatgtattattcgtttagtcgatgggtatgattctgattttttacaattatttttatcgtcttattacggtcaaattcaaatatttcgtaatcaagcaggtggtggacgagaaggtctaaatttctttcaaattggagaaatgacatttaaattccccacattgaacgaacaaaaacgattttctgagttcttcatagatattcaaaataccatcgctgccaatctgcgacagcgtcttaataactcactaaacatagagaaccattcaaaagcatcaatcaatgaatagaaatgtaaaaatccagaacacccattctacatattgataactattcttagaagcttctgaataatatgcaaaacattcttccatctaatccttaggcatacaattccctatcagactacaattatccatttgctttcactcatactgaacaaaaataaaatcaaattattgctcaacctaacttttctttatctctccaagactttttagcaagacttagaatatattctaaattagtatcgtctttaacaactaattcataatcaccgtttccccaatggcctatatgcttcacatttcgtgctaatccaagggaatcatcgagctctccttcaggacaattaatccatatttttaattgcttcttttgaatctgaatatcaatgaagttatgcttatgaattcgaaatccaatgtaaagtttaactggtttcacctcgattgtgctatcccatgagagaatggcatctttaaacgcttgatataatcgacgaatctcttcagaaccgttacttaaatgatcttcctcagtatatagtgcgattgaagaaacatcttttacactttgcaccgacttaggctttgcggcaacatgggtatgtgccgtttgccccaaattatccttttcaattttattaacaatcacatagtcatttgtatacttgttgacttcatacaattcaatcggtaaaaccgggttgttgactgcgtctttttgatactgagtaaatccttttgccacaaaaataacttttatttgagaccaatcaaaatagctttccgattcattcaccccatagaaatgaatataaagtaagatgaagtccgccttgtgatttaaaagagtatttaaatatgagtacccttgatcaatcacacttgatttagtcatattcttgtattccaagattacaaatgatttaagctcttcatcgaaagctactgtatctaatcgataaataccaaccgtaaattcagacgaaagaaatttatctccaaaaagttgttcaacattagcttgaacgatattctgcatttcacgttcaattttgaaatcttccggcttgatgatttttaattttttattctcacttattttataaagttccattgattaccaccttccttacatcaaaatacataatcacaaaaacagagagaacctgacttaaaaaccacttccaaaatcctcttattacaatatcactgattggcagcgatacgtatctaaaaatattaaaaattagacgaacatattttgcatcaaatatttttttaaactttgtaaatgatcgagccgtcgttgattggcagcgataagttgatcagttaaaaataaaattttaccaatatacttttgctctttttcatctggaacggctaagaaatatttttgaaccttatcataatttatcccaaatacttttaaaccagttccaactttataaacgtaatgtctaaagcccggagacaaaaaaagatataaataataaacggggtccccacacttaagacgaatagctattgtatgcaatcctgatactacttttcttcccttgatatttttcattaacattggttcagcaatttctttataatcttctgaagcatctgccaaaacaatgtcgccagtttgaagtagctggaagtcacctgatttaatattaggcaacctaaatgatttatcaacatattttcttgacgaagtgtggatatcaccataatgaatgtattcagtatcactttctggtacttcatactttctgggcaaggaataggattttagttgcttaagaccttctcccaacttacgctgttcccaaggatcagtgaaccctttgaatctccactcttgattaaaaatcttttgcatcaacaacttcttaagtcgttttagctgttcaagcttactctgattggcagcgataagaataaagatattttgaaatatctttccgactttatcctgttccatccatagttgtggaatatttaatttaactttagaaaaatctttctttgtaatatgaggttgggcagatccaacatgatcgttcctcataaaattgtctattattttcccccttaggctagattcaagaaataaattggataaatgttggctgctttcttttctaagaattaacatagcagaattaattcttatctcgggaaatttttgactgatgctcttatcataataagcaacattgcctaacgttcctctagaggttagaacaaagtcacccacatttagttttccattttttagttgcttatctttttgatcacttatatatttttgggtttcaaaattaaacccattttttttaacgtttccggtatctaggaatagaacatttccactttccaagaagtttgactcatgaggatagttatgccctctatctccatcaataatattaaagatttctcccaacttacgctgttcccaaggatcatcaaatcccttaaatctgattttaggctgtttttcctcactcattcttgaacaactccttaatctttgtaagctgctgttgagcgacagggttcttgccttccagatcatccagcattgacgaaaattctgactctaatttgctgatttgttcgtccgtgtccttaatatcagcaaccagtttgtccacatcgactggcggttccggttcgaacgtatcaacgtaccggggaatatttaaattgaattcattttctttaatctcgttaaagtcagcaacatgcgcaaactttttaacatctttccggtctttgtaagtatcaataatctttttgacattttcatcagttaagttattttgatttttacccttttcaaaatcttttgaagcgtcaataaataaaatgtcatggttgattctactcttgtcaaagaccagaacaaccgttggaattgacgtcccataaaacaaattagccggcatcccgatgacagcatccaatacattatctttttcgatcatgtattgccgaattttaccttccgcggcgcctctaaacagaaccccgtgaggcaatacaactgccattcgaccatctgttttcaagtgatataacatatgttccacaaaagcaaaatctgccttagacttgggagcagttttcccatattttctaaaccgttcatcatccaacttatcggttgcgttccaatttgctgaatacggtggattagccaccaccgcatcaaaggtccgctctggaaactgatcattttccaaagtatctccctgtctcaaatcaaaacgactgtaattaattccatgcattaacatattcattcgggccaagttataagttgtaccgtttagttcctgaccatagtattcggcaacctttgcatagtcacctacccgtaatagcagagaaccggatcccattgttggatcataaactgttcgaacttcttccctattaagtgttaccagttgtgacagcaccttggagacttgttgaggtgtatagaattctccggcttttttaccagccgttgcagcaaattggccaattaaatattcgtaagcatcacctaaaacatcaatttttaattcattttcgtgaaaatcaatatctgccaaattcatcatcactttagcgatcaattcactacgttcggcaacggttgagccaagccgcgaggatgccaaatccatgtcttcaaacaagcctttaaagtcatcctctgattcctggccaattgttgaactttgaacttcattaattgaatcctgtagcatttcgatatcaaaattaccggcttgaatatgctgaatcatcgaatcaaacaaagcctttggttcaataaagaagcctagtgaagatttgatttcagcaactaaatcatctcgataatcttcatcttgataggcttcgctaaacgtatatgaatcattttgcagtaattgatttgcgtacatctgaaccctctcagacaagaacctataaaaaatcaatccaagaatataatttctaaactcacttgcatccatgttgcctcgtaaatcgttggcaattgcccacagtctcttttgaagttcagcttgttgctgtgcctgttccgtatgtgtcgctaccattttgtgtcttcctctttacgacattgcaaatcgtttgattgtcttttggacaaacgatttgatgcgtttctttattgttattttttgcttaaagtcataacctgcttcactcagggccttcataacctcctgagaatttgtccgaccataaaaatcataatcacttaattgatggtcgataatatccaacggaattttatttttttcagagaattgttgaatttcattctgccgacgttttgccaaatacttatttaattcattactgacatttgcgtcagactgtagcttgggaataatttgatccaaaaaatccgccaacaaatctgctttggatttcaattccggattatccgcattattaagcatccgtttaatcttatttgtgtctgacttctttgattccttactgccaagattgattgacttaatcagattcataatatattcaacgtcaattttatccgtctccaacagttcaatttcaaaatcaatatcatcaagaattgaagctttctccccaccaccgtcttcttcttgctcaagcgcctggtgggcagcaaaatatttcgaacgatactgttccatttcctgttcagataattgattttcaaatttatcccaagaaaagtcatcataaacacgtattttattttgtacccgcaaaacatccctaaatgccaaaacaaaatctttaagcttatcttcaccttgattatgaaggtcgtccacatccccaggggtgatcgctacctcttttaatcgcttgattttatcgtcaaattggtctgccagctcttgataggatggcacaactacaaagttaccggagccaccggaaaacaatttgatagcatcatccgtttcctttttaatatttcgataacaaataatatttccaaagggtttggattgcttttcaattcggttggttctggagaacgcttgaagaaggccctgccactgtaatcttctgtcaacatatagagtggataacttaggcgaatcgaatccggttaaaaacatattgacaacaatcagaatgtcaatattatcatccggtgtctgagcgttatgttctttcatgcgcttagaaacatctccgaaataatctgaaaacttatccgtactaaatgccgtgccatattgatgattataatcgtcgattactgcatccaagccgtgacgagatgttttaaacttttcatcctgtttcttttcggcatccttttcattttcagcccaagtaaatatcgttgtgattttaagatcactgtttgattcttcttttaattttttaaacacttcatagtatttaagcgctatattagtgcttggcactgtgaaaatagcattatattgtctatttttagtaacgttaccatggttcaacataatatgcgtagcaacctgtttaagcctctctgggctttcaaaggccgctttggtatcaataccgggaaccttttcgtcatcaatagtagtgtcctttcccttgattgttccgatatattgaacactaaacccgagcacattatgatcccgaatggcatctttaataaggtaatgatgtaattcttcatcatagagtgttttagttgtccgcccatctgccccgatattttcggaaaagatcggcgtacctgtaaagccgaaatgctcagaatttttaaaccaattattgatattttttctcatctcaccaaactggctacgatgagcttcatcttcgataaaaattactcgttgatcatgaaattggcttaataactttttatattttggattactaatagcaacgttcattttttgaatggttgaaataatcagtgggtcgtctttagatcgtaactgtttcaccagactacgcgtgtcatccgttctatccaatgcaggttgattagtcacggatttaggtaaataagaattaaagtttttagccgtttgtagatccagatcggatcgatcgattagaaaaatcactttctctgcatcggtttcacgcgtaagtcgttgtgcagacttaaaggcggtgatcgtcttgccagaacctgtcgtgtgccagataaagccattcttttccggatgatgcttagcctgattcacaattgcttcagttgcgtaaacttgatatggtcgcatgattaacattctctgattgtcgttatcaaaaattgtatatttggcaatcatactatgcagtctttttggcacaaagaaagatgatgtaaaggcatcaatatcattcaaccaattattttgtcgatctgtccaataaaacataaaattggaattaagtttgccatcaccattcgcaaaatacctggtttcatcaccattcgagactacaaaaagctgaacaaaccgataaagttgccgaaaggattcgtcacgatagcgaatgatttgatgaaatgcttcagaaaagtctacaccacgtttttttaattcaatttgaacgattggaagaccattaatcaaaatagtaacatcatatcgattaacatacttcgtattaaccgttacttgatgtgtcacttcatatgtattattttgataatcgtgaccatcaaaaaattctaaatataattgagaattatcatcccgttgaatcacaatttttccgtagggctgaatatccgctcccctcaacaactgggcgatctcaaagatatttcgtgcgccaaccatttgatggagcacccggctaaactcagtgtcgcttaacggggtgcccttaagtctttcatcgtttcgttcatttaataaagtccgaaaatgatcagttaattgtttttcatcgctaattttgacagtcttgtatccaattgcgttaagccggttcataaatcttttttccagtaacgcttcagattcatatccttcactcattgataccagcccccttacagattcaaatatgtaataactaatattcttctttatattatcatagctaagactattgaggtatacgattccaataaaaatacagccaaccatcgttagctgtatttttagattgtattaaaaaagttaagaatcattattccttaatctcatccaatatccgctgctcatcatacaacctcattacaaagtacattgctgcataaatcaccagcggaatccaaacataattcacatcaatcatcgtaattgttgcgctattctgcgtctggttggcaacgtatccagaaatatgaaacaacccggctgtaatcaagccgccgactcccagcccgaaattgacaccaaaatcatcggtcgaagccaagatgccctctgcctgaacgcccatactgaccccatatcggattgtatccgcaatcatgatcgacaccaagccaataataataccgttaccaattgagttaataaagataccgccaaacagcgttggcatattgcttagataaacaccaagtgcaatcacgatttgaccaacaaaagcggtcaaaatgccacccatcatggtgcgttttttactttgggtttccgtaatccgcatgatcaacagtacaccgattaatgacgtaaacgtaaaactgttagcaagtggcaccaggttttcatttcccaaaacatacttaaaatagtagatagtggtttgattcttaatcgacgtgaccagccagtacataaaaatcgatatcgaaataacaatccaaggttgatttttgcgaatcattgcggccactgacctcaatggctgatgtgcaatatttggattcgcataccgctcacgaacgtggataaacgtattcagaatcaggatcaacgaaataataccaaacaagataatcgtgccaagaaaacctgcctgttgatttccctttccgaaaagtgccacgagcggcaatgtaaataccgccactataatttgaaccaagctgccaaagaactgacggatcacaccgagtaacgccaactcacgcgaattttgcgacatcgttggtaaaatcgacgtaatcggtaaattaaccgctgtgtataaaaagccgagccccaagtatgtaaaatatgcccacgccaatttgccaccgtatgaaaaaccgggtgttataaacgtaagaacagcaaagatcacataagggaatgcataccacagaaagaacggtcgactcttaccgaatttagaatgcgttcgatcgatcatcacaccaataatgaaactttccgccacatccgctactcgagctaccacaaataaaatggcaaccgcactggcacttaggccataaacgtccgtgtagaaaaacagcaggtaagttgtcatcatttgaaaaaccaaattatcagccgcatcacttaatccgtaactgattcgttcaggccagcgggttacccaaccggcagttgtttttgccatttaatcacctgatttgctttaaattgttaacatccttattgttaacaactattctaggcgtttccaggtgttaatagcaatcaattgtcaatttttattgcgcaaaggccataagaaaagacctgaacttggcgtccagatcttaagggaagagttttcattttatattgaagggtattcatatacatgaagttagttaagaaatcgttgagttaaataattatttgaggggttaattattttacacattttctcgttacaagctgctaaaatccatcgcatcgcttccttaattatattaagagagtgctgatttggctttgtggtacaaatcaagttggctttgcatctctcttatttgattgtctatatcatatcgtccttagcttaactgaagcttaagttaaaaatcttttttgtttttttctcgaacttctttaaaagcggaaagaaggaatcaaaatgcaaaacaatgaaacaacttttgaaaaaaatttgacattaccattgattgttccgggcaatgatgcttggaaagtaacttttagtaatgataacctattaggccgaattgccaatcttaccatctatgtggtctgtccaattgtcctgttgattgtcctttatttgggtctttgatcttttttaagagaatccaacaacgcttcgaagccttaactaagggattggagcattgtcattgtcaaatataatcatcgaataccctcctataagataagaaaaggtcctgctaacgcaggaccttttgaggggaatttttttcattatatcgaagggtattcacatcatgaagtttgttaagaaatcgtttgaatttgtgattatttgaggagtgagttttttagtgtttttgcatgcaatttgtaactagttaaatgtcatcgcatcactcctttcaaagttagcgtgtgtgtactgagtttcagctctcgaactggattaactcaagggtttaccgtattagtagcaactccacacaacgatgcgggtatgctcgagaagtttcctatcatatttaaactttggtttgatttttgcactgtttgctattgtcatcagtcatcattccttccgttcgatcatagtcattatcaaaagaggctctttttatccctgcctcttattttattgtctacatcatataatccggagcttaatcgaagcttaaagcaatcaaatatagttaattaattgagaggccgcctggaaacagccttgttaccgttttgtttgttgtctttaccattaatcgttgttggtgtcgtatccgcattgacaacaattgagcttgctgccgttgttccaaacattgtcaaggcagcccctgatatatataaaatctgtttcattgtcatcatttaaaatctcccttcaagttaattctttcaattgaatagttaatgatcacgacttatttttagtgagcatttaaatttttaattatttagtttttattgccaagttgaaagttcggtgactatcgttatttttagaccattggcatcgtcccctttcaaatttgattgtctacagattacctgtaacaacttaatccaaacttaaatcagacccatcaaacaggaaatttttttcttaaaggttgcgctaaccttttaaaaaattgccaaggattacgaaaaaaaccgcagtttcttctttttgtatcaggaaggaaatgcagctttttattttgtcactacatagaaaaaggccctgctttcgcaaggccaatctgagggaaaatgtaactagagtgtgtattcgttagaaagtattggtattagtcattatctggggcgagttattgtatcgggtatcctaactgtacattgcatttccctaaatattcagagcgggggtattaagggttcatcatcttcaaatacattttcgcttggagtaggggtatcatcagaagaaatcatttgcttaaacactctgaatatttaatatctaaagaataacgagcttaccttaactcaaccttaaaaacagttaagtttcgaaataaaacgatatttaaccagtactttcacttctaacatacgaagttgttagtcaaagtttaaacttttcgaattctaaaaaagtcggttccggttcaaatcaaaaccaattttattttaacaatccatttaaaaaccgaaaagataattctttgcctattcccttaaagcctcaacgcatctactcccaatgcattgaccgtcattttaataaaacgatggcttgtccccatccgtattcggctggttaactccaacagaatggcggctttctttatcaggttcattaatgagatgaacgacgaagtctgcaatactttttcgtgaaacttcggttcctttaaatggttctcccttttcggttgtttcataactgacaatatccttgttggataaccaagccggccgaacaagtgtataatccaagtcagaattctcaatgatttttgcggccgctgcatatgtttccaaataaccgccatctaacatttgatgattccatttaccgaagttaccaggtacttcatcataaatacccaaagtagaaatccaaatcaatcgtttgacaccgacagtattcattgcagttacaaccgatttagcctgctgctcaatatttttacctgctaagttagcatacacaatatcaatgccctttaacgccttttcaagagattttgtatctgtcgtatctccttcaacaaccatttcgcgtttatcatcactcgacttcaaacgatcggcattcctcaagaacagggtcaattgatgagtcgttttctccaacaattctttctcagccaatttggcaatcttaccgtttgcgccaagaatcaagatctttgccataaataacattcctcccttattgcttctacatatactatgataagaaggaatcaacttaaagaaaacggacaattggggctaactgtccgcaggatcactcaaaattttaaaggggcctttaaatgatttcacaaacaaaacttaagattgccaacgcaactaaacatttagtggtatcacaaccgttcgatcatatttcggtcaccagtattatggaagccgctcaattacgtcgccaaacattctatgactatttccacgataaatatgacgtccttgattggatttatactgttgaaatcaatgaagcggtaaaatactgcaatacttatcgctactggccgcaaacacttctgaaaatgatgacttattttgaagaaaatcgtgaattttaccaaaaagtcattgaaattgatgaacagaatgcacctgaaaaagtcatcacaaatcacattcgccaaatggtcggcaacatctttattgatctcagcaaaaaagagcagctgccaattaacactgactactgctcttttctacaggaattattaagtcgtactttattgtctgaattgaaacgtttcttacgccccgatagtcatttaaatctccacgatgaagttgccaacttaagggattatttagatgatgggattaatggcttgcttctgagaaccagacggattgactcatatcggcattcgcaaagcttgtgaagactacttagttgcaggaattctccactgctaccgagccgaaacgtgcaaaagaaaagcagaccccggccatataagtcgccacagcaaacattccaaaaccgggaatattcattatcactgctaccaagccaaaacgtgctccgccaaccataagcttgcatgtaaaggcacttgcattaaattccgaattcaggaattcttcgctgttaccaagccgaaacgtgctccaagagacaactcccggccatataaggtcactaatcagacattccaaaaacaggaatatctgattagtgaccttatattctgggagttaaccgtctctttccgcactctgactctatccgaagtcactcccactcaaatcatccaacagctccatatcatccgggctgatttcaaaatcaagttgagtattgtttttaatgtgttcttcattgacagctttgggtaatggtagaacatcgttttgaagcacgaacttgatcgctaattgtgcaatgctaacaccatacttatttgccatctgttgaatatcctgattctcaaataatgcaccggttgctaacggtgaatatgcttcaaccaagatcccattatctttggtgaatttagtgatctgtggttccgtgtacccggcaaagtaacggatctggttaacggctggtttgacgtctgccatatccaaaatattctttaagtcatgaacattgaaattcgatacaccaatggcctttgcttcaccactattataaatatcctgcattgcctgccaaacttcacgattggcttcatcatattctgttgagccgcgttgtccccatggccatggtgcatgaaccagatataaatccaaataggaaaaatccagtgccttcatcgttgatttgaagtctttaataaccccatcataggttttggtttctgccggcaatttagacgtaacaaagacgttttcccggtcaacgtccgaatcaaagattgcttggccaacactttcttcattccgatatgctttagccgtatcgatatgacggtagcctgccttcaaagcagccgttactgcatcgtaagttggtttgccatctggaatttgccaggtaccaaaaccgactttagggatttcgttccccgtattcaattgatacgtttcagttagaattgacattgtaatgcctcctcgtgttgtattaagtagttacattatggaacttaaactataaaaacgctagaaattggcatttcagattattctgagtgccgcattaaaaaaagggattaagagttgtatttatttgtgaaaacggttactttatataatgtaaagaaaatcattaaattgatgcggcatacaatacgatctcttaaccgcatcatttattttgaaaggatggctcctatgacaatcaatgttaacgaagcaaatcttgtctttcatcttcaaaccgaccataccagctacattttccggattatggaaaatggtgaagccggccaaatttattatggtcaaaaaatccacgttcaacctaattataagaatctcacttcaagagaatggcgagacgataacccgtcattaagtgaagaagatcccaattttcaaccgcccgcaatcaagtctgaatatgccagcttgggcaaaggggatttccgttaccccgcctttcaggtcacccaagaaaacgggagcagaatcaccgaactaacctatgaccattaccaactcctgaatggtaaaagccggttggtagatctgccatcaactttcgatgatacaaacgacgatgcccaaacgttggtcctttcttttaaagaccaaattaccggattgacactcgatcttaattacagtattttccctcaccaagacatcatcgttaaaagtgtcaaatttaccaacccgagttcagaaaaactggtcttaaaccgggcactcagttcacaacttgatttaccggattcaaattatgacctcattcaattttccggcacttgggctcgcgagcgtcacttgtatcgtaaccaattaagacccggcattcagagtatcagcagccttcgtacgtcatcaagtcatcaacaaaatccatttatgatgctggcacgtccacagaccactgatgaacaaggtgacgtttttggtttcaaccttgtttactccggcaatttcttagactcggtcgaagttgatcaatatgataccagccggatcctaaccggtatcaatccagacgagtttggttggaaccttgctccccaaacatcgtttcagacaccggaagcaattctaagttatacaaccgaaggcatgaaccaactttcccaacaaatggcggatttctacagtcagcatttggttaatcccaggttcacgcatgaagatcggccaattctaattaataattgggaagctacctattttgactttaacgaagccaaacttatgacaattgttaatcaggctcatcaactcggcattgaaatgttcgtgctcgatgatggttggttcggtcatcgggatgacgacaccacttccctgggtgattggttcgttgataagaagaagtttccaaacggtatcgaacacttcagtcaacaggttcatgatcttggtatgaaattcggtctgtggtttgaaccggaaatgatttccatcgacagcgacctttatcaaaaacatcccgaatggatgatccatgatcccaaatcgacaccaactcccggtcgacatcaattcgtgcttgacatgactcgtccggaagtaattgattatctgtataatttgatgagtcacatgattgaatcagccgatctggactacatcaaatgggatatgaaccgccatattactgaaatgttcagctcggaattaaccagtgaccagcaattagagatgccacatcgctatattctcggggtctatcaactatatgatcgcctgacaaaggcttatccaaatgtgttgtttgaatcctgtgcctcaggtggcggtcgtttcgatctcggtcttatgtattacgcacctcaagcatggaccagtgacgataccgatgcagcagaacgaatgcttatccaattcgggacttcctatggctatccacaatctatgatgggtgcccacgtttcagctgtgccaaacgatcaaatgggtcgaataacctctctaaaaaccagaggtgccgttgctttcttcggtgactttggttatgaactcgatattacaaaaatggcaccggaggaacttgaccaaattaaagaccaagttgccttctataaacaatatcgtcacctcttccaattcggaaagttctatcgaattgacagtccatttgttggaagtggtaacgttattagctggcaagttgtcagtgatgaccgaaaacaagcaattgcggcccgttatcaactgctaaaccatccaaacgcaccatataccagattctatttcaagggcttggatccaaatcagcagtatcaaatcaatgatgatgcagaaacatattatggtgatgaattaatgaatgccggctactttgtcccaaccattctggcagacggcaaggaatccaaggacttttattcacaactatttgtcgtaaaggctgtctaaatgatgtcatttaagcgactaaaaacggcttccaaaaatggaagccgttttttaattactttttaatggctattaagcaagcggatttgctttatagaagagtttaacagtatctccatacttggcattcgcattttcctgctttgtcttggttgcatcaaatttccatgaaggtgtttgatatcgtccattaataagaaccggatttcccgtcaaggaagccaaattgccacccttaaaaatatcattatcaaataccgttgctggaattgtgccttgggttgcactcgtaaagacagctttatcagtatcgttgaatacaggataaatgccctcaaccagtgcggaactcgaaatcggttgattactgtccgaatcataataactcaattgtgaggtgtagttatgagcaacttgatcaacgtaaacggtgtagttactgccgaccgtcacattggcaaccggattattaggttgactcttgctgagcgtgtagccggttggaatatttttattagcaacatccgttaattcagatgagttgtttaaaatatcacccaactttgccccatttgccagtttggcgccactcttcaaatcactgttctgaataatccagttataggtttgacccacctgttgaccggatgcattcagataaacaatttgaatactgttatctttggtcggcgttgtcgttggtgtcgacggcgtggttggcgttgacggtttacttgttggtgcattcaaaccaccggcaaatacccaaccagtaacggcggaattgttgtcatcagttacttgataatacaaccatccttcacgggtcttagtagcggcacccgtaactgtaaaggtatcaccactcttgtagccactcatatcagctggttgtgccttatattgactccattttggattaacccaaagtgaatttttagcagcgttagctaacgtgtatccctttgtaacggatggcatgctggcttgagtcatcgtattagtcgatgaaataccaccgccaaatgatgacgttgttttaccaccgtagatccaaccacgaaggctgccattaaaggaaacaactttatagtaaacagatcctctattagtggttgccactcgatatgcccggaagtattgttgggaactatttgaactgccatactgtgacagggttcccttgccggcaatgactcgagcaccacgaagcgttcctgctttggtgtacaaagcatttgttccgttggttaccacgtttcgagtagtcggatcacttgataacgtagagtttgaagctacggttgcgtaagtcttggcactcgcatttgttgtcgcaaatccggttgcagcaactaaagacaatgctgccaaaccaacatacaatgactttttcgtatcaaatttcatatttatatatgcccccatatatgatctatgcggttcttttaccgcaacttcaatgtaacaccatccaagggcaaagcgttaattttacgtctggatttaatcgaactgacgttttattgagataatcttaacctttttgaaattaattggcatttttatttaacaaaaaaactgatctactttacgtatcaccttttgtcatttaataacaaattattaatgatctaaattattttggaacctttgtcacactcaatgccggcatccgatgctgaatcaatcctcgagcgaagtcgttatcaaacaaccattgtttaatgtctttttcaccgattaacaccggcatccgattatggatcgggctcacattttgattaggttcagttgtcataatgattgaacgcgggccatcctgttcatttcgaataaagccaccgacaaatatcaactgatcatcagggtacgtaaagtagaacttatcctttgccggactccattcgtaaaagccggacatcggaaacaaacaacgatttgttaaaaacggtgttcgaaacatctttttatcggtgacggactcggcacgggcattaataatcaactgattttcccgaaagccctcaaatccccatttaataccggaaagttgtgttttctgatgactggcattaataacagccgtcacgtcgtttggaaagacttcaccggtcttcacgttaattccggcttccttcaaaaggttaaccaacttttgaagccgctttgattttaaaacatcaaaataatatcgtccacacattatcacaccttctcttttatctgccataacccattatgtcacaatcaattaaaaatcggattgaagctaaaccgcctcaacccgacttttaattgattaacttctgagcttgtattcaaaccaaagacgatcttcataaggttttaaagccttttccagctgcaccctaatgatattaacccgaaaatccgcggctaaaatagcaccacaaatgacgagcatcgtaacttcaatcacaactaatccccaattttgcttagctgtcatgaccaaccattgttgtaaggctaaaataccgatcattgccagtgtcttgttggccaaccagtacaaccgatgaatcgctcgaaccttcttagtcaccagcttttgaagatcagttgtgagattggcagattcctcaagggcaatttgaagtccccttgcgttcttctttaataattcagagacataagcagatgatttgccgactcttctcatggagaaaaagtcaccgatccaaagcgcaatcaacatatagatcagaaaaaaatcagttaatttcaaaaaatcggtcatttcaatccctcccattctgacttctatggttcaattgatcaaaaccaaaccatccttaacggcatcccccaatgcgttaacttaaaattctgtttgactatttgcgaaaagtatacagccatctacaataaatgtgtaagattatgcctacaaatttgtaacagacaaaaaggcggacaactgcactttcgcagttatccgcttaacgttttttctaattaacttcgaagttgatattcgaaccagagacgatcctcatatggtttgagttttttctcaagctctactcgaacatgattaactcgtaaatctgcagctaaaataaccccgcaaataaccagcatgaccaactcgatcacaacgagtccccaattttgtttggccgtgatcacaagccactgttgaagaccgagtaccaagatcatcatgacatttttatttgccaaccagaaccaacgattaatcgacacaagttttttggaaataaacgcttgggtttgttcagacatatgtaccgggtccttgattgcgatttttaatcgaccggcatcgtttctcaataattttgaaacatattcggatgacttcccctgcattttcatggaaaagaaatcgccaacccacaatgcaattaacaagtatagcaacaggaaatctgtaatcttcaaaaatagtgtcatatgtatatgcctccagtttctttctcaatcaattgctctcttaaatcaactgatgaatcccacatgtaaaataagtaaatttcaacctaagataatcaacttatgaaaatatgctatttaactttcataggatcaattggcttaatacttgatttggaaacgattatacaatcattttccaagaccggctatagcttttgaacccttttttcaggtaacgttttcatgaaaacgacaccattcggataaggattgtttttacttaagttgttaagaaagattaaagattctgctttttcaggtataaaaagttgagattcacgcaataagttcttttgcgcaaatctcaacttatttttgatgatcttaattttttcaaaacagccacactaatctatcggtgcaatccgcttaccccgatcttttcgataagcaatcaagacgactccgagattaatcagtacaagcaaggttgtcattaagaagacgtatcgataatccaatattcccgcaacacctgatgccatcattggtccgataaccgctcccactgcttgggccgattgattataactaaaaattcgactaacagaactggcaggtgtttccaatgtcatcacagtttgtgtaatcggcatcaacgctgcattggcaattccgattaagaaccgtaaaattcccaacattagcacagttgtcacaaacgtcatcgggaaaaagacgactgctgaaaaaatgagcccagcaagcaggattttctcgggaccgatatgatcaccgagtttcccaagggttggtgccgtcaaaattgtggcgatccccggaagggccgcaacaacaccactgataaacgccacgtttccatgaccatgcatcaattccctaacaaacagactaataatcggattaatcgacatggttgcagccataatcagcattgaggaaacgatcattgcggaaacaacccactttttctgtataccggcaaaagcatccttgatccccagtttggcactttttttgaccggtttgaaatcttccttaacgaacagccatgttgaaacagcagccaaaaacatcataaaaccgaaaatatagaaaggtaatcgatagccaaacacgccggataggtaaccgccgataatcgggccgatcaaattaccaccaacgtttccggtcgtcagcgttcccattgtatgcccactttcttcctgaggtacctcactggccatcagggcataggcattattgatgtatccggaaaaagttccctggataaaccgaattaatattaatgtccaaacatttggagccaacccacagagtgtggcactgatggtcatcccaatcgatgctcgcagcagcattggcttgcgtccggtccgatcagccaagttcccccacattggtgagacaattgcttggcttaagaacacactcgaaaaggccagccctgaatataacgttaattcccattttggaaaattaccgaattctgaaatgaacagcggtaaaaatggtaacgccatactggctccagcaccggtcgcaaagttgccgaaccaaagtgcccataaatttttcttccattgtggtgtttttgattttgccataattttttatcaagatcctaactattatcgtattcgaattaattgcacaagaaatattatagcgagaatagttgtatgttgcaattttaattttagagtgtgcgcagcaaagcggttaatgttcggagtgtaagacgttcattttggaaatcccggttttggattttcgaaatgaatctcttacatgcagaacattgctttgaggagcagtcctaatttagtgtgcgcagcaaagcggttagcacccggagtataagacgtcgatttgggaaatcctgggcttggatttttcaaatcgatctcttataaggagcggtgctgctttgaggagcagtcctaatctagtgtgcggagccaacctggggataaaccggagtgtaagatgtttatacaaaaaataaccgtcccaaaatgctaacggttacttcagtagatttactatttatttttcttgattttctcgtcgataatcaactaattcatgcgtcatttctttagtacttggataaatctttttataaatctcatgcaatttttgatacttcttcacatttgccggctcgggcaagaaaacatctttaaattggacaaaaactttagtgcactcggaaacgctcttgaaccagcctaagccaacggctgccaacattgaagcaccaagaccgggtccctgctcattcttcaaagaaacaacccgagtgttaaaaatgttagcttgaatctgttgccaaagtggactttttgcaccaccaccaatggaaacaaccgtatcaaactgactgcccttagcttcatattcgtccattaaatctctgaacgagaaaatgatgccttccaagaccgctcgaacaaaatcatatcgcttatgaataccatcaatgccaataaagcttccccgaatatcggcatctgcatacggcgcccgctcaccaacgatgtaaggtgcaaataatagtccatttgcgccaacggttgatttagcagcactttcaacaactgacgtaaaatcctcgtcagctgcaaacgtctttttgaaccaacttaatgaaaaaccggcagcaagtgtcacgcccatcgagtaaaaagcatccggaatggcgtgatcctcatattgcaaaacaccattatagttggtctccttatttggttcatattttaaaatcacgccggatgtcccaatactggataacactttggttggactatcaataccggcaccaacggcaccacaggcattatcggcaccaccaccgaaagttttggtatctgtagacagtccggaatattcagcataccaatcatcaatgttccctgtatcatcaattgaacgaaccaatgatgggcacaggctcattggaatatcaaaggcatcaaggatttcctgactccactgctgtttttcaacgtccaacatcactgttcccgttgcatcagaataatcaatggctaagttcccggtcattcgaaaacgtacatagtccttgggaagcaacatcgtttttgcttttgcaaaaatttccggttgattttcctttacccataatagctttggcaaggtgaatccttccaatggttgattatgggtaatttcgataaagcgatcacccatttttgccatgatttcttcacgctgcttggtagaacgggtatcattccaaagcattgccggtcgcaaaacttggttgtctttatccaaaagaaccaatccgtgcatttggccagaataactaatccctttgatttcttcaggttttaatttatcagttaaaataagtcgaacaatcgctaccgtcgttgcactcacccaatcttcgggatcctgttctgcatatcccggcttcggttggcgcaatgggaaatccatcccttcctgagcgatgatgtcaccatctttggtaacagcggagaccttaaccgcactggttcccaggtcaacgcctaagacgcactcggtcataataactcctcctcttcttcgaaaaaaggaatggaaggtgagttccattcctctttattatatgttatctatcttgcaatttgtttctctgggggtaacaattaatgtttcatttaaaattatttagcggtgctaaccgctttgttccgcacacttctttaggactgcttctcaaagcaatgttctgcatgtaaggattcatttcaaaaatccaaaaccgggatttccaaaatgaacgccttacactccgaacattaaccgctttgttccgcacacttctttaggactgctcctcaaagcagcatcactcctcataagggatcaaattgaaaaatccaaggtcgggatttcccaatttgacgccttatgctccggatgctaaccgctttgttccgcacactattttagtgtttgaataatataatggttgattgtgtccttaatctcttcaagatgatcggaatgagttgcgtcacgcaattgtttttgtgtcttgtcgagtgagtagtcttcaagttctttcatagttgctttgccactttcaacttcggcaccgatacctgaatcaaatgaactgtaacggttcttaacgatattatcaagaacgccatcttccttcatagcaacggcaactcttaagccggcagcaaagctatccataccaacaatgtggccatagaacaaatcatttggttcaaatgatgaacgacgtggtttggcatcaaagtttaaaccaccacgcgggccgatgctaccattctcaacaacttctgtcatagcagcagttgtttcataaagatttgaaggatattcatcaatgtcccatccgattaacttgtcaccttggttggcgtccaatgatccaagcaaacctgcttcacgagcaacacggatttcatgttgataagtatgaccggccaagttggcatggttaccttccaagttgagcttgaaatctttatccaatccgtattctttcatgaaggcaattgtggttgcggcatcgaagtcgtattggtgagtcgttggttcctttggctttggttcaagaagcatttgagcatcgaaaccaatttcattagcataatctttggccatatggaatagtttggcagcatgttcctgttcacgcttcatatcggtgttccagagtgattcgtaaccttcacgaccgccccagaaaacatagttctcagaaccaacccgcttaccaatttccagactgtgctttaattgagcagctgagtaggcaaagatatcagcgtatggagaagttccggcaccttctacgaatcgaggattggtgaataaattcgatgtattccaaagaactttcatgccggaagtcttttgataatcaacgattttatcaacaactttatctaaattcttgttggtttcacgaagcgtgtcgccttctggtgcaaggtcacgatcatggaagcaaagaaaatcaacacctaatttatcataaaattcaaatgcggcatcaatcttagctaaagccaaatccattggatcagtatacttgtcataaggacgaatagcagttccatcaccaaacgggtcaaccaaacgttggtcgaatgtgtgccagtatgcaacggcaaaacgtaaccagtcacgcattttcttgccgccgatcatttcatctggattataatactgaaaacccaaaccagattttttatctttggtaccaacatacttgattttatcaacattccaataagccataaagaagtcctccaattttgttcatctttaattagttcgttcacacaaccaacttacaaatcatattatagaaaatagtcagcaaaattgcaagccctttcatgaacttttttatttaatttgccttaaagccttttatctcaactcgtcaaagtaccgattagaatgatagtataaggaaagaatctccacttaacttaagaaaagagacacaattcaatggataaacttgatcgaaaaattcttaatatcgtccagcaggatggccgggtctcaataaaaagcattgctgaaaaatgttttatctctgccccttccgcttctgttcgactgcaaaatttagaaaaccacggttttatcaccggctacaccgccaccgttaactacgaaaagttgggctatttaataaaagctttcgttcgaattgatgtaagttataaggaactgcccaaattcgttaagttcatttcaaaagttcccaacgttgtggaatgtaactttatcaccggggacgcatccgttcagttaaaggtcttttataaaacaatgatcgagcttaatcgattcaacgcatcattaaaagaattcggtaatacccatactaacgtggcctttacaacaaatatcggaccacgacccttgaaattacccgaaaaaaagtcggattagataccatttacactccgaacattagacgctttgttccgcacactagactaggactgctcctcaaagcagcattctgcatgtaagggattcatttcaaaaatccaaaatcaggatttctaaaatgaacgccttacactccgaatactaaccgctttgttccgcacacttattaggactgctcctcaaagcagcaccactccatataagagatcgatttgaaaaatccaaacccaggatttcccaaattgacgtcttatactctgggtactaaccgctttgatccgcacacttatttttcattttcataggcaggcttccctatttgcctttttttcattaaaaattttctcaatttacaaaatcatgtaaaaagattccttgaaaacagccgtttttcgacgctgtcatgttaggataatgccagattaattagagggcctctaatttaaaattatcattttccatcactttcaaggaggaatctatgcatgcaaaaatcgcatattactgaaaatgccgatgggacgaaacgctctctaagcaaccgcaacgtacaaatgattgccatcggcgggacaatcggaacaggattatttttaggatccgggacaaccattagtaaaaccgggccatcaattctattagtttatttagttttaggaatctttttcttcttaatgatgcgggctatcggagaaatgctttactccgatccctcccaacatactttcgtatcatttattactcgctatttaggtccgacagtgggccattttaccggctggacatactggttgggacttactttctgtggcatggccgagctgtcagctatttcgacttatactcaattctggtttccgaatattccggcttggcttattcaagtcgtcttcctgggtgttttggtctcagttaatttaattgcagccaaaatctttggtgaagcggaattctggttcgcactaatcaaaatcatcgccattcttgctttgattgtaactggtattttcatgatgaccagccattcgctgacaccacttggacatgcatccgttcaaaatcttttccatcatttcagtatgttcccacacggtggactaagcttcatttcagcattcccaatggctttctttgcctttcaggggattgaatttgtcagcattaccattggtgaagcaaagacccctcatcggattatcaaaaaagcggttaatgaaaccctactcaaaattttgattttctactttggtgccatgattgtgatcatggggattattccttggacacatttaacacctcaaagcagtccttttgttcaagtctttaaattggctggattacctgctgcggcagccttcattaactttgtggttctaacgtcagcctcctcatcactcaatagttttattttctctgccggtcgtcatttttaccaactggcaaccgaattaccaaaagaaagttggatgcatcaacactttgcaaagatttccaaaagcggtgttcctgcagcggctattaagatctccgcattattactgctggtgacgcctttattaagtttgaccagcgctaccggggccgtctttacgatcgtggccggttcttcaaacgatatgtacattattgtttatgcattagtcatgattgcacaccgaaaatatcgggaatccagcgacttcttggcggatggctttaagatgccttggtatcaatttaccagtcccctcacgatcgctttctttgccattatctttatgaccttattcttcattccacaagatatcatcggagcacttggtgcaattgcctggaccgttatttttggtggcattacttatttacatcaacgaagtatggtttctgcaaacgccgacaactaatttaacagcttacttggttcaaaaagggaccacaaaccgacctttctatcgtttggttgcttgtggtccctttttgtgtcctgattgacaatttttttcaagaaaaagttccccaatctcaatcgttttatgctaatctgtaaaaggtgcgcttttatacgtcaatcattaccatcactaacaagggggaactaccgtgactaaattcaaaatacaatcaatcgtctttgtgctcgttgctttcatgttgggatgtaacgaattcattgttgtcggcatattatcggatctatcaaagcaatttcaagtcccaatctcaattatgggttacctggttacaatctttgcgacagtttatgcggtcagtaccccttttgttacggttcttaccagtcgattcagtcggtataaaacactattatcattaatgattgtctttctgattggcaacacgcttagcggcttatcgaccagctatctgtttatggttgtttcgcgaatcatcaccgcaacaactgccgggtcaatcatttcattggtaatgacatttgccagcaccattgcgccaagaaacaaacgagccagtttggtttcctggattttcgccggttttagcatcgcttccgttttcggggtaccgattggagtagctatcagtaccagttacaattggcgttatacgttcttcagtatttcagttatcactattttgacatttattctattaatttttatattacccaggaaagttaaacaaacgcagagctccattaaaaatcaactgacactgcttcttgaccctagaatctatatcggcattgtgttggtcttgttcaccgctgcgacaatgtatgcttattacacttacattcgtccgctgctgacaacctcgatgggcttcagcatcaccagtttgaattggctgttattcatcattggtatcatgagcatcttaagtaaccgcttgtcgggagcaatcgctgaaaagcccaatccactcaggaccatgccaaagttttacgtggctgatattatcttattattgctgatgccctttggattgaagaataaaatcacgggaatggcgattattttgatattaacgttgattgtcacggttttgaactctccaattcagctgcattttttaaatattgccgaatcggattacccacaatcattagtattagcgtcatccctcagctcaatcttcttcaacttcggtatttcactgggatcagcaactgcttcatcaatggttggcattgtcggcttggataaaatcagtgtgggcgctgcagtatacgcagcaatctctctgttatttgtttatctgcttaataaagcaatcaagactaagcaaaaatcagcaactcagttgtctaaataatcaaacgcagctctggatatcctcattacgaagatgtccagagctgtgtttgtataataacgtctctttatccaacactattttatatagttaatattttaatttatatataacccaaccttgtcaataggcagttttctctttagccgcgcttataatattttttataaaattaataaaaaaagcccatgctatcatgatgccaataactcaattggaggacatcatcatgcgtaaacgaactggcattttagcaatcatgatctttaccggctgcctattagccggtacaagcaaactttctgtcacccaaacggctgctgcaaaccagccgaccatttataccgccttacccaagcctagtgacacttactatcgaccgtttaataaagcgttacgacatttcgacagtcaactggccaaacaggatccaaataacgtcctcaccattaccaagcaaccattagcccatcgaaccagcaatttcacctatgatgacatttggctccgggatgtggcaccggtaatcacgactaaaatggtcaaattccgttacagtccaaattatctaaaaaaggcagatcgtcattatttagaccaacgatttcgtacgtggctcaaccgggaaaaattcaattatcaaaccagtgacttggtccttgacggtggcaatttgatttggaataacagtgataccgttatcttaaccacccacgttttcacggacaatcccaattggtcccgcactgaaattattaaggagctaaagacaaaattagccgttaaccatgtcatttttatccccaccgaacccggagacgtgttggggcatgccgatgggatggttaaatttatcactgcccggaaactatatattagcgatttctctgggaatcaaaaattagttaaaaagatcgagcagctaattagaaaacaacttcccagtgcgaaatttgttctcctaccttctgcctatacatcaaaggggcagtatgataccaaaattgcttcggctaaaggcctatacgtcaacatgttggaaacaccgaagaccatttacgtcccacattatggtcttaaaacggatgctaaagtcctaaagatcattaaacaacagacgactaaaaaagtcgtgcccattgatgtagctcaaatttcaactactggcggttctgtacactgcctgacttgggatgtcccagcaaagtttaagcctgacaaaagctgatgtttaactctcgtgacactgatttggataccatcaaaacctaaacaaacactttgaatttgaccatggggattgccagagctgttttaaaagtaagtcattggtagtagtatattagaagtatcttactttctgaaaggatgtgtgcttctaccttgatattgacatttatctttttaatcattgccggatttgcggctggcctgttagcctcggtagccggactcgcttcgctggtttcctatcctgcccttttagccgttggcctgccaccggttatcgcaaacgtcactaatacgactgcactgatcttttccggaattggtgcaactgcttcctcgcttaaagaacttcgcggtcattggaaaaaactatcaatttttattgtgttatctttaatcggtagtattggtggtagtatcctgctgttagttgcacccgcttcttcgtttgagaaagttgtccccttcttcattctgtttgccggtattttactatttctttcaggtcggaaaaaggacgtttctacttcaaaactaaaagaagcccattcctcccctgaaaagaagtggtgggtgtcactgattagtttaattggtattatcctggtcggtgcctacacgggatatttcggtgctgccggcggcgttatttttcttgccattctctcggtcattaccgatgatcgttttgccgttgttaacgccatgaaaaacgtgattgcctttgccggtaatctgattgcgaccatcattttcatcttcaagtcgcatattgattggctgcttgttattcctttaggctttggccttctcattggtggctacacgggtccgattattgttcgccacgcaaacattcacctattgagggccttaatttccattgctgctttcgggttggccgcctacttgttcgtaacagcctacttctaatggtgagagctcgccatcatttttataaacacttgaagaactccttcctgatgttacataaaaagtcccaagaaaatcgattagaacgattctcttgggactttaccattattaaatccatctaccagcttaactttccaacacgggttgtgcgcaccctcttgccatttttagaaaaaccggctgataaagtggtcattctcgaatggggttaaggcagcggaccactttaatttaaaaagtcaactaccaaatcttaatgtgattttcaccactatttaatgactggattggccctgtgagaacatgatcatcggcaacacgacccagcagatccgtatttatctttaatggtgatccatccggctgctcaaagtcggcatccacaagcctgacatgtggtaatgtatcagttactttagccggtactttaaaaacggtgtaggcttcaggaagattaatcgttaaataaagcgaccgtccacgctcctcaatagcaaatttcgagtcaaacgatggatcggataatttatttgcctcatcagcgtaattttttgcaccgttaaaatatgcattgttattaatataaaccggtgtcttctttgcttcatacccctcaagatcggttggtgcctgagtttgaacgtcatcaatataggcctgtaatgattgtggatgaccatcatacatatctgtcccacagtgtttagccttttcgcgagagataaaaatattgttgaaatagcgatcatcgccaccgtaaaccggtgtcatccctttaatagtcgtactgtgcggtaaatgatacggcgttgaccgatttcgaacatcatcaaccagcatatctcctgcaataatgttattcacataggctccgccgtccgagagatgtctcaacgcatacttggaagcaaaaatattattttcaattaagaatggcccatgagaaacttccacgaagaaatccataccattatgataataaatattttggcggacccgggtgccctgtgcctgccaatccaaccaggttccgagtgaacaccggtaaattcgattatgacgaatttgagtatcaatagctgcatgcagtttgatgccggcaatctcccatccttcaaactcgtgtcgcgtggcaatgtcatgaatgtcattatcataaatctgactgaaagcacagcccatatgacccacaataccggtttgaccacaattataaatatggtttctacgaataatgtggctgccgacattgtctttagaccagccgttatgttctccagcaaaaaccgtctcaatttgataggtgtatccgggcttatcaaagcggcgatagtaataactgtcccccgttgataattccttgcccaagctaataccactgcattttgagtcatggatcacgttatcttcaatgatccagcctttactccaatgagggccgattagtccctgctgctcaccagttggtggtgcccattgcgtagccgtttgagccatttcaaaatttcgaacggtgatgtagttgatgcctgtcctttccgggaaaaagcaacatggtcgaacattaatttcagtcaaggcagtattaggatcgattccttgaaaattggcataaatgaccgttcgattttcttgtacgtctgcataccacaagtattttgtatcatcggaataaaaatccggtaattgttcatgcgtaaagaagttttcaactgtttgacgttgttttggatgttcaagcgcctcacgtgaatgggcttcaaacattgctttaccgtcgatataaaccgctccaaggtggttggtatgatctattgacgttagccagtctccccaaacagcttttgcaaatggattgaagtcaccaaatagttgattgtcaacactggtcttccagatatgatcaccaacttcttcccaatgttcaataacttcggagcccttgataacaacgtgttcattttcggctgcttgataaacaattcgtctccggctgctgagtcccggattgagaggtttgacccattcacgataaacaccttcatgaactgtcactgtatcccccgcaattgcaacatcagccgctttttgaatggttaaaaacggactatctttgtgaccatcgttttgatcgctaccgttttttgaaacataataggttgtcataaaaataattatcctttccatggtttcaacgtaaaagcatatgctaaatagtgttaaacgcttacaataatacataaaaaacaatacccaatctagattacaaccactattttataggtaatctgtttgcgttgatagctagttataagcttgcatcggacattatttgtcataaaggtcaaaaaagtcgtgacagtttacaatcacgacttttgcgacatttattattggatattcttaacaaacagtttgctaccggttacatagtgtccatttgtcaattgaagcctagttgtcaatttaaagtgaacaatcttttttactgcaatatcggtccccttgtgaaggtaacagacccgatttccctttgaaaaagcaatttttttgtactcgtataaaccgtgtttattaatcactttggcttgattctttttctttgtcaaatataatttatcaacaaacttatcattagatgttatatagcgaccattactcaatttataacgattcagcccagaagcagactttttaacgcctattactttgaatgacgcgtgttttaacactttactctttcgacttttttttgaaaatgtcgtgctgttatattcataaataagatgttttgcataacccgtaaaagcactgaattttgactttttactgacacttgcttttttcgtggttggcctgctacttgaagactgacttgttgtgacaggctcggaacctgtagtcccatcagccgagttcgaagatgagtttgaattagttgtctgtgcgggatcagtattattaggtactgccgtacttgttgtactacttgtacctgtgcctgtacttgtgcctgtattcgtatccgtgaccggatcagaacttttcaatgccacatccaaatagtccaaatccaaggtcgaacccgatggatcagtaactgtcacttcatttttcccagcatgcagatataattgagtctgctttatactaccatctgagaaccaaaggagaaacttgtgacttgtactattatgagcgccacttgggtaactggaattattcgtaaatactaacgtctgctgtgccaaactatcatcaagattatccccggagacagctgacgttttgccgtcattagcgacatagtattcttttccatctgctaactgtgctttcacgtaaaccggactactaacatcagaattggaaccgtagtgaattaagacatcataaggaccggtttgaggaacgttaaccgtctcagttaaggttggattggtttggcttaatctgacaaaacgagttcctgaaacatcttcatttccccgccaattcctttctgcatcagttccctgtgcagcatacttactactatccaacgattcagcttcatatcgcttatattttgtgctatccagtcgaaatgccggtaacaggctatctgggaaaccatcaccatcgtgatctgtatagcctttagtataacgtggcataaaaagagccgttcctacttttccgagtggctgttggctaaggctgctgccatcatccgttaaataaagcccactcgctttattctgaaaggtatcatatatcgcagtagaaatatgattagacaagtcaggattagtttcattatcagccttattaattgcccacagttgactttggcttgatgcattttcatcttccgtgatcacattgtatcctgcgttgttattagctacagataaatatttaccggtcaagtcatttaagattcgataataatgattaccatcctgatcacctgcataaatgaatgtccaccattgattagcagtttcctcatcttcacctctgtaaacaacatcttgggcagtagcaccattatcagctgttgtcgaatcatattttccggttgtgtcaaattgacgatccctggtttcaaccagttgatcatccatataaccgtcattacccgtcccacgactaatcagcttataactataagctggtaagataccatcacttgtatcataaacaactgcagttccattattaacttgattaaaagaaacatcactaacaccaatattatattgagcattatatccggaaatcttctccaactcaccaattttaatcgtccccgaaaaccaaataaagcggtcattatacccaattccgggggtgtcgtcactttggttgtatgatgactctgaaaaatactgatacccttcacctactgattgaactttagtatcctttgtctgcgcactaatttccggcattgaaattttcccaatgccataccagaattccagttctgtccgaattctcaaatatccggtcccggttatttcaatattatcgccccggtgcatcagatcacccaaagtacctgcaacatatccatttttataaggtgtaaacgaaccaccaacaactttcatgccactttcttgtcgttgtttcagtgtcggtttagataacacttgaatggtcgatccggtttgctcctgtaatccttctgcatctgcaatcggattagcaaccgaaagtgtaataaagatagaaaacaaaaatgccaagcttattagtaataattttttcatttttccaatcctctacatttaaaataaatactttatttaacttttgaaactacctttaaaatagatttcatctttaatttgctgaacttcgtgtaaatagcagggtccctgctgccggataatctggagaagtcccttccggcatccgggcctcataagcttgtgtaagcggtctatatttatcatcattcatgttcactttttgatcatacttataataattatataaaatcccaaggaaaggatcgatacgcccacgtccagccaacacaatggtgccaattaataaagccaacctcttaacccaacccatatataaaacacgctcccatttatattatcgatataattgtagattgatagttttaatcctgcttaattataatataaacacgccataaagtcttcactcaatccactcaattgacgttgttaatgtgcttcgatgtggtaattcattgaaatcatataaatccacacaaacaattgccgatgaatcctgatttccaggacgattgaccgtaatcgacgtgattcgctcctgatccgcaatctttacaaatccagtatagtcaccggcacgtgggatcttaaattgatggtcaaaaagattaataatccaacgcccgttgatttgggctctgatcagttcaccctttgtttcatagcgatgtcccagtaaattgtttgcgcccataatatcgcctgctttaatcatttcatctatttttttcaaatccattttgcttctcctctttcattgctttataaacgattatgtatggaaaggattctaactgctaattggcagctagaatccctccaggtactttatttatcacttgtgttcaattaaaactgtgctttaacatattggcgactgccagtaatataataaccatttgttaattggtactttgtcgtgcttcccgacttaacaatctttttggttttaacgatagtcccttttttcaaatgcttaactgcattcttctttgtggctttagtcgttttataggtccatgtccctttagcattaataactttcaatgccttaacgttcttggtcaagtataacttaaccgtataaccggctttagcagtcacatagctgccatcacttaattggtatcttaaagcaccattagccgacttggccgttccaacaaccttaaacaccggtgctttggtaattgacttcttcgcataccctttaattcggttggctttgctaaaagtcgtactgttatatcgatacaaagctttctttgcgatgattttgaacggtgtcactttcttagtcgttgaagcttccggagtagtggtactggatgagctttcagtcacgttgcttgaactcgaagcttcagttgatgaagaggatgagcttgtgaccgctgaacttgatgaactcgaactgctgcttgacgctggtggcgtaacagttgaaccactgccactattactggtggtataggtcactgtaatttcaattggatcggcaccaaaattacctgctaaattattttgaccctgagtcacaccttttaattgataaccggtaattgatgacttggtcttatcagtgacatcatacttggtaccaaccgttccgactgttgttgtatcatcgggcttaatttgtttaccgttttcatctacataatgaatgacaaccttgccttgctgaacagtgtcactggcatctagggtttcaaccttaattgcatttggtgtattccctgttccaccaccgtttgcaactaaaagcatgccatttgcgagtggtaacaactgacgattataggcttgacctgatttaggcgtaaacgttgcatctggatgataagtccctcttaataggctggttttatctttaaaaataaagacttttccgccattaccgttgttgttgaaagctaattcaccattattaagagtcgtaatatatggtgcgccacttggtgcaattgttgtgccgggatcagcctgatcaaaattcaaaggatccttactgaacttggcacctgatgatccgccaccgaattgttcataggtcatcacccattcgccattgctcatttgagtcacaatcggcattcccggacgttgatctttattagtcaacttagttggattggcatcaaatacaattggactccaagttttaccatcagtggtcgtttggtggacaattgcctgggacttggctggaagtccggagctgtcacgttcatctgaatagtagcaaactaatttgttgtcatagaccatgaggtagggttcccaaaccggatcaccgtacagaaagttaccaccagattgagcaattgtactttcatatgtccaggtttttccaccatcggtactcttatcgagctccaaatcagttgcacttctgtcattaggtgttgcatcaccggcgacgacaatagttcctttggtcatatcaccgattgtctgtggtaattcatataactggggacaattcagcttaccccaatccttattgtttgtctcagtaacttgaccaacctgtttccaagttgcaccattatcatcactttcataaatcggaaatacgggatgtcccgtttctccggctttatttgtaattacctgttcaaaggtcattaataatttgccattatccgcagaattggcttgatgttttaactgaatgactcttggtgaaagagcgccataattcttaccattcaagaaaccacttccgtcgtttttcgcctgatatacggtaaccggatcaattgccgccggctttgtatctgctttacttgtgaccgagaaagtaaataacagggtaacggctgctaccgccgttccaagaatatgtgatattttaaccatgaagatactcctctcaatttaacaatcccaatttcttaaaaactaaccctacaaaattcaaaaaagcaaatgattccgctttcattttgatataaaaaacaatgggaaaaagcgtctatcaaacgtttcccccatcgttttttagtccctcaattattcaaatctaatcaaagacaaatgtgctaaatgagtgttctttcaagctggccttatatgtctggccctttacatcaatcgtaatatcgcgatcatgattcatactgttggacatgaccacaacaatactgccatcaggattctcatatgcagttgcttcaccggcagcgtgaccaccgtatgatagcaagtgggcaccgtgttgaatgtagtgagcataatgacgcatgacataatattccggatttttggttgcttcgcctttgtcagcatcgactgaaatcatgctgttttgcagccagccccaagtacttgaaccaccttgtaggacagagttccagtacatataaccgttgacaccgttactgatatagtgtcggaacaggttaaagacgtactcaccataagtccaagtattatctccgttaccacattcactttcggattgaagatatcccagttctgggaaagattgaaccgttcgctgcagaactgatttaccagcccattgataggtcacacctttaacatacttgtatgcttccggatctgaaaggaccgtttcggtaatcactggataatcagtggtttcgtcctttgtcatttcagtgtcttcaagtggtgagttaatagttcccaaccaaatcttggtatcttttaaatcagacttttcaacagttgggccaagatagttcttgataaagtcacgaagttcttcacctgtccaataacatgaagggaatttctgatcacgttgtggttcgttttgtgggaagatccagctaatgtggacgccctcttcttcgtatgcttcacagaatttaacgaagtagtcagcatatgcctgttgaacctttggatcatgctttaagattccgtaattgtagaccggatgactcttcatccatgttggtggtgaccaaggcgaaattgaaaagacaatgtctggattacgcttttgagctgctttaacatatggcaacaagtatttcttgtcacgttcaattgaaaagtctgccaaatcataatcatcaggtgtttcatcggcactataccagttcaatgcatagtcactggcaccaacaggaattctgcagatgttgtagttcatgcctttcggtgtaaataaatcatctaaaatttcattacgtttttcttcagaaagattgtttaaagcaactgtccccagttcattaaatgtttgaccgaatccccaaatttcttggcgtttttcggtaccaacttcaaggttgttatgcagcttcttgtctgtcgtacttaaagtcgtttctttgagcttcgtatcttgagtactttcgatttgtgttgcactcataaatttttcacctctggtttatttttgccttcacattttagttaatgttaattctcgtggcagcgaaggcatgacagccaacaagaatgattgaaacccgttaaattagtcttcagctttctcttgttgattttgaacatcacgatgttcgttaacaaagagaatcaagacaccaccgacaagggcaaggccggcacaaaccgggaaaattccgaagtaactaccatgagcagcagtaacaatggcagcagcaacaattggtcctaaaatttgtgaaccggtgttggctaagttcagaatccccaaatccttggcagctgtttgtgggttaggcaatacttcaaggttaagcgcctgatcaacagcgaagaagattcccattcccaatccggctaataatccataaacaagcattgaccatgatgcgtttgtaaatgcagggaagataacgccgacagcaactaataatgccgcaataaataccggcaccttacgactgtgcatcttatccgaaacaggacctgcagagattgacatgacaatcgcagttaccatcaagatcattgaaatgatcgatacatacttttgttgacctgctgtattcaagttaatgtagtcactcaaaatgtataactggtaacccataattgctgtagtagcagtgttaatcatcatcttaccgaagagagcaaggtagaaatccttagcattgtgcaatgggaaaataaagttttgcaggaacatattgaaagtaaagctcttcttaggcatgcccttactggaaggttcacgcacaatcattgcagcaaccggtcctgaaagtaatgttaggaagcccattaccaggatacctgttccaacatgacccaagaactgtgcaccaacaacctgaccaccatactgaccgataacataaccgaaagcatagattgaagaaattgtcccacgatgttgaggagcaacttggtcttgcaggaaggccaataatggcgccacaatcgcgttcaggaatatctgataacaactccacgatatgaccatcattggaaccgagccggacatgttaaaccaagctaaagtaattaaactaccaacagatccgataatgatccaaggtgtacgacgtccccatctggaacgggttaaatctgagaaaccaccaataacaatgtttgccaatgttgcaacgatcattgcggccgaagcaagtaaggcaacaacttgagccttctgtgaaggaatgatttgctcaacttttgcgggaagtaaaaccgcgttaacacccaagtaggggcctaaccaaagtaaagctccgattcctgtagcaataccaattttgattggcgcctttggctgttcactgtctaaaacagtgtcatgccataccggcgtactttttgaattttgtgccatattttccaccttttcttgtattaaactgattaattcacatctcattagtcgctaggttctaaattttctaatatatcagttagtttgttgtgtaatcaaactattgtcttgaaaaagaaacagatttgacaatttaccgttaaatttgaaaatggttggtgccgggctttaatccagcgaaaggtcccatcgctccggtatcattaaacggattgccaaagtaatcattgttgaattggagcggtttgctgtcagcgctttcaaatttagcatcaacaattctcagctttcccagttggtctgctgatatcggctgtgcttttgcgcttgcaagattactcggcatttcaaacgtcattgaaaccgaatcttcattttgcttaatttcaaaatgagtattaagctccgcattttccacaaatgatttctcttttgaaaatcgtttagccccctgcaggtacacgttatgatcgatgtaagttggttgtcgaacggtctcaaataactcgacatcgcccggcattcgtttttcgatttgagaaatataatcacgcatcgtcgttggactaccattgtaaagactcgttccactaaccaggctttcgtcttttggtttgataaagatgttattgtagtaacgatcatctccaccataaaccattgcataccccttaatcgccgtactatgtggcagatgatacggggttgcccggttcaaaacactttgaatcgtattttgacccgcaatcaggttgttaataaaggccgttccctgagcatattcatcaatcgcccgtttggaagcaaatacattgttaacgaccaacaatggtccgtgacacatttcaatcagtaaatcccgtaagttgtgatgatataggtttcgatcaattttggtaccctgggcttcccaatcgagccaggtgcccaaaatacagtggtcaattttgttctgagaaatctcggtatcaatgggtgcatgaaatttaatagctgcaatttcccagccaccaaactcatatttggttccgatttcaaaaatacgattatcaacaatccggctgaagatacaccccatgttaccaacaatggcgcattggccacaattataaattgtattatgaacaatctcatgtgcaccaacagtgtcagctgcccagccatgtcttgaagcattaaaaatccgctccaattgatattgataacctggtttatcatgacgctgattatacgcgttgtcgtctcccagtttggggcagccaatactgattgcacaacatttggcatcgtgtaactcattatctttaatttgccatccctttgcccaatgaggtcccaccataccaatttgctcggtagtcggtggtgcccaaggcgttgcggcttggcaaatttcaaatccggaaagcgtcacataatcaatacccgtgtggcgtggataaaagcaacattttctaacgctaatttcaactaatgcctgcttgggatcaagctcatgaaagtttgcataaatggttgtcgtctgatcggatacctccgcaaaccaacgatatttggttcgggctgcatgtcgatcggctgaccgaatgccggtgacatagtctgtcactgtctttcgttcatcggcagtcgccattttttcataactatgagcttcataaaatgaatgatgattaacatataaatcgccagcatgacagtcattaccctgttccaaccagtcgccgtccaatttaacagcgaacggattgtagtcgccaaagagcttgttatcaacaaccgttttccaaattccctttgtaaccggctgccaatctttcacaacttcggacccttttagaacaacatggtcaccggcaaccgcttgataagtaatccgctgccgatcatttaaaccggcattttttggatcaacccattcacgatataccccttgatgaaccataacagtatctccgggcagggcaatttgagctgcatgattaatggttaaaaatggctgattctctgtcccaacattgtcatcagttccgttcttagcaacgtgataaattgccatcgctcactccttcttccacaaaattttaaagcgctttctaaaatgtgggtaaccatcgattcgatcaaatctgtgataattgtatccgagaaaacgctttaaagaaaggttgatttttgttattatttagacaataattgtcatcgtgaattggaggtataaaaaacatggtcctttttcaacactttggccttgaagcaaagccgatatttaagcattttgatttaagtgacttcaactatccgccacacttacatcgagcctttgagataatatttgttaagcgtgggcagctccacgtccaaatcgaaaagcaaacctacagtgttaataaacaacagtttgctgtggttttccccaaccaaattcatggctttaatatgctccctaactcaacggcaacaattgtccttttttcaccagaaattattggcgcttttaacgaacaatatcatgatctggtaccggaaaatccggtgatttttgataaccatcccttggactttgacggtgcgaccaatatctttgccattaagggactgctgtacaccctgtgcagcaagattgtcgaacaaacaaccttcatcccccaaaagacatctgaaaagttaagtattgtccacgaaatcattgactatattaataatcattacacacacgaatgtactttacaacttgcttcaacagctattggatatgactacgtttacttgtcaaagctgttccaaaaaacgatggatatatcattcaccaagtatctcaatcgatttcgaatctcaaaagcaagacaacttttaaaaaacactgatgagccgattacgcaaattgctttcaacgtgggctacgcaaatctccggacttttaaccgtaattttaaattactgaatgaaatcagtcccgctgattaccgcaaaacagatcaaacaacaacgtatggaaaagccatccaggaaaattatatttccggataatatcaaaaccgttaaaaagcttaaaattaaaacaccgcctcgcaacaatcggatttgcggaggtggtgtttttgtctgattcttaaaatgatgtcagttttttgttttaaaaaagtttagtggataaccgaccagatccaaagcataatgggtaatcactgaacaggcgcctaacagtgttgccttatccgaatcggttagccgtactaattttatttcagaatgactcagctgttgaactttaatcaacacctggtcaaagatttccggtgccgcttccattagtggcgatccaagatagattgcaccggtgtcaaaatacatagacgagttataaatcaagctggagatttcttgaataaactcatcaatggctgccaccacgttctgattatgctcgcgatacatttcaacgactttatatcgattcaacccggtcaatcccaactcatcactaattctgttaatgatggcatcctctgaacaaatttgttcaatcggtgttaattgtccttgggcatttttggtcagtgttcgaccaacttcacctgcttgacctctaaaaccacggaacaaccggttattgataatcacgcccgacccaattcctttatgaatcccaatagcaaccaaatttttgctatcaaatttcatcataaaatcccgaacgtaaaccgccgtcaggttagactcgttttccaagactaccggaacatgatacttggcacttaaacgttcattgagattgacgtcttcaaaatctatgaagggtgaataggtgatttcctgctgttcgttcacgataccgtgaattgatagacaaatgcccaacaaccctttgactgaaacaaccgtatccacatattgatcgatttgatgttcaattatagcgacaatttcatgaatattttttcgataaatagtggtttcagcttgctcaatcacacttccatctaaataattagccataaaatgaagattgtgatacgagatatcaaagttgatggtaaacccatagtttgcatagattctgatattggtcggctttcttccgccaacatgtgatgccgcaccctcgccgacttcttcaactaattgttcttcttttagttcatcataaattgaagaaaccgttgacttatttaatcccaattgccgggaaattgccgctcgggtcgtatagtcattattaaagatttcttggaggaccagcttactattagctcttctcatcaaatctttattggttatcgttttcatttcagtgtccttctcacgttaatttcatatatcttagccttatcttatcagaggcatatcaataatcaaagattttcccaacatttactaaaaagtcttacccattacctgctatctttaagtttaactgattatttggtatgtcgctgagaatccggttgcgcaattatcatttatttaaaaaaatttgtttttcatttatcacgctcatcgctagaacggcctatcttctatttaaccatactattgaaaatctagccggataaatttgaaagcggttgcagataaaattcggaagtgctactatttagtcacgttaaaaagttcaagcaaccaacctacttacaattaatttgttgttttcagtttttaactaatgacgaggtgtgaatacatgcaaaacaatacggaatctgcgccaaagattcacaaggtttcttcagcgtttgtctatttctttggtgctttaggcggtttattatttggatacgataccggtgtcatctccggtgccattttatttattgagaaacaactccatttggattcttggcaacaaggctgggtggtgagtgccgttcttctgggtgccattttgggtgccgcggttatcgggccaatgtctgatcgctttggtcgacgaaagctcgttctgttatctgctattatcttctttattggtgcattgggatcagccttttcaccagaattttggaccttgattctttctcgtatcattttagggatggcagttggtgctgcctctgccttaattccaacttacttggctgaattgtcacccgctgataagcgtggctcaatgtccagtttgttccaattgatggtcatgacagggatttttattgcctacgtcactaactattcgttctcgggattctacaccggatggcgttggatgttgggatttgccgcaattccggctgctcttttgtttttcggcgccttggttctaccggaaagtccacgtttcttagttaaggaaaacaaagtttctgaagctaagcaaattttggaaattatgaacaagcacaacacaagtgtcgttgataaagaattatcagatattaaagaacaagctgccattaagagtggtggttggtccgagttgtttggcaaactggttcgaccggcattagtcattggtgttggtttggcaatcttccagcaagtcatgggttgtaatacggtgctttattacgcgccaactatttttaccgacgttggctttggcgtatccgccgcattaattgcccacatcggaatcggaatcttcaacgtgattgtcactgccgttgcggtcatgattatggacaagatcgaccgaaagaagatgctgattggcggcgccattggtatgggtgtgtccctgtttatcatgagtttcgcaatgaagttctcgggacaaagtcaagcagccgctgttatctgtgtcattgctttaacgatctacattgccttcttctccgcaacttggggacctgttatgtgggtcatgattggtgaagtcttcccattaaatattcgtggattggggaactccttctctagtgtcattaactggactgccaatatgattgtgtcactaacatttccaccattacttgatttcttcggtaccggtagcctcttcatcggatacggggtcttatgttttgttgctatttggtttgttcattccaaagtcttcgaaaccagaaaccgctccttggaagatatcgaagagactttgcggaaacgtagtgatcaaaaagtaactgaagcagaacgcgcaaaataaatcgatacagatataaattagtctaacaaagcttgaaggccttccgtggccttcaagttttcgttgttactaaataaaataagagagaatgcgattagattgaatcttaaggaagaactagcaaaaatggccaatggtgacctttatgatcaaacgcctgaattattggaaatcagaatgaaagtaagagacctactgtatcagtacaatcggctcaattaccgtgacctgaccggcagataccaactattaagcaaaatcttcaagcaaatcggttcccattgttttgtcgaaatcccctttcatattgactatggcttaaatacgtcacttggtgaaaatttctttgccaataataatctgactattttggatgctgcccctgtcacaatcggagataatgttttatttgcgccaaacgttggtctctacactgccggacacgcattggatccaaaaatcaggcagagaagcggtgctgaatttgcatttcctatccacatcggtaacaacgtctggttaggcgcaaacgtcaccgttacccccggtgccacgataggtgataacagcgtcattggtgccggttcagttgtcacaaaagacattcctgctaatgtcttagcttacggcgatcccgcaaaagttgttcgtcagttgggagaaattgaccgaaaatactatgctaagcatcggccaatgccccaaaaatacttggatgccattaaaaatcatcaaccgtttaagcacatctaactgcaaactttctgtcagacatgtcgctgctcaatcagtttaaccaacaggcagatttaatctgcgttaaactattagtaaacgatacattaacttctggagaaaaataatgcagaaaatttttattatcgaagatgaccaaactattcgcaacgaaatggttcaatctttaaagaaatggaacttccaagctagctgggtccaagattttcagaacattgattctgaaatcaaacaacaatcccctgaccttatcattatggatatcacattgcccttttatgatggcttttattggacacagaaaatccgggaattttctaaaattcccattatgtttgtctcagcggcagaaatggatcctaacgccattcgggccatctccattggcgctgatgactatctaaccaagccattctcagttgatgtatttgtttcaaaaatccaagccattttgagacggaccaatcaaaacaatcatttagctgaaaccatcagtttcaacacattctctttaaacattattacaaatgtactgaagtctcaaaacgaatccgttaagttaacgaccacggaaggcactattttaaaattattgtttttaaatcctgatcaggttatttctaaaaagaaaatcattaaatcaatctggcaaaacggtgactttaccgatgaaaatattttaaatgtcaatatgagtcggcttcgtgacaaattaggtcaaatcggtttagcagacaagatagtgacagaatatggtaaagggtacaggttattagataatggaaaataatacaaaacttgtttttaaagtaatcgtctctgaatggaccaaccttgttatttacctactttttttgtccctattttattttatatgtattctttacaaaatagacttaaacgttatcggtgacttgatccgctacacaataatgccatttttaatgatcattggttttcaagcataccgaaaatatactgatgtcaaatcaatcaatacactgattagagaaggtaactttaagcaaatccaccttcatggcttttatggtcatttatatgcccgagctcttcggaaagttacgaagcaaagattaactgaaagcaaaagcttaacggcatcacttaaaacccgtaaagactacttaactttatggagtcacgagatgaaaacgccacttacttcattattgatgattgctgaaaataatcctactgttccaagtgaagaagtttccgagaaaattgaattagtcaattatcagctcaaacaactcctaacttttgaccgattggatgattttaatcatgatttggtctttgaaaagattgacttgtccgattgcattaaaagggtaatccagcagaatgcttctttctttttgtctcatgaagttatgcccaaaattgctgtgccaccggtaaaaatattaaccgattccaagtggctatcctttattttagaacaagtcattaccaacgccgttaagtattcaaataaaaatggtgttgtgcaaatcagctttaacaatgacacattgactattacagaccacggcattggcattaccaaaagtgacctacccagagtctttgaacagggattcaccggcggtaatggccgaacccacggtgaagcaaccgggatgggcctgtatatgactcagcaaatcgctaaaatactcgacataaaagttggcatttcatctactgaaaacgttggcacaacagtcaaactcactttcaatcccaaaaagatcacaacaaaataacaaattgtaagattccttaatgcattgtaactacaaagcttgaggaatcctttttatactaagttatgaaatgattttttaggaggaaaaaaatgagcttactaaatttaaaacatatcaaaaaagtattttcagtgggtaacgaaaatgaagttcaagcattaaaggatgttagtttttcagttgaaaaaggtgattacgtcgccattatgggagaatccggtgccggtaaatccactttattaaatattatcgcgaccttagaccagccaaccagcggcgaaattatgcttaatggcatcgacttgagtcatttattcgaaaatgaatcttcccgatttcgcagagaacaccttgggtttgtctttcaaagctttaatctgcttgatactttcagtaaccgggataatatttatttgccactggtattatcaaggaaatcccatcaattcatggataacaaactacagccactaagtaaaacacttggtattgagcaacttttagaccggcagccttccgagatttccggtggtcaaaagcaacgggttgccattgccagagcattaataaccgatccaagcttactacttgcagatgaaccaacaggcgcactggattcaaataacagtaaaaaaattttaaatgtctttgagcgaatcaacgagcgggggcaaacaatactcatggtcacgcatagtgctcaggcagcaagttatgcgcaaagaactttgttcatcaaagacggtaaaatttacaacgaactttatcgtggtgatcaaagcagaagccagtatcttcaaaagattatcgacagcttgactgccttggaaaataacgaggaggttggctaatgattcaactaaagctcgctcttcataatttagttaaaagtaaaaatcaaagtttaccgtttatcttctcaaattcaatgtgggtcatcatcacttatattttcctctcaatgatctataacacaaatattaagaccaattcttacggaactgttgcaaattatattctaaaattaggcttggtatttgtgatcctaattgctgctttatcaacgttttacgccgaacgcctacttagtaaacaacggatgcaggaactaggcctatacagtatgcttggtctgacgaaacgtcatcttcgccaaatcattttactggaaaatagcttgttttacatgatctgtatcattattggcagcaccttaggtatgaccttttcaaaattggcttttatgagcttgaaatcccttttgggagcgtcctctcttcatcaaagctttacgttattgcctttgctgtatgttgctgtcatttttgccggtatctttatattgatcatcctctttgatttctggggattaagaaaggttaacccgattaatttatgggccaaatcctcccagcccgaaaaggaaccaaaatcacacattttacttgctgttttgggtattatcatcttattgattggatactacatttcagtgacggttaggccaaccggagctgcattcggacagtttattattgccattatgtttgtcgttgttggttcatatttggtatttatcactgcaagtatcagcttactcaaagccctcaaaaagaatcaaaattattattacaaacccaatcattttatctcagtttcaaacatgctttacagaatgaaacaaaatggtgcgggactggcttcaatcagcttgttatgtacatcaattctggttgccctaattgcatcagtatcgctggttgccggacaaaagaatctgattaatctttggagtcccagagatatccaaattgtgtctaaggctcccctttcaacaactgcaaaccaaaccatccatagattggcaaataactatcaaattacaatgagtcaacctcaaacgttaattgttacaactcccgtgatgggtgcattatcaggcaaccagttcaactctcaatttaacaccaaaaccgaatatacattatcttcacttgatctaaaacagtataatcatcttcaaaataccaactatcatcttaaaaataacgaggtattgctgtacgcacctgggagcaattattcacaacgccatttaaccattcggggaagaacttttaaagttaaaccggtccaaagatttaatggagcgtttgtttatagtcacactatctataaatccatttttattgtggctgccaacaaaacaattgcaaaacaacttaatccccagccttacatttatgctcaaggctttaatacccacggaaccaaacgccaccaaaagcaatttgcaaaaaccgttcaaaaaactttgaacatagatccgggcaactttacctcaaagtacatcatgcgagacctattaaaagcgatgtttggtagtttactgtttatgggcattttaatcagtatcgtcatgatttgtgcgacaaccatgattatttactataagcaggtttctgaaggatatgccgacaaagatcattatcatattatgagcaaaatcgggttaagtaaaaaagagactaagaaagccattcaaagtcaggtgttaacggtatttaccctcccgattatcggagcggttctcaatctgatatttgccttaccagcaatcaagagtgtgctgacgatcttctcaatgtataacttaaagattttattaatcgtcagcttacttacaatcagtgtgttgattatcagttatatgcttatttacttagcaacgacgactatgtatagacgaattgtcgaaaacccgtcaactgattaacatgcatgttagaaaatcattaacgaaaaaaggttaagccggggaacatgttgaaccccgtcttagcctttttattaacaagtcattaagatctaaaattggtttggaatttttttattttgcgtagctcgcaatcaccgtcataaatccatccaattgataattggagacctttttcggtaaaatatacgacatccctttcctgactggatatcgaacatcattaacgattaagtctccctgaccatcaatgacggtttgcaacatataattgtgaatctgatttaacgatagcttaccggttgtctgaatcttttcaactacaaaatgctttgcgttcaccaaagttgtgaccattccaaagctggctgctcgagttgcttgaacaacatgaggatcctgatgtggcacattggttactgccaacgcgtctttaacctgaagtggtcgctttttttgagtcgttgcgtctacccgatcaaaatcataaagccgaaatgtcatatcagaattttgttgggtttcaagtgcgacgatgccactgccaagggcatgcaaaacacccgctggattgtaaaagaaatcaccggttttaacgggaattgtccttaaaatggtattgatttgaccattatcaacagccatttgtaatccctgctttgtttttgcagtatgtccgtaataaattttggctcccggcgctgcagacaaaatataccagctttcagctttaccaaacttttcaccgtgtgcccgtgcataatcgtcagccggatgaacttgaattgataggttttcctttgcatccaaaatctttaccaacaatggaaattcttcattctgagcatggccaccaaaaagtgccggctcttctttccaaagctgatccaatgtttcccccttaaacgggccatcggaaactttgcttaggccatggggatgagctgagatgatccaagcttcaccggtatgatcactgggcagcttaaacccataatcctgtagtttggtaccaccccacattttgctgtggagaacaggcgttaaaaataatggtgcaacttttacttccataattagtttaagtcccccgtaaaaaatagttggaatcaatcccgtagcggaattcaataccaccataacgctatttgtgaaagtttgcactaaatttataaaattctaattttgtaagaatcaaactctataattatcaaaatgcgaacgcagataatttgttgtcagactcttaggcgctttagtcaagtcctccggcttaccttcagccacaattcgaccaccctgatcaccaccacgtggccccatgtcgatcatataatctgcatttgccattaaatcaagatcatgggtaatcatcataacggttgcaccttgatcaatcagctgggaaaagaccttcagcagaacgtggacatccaatgggtgcaggccaacggaaggctcatcaaaaatgaacagtgtattatcctggctgcgtcgcatatgtgacgttaactttaatcgctgggcttctccgcccgataaagttggtgtgtcttcacccagatgcaaataaccaagccccatcttttgcagcacccttaacgttgctccaatagccgtatttttcttgaacaactcggttgcctgatcaacgtcatcatccaggacatccgcgatcgacaggccatgccatttaacctggagcacttgtttattaaatcgctttccgccacaagttgggcaggtttcgaccatatccggcagatattgaatatccagagatatttcaccggtcccgccacaggtcgggcaaccgccctgcttattgttataggaaaaataacttggtgtatagtgcttttgctttgcttccggcagggccgcaaatagttttcgcagatgatccatgatatttgtgtaagttgccactgtcgagcgagcattcttaccaaccggtgttgcatcaacactcacaatgtgtttaattcgattcggatcaaaatgatcgatataactcggcaattttctatgattaaaatcagctttaaacgcatccaataagccatccaagaccagtgttgttttgccggctcccgaaaagccggtgacagcaatcagccgattaatcggaaatttagcgctaacctgatttaagttaaaccggtggttgatttttagttccaccgtgccgtcagcgaatacatcatcttttgatttttgccgtgttaatagctttccctttcctgttaagaacggtgcgattaaggaccggcgacttgcctttatctgatttggcgttccctgatcgataattgtgccgcccttttctcctgaaccggggccgatttcaataatccaatccgctgcatcaataattgacgtttcgtgatcgacaaccacaaccgagtttccctggtccaccagctgatgaaaaatcttaatgagtcccgaaacattatccggatgcaagccaacggaaggttcatccaaaacatatagaacaccggtggtttgcgtccgcaaagttctgccaagctgaatacgttgaagttccccggttgaaagcgttgcgccggcacgatccatcgttaaataatccaaacccaagtccagcagcggctgaagttggctcagcaattctcccgtcaaattattggctaaatcacgcatattatccggcaaccaggcttttatttccttaacaaatgccggtagttttccaagcggcagttggctggcttccgcaatacttttcccggctaccaattgacccagccgatcgggattaattcgcgtgccgtgacaaaccggacaggtgaaaaaccggtaaaatcggttcagccgtttcaaggcaatatcacttttggtagttgccatactatcttcaattgcgttatatgcattttcataaagtgcatggtccatatgaaaaacccgaccatttttacttggaatattaatggcaaatttctgttgtttaccatgtaatacagtttctttttccttatccgacaactggttgtacggcacatcgatccgaacgccggcagcctgagccacaatcggcataaaattccgaccgggtgtgcgccaagccgcaaccgctccgtcacgaatggttttggtctcatcgccaatcaacgtctccgagtcaatttgctttgtaaccccgaggccctcacaattcttgcaggccccatcggaattaaaggcaaagtcctcggcaccaaatgccatgaaccgaaccccacaagttggacaggtaatcatgcccatttccgatccggctttatccatggcttccgcaattttaatggtcggtggtacttggtgaccattgggacataccggcgaacccaatctggaataaatgagccgtagtacgttaaaaatttcagtcatcgtgcctaccgtggatcgagcgcccggcaccgtcggccgttgacgtaatgccagtgcagatggaatgtgccgaacttctttgacatcagctcggcctacctggctgattcttcggcgcgtgtaagttgccaaggcatcaaggtaacgccttgcaccttctgaataaagaatgcccattgccaacgaggactttccagaacccgacagtcccgaaatcgctacgaatcgatgcaacggaatgttcaccgaaatattcttcaggttattaacattaccgtcaatcacttgaatctgttcaggctgtgcttgatctgccatataaaaactcctttcgaaaaatgcttagtctaattataaagcaaaaaatgttgtacaaaaaaacgtctatttcaattatagaaaaaagacgtccaaaataattatatgtgtgaaagaaaatcaacaattaaacccaaaacaaacacacccgccataatagtaaggctccacataaagaaaggatacctatcatacaactttttactatcattaatagaaattgatttatcggacatagtagccacggccttcaaaaggaaaaataataatccaattagtacaattcccaacagtgaaacagaaatcataatacgataaattctatcaccattggccatttgggcaactacacgagatacggtcagtaatccgccaaacaatgtaaaaataactgcggcaaaaatccctaaaatagcaatgaaatccccatacaaagcctttcatcttattaagttttttatatctctttttcgtttttgaaatatttttttcaagcacatttattttttcttgctgttgatttaatttatcttgttgtttcttatacaaattgtccatttgcttatttgccaatttcatatgctctacagattttattaaaacgacatattcatttgcaatctctggggaatcctctaatttaacgttctccataattttttgatttagcttcataaaaaaagcgtcaagtccatcagcattattattataaataattcgagtgacttctgaataaggaatgaattctgtatgtattccctgcatggttgttaatagttttttaaaatccgtatcaaaaagcaaatcagagtcattaagttgataatgaccacctgcaacccaattctgtaccatactttccagttgctttaaaaatcctctgattattttagattcttcagactggctatccaaataagcaagtgtttcttctctacttattcgcatacctaattgatttccccaacgtctcgcaaagaatacggaactgaactccgccacccatctatggcagactcatgctccctctaaaaggtcacatcatgagattgctgaaccaattcaaaagggtcctcttccaataaagaaataatcttttcattcaaagattcaaaatctgaattagacttattaggttcaataataggatcggcaccataaatccggtattcatcatagatatctttttcaacaggaccatatctccaaacaaggaacggcttatcgtatatcctcattaaagctgattcgctaaatcgatgattaacaatggcatctttcaaagaaaagaacatcactttctgtaattgtaaattggtaatcggcaaattcttttcttgcgcgataccaataatgtgatgagctaaatcttccattgtcatagaatccaccttcctgtatatttcataatacacctactttgaactaatttttgaattatttaatccttctactacaattgttaaatacggatttaacaataaattctttccccaaatagatattatctactcttagatacaaaaaaatgcaccccggcaaccggcgtgcattcaggttttattaatggcaaacaatgattaatttctgattctcagaatggtctacagtgtcttcagctttcctctgaaatcatccaaactcgtgtagcccttttcagccataatttcttttagctctttggaaatccgatcaaagatcttaacatcttcaaaaccaaaagccgttccgatttgaacaacattggcgccacagagaatatgctcaaaaacatcccgaccggatttgataccgccagtaccgatgatcgcaatttccggcttcaatcgaagtcttaagccacgaacgttggcaagcgcagttggtttaacatagtcgcctccgaggccgccaaaaccgccctttggtttaaggacaactgattcagtctctggatttacaatcagcccgttaccaatggagttgattgagttaacataagcaatcgggaattcattcaatacgtcggcaatttggtcgaattgatgtaagtcaaaatatggcggcagcttaatgccgatatctttggtaaagaagtcaaacgctttagttaaaatgtcgcgaacagcttcaaaatcataggcaatctgtgactcacccttgatgttcgggcaggaaaggttcaactcggttaaaccgtcaaacgaactatcctggatttgatgaagcatttccaggttttgatcaacggacaatccggcaatcgacagaataacctgattgtcatttttcccttgattttcttcagcaaatttcaaataataatccagaccgtgattaggcaagcccattgagttgatacagccaagtggcgttgctttcattcgagggctctcgtttccttcacgtggttgaggggttgcgcttttagtcacacaaccaccagctgttgaacgtaaaatcttagtgagttcatcggttgttgcgcaacggattcctgcagcgtttaataaaacgttgttaaatctatacttgccaatgttggcctttaaagagattttattttgcagcatttgcctgttcctcccgttttgtccagtcccaaggggctttgtgccaagttgatagtcgtgaatactcctcatccgagaacttgttttccttgtgtccttgggaaataagttccgcatagctcaagagtggatgaagtgttgtatgtgcgtccgcaaagttcttgtcggcatccggcattccatatgtaaagacggaagcaacaccgatcacgttaacgccttcgtttcgaacagccttcactgctcctaaaacactgccaccggttgaaatcaaatcatcaatcaagacaaccttgtcatcttttccgatacggccctcaatctgttttccggcaccatgatccttaggctttgcccgaacatagatcagcggcagattcaaacgttgtgcaacccacgaagcatgaggaataccggcagtcgcaacaccaccaataaccgttgcttcgggatagtttttccgaattaattcggccaacccgtcggcgatcatatcccgtaactccggaattgaaatagtcaggcgaaaatcggtataaattggtgaaagaatgccacttgcatatcgaaaaggtttctttaaattaatactgacgattttattatcgattaatgattgaatgattttatcagtttgcataattccactcctctagcattttgtgataagcggctaccggatcgtttgagcgaataatcggtcggccgacaaccagagccgaactgccatattctgcagcttgttttggtgttgcggttcttgattggtcgtccttggggaagttggccggacggattcccggtgttacataaaggaaatcatcaccgacctgcttctttaacgagctgacttccagtggagaggtaatcacaccatcggcaccggacttcttagctagttttgccagggaaacaacttgatctaccatatccaatcggcaattttgttcgttcttcaaggcgtcttcagtaattgaagtcaactcggtaacggccagtaattttggcgtagggacgccggcttcttcacttccaagttccaagccttccttggcagcggcaatcatttccgatccgcccagtgcgtgaacggttgtataggtcacacccatccgaccaatttgcatcatacccatctttacggtgttgggaatatcctgaagcttaagatccaagaaaactttgaaccctttgttaagcaggctgcgaacaatttccggtccctcaccatagaataattccatcccgattttaacggtcatttcttctccggtaggaaacttgttgataatcttaaataatccttctctattcgcaacatcgagcgatacaattagtggtcctctcatggttaacctccgttatttttacataaaaagagcccggaatcatgcgatccaatacatccctgcactgaattcttcgcaaaatcacggactctctgattattttatgtcgtccgcttttggcctctctgaaccaatttaaagctttgttatttgttaattactttatcacgtcacgtgattttgttcaagttgattttagggaaaatggcacactaacgggttcacaactctcaaccagggataatgactatacaaaagggcctcatgaatcttaactaactgtacgttcaagcgtcttaatgtatactatgtgtatcccatatgatgaaagaaggtctcctcaacatgtcagttaaaatgagaaaagttggaaatcccaatacactaacagttcccaatgatattaaacctattgctaaagaattcgatgtctttcagggtagagacggtgtgatcgtttacgttccaaaacacaagaatccgttccacgatgaaaccttcatcaaatcacacaaccttaaacaaagtgaagaattcgggggacccttaattggcgaagaaatcccaaaagactaacaattacgttccaaatcagcaagatattatttttattgatttcgatccatctattagtcatgagattcgaaaacgtcgcccggcacttgttttgagcaatcaggggtacagtcgtttgacgcatttagttgtcgtctcccctattacccacgcaaacaataacgcattacgcaaaagcggttttttagttcgcgtcatgaataaaaatatagatggttttgttaacccattgcagttttatacctatgattttgataatagaaacgccgaatatgtcggcttacttgatacgcccagttttatcaaagtcaaacagaccattattgatattttgaattaatttccgtcatactcatttgaatagtgccattcttgcattttctacctattcatgtcatactattttcagcaaaaaaataacgagtgccggtgagcgctcattttggaggaacgagtatatggaaaatacaaatacaaccgttacgcacagccgtcattttaccaagaatcagaaatgggtgatcgcttcaaccagttctggcttcgcattggaaaatatggatgtgctttttctatcttttgcaatgagttcaatgatcagccaacttcatttaagcggtggtgccgctgggttaattggctccatcacaaatttgggaatgctgttcgggggcgttttatttggactgatcggtgatcgatttggccgcgtaaaaacctttacctacactatcttcatctttgcctttgcgactgccgccatggcttttgccaataacattgccttaatttatgtcttacgatttctggcaggtatcggtgccggtggtgagtacggcgtcggtatttcactgatcgccgaatcatttcacaaaaatcaaatcggcaaaatgacatcaatcgctgccattggcggccaagtcggtgctattctagccgcaattgctgcagcgttcattatcccaaatctcggctggcacgccctgtttctgatcggattggtaccggttattctaacctattttgtccgtcggcatttaaccgaaacaaccgcctttgttgaagcaaaaaaagaagaaaccgaatcaacgaccagtgctgttttcaaattcatgttcagctcccctaaactggcttatcaaagttttgccctgatgatcatgacaaccgtacaaattgccggttacttcggcttgatgaactggctgccaatcattgttcaaaaacaacttggtttaaacgtttccggttcatcgctctggatgattgcaacgattatcggtatgagccttggtatgatgacatttggctcgattcttgacttcttcggtccacgccgggcatttgggatcttcctcgttgcctctgccggcatggtttatacaatcacgttagcccatagtaccctatcactgctgattatcggcgccatagttggattcttctcaaatgggatgtttggcggttacggcgccgtcatcagccgcctttatccaacggaaatccgttcaaccgcaaacaatatcattgttaatatcggtcgtgcagttggcggtttctcctcagttgtgatcggcattttaatggataactactcggttgccgttgtaatgggcttcctatccgtgctctatatcatcagcttcactactatgatgacactaccggggttgaagaaattagctgttaaaaatagttaatccccttttaactattatctgcctaaggtctggaaacaacttagattaaccatattatttcaaattaatattaaacaaaaaattctcggcaaattcaattcaaatttgtcgggaattttttaatagacatcgctcattcatgcatttttaaaaaattgtcattaaaattaaaacaaccagtagaacaaaaatcaaaattagtgtatctacccatgtattagcatgatgttgatcacctaagtttccaatcatagctctttgaacgaaatctaccattatcgccattggatgttcagaaccgttcttaatttttttcttattattcgccactaggaaatatagcctccaactgtcttttaagataaagtgctgtcaactttaatttaaggcaccagttatggaacaatgattaatcattgataacacaataacaatatatttttttgaaaacaaggttttccaaaaaaagtcaataaaagttcaacttattttcatattttattaattttatgcttatctaatacttagtaatttgaaataatataatttaatatgtatcgaattttttgatccaaattacttttaaatcattaaatcattttttaacactagcgcttaaaaataatagatattaaattaagtcactttgaaaaagcaagcatgattatctcttaatttatcattataaattaaccagccattgacttatacggataaataaaatatgattttattgtaagcgtatgcattcttcttggcattttcaattacaattatcaaaaataaaacttggaggcttttctaatcatgtcaaacaatcaaaccgtcggaacaatcgacaagtttgatgactatcaaggtcatcaaattgacaaactaaccctttcaaacgccaataacgtttcgatctccgttattacactcggatcaacactatacgaattaaacgtccctgataaagaaggcggcgttcgtaatcttgttttaaactttgaacacagtcaagactactttgaaaatccattttacatctgcatgggtattggccgtgtaggtggtcgaattgccgatggccagctggttgttgacggaaagcaaactcaattaccacaaaatgaaggtacgacaacccttcatggtggcccagacggtttcaacacgcaaatttggcaaggtgaaattggtaaacaagacggaaatgacgttatcatcatgcatcaccttcaaaaatcagaagatgatgggttccctggcgatatggatgcaaccattacctactcgctctctgacgataacgtggtttcgatgaatttctccgccaagagttctgaagatacggtcttcaatccaacccaacacacttacttcaatttgggcaaaacgtcagatattatgagccatcaattgaagttgaacgcaatccaagcgcttaaactcgatgataaaaagatcccgactaaagaccggattgatgttgaagggacgccgtatgattttagaaagtcaaagtctctcggtgacgcaattaacgccatgtcgaacactaaagaaaaaggctttgatgatgtcttcgctgttcatccggatgcacacaacattatcgcggaattaaaggatcccgacactaactgctctgtcgcaattgaatccagccgaagcggcatgattctctttaccgcaaattcatttaccaaagaccatatgaactttgtccgcacaaatggcgttggacatcctcatgaaggcgtcgccatggaacccatgattctacctaaaccgggtcaagaaaaagatttttcagaaatgaccatcaaaaaagatcaatccgtttcttatgcaattaagtatcatcttagtttctaagccggtttattaaaaacactattcatttctaacaaaggggtcaatcacgactgcatgacaagtgattggcctctttgcttagaatgaatagtgtttaaatattttaaaaagtctcggtaagcttgagcgtaccgaccttacaaataaaagacaattgacagttttcttaattcattctattctaatatcaacccatagtacgattactatttcaacattagttattacgtatttagtctattaaagggagattattaaatgaagaaaatattcagccagctgatattcgtcatattcgcattattgctgtttacagttttccctttctccgcaaatgcggatacaggtcatgtgagagattctcaaaagccatcaacaatatccgattcgattactatgaccatttcaaaacagtcagcctattcaaagccaaaacgctatcataccagtgccaagtcacatatttcgctatacaaagcccacatctttagccatgctacaaaagttacttttaaattaatcggctttagcaaagcggacacgacttataagattactaaagtcatcaatgctcaaggactcaattggtactatcttaaaggacacggctggattataggaggaacccacccatctcatggcacaacccactaaattaacccattggttcatctattattgggaattttggtcaaaggcttttatttttaatgccaccgcaacccgcagtcagtattggattccgtggctgattaataatgttcttttctttggatacggatttatcaccggccaatggcagcacttcgccaaatatggctctgtccgtttgggtcttgcaccaccaaactccctcgtacacgcggtcattattcttcttgtaatgacagtccttctgattgccactatcggtcaattcaccagtcgggctcgtcggcttcacgatctcaacctcagcaattggctgatcttattacttatcttccctctcgccgggaacctagtcctttttattttgaacttaatgccttccaaaacaaataccctttggggaatgaatcaatccgattattaaaggaaacttagatttccctaatacgctttgtaatctagtagtataatcgacttcaataaaagatttttatgaagggatttggtgctatggacacaaacacaatcaagattcaagaaggttacatgccatttcgtggttacaagacatactaccgaattatcggtgagccaagtgaaaataaggcaccgctacttttaattcacggcggcccgggatcttctcacaactatttcgaattactggacgattatgcggctactggtcgacagctcatcatgtatgatcaggtaggttgcgggaaatcatcgattcctgatgaccgctccgtttatgtcaaagaaacctgggcggaagaattagttgccctccggaaatacctgcatttggacaacatccacatgcttggtcaatcttggggtgggatgctggaaatgttctacctgaccaactacgatcaatccggcattaaaagcgtcatgatcgatggttctcctgcgtctattaaattatggatacaagaacagcatcgattgattaaatacttaagttatgaagatcgtcaggcaatcagtgaggctgagaggaccggtgacttttccgggccaaaatacctggctgccaacgacagatatatggagcgctattgctgggacgatcctgacgaaaattctcccgaaccgctaagacggccgaccaacggtaagaaagcaagcttaattgccgaaggacctaacgagtttactgagaacggcacgatcagtgacttcgatgtgacggatcaactcaaaaacatccatgtcccggttttagtcaccaacggtaccgacgatttatgcacaccacttatcgcaaaatcggtgtatgatcacattccaaacgctaaatggcatctgtttgccaacagccgtcacttagcgttgctggatcaacatgacgaatttattaaagtgatggataattggttaaacgcacatgactaactagtcactttcaagtgagcgggatttttctcaaacaaaatcccactcattttttaattcagattaagctgaacgtagttacttgaacactcacaaaagtttggaggaattatcatgccgttaatgcgaatcgatatgctcaaaggacgaaccgaagacgaaatcaagcaggttttggatatttcttatcatgttatgctgaaaactttcggtgcgcccaatggtgaccgctaccaaatcgtcacccaacacgaaccatacgaaatgcctgttttggataccggattgggcattaaacgaaccgacagggtcattatcttcaacctggtcacccgaccacggacaaccgagcaaaaacagcagttttatcaacaattggttgatcgactgcacgaaaaattgggcatgcgaaaagaagacatcgttgtcagcctggttgttaacagtgatgaagattggagcttcggactcgggaaagctcagtttctaactggtgacctttgattatttttcccttttaatagacaaacaacaagccaagcactccctaaattgggaatgctcggcttgttgttatattaaaactcttttttaattgactttcagcctaaagaccattctatacccgacttttttccaaatccctgaagccaatatcttttcgatagtagaaatccgacaggttgatttttgccaattccgcataaactttatcctgagtggcttgcaacgttggggcatgatccacaattgtaaaaatccggccgcctgaactaaacaatttatcattatcgctggtaacgccggcataaaaaatgttatcgggtaacgccggcagtggaatatcctgttgcggtgcttggggatatcccggagctgcaaccacaacgcccaagtaataatcggagtcctgccactgcatgtccggtaattgatgatcaaccaggtccataataacttggtaaaaatcactctttagttggggcagcagaacttgagtttcaggatctcccaaacgaacattgtattcaatgactttaataccgtcattagtcagcatgcagccgatataaattgtgcctgcgaactccagaccttcatttttaagaccagccatagttggatcaacaaccgtcttaattgtttcctgcaagacatcatctgtgatgtggggaaccggtgaataagcgcccatgcctccagtatttggtccggtctcaccttcatgaattttcttatggtcttgagaaatcggtaaaatcactcgtttatctccaccaacgaaaagcatgagggaaaattcttctccttcaagatattgttcgatcaagatttcaccggacttttccagctcacttcgaagcagtggattaacatctgctcgttgggtgacaatcgtgacaccctttccggcagccaaaccattttctttaacaaccaacggcaaagacaagctttcagcataggccgctgctttatcataatccgtgaaggtttcaaaatcagccgtaggaataccgtttcgtttcatgaaacgtttggcaaacgtcttgtcgctttcaaggcaggcggacgcctgaccgggtccaaagactttcaaaccgcgtttttgcaatgtatcaactgcacccattgccaacgggacttccggaccaacgaatgccaaatcgatttgatgactttcagcaaagtctcccaatttctgaaagtcagtttcgtcaattgccacaagatggataccatctttcttcatccctggatttccgggtgcacaataaacattttcaacctggggactcttcataaatgttgccgcgatcgtatgctcacgcgcgcctgatccaataacaagaacgtttgccaattttatctctcctttatttgactatgtaaccaagaagtacaaactttcttggttgaaatgctttgcttcaaatgctaaccgctttgtttcgcacactaattaggactgctcctcaaagcaacattttacatataagggataaatcttaaaaatccaaacccaggatttccaagattcacgccttatattccaaatgttaaccgctttgtttcgcacactaatgtctaaagtgtcttactcccgttgtgaccatagcaatgccgtacttatcggccatagcaatcgagtctttatcccgaatactgccacccggttggataattgctttgatatcgtgttgagcagcatactcaacacagtcgtccatcgggaagaaggcatcggaggccataatcgcatgctcgtagccatcttttggcattgccttttgaatagcaatcttggctgaatcaatccgatttggctgacccattccaacacccaatgttttagtatcagttgtaacaaccaccgcgttactcttaacgaacttaacaatgtgttgaccgaattggagcgcttttaactgttgttcagtcggttgagtcttggtaaccaccttaaaatcaggaatttgatcgatttgatgatcagattcttggattaacatcccgccactgaccgaaatggtttcaaagcggtccggttggtcacggtgactcaaatcagcttgaagtaaacggatattcttctttttggctagaatctcgaaagcttcatccgtaaacgatggtgcaataataatttccaagaaaatcttgtgcattttttcagcagtttgcgcatcgatttcacgattgacggcaatgatgcctccaaaaattgacattgggtcggactcataggcttcatcccaagcctgactaatattatcggcagtgccgacaccgcatgggttcatatgtttcatcgccacaacacacggatcgtcaaattcactgaccatgttcaaggcagcatttgcatccttaatgttgttaaacgacaattcctttccgtgaagctgcttggtaatcacagacagctttgaaggaatcggatcacggtagaaagcagccttttgatgactgttttcaccatatcgaagactttgttgcttctcgtaggtcaatgtcaattgatccgggaattcctcttcggttaagtagtttgaaataatggcatcataggcagctgtgtgtctgaagacttttgcggccaagtgttttctaaacgcattgtcgtcactgtgagctttaagtgcgtcaatcactggttgataatcattaggatcaacaattgttaaaacaccggcgaagttcttggctgcggcccgcaacatggaaggcccgccaatatcaatttgttcaattgcctgggcttcggttgtctccggcttctcaatggtctgtctgaagggataaagattaactgccaccaaatcaatcggcgtaattccggcatcctttaactgcttcatgtgatccgggtcatcccgtttagccaataaaccggcatgaatctttggatgaagggtctttacccgaccatccaacatttcgggaaaaccggtaacttcttcaacgcccgtaacgtcaacgccgccggcttccaatgcttttttggtaccgccggttgaaacgatttcgaaatccaaatctttcaactgttttgcaaaatcaaccaaattagttttatcggaaacacttaacagagctcttctagccattatgatatttctcctctttctaatagttgtttgactacctctggatataatcgatgttcggtagcgtgaattcgctgctcaagttcactcagcttatcatctttatacactggcaccgtccgttgtgcaatcacttttccggaatcgattccggagtcaacccagtggatagtgacacccgtttcgtcaacaccggcctgataagcatcttcaatcccgtgacggcccggaaacttaggcaacaaggccggatggatattcacaatttttccttcataagtcgctaacagggttggcccgataattcgcatgtaaccggccaacaggataaaatcgatcttttcgtccgctagtttcctggcaatgacactttcggcagccgctttatcgggataatctttaaagttaatcacaaaagtcggcacattttcctttttagctcgattcaacacgttggctttacggtgatcacataccaataaggccacattaatcggtaagccttccttcttaaacgactcacagagcgcggtgaaattagtcccttcacctgaagcaaaaatggcgattcttttaacgtctggtttcataacaaatcctctcgaatcacaactttttttgaaccggaaaccaatttaccgacttggtaaaccgtctcgccggctttttccaattcagccttcacgcgatccacatctgtcggtcgaatggccaataccattccgagtcccaaattaaacgtctgcttcatgtcatcaaatgacaagtggccgatcttttgtaaattcgtcatgatggccggtatctgccaactattcaggttgaacgctgcatccaaatggtcaggtaaaatccgaccgacattttcaatcagtcccccaccggtaatgtgcgcaattgattgaactaatccctgttcaatcaacggcaaaaccgatttgacataaattcgagttggtcgcagtaactcatgctttagatccaattgacaacccggtaatgtctcatccagtgaatagtggttttgtttgaacaaaatatcccgtaccaggctgaaaccgttggagtgcaggccgttggaggccaagcccagcaaaacatcgccttctcggagattatccgatttcaataatttatcccgatcggcaatcccaacggtaaaaccggccaaatcatagtgaccgtgctgatacatatccggcatttcagccgtttcgccgccaaccaattttgcatcagcttgagaaacaccgtcaacaacaccggttaaaatggcttttgcctcagcctggttcaaatgaccggttcccaaataatcaaggaagaaaagcggtttagcgccctgtgccaacacatcattcacacacatggcaaccagatcaaccccaattgtgtcatgtatgccggccttaattgcaattaataatttggtaccaacaccatcggttccagacactaaaaccggattctgataatgacccaaactcaatggaaacatgccgccaaaggcacccagcgcatcgttatgagataactgtttaatttcatcaaccaatttatacccggcgttaatatcaacaccggcttttttataggcatccattttatttccctctcatcccatttttgcggcgtgtaattgagcctgatcacgatcatactctctttgataatcataaagcggcgttgggtatttgccatcaaagtatgcgacacaaagacctttattaggcgcagtggttttcaagttaaccgctttgattaaactttccacactcaagaatcccagtgagtcagcatcaaagatctgacgcatttcttcaattgtatgattggcagcaatcagctcactgacgtgttgaatatcaattccataaaagcatgggtagcgaagcggcggtgacgcaattcgcaaatgaaccgaagcggccccggcatccttcaataatttaacaatccggcgactggtggttccacgaacaattgagtcgtcaaccaagacaacccgcttgcctttcacaacacccttaactgctgaaagcttcatattgacaccctgctcacgtaattcctgagtgggttcaataaacgttcgtgccgaatactgattcttcacaagtcccatttcataaggcaaacctgctgcctcggcataacccatcgctgctgacaatgacgaatttggcacacctgtcacaatatcggcatctgccggctgttccttggccaatatttctcccatccgcttacgggcggaatgaacattgaccccatagatatcggaatccggacgggcaaaataaataaattccattgagcaaattgatagctgtgtgtcatcggtatattgatcaatcgtaatcccggtatcatcaattttgattaattggccgggttggacatcaaatttaaacttggcaccaactgcttccagcgcgcaggtttcactgcagacgacataagcaccgttgggcaattggccaacaaccaatggtcgaaaaccgtttggatcaagagcagcgtacagccgatcctttgtgataatcagataggcaaagcctcccttgatgatattcagggcttccttcacctgatcatccaaatcaggcgcctgactcagacgaatcaaatgcatcaggttctcggtatcggaacttgaatgatagatggccccacgatcctccaactgctttcgaattgaaatagcgttggtcagattaccgttatgggctaatgcaaactgggtatcactgaaattgaatggcaacggttggatattttccaacaagttactaccggccgtggaataacggacatgtccgattgcggcatttccgtcaagatctgcgactgcatttggtgagtcaaaaacatcggttaacagaccaaagccgcgtttggtacgcaactcgccatcgttattaacagtaatgccggcgccttcctgaccacgatgctgaagggcaaacaggccaatgtaagttaagcgtgcggcatccggtgttccccaaacgccaaagataccgcattcttcatttaaactctttacttcaggctgcatggcagtgctcccttccaaaggtgaaatgcatcatcaacatccatatcaaagtaaccatcggctgcggaaacaaataaatgattattgtcagtgacttttcccaaacaatcggcattttcacccatcaacttttcaaacgcatcctgattttcagatgcaattgacacaataaatcgtgactggctttccgaaaagaatcgatcaacaggcaagtcgctggtgagatcaaccccgagttgattgccgaaggtactttcggcaactgccgtgatcaggccgccctctgaaatatcatgggcactgtgtaccaaatcattttggatggcgtcgatcactaattgttgcatttgggcttcgtagtccaagtcaaaatcaaatagttttccggaaatcttaccggtctgcattttttgaatttgagagccgttaaatccgtttcctgttcgaccgacaacgtaaaccaggtcacctgcctgtttaaagtcctgggtcgtcacatgcttcaaccccttgatcaagccaaccatgccaaccattggcgttggataaatcgggacgttatcgtattcattattcagtgagacatttcctgaaataaccggcgcattgaatttctcgcaggcatcactcatccccataaccgcttgatccaattcgtaaaattgatccggcttttcgggattgccaaagttcaggcaatcagtaatgccaagtgggacagctcctgaggcaacgatgtttcgagctgcttcggcaactgccatttggccaccaatccgagggttcaagtaaagatagcggccattgacatcagtcgtcattgccaaagctttatcataatgacgaacccgcacaaccgcggcatccgatcccggtgccaccaccgtatttgtttgaacctgtgtatcatatgtttgataaatactttcctttgaagcaatcgttaactgcgtcaacatctgttttaaagtcgctgttggatttttaatttcgggcacaaattgtttggtatcggcatcctttaaatgcgccggcacttcggattctcggtgataaaccggtgcttgagaagccaatgagtcaaccggaacgtctgcaacaacgttaccgtgctgcagcaattgataatgatcgccttccgtcacatggccgatcacaactgcatcaacaccatgatcgtcaaaaacggtcaagacttcatcttcatgtccggcctttacgcaaagcaacattctttcctgtgactctgacagcataagttcaaatggcgtcatgtcggcttcacgttgcggtaccaaatcgaggtcaaggaccatgccgttaccgccggctttagagcccatttcagctgatgatgataccaatccggctgctcccatatcctgaataccgaccagtgaatccgaatgatgattaataacatccaggcaagcttccataaccaatttttcagtaaagggatctccaacctgaacagccgaacgctggctttcatgttcggaatcaaattggaacgaagcaaatgaagcaccgtttataccgtcacgaccggttttggcacccacatatacaatgctgttgccgacaccggctgcagcgccgacttcaatcttatcgaggtccatcaagccaacacacatgacgttaaccaatggattgtgttcataagcatcgtcgaaactcgtatcaccgccaacggttggtaccccgatgcaattaccgtaagagctgattcccgctacgatttgagaaataaagtaacgatcctcatcggttttaggtgcactgaaacgcaggctgtcaagacaggcaatcggccgggcacccattgaaaaaatatcccttaagataccgccgacaccggttgtcgcaccttgaaagggctcaacggctgaaggatgattatgactttctgctttaaaaacgaccccctggttatcgccgatatcaataatgccggcgccctcgccaggccccttcacaacatgttcgcccttggtatagaacttctttaatacaggtttggagttcttataggaacaatgttcgctccacatgccagaaaaaaggccaacttctgtgtaatttggtaaccgatgtaaaacgtcatcctttatcaactgatattcatgatccgacaaccccattgactgatacaatttttgatctctgatttgttccggtgtagcttcaaccgactgattcatcactttatccatgagcgactacctctcgactttttacatagttaacaattgactgaaaaataccaacgccatcgcttgatcccaagatatcttcaacggctcgttccggatggggcatcatacccaggacgtttccggctttattggtaattccggcaatgttggcgacgcttccgttggggttgtttcgatatttaaaaataatctgatcattggcaatcaaccgctttaaagtctcctgatcacagtaataattaccatctccatgagcaatcggcaggttgataatttgtgccaacttaaaagctgaagaaaatagtgaaccagcattattaacgaccagcggttctgtctgacagataaatttggctgaaacatttttttggaggctgccgggcaataacccggcttccgttaaaatctgaaatccgttgcaaattcccagaaccggtcgaccacttttggcaaattcctgaagtgccggaataattggtgagaagcgggcaatcgcaccactgcgaagataatctccgtatgaaaagccgccgggaattaagacagcgtcaaagccttctaatgagttcttcttgtaagaaaccaattcaacttcttcattcataatgtcttgaatcgcgtagtacagatccatttcacagttggaacctgggaacgcaaggattgcaaatttcattgagcagcctccgtttcagtaatgtcgtaatgataattttccatgttgtagttagccagcatcttatcgcagatatcgttaatttccttattcaagtcgtcgcgtgaaatgtcgtcggcaacggtaatttcaaaatatttaccaagtttgagatcattgacattatcgtatcccaaacggccgagtgccttctgaatggcttgtgcctcaggatttaaaattgattttttatagttaacgtatacttttaccaaagccattattgaacatcctccactttttccaagcgccccagcagctctttatagacaggcaccaatgcaccaagcccttttctaaagacatctttatcaagcgacttcttggttgtgcgatcaattaagcgacagctgtctggtgaaatctcatctgccaaaatcaactgaccatcactggtcataccaaattcaactttgaaatcaaccaaatcaacattcatttcggaaaagatctctttcaagcgatcattgacctttaaagcaatgtcacggatttttttcatttgatcctcggttgctacattaagcgcttcggcatcaaaatcattaataaagggatcgtcaagctcgtcactcttgtagaaaaactcggtaaccggcttttcaaatgccattaaatgttcgacgccataccgtttttcaaaactgcctgaagcaaaatttcgaacgaccgtttccaacggaatgattttgacccgcttaaccaattggttgttagcatccaattgcttgataaagtgattttcaataccgtgctttgccaagtccgtaaaaattaacgatgaaatttcacagttggtctggccttttccctgcatctgaacttttttcttaccattaaaagccgttacttgatccatgtaatgaacccacatgatgtcgggatcatttgtggtaaacatttctttggctttacctttgtacaataaatctttcttttcgatatcagcaatttcagtcattttaattttctccctttaacatgtcgattgatttcaataactggtcgatgtcatcacctaaaacggtcacatgacccattttgcgttgtgggcgaatttccgctttgccgtaatcgtggaaatgccattccggatgatctttaagcaggttccttgcaagcgttaagtcggtgccaagcaggtttctcataacagccggcttttcttgtacaatttgaggaatcggcaatccgcaaatgcttctgatatgtgcttcaaattgtgaaatgttgcaggcctcaatggtgaaatgacctgaattatgtgggcggggtgccaactcgttaaccatcaaatccttgtcatcaatgacaaagagttcaataccgagcacaccgtacaaatcaagtttattggcaatagtttctgcatagtcatgcgctttttgatgaatggtttttgagaaccggccgggagcgatcgttgtatgaagaatgtgattcttatgtcggttttcaaccaatggaaatgtgatcaccttgccgttgacatcccttgtaaccatcaccgatgcttcggcaataaaggactggcgggcttcaagaatgcattgggatttcccataaagttcaacggccttttcaatatcttgagggctgttaatatccatttgaccatggccatcataaccgcccgatacggttttcaggattgccggataaccgacttcttttatggcatctgtcatagatgcttcatctgaaacagccgcaaagttggttaccggaataccggcttggcgaagaaagtttttttcgtttaaacgttcgccggtgatgtgcagtaagttgactccctgcggaagttcggcaacttttttggcttttaataaagcatcctcatcaacgttttcaaattcataagttaaaacgtcgcttttatcggctaattccatcagtgagtcaacgtcatcgtattcagccacaatctgaaagtcggcaacctgaccggcaggtgcctgaggcgttggatctagaataccgactttgtatcccattgatttggcaatcaacgccatcatctgtccgagttgcccaccaccaacaatgccgatggttgccggtggcaaaagtgttttaatcgaattgctgctcactgtttttggcctccactcgttgttcgtgttttaaatctaaaagtttctgttgaattgattgatcttcaactcccaaaatctgggcggccaacaaggcagcattctttgcgccggattcgccgatactaacagtagccacgggggcaccaaatggcatttggacaattgaaagcagggaatcaacaccatttaatgttcgggttttaattggtacaccgatgacaggcagcgttgtgtttgcggcgatcattcccggcaaatgggcagccccaccggcacctgcaatgataacttttaagcctttatttcgtgccgactttccaaatgcttgaagttcatagggcattcgatgtgctgaaatgacgtgcttctcatacgaaatctccaagttatccaattgctgacaggccaatttcattgttggccaatccgagattgatcccattgcaaccccaacgatgtttgccatcataaccactcaccttttaaattattttgtgtctaaataatacttaacaattaagcgaaagtcaatatctaaagttcgtgttttgctgtatatttccgaccaaaaatttacattgtgtaagattgttcgtctttgcttgaaataatgatatcatttagcatttatttcagttggttgataataaaacagctataaaataggaaacacgaactggttttgtaactttaatttaattgttcgtgtctaaggcgattttgttttgatgcggtttttgtttttaggcaaaactaatgatctaatgtgaaattatgatataagttcgacaaaatcattacaaattgcgtcaaataagttgccctacaaaaaaaggatccttcacgactctttgatcatagagtcattaaggatccttcttcgatatacctgcaatttaatcagtctgcatcgtcttcttcatccagcccttccctcggcgtcttacccaagagtgcctgtaagaaagcaatgttatgattattttcacccaataacgtagtgagatgctgtgccaaaacgggacgatcttctttttccgccaatttaattgcccgggttacaaagaggttcgatgtatcgtagtcatgaaccaaatcgtcgaccagccagtcggcattctgatacttgtttcgaccattttcctgaagcatggcatattcggtgaattccttttgagttgtcggcgtcaacagcgcctcatcaatcaaaacacttcccatagtatctttttgacgataggcctgctgcaataaatcggctatcgtttgcttcagtgaggctgcattcatccccttaacataccatttgatctgctgcagcttatcagccaggaccaccaaatttgacacaatgtggccggtcattgccccggctgttggcgtatggtgatcaagatccgcttgcttaacttctgcttcatacaatttttccggtgtttgcgttgtcattttagtcactcctacttaactttcattgatttaacttcatagcccaggtcagtcacggtgtttgataattgatctgcagaaatccgatccgcatcaaattccgctttgactttggcagcgttaaacaaaaccttaacagtctccacgcctgcttgtttctccaacgcaccttggatcttttgcatacatgacgggcatgataatgcatctaattgtaaaattgctttactcattttaacgacctccgtttttctttctataattaagataacttaactcggctctcagttacttgatctacatcaatttttggtgattttgtttgatagtggatgagtcgcatggcgttaaaaataacaaccagaatactggcctcgtgaaccagcatgccgctagccatatagatatagcctgctatcaacccgacgagcaggaatacaaccgttccaaccgcaataatgatattttctttcgtatttaacactgtctttttagccaagccaaaagcatgaaccaactcatcgaatccggaagacatcagaacaacatcggacgtttcaaccgcaacatcggtaccgcttcccatcgcaatgccaatgtccgcagtggcaatcgatggactgtcattaataccgtcaccaacaaaggcgactttttgaccctcgttttgaaattgcttaacaaaagtgaccttttgctccggaagcaaatctgcatgcaactcatcaatttgcaactgtttggcaactgcttgggccgccaattgattatccccagtcagcatcactgtttttttgacacccatttttttcaattgttgtaagctttccttaacgccggttcgaacgacatccgagataccaacaatcgtttgaacagaatgattcacggccacaattaccgaagaactcccctgtcgctgaatggcatgcagatcgtccaactgtttggtcgataactcaatccggttatccgccattaactgttggttaccgattaatacccgttcttgattcacaagggcattaatgccgcgacctttaatcgtattgctggacgtaaccgatatatatgaaaaatcaagatgcttcgattggacgaaatcaaccactgctttagccagaggatgatcggactgactttcaaccgctgctgccaccaataatcctttttcgtcatcactgtaagtgtgaaaatgggttacggccgttttgccttcagtcagtgtcccggttttatcaaagataatcgtatctacgtgactcaatgtgttcatcacgtcgccacctttaaccaacacaccatgtttggcaccattaccaattccggcaacgtttgacaccggggcgcctattaccaaagcaccggggcaccctaataccaataccgttattgctaaacgaaaatcggaaaaaataataccgacaagtgccgcaatgattaaaacggctggtgtatagtaggtcgcaaatcgatcaataaacttttcagctggggatttagtatcctgcgcattttcaaccaattcaactattttgccaaaggttgtatcatcgccaactttggtggcttgaacttttaacgtcccgttatccaaaatagtacctgaataaacagaatccccgctggttttagaaactaattttgcttcgccggtaatactggcttcgttaacgtgaccggatcctgaaacaattcgaccgtcaaccggcacttgagcacctgtcttaaccaatacgacgtcacccgtgtctacaaagtcaacatccgtttcttcgatttgatcatgttcaccaatgacaagtgccgttgttggtgccatttcagtcagatctttaatagaatgtcgggtctttgccagtgttttattttccaaaaaagttccaaaaagaaataggaatgtgacgatggccgactcattgtattcaccaataatgaatgccccaacaactgcaatactgaccaacagttcaatactgattgttttaaatcgcaaagctgagaatgctcttagaacaatgggaaccgccgaaataatggaagctaagataaatgaccaggtatataaccaccctatcttggtgatgttccccaataagccaataccgattaaagctgccgttattaatgtaatttgattaatatgctgattaataaagcgttgaaatttcatttaaatgtctcctccccgatatgatacatttagtatatggggattttagatttaaataattgatgcagatcaagaattcaatcttttccaagacttttctttcattatgtgggtcataaccgatatactaaacatagaaagcttaaaggaggacaaacatgaaaattatcgtcatcggtgccaccggtcgggttggcaagcaagttgtttcaaagttggctgaaaacaagagcgatcaagttcttgcgggtgcccgtaaacctgaaagtatcgaaaagggctctaatatcaaacctttcaagattgatttacacgacactaaagacaacatcctaaaagcgttgccggaagctgacgcattgatctttactgctggttccggcggtaaagatcttctgcaggttgacttgaatggtgccgttaaagtcatgatagaggcggctaaacgcggaatcgaccgctttgttatgctgagctccaaggactctttgacccctgattcatttagcggcgacaatccgtccccacttgcaaattatctaatttccaaacattttgccgacctttggttaattaagaatacaaccttggattacacgattcttcagccaacggctctgacagaaaccccaggttccggtaaagtaagtttgggtgaatacaccaagaacgaaaatagcatcgaaaacgtggcggatgtacttgcagaaattgttaaagatgatcataccattggcaaaattcttccaatgagtgatggtgcgacgccaattacagatgcagttgccgaagttaaatcttaaacaaacagttatcctatttaaagtaggataactgtttttgtaatatttgttatattatatgacatccaccggttaatcaccaaaataaattttagctttttctgtgatttttgaattgctttttaacaggcttttgagaccggttccattttttaacactcttagaattaaataagaacgtttctaacaaacactagacggtttgcattgatgatgttagaatttatgacattaaataaaaagggaagcgatgttatgaatgctgctaatacttcatttatgattctgtctagtattttggtcttattcatgacacccgggctggctttcttctacggcggcctggtgtcaaaacgaaacgttgtcaacacgatgttatctgtattcgtcatgactggagtcgcaattgtcctctggatcatggttggctacagtttatcatttgaaggagatattcacgggatcgtcggaacgttagataatttctttatgaacggtgttaaattgggcaccttaaccgcaactaaaattccaaccggaatcttttccgtttttgaaatgatgtttgccattatcacaccggctttattcgtaggagcggttgttggtcgaattaagtttaattttttactggttttcctaattctctggtcaatcttaatttactacccaatggttcacttggtttggagtcctaatggtcttctagccggacttggtacattggactttgccggtggaaccgttgttcatattaacgctggtattaccgcctttgttctatcagcctttcttggtaaacgaatcaaattcggtgataaacctcacacccactacaatttaccatgggttttgctcggaactgccattctttggattggttggtatggctttaatgccggttcagcacttggagttgataacattgctgctcaagcaacgattaccacaaccatgtcaaccggtaccgcaatggttacctggatgattctggatatgatcatttccggaaaaccaaccttagttggtgtttgtaccggtaccctttgtggactggttggtattacacctgcctgtggttttgtaacaattgccggctcattttggatcggcatgttctcaacctttgccagctacttcttcgttaactacctcaaagacagaatcggtgttgatgacgccctcgatgcctttggatgccatggtgttagcggaattgtcggcagtatctttaccggtttgtttgctacaaaggcagttaacccaatcgtgtcccacaacggcctcttctatggtggcggttggcatcaattaggtatccaagtatttgccacccttgtcaccatcgtctttgtatcaatcgccgcaaccattattattaaagtacttggattaatcatgccgatgcgtgttgatcgcaaggaagaggaaattggacttgataaaggtgaacacggtgaggaagccgattacaccgttgatatcagtaatgatatggatgcttatcaatccgatatgaatatgtatgctaaggaattcagaggccaaatggcaggtttgaattcaccgaaaacacccggtcccagagaccattgacagaaaaataactaacatcgccaaaaagttaataaaaactgcttttgaagtctgctatactgatttcaaaagcagtttttgcgatattaaggaagcgagatacaatgacttattcacgttcagagcatgttgaactggtcaatatgtgtatgatttataacccgaaaacaaaagaagtactggttgaagataaaacagacgttacctggaagtttggtcatacttttccaggcggtcatgtcgaaagaaacgaaagtctttatgatgccatggtccgggaggtctacgaagagaccggcttaaccattacccagctggaatcatgcggtactgttgaatggtttaatcaagatcccctttaccggcgattgggttttctatacaagacaagccatttttccggaacgttgaagcaaagcagcgaaggcaaaatctattggatgccattggcggatctcaacgagaacaacactgccgaaagctttatgacatttttaaaaatatttaccgaacccactactgtggatgccacttcaaaaatcatgaacggctctttatcgataatccccaaagaagcatgagagaagacaataggatataatacgggtgtcccctattaggaaagcggattcaatatttaagagggaggcccggatcatgcaaaattatctgattatttacaatggaacagctggcaaatccgataacgaaacgattgcgaaaaaggcacagcgaatgttgcatcaagcagggaaaaatgttgatttagcagcgaccagctctgaaaaagatgccgttaagcaggctaaagcatcaaccagtcgttatgattgtttagtgacaattggcggtgacggttctattaacactgcctgcgcaggctttcttaaagctgggcaatcaattcctttgggtatcatccccggtggcaccgttaataatttcgccagagccttaaagatccctctcaatacagacaaggccattcaaaatttaattgatggctctcctgcaaaagttgatcttgcaaccattggtgatacaccaatggttagcagcttaacactgggacgattggcagatatttctcaaaatgtcaaacaggccgagaagcgaaaatttggtacgatgatttacctttttaagggaattaaagaattgtttacaaaccgttcgtataaattaaaaattgatgcagacgggaccagtgaaacattgcgtgctcagatcctactcatcaccacaaccaattccgtcggtgggtatgttgcctttaatccggacgcaacatatgacgatgattgcctgcacgtctttcttctaaaaaaattcacgctccctaaaataatgacctatggtgcctttttcctttccggaaacctaaagaatgccaggggcgttaagtatataaaatgccaacagattcgaatcgaaaacttatcttccagaaagatcaaaacccgaattgatggtgatccggcaatggccttaccgattactgtgaaggtaaaagcggatttcttgaaaatactattgcctaagtcattaagataagaaatatcccctgaagttaaaggactttaactccgggggatatttcttattaataatggtcatcttctttataaggacaacctattatctagtacttcgattgtaacgctttgctcatattttccatcatttccgtaacactctgactattaaaaatactgctatttttatcttcaaggttattatagtcttcaattaacaggtaagcagataaataccgttgaagcgccactttgctcgcttttacgtcgtcactttcagtcagtgtcgaaccgctcacaactgccaaagcaaacttatctggattaatcttgatctttttgctgctcatttaatcaactcccgtaactatttacatcaataagccgatttttttacagatgatcaattaatcgttcccgaagtttctcagctaatttatcatcactcattgccggccgtgtgtttgacaatgtcatcaccctggcttccgcggttgccttgataaagtggtgctcccatttgtcttcatcatcactatcacccaacgttcttaggtaatgacgcaggaattcgagctgtgaaacggccaatggcacattgttatagccatcatttttataaaagtcacgccattttgttgatggattcgtcttttcagcaatcgtaatttcatttaagtatcggtatgcttcatcagtcaccaagaatggcttaacgtaatcatcagacttcttcgctttagacacttcctgatatgcttcaatgaccaaatgaaatgcttttaagccacgtgcttgattaatcacgcttaaatacaaatccccatataaacgtcgggaatcttcctgatctaacgtcaataataattctcgaacctgcagtaacaaagtatcccaatctgctagtttaggtgtaataagttgatccaatttctccaatgatttatccaattttgcatcaccgactacccagcccgcatcactcaatttatcttgaccactaacccaagccttaataaggcgtcgaattaaataaggtgcaaactcatcaccggccgtttcatccgtatgtggtccatactgaacgattgcttgccagtattgatcatataattgaacgacctcatcacgctttttggcataataatgagtaacataatctttcaaaatagtttcattattgcgtgccgaataatcagtcaaccacgacttggcaacttctcttaaatagagaatatgaggtttgatgcttccggtattaattaattccagtgtatcaaaatgatgctgacgaaccttcattagctcagaagatacaaaagccggactatttgacagcaagcctaaaaaattggaagcctgaagatcatgaaaggccacatgatagtaaatcccccgctgacgatgttcaggattggcagcttctagaataggtgaccgtggattatccaacccctgacgtctggataccattttcccataaccactatcggcccaaatctcaataatatcatttggtactttaatcagccccttattgtagagtccggttaattcaccatacacattcagggccatgggtgcacctggatcaagttcctttaccatgttgtattgttctttaataattccattaataacgtcggcaatcgcgtgatcatcccactttcgactgtcatcgtccagccagaaaggcttatcaccctgaccacgaaagccaagactataaatggttggtgtccctttttgttccataatggcatcccgccataattttctaaataagtcaggatacttgataaacgaagccgttaaggttggatattcccgggcaaacattttagcacccaacggttcagcatgatggtgtgcaatcatcaagccaaattctttggccggctgtctattgatttgcgaattaatgtccgttcccggaacaatgaggttgcaccccacacgcaaggctgtttcaaaaattcgctgccaaacgtatctttgagaatcatggtcttcccagcccataattaataattcatcattaacaaaccagccacgatatttggtttgaaattcaggaagatgcaaatcaaaattcgtccatttaattgtgtctttagttacgggaagtttatccatccagtaccaaaaatcatctacacccagtatctcccttgagattgcaagggctccgtacataacaccaagcgcagtcttggctgtcaatttcacgatatcagcagatacgaatgcaatccggtaagcatcaccttctaccgttgcttgtggatcaagtatcagctcaattcggttttcatctacgtcctttgtagttactttttcaatatcccgttgtaaaatcatactggcgttttttaacaccggattcctaaaatcggatgcttttacaatcgttttttttgagataataaacgctttttcagccaattgtttctcccttctgaatatccgttactattgataacacctttaatgactactgatcatcactgtctggaacacccgcaaccacttgaaagacatcggctaacgacatattctgatcagcaaatttcttgtgtaaaattaattttctgaagtcttcaatagacatcttttcagtttgcttgaacggtaatgccgtcgactcgttctttccagcttgatttattcctgttatcaacgtgatcaccaatccatcatggctatccagtcgcacagtgtaatgttcatagtatgacggaatgtcatatgaaccgcttaattcctgatgttctttaaaatagttcgtgataaagtctttaaatgttgtttcagactttaacgcttctttccaattcgatccattttctgccataatgaagcctcctatttcagcgataaacccgatatataataaacaacatggtccgatcgctttccggattcatgccatttgtaattaaaaattgatataagctatttttgaatcgttggcttatcatttttcttccaaaaatcaatcgaatcatatttaacaccggtaagatcctcacaaaccgccttggtgtgtggatcaacatctttcatgctgccgcccttttgaagacgccctagttcctgagccagaaccttaaaagtcttcttgctcaagtggaatcgagcagcaaagaacattgccagcagaatcataaatccgacaccaccggatacgatgaaaataatcatgttggttgcactttgtggttgagaaaccgcaccacttgctgattgacggaagtgtgcaaaatcaagcaaatacccggcaacaaccgacgcaagcccttggctaatttgattgataaaggtcatcactgatgcaaacaatccggcacgattcttaccagttaccaatgtatccaagtccgggataaatggaaagacgttccaaggtgcaaagtacaaaatgtacagtccaacttcatagaatgacataccgacaatcagccagaccatcatgtgtgccggacgtgtcaaagcaacaaatgcccaattggccgcacttatcaagatcaatgagtagccaaagatataaagtgatcgataagtaaactttgtcactgcaaagccagcaataatcgttactggaattgaaacgatactcagagattgtaggaatcccgaaacactggtcgacattctcaatacgtagacgatgtaataaacgaacacagtggagaacaaaattgttgcgaaataggaacttagataaatccccatgtgtaatctgaacgtcttaattttaaaagtcgagaagtagtttttaagctctgatttaagattaggcttctgaccattattttcttccaatgcttcagcttcaagctttttggcttccttcttggtcacaaaatgttcccaagtagtgtggtaagtaatcagaatcaggaagaatgttgcaactgaaaaaataacttgcattaagatatagggttcaggtgatgacttaggaaaatacttgaataattgggcaggaacaaattgggttaacataccacctagtccggctaaaaccattcgcgtcgttgacatcttggttcgcgcattgaagtccttggtcatttcattaggcagcgtttcccaaggaatctgaagtgtcgacatcagaactgtcacaatcagagaactgtcacaatcagataagtaattaaataataccaaaagttcattccagcaacccacatcgtaattgcgatcaaaactgcgggagccgcagctaaaataaacaaatgacgccgaccgtatttccggcctattttatatttataaacattatctgaaatatttcccattatcagagaaacaatggcatctgccacacgaccaatcaggaaaatagtagctccttgaccggcacttaaaccagcaaaggtggtgtagaagaacatcaaccaagccccaaccagtccctgcatcgaaatactgaaaaatgagaaagcaccaaatccaagtgaacgccaaataccaactttgccacgactctgataaatccgcttattggcgtattcatcccagccatcgtgaacaactgattgcttattatttgtatccattatcgaagaaccctcctatagtcttagaatccgcttacacttctgattaatgccgaattttcatttgacctcaatcatctttttaaccattgcaatgagtaaacaggaaacacaccggacaatattgattaaatatagagttaataattgctgtattgaagaacctgtttacttaatggttaatcttttgtacactgataattgtaagcgatttatttcgcatgttctttgcaattcaacattcatttattgcaaaaaggaacatttaaaagataacaattcttcaccgtaattgatagcgctaccaaaaagtgtcgcttttgtcagttttcgcaacttactattgcaaaaaaggaggttttgctgatgaatattattgatatgccggcagacggcacgataaatgaggacgttgtttgtgcccacaatcaaagtcgatatcacgatacaccgtttcaccagcatagtaatcactacgaactttatttatttctagccggtaatgccaccttttggacccgtgcgtccgcttacccaatgaaacgcggctatttggttgccatccccaacggtcattggcatagagccgtcactaacgatgacagtctgtatgaacgcatctttttaaatattcggactaatctcgtaaaggatttttcaacctttgataccgacttatcaacgtgtttcaaggttgacaaatcaaaagaaatcaacattcttaagttgaatgaaacagatttgtctgagtttgtttcactttgcgataaattaattgcagtgcttgatcagccaactgctttcggaaatgatatccgggaacgaattttactgtcagatattctcctattaattaatcaggtagacaatatcacgaaccaaccccaaaacattattccagcattgctgcaaaatatgattcgattcattgatactaatttagctaacgatttaagtttatcggcgattagtcagcatttttatttaaatcaaagttatcttaaccgctatttcaaacgatacatgggcttatcgattcataaatacatcagtgaaagtcgaatcaaccaagcaaagatactactgaaagctggaaaatcagtcacagacgcctgtaatcaatgcggttttggaaactatagtaattttattagggcgtttacaagatatgttggcatatcaccaggcaaatataaaaaataactatattcctgaatgcaaaaaagatcgaccgacaatttaaacttgtcaatcgatctttttgttaaggagaatgagatcagtcattaatatttaataactgtaaagttggtattgctacaccgaaaagagtcatcagtttgacgccaatgtgagaagtccggtgtcgcagacgagttattctcaaaacaatacaaaaatatcatgttaaggttttatcatcaatccactattcaggatctgttgccacaagaccaccagccaaattacctaaatctggtttgtctgttttaacgattaattgttcgttaacaaatgccatttgaccaatgtggctcatttcacggccatagcctgacaacttgacaccaccaaatggtaattcaggtaaggttgccatgaagttgttaacaaagaccattccggtttcgatttgaccggcaacttctgcaccgtgatcggcgtcacctgaaaatacgatgccacctaagccgtaaggagaatcattagcaatatcaattgcttcttgttcactatgaaccttataaacagaagcaattgggccaaacaattcagtcttaaatgctggattatctttatcgatatcagtcaaaattgttggcatgaagaattggcctggtaagtcaatatgttcattaccataagcaacttttgcaccgtgagcaatcgcatcatcaagttggctttgcagtttatttttagctttttcagtattcattggtgctaaagtcgttgcaggatccattggatcacccggcttaacagcagcaaaatgtttcttcaatgaatccaagaactcgtcatagacgttgtccataacaatgaatcgtttggaagaggtacatacttgtccacagttataaagacgtgcacgccatgcaatgtcattaaccgcatccatgtcagcatcacctaaaacaacaaatggatccataccgccaagttccattgtgtttttcttgaggttctttccggcagcaccggcaacagctgtcccaccacgttcagaaccggttaaagcaacgccttggacacgagggtcttcaattgcttctgtaacttgatcatatgataagaacaaattagtcaatgaaccctttggagcacctgcttcagctacaacatcggcaaacatctgagcagatgttggtgtattagcagcatgcttcagaatcataggattacctaccataaagtttggtgcaaatacacgcataatctgataataagggaagttccaaggctcgaccatcataatcacaccggttgattgatgacgaatttccgcctcaccggtcgcaatggtatcaatcttttcggatttcaataagtcttcaccatgatcggcaaaccagtcagcaataattgcaaccagttcaacttcaccctttgattcacggtaaagttttcccatatctaccgtacaagcttttgctaattcatccgaatgttcacgtaactttgccgcaacattatgaagaatcttagcacgctctgaaatcggttgcttacgcattgtcttgtataagtcatgtcccgttgcaagtgcttcctgcaattgatcttctgttgcattaggatattcctttacgacttcattgttgtaaggattaacagttttgtatgccataatatgcttcctcctaaatatagacttctcaaacgtctcacaatctcagacagtcacccatgcataggtttaactgtctatgtattatcatgtgataaacatttatgcgtctattagaagaatagcacactttgaaagtggttacaataaattactttgtgatttacaaaagtgagtacatagtcaactatagcttaaaatatttcgtgtaaatattttacattcacaaaataaaagcaactaaaaaagcacagtatcaatactgtgcccttgaaaattattcattattttataattttatccagttttggaaataattatcttgcctctgcgacccgttcggcagtcgtatccttaatcatcattgccaaccccattgcggcaatttccatgaccaagaatgttgcaaatactgcattaaagttaccatttccaagaataaccgttgctaacacaattgcagtagatccaagaatctgtcggaaagttgcaataatcgaagagccgtggggaattaactcatttgttaatgaattggctcctaatgtcgtcgcaggcatcattgcaaacgcatttccggcttcaattatcattgaacaaataatggcaacccaaacgctctttaaaccagagagaatcagtagcatcccccagccgacaataaacaagccaaagccaattgtaataaccggtttgaaccctatcctatcggccaattgaccacttctgcgattcagccatgaaagaagagcagcggccgggaccaatgccattcctgaccaaaacggtgtcattctaagagcttgttgataataaagcggcatgataatcgtcactgtaattaaagacatgtaagaaagtgaagtcagtgcaactcccaagtcaaaattgccaatctttaaaatgtccaagcgcaataagggctctggcattctcaactgacggcgaacaaatagatacagcagaatcattgaaacacccaaaataatccaattaagataacttccacttgtcatatgagaaatttcgttaataaaatacaacaatccaataattcccaatgacataaagactgaaataaaatcaaagttggttgattttaattttaatgggcttacaaccgttttcaaagccagtatgaaaacaaccgacaatacaaccaagaagaaagcaaagattgcctgccaattcatcacttgtaaaataactcccgagataatcgggccaacagcaagtgctgatcccataaccagtccaactgttcccatgacactacctcgtttattttgtggtgtaatctccaaaataatggactggtatgaaggaaaaagtaccccgacactaaacccttccattaatcgcccaaccatcattattgggaaattcggtgcaaaaataacaattaacgttccaaccacaaaattaactaataaagtaagatacaatggtttgaatttaaagttatccatcaaccatggtgacagcggcattactacggacatgatcaacataaatcctgtcgttaaccaagccaccgtgctggccggcaaattaaaataccgcataaatgttggataagccgtcgaaagcgatgattgactaatcgacatcgtaaacgtacctaatagtaacgttgctacaaaccattttcggctcttttctgtaagttccatctaaatccatcccctagtatctacggtaaaatatgtaaaagggagccggtacaaatattaattgcacttagctcccttcagttttatcgtatattcaattcatttcaattgtattcttgaaagtaacgagttgcatcaatttagttctaacgaacaaccattactgaaattggtgcatattttgccatataggctgcctgtgatccaaaatactttcgaacaccctttttcgaaagtgaaccaacaatgagtaagtcggccttaacagcaggaatcacctttttaacgattgtttcgccgggatctccctcttcgacaaccgtatcaacagtcttaacaccggaacgtagtgctaaatctcgatattcctttagatgggcaactaattcttttcgctcaccatgaacataatctttgcttagcgcctgataaacattcatttcttcattttcaagaattgaagcgatgaccaacgatgcacccgacagacgagcttcagaaactgcatacctaaaagctaattgagcatcaggtgagtcatcaacacctactaaaattcgtttaaattttgtgtgtggagaattctcattatccatttgatgtataccctccgataactttaaagttaattttcactcttactttcatcataatgctcttcggtcgtttcaaaccgttttggcatcttgtttctgcttgaccacatatcataaatggtccaaataagaagtaagataatgccggcaataataacgtaagcaatcgtatgagctaatgataactcacttgcagaaggattgttaccaaagaaactggcaatattatccggaagtcctttcatgtttaagaaagttaaacctaaaacagaaatccagccaagaatcttaacccacattgtatttttaaaccggtctcccatttccttaggattatcagtcatcattaacaatggcagcattgagaagggcagtgcaaaggctaagaagacttgagagttattcatcagtgtgtttaaggcctcatgttgttgaatagccgtttgaccacttgtcatggcaacacaaatcagaacaggaataactgaaatcaaacgggttaccaatcgacgaagccaaagaggcatcttcatatgaataaacccttccatgataacctgaccagttaaggtaccggtaatagttgaattttggcctgaagccaacaatgcaacagcgaataggactgacaagataccggattttgcaacggcaatcagtaaaccattacttaacattgaactattggacaaagcttggaacaatccaaagaatgatggatccttcacagcgcctgtcttaaataccgcaacacccataattaacagtaatgaattgacaacaaaggcaaatgataattgaatgttggaatcccatgttgtgaaacgaactgttcgggcaacatcttcctgatcgctgtgatcaacttttcgtgtttgagaaacagcagaatgcaggtacaaattatggggcataaccgtggcaccaataattccaagagcaccggtcaaaggtgttgatccgttaacgtgatccgtgccggaaaatgtttgaccggttggaatcaagcctttaaaaatagcaccgaaatccggattggaaagtgcaacttcatacacgaagatgaaaagaataaccaaaatcaagcaaacaacgattgcttcgatttttctaaaaccaaccttggttaataatagcaaaagcaaaacgtcaaaaaccgttataaatacggcataaacaagtggtatgtggaatagaagataaagggcaatcgcagcaccaataacttccgcaatatcagtcgccataatagctaattcagttaatatccataaaacatacccaagcgttttactggttctggctcgaattgcctgggccaaatccatctgtgacacaatacccagtttagccgccatgtattgaagcaacatcgcaattaaactcgacattaagataacagacatgagtaggtactcgaaattttgaccaccagtaattgaagttgaccagttaccgggatccatatatccaacggcaactaatgcaccaggccccgaatacataaacaacgttttccagaatcctcggcccttcggaacttcaattgttccgttaatttcttccaatgaaggtccatttgcatagtgaatcaaatgttgcttcttcggagctttatcttttaccatttttcataggtacctccttttaatttcaaatccaatactaccataatctaatctaaagtaaatatgaatttaggagcacctaacttaataattgtaagtgtgtaaaacaggattcgttaattaacgctgatgaaaccgcttatcatattagtaaaaaaatagtcaaaaaatttagtgcttacttaatttcactctcgcatttgattaacgttacgcaaaaaatcgttaattgtttttaactcatctttcgaaaaatccatagccaattgttggattttctgattcattttttgatggtactccatgtgaagccggtttgctttcttgccatcgtcggttaagctaacgtacgtatctttacgattatcaggcttatgtttttttatgatcaggtttactttggataattttgcaatgatcttcgaaacggctccctgggttaaaggcaatttagaaacaatttccgagattctaacatcctcctgaccaatggcttgaatgacatgtaaatcgtttattgtcacgtttttgatcacaggctccggcaaaacgtttgagtctttaatgactgttaaaatccgttgatcaacatccttgctgcgaaaaatggttaattcattttgaatatcgttaagtagcttttgctttttcatttttaaattcctcggaatgtatttgacattttatttttaatgcttatactgattatattccttggaatgaaaaataaaaagtgaaacttacacgtgttaataaagaaggttattaaacaatgaaaacagttattattttcgaccatccctataccttggcggctagtgataatcaaccccattttcgcagctatagtgcggcactggccaaagcgacaatcaatcgcttaaaagaaatgaatcaggaagtcgatgtgattgatttgcacgcagatcattttgatcccgtcatgcaccaaaacgacctttccaattggcgcaaaaaacaatccatcaattctcaggtggatcaatactttgaacgattatcatcggccgaccatcttatttttatctttccgatctggtgggaagttatgccggccatgactaaggggtttattgataaggttttcagtaaaaatcggctagtatccgcccatccccgcattgttttaccgaagaatccaacaattaaattttttactgtctccggcactccgacaatactataccgtttgaaatatggaaacccgattgaaaaggccctctcacggggtacctttaaaaagctcggtttaaagaaggttaattggtataactttaatgcggaggatcaatctgcagcaaagcgggaaaaggcattgaaaacaatcggaaagtatttgtaattcctgttatgattaggttaaagattttagaaagaagcgacaaacattatttttaaaagggacctgttcatacttgctggttttgcaatgatgaccatcaattctgtcaatcagtcccaggtttatgctaaatcccgatccattcacggtacccctgttcaactccacgggacttcaaacacgtttgatcttggtggcattaaagccaaaaatggcatgactatcaaaccaaatagactgattcgttctgattcactttctaagctcacttacaaagacaaatggcgcttggataagcaaagtcactttacgggttgtgattgattttcgctctaccgctgaaatgcatcaaatgcctgataaagagctgtcatatgccgtcattcatcatcttagcgtcatggccgatccccgttttggtgtgcacagcccaaaacaatacgctgttcagttagctcacagacagccaaataatatgcagctgttttataaaaaaatggtgaccaatcgtcacagcatcaaaacctatcaaaaaatgttcaaattgttgttaaacaaccgttcaggcgccgtgctttaccactgtactcacggaaaagatcgaacaggaattgcaacaatgttaatcctatccagtttaggagtccccaaaaaggcaatttttcagaactatcttcaatcaaatcaagcattaaggtcctttaataagattgaacagcatcaaataaaaagaataacgcataaccgtcgcacactactaaacctaaaacgttcccaaatggcaagcagatcgtatttaagagccgcttattcagcaattgatcatcaatcgggctcagttaaaaactatttgaaacacaaaatgaaattatcaaacagtgctatttcaactttgcgcaaagactatttaacaaaacaccagccttagtttttatctttcgaggaacgaccaaggctgatgtttttatttagttttatattgattttgataccgctcaattctcgaaatcagcttttgattaccgttaaatttggcaaaggcgtaagcgtctcgaattgtttcattgatgatagcctgtttaacatgttgtccctcaaaattacgggcaagtcgaaactgggcccgagccacgtaaaaagtgacgtgtcgctttgaactcatatgaattaaagattgcaacagcatatttccggtcacaaaatcttctcgatacgaataatagttgccggtgtaaaacaacattgttagtgttttccaaatatcatccacgccatacatccgttgattttgaagctgttgaggcatctttgagaaataaaaatctgcccgctcaaaatttttcccatgctcgtaagcaattcccagaccaacatacgccaattgagaaaagattgtctgatgttcttcatctaacccatttaaaatctgatcaaaacaaaaaacggcatcgcttgtcggataatcactaagtgcaaataaatatcccttaataaacaaatattccatttttgtatcatcgtcatccatttgatccattgaaatatcagagagtgttgctgcaacatcttcatattccatcgtgattaaattaaactccgcctgatgaagtttctccaacaatttggaatcccgatcaacagggccaggaaagatatcactcagcgatagtcctagtctttggcatagttgagttaaaatttttgttgaaatcatcttcccaccattttcaaacttactaatggttgcctgcgtacagatcccttttgccagttcgctttgagaaaagccaagctcttttcttcgggcaataaacttttgaatattcataacgaatcctttccaaatatgctcttccatgcgttctttaagttgaattcagtttacttaaattttgataatatatcaagtttttatatatcatgtcgtatgtttttggaatatcaataatcacttcagtttgttggtttaattccttactagcatatttattcttacttaacctcgcctaaacatagtctgcttatgagatattcattaaagtagccgccctgttctcaccgttttttcacttttcttctcaaaaacggttgacttccaccacggaattaggtatattgatgacaacaaaatttcggaggtgtcattatgaatcaatcaatgtttaatgtgattaattgttgctgtcgaacaacgcgtttttggcgatgttcggcctgttagcattgacattttttgaggaataatgaccttaaagagttcaatgtccacttggctggagttgaactaagggcgcgaaaattctggatttcagaatttcgcgccctttttatatcaaaaaagtcatccttcctaaaaccgacaggcaaacaatcgtatcatcattcagaaaggaactcaccatgataatcaattcggtttcacaacttatcgggcacacaccattaattgatcttcaaatcgatgtgcctaaccacagccatatttatgccaaactggaaatgtttaatccgggcggcagcatcaaagaccgcctcggccagtatatgattcaggatgccattaaccagggcaatgtcactgagggactaaccaccattatcgaacctactgccggtaataccggtatcggtgttgcccttgccgcacaacaacatcacttgccaaccatcctagtcgtaccggaaaagtttagttttgaaaagcaacaattgatgaaagcacttggagcaaagctcatcaacacccccagtaatcagggtatcaagggtgctattcaaagggcttataaactccaagaacaaacaccaaatagttttgttccaatgcagtttgagaatcctgcaaaccccgacacctactaccacacactggctccggagttgatcgaagacattgacggcccgatcgacgcattcgttgccggtgcaggcagtggtggtacctttgccggaattgctcgttatttaaaagaacaaaatgacaacacccaaaccgttgttgtcgaaccggaaggatccattttaaacggtgggccagctcattcccatcgaacagaaggcatcggtgtagaatttgtcccgccattctttgagaaagttcaaatcgaccaaactttaacaattcctgattcagatgcttttaaccaagttaaagaaatggctcaacaccaaggcttattcattggcagttccagtggagccgcattagcagcaagcttaaaagtagcttctcaattgcccgaaaacagcacgattgtcactgttttcccagatagcagcgagcgttatatgagtgaaaatatttacgattaaaaataaaaaaatagaaaacagaaagaggtaactcattatggaatttgatacaaaattaattcatggcggcatcagcgaagacgaaaacacaggcgcagtttcagttccgatttacatggcatcaactttccaccaacaaaaaatcggtgagaacaaatacgaatattcccggtcaggcaaccctactcgggaagcggttgaaaaattaattgccgaactcgaaagcggcacagcaggattcgcttttgcctcaggctcagcagcaatcgacacagtcttctcaatgttctctgcaggagaccatttcgttatcggtaacgatgtctatggtggtacctttcgattaattgacgctgttttaaaacgatttggcatgacgtttacagtcgttgacacgcgtgatttaaacgccgttgaacaggctattacacctgataccaaagctatttacctggaaaccccaacaaatcctttgctgagggtcactgatatccaagcagttgccaacattgcgaaggagcatggcatcttaagcatcattgataacacgttctcctcaccgtacgtacaacgaccacttgagcaaggcgttgatatcgtccttcacagtgcctctaaatatttgggaggtcacagtgacgtgattgccggtttggtcgtcaccaaagatgaaaaattaggtgaaaaaatcggttatttgcaaaatgctattggtggcattttggcaccacaagaaagctggttgcttcaacgcggcatcaaaacactctccttgcgaatgcgtgctcatttggctaacgcggaagcagttttcaattacctttccaatcaaccacttgtaagcaaaatttactatccgggagatcccgacaaccccgattatgaagttgccaagaaacaaatgcacggctttggtgccatgatttcgtttgaacttcaagacggccttgatccaaaacaattcgttgaacagcttcacgtgatcactttggctgaaagcttgggtgcccttgagagcttaattgaaattcctgccctaatgactcatggttcgatcccacgtgatatccgactgaaaaacggtatcaaagatgaattgattcgcctttccgttggcgttgaagatcaaaaagacctgttggccgatttggaacgcggattcaaccagcttaaggggagaaaaaataatgtttcaaacagcaaggtccattctgaagcgtgatccggcagcccatagtcttttagaagtccttttaacctatcccggaattcgcgcactattctggtatcgaatggcgcactttcttgcctttcatcggctttatacacttgccggattgttgagccaacatgctgctaaggtcaccggtatcaccatttctccagaagcccaaatcggtaaacgtgtctttatcgatcatggaacaggcgttgtgattggtgcaactgcaatcatcgaagacgacgtcacaatcctgcatggtgtcacgttgggagccagaagagctgttgaaggccgacggcatccctatgtcaaacgaggagctttcattggtgccaacgcccaactattaggtgcaattacgattggttcttcaagcaagatcggtgccggcgcaattgtcttaaaagatgttgctgatcaaacaactgttgtcggcaatcctgccagaagagtcaaaaagcctgaagcaaaggtcatcagtgtcacttttacagaattaaatgcaggaactaaacataagtaaaaacaaaagcatcttgaaaattttctatttgggagtagaaaatcttcaagatgttttttcgtaactaatttatagaggcaactgctcaattaacctcggtcttttgaggggcttcttcaattaattgtgccacatactcgccaaacccactggtgctcaaaactgttgcatcaggcgttttagcaaaatcaaccgttacatgatgcgacttaattgcccgtttaatcccaattcgaatcaaattggaaacatcatcccaacccagatagtcaaacatcattgcaccagataaaatgattgaagtcgggttcaacttattttgcccggcaaattgaggtgccgttccgtgggttgcttcaaaaatggcatgaccggtttgataattaatgttcccaccaggtgcaatgccaataccgccaacttgggctgccagggcatctgaaatataatcaccgtttaggttcattgtcgcaaccacttcaaaatgctctggatagagtaatgcctgttggaaaaaattatcagtgatgacatcatttacaatcagtttttgttcgtctcgcgcagtttgataagcctggtcagcagctttttctccctgatccgctttgatttgattgtattgattccaagtaaaaactttgtctccgtacttttcagcagcctcatatccccactttttaaaaccaccctcggtttttttcataatattacccttatgaaccaaagtcagggtatggcgattgtttgcaaacgcatagtcaatagctgcatcaacaagccgtgttgaaccctgctttgaaattggcttaattgcgaaggcagacgtgtcaggaaaacgaactttgcttaatttatcctgtttggcaagtagacttttccattcctcagcgtctttagtgtcaacatcactttcaattccagcgtaaatatcttccgtattttctctgaaaacatcaatattaacgttctccggatgaacaaccggagatggtgtgcccggataataggtgaccggtcgaaaacaagcatacaaatccaatttctggcgtaacgtcacattaattgaacgatggccgacaccaatcggtgttgttagcgggcccttaatgccaaccaagtattcccgtagtgttgccaatgtcttatccggcaaccactgaccggttttcttataggctgtctccccagccaataacggtaaccagttaacctgcttttgaccgtcatatgctttcttgacagccgcatcaaacaccgttttagctgctttccaaatttcgggaccaatgccatccccctcaataaagggaatcgttgggttgtttgggacttgaagctgaccattgttcattgtcaatttttcttcagtcaattgagttttcctccttatcggcgaggtaatgccgatttgtcttaccaacgtactcagacgatggtctaatcaggcatccctccgcctgttgttcgataatatgagccaaccaccccgctgttcgacatgcggcaaacatcgttgtgaaggtctgcctatcgagattaaaacaatgataaatcaacgccgtatagtaatcaacgtttggatggagatgcgttttttcgaacatatagtctctaatctgttcttgtaaaacaaaatagggatcattgcccgtttcatgagcaattttacgggcaatttcccgcaatatggctgcccgtggatcaccatctttgtatactcgatgtccaaatcccataattttatgtccactggtaattcgtcgttcaacgtattgaaccgggtcctgtcccgtttcacgaatggtttcaagcattttaaaaacctgttcgttagcgccgccgtgaagaggcccctttaatgcgcaaacggctgcagttagacacgaatagtaatctgattttgtagacgcaacaacccgggcagtgaacgttgatgcattaaattcgtgatcggcatgaagaaccataaccgtattaaacattgaaacctgttcagctgttggccgtttccctgaaaataaatagataaagttttcaacaacgccccaattcttacgagcatgtttaatgggtttatcgtttctgattcgaataattgctgcgatagccgttaacatttttgctaaaatgcgcggcggatcatcgcgttcaacatcattagttgttccaagaagtgaaaccgtcgttctcaaaatgctcattggatgttgcggttcccttgcaatccgggccattaattgaacggtttcatagggtaatgccatttgtgaaaccagtagtttcctaaaatcttttaattcatcagcatttggtaatcgtgtatgccacagcaggaaaacaacctcttcaaacggcgcgtttttcaattccttaatcggatatcctgcatatgtcaaaatggcatttttggttgaactgaccttggtctgatcaacaacaacaccagctaatccttttggtaattccatttagtcacctctgagcatcaaaactcatccattgcttgtcgtacttttggtagttgccttattagaaacaatcatcggcataatgccgccatctttgtaatacgtccaatctaccggtgtatcaaagcgaatgatcgtatcaaattttatttgcccgccatccttttttgcagttacatgtgccactttgccatccaagtcaatcgagaaggtttcggtaccgtctaatcccaacgactctgcggtttgaccaggctggtattgaagtggcacgacacccatcatcgctaaattggcacggtgaatgcgttcgaagctttccgcaatgattgctttgacacccaacagtttgacacctttggcagcccaatcacgagaagaacccataccataatccttaccggccaataccactaatcccgtatgatcagcctgatactgttgtgccgcttcaaaaatggtggtttcttcatttgttggtaaatatcgggtaaacccacctgtcttatcaggcgttaattgatttctcaatcggatatttgccaaagtcccacgcatcataacttcatgatttccacgacgggaaccataggaattgaagtctttaattgcaattcccttggatttcaaataccgcccggcaggtgtttgtgacccaatgtagccagctggagaaatgtgatcggttgtaatcgaatcacccagcttggcaagtacccgaaggccggttaagtgtttacttcctgcttcattatcaaaaaatggtggagacgcaatgtaagttgaatcgtcatcccactgatacgtttccgattccggtgcaggcagtgcatcccaggtcgcattttgattcaaaattgattggtagttcttttggaattcttttggtttcaaatatttttgactaagttgtgccacttccacatcttttggccataaatctttcaaataaaccgggctgccattcttggaagtcccgacgggttgtgttgtgagatcaatatcacaagttcctgccagcgcatagataacaacgagaggtggtgaggccaaataagtatccttaatgagtgggttgacccgcccttcaaagttccggttaccactttcaaccgctgcaatcggataaggatcctttgtcagacgagtctggagatcctcttttaactgacctgaatttccaatacaggtcgtacaaccatatccaaccaaattaaatccgagtttgtccaaataggcttgcaatcccgaagcagccaaatactgtgttaccactcgagaccccggtgccaatgatgttttgacataatcgggaacctttaggcctaattcaacagcttttttggcaattaacccggccgccaacaacacttgaggattggatgtattggtacaactggtaatagcagcaatccccagagaacctacccgaatgttgaattgcttaccaccaacttctacgggatagtcaggcatctcacgccgatcatcgaattgtttgggcatatcttttaggtagaccgtgtcctgtggtcggttaggtccagccaaactgctttgaacacttgccaaatcaagcgattcatcctcgctataatggcgaacagccttttcgttatagaaaagatgattggcttttgcataattttccaccagatcaatttgtttgtcagatcggttagtcaatttcaagtaatcaattgtttgttgatcgattgggaagaatccgcaagtagcaccatattccggtgccatattggcaatggttgcccgataggcaagtggcaaactttgtgtcccctcaccataaaattcaacaaactttccaacaacattgtgttcccgtaatagatgcgtcaatgccagagcaagatcggtggccgtaataccctcacccaatttaccagtcagtttaacgcccactactttaggcattggcatataagtcgcttctcccaacatactggactcagcttcaatgccaccgacaccccaaccgagaacacccagcccattaatcatcgttgtgtgagaatcagtacccactaatgtatccggaaaggcttcataactcccgtccgtcaactgttttgcgtggataacatctgcaagatattccaagttcacttgatgaataatcccagtatcgggtgggataaccgttagattttcaaaactattctgggcccattttaaaaatgtatagcgctcactgtttcgtttgaattcttgttgaatattataagagaaagcttcgtcatttccagagtgatcaacttggacagaatgatcaataaccaagtggaccggcacctccggattaattgagctgacattcccgcctcgcttggcaaccgcatcgcgcatcgctgccaaatcaaccaacgctgggacacccgtaaaatcttgaagaataacccgttccggctgatgaggaatatccttgtcatgctggtgatcccagtcattgaatgccgaaagaacctgttctcgttcaggttcccgatcagcatgtcgcaatgcttcttccagcaaaatccgaatgctgtagggaagcgtttcaacatcttgcccatgatccctcaaatatgcgtcaatattgtaaaaccggtatgaaccgcccgataaattgagttgttgccggtacgatttgttcataaaaagatccaccgtccttcgtaggtgtcaacgaatcattaatttcttcaattataaaagccgaatatttttcagtttccccaattaaattgttaacaactcatcttattttaatgttaatttcatgtatatttaatctaaccgcaagaatggactgtgtcaaggttgatttgtattattatgtacgtttaagtgttgaaatgaaaagaaatccattattgtgaattcggttttaaattggcatataaaaccaaaaaggcatctagaccaattaacgatccagatacctatcaagtcacttttaatttttttcaatgccaggctactttttatgaaaaaggatcactatttctaagttcataccattctgaaattacggatgatatccatcaactgaaaaataccaatgaactttatcaccggctttaatttttttgtcaccagcagatttatcaacgtatttgccgttaaccgagtacatccaaccactgccaaccttgacatcattttctttcaagccgttaatagcactgacataaatggccgggttgctggtataagtgaccttcaagcgggttttcattagcaacgaaaaagccgttgatttaccggtgattttttgaactccggcatacaattgtttcttataacccgaaactttgatatatgctttaccgaccgtcgccgcttgagtcaccttagcagttttgtgatgaccaccagtcgacgcttttgcctgcttttgctttgaagtgggacgcttggctactggtgattttgcagatgaaggacgagttgttttaaccgaaacccgatttttatcaacatgatgcctatttgaagaagccgtccttgttccactgaccttgttacctgccgtctccttggctgaaagtgatttccctttagcttgcttctttttcttatctgttttcggcttagctttagtgcttgagctctgtgacttggtcgaacccgactgacgctttggctgacttgaagaacggttaagctgtgctgttctagactgattctgtgcatgctgtgcgacaacttcacgaataccaaatgccagtccgaacactaaaacaaccgcaattaaaataccaattatctttttcattgattaaaaacagcccttataccttaattaagtgagtaaaccgagtgcttcttttgtgcttggcggtaagccgcgcttgccaagttcacctgaccgacacccaacgtttgacttgcagcgcccttaattgaaccggtcttattaacgtaacccaacattgcacgtaatggagaggcagtttgaccatctttaaaagcactattagcatatttcaaagtattccgtttcgttgaaaatgcaataatcgcttctgcggttgaattggcatttggcatattcttgccattataagtgtacccataagccccgttatcgtaaaccgcaccctttaagtagctttgacccttttgaagagcggattgaacagttgatgaaccagccttgccacgagccaaactcacaaccgccattgctgttgtgtcgctgtcaacggctgctgccgtattattataagcccaaccattattactttgttgattcttcacaatcaggttactcaagctggtcttggaaaatttagcagttgatggccgtttgaatttagaactcattgatacagcaatcagtgcttgactttgaacgttaactgtttgtttagtcatcgactttttgtaaagtgcactaaccaagttaaccttttgcttagtccctgcaagtctaaaactttgtggattatagccaatcgctttgagtcccataatggcatttgccaaatcagcaggtgtgctcttcttatttaaaactaaattcttggcaactcgttgtcgttgcgtcttcgtaaagtgataccccagtcctttaagacccaacaagaagtctgaatatcctgcagccgcaccggttgcagggtaagcctttcgactaaataatgccgttgtttttcccgataaaccagatttgttcttcacaagcattttcttagcataactgtaactcgcctttactttggtgctctgatagccggttgttgccgttttaacgctagccgcattgaccgttgcaactggtgtcacaactccaaaagttagtaagctgactgccgaaagcattaataccttcttaaaattcctcataaatccattacttcccttcgttatttgtagtaggcagaaaattatatttgtcatcaagacggctaaacaatctctgccagggttttgaaaacagtgcaagcagcactgcatttgaagcactatgataaaaatcaaacttcacgctcaaaagaaaataagccagcaccgttttaaaggttaatggatgaacatacatcattgctgaccaggcgtccattatccagccaaatatgaatccccaaacagcaccgaaaatgaccagtggcattactttcttaccgataacagtatgagcaattaatcctgctgtgaatcccatcagtccccaagcaaacatctgccagggcgtccatggcccttgaccaaagaaaagattcgaaacaagtgcggtagttgcaccaacaacaaatcccagttccggcccaagagacattgcacccataataatcacaaaactggctgcctgagcactggggatccatgcaaacgccaatctgcccacaactgccaaagcaattaggatggccataaacatcaatgtcgtcgtcttgagcttttcatgttcaaagcgccagtacaccatcaacatactgcatagtaaaatcatgaaactaaacattaaataatgtccgccacgcaacaactggaacagcgttagaaaaatgcccatgactataaatactagcgtcatccgaaaaatggtgagcttggaaatatgtcggttcacttggcaccatcctttccggctcttacatcggacactaggattgcatccggcacctgatcccttaatagtcggttaagggcggtcgtaaagaaaaagtttcccgagaaaaaacgtcggcggggcaaaattgattcaagacgaccatcaaacataaatccacagtttccggaaaaagctgcagcaaaggccatatcatgagtcgccataataattgccccacccctacgttgataactcagcaactgttcaccaattaagtgcttggtatttggatcaaggccattggtcggttcatccaaaaccaatagctgtgggttggcgatcattgcaattgccagccccaacaactgttgttgaccgccactcaggtcaaacggatttttgttttcaaggcccgttaatcgcaaattttccaacgttttttgagctctggtttcagcgtcggtgatccccagctgttttgcctgcaccatcagttctttgaatacagtctcatttccaaactgaaggctgggttcctgagataaaaacgatagtcgctttatccgttcagtcgtctgcatcttccaaacggtttttccaactaagttgattctaccatgctggggttttcgcaacccgccaattaagctcaataacgttgattttcctgagccattcttaccaacaattgtcagccactctccttggcgaatgtctaaactcaagtgatccacaacgttttgccgttcatcaaacgtaaacgacacgtttttcagtgacacaatgattgacgcctcttttggcctctcagctgtttttaaatcagaatttactgattcaaattgaagatttttagcatgaatcacccgctgaccggaactaaccgaaagaggtaattgaccggcttgtggatagttgcgtaaaaacaaagccggtatttcaggaacgaaccgctgtaattgggctttctggaacatctgtgacataacaacagccggcgtatcattgactgctatccgacgatttgaaatcagcaccattctattggccatcgtaatgggaattgccaaattatgctcggtcatcacaattgtcattcccaattcctgatggattctagataaaattgtcataaaattttgtgtcattaatggatccaactgagctgtcggctcatccagaagaataactttgggacgcagaatcattaccgatgccagattaacaatttgaagttgaccgcccgatagatcatcaactcgtttgtgcagccactgatccaacccgagataattggagagttcagctacacgtctgccgatttcttggctgggacacccgatattctccaacgaaaacgccaattcctctatgactgttgccattaccggctgattccttggattctgactgacaaagccaaccatttgggcgctttgcagttgagtgaatgttgagatgtcctgatgctgaaacgtgatatgcccgcttcgatgaccatttggcatcagttctttttttaggtgacttaataaagtcgttttgccactaccggtatctccggcaatcagtagaaaatcatccgtaaaaatttttaaattaacattttccaacgttgattcagttgcatgtggatatgtaaatgttaaatgatcaatgccaattagttcgtccataaatcagccaccttttctgaaattatcggaattaatagaaaaaggcccagcaaacaaagaatccaaccatctgctacggaaaatgaaccattgaactttaaggctgaatttgtccaaccaaatgatccagctttaaaacctatcagaaccaaaaaaacaatcagcgaacccgtcatgaaaaggctatcggaaaactgccatttaaagattctgtaatgacttcgctttgttgcgccaaatcccctcgcatccatgcttcgagctctctccattcccgaaacaagtgcaccctcaagtaagatacccaaaaaatgcatcccaacactcagccgctgtctgatcgacccattaaaaggatccacgtttctggtctgttgataaagaaccaatcgcttaaactgcaaattaaaagtattaaccaaattaattgaaagaacaaccaatagcgccaatctgggacttaccggtgaaaagacagccaacaatttattagttgttaaaatcgaattaaataatgcaaaagccattaacatttcaaccaacatcaatcccatgacactcccatagagtatagcaggaaaagaaagcttaaacgataatcctaaaatcgatgtctgccacaaatacggaccagcaccctggttcaaaaaaacattgaatacaacgattgttaaaaacattaaacaactaaacttaagttgacgctccaccttcctgatgccaagataaaaccaattcaaaaatacaattagaagaaaagcggtcagtacgatactaacatgattgaacaacagtaataatgtaatcagtcccgcaaaatatccggttgccgcaagtggatgaatatgaaaaaagaaacgtttttggatcgatatccgactcacagttttttcccctttcctgctataaccgttttagcagatcaacatctccacatttcacgataataacttaacacactttagtatatcatcgctttctatcaaaaaagatgaatttaaaggaatcgtttcttatataaaaatggcatttatttttatatagttttcaaattcagccgttaatccttaacgaccacacccaatagtccaataagtaaactggcctgccacgggttaataatcattcctttaattaattccgggttcaccacaagtgtgtcgaatttcgcttgagacaagtcaacatcctttaatttcgtatcaagaaaatcgatctgatcaatgtcactttgatcaaaaatcatttttttaatatagggcaaggaaacacgttcttttaaggacgtgatgaattgcccccttcttggcgtccaacagacgcttatcctgattaattgtcaaaaaacaccatctttctaaatttgagcgtatggtgacactttggatatgatataatggttggtatgaaagatacaaacagactaacgtatggtagaacatcggtgtacaatctgaattaccatctcatatggggaactaagtaccgccaaaaggttttaactggacatgttgaggagattttcaaacgcttggttaacgaaatcgccgatcaatacggttttgaaatcgcccatctggaaatcggtaaggatgatcatgttcaccttctagtcagcgcaccacctaaattatcagtcacaaatattgtccgctggttaaagggcattactgcttttcaactattccgtcagtgccctgagctacagactcatgattggcaacaaaaggatcgtcacttatggtcacctggttattatgttgaaagcatcggtgctgtcaatgaacaggcggtggctaaatatattgacgatcaacgcaaacgagaaaaataacaagaggaggtcttgtatgaccacggtggttaaaggggttaaactgcgcttataccctaaccaaaaacaaatcaatcaattatggcaattatttggcaacgatcggtttgtttggaatcaaatgttagcgatggctaataaacgttatgaaaataacccgaaaagtcagtttgttggcgaatacgatatgaattatctgcttaaacggtttaagcaagagtaccccttccttaaggcgagtgattctaccagcttatttgtggttaaccataacctcacgcttgcttttaataacctattccaacatcggggtggtcatccgcggttcaagtctcgccatagcgctaagcaagcctatactgggcaatcaatctgcgtcgtggaggctaagcggcgtttaagattgcctaaactcgggagtattcggaccagcaagaccagccaattagccgacgccaaaattaagcgttatacggttagtcatgatgccacgggacgctactatctttccctgcaggtcgaaaccgaagttctcgacttgccgaagactcaccaaacggtgggcttggatatgggtgtcgccgatttggcaattacctctagcggggttaagtacgggactttcaatgcccggtggctggaaaagcaagccatgctttggcaatccaagtttagccggcgcaagcagcgggccactgttgcgatgcgccaatggaatcaccgccataaattgtccaagctggaactcaacgactatcaaaattggcaacgggctaaaattaacaaagcgcgttatcaagcaaaaatcgccaaccagcgcaaggactacctgcataaactgacgacggacttagttaaaaactatgatgtgattgtgattgaggatttgaaaaccaaaaatctgatgcgcaatcaccacctagccaagtcaatcgctaacgccagttggtctcaattccggatcatgcttgaatacaagtgtgcctggtacggaaaacaattagtggtggtgagcgccaggaacacttcccgaatctgttcagcgtgcggtcagaatgacggccccaagcccttagctattcgggaatggacgtgttctgaatgccgggctcatcacgaccgagatattaatgcggcagttaatatccttaattgcggactaaaagctattggctaggaactagccatggtaaaagagcggagttctgtaagttaggtcttcggcataccgatgtaacagcctaaatactacttcgtgttcccagaagctcggtcatttatggccgagtagttcaccttgaaggtaactgcctgaaagcttgtttctaccaaatttgaactattaaactgcacattttccattttagtttcactaaagttagcgtatctcagatttgaatccgtaaatcggctattaatcagtcttgtcccaagagaaaaatcggcacccattaactggccgccgataaattgactatttgaaagatagctttgatggaaactggcattaagaaagttgcatcccttaaaaactacatcattccaatcactttgatcaaagttagactgttcaaagttgcaatggtcaaataccacatcactgatttggatagactgattggaaacgctgaacgtacaatcaatatattcgttgtcgggttcgatatcatctaatcccaacgtctgcttttgaattgttgccatactaagcctccgaatgatttcgatgggtcattttgcttaaaacggtgtagatggcagcggcaatgatcattgaaataaaagttgaaccgacactgtctgccagcaccggaatggttttaatataagcatatgctgctactgcaacagcccatgatccaatcgcaatccagttaataccgccagtgtaccagtattttccatcgcgcgcagcaaaatgttcaatatcataatcctgctttgtcacaatataataatcagcaagaaagattgcaatttcaggtcccagaaacatcccgataccatctaaaaaggcagtgaagacatccaaaaatgtcgaataaaaaatcgggatgaacgtgacgacaactgcaacaagtgtcactaacacaatactaatcgttaaagaaagtcgttttgtcatattggttaaagccgatccggctgacatcaaattgacagcattggctgttgtgctggtaataataatgaccagcatcgccaacactcccagccccaatttactggcaattgtggaaggatccgaattatttgcatcaaagtgattaagtgtaatcgccgttgcaattgttgaaatcacgccgatcattgcaaaccagatcaaaccaagattggcaccccaaaatggtgcatgagttgaactgcgtttcttttttgcaaatcgggtaaaatcactagctgcggtgacccacgccaggttaaaggcagccagcacatcaacagcttgaccagaagtcatctgtaaatcatgaggtggccgccaagaaataatttcggaaaaagaaacgtgttggaaaaccacaatacattcccaaataaccaaaataaagactaaaatgatgccgacccgctcgatgatccgaacagagcgttcccccattgaaatgcttagcaggtgaagaatgctcattacaacaataccggtaatcagcccttttaaaccgcctggcttaccatataccggccaccccaaaatatcatgaagaatgtagctaatcgaagttgcggcaataaatgtgttaaccgctgcccagccaataaattgaaccacattaataactgatggtaaaaaactgcctttcaacccaaaagatgctcgggttaaggccatagcaggtaatcctgtttgatatcccatgtagcctgacaacgctaacagtaagtatgtaatcacaccaacaataattaaagacgtcgaagcagttgcaaaaccgcatgctgcaataacgccaccgacataccatgtcccattattggcattagctcctacccaagtcgcaaacatatcccaatatgattggtgtcgatgctcctttgggatcgccacgactcgaccaaaagttttattttccattattaattcctccgactattatctccaaaaaaagaacgccccaactcacaacgagtcaaggcattccttaccagatgtattctggaagaacaatgttcattaatggcattccttaacagactcgctgggctgtatttaaaggagtagtattttactgtccttaattatacgggagcttgtatcaaaatgcaatttgattggaaactgcgtggaacaaaactgttagtgtccgaaaaaagggattgaattggaaagccccgcagttttgcgttcaggcttttgaattcaatccctcatatacagtgatacgactttataaaacgattctaatcagtgcgtggaacaaagtgaaaacaaaccattattgtgcagtatacccaccatcaactgtaaattctgctcctgttgcaaacttggattcatcagatgccagataaacacaaatccacgcgatatcgtcaggctcaccaatgtgacccattggtgtttttgttcgtgccgacattgctgcttctgctcctggtaaatcatcaacaagcggtgtcttgatatagccggggtgaacggtattgacacgaacaccataatcctttaaagcacaatcgacagcagctgacttggacataattcggacagcaccttttgaagcattgtaagcgcctaaattaggatcgccaacaaagccttcgatcgatgacatattaataatagaagcaccaaggtttttattcttcatgcgttgaattcccaaacgggtaccgaagaacacaccgtccagattaactgaaagcagcttacgccattcctctgtggtggtattctcaacactcttattaacggcaataccagcattattcacgaccgtggtgacagggccaaacgcctgctcggtttgatcccaagtttcaacccagccatcttcgtcagatgcatcctgtttaataaaacgaataacatccggaccaccaattgactttgcggctttttcaccaacatctgcatgacgaccggtaatcacaactttagcaccctcgtctacaaaacgatgagcgacagctaacccgattccaagtgtgcccccagtgacgattgcaacttttccttcaagacgattactcataatgatagcctactttcattttaaaattatttccatgtgaatcatatcacttttgggatgtatttgaaagcgtttttctataataattgataaagaataataagctttttttcaatatcaacacaccttttttatgatattcacttcatcattgcaattatattaagcatcaggaagtgtttcacatattaagaagtgtattaaaatccatgaaaataatttacgatatttcttcttgacaaattattttcttccgtctaaactgcctactattgaacctataaatgaaaaagcaatgagaagataagtactggtcccgatcgtccacagaaagtttgcctggctgaaaacaaacgtcgatccatcacgaaaatggtctttgagcaacatatagctgagcaaatgtaaagttatattggaaggtgtccattaacgcaccggaatttttatttaaagcaacgtcgtttctctttaaataaagactctcagagttggctggtgtgaatcagtcaaaaattaaggtggcaccgcgattaatcgtccttggaattattttccagggacttttttaattatcttaatgacaaggagtgtttcatcatgacagttgcatcaaaaattaagtatccgaatagatttgacattgttggcagttttttaagacctcagcaattaaaacaggccagagccgatttccaagataaaaagatcagtcgtcatgcgctgacagaagttgaaaaccgggaaatcgatcgacttgtcaaaaaagaagttaaactgggtctaacagacgttacttccggtgaatttcgccgtagttggtggcacttagactttcttgacggcctgaacggcgcgcatttctttacgccggaccacggctttatctttaatggtcaggaaacacgcaagggcggcattaagattaccgataaaatttcgtataatcctgaccaccccttctttaaggatttcaattatcttaaagaaatcgttcccgacggcattacaccaaaacaaacaattcccagcccatccgtactttttccaaataaagatgctgagatttatgacaatttctacgaccataactttgatgcctttttaaatgacgaaatcaaagcatatcaagaaacaattcaacatttttatgatcttggctgtcgctatttacaaatcgatgatacctcgtggggcatgtgggcatcattctcaaaagacaccattaatccggatttaaagccactttgtgaagccgccgttaaggcaattaacgccattgccgataataaaccagatgatttaacattaaccatgcacgtctgtcgtggaaattacgattccaactgggccggtgccggcgcgtacgatccggtagccgattatctggcacaattgcacattgacggttattttcttgaatatgacgacgaacgttccggtgggtttgagccgctgaaaaagattgcagccaacggccgaaatcaacgaatcgttttagggttggtcacaactaaaaagcccgaattagaggatcaatcgctattgatcaatcgaatcaggttagcgagtcaatatgtgccgctggaaaacctttgcctgtcacctcaatgtggatttgcttcaaccgaagaaggtaatcatcttactgaaaatgaccaatggaataaattaaaattagtcattgatactgctaaggaagtctggtctgactagcttttctaaaagacagatttataaattgattctaaaccattgacaaacattaaaagtacgtctattattatcattaaattttaatgctaatccaaaagggaaaagctctgaagagaagagtaactgattttgataaggttcaaagagaatccggttggtgaaaaaggatacctgaacagtcagcgaatatgaactctgaatagcgcaatcaagttaacgctcgattgtcggttgcaaccgttacattgcaaggtatcagaaattaagtatcttaatttttggcactttcagaggtattgcttgcgaaagtaatacgaattcagggtggtacagcgagacattcgcccctccgtcagattattctgatgtgtgggacgaatgcctttttgtttgccgtacctccgaagggattttattatttgtcagtgactgttaagatagtaactgtataaaataatttttaaggagatttgatattttatggcaaaagttgaaagttttacattagatcacacaaaggttaaagcaccttacgttcgtctcatcactgaagaaactggaaaaaagggcgacgtcatttctaattatgacttgcgacttgttcaacctaacaccaacgccattcctactgcaggtttgcatacgattgaacatctcttggctggtttacttagagatcgtcttgacggtgtcatcgattgctcaccattcggatgccgtaccggattccatttgattacttggggcgaacacagcacaactgaagttgctaaggccttaaaaggctcattagaagctatcgccaacgacatcgaatggaaagacgttcagggtactgacaagtatagttgcggaaattaccgtgaccactctttgttctccgctaaggaatggagcaaggaaatcttgtcacaaggtatctcagacaagccttttgaacgtcatgttatctagtttctgaagcacacattaacgatattttaaaaaccgcaataatctgataaatagattattgcggttttttctttttcagggctcctgttggattggcaatcgccccgacttcaaaatctagttgggaagtactggttttattatttgaggaggattttatttatgacaacaacaattattggatttccaagaatcggccatcaccgagaattaaaattcgcaactgaacattattggaaaaacaagattaaccaagaagcattgcaacaaactgcttatgaaatcagaaaaaaccactggcaggcacaacaggatgccggtattgacttaatccccgtaggcgacttttcgttttttgatggtgttttagatacggcaaacctgctgaacatcgtcccttcccgatacaaagaacttaacttatcagaattggatgaatactttgctcaagctcgcggctatcagaaaggcagcgagacagtcaaagctttaccaatgaaaaaatggttcaataccaattaccactacattgtcccagaatttacaaaggatactgatattaaattagttggcaataagcttttcaacgaagttaacgaggcacttgaattgggtgtcaacgccaaagccgttatcactggaccttatacgcttctcaagttaagtcgtttccttgatggtactaaaccgcgcgattacgttgacagcttgatcactgcttacaaacaggttatcgcccgtttaggagaaaaaggcgttaagtgggttcaaattgacgaaccagctttaagttttgacgttaatactgctgaaaagagtctctttgacgacttatatgacggcatcttagctgataaacgatcaactaaaattctccttcaaaattactttggcgatattcgcgacatttacaatgatgtcgtttcaaaagattttgacggtatcggtttggattttgttgaaggtaaatacaataacaagttacttcaacaaaacggtttccccgctgataaagtattatttgcaggtgttgttaatggtaaaaatatctggcgaaaccattacgaaaataccattaagttcttaaatcagcttaataccaaagctgatgttgtcctcagcagttcaacatcccttcttcatgtaccatatacagcagaagatgaaaccaaattaccctcagatgtcaaacaacatttggcatttgcccttcaaaaactggatgaaattaaagaactcgataatatttatcacgatgaggcagatggtaaggctgctttggaaaagaacgatgagttgttccgcagtgttaaacaccctgtcaactcagctgtccatgatcgcatcgccagcctaaccgatgccgactatacccgcttaccatctcgggctgatcgtgagaaggtccaaaagaaagaatttaacttacctgtcttaccaacaacaaccattggctccttcccacaaactaaggacgttcgccaaaaccgttccaagttgcgcaagggagaaattacccgcgaacaatacgataaattcaacgaagacaagattgttcgaatcctcagaaagcaagaagagatcggccttgatgttcttgtccacggcgaatacgaacgtaatgacatggttgaatacttcggcgaaaagctcgacggcttcgtctttactcagaatggctgggttcaatcttacggtacccgtggcgttaagccgccaatcatctggggtgatatttcaagaactgcaccaatcaccgttaaagcttctgtttttgccaaaaatcataccgacaaattaattaaaggtatgctgacaggccctgttacaatttttaactggtcattcccacgtgaagacgtcaccgctaaagaatccgtcacccaaattgcgcttgcacttcaagatgaagttttggatcttgaaaaacatgatattaagatcattcagattgacgaaccggctttacgtgaaaaccttcctttgcgtaaatccaattggtactctgaataccttgactgggctgttccggcattccgtctggttcacagtaaggttcaagcttctacccagattcatacccatatgtgctacagtgaatttggcgacattatcaaagccattgatgacttggacgccgacgttatttcctttgaagcatcccgtgccgatttcaccttaattgatcaattggttgctgccaacttccagaccgaagtcggtcctggtgtttacgatattcattcaccacgaatcccttcagaacaagaagttgaagacttgatcaaacaattagtccacaaattgccaattgataagatttggatcaatcccgactgtggtttgaagacccggactgaggaagaatccttcaagagcttgcagaacattgttgacgcaacgaagaaagtaagaagtgagattaatgagcctaacagcgttatttaacgacaaaaccgtcttttcactggaagtctttccacctaagaaagactcccccaaagaagccattctgccaacgctacaacagttacaatcaattaatccggatttcatttcggtaacgttgggtgcgggcggttccgatcattatacaggaacggtttcaattgccgatttaattcaaaaccaattaaatatcccggcagtcgcccacgttccaggattatatcaaactgaaagccaagtgcttaacctgttggatcatctttctgaaatcaacgttaaaaatattttagcgctgcgtggtgataagattcccggtaaggaaccggttggcgtttttaatcacgccaatgaattggtttcgtttgtccataagaatcgtccagactttagtattgccagtgcctgttatccggattgtcacgctgaagcaaatggatttatagatgatatcgcacatttgaaagaaaaggtcgatgcgggtgccgaccacttaatcagccaactgttttttgataatcaatcattttatgatttcaaagaaaagactgagattgccgggatcaatgtaccgattgaagccggaattatgccttgtaccaataaaaaacagattgaacgaattacccaaattacgggggttccacttccaaagaaattcagtgccattcttgatcgctatcaagatagtaaacaggcaatgaaagatgctggaattgcctttgcggttgatcaaattatcgatttggtttccgaaggtgttgacggcattcatctttatacaatgaatcacgctgacattgccgaacgaatttgggatgcaaccaaatcagtgtttgaagccgctaatcagaagaaaactgaaaaggcgagtaatcattaataagtaaaataaaaaccactacacaagctgaccaatttgaggtttggactgttgtagtggtttttattttaattaaagcgatattattttattcaaaactgaccgccggatggtcaaaactgacatactgcgtctttgttgtcgctcctaaatatttttcaatgttttcggtcagctcagtcatagcatgctcatgggtttcccgccattccggtttcagacactccgagtacatgagaatactatttgaatcttcggtagtttcaaccctctttgcatcacgccaagcccagcaacgactcgtaacggcctcatcgtctcggtaaatcacttcgccgggaagtgcaggatcaggttgatcttcaccaatcgccgtgaatgattcgccacccttggcgacttccaaactgatgccacccttaattttatccagatcaagcgcaccaattggaaagcctgtccgaagtgagatggcattgtagagatcaaccagtggatcaatacttctaaccggattccccttcttcgcccgttttaataaattctccacagcaaaacgggcaccttttttagtcttgaactttttaaacgcctgccgccactcatgtatcaatggattggcactgatcggctcatccggaatcaaatctgccacgccggcatttgcctcgtcaagcatcttcggcggcacctgccctttctcatgattatccaagttgtgaacggtgataacagcgattttaacgtcgggaaagagattccaaaaactgggttgcacgataaattgactcattgttcttccaccttatctgattgaccattctcgttaacaaattctacaaaaagtataatctttattaccaagcttatcaatgaaactaataatacgcacgcatttgcagttaatctcttcttctctgtttatgtacccaatctaccggctaatgccgtttcttcattaaccaataaccccttccgactttcaagcgcaattaaaaagtcagagggggttaagttaaataaataggtgtagaaactaacttgcatggctgcgcaaatactttgttgcgataacaagagcaatcaaagttgctgccagtcccgacgtatagtacatatttcttctaaacatgataagcttcctttcttgtatataacgacaccctagacactcttttacgatggaatctatctatatataggcgaatccatttaacaaaaaatatcggggtgttaaagtcttttaactattaatcggtttcagctcactggctgttattaaccgttcttataataaagtcacccaattcccctttccttttcgaattattcatagattacaggcaccaacttaaccgaagcttaaatcgtctatcgatttttaaaaacagcaatttctttataaaatcacaactttctataagcgaagcaaaaaaagcgaagcaaccgatagtttccccgtcactttgcttcatcatttaacatacattaatcatactggcgcataaaggccgataatcgctttaacccttctcttaatgtcgactcatccgcacaatagcccagacgaacgtggcccggcatatcaaaacgagtccctggtaccaacaggacgccttgttccttcaagaggcggatacagaaagtttcaatatcttccggtatatccagcttgggaaacgacgtggaaacagcttggggcatcacaacgctggcccggggttcggaagcgacccaatccttataaattttgagattattaagcaccagtttccgatttcgattcagaacccgatcccgatgtttgagaatatagacggccatagcgtcattaaagaccccacaacaaatcattgtataatcccgatacttccgaaacagatcagccactgccgcatttgatgccgtccaccccactcgaataccgggcatcgaatatgttttagacagggagttggtcgcaatccctttatcatatagatcaacaatcgacacaaattcttcggaatggaccagtggtagataaacctcgtctaccaaaacataggcaccggattgtttcgccagttcaacaacttgttttagaaaagtctcatccagcaaggtcccggttgggttgttggcattattcagacagatcattttggtatccggtcgcatcaatgattttaattcatcaatatcgggataccaattttgatcttcgtgaatatgccagtaatcaacgtgggcgcctaatgatttgggaatatcatataactgctgataggaaggatattcggaaataatatggtctcccggttcaatcaatgcatataaagccaagtgattggcacccgttgccccattagtctgcaaaatgttatccggactaatgtcctgatataattttgatacttcctgcttaaaatccggcgatccttcaatccaaccgtaattcattttttgttgatccaaaattttgtaaaaatcttcaccatctttgccatccaaagaaagcgcctcattcattgtcattgaagcaatcgtactttgagaaatatcatatgtagctgatttttcccatttattgagccattcttcgactccaaaacctgcaattttcaatttaaattctccttttactaaaatacagtaatgacgaaaacataatatgcatagaagataatgattgtgaacaacttaattattcgtaattgttacggataaataccatacaaatttttagaaagcctgtaaaatcactgttgacaatcctaacaaatatgatatgatgaatatatcgaatcgttagatatcgtgtatcgcataactcatgtattattgttagctggttacaaagggggaaaagtaactatgttgaacttatatgttgctccaagtagtgcttccagtcgtaaagctcgtaaatggctcgttgatcacgggattgaatttaaagaacgtaacatttcaagaatcccgttaaacgccgatgaaatcaaacggatcctgcggttaaccgagaacggtagtgaagatattatttcaacccgttcaaatgctttccaaaaactacacgtcgatttagataatttaactgtatcacaattaatcgatttaatggttaaacatcctgatttaatcagacgcccattaatctttaatgatgaacagctccaagttggcttcagcgaggaagatattcgaagctttctcccaagaagtgttcgagaagccagcctaaaacaacttatggatagaattagttaaaaaaatcatacacaaaaagttcaagcagtcgctgaaaagtgatcatgcttgaacttttttacgcttatttttatgtcatcttttagcaatcatggttttacttacataatgattatctagcccatccccgtctttttaaaatcattcaatagcctatcagtatatttctttaatggcttcttggtcgaaagcccaactgccaacccaagcagcgacatgcacattaatacaaagaagtctacaacaactgttcccatattagcaccgccaatcgcttcacgaaatcccccaacactatatgcaaagggaaatagaggttgaaaaattcgaaaaagcagtggatttaattgcgttggatacattgcaccgctaccggccagttgaactgccattagcatcacaattaatgcctttcctaaattgccaaataatgctgccattgtgtaaacgatgatcgtaaacgtcaccgaggacattagtcccaccattaatagcaaaaagaaactggcaacatgaatatgcaacaaacacattgaagataacaggatcaccagtgtttgaataagtgacagcgttccaaaagtcaaaagcttacccaaatattcttctcgcaccgacaagcctctaaattgtgccaacttgggtgcttttgtgtgcaataccgcaacaagcatcgtgcaccctacccatattgataacgcaatgtaagtaggtgcaaaggctgcgccaaaactattcaccttataaatatcttcagatttaacggtaaacggctgtgccaaggcgcttcccatcaaatccggattgctctgcaagactgtaacgatatttgcaatattgttgtcactggtcaatttaagccgattactcattgtcatgatgtcatttttgtatgaagccagttgattttccaaatttccagaagtgttggcaaccaattgatttccctgaataatcgtatccaacgattgattatttaattgcttaactttcttaaggctccccaaaacatcccgagacgaaccaacagctgccatcaagttataaccaatgtcacttagctgcgctttaactgaatgattatattgagctaaagaatggtttaatttcagaatcatttcggaaaaacgatgattaatttgctgctttcccatcatatccagcttgccattttgatcaatgcctttttttaaggcattcagttgttttttctgggctttagctaattggctaacgctagtcaatgacgttattaaatcacttatctggcgagattgattaatctttttaactgactgaagcaactctataagcggtcggatttggccatctaataagtctacctgtaaggataagttactaactttggcatccagatcacttaagcttgcgctaccaacagtatgatttaactgattcgtcaatccccgcagttgtttagtaccggcagtgagactggctagatgatgtcccaagttgctaaatgaacgattaagcgattttttagcaagggaggatgtccctgtccccgatgtattcgattgatcgttcaaattaacattctgtgatgcattaataacaggtttaaattccgtaaacgcaactgccaacgtattcgatgtatcactaatggcaccaagtgagttggaagttaagttcaagctgtccccaagcataataatcaaatcttttaaactcaaaatttgagattgatgctcactggcctttcgaccaacaatattcagatatgagaagattgtccggttaactacataaataaatttttcccttattttagttaccagagttttagccgccatggcagtaatctttgctcccatcgggctatttttagtattcgttttatacacaagatgtgctttttggggcgtatcggtcacaatactggttaaattttgagaaaaatctgtcggaatttcaatttctgcataatatgtcccgttccgcagcccttgagctgcatgagatttacttgtaaacttccatccaattttcttatttttacgtagattggaaaccacttggcttccaagattaacctgtttcccacgaagatatgttcctgaatccttattcacaactgcaacagaaatattatcaaccgcacttggtttatatggattccaaattgcgcggacgttgacaagtgtgtataagctcggcaacagacacagtacagttattgtaataaaagccgcccgatatttaatgattgcacgtaaatcacgatgataaacgtttctgatattagccatgtccctaaactacctctcaaagttgtcaatcccccctcttaaacgataaaaaaggccacagcaaaacacaccgttttgcttcggcccccataataaatatgtaattactaacatccccattgttcgtgtatcgatatgtaaaattgatacatgaacaatctattctattccttcaaaattttggctgttttctcactcagaatgcactataatgattgtaatgcatctgttaaccattaacaagcagcaatcgttattgccattaattgtttgtgacatatctttataatcaacaaaaatcatctcattatcaacaattcgattattaatcaattttaaggaagttaatcgtgaaaaaaataatgataactgttctgtgcactattttgggaatttgttttttaagtgtccaatcaacttcggccaatacgaaatcggccacagttatttccactgctaagctgataaaagcaccttatcacgccgtcagcggctacatctatcaatcaacatcgttgacccataaacaacataacgccgaccattaccctcttaccacattttatgccactcgatcggccaacatcataaggcccaatggcaacaaagctgtttataactacataaagaatggcaataaccacattcatggttggatctggcgtggatatctcgtaagagtgattaatgttcaaaaacaaaaagccgctatcaacaagcttgtctcactaattgatgcattaacgcctttcagtcatgataaagtgacttcgcttttaaaaaatgttggtcggaaagaatcgctgaatacgctattgtcaaccttatcaaatctatccagctcaattactgatacttccgatatccaaaagatcgaaacaatgtataagcttctaaagtccgatggccaaacactcgccgctatcttccagaatggtttgaaaaaactttataccggcgtcatcgcacttcatcaatttaataatcaagtctttaaattggcagagggattattggcactcattcctgactaggcctatttaacaactaataaggggtttacgtatggggacaatcatcacacttttaatcagagattttaaaaacatcgttcatagccgaccagtgttgattacactgatcgctttttgcattattcccgcactctatgctttattaaatattaaagcttcttgggatccatattctcctacaaacaccagccgattgccaattgccgttattaataatgacgaaggcacgatcattaataacaaatccctcaacgttggcgatcaggtcattgaagagttgaaaaaaaaccatgatattaattggattgttaccaatgactggcagggaaacgatggccttgatcagggaaaatattacgctctgattgacattccaaatgacttttcaagccgattagcaacgctcaccacaggaagtcctcaaaagccaacgatcatttacaaatcaaacgaaaagttaaacgcggctgctacaattctttcagaacaggcaaaggatacattaacccaacgaattcgcacaaattttacaaaagtgaccggcagagaaattttagaacagatgaatcttgtcggtaaaaagcttaatacaaaaaaacctcaacttttgcaaatcagatcatcgttactcaatgccattgctactattaacaaaacgaaacactatttaaatcgactggacaatcactctaaagatgtccaggcttatctaaaaaatattaatcggaacattccaaaaatttcctctcaaattaataatcttcaagccattattaatcacggaaaatcccttaacatggcaactcgaagaacgattgattcagctaaagaaaatctatcaagcggattggacggcctacaatcacaaaatagtcaggttcaatccatgctgacaaacacctcaaataccctaaccaataacggtagtccgtcagtactgaaaactgaagcagtgcagctaaatgcattggatgatgcaatggttgataaagttaataatcaactgcgtctgttggatgttgtgaacaatctgcttccaaacaacggtgcgacatctctaatcaagtcacttgcatccgttaaagataagattaaggatcaacagcagacaataactaaattgaagacatctgcaaatgaaaacggcgaaagagtcaagatgcggtcattgcttcagcaactcatccaggaaaacaaccggctatcaactatcattgatttggctacaactacatttagtgccgataccagtcagtcattggaccaattaagtaataccactgataacagcttggataatgataatgaggttgtccaagcattacagagcttaacccctaaactgagagcactccaaagcgccggtaatgctgccagtaaactttcttccggtagaatcaataaggttaataaccgactggatgatgtgcaacaaacactaacaagtctagataaaaaagccggcttcattaatagcaaaaatttaactcagctaaccaatattctcgagaagaatcccgatttatcaaacctgctatcatcacctgtcaccttacaaagtaaggagctttataatcttggcaaatttggttatgcagccatgccattctatgcagtcctttcaatctgggttggcattttattattaaccgctattattacttggcgatataaactgccaaacgataagcacttacccaaacctaacctgattcagcagtatgtcggtaaattcttactatttctaagcttctcatttctacaaacgactttcacccttttcggtgaaatgctcattttaggcatccgtcccaacagcctttgggcattattggcaattgcctatacaaccacttttatcttttctttgattttattcacacttgtgtttctatttggaaatgcaggcaaggttttcggtgttctcctgcttatcgtccaaatatttggaaccggtggtatttatccattgcaaacaattcctcacgacttggctgatctagccccacttctcccattcacctacgccatccggggatttcgggaagcactggctgggccggattggcaaacctttagctaccttattttaatattgggcatttttggtagtattttcttacttctaaccccgctgaagcgattctttattcattcagtaagaatgttggaggaaggtatgaaacgatcaaagctttgacagcaaagtgacttgatacaacatattcagataatcaccataacaaaaaggtcaggacaatttttgccctgacctttttaaataaaaaatatcaaattctagtaaacacgaataactatctaaaattaatttatttagtcgcaacattctctttcaaaacatcatgcaaccgttcaaataaaataccttctcttaaaccactggttgaaaatgtaattctatccgaatccagataattcatcaggaaaataaccgggatcaacccaccgacaataatatcggctcgatccttactaatacccggtacctgttttcgaccgtctaaatcatggctcacgatatcctcgaaagtatcgttgacttgggtatcgcttaactgatagccatgtatatcatcaatatcaagaaaattattacgacgtcgattaattttagctaacgttcgattactgccgccaagcccgataatcggtaagttcaaaccgtttttcagccaccagacactttgaaaaatttcattaacgaaaataactgccttgaaaagctgttcaggtaatatcttatcccccagattaaacttggacgataatgtgacggaaccaatagggatactgatcaggttagctactttaccgttctgaatcagaataatttcagcactggcaccacctgtatcaataataaccccattcgttgccggcaaggtttcactcacaccgacatagtcataataggcctcttgcgcaccagaaatcacttccagtttaatcccaatttcagatttgacttttttcaggaactctttttgattggttgcttgacgaaccgctgccgtggcaactgccttcatttttaggttctcaagctttgaataaacctctttaaatgaccgaagtgcagctaatgtccgttcaattgcatccggttgaagaattttttcaggccccatgttttcagaaagccgaacgtattctttcatctgagtcacattatcatacgtaccatcttcattaatacggctaactgtcattcgaaccgagttggaacccaaatctattacggcaaagttttccattattcttcatttcccccatcctggtcttcatcacttaacgggtcaggctggttttcaggactcatcattggttgaaattgatttgaattcggcttacgcgattcagattgttgttcttccgctaatttagtcgcctgctttgcaaaatagtcttgggagcttagcggtgcccgccctctacggtcgacccgcttataagtcccatcagcatctaatacccgtgtcttgacattatcttcccacattgtgctatagatatccaatactctttgtgttaaatcagactgttcaaccgggaatagctgttcaacacggcgatttaggtttcgcgtcattaaatcggcagatgacagataaacctgattttcaccatcaaagtcaaaaatataaatccgactatgttccaagaaacgaccaacaattgaatgtacttggatagtatcactaatacctttaataccggtctttaagcaacaaatcccccgaacaatcagatcaatttgaacccccgcatgtgacgcctcatacatttttgtgatcatatccttgtccgaaagtgaattcatcttcatccgaacatgaaccggtcgacctgctttggcatattcaattgcctgatccaatcgatcggtaataaactcccgaatcccttttggtgaaatgtgcaatttatggaagtacggaggccgtgaatacccggataacatattaaagatattggtaacgtcaataccaatgtcgttgtttgccgtcaataaaccaatatcagtgtaaaaatgggctgtcacatcattataattacccgttcccaaatgaacataccgccgaataccgctttcctcacggcgaacaaccaatgataatttagaatgtgtctttaggccaactaaaccatagataacgtggcaacccattctttcaagctgtcgtgcccaatgaacattattttcctcatcaaaacgagccttaacttcaaccagtacagttacctgcttgccattttgcgcagctcgtcctagatacttaatgattggggagtttccggaaacccgataaagtgtcattttaatagctaaaaccgctttatcaatagaagcttgtctaataaactcaaccactgaatcaaatttatcataagggtgctgcatcaaccaatcatgtttttgaatggcctcaaaaatattatgatccgagttgagtgcctcggcttgataagccttgaaaggcgggtatttcaaatcatcgtggccggtcactgcactggctaatttgcctaaaaaggttaaatcgattggtccattgacttcataaacagaatcttcatcagtttccagctcacgaaccaagcgtttacgtaattttttactaatatccgaatcaacttccaagcggatgacttgcccgtgttctcgaagcttaagttgttgttgaaccttttttaaaagatcggacgtatcttcttcggcgacatccagatccatgtcccgaatgacccggaaagtggaaacctcttgaatatcatagttaataaagagttgatcaacaaactgcttaacaatgtcttccaataaaataaaatcattatcggctctcggtagtttaacaacacgtgggaaaatactaggtacctgtaaagtggcatatagtgacttgtcattttcctttttacttagccttaacgataaattcagtgtatcattactgataaatggaaatggtcgagaactgtcatctgccataggtgtcagaacggggtataactcgtcgtgaaaataccccttaatatactgatattgttcttcacttaaatctgtcactttcaataaccgaataccgacttgtttgatggctggaagaataattcgattcagggttgtatattgcttgatcagttgctcatgggccttatcattaacagcctttaattgttgttcagcggacaatcccgaggcatccttgccatcccatttaacctcaatcaatttagcaagtgacgcaacccggaccatcacaaattcgtccatgttgctttgtgtaattcccaagaacttcacacgctccagtaacggattgtttttatcacgtgcttcttcaagaacccgatcgttaaaatccaaccaactaagctcccggttagtataataacgcggatcttcataatcaatttttgccattagtctttcacccctctttgtttgagtacagctttaagcccatacgcttctttgaagaattggcttttggagttaaaaatccagttttcataagcaagattagcgttgctgtaaactgttatcacaacactatgagtcttaattgagactgagattttcttgatcttttgctgtcgatcatcgtccaaagcatcagctaaacgcaagatagctgccaatttagcaatcaggcgccgattttctgcagaaatttgactaaaatggcttagatcttcgctcggtgtcgttgaactatgatatcgcgcaacagctgcgataattgatcgttcaattcttgacaggccaataatatcggaatgacgaataatatattcagaatgaatataatgctcatgaatacccacatagttaccaacatcatgaagaatagacgcaacttgaagcaatactcgttcgcggggaccgagcatatgcaatggttttaattggtcaaataaatgcattgcaaatcttgtaaccagatctcgatggatcggttcaacatcgtaatggtcagccaaattcacagccattgtaatggtttgatgggtaaagtcatctttggaatacccaagcgtaacagcctcgttattgaccaggccatcaacgattccagagtctgaaaagcggatttcctttgcgttagtcaattgaatgacccggcgaatcagcagtaattccggcaaaatcaatggtaccgaatcttcattaacctccaattgttcaatcagatattgatccgaagcatcaacgatatcatcaaccaatgcctcaaacgcattcacatctatcgacatcaatgaatgatctttttcataatgactgaccaggctcttaatcggggacgtccctaataagaatattttggttggatccggtttcttcacaaagctggcaggcttgcccatatcaaaatcatttagcttactatcaatataatcatttaggacaccaattgagtttggcgcggattgccgcaaactctgtaaatcctcagcaattttaatcggaccaagtgcaaagttagtcgaggtcacgaatttcccatcatcgaattgcgtaatcgatgtgttcccagatgtaataccaactaagtaaacaatcccgtgactcacctttttagaatctttaaacgaaagagaaagatcttgatttcgatagtaagcctcttcactcattgacagccatcgaatttcaagtccggtatgcataaagagctgatcagcaataaaatcagcatttattgcctgagaaagggcctggcttccccataattcataattttcaacaccataatcatgaagaatctggacaaagccagttaaagcttcagccactttactgacaatctcgtattgaactcggtgatcgtgataaatatcatcacttagattaatctcctttgtcactcgttcaattgtcttacgcgttttcagattaacaattaacagctccacaccagaaacgttaaccatgattgctccgaaatatttttgagccatatcgacattctcccatttagacattgtttttcgtcattaatattcttttatgctagtatacaatatttttttagtcattgaatcatagttgccacaaaatatatgcaacttttacatcgtaaatcaaacttttacagactctctatttatcgttcgtatgtaaatcgtttagaatgtagttgtatcaaattatttagaaagaagtggcgttaatgacagatttaaatgcagcaaattccggcacatatgaatttgataatcactttaagattaaccgccttggttacggcaccatgcagttaaccggatcaggtacttggggaccttataaagatccaaaacaagcagaagccgtcgttgttcgggcaaccgaacttggcatcaacttctttgatactgccgattcatatggtccatggtttgccgatcgttatttggcagccggtttaagaaaggctgccaaccgtgatcagatttttatttccgataaagttggtcaaacccgtcaaggccccggcatttggacaccccatggtgagccaaactacctacgccaacaagttgaagtttccatgatgacacttgggattgaccatgaagatctcctattccttcaccgaattgacagtcacttctcggttgccgatcaagttggtgagctcaaaaagatgcaggatgaaggtaagatcaagcatatcggtttgagtcaggtaaccgttgatcagattagggaagcccaaaagtacgctcaaattgatgccgttgaaaatctatataacgttgccaatcatcaggacgatgacgttgtagattatgccgaatcacagcatatggcatttgtaccttggtttccgttaaataccgggaaattaaccggtggtgacagtccgttaagcgcaatcgcaaagaaatatggcgtttctgaagcccagattgcattagcctggctcttgaaacgatcaccaaatattttgccaattccgggaacttcttctattcaacatttggaagataatgttgcggccgcaaatgtcaaattgagtgataatgactttgaaaagttgagtcacttgtcaaattagccgattaaaagaagtgcaaaccggactccttttaagtttccgatagtcggatcaagcgaagcattaatcaaacccgagattagcaaaaataaggggctgggagtgacaaactctcaacctcttatttttatcctaaaaactgatgaatcggaaaccttttctgtttgattttaaaaaaggttatgacaccatcaattaaaataagtgccatcccactaatcagtaacagcatattaattgaaatcaactgtccggcttcccataatcgaacaaattcaacgattccaagtagtaacaaaatataatggatggttaatcgcctgtaacgctgtgcaactttagttaacatattttttggattaagatgttatgcttgatggataattcttaatcttccctccctgctcatgtcatttttccggcacatcacttatttaccctttactttatcactcaaaattatatacgtgaatcattaccgttaattttgatttaattcaattgatttgatttctctgacactcttttgaagtgaaaccaaccattttaacttgctattttggcaaaccaaagtaccactcccactactgcaatttccaaaaccacaactatcccaatagctataaacgaagatgaaaagaaaaatccaaacgtgacctacacattattcgccacgtgcaacagaatcgacgttaataatcgtcctgttttcatataagcaaaccccaaaatcatccccatcacaaagtaaattaagtattgaggaatgttggctgtctcatggaaaagcgcaaaaacggcagcacttgcgataatcggtaaccaaaaaagattgtctttgaaaatcagattaataaagagtcccctgaaaatcaattcttcaaggattggtgaaacaataaccaccattaacacaaaaccgacagcggtattagcattaatactttgttccagcatagtttgattttcagttgtgggcaccaccaagtcggaaagggcagaaaacaacacaatcccaattaatgataccgcgaagactttaaatacctgcttgaagtccacatcacgccctgcaatccggacactcgacgtcataacttcttgataagatttaaaagcaaatcttattgcaaccgttgcggttatggctataaacaggatgaaaaaaatcataaacgcccatgatcttccgtgaatcgcctgtccaaaaggaagagggatactgacgatctgatatagcaaaaaagaaacgatgagataaaacaacgtatggtaaattgaagttgatttaaaatagtgtctttccttttgatgattggttttggcgttcagcagcccctttttatcggccgagttcattgtttttcgttctttttgcatcctaatatctccttgtctttttcgatgtatcactatatgtaacgctccttatcactgactttaatgaccaaaagcgtttattataaccacacttaataatgagtttcttaattgatctagcaaaaagtctttttaaatcctttcataaaatcatctatccagcttttcttttcatggtgccgatatcgggtaacgcctccgcttatgtgtgaaagctcatcagctgataattcctcataacgttgactcatattttccttttcttgattaaacatcgaaccgctccctttgctttgatgatttcaggttaaacgtcgaaacatcattaagtcaatagactcattgtctataaaatgcagacatgctttttaccaatgtctaagaatggtagcatttcctacgcaacgctaaaatggctgttccttggtcacgaaggatttattgatcgagaaccggaaaccattaatgattaaacaatcggatactaaaagtagcaccaccttcaaccaatctgaaggtgatgccactcttattcaatgcttttttgttttactcttttgtactcggacaacagttcatccggattactaactgttaaaaataaataatcatatttttcgttagttaaagccacaaacaaaatatgttcattgccggatacatttaagtacgatctcttgtggttgccataaaaggttccgacttgtttccaaggtaatcccagtccaggtgtccgaaattggaccacccgccatttaccatcctggtttagctgtttgcggttttcaattgtcatatcggaaacgtggtctaaaggaatgattaagcggtttttaaatccccataatttatccattcccgttatcgtaacggttaactgattattgttaatttgaatgtcgttcattttttaatcgtcctccacgttaatcaacgcttagtattttcgcggccgtttaaatcctgaatcaatctgttcgaacccgatttttggataatagccaactgctgacggtgctgctgccaaaactagtgaaacagttgagccaaggtcccggtgaatctttttaactaatttacgaccaatgccctgcttttgataatcctttttaactgccaaatctgataaataacagcaatacgcttcatcgctaaaaccgcgggcaacgccgaccaacatgtcgttatcccatgccgtatacagcaaattggcattatttatcattcgttttatcctatttatatcagctgttggccgtttaatccccgaatcatcaaatagatcagcgagttgttttggactaatgactgcagtcgcggaataaataatcatttttaagcctcccggtgaattcgaaacatatgatcaacttgttgataaccgacttctgaataaaagccgattgcctccggatcagctcttaacgtgactgccactcgttcaccaagataatcatgaatgctttgcaaaagtcgtttttccattccttgaccacgataatccggtaaaatcacaatctcactcaagtagcagctatattcgaaatcagtcagacaacgcgccatcccgattaatcgatcgtcatccctcagggtaaccagtagttgcgtatggtccagcatcatttgtaatcgctttggatcatcatcgagtttctcctgtgcaaaatctgccgttttgtataaccctaatagttcctttaaagtcaattgcttattaaattcaactttgatcataacgcagtcaatacctccaaaatgatatttttgagtcataaataacttatccgtacaactaaccggatgaattggttttcttcattatcggcgtgttgatgccgcttgtccagaagattaaagaggatagttatcattgacttaaacacaatgtctaatgataactatcctcaaaaatgacacttgatcatattaagtgtccgcctattataagccactgcctgcaaaaccgacttttttcatcaactctttttgcatttcagcctgaatcttctcaatcgactcaccatttttatctaagaactcaccaaaacttttttgatcaatattaagtgtccgatcctttaggctgccggtagtctgaatcttatcgtccctaatccagcgactaatcaaattctggtcagcactaataccccgtttttgcgcaaatttaattgcttctttaattgtcattaaagacacttcctttcactaagcaattcacctgaagtctacgcccttatccgttgcaatacaagcttacgacctgatacagcaatagttttgctcacaagtgagcgttatggtcgaccttctactttagaattgttataatctaggtagagatacttgatttttagaatggaggtaaccaatcatgactcagttaacaaactattggcggcttattggcgtctttctagtgagtgccttggctttgatatgtcaatttatacttggcttgccacaatatgcccaaataataatctcaattttaggatcattcattgcactactcatgttcatagatatgattaagaccctccgttccggtaaattcggtgtcgatttactggcaatcacggctgttattgctaccattgccgtgggtgagtactgggctgccatgattgtcctgttaatgctgaccggtggcgatgcactggaagactacgccgcaaataaagccaattccgagttgaaattgttaatcgaaaattctcccagttcggctcatcttatgattaacgaaaccattaacgatgttaatattgatgccgttaaaattggggatcgcctgttggttaagccaggtgaaatcatccccgttgacggcacaatcactgaaggaacgatcaccattgacgaagcttcattaacaggcgaatcgcgtcccgtagacaaacaaatcggtgaccacgtgatgtcaggtgcaattaacggtgatgcctcttttaaaatgattgcggataagacggctgataatagtcagtatcaaaacattattcgcttggtcaagcaagcagaagaacaacctgctcattttgttcgtttagctgaccgttatgccgttccattcacactggctgcctatttaattgccggagttgcctggtatctgtcaggtgatccggttcgattcgccgaagtcctcgttgtggcatcaccttgtccattaattcttgccgccccgattgcattggtttcgggaatgagtcgcggcagtcgaaacggtatcattgttaaaagcggaacgattatcgaaaaactggccagggccaagacgtttgcatttgataaaaccggaacgatcactaaaggccatttaaccgttgatcatgtcttcggcacaaatggttatacaccggatcaggtcttacagttggccgcaggagcagaacaacaatccaaccatattttggcccgttcattggtggcagccattccggataaaattcccattgccaaaaacgttaaagaaaccactgctgaaggtatttcggcaacaatcgacaaccaactggtaaaagtcggaaaagcagaatttgtctcaactgaccctatcaagaaaatcgatcaaacaaccgtttacgtgtcggttaatgatacttatgcggggtatgtcagcttctcagatgagttgcgtccggaagccaagggcgttatgacgaggcttcatcaacttggcgtcaaacaaatcatgatgatttctggtgaccgtcagccgattgcccaacagattgctgataaagtcgggatcgataaagtatatgcagaaaaattaccaaaagaaaaaattgccgttcttgatcaattagatgccaacgatcgtccggtttgtatggttggtgatggtgtaaacgacgcaccctcgcttgcagcagcggatgtcgggatcgcaatgggcgcccatggatcaactgccgcaagtgaatctgcagatgcagttgtcttaaaggatgacttgagtcttgtcagcaaagccgttgccatctcaaaggaaacaatgagtgttgcccgtcagtccgttttaatcggaattgcgatttgtttaatcttaatgatcattgccagctttggcgttattccggctattatcggggccctttttcaagaagtcgtcgatacagtcactattctatgggccttaagagctcgaattgataagcaggataatgttcattcagatcccggaacgggtaaaaagcaagcattaaatgtttaagctgtgatagaatcgatttgttctatattttggaattcgaaatggctataatgtaataaaatgatttaaatacgaggagaaatgcttatgacagcaactatcgttcttgatagattcaatatttataacgatcgtgacttaacgttgaataaagtcacagagacttctagaatggttgaagatcctcccttttttcagattcgtttttacgtgagtagcccatatttttctgaagatatgaatggtaacaaccaactcgccagaaaatatcgtcgtttatttaacaaattaaaagctgactttgcaaaagtaaacgcgcctatttttgatagtccagataattatcccactggatttgagtctctggcacaggtcgatcaagtcgttaaagatttgcaaaaagcaattcaatctaaaattgtcatcccaggcaaaatcgaactaaacacaattgaacttttaggcaattgggaagtttatagtggtaatgaagaaacagagctggcacaggaattaaatcgtcaaacgaatgccgaagtagcccaatggtttaaagataaccatattgatccaaacgtttaatttgatataatccaagtagtatcggaaacgaaagtctacaataattactttcaaaaagatcctgataaatcatttcagatgatttgccaggatcttatttttggatgatcaattgtttagtagtcttctttattttttttatattccaaatattgatacaacaatagttccataatcacaatcagcgatacatgggatgtcatatccacactattaattttcaattcatcggtaaacaggtacaaattttcatcactcatattttgaatagtgttgttgttagctcccgtgatggaaaccaatgatgcaaactgggtattgcttttcagattctgaataagctggatcagttcatcatcttcaccctcatagtcgaacacaaaaatgatgtcgttttgatcaatatttcgatacgccagttttcgttgctcatagttcttgggaaaaatgacaatgaaatcgtttaacgtgtacaagtactcaatatagtccgttgtgtacttactgaaccccttggcataaaaatataacttgggatgcttatccatttgttggcagatcttcaacaactttcgttcatccaagactcgaaccgtttcttcgatatttttcaaatactcatttcgatactgggattgtttttcaacgaacgtgacatcgctatccgccttcttatcactgtttaaaaccgtgtatttaatcaccgtactaaattcactatagccggaaaaaccaatcttgcggacaaatcttaaaaacgtggttgttgagacaaaacacgctgccgccacttctctaatactcttattttgaatttcagccatatgcttaatgacgtaatcaagcagcgtgtactcatttttagtcaatttttccacgtatggtttgataatttcaaaaaagttcatttaaatccctctagtccggaacacctaatacgattgaatgaatattaccgccgccaagcagcagctcacgagcgtatacgggttcgatttttcgatcaggaaatagtttttgatactgatctattgcttcctgatcatgttgatccccaaaaataggtaaaataacagcattattagccaaataacaattaatataagaagccgttaaccgatctccggcatatcttggtaagaggccgttaaccgggtcgacaccctgactttcttcttcagtagccaataacggtcgaggcaggctcactttatgcaccttcagctgccgccccattgcatcggtcgcctgacttaaaattttaaaagcttggtgggtaatcgcaaacattggatcagttcgatcctctgtccaattcaaggccacctcacctgggcgaataaaattgaccagattgtcaacatccccgttggtttcgtccatgaagtacccttgttccaaccagataatcttagaaacatttaaatccttttttaaaatttcctcgacatccgcccttttaacttcaccatttcgtccttcggaaagaaccgactcctcaacggccattagtgttccctcaccatcagtttggtagccgcagccttcaagaacaaagtcgacgtcataataatcaaaccggtccaagtcagttactttcttagcgaccaggttatcctgatcccacgggaagtataaaccgtcaattaggccaccccaggcattgaattgccagttaaccgtccgaacttgatcatggtgattgattaaataagcggggccaatgtctctcatccacgcatcgttataactcatttcaatcacgcgaatggattccggcagcacatcacgggcatgctgatattgcgattgggaaaccagcatagtcacgggttcatattggctcaccttaatggctacttcggcaaacgtcttttgggccggctttgcgccctcacgccagttatcgcttctctgtggccacatcatataagactgttgatgctgatgccactcgggtgccagataataaccatccttttgtggatttgaatttttgattttcattttcttacctcgactactttctaatccaattttatcatgttctctttacggatagacaaaaaattaggagatcggccactcaagcagcgatctcctaattgataatctcttgatgatttaaatgaacctgttaatctgcttaaacgctcacacgctgtttgacaatcgtggtgccctcagtgcccttaataatgttttgaacatcctcaagagcaccgataacagctggattaccggtattacgaacaaagtccaccgctgcttttaccttaggcatcatactgcccttggcaaactcgtcagcatcaatatgagcttgaacctcgtcaacgcccacttttttgagttcctgctgatttggcttaccgtagttgtagaagacaccgccaaccgaagttaaaataattaacttgtcggcatcgaccaattgggcaattttagaagcactaaaatctttatcgataaccgcttcggtacctactaatcgattgcctttcctcacaacgggaatgccaccgccaccggagacaattggaataataccggcatccacaacctgtttaatggcgtgatactcattaatttccaaaggtttgggtgaagcaacaacccgtcgatagccacgaccggcatcttcaacaatttcccaatcagggtgttgggcctttaactcggcaacctcatcggccttgtagaagggaccgattggttttgaaggattttgaaatgccggatcattttcatcaacaatggtttgggtcacaattgaaataacatccttgttaatgccactatccaataatgcttctttcatggcattttgaaaccagtaaccgatggatccttgagtcatcgccccacaggtgtccaatggcatcgccggattttcattactgtcggaagcaatctgttggagtaacaggttaccgacttggggaccgttaccatgggtaatgatcaattgatcaccgtttttaataaagttaaccaactctttggctgtttctttaacagccttcatctgagcctttgcggaggcatcctttgaaaggatcgcatttcccccaagggcaacgacaacttttgccaaattaaattcctcctatctgcctgccggtacttgttgggtgatgcagtgaatattaccgccgccaagtaagatctcacgtgcaggaacaccgacgatttgacggtctggataaagtcgttgtaaggtttctttggctttttcatcgtttggatcgccaaattctgggaagacaattccgccatttgccgtatagtagtttacataactggcagcaagccggtcgccttcttgacgaggaagcgttccatcaactgcgtcaacaccttcgctttcctctttggtgatcgttaccggttttggtacataaagtttttcaacttgaatcttacgacccttggcatcagtagcgttacttaagatgtcatagttttcttttgaaatttcatactgtggatcattcttgtcatccgtccaagccaaagctacaacgcccggcttaacaaagttggcaatattatccacgtgaccattggtttcatcgttgtaaatgccacgctttaaccaaatcactttatccaaattcaaatattctttcaaaacattctcaatttgttctttggacagctgtgaattacggccttctgaaagtaggcattcttcggttgtgatcaaggttccttcaccatcaacatgaattgagccgccttcaagaataaagtcatctaatcgataacgatcagcatgttccaactcggtgaccttctgagcaacccggtcatccttgtcccaagggaagtacaacccgtcaaccaggccgccccaagcattaaatgtccagtcgacaccgcgaagatcaccattctcgttagtcacaaatgttgggccgcagtcacgaatccatgagtcatcatttgacatctcaaccacttcaacctcatccggcaacatgtgacgggcattggcaaactgttcgtctgaaacgccaacagtcacatgttcgaattgtgaaatagctttcgcaacgttcacaaaagtgtgttgtgccggtttggcaccgtttctccagttgtccgggcgttccggccaaaggatgtaaacacccttatgatgttcaaattcgcctggcattctgaaaccgtcttttttaggtgatgattgtaaagttttcataatttaataacttcctttacgtttaagtcaaaattcaagttacttttctaatgcgtgttccgagtgtccttcgatgtgactactcgcctcttgatgagctttcttatctccgtgcttttcagcaattcgaatacagatttcaccaagaatcaatgtgataatcgtcccaattagaattggcactttgccgttaatctcttcagcactaccgttcaaaggaacagctgacataataactgtgacaaccaagagtgttaccggaatccaagtcattaacgaaatcataaacttgttgccgggaactttgaacggccgctcggcttttggatcgatttttcgaagtttactgaaagatgggaacattaagatgtatgatcccaacaaagcaaccacgttaagtgagaagaacgcccagaaaatattttgattgggaatcaaaggagatacaacaaccagaattgcagcaatcagaccgtttagtaaggttgccccaatcggcataccgtttttcttgctttcaattgcgaagactgccggaaggtcatgattttttgctgcataagaggcaacgtagttaactccggctgaccatgagatcaggttggcagccaacgtatacatgaacataatggcaatcagaatcacgaaccaattgttaccaccgattaataataggatactttccattaatccacttgaggttgacaatttatcacttggaattgcaacacccattccgaaggcagcaaatacgtagaagactgcgattaaaataccgccccagatgattgcttggggaatttgtttcttcggattcggcatttcacttgccattgatgtcacaacttcaaatcccaagaagttaaacaggataaccgagatgtaaccgaggctcttaacgtccatctgcggtagcatcgttttaactgtgaagttacttgcaacacctttggtcatcgcaacgtaaatcccaagaattcctaaactcagcatgatcacgactttggcaattgcggccaggttcaagatccatttgctatccgcaatcggataacaggaaatcagggttactatcgcgataaagaccaattggataacaacgtttgtccacgtaccaaagtgtgtcggaaaaacttgaccgataacgccggtaaatagaacggccaggctggccatccaaatcggaaaattaatccaataaagccaggcagctcgaccaccccaacgttttccaaacgcctttcgaacccaatcatagataccgccatcgccatcataagtagtcccgagttctgcagaaattaatccgtatggtaggaagaagagaatcagaagtgctccccaccagaagaattgtgatggaccgattgctgcggctggtgcgaccgattcaacaactaggacaacaacgaccgccattagtaccgcatcaaataatctaaactttttctctttttccatttcttccaccttcattaaaatctgttaaacgattgattaacgagtcgagttgtcaacaagatttagaatcattgatttaagctttggatcattgaagtcatccaattgtttttcactgtaattcattgatggtgccatcaagtatacgagtaaggcacgcattgccgtcaaacgattttctgcttcatcccaagcgattgaagccggtgaatcaatcacactgtcagtaacttcttcgccacggttggctggtaagcagtgcataaacattgcgtgacttgaagctttgctcattaagtcatcgtttacctgatacttaggatagaagatcttcattctttcatcatatgaaagtggtgcttcgtataagccataccaaacgtcggtgtaaatgaaatcggcatctttgagggctgcatcggcatcttcggaaatttcaacactgccacctgagatttcagcgttcttcttaccaatttccaaagtttcgggtttgatttgataccctttagggccaaattgaacaaatttcattcccatcttggaagccataaacattgttgaaacacaaacctgggttgcgtcaccaacaaaaacaatcttgcaatcactgagtttcttaccagctggtagatgttcagccattgtgatgatgtcaccgacttcttgggttggatggttgtaatcactcattccgttaagaacaggaaccgttgccgtttgagctaatttttcaacagttgaatgttttgcaacccgtgccatcaggatatcaaccaatcgtgataacacaattgctgtatcgccaagtgattcgctttcggcactgcctaaatgaatttggcctggtgcaagatattgcgcgtgaccacccaactgagtcatcgctgtctcaaatgaaacccgggttctggttgaagactcttcaaagatcattcccaatgtgcgatgtggcaaaagctgtggatagttgccaagtttgatgtcctgtttgatttggatacctaaattaatcaaatattgaatttcgtcgcgggtgtatgagtttgtatcgataaagtctcgtttcatgatgtttatctcctagtctttttttaaattcgttttaattgtgttccagaaatcctcgagtatttctttacgagtcttactatacttgatgaaagcgcttaagtatatggttttgacccctatcggcataggctgaacaagcatgtattttgttccgtaacgcgtaacatgttacatatatggagatcgcttgaaaccattgcgtttgcacgcatcaagtgacatggcattgttagtaaaacgttttcacttgagtggaacaaaaaaaccgtcaattctctttcgggattgacggacatttgagcttcacgattaatctgatacattcacttcattcaataggccgtcaaagaaatgtcgtaaagatgttttaccacccgtttgccgggttcctcttaaaaactgcgtttcatttcgaacattcttgtattcatacaacgaatttgcgtattcaatcacgacttcattatccatatcatccatgcagagagtcgccagattggttaagccggttttgatcgctcttcggattcgctgaaacaaaattttcttttcccgatcatcgatatgataggccttattaaagtcaatttctcgaaaagtaaggtgttgttccagcatcatttgggcaattgccaaaatatcagaagagccggcttccgatgtcattcccagaaaccttaatattgaaagaattcgctccttagctttctgtcgctgatcaaccaccggttcagccgtcaaactgccgccaaccagcgcttgaatatgcgttaatttttcagtcatctgaatattctgaattactttttcaatcaccgttttaacttcaatgacattaattggtttatcaatgaaaaactcaatgccggtttgataagcttctgaccgcaactcactgtcgcgaacctgagaaatcataataaagcgcaatgacggctttcgctgctttaattgcttaattaattcaatccctgagatttcaggcatcagcagatctatcaaaacaatatcgacagccatcaacgttaaatcagccagcgcctttttagcctcgtgggcaataccgaccacatcattttgaggatccttttcgataattcggcgaagcatcattggaattgatggatcatcgtcaacaatgtaaaatttcatgatcgtgcctcctgtgtcagtcgtcgtttactgagcgttacctgaaaatcagttccctgaccaggcttggatgccacttgaatatcgccatcaaactgctcttgggtaattattttaacatgtgataggccgatcccccgataaacgacgccggtactttcatcaaatttagtcgtgaatcccggttcaaaaatcatcgcaagcgtttcttgatccattccactgccattatcactaacattaataataatttgatcattatcatctgccacagtcactcgaatcaacccgttagccttatcatccattgcgtccacgctattaaaaattaaatttgagagaatcgatacaacgtaataatggtttggaaccaccagatcaacttgattatgaacctcaatcacgatattttgatgacgctgcttaattgcttcacggatgtaatttaccgtcacttttaaaatatcggccaactgcattggtgcactggtatcatcatcaaaataatcacccaggccacgaataacgttttgataatctttcttaatctcatgaacatccctggcaatactcaatgccatatcctgttgcttttcatcgactttgtcctgctgcaactgttggttaagcaaataagcgttcttcatgacgttttcaatttcactgatattcttgcgcataaaatacacgtcactcttaacggcagaggcaacccacacaaaatgataataacgttgttcgtggttttcatcccgtaacatcagtgtgaaatagtggtacacaaaagcaattgaacagcttcccaggctgcgaatcaatgcggccataaacaagaattggaatagctggtaactgtaatgcgaaaagccggttaataagctgacctccagcaaattcgagagataatcgcacaggacaattgtgaagaagaaatagccgttgttacgttggccatttcgccaataaatcaaataatagagggcaccataacacacataaaaggccatatccgtgatcgtaaattgaataatgtgattggcactggcatcctgacttataaataacaggacgcctcgaaaaatcggtgatgcaactgcgaccgccaatgtcagctgaaacggatttaaatcgcgattaaaatacagaaaaatcggcagcagcaaaactgccagtgtaatgataaatcccgacgtatacgtttgaaaattgatttgcgaagccagcgcaatgcagatcgccgcaaccaggatccgctggtaacgtccgtaactaatgaaacgtgattgcttgaacatgattaaattcccctagacatttttacacaagtttttgaagtatcgtgaagttatatgaaaccgcttcatataataccaattgtatagaacgaagggggattatacaaatggattcagcaattaagcccaaacggcatttcaaactaaagatgcccggtgcgtttgtcatcctgtttatcttaacggtcgttgcagtagcggcaacctggatgattccggccggcagttattcaaagctgtcttataatcaaaccagctctcacttacagatcactgacccacacgggaaaatatccaacattccaagtacccagaaagaattggataagctcggcgtaaaaattgatattcaccagtttacgtccggcggcattacccaagctgtttcagtacccaacacatacaagcggctcaaacaacatccagccggtgccagcgatattaccagcagtatggttcgagggactatagaagccgtcgacatcatggtctttattttagttctcggtggcctgattggggttgttaaagcaagcggtgcgtttgagtcgggattaatggcactgacaaagaaaaccaaaggccacgaattcgcactgattttctttgtctctattttaatggtcttaggcggtaccctttgtgggatcgaggaagaagcagttgcgttctatcctatattggtgccaatcttcattgcgatgggctacgactcgattgtctgtgtcggagccatcttccttgcaagctcaattggaacctcattttcaacaattaatccgttctcggttgttattgcttcaaacgctgccggaattgattttacccagggaattatgtggcgggtagtcgggtgtattgttgcggccgcattcgtcatcatttatctatattggtacagcaaaaaagtcaaagcggatccgaccttctcgtattcctatgatgaccgtgatgaattcaaccacatgtgggaaattgcatcgactgacgatcaccagaaatcatcttttacaattcgaaaaaagattattctactcttattcgtctcagctttcccaatcatggtttggggtgtgatgtcccaaggctggtggttcccaaccatggcatcctcattcttggcatttgccattattatcatgttcttaactggaaccggtaaccatggtcttggtgaaaaaggagtcgttgatgcttttgttaacggtgcctcaagtttagtaggcgtatcccttatcattggacttgcccgtggtatcaatttggtcttaaatgaaggtctcatctcggataccattcttcaattttcatcaaccctggttgcccatatgagtggaccgacgtttatcttagtcatgttatttatcttctttgtacttggctttattgtcccgtcatcttccggattggccgttctgtcaatgccaattctggcaccacttgccgatacggttcatattcctcgatttgtggttgtcactgcctatcagtttggccaatatgcaatgcttttcctggcaccgaccggtttagtcatggcaacccttcagatgctgaatatgaagtattcccattggctaaaattcgtttggccggttgtcgtgttcgtcctggtttttggtggcggcatcttggtagccgaagtattaatttattagaatatattgacattttaacgattagcagagcaggttgtcagactgctctgttttttattggttgcaatgcttctaaaataaactgactattctccgattcaggtgttatgatactcaaaaaggtgattttaatggatatcacattcgattgttacggaacgttattagacactcggccaatccaaacctggttgatggcattcgggacagctcacggcattgacggtcaggctgcctggtcccaattcgaattgtgggaggatcgcttaatgtatggcgaaacaacgctgccattttccgccttattgaagcgggacttagcgtatatggacatgacacttcaaaccggatcgttgttcagcaaccattttaacgatttaatcaacctatacacgactttaaccccttggccggaagtcattgccgttctgcgtcaattgcgtgaggcagaccaccgtgtcatcattatgtccaattcaacgtcaagcttgatggcagctcacctcaacgcgttggatcacgaagtcgatcaaacgatcctacctgaacaaacccgctgttataagcctgccataccgttttttgactatgcctcaaagcagctcgaacagcctcacctacacgttgcaatgggctattggtgggatgttgtaccatgtcataaaatcggatggtcttgcgtttggattaatcgactgaagttgtcggcattagccgatatcaagcccacttataccctgccggatcttaaggaattaccattgctggtacaatcaggttattgattcctttgactgccctttaagcccaccatgcatgatcatacgcatcagcttagactttctaaataaagacgccatacaaggttttgttcttgtatggcgtctttattttattcaaaacaatctcaactacttcactgtagccggcacactttcgctgacaatagtggttccttcattgcctttaatgatctctttaacatcttcaagatcaccgatgacagccggattaccggtatttcgaacaaagctggtagctgcttcaacctttggccgcatactgcctttggcaaattcctttgcatcaatgtgtttttgaatctcatcaacgctaacttctttaagttcaacctgattgggtttgccgtagttgtaaaaaacaccgccggcagacgttaaaataatcagtttatcagcatcgattagttgggcaatttttgaggcgctgaaatccttatcaataacagcttccgttccaaccagccggttaccttttcgaacaaccggaatgccaccgccgcctgaaacaattggaacgatgccagcatcaacaacctgcttgatggcacgatattcattgatttccaacggcttaggtgacggcacaacccgtctgtagccacgaccggcatcttcgataatctgccagtccggatgaagagcctttagaccttcgacttctgtttctttataaaacggtccgattggtttggatgggttttggaaagccggatcattttcatccacaatcgtttgggtcacaattgccataacgtctttgtcaatgccactatccagtaattcctctttcatagcattttggaaccaatagccaatacttccctgtgtcattgcaccacaggtatcaagtggcatagccggattctcatcactgtctgcagcactctgctgaagtagtaggtttcctacttgtggtccatttccatgggtaataatgagctggtccccattcttgataaaattaacgagttcctttgctgtttctttaactgctttcatttgagcctgtgcggatgcatccttggaaaggatagcattgccgccaagggcaacgacgatttttgacaaagtaattcctcctgcttctctatttttaatttatcactctaaatgtttattttttccttatttttacgataagttgaaacttttttctcagttttgaccgtgactctgccatctttaataacataaagtcgctctggaatatcaataactgcatcagcttttcgtttggtatcaagaagaaccagatttgcaatattaccttctttaattccataatggtccagcttcaaaatttttgccggatctaccgtcaacatatccaatactgatggtaaatccgccaaaccaccaagatgtgccgcaggtacggctaaaaaaccaacctgcataatatcaccattaccaaatggggtaaacggatttcgaatattattagtagaaagcgcaacatttactccaccctttcgcagtctacgaataggtgtgacacaccggcgaacattataggtgtctgttcgtccacctaaatgtaaatcggtttctggtaatgaaataacattaatttgagcctcatgtaacaaatcgataattggatttagcttttcaagtggtaacgcagccaatgcagtttcatgtccaactgtcactcttccttgatatccctctttaatcgtcttacgtgctagatactcaatagaaatattatctgcatcatcaaagaagtcttggtgaaaatcaatatctttatcatacttctttgctaaatcaaataagaagtcaatatgttgttttggatctggatctacgtaaggaataccaccgacaacatcagcccccatcttcatagcttcatccatcatctcagtcatccccggaagtttaaaaataccatcctggggaaacgcaacaacttgcatgtcaatcatgtctttatattcttccttaagtttaaggatagttttaaaaccgacaaaaccagtttcaggagaaaattcagcatgggttctcatattggtgaccccgtgctcaatttccatttcaagtgctcttttagctcgttgataaatatcatcttctgtaaaggttggcttagcttcagcagtaacctgaatagcttcctttaaagttccagactgattatgaactcgattagaaattaatgctttatccaaatgaatatgcgactcaaccaaaccaggtattaaaacatgcccattcccttgaataatttgatttgctggactattaatttcatcagcaatcttctgaacttttccatcagaaatcgcaatatcctttaatgactgattatcgttcaaacgtacttgcttcaacaaaatgtctatcattattttcacctcaaatgattaaacctattggcaacaacaattcatcgtatgataacgcttacatacatattctcacacacatcttcttcaaaagcaccggtaaccgagtataactcgaatatatttttttatcttcagtggataaatttactcttcaataacataaaagcagcatacattcccagtagcgtatccgttcctgaagtatggccaaaattctgaatatccaaaagtgaagaagccaactgctcctcatctttatctcgaataactttcaagaattgaaccattttctttgaagtatagttttccaagactgcctgaatatatgattcagaaacatcagtcgttgcacgactttctaagatgattttcacttgctctttccataaggttaactgtttaaatccaaaggcgctaagaacgcttgtaaagccaacgataatatcatcaccgcttggggtaagacctcgccctcgcccataaagaaacttcagagtttccatgatttgctctggatcacagctttcaatgagcattttaataaccttattgggagaatattcatcacttagtccccaatcattctgaaaatcaataatattaaatttctcaataatcttttttaggaaatttaaatctagcttgatttgtggaattcttaaatcaacagtttttaaaggctctaaatcaatcgttcttatttctttctttgtataaaggtacaactttcccttaataaaagacacaggatcatttacatcaatatattttaataattcatccactacatcatcttccagagtaatccccgtacaagaaagtgaatcagattcatttccgacgtgaaaaagtaggtctgggaaatcaatattaaaactatgctgaaacatggtattgataattccatggtctttattaaacaaatggagagggagcatattgctcttctctccatttgtttgattatgattaaggctcataaacatcacttattccttaactaattctttttctaataacgttgcatcatcgtcttctagcagtcccatattgttggcataagcaattaaggccttctcgaaacaagctagcggagcatggacagtaccagcgcctacttgaccaacacctgcaactttacttgcaattccagtattaataattggtgtaatcccagtttcaacaacttttacaatatcgatcccgatagctgttccttggtaatcccaagttggaatcgtaaagttagggtttcgatcaagcgtaatcttagccatttcattgctaatcttttgtgcgtccttaaaaccgcctgcaccaacaaatcgtgttacaccaggagcagcgatcatagccattccgccaaatccaacagtttcagcaattgcgctatcaccaatatccggattagcatctttttgagaaaagccagtaaagaacagtccttgcggtgtattaaccggtgctgtgaaccactgatcacctaaaccactgattcgaataccaaagtctttaccatttcgagtcattgttgtaacaactgttccatgcttataagttcttgcggcatcaaccattgactttcctgttgccatcataatgctcaagaagaattgatcagtatctgccaagaattgaataacatcttgcttatccttttcgctaatattaagcgaaacaatcaacggtgccacttctttgaggaatactaatgtagcggcgatgttacgttgatggaattcatcacccatagtaattgctttagccatcataacattaacatttagaccaccatcaagtttcttgagtgcagcgcttaatgttggagccaacacatttgccatccactttaaacgagttattacttcttcagaataagcaccaaaccgaagtacctttccaataccttcgttcattgtgcagtacgcgtcattgcccttaagtgcatttttaatcactagtaccgccatatgagccgacgtaatgcctcccattgggccaactgcgttaacatcatgattgcaaaggaatttaacatccccactttcaagcatttgacgtgcatcatcctcattatcagcccagccttcaaaaaggattgcgccaatacaaccaccctgcataggttctgtcatttcattatattcaattggaggaccggcatgaagtaatgtatgtcccttaagctctgaaataactgttcctgcaggaacaacgtctaccaaaaatggagcggctttcttatatgcatcaacaatctttgcgttttcttgatctcgattttgaagagccttaacttttttaataattttaatcagcttcggatttccaccagcaactggtttccagtcgaattgaacaccagtaccaccaaacttaataactggatctaagaactctgaaagtccaacgttaactactcgtggctttgtgtacaatagatcaagaacggattcacttggagttggcacttcacgtgttccacctgtatagttaacaacctttttatcgggttcatttaaatctttaccaattaagttgagtgcatacctaacagcttgtgcattgctatcaagaacaatgatacccgcatcttgtaacgtttttcttgcagcatcataatcttggggatcatctcttgttccaacaactgttgcaacaaacttaatacgtggatgttttctagaaacgttattaacagcatctgcaaggctttcagccattgtatcatcggtaccatatccaagaacatcatccaaaagaataacgccagtcttaggatcgttagcatactcactaattttttcaatccgaattcgtggatcgatcattggatgtggacgtccttgagtgtaaatatcatcaccaagatccaatacctcattgccttttgctttaagaacataaccatcttcggaaataataccacccagatttaatgcttcagaaaccaacattccagcttcatacgcaagtgtgccaccagaatacaagccaataatatgctttccttcaagcttaggatctgcatctgcaagtggttttttagaataataattatctttaacgggtttattatcggctaaatccattgcaatttttgctgtttcttccaatgtatgagccaaatataccgaatcttcatgatgatctggtttttcacctaagaaaattgcaaccactggtttatcaatgctatgaagtaaactaaccacatcatcacgaacttcttttgccggtggcttggaaataatgcctatcacttcagttggatcatgatgggcaagaccagcaatcgcatcctccatggttatcgcacctacactatccgataaatctcgaccgccggttccgattgcatgcgtgactccaccaccaaggcgttcaatcatactggtaacttcttgaattccagtaccagaagcacccactaatccaatattgcccgagcgaaccacattagtaaaagctaacggaacattactaataattcctgttccgcaatcggggcccattacaagcaacccttttttatgtgcctttttcttcaatctgctttcatcctcaagcgatacattatcactgaagacaaaagcatttaaattatgatctaatgcattatcaatttcatctgctgcatataacccaggaaccgatataactgctaagttagcatctggaatactcttcatagcgtcatcccaattggtaacttttttagaatcactatcagaatcatcactttttactgataaatcatttagaaatttatcaatctgtttcaaaacatcatccatgacatcttttttatcagcatcaagaacgatcatcatatcgtttggctcagcagacttagcttcatcagttaataaccctgcctcatcaaaaatatccttatttgcatctgtccccatcattacctgaacttctttaacaccaggcattgaactaatatttttggttagaagcatcaaattgatagaatcttgataactattttttctaattactgtatatagcaaattggtttcctccctttgctggttaacaatttaacttacgctcttataataagaatttttggagtcaattacatttacttatctagataataaagaaagcgcttttatatcttataaggataatagaaatcgctttctttaaattgatttttatcctttcaagagtatccttaatgttgaacattaatacaaggaggaaagaatatggccatcatattaaaagatattcaaaaaatagaatcgcttaataattcaaagttaattgctggatcagcaggtttaaataatcccgttgaaaatattatgatcaccgaagcacctgacgttgagcaatggattacaccaaacgaagttctgctatcatcattatatggattcgataacctttcagaaaaagcaatcggccaattcatgcgatcacttcataatcacaattgcagtggattaattatcaagacttcaagatttgttaacgaaatccctcagactattattgatgattgcaatcagtacaaaattccgttaattgaaatccccaaaaatattaaatataacgacatcatgctggaatcaatgcaattactgttcaacgaaaaaaatttattgctgaatcaatacaaaaaaataaatcagcaatttattcaattagcaatccaaaacagctcattcaacgccatcgttaacttactttcatctttagtaagtaatccaacatttatttttaaaatcgaagataatattgcctccaatattattcataatgatcaaaatacgcataaattaaaagaaattgatttcacccaaagaagacctgtgccaaaaaaggagtatacaaattatcaatactatgaggtaacattaactgacaagagttttaaattattaatggtaaaaattcctcagagccaagatcagctttaccttggagtgctacaagaaaatcagatccttcaagatgtcgattttatggctattgaaaatgctgttaacttcacacaaatggaagttctaaaacaaaccgccttaaatcaagggttaagaacatatgccaacgacatcattgatgatcttattaacggaaaaattgcaagtgaagaggaattccaagctactttgaaacactttaaccttgtagaaacaagcaattatcgcgtcaccgttgtgcaagccttaaaagaagaaaaagtacagccagattactatcgagataatccccgagaagctgatcgcgtcgttagtcaatttaaactatactggcctaatacagtttatcgtattcgccaaaatagaattattctaatcatttcggaggatcagcaaactcccgaaaagcttcaggataacttacaaaaaatactgcagacacttgaggacactcatcctaatctaaactttcagattggattaagtgaaacttgtcatccaaaggactttaaggtctatgcatcacaggcattgaaaacacttcagattgccagccatttaaataaacggaaccagattttcaactacaacgatctcggattttacagattcctatttcaagttgataatccagaaaaattaaggtcttttgttccagaagatcttctaaaaatttacaaagacaaaccagaactatatacaacgttaaagacctatctcgaacataatcaaaatgccaaagctagtgcaagcgcgctctttatccatcccaagacaatgagctatagactaaataaaattcaggaaagaacaagtattaatttttcagatgtagatgaagtctttagattaaacgttggtattcgggtgcttaatgtactaaatgatgaaacagtatgaaaggaatgattttaattgcaaactattagttacagcacaggtgagaaaattacagttcatgccacattttggaaatctgaggcaaaagttaaaaaaccaaccattttttatattcacggtggcggtctaatttacggtaatcgaaacgacttaccagctccttacgtcaaacttcttctagagtcaggttactcactattttcaattgattattgtttagctcccgaatgttcctatagcgcaataattcaatccgttaatgatggattaaagttctttctaatgaacagtaaaaaactaggattactcaataatgactatattctttttggtcgctcagctggtgcttacctttgtctgcaattaatgacagaaaatcttagccaaaagcccaaagcattcgtcgacttctatggctttgaaagcttattatccactaatttacaaaagaaaaattcaatgtatgccagttacccaaaagtgaccttcgaagaggcacaatcgatgatttcaacgtctcctgtcacctcaagttctgtagaagaacggttcttattgtatgtttatgctcgtcaaagcagtcagtggcagaaaatgatctttaaggaaactcaaagtaaagaaaagcaactttcaaaaagtacactacaaaactttccaccgacttacatgtgtcagtcctcatctgatccagatgtcccgttcattaattcaatcatgttaaaagcaaagctactgtcaagggcagtttaaaaatgtaggttttcggcagaaagaaatgtaggttttcggcagttacttgaggccacgtaatcggtaagatttaccagtgatcttcactacgtgaacatgatg

SEQ ID NO: 445 - DNA, 4082 bp, Unknown
  Metagenome-assembled genome
gtgaattaactatatcaaaaagggggttctttttctgcacttaatgggtgaaaataaaaaatcgctgttaagtttggtggttccggacttaacagcgataaagaaacttagtaagaataatttgggttaaaaataataattttaaaatttttggatggtatcggattgtgctgagtctgattgtaattgcctactttggtttgatcgccagataggtcgttagcggattctttgtttccctcgttaactatagagcatgtgttgtatacattttaatgattcagtatataatagtaagcaaaattaaaaaacacactgatcttcgggggaacgttgaatgaaaaatttcaaattaacagcggctgctctgggcttagttctcggattgggagcttctgtaaatgtggacaacggtctttttgagcaaccagctcgagccgaaacggtttcgacagcgaaaactgttcagaagacatttagtgatcaaactaattttgactggacatacaatacagacggaacggcaaccttatcaggttttaacaatggaacagtcgtttctgaaccatttgaagcagatattccggatacgattacgcacgatgggcagacttataaagtcacttcgattgcgccgtacgctttttggcaacagaacaatctgataaaagttgtcatgccaaaatatctaaccacaattcaagacaatgcttttatttatcatgctgatctccaacaggttgatttcagcaaagccaccaatttaaccacaattggcgaccaagccttttttagctcggggccaacagatggtattaatttaccggattcagtaactacgattggaaactcagcttttgcgtcttcacaggctaaaagcatccattttccggccaaattagaaacaatcggcaagcaggcttttgccagctggccgggaactgacccgatcacgcttccagattctttgacgtctcttggggatggggcattcatttacagtcaaattccaagtgtgacattgccggcaaatttgacacggattggtagtcaggcttttcttcacaacccgaatttaacaaaagttgtcttgaactcaaagctgacacaaattggttcacaggcattcctgtacgatgataacttaagcgatgtgaattggcaggatgcatccagtcttgagaccattggggataatgcgtttacctttaccggtttaaagggttcaattgcttttccagatgcacttcagaccattggcagccaagcttttttgggtaataaactgacgactgttgattttggtcagaatttaaaaacgattggcgatgctgcctttgcctacaacgcaattaacaattcgcttgtgattccggcttcggttcagtcgattgggtctctggcattttttggcaatcatttaacacaagtgggtatcaatggcacgccaacggtagcgaccgactcgttttcttataatcggattaccaaatacgcggcgtcaaatgcgactatttcgagtggcgctgttcagcatcagacagcgacagcgttcgatgatagtccgacgttatcgatcaacagtctgtttaatgttaattttacgggaaccactcaaagcaaaattgcgatatcaaatttaacaaacaatgttacctatcatcaagatagtgggacgtttacaattcctgaaacaacaaaccagtttgagtttgattggacactgacagcggcaaacggccaagtttacaccggtcactataccgttgttcatgaaatccctgatattcgggcatttaatagccaaatttatgttggcagttcctggaccgctcaagataattttaacggggccacaattaatggcaaggatctggagttgggagagggcggcattcaatacaaagtaaccaacgcagcgaacaatgagccggttgatacggttgatacatcaaaggccggcaaatttaatgtgacttatttctatggtacaagtgcacaaagaacagtgaccgtggatgttctgccacaagcgaacctcatttatacgctgtccggtgatcaggagggcacgtatactggcaatgcccagagccttgacctcggcaaatacagtcttaatttaagcaatggcgagtcttatacattaaaagcaggcgatattgcggttaaagagggcaatctgacaggtgccggcacctaccaaattgtattaacatcacagggattagataatctaaagaaggatgttggtgccggtgctaatttaacaggaagcagttcagcaacctttaccattacgcctaaaaccgttacaccaacgttaacaggtaatgaggcagttgcgtatgatggcaacgcacataagccgacggccgggcactatactatttctcttgataatggcgaggattattcgttaaaagatagtgatattcaaatcgtcaatcaaccagatggtgtcacgcaaagtgggacttacgatgtgacattatcccaatccgggaaaaatgatattcaaaagcaaattggcgccaactatcaattggctaatgttgacacgaaagcggtctttacgattaataaggcagcggatgccaaaccggtgacggttaagtacgtagatgagagtggcaaagaaatccataagccacagatcattaccggaaaagtcggagaagcttatgacaccacaaccaagacgtatcaaatctccattgatgggtacacattgaatcaggcaaagttgccaacaaacgagaagggaaaactatccgataaagagcagaccgtgacgtacgtttacactaagaatacgacaccttcaacaccatccggtgatacaggaacagctacaccaacaccgggaagtggttcggaatcaggatcttcaagctcttcgagttccacaagttcgtcgtctgattcagctttggaatccagtacgccgtcaacaagcacccaacaaaagccattattgattgctaaaaagggtgccgctgtttattctctaaagaagattgggttgtatagcagtaagaacttttctgataaggctcgaaaaacctggtacgtatcgaagccgcgaatctatcggccaatgtttgtcgtgaccggctataccagatccagtaccgggaaactcagatacaaagttcgtgacgtcaatcatttgactaaaaatcggaataaaaccggttatattaccgcaaattggcaatatgtccgtccggtttattatgcggccaagcacaccacgtttacggtcattaatccgcgaggcgtcaatgcttatcgtaaagttaatttaaccggcaaggtgaccaactataagcagggcacggttctgaaagtaaagggcatcactcaccataatttgacgacccgatatattttgtcgaatggtcaatatatcaccggaaatcgaaagctcgttcaaatgggacggcacaaacaggttaagacagtgcgtgcaaagggtgcgattaaccggcaccgtgacgttaatttaagttacagaagccaacattattcaaagaaacagcaaaaagtttttaaagtttatgggttcgactattctcgcggtaacagtgtgaccaagcacggtactttaagatatcgggttgccggtggttacattaccggaaacgcgaaatatgtgaggatcatcgactcgaagtagaatatgttagatgattaaaaactaaaaaaacgacttgttagaaaaagctactatttctgataagtcgtttttatttgtgattgacgttgctttggttaaataaatagatcatgttaaacataattgtcatgattttaaataacttccgattaatgagataagtgagaaatttggctgataagatatttttaatggaaacaaacaaaggttgtacatccataagaaaatagttgataacattagttggctggcctattcatccatgttaaagtaataactgaaacttgaaagtatgaagacagactgatcccttggtatcacagggcatattttaattaatttaaccatttagcttgctgttaacagcgaaactaaccgtttcggcaaaaatgtgaagaac

SEQ ID NO: 446 - DNA, 7221 bp, Unknown
  Metagenome-assembled genome
taaaacagcccaactgattatgtccagattgtgaacattaaaaattgaacaaaaggtccatacaagatatttttatacaaacacttgcatttatttgtcacaccatactgtatagtacaagataataggtagcgtcaagaatcttgtgtaaatgaaatgccttcgtacatataatatacctcttgtgctagttaagaataccaccagctaaattgaagccataacgctcttgccctaaggcatgcacgacttccatcgtatgggcaaacaagatggtctctacggtcaatcggatgccggttagggtttgcgatcccagttgttcaaaattaaaactacgggtaaaagatgaaaacgtcgtttcgattcgtttccggtaacgctttaagcgccgcgtctgttgtgcggattccgttggtgacatattggatcgtttaggcgtccacaagataatcccgttagcccttaagtcgcgctgctgcggctggtttaaatagcctaaatcacctaaaaccaccaagtcacggcccgttgataacaggagatcactggcaacttgactgtcatgcaccgacgctgctgtgagctgccaattcagcacaaagccttggttcgttaaaagacaatggaacttaaacccataaaagggagtgcgtttagacgaattaaagccgatatcggcataatcacgcaaccgggtcgcggttaaattacgaacgggttgacaaagtggcatgggtaaactatcaatgatcacatacttgaaatcccccgccacgcgctgaacataagcttgacgtaaaagactaatcaaattgaccaagtcccgacagcgccgattatagcgtgagcgttcaatgaacggccgccgggcaaaccgtgtacggcacaaccattgataccattttagctgtgatgaaaagtgatgaagttggcccagaatggtggttgcgataatttccacatcagaaacgactaagtgctgatagttatggcgatgtcgaatggctaacggaaccaactgctgatataaaggcttgataatccgatagactttttgatattcacgttgtaattcatgacgatattgtttaaacttaaggtgctttcgcatgatgaatgcctcccgattaaagtttagatgattcaatcggggctcattttaatgcgggagctcttttgataccaggattcgagcttcaactagcacaagaggtaaatgaatgtttttttgattcaagattcccgctacttttttcattaagtcgtccattaaattggcgataaggaccgaagatttttttattgaaaaattatgtgcttcaaattgaactaacgtcatcatgtcgtccatcaaatgagtcaaccgtgcactttcatcacgaataatactcaggtattttacccgttcaccttctgatactgattcccgactggcgatgtccgtatagccttttataaaggttaacggcgttctcaattcatgggtaacggccgcaaaaaactcattccgttcctttttcgtgtgtcggagtttattagccatgtcttcgattgaattagctaagtcccccaattcatcctgactatctatcgataatgctacggacaagtttccctgggcaatctttttcgtttcagacgttattgctctgatgggtaaggttaaattttttgcgatagatgcggttgcaaaaatagttatcaaaaacgttaatataaccaaaactatgaacacgctagaaaaatcaaagaccattttctgaatctgcttagtagataagaacatataaacattaccaagcaatttgccctttttgatgatcggtgattttgatacgagataactttttttcatccagtcagagtgtaaaacctcagatttaccctgactagcactcgtgaattttgcaagatgctttttcattttagaattcaccacttgtgaagccatcaaagtttgaccatctggactttggacaataattgccatatcagtatcccctttttcagtcaaaacaacatgttttattgtttgagcagtgaaatcgttggtcaaaacatgggcatggttctccccacgcttgactaaactactggcctgttcattgatccaagtgttaacaactaaaagaaataagcttataaatattcccatttcaatagcaatcgccatcaataaaaatgacagtcctattttgaccgaaatcttatggctaaccctttgtttcataatattaatagctgcttttatcctaaccatttgtaaccaactccatatacggtaatcagcatcgaatccacagcaaaaccattgtttcttaacttttctcgtaaatttcggatatgtgagtcgacggttctatcatcaacctcagcgttgtatccccaaatacgctcaattaaatgattgcgactaaaaatgtcatttttattgttcaaaaacagcgttaaaatattgaattcaattggcgtaatttcgagttctgcccgatcgatacgcagttgatgagtccgctgatctaatgttaaattatttgattttattatgtccaccttctcagtacgccgaactagtgcttcaattcttgccattaacacatgctcatcaaacggtttagtaatataatcatcagcaccatttttcaagccaaagatcatatcgttattttgatttagggcggtcaacataatgattggcgtattatcaaattccctgatttttttacaaacttcccagccatccataacgggcatcatgacatctaatagaactagatcaaacttttcatgtctcaatcgctcaattgcttttacaccatcatttgccttctcgcaatgatagctatcaccctccagatatagctgtaatagatctcacattcgcggttcatcatctatcagtaatatatttttcacgctttccccctgcttttcgtctaaataaaaaaggctcgccgatcacggcggacctctctttgaaaatgacttgtgttatttttccactaccgtataaagacggacatcataacctgcattagctaccgcatcgcttatttcagctatctgtaacttatgtttatcaaattcaatgacgacttcatctttttccaaggttacattggcatactgcacgccattagttgcttcgagcgcatcctccacaatatgctgacaatgttcacaatgcatgtcatcaattttggcaattactttttccatgggatcgcgatcctccttaatttgacgctagcttattttcttttggtaacctgacataattaagtaacagcgaactgataacaaccgtaatggaactaagcgccatcgcgagaccggctagttccggtgaaaggataaacccgagcgcatagaaaataccagcagcaattggaatcccaaccacgttataaataaaggcccagaataagttcaacaagatgcggctatacgttttacgcgccataaccagcgcagtgaccacgtccattaaatcattttttacgagaacaatatcaccagattcaattgcgatatcactacccgaacccatggcaatcccaacggttgcagttgataacgccggcgcgtcattaataccatcacccacaaaagcaaccggcgctttttcttctaactccttaatatgttgcgctttatctccaggcataacatcggcaataacttcatcaatgccaatttcctcagcaatcgccgttgccaccagtttgttatcacccgttaacataactgtccgaaaaccggctttctgcattgccttgattgcggccttcgaagttggtttaggtgcatcttgaatcccaattaaagcaataatttgcccatcgtagcctaccaagaccaccgtttttgcttgcgcttgaagtttggtcattttatttttcagatcagttgtcatattaaaatcatctgctaatttgtcattgccgataaaggcttgctttccatcaataacggcctggacgcctttaccactgatagcttcaaagttttcagcttgtaagggcacgacacttttggcttttgcttcatttaaaacggctaaggctagtggatgttctgaagcaccttcaagcccggaagcaatgctaagaatctcggcttcttcaaatttaccagttgaaacgatatccgttacttgtggtttaccaacagtaacggtcccagttttatccataacaaccgttttaatcgtgtgagtagcctctaagacttcaccatttttaattagaataccaagcttggcggaacgtcccgtcccaaccatcaatgcagtcggagtagcaatccccagagcacatggacaagcaataatcataactgacacggcgaagatcaaggcggtaaccggagtagcccctaaaaatgcataccaaacaacgtacgtcaaaatagcaatcatcaaaacaaccggaacaaaaatgtttgaaatggtatcaacggtcttttgaattggtgcccgcgagttctgtgcttgacgaaccatttcagcaatattcgacaacattgtttcagaaccaactttggttactttaaaagtaaatgatcccgtattattgagggttgcaccgataaccgcgtcaccaggtcccttttcgacgggcattgattctcccgtaaccattgattcatcaagtgtagattgcccttcaacaatctcaccatcaacagccactttttcacccggcttaacacgaacaacatcaccttcgacaacctgatcaatgggcagttttacaaattcgccatcgcgaaggacttccgcttctttggcttgcagatccatcagcttatcaaccgccgatgaagctgacgacttcattttttcttcaaaaacggagcctaatagtattaaagtaatcacaaccgccacagcttcaaaatacgtaccagcgggtctagtaaacatggcataaatactataaatgtacgcaatcgtagtacctaatccaactagggtatccatgttggcgtgatggtttttaaatgaaacgatggcagtatgcaaaaatggcaagcccgcaaaccaataaactaatgaaccaaacgcgaacaaaatccacacaccatatttttctccgcccaacatggagccgccaaagctcataaacatatttatgagtaacggtactgagccaatcacaccaatgatgaatcttttcataactgacataaggtttcctcctcaaatatcgagcgttattatttaacgcgatagttgcccttaaccatgttcataccacacgtccattcataatttcctttttgaggtgtaaacctaaccgttacctgctgattgagtggtagatcatataattcgccgttgaacttgacttgttgcgtgcagcccttatcagcgactctcgtaaacgtaacctccgctggcttaccagcttttaatttgaaattatttggcgaatagccgccatcaaccgtgatattgattttattattatttaatccaagcataaacctagctcctttgttatttgataacgatcttgccatgaaacatgtgcattccacatgaatactcgaactcacccgctttagatgtgtcgattggaatcgctacgtcttgattcattggcaactcggcgtccactccgaagtctggaaaaacgactttctcaagacaggtcgttgaatctttccgattaaagactaattttacaggggtatctttttttatttttaaaacagctggattaaagccgccgttgacgaccactttagctgtttgaccatctttcgttgtaactgcagttgcttgactctcactatgtttgccaaaaaaccaccaaccaataaaaacgatcaatattactccaactactactgtaagtatttgtgccatatcatttcctcctcttaggtaataacggttatgtttcttttcaataatttaagattacatctgtaaacgtagaaagtcaacactaaaatttacatttgtaaacataaattgaaaattttttgagaaataaaaggtagattgtaaaattaatccgaacgctgttcggattaattttacaatctaccatttacacaagatattttacgctctcctcctaatgccctttgtgtctcatactagtttgtcagaggacagcattgcccaaattatcattattatcatcagtttattttcggcaggtatcctaactcgaaagttatttggccccatcaccttcaaccaagataactaaagctttgaggtcattaagtcgcggttaaatcgttacttcttaattaccagcaaaagcaaactgttaatgagcaaatgaaattttaaattccctggctaaagcttgccggagtcgcccttaatgacttttgaatcgttccggtcgttgaaccccatactttttccggtagcgaataaaggtggtccgtttaatgccggtcgttctggcgatgtctgcgtcactcataccggtttggtagagttgaaaggcatgctgcaggcggggatcgtcttgggtatattggggtctgcgaccatgatacttgccctgttgtttggctagcgcaatgccttgttgctgccgatcaataatccgcttccgttcactttcggcttgatacttatagagttcaataatcaggttggtcatcagttgccgtaagttgggatccgctattccggtcatggagggtaagtttaagacgtctaaggtagcacccttggcttggatggtgttcataatcttagttaggtcttgattattccgtcccaagcgatctaattccgtgaccaggacaatgtccccatcgcgaatataggtcaacagcttttgcagagccggccgctgagtattcgccccacttagtttatccgtaaataatttatcaacgtcttttaaagccgctaactgccgatctaaatgttgctccttggaactcacacgcgcataaccgattttagccatttccaattctccttttggacagttctaatgaacacttgtaattcctagtatagcacaaaaataaaaaagaccaatagggcagggcctagttaaacatcgtgctatcaacagacgcaaagggcccgctcatagggtgatggtcaggccaattacgcatattttaccgagataaattttgtacacttaggtgtacgatgtatattataagcggcttggttaatcaataaaatctcttccgttgagaagagactttatccgttaacaatat

SEQ ID NO: 447 - DNA, 4727 bp, Unknown
  Metagenome-assembled genome
cttctcttaaatcacgtctcacatcaaattcctcctacactctgatgtgattcatgatacaaaaaatgtaggaaaaccaacagttctaacctgccgttttcctacattttacgggtgccttttacaatttttgcgggtcgttccgataacgtttggtttgttccttgcgatacatagtatagggaattaaagccttgcggtttagagtttcattaatataggcataattttgctcactaccatacccagcgtcggcgacaatatagttaactggcgtttgttcaaaatcgatcttttcaagaaatggaatgagcgttcgctgatcggtggggcgttgattaacttggtaatacagtacaaactgcgactgcgttgcgatttgcagattataacccggctttagctgaccattaagcattggatcttctttcatccgcataaaggtagcgtcatgatccgtttttgaataactgttacgatcgccaaaagtggcttgttgctcttcgtatttttgtttgcgaggaagataatctgtttgaatcaaatgttggaacttctttaatcgacgtcgctgacgtttcttggctgaccctccgactactggcttttctgcggcaatttccttgtccagctgtccaatttcttgatcaagagctgaatttgcggcgcgaagcgcctccaccgacgttctgtcatcctcagcgatcatggcgacattaacttgctcttggattaaatcatgataaagtgctttggttttcacatctagccgtgcttcaaacttttcagaacttttccgccaaataaaactgtatttattggcatcggcattaatcttggtaccgtcaataaacaacgcttcgtggctaatgatgccattattaatcagactttggcggaaatataggtacattatttcaatgagcgacctattctttggatcactccgaaagcgattgatagtgcgataacttggtaccacgtcgggatcgccgattaaatatttcattgcgaggttctcctgtgtcatttgctcaatcatccggccagaaaaagtttgtcgcgagtaggcaaacagtaatatttttaatagagtggctggtgagtactgcggccggccgattaatgattcattcgcataaaggacggtagctggaattgagtcgataaaaacattgatgacatagacaatgtggccttttggcaaacccagttcaattggcaatgttaatgaggtctgattattgttatactgttggtacatagagaatcactcctattctttggtttggacgctttaagaataccagagatgatttctctgtgctacataaaaatacaaaaaatccaagtaactcgagaatatgatctcgttttacttggattttttattttactgagacttttgtcccagcctctttttttgtcttaattcaccaacaacgattgacgaagcccctttttaataaaagaccaatggaaattgataaacaagatgaatcttaattatcgaatggtgaataagtattagaagaactagcggtaggaaagcttgtctgacttggtgttgttgagtaactgtagtaaacagtcgtagcaccttgaccaaaggttccacccaatgcttgttgagctgtgaatgtatattgagcaaaatggctgatattaccatctttgtcaaatacagggaaaacagctgacttcaaagttttcaattcattatgcttgttgagatagttcagcacatctgttccagtataggaagcgttcgtgttaccactaaacaaatcactaattgctaaattggcaggtgcgatataagtgttttttgcagcagtagcaattgcattgttaatattatttaatcgattatctgtagatttagtggtggcaccacctttatgcttggtgctattaacccatgatacatagttagcaacttgtttcttcaactcatacaatggaacgccattctttgtgacttgagaaagattaaactgatttgttttgtcaacaggaaccttttcggcaaaatatgatgaaggtaagtttttaccacctacataactggttaattttgagttattagttgcattgctaccatttacataagctactggactaagtttttgatatacagtatcacccttagccaaaggaagcttgacttctgaaccagttttagcttgagccaataatgagatgttgttatcaagcttgaatccataaccagttccctgaagtgcttcattagcttgactttgtagactggtttgtaccgaactgtctaaagtccaagtataagtaccattatctgttgatgtaagagtgcctaaagtgtcaccttttttagcgttagtcttagtgtaatcaaacgacttgatagtttgacctgaaggatcagtaaaggtaattcgtacagcattatcggcaattggggcaactgctgatgaagaagcgcttgtagcttgcagatcagaagccttaaaccacttgccgttcaattgagcggcagcggattgagcagcagcagaagctgatgctgaagaagcagctgatgagttagcacttgatgttgaagctgaactagcaggggcagcagaaacttggtaccaagtttcgccttcacgagaagtagttacggctttagtaacagtgaatgaagcgccagagtatggtgtagtagtagtaactaccttgccatcaacagtagcacggcccactttgtattgtgaccaagcaggtgcattgtaagctaagctgctagtaccaggattcttcaaagtgaaggttgctgatgaagcaggagctgatgaagcagcactagtagtgtcgtatgaagcgataccgccagcaaagttagaagtgctcttaccaccatagatccagccacggtaagtcttatcgaatgatacgaccttgtagtaaactgagccacggttagtagtagcaacacgatatgcgcgccagttcttctgaccttgtttgctgtccttaacaccatttaaagtagttttagtagcaacaactttagcaccctttaaagtaccagctttggtataaagagcgttagtaccattaacgttaacgttacgagtagtagcgtcggaagttaattttttattagatgtaaccttagcaaatgactttgcactggcgtttgtgcttgttcctgcaacggcaacaaatgccaaggcagcaacaccagcaaataaagtctttttcatagactttttcatgtgttaattcctcctaaataaatataaattatccaagttatgtaagcatgcaataaacatacccccgctaacttgctactatgaagtatagcataactggcgtttaatgcaaagaaaaccgcgtattgtaacttttttaacatctttacgtaattaattaaagaaataatacctaaaaaataattatattaaagtctttcaaaaaatattctaagtaataacgtggtataatgcaaaatataatcagtttatctttataaaactgattatgctgtaaaaaaatattcccctcagaatataaatgatatcagttagtatttttgtacccccgacaacaaagggcgtctatcatttgatagacgccctttgttgtgttccttaaagcaattattaactatgaatcaaggataaggacatctactatgagacatatcttgaaggaaagtaataaaaaacaacctttcgctaagggaaggttgtcaatacgtatgtgtttggggaaacatatacatgaaatatgaatattaatctggagaaaacataattcttataaagagaaactatattttctttgggggtacagacgctaacacttggatattaaacatctgtgctataagcataacacaagtcacaaaagactgttcacttttttcttgaataatgcttttttatgattagattgtttctatcaattggaagatgaaagaactccacgaatcataattcgattagactcttccggtttacccgaagcacaggtaattaaagtaattacctttttcttgccaatatttttaatgtaacctatttgatattttgaaataactggattgaagtcaatatttgagacagattttaagagacattcagaaccgcgtttaccttccacagctcaaataaatcattaatcgcgattaataacttatttgaaccctggaaagcattaaatcagcctaagcaggattttctcgaccactggtttaataaatcaaaaatggacctctgatatggacctatatcaacaagcgtaaatggcttggtgtttacttatcaaccatcatggacctgactcacgacgtattatcggctattcgtttcaaaaaaagatggatactaatttagtcttaaagacccttgaagcgcggttaaaacatcgaaccattactggggacgctgattatccatacggattaaggatcacagtataaccacgatgattcaatcaacgttaactgagctacatatccgccctcatacagccgtcaaggtttgtccgtacataatgcgccaatggaacctttcacgcttccctcaaaaaggatgtgttttatcccgtgccggtcttgtgaagattatgaaactgccgctacccgtccttttgaatatgtgcatgctttctacaatagaaagagagttcatagtactgggctcccagacccccccctacagttgaattgcaaacacttagaagcccagatggccgcc

SEQ ID NO: 448 - DNA, 12529 bp, Unknown
  Metagenome-assembled genome
gtaatgtatccaacagctggggacagtggccggagtgtgtaggtaagctctgccggatgaccaaaactttgcgacccgagccccgaccatgaaacctcacgagtaccgaacacctgaatgtttgtgtctgtaattccccgtaatttaagtgtcattgaattagttgagacctctttcctaccccggcgtatctgagtttgtcgcttaaagcatagcactagggaggctagtgctttttttgtattgtgcaaaaaggtctagtacgcctagtaacattttggaatgacatactttccacgccaacaattctgaaccccgatatttaataaccgctagactgaccgagctaaggcggttagttattttttttgctgactttgatcgctcaaaattaatgcgattaaggccacgagaaaagtaccgaaagccagcattaattgtaaaggcgtccgacacggacctaggctactcctttcgtttaggattttctgggctttaaaggtttaaacaccataagcacacctccgattggaaattagccaccgccttaacttctctatggatctattataccggcagccgctctttaaccaaatataaaataaagaatcagtaagaatactaatttatatctggcagtgcaagaaataacttgaacaaatttagtaacgcagattacgcaaaaagatctcaatggttcgccccaatttaaaacatttgagtggtcgggaatttcaaaatttttaccgtgaatttgcatcaattcatcatcggtaatctcatcaagcggttgacctttgggaatgaagcggccgcgtatgtcactcggttgacaattttcattaactgcctcgttcatgtggcgaataatgcgtgcgcaaagtacagcggccaaacatcggttgttcttcaattcaaattgtagttggcgaagtctttccatggtcaaacagtaagggtcttgaggatgatctcctaactggttagccaattctaaaaaaattaggccttggtcagtggaatactatatcgtccattaagccgttaacgatggtaagccgactcttacgatcgacaacgtagcgactgcttgacctttacgtttttccagataaaactgtctcagcttcgaagtgactgaagtcttacgattcagaaattcagagcggacgatcttcgatggaacgtccatgacaaaagtaccacggttcttctttagccggttgcgacgaataaccatggtcagtaaatcagtcacattaatatccagtagtccctgatcaatccaagtatgatggttttgtaggcaattctaaactacatgagccacttgttcaatgaccaatttttggatctgatttttctcaattcaatcgctttaggttagtcgtaagatggtgttacgaccacgatggactctaaggtttaacttcatggtcagtttggactttaaaactgcgtgatatcaaccagctaagcgatgaacctcattaaagatagtggttttactaaagcctaaataatcggcaatatattgaagtgagggcttttcatgatgtgaagtgtttcgatggacaaccggtcgtcaaatgattaaaatagtggaggcccataaaggtccttttctaatggaatgttgttgtggtggacacagtaaagacctgtatgggtgtttctgtccactacaggttcacttaaattttacaatctaccatctgttaaaaaaaacagtttttaactgctaggtcattaatgtatagataaaataaaaagcaagcactagtaaaaagtgcgctgctttgattaattatcaaaaaaatccaatctctatttataaagggttatcttaccaattaaaatattgataactgatcttcaatggactcattatttacgttctaagaagcctaatacagataaatttggctaattatccatgtaaatttttgtgcaatgtgtctcctaaagtattccagtttctagtagcgaatattatagtacacctaaaataatccactaataataaggtactagcaattctaaatttgaatatttttttcatgattccattcatgttactactttattacattcgggccccaacaacgagtgtgaaatcaactaatactaagtgatagctccaattatgaaggaaataattgccctaccagctaaactaggcccccaaggaaacccaacaacggcctgtccaagaggccgatccaactaaaccagcaaacaaggttagcaatccaccccatcgatttacaattatagtcatggacaccagcatagcgccactaatagcccggacaataattgcccaacacatccatgagtcaacatctcctttattatttaacccgggcggctgactaatcattctctttctgattatccacgctttttttagtttatcggtcacattctccacccgagattgtaaactgacccgcgtctttttcgtatgctgttttagttttaagtcggactactttaacgttacttcaataaacgtttgaaatcgtcctctttttaacatgtccacgatttggtcttgatttgatcatagaatttagaatatcaatgtcattattcagcaaacaagttcccaaatcaacggccactggtgtttcccttcctcaacatcaaattcccgacgtgacatcgtcactattgactatttatcagctaaattagagaaaaagccgcattaactgtcaagcagggcctttgacattggccaatgcagcccgatggatcttttttgaaattaccttatcatcgtagtcattcgcctgtgattagttgtgtggagttagttaatttgtggttttgattttgcaataataaaattccccctagcgtaaagatccttaagattaccgcaacttttaagtaacttattaaaaaagttacatcgttgcagtaccagcatacagccgatgccaatcagaaaaacaataagatgatcagggtcttttaaaaagcccaagcgtaagattaaaaggcgattaataagcctctaagcccccaccaataatgggccattatatttttgccaatatttgccatataaatttacctcctacataacccgtgaatggtggaattggctggatgatcatttaaacttaatactatctgttgtcaggagccagacccaaggtcgttttaagcgctgttttcaaatgtgaaagaaactcttttccatgttgagtggcctgatcagacggccaacaaagcacatgagacccgagttcaattttgtgtagataatctggtccgtactttggggtcttgaattattaggctcttgccttcaaagcagtcaaaacaaaaatactaaggcttcccgagttacaatttaattgtccgtaggcttctgctacaggtacatcgagttaggcgatgccagaaaaattaatgaccgcaaaaggccaatcaaaatgagtgataaagcacacttcccagaataaatataggggtgcattttaccgattcacccaatcataggggggacagttaaatcgatgggagatggcgtatgagtaaccctagccaggttgccattaatgggaaaatgaaaatggaaatagaatgaaattaataatcaggtttagagcaatttattaaattatttttcaaagatcgcctcccttctatgacatcagaaaacagttttttaatcaaactgctcagttttgatgagacattcaataaagaaaaatatatatgtttaacgttattagataaatagatttattccaatattcataatttacgattttaagtatgaaatattctggttaggtaataaaaattcaccttaaaatatttaagagtagaagtgaatctaaagtaatagctattcatcttaaattaatggggggaaaataaatttcaattagacgacccacttacgtcatgaaaagggaagcgaaatctatgcgattaaattatttgttattgttcaaaaaaagattaaaaagatgctaataaattatcgttcggcctttgttgacaataaaatttcggcacacgttttttcccgcactggtggcttttatgagatctggaaatgcaaattattttttagcagtgaaagataacccaatttgattaacataaaataattttttttaaagaaaacagttctgcgagagatcagtatgttaaatccaccaataatttcattggagatccatcaggaacatcttacccactatggctagagtggagggagcaacaatattattttgccaattgaaaaattttatcaattttaattgtatcattacgaattaatattattggacacagggtaaaaggagtaaaataatatgccttcaataacaaaaattctattgaaaggcattggaataaatgtgattcaaaataagaaagcgattcagaactatttcgagattgttatgtaaattttaagcaattttacttttgtttataaagtgataacctagtagtaaattaatcagttgttccaaatcattatttacgccactttttaatggtataggagggaaatttaaaatgataaatttactagtaacaccaagtaagacttcaagtcgataaagcttaaacattggttattagaaatcatgtgtcattccaagagagagatagtctcgcgaccatgaatgcgtccgaaatcaaaatattattaagcttacagaaaatgggttcgttgggatctagtatctacacgttgcaaagtatttaaacaactcaatgttgatagaggagctgacttatcacagtttattcggtgcttactaagcatcctgcaaaatgataaacgtcctattatttttgatagaaattactttacaatcgcgatatgtaacgagacgagattcgaagtttcttcctgaagcgttagagagaaaaattttaagcacctattagccaaagcaattaaacaaatgaaggctagtcttctttattagataaaacaaatagtgatataggattagtactatatgatattcctgatccctttttattcattggtattggtttagcgtcagaatcttgtgtaaatgaaatgccttcgtacatataattgtatataacttaaatatgatgcttccaacggtgtcctggaaagtctttgaaccctcggtggatccgcttcagagacttctcgttatcaaactaaactgagaaccagagcatccttaatcttccgtgcgaaattgttctttgtggtgggtggtgcgcttgagattgcttattcaaagttctcaatcaggttagtggagtaagtgatttgccgtaatagctggtgaagtccccatgaaagttagtagattcggcattttaagcagatctttgattaattttgggataggttctgatgccagtgttttgcgaacttcattcagtttcagttcggctgcttcggcggttggcgggcccgattaacttgttttaaagtcactgatcacggccttgcggtcttttaaccgaactttggtatcatcagagtcgcgccacatgaaccaggcaacgttttttttttttgtgtcgtttggcttttagggaatgccgatcagccttcatatccaaaccaactaacccatcggccacaaaccacacacatctttaacgccctcttgatcaaggttcccaacagttcagataccagaattcccagacgattccgttgcgccacgtggtagttccatcactctttcgtaccatctggacgaatgccaatccaatatgaacgcttcttttttgtaagacggtatcccgcgctttaacggcaagtaatggcatcgtagaagatggccgcatattgtgaagccagtcgaacgttgtctgaaagcttgaacctgttcattgacggctttaggtcatgttggacaaccgtggcttttggagtagtgattcacctacattttgctcaatgagttcggcaattcagcagtggtaattcctttgggtatatcaactgaatgaccgttgttttctaaattatcacctgtggccgaccgaggctgcaggtatgattttcaaacaaaaaccggccattgcgatcctcgaggaaggttaagcaattggccgtacttcgtatcaacgaacgctcataactgccgtttggcggttattaccatttgttttaatcccagcgtaggagtagcgttcaagaaaggtaacgccccaaactctgccaattcggtttgaagcagctggttaatcgcaatttccgagtggtgacgaaaaccttcgtccaatcttgcttttggctagtgcagcgataatttctgtggtaagttcattcatggggaaatgcctcctgttatgtgttctgtggttacaaatatcataggaaggcattccctatttctaatacattccgaatgctccaacgtcaagttttggtactaaaaaaattagccgttatcctaattcttttctttcggtgtttatacccagttactgtaattttcaactctgaggactaaggtttcctcaaaactagtaaaacgtgtttgaaaaataaatctcgttaaagtagcgaatggaaactttcggcggaccgttatcatatggataaccttgtttttggaatatgaatgcctaatcaggggtgccgcctttaacagccttcataacaatactggtgtattgtgaacccatatcagaggcaaaaggttggggcttataagccttgctcaggcttgcaacaatgtcttaataaattcagtttcgatgccatctccttgccaatgttgaaagcgatgatttgcttactactggtcaaagatggtactagataacccaagttccgtggtcttagttttcctagggtctctgaagcggatccaccgagggttcaaaggactccaggacaccttggaagcatcatttatttaagttagatacatattatatgtacgaaggcatttcatttacacaagattcttgacgctacctttttattcatcgaaatgcgtttagtgttttactataacacgtatttagaagcaacttgtttagatctctcggtttgtaaaattaagttaaccccgatttaaaattgaagtgcaacacttgataactagaccaattagactagcttaaaaggccatgaaggcctattcttattattaacgacaaaatcaacagataaggataggtgtcttcatgacccaaactaagaatatcatgcctaagcattaccaacaactctaatcttttgaacgcggtcaaattgagtccctgactcgattaggatttggcgttcgtcagatcgccagccggcttcaccggagtcccagcaccatttctcgcgaattaaaacgcgggttaaccacccagattgattcccagaaacatcggtcatatcagggctactttgccgagcgcggggcggcttactatcgagaacagcgggccaagtgtcaccccaaaggtttactgcagcgggctgccgtgttcttcaagtccctgccgaaagctttaaaagctaagccacgagttttcagtgtcgatacgtatgtccactatttcaaagctcattacccgggctttccctgcccatcaacggctacggtctatcggtatatcgaggctggcaagctcccggagcttcacaactatgatttacccatgaagctacgtcgccgcgttaaacgcccgaatcaccgacatgcccgcctgaataaaaaacggcttggacagtccattgaagaccggcccgcagtggttcggaaacgtcaggagttgggccattgggaaggcgacttagtgaaagccaaacgggttgagtccgaaccagctttaatgacgttaaccgagcgagttagccggatggaaattatcgttaaattgcctgattaccgggcagagacttgccggcaagccctccaagatacgattgatgatgacggtgcagaaaactttcggacgatcacgtttgacaacggctcggaatttgctagtttaaatcaggttcaaggaacggaaatctactttgcccatccatattctccctgggaacggggcactaatgagaatgtgaatggtcaattaagagagttcttcccaaaggggcattcctttaaaaacctctcattagtggatctgcagttggttcaagacacgctgaatcaccgtccccgccgctgtttaagctatagttgtccagcggatgttatgccacaactggtttaactttctagaccaattataagaataggccattagtgttgcacttaacttgacaattgaggaaaattaagttaatggcagattgcaagaaaaaaactttagtaaacaccctccaaaactataagtaaagaaaatagggtccctattttcttttaataccgtatttcacacggtatcgaataaaggtcgtccgtttaatacctgtatttcgggacacatcaatgtcactcatgcctgctcgataaagcttaaaagcatgttgcaagcggggatcgtcttgggtgtattggggtttgcgcccatgatatttaccctgctgcttagctaaggcaatcccttgctgctgccgctcaatgattcgcttacgttcactttcggcctgatacttatagagttcaataatcaagttggtcatcagttgacgtaaatttgggtcagcaatccctgtcatggacggtaaattcaacacatctagggtggcacccttattttgaatggagttcatgatcttagtcaaatcatggttgtttctgcctaagcgatctaattcagtgaccattacaatatcaccctcacgaatataggccagcattttttgcagttctggccgattagtgttagccccacttaatttatccgtaaataatttatcaacgtcttttaaagccgctaactgtcgatctaaatgttgctccttggaactcacacgtgcataaccgattttagccatttccaattctccttttggacagttctaatgaacacttgtaattcctagtatagcacagaaataaaaaagaccaatagggtataccctattggcctgttttgattccgtgattccaactaactttctttggtctattaaagttaacttactattagggtctgtcttaaaacaaactttttagccaaagttccggtataatctggttaaaaaacaagaaatgaggaatcaccgcatgactaagcctccattaaccactaatcgacacgccatctctgatgaaaagtggcagcaaattgaaaagctctttcccgcctataccactggtcgaccacccaagttaagtaatcgagcggctttaaatgccgtgctctggcaactcaaggtcggctcaccctggcgagacttgcctaccgagtttggttcttggaaaaccgtttatagccggttccgaaagtggacggatagtggtctcttcgaacagatcttcaaaatcatttgtgaggacgacgatcccgacatggagaatgtcagcttggactcgacgaccattcgggtccatcaaaagggcactggggctcaaaaaaatcccgctgcacactagaaaatcaagcgatcggccgcagtgccgggggcctcacgaccaaaattcatgtcgtcgttgatggcctggggaacccgctcaaaatgatcctcacgggtggtcaagttcacgacagtcaagttgcgcaacccttaatcagtcagttaaaaattgccggcgtcaatgtgattgcggataaagcctatggcagtgaggcttttcgccaatacttggaagctgaggaaggcacctataccattccgcccaagagtaacgctaaagagaaatggccggtggactactacgtgtatcgtgaacggcacttaattgaaaacttcttcaatcaactgaagaacttctggcgaattgcgacccgctatgacaagttagctcacgtttatttagaacgcgtttacttggcggcgattctgattcgcctgaaataaagttttcagacggaccctactttcagtacaacatttttttggttttttgaaatagcttctttttgtgcttttgtaagatttattttaccttgattagcggctttaccaggagtgatacttacaaagtccataaggttcttataaaacaaattagttgtttcgttgtgagccaatgtatttttatataaaagcgcaattaataattgtaccttttcttgatagttaataactttttctaaatcaagattaatagagtcaccattagtatgaattaatttattacggcactccattcccctcccaagtgctgctctcaattctttaggtattttccaaccaaaaatgggattaaagactttatcacttgttaatttaacaatcgacggactcggtaagttctcgattagtagtctaagttcagtactccgactactaaaagcttctttaaccccaatttctgctgccatagtcaaagatacataccttattctcaaatctgtaatagatttgctgtgctgaaaaatcaataatgataatggtatattttgattgtgaatgatacaacttcctaataattttaagttatcctcattagacaaggacagtctcatagctctatctgggaaaatgattttcaaatttaagggacaatctgtccaggtgtcatcattaaaatttatttggagttttttcgttattttgtttgaatccaaattaaccaaattaaaaaagccaacaagataatttataattttagtgtcaatctgtagtagtttatcagagatttttttgctaatttcaggattgtctttaaatcccttcttttcatcaaacgcagctttatcaacgttgaggtttaaaaaaaattcaatggttttatccttaaatattattgatttaatttcaccagaacttaaatttaaggtagctgtaccgttaactaaatcgtcttcaaaaataatagtgcgttttaaaatagccatcttgtcctcctaaacttcaaagcttatatatattatgcgtttaatctgtcttactctttttattttctatgaggtaaattcgattcacagtttttcaaccaaccatcaaaattatttttatttctctcataaatatcgtaagcagttggataaatttccttgaacttatttttaaagtcgtcaaaaaaatgcacttcgagtaatgaatttctaaccttttcaagcttcttattaatccccttgactaaatttccttttttccctttagttagataaataggcctaccatttttagaaatgcctagtgcttgagcaccgcgaaatgcagaatttttaactttagataccggatcatgtatcaccagtctagtcagtatatctttagattgtctgcaatcatattctttcagaacctttacagcagacaaacgttcacaccaactattcttattatttgctttcttttttaactcttcaatggatgtaagctagttcctgagaacctgtttttaatctttgctagatagaatccttttgatataatttcattaaaaaggtgattttagatgattggttatcccagcgatattacgcgacagcaatttgaactgattcgaccggatttagaagccgtgcgtcaacgcacacgaacgcgccaagttgatctctacgagatctttaatgccgttctctatattctgcgtaccggctctcaatggcgtcagttgccccatgactttcctaattggcaaacagtttacggttacttccgccgttggtcggaaccaattgatgaagttggccatagtcagttaggtttaatcttaaaaaaattgtcgatcaaggtcgattacacatgggccgttcggcaccaacttcattcatcattttagatgcccaaagtgtcaagaatactgaaacggctgaaaataaaggttatgacggtggcaaaaagatttcggggattaaacgacatttagccgtggatattaatggttggccgcaggccattcatatcacgacagccaatttcctgagcgggacggggcagcagcgttactggctctgaatgtggatcaatttcggttggttaaacggttgatggccgatggtggctacacgggagaaaaatttgccggtttggttcaaagcatgatcggtgctgaaatgatcatcgcgaagcaaagtgatttgaagcatggacggataaccccacagcgttgggtggttgaacgatcctttagttggttagacaagtgccggcgcctatggcgcaactgcgaacgacacttacaaactagtcgcatcatggtgcccttagccttcatcggaattctattgcgacgttattaaagattaaaaacaggttctgagacaacttatttattttaataatacccgaattattcatagcttcaaaacagcccaccattttaacgatttcgttaaaatggtgggctgttttgaccttaatgagcactttactgatgcttcgatcatgtttggtgatcgcttaacgaaacttttctaaatttggggcgcacttatcccttggtgttaaaaaattgattttttggttaaaccaaca

SEQ ID NO: 449 - DNA, 12722 bp, Unknown
  Metagenome-assembled genome
gaccaacgagcgaaagcgctcgttggtcaataaaatactttacctaactaaattatactaattttttcggtatttgactaccgttaggttagtatgtccttttttaggttactttcttataaaagttcaattaaaccaagtgcaaattcatctgctcgtttctcatatttacttcttgaataaactaagcaatgatacccgcgtaaatatggtgaatgatcagatggccaagctcatgcgtacaaataaagtagttttgatttccaccaagtaggcggtcatttatgaaaatagcgttccttttaaatagctaagtctcatccccatatgcatgaggaatactgtgttttcaacattgccattttaggatcccaacgacaccatttctatttagtttagaaaacatctaccaatactaaattatcctaaaaattaattcatttcaagctggatttcaaacaattcgatattttctataagtatagacagcctaacgtcaacatctttaatggtaatttatcaacttaccaagactaacgacttaaatgaccaagtcttatgataaattagacattttcttgtagcattggaacactaattccagtttaagtgcttttacattaatctcgttttgctttacttcactataattagctgaaacaatgtctgattgatagcaattctcccaatgcaagcaaatccagtggataaaaaatgttaactcaaaacttaaaaatctccccaacaagacatggtattaaacccatgacccattgaggagactgtggctgaagcttgtttcactactgatcacatttaaaaatttatcttctatacttagccgaacgttatcagataactaacgcgtgcaaactctcgccaatcccgctattatttaagatattgcggatcatcggtttctgatccccacaaataataaaacggatgactgccgaccttatatgtccgccacatagcagcgtatgtgtggccgttcgacttccaggtttgggacttgtcgccaagttcattaatcgttaatcggtaatacccatgcgttttcttttcggtcagaccgctaatcggttgtcgataatatagtcggaattgtttgtccttgcttgtcgatttagcgatttttactgtctttgacggcttgattgtgtaaatcggattctgcctaccatttgcaggcgtcttaccgtataaccaagtcgtttgaatatggtaatgcttcagccgtgatgaactgaaatattgaagataaccgtccattgtaatgttaaaaatcggtttataataggattcctgtgtattggagaagcttcccgcttgaaacatatactcggaaattgggagttttaatttatatggttcaaaatatgttgtattgaactgcttgacggcgtatgaagccgatcttggatcatagaccttttgtcgtaatttgtgactgatcaatccccaggttaaggcagcttcagagcgttgaccattttcggctttctttatcttgaccacccgtagaacagtccctttaggtgttagaagccgttgatgatgccccttgacgattttgtactggcccgtaaaaatcggctttttaactttgacatagaataaatgtggcgtcttccctaagtccgtcgacgcgtgagttggtgttgccaacccaaccaataatgcaacccccgttatcatcccgatacataatttcttaaacataaccccatcccttcctttaggcagctttaaagttaatgccccttacttttaatcgtaccagtcttgagagattaatggaagaagtgttctgaaactttccttttgctggaattcattttatgatatctatagttatcatatacaagtgtgtggtgcaaagcggtcatcacccggaacttaaggcgtcgatttgggaaatctcacttttggatttttcaaaccaatcctttatttgaagcggtgatgctttgaggagctgtcctggtataaatgttgctattttccacaactacgaaaaaggagtctgatatcatggcaaataaagttactcacgataagacgtattcaaccaaagtcagtcaagaagttggtaataaagccgaagcctacttggcacaatatgatattagcgtatccgactatttaagcgatgcgttaaccaaagcggccaatcatgaggttaagatcattaattacctcgatactccggaagcactggaagcaaaaagggaagctgaagccggcgaagggaaaacttatgattctctagaagaactttggaaggatctaaacgattgaggggcttctcgcttttaaacgagttaacccactcacgacaaggtattaagaaggaaatggtacgaccatgaaaattgaccaattaattgcaaaggaacggcgtaacgctgaatttaaccgcgaatatgaacttgagggcgaaaagctgcagatagccgttgccttatataaagcacgtgaaaatgccggtttaacccaagctcaactcgctgaacgcgcccaaaccacacaggcaattatcgccaaaattgagcgtggcgataacgtttcgattgataaactttcgtcaatcactcatgcattagcaaaaaaataagggttcgttttgattaaaaaaggatgtttacagggccgcttaaacccttgcaaacatcctcttttatgcttaacgataaaccattccaccatcaaccagaattgtttgaccggtaatataatccgaatccggtgatgccaagaatgaaactaatttggcaacatctgatggtacttcgtaacggcctaacgatatttcagcactgtattttgcgaatgcctcacctggcttcaatgacggatcgtgcttaaccatttcggcatcgattcgatcccacatcttggtcttggcaacacccggtgcataagcgttcacgttaatcttgtattttgccaattcctttgaagccgtttgcgtaaacgaacgtacgccgtgcttagttgcggaataggtgcccagcattgcataggactcatggccggcaatacttgaagcactgataatcttaccgccgccaccttgtttaatgaactgggtagccgcagcctgggtcccataaaccattccaaagacgttaattgaaaagacacgttccagctccttttcgtcaatttccaggaatggcgtcacagcttcgatccccgcgttattaacaaaaacatctaatcggccaaacgtatcaaccgcatgtttaaccaacgcaaactgatcgtctcgcttggatacatctcccgcaaaactcgttacttcgatccctttatccttaaattccttttcggtttcagctaacagatctttgttgatatcatgaaggacaatcgcaaaaccatcattggcaagacgctctgcaattccctttcccaagccacctgctgaaccggtaactacagctactttttctgccataataaagcctcccctaaaatgaatcggtttagattagtatctgaatacgctatcatattaccccgaccacaaaaatgttgcacacaatttgactccgaattcgatgaatcttttattgctaaaagttgcttttgaattccttaatacttatgatccaaagcctaatccacctcatttccatatctcctttataacaccatctcagcctactattttctgatgtctatgattgatttttcccagtttttaggttatatgttaaagaaaaccaggagaatccaaacgatgacacttttaaatttaactcgtgcatggccggcacttcaggaacaaacaaccactcacgtcatcctgccaaataacattcaatcggatcatcccctacaagtcctctggctgtttcacggactcggcgacagtggcaatggttggattcgaaaaacgaatttggaggttctgacaaaatataccaatttagctgttattacgccggaaatgggcagaagcttttacatgaatatggctaatggcctaccatactgggattacctaactaaagaagttatccccgaaatgagaaaattgcttccgctatccgccaatccaaaagacaactttgtcggtggcgtgtcgatgggcggattcggggcacttaaacttgtttttacccatcctaactggtttagtgccgccatcgccatttcatcggtcgttgatttatcaattttaccggaactgatgccggactggcgcggcattttcaatgaccctattcccaagcactatctggaaaagttagcatcccaggcaccacagagctcactgaaaaaaatccgcttttatgactgcatcggcgatcaggatttcctgaaagccgataatgattcttttgtgacttatatgaaaacaaggctgaacttgaacgtcacttacaaaacatcgccaggtgaccatgactggttatattggcagtcggtcctgccggatgttttaacttggttgttgaaggctcggcttgataatggtcggtcggtgttaaattagtctgaaaatatatcagaataagccaaatatcgacacacacaaaaaggaggctacctcatgaaagataaagcagttgaacatgataaaaatgacaaactcattcaagttagaattgataaatcagttgccgctcaagcagaggacatttttaatagaattggtgtgacgccaactacagcaatcaacgcattttatcgaaaagtcatcagcaccggtggtatcccgttcaatttaacaataagccaagatgataaggatgctttggagattcgccaactagcgaagaagatccctgtagaacgattagacaccgacgaaaaaataaaaaaatggtttgacgatccgaggtatgattattaatccttttgatgtggcttggatgtacgttgcctttgtacagggaaaaggtggcaagcgaaggtccatactcgttctggaagattcaaataatgatttatctttttatccgattactcatcaacacaaaagaaaatcaccccatatccaaaaacagtattgtccaatcgtcaattggaatcagatcaaaggtctaaccgaaccttcttacattgatatcgtcaaaatctttgttattagttaaaaagacttaaatgatgtgatggtgactgggcatttaaccagacttgatgttatcaatctaaaacactttattaaatactacatcagttccaaaaaagcctaaatcgttttaaacctttaaatgatgattacccaattccacaatttaaaatttgataaagcaaaagctggtcatcctaattcgaccagcttttttcatgctcatttttcgcgcatgataattttaatcaaaaataaagcatcatctatatgatcaatattaaatggctactacattgtctgtcatttttcacctgtttttagattataactatgtcaaaagtattatagtcagccggtgcaagcttcacttgaaacccgactgccaaaataacggcaacaatcaccattaagataaaaataagcagaaccgtcaaatcatccatcgttaagtatcccctctaattccccatttttgctattagtgctatgacactttccattaaagagtaatcataagttaaatagttgtaaaccgttttatcaaatagttaaatcgattttaaaataagttgcgattttatgacgttccttcattttataataagaaacgtataaaattagtttaaataagaaactgaagtaattaattaagtacttgtgttatgttaatataatttttgttgtttccagctggaacaaaattatttagggaatgagtgtgtttaaatgattatgaaaaagggatttgttattttggcgggtattggagccggtttgatcttaagtgcctgcagcaaccaatccgttgccaccatcaacggatcaaatattaccaaagacgcctattatcaagaaatgaaagactctcccagtggtcaacaggctttggggcaaatgattcttgataaggggttagaaaaacaatacggaaacaaggtcaagaatacagccgttacccggcaattgaataccgtaaagaaacaatacggtgcttcttttggtgcatttttgacgcaaaacgggctgacagccagccaatacaaacgcaaccttaaagaggatcttttactaagagcggctattaaggcagatacaaaatttacaccagatatgttaaaacaacagtttaaacattatcagcctaaagtgacagtgaaccaaattttggtttcaaaaaaggcaacggctcaaaaagtgattaatcagcttaacgccggtcattcgtttgcaaagttggctgccgcctattcaaccgacacagcaaccaagaaaaagagtggtcgcatttctccgttcgacaataccaacacgacgcttgatcccaactttaaaaaagccgcattcaagcttaaaacaggtcaatacaccaagacgcctgttaaaacccaatatggctacgaagtgattcaaatggttaatcatcctgctaagggaacgtatcaaaaccataaagaggcactaaagaatcaaattgtagacacaaaagcagccgataacaacacagtccatgccgttgcaactaaagtgcttaaacgtgggaaggcaacggttcacgataaacagctgcaaaatgtgttggctggctttgaaaatcaatcatcaatgaaatcttagaatcaaagccaagcattaattcatcactataaatcaaaaatactgcctagaattttcaaatggactaattctaggcagtatttttaaggtcaactggagaaactaagattctctaaaatcgactctgttgtatttataacatcatcaaaagaaaggtctttaacaaaagaatgtttatttgcatactgttgccaattccgttgaaaatgcttgtcagttcttattaagcttataatttcttgccaattttcccattcagatgatgtatggcgattcttaatgacgtaagagaaagcaacctgcaatattttaaagtttatttgcttcgtctgatttagcacatatatatcataaaaatccctcattcgtgtattaagaatgccacgatacaaaacagtttgcagtttttcagataaaattctttctgggcgataaattagtaacgggatcttctgatttcctaaaagtggtttataggaaaaagcaatttcatttggaaccagcgtctcacctgttgcaatgtcaagatgaaaaatatctttcaaattatcgatagtagccaaaattcgtacccgttgaccagtatagtctttctcctcctgtatttgttgaatatcaatcaagagataagaaaccccatcataccgtttaccatcaataatttcattgataatttctgttagttcatcagtcttgaggctaaccccctgaagcattgtatccaaatcaacagttgtccgatgttgaataccagtaatcgcagataatacaaatccacccttccaaataaaattcttctgatattcagattgcgacaacaaatacaagaatccgtcaataaagtactttctcagtaaaatagtcatatctgttccagtccgtttacgaacatttttaagacgatcacgcaaactattcacttcatcaaaattattcaaatcataagctccataatatctcttactttattttcaactttcaagcgtttagccactactaaaagctgattaaaattacgatctttcgagtgtagataacgacgataactttgcttaatttgctcttgatcagtcgggcgggatttcaccaagtcaaccaatagccgttcttgactatatagttgaatcgtttttgttgtgccctcaacatcaagacgttcaacatcattgctaagcatcggctctctaacctgtttaaaatgtacatttttagtccaatcaggataacggctatcgggtattcgatagccaagaggcatggcaatatggattgtgtacgggaatgtgtcacttaaattccatagatataaagctgtattaccataataaattccctttcccaatactaattgcctgattaagaaatcattgattggaaattcactagttatgaaaatacgattatcaatactgtgcaacagcttttcctttgtcatttctttagcaaggaccaaatcactatccgacagttctgttgctaccaataaattatcctgagctaacttttttctcaaatcatctaaacgtttttgcttttttgaaaaatagttttctattttagtcactgctaactccccctgctatgtagtatacagtattccaatacatttgtaatttaaaataatatttaatttcatttttgtattttgcaattattttaaaatattaattacaataatcgcaaccttccatcccctaagctgctgcccaccacaatcaaacgcgttataaatatcatacataaaagcagaaaaaagccaccaagaaaatggtcatgccgacacattcatttcccagtgactaaaaatttttatagtctgtttcgctaaaatacagtgtacatgaatttagcttgataccaaacccgacttctaaatgcatacgtatcaccgatatcccaaccagcgccagtggaactcagcaaagctttccaataatgattgtgaacccttatcttcttaacatgccagtattcaggtaccatggctgatctggtatgagtcgttttagcaattggcgcggtaaagcggtgacctgaagcgatatacacagattttttaggcaataactcgccattaaatcctctgcgcgtaatcacattaaaatatcgatgccatctaccaccataataatcatgatcatacacatgtttggctgtaattgtgatcttatcataatgaattctttttgcatggggcgtatacgaataccaggttccccttgcccatctcggaaacgtactttggctgtatgaagcactagctgatccaggcactaccgctaaaccaatcatcaatattagaaacgctgcaaaagctaacaaaatctttttaatcatcctttatccctccatcagaaccaatgatatccatgataaactttcaaaatcttgaaataatgtttggaaggccagctgacattatagccatacttagaagttatatcataccggccattaggtccaccagtgagatgccaatcaaatccaccaataccggcataccaagtcctgacaatgcttcctttatgtaatctaccgccatttacccacttattttgatacgtatacttaccataaatgaccctattgatgcgaattggttttaaaacttcgactttatactcgtgccgataatgttcttcccagcacagcggctgagctgatacccgttgaatgttgccaaaacatgccaatccaatcactgctgacaaaagcgttactaacccgattaatccttttttgttcattctccccaataccccatttctaaaaactgattgattttataccaacagatgctttcgtggtctcaattaacagtaatgccaaaagccactccaattctaaggtataagatcaaaatacatcattaaatgtattcaattttattatacttctaatactattttgtaacctgaaaagtcataattttttgctttgtttcttacctttcaccctgattgacagaaaatcattttcaacagacatctaactatgatataaacttattagaagtgtttttttaaactgtcattaaaaagttaatcgaaaggataccactcatacatgatcgcatttcaagccatacgaggtgtcatcttcactgaatccgacgaacaatcatgccattatcactatgcctgcccatactgtgggtggattcaggaagatgttaccctaactaaaactgaatcatataaaggaaactgcaaatatccggattgctggatcagattcaaggtcgaaattagaaagattcacatcaagagtcccgaacagactcataaggaaatccacaaaattgaacttcaagaaatccacaaaacagaacctcaagaaaagcgtcaagcttcgttttggggaagagtgatcttatttttcaaaaggatctttgcttaaagcttgtcaaataaagccgtcaacaatcattccaaaaactgatatcaaacattgtttttcaacggagtaatagacaggtactaacaaagttgggaaagaccatgagtctccccccaaaaataacattttcactttacatctcaatacctcgctcagcctttgaccgttactcacccggtcatcgtatttactacccaatttggtaatcactcattataaaatcctgaaacgatcaatcccagctcaattcgcttactcatggcaaagttgcgttgatcgcgggctaatgccagcattttctttgttgccggaaccacgatttgtacgaggggggctccatgtcgccgcgtcatttgaccttcgtcaattaaaaaagccaagaaagctatgagcacttctgcaaaatcccagtattctcctggcgcaagaattgaccttgaaatgaaataacctgtcaaaacattttctaacgcggatggtgtccaatccatcaattttaaatgggtatcgtaataaattcgaacacccaccgttctgatcaacacttgcgcatagtgccccgaaatagatttttgaatatcttggtctggccaggacgatgacagaacgaatttaaacgtccattggtcaatttgacgactaacatcggcaactgcaagctgttcataattaataaccgacttttctttttgctcatccctgcctatagacgctcctgcccccaacacgtcatgataataagccatcgctagttgatgagttgcgatgtccagagtccctctatccaccagccacttggcaaagagtagccccgttttggaagctgccatccaagcctcatcagattcgtcgctgtgcccgtggaccggtgaatcttctgccgcatggctgacacatcttctgatagctgaaatgatatcctcaagcgtccattctcgaagtggtatcgctcgtttggaaaaagctacctttaggaacctgataaatgcgttataaaattgatctttttgtttcgcagtcagtgtttccggctcaataatgccattgtttgaaaagaaatcctgccaataaatcctgcccaacttatcaatgtcctgttgcgaattactttgttcttcagtcaatttatctttcctttcggatcctcatttcgataactttgttacaaattattctacaccgctaattaccaaatcgccatttggggattggaccatattttaactggatttgcattttttccatactaaccatcatatccacaccaaaataagccaaccgggattatgattttcccgactggcttactgtctgattgagatgatttctatattctcattcaaccacatgactggactgctgataaaccggctcacgattcaacgcccgcttaatagcatcctcaatactcaaaggactattaatgttacttgttgccactaatttatgaaaatctttggcatgggcaatcgccttatttgccgtttcatgactaacggcgtgcaacatcacaatcacgatatccgcatgtttaacagcggtggcaaggtttgactcaatccccttacctttaccactggacgtatgatcaaaaacaatcaatttgccatgatgagccttaaccaaggcggcggcttcttcccgatgtgcggcataaccggccattaaaaccgttttgtcggttaggtcaaaggcaatcttcggtgtaaatacatccgtcgattttgctttatgcgttgtataggcactatggggtttaggttccggtttaacagtctgattagtctcatttcgataaatccaggaaatccgagctcgcccagaaccctgatcaacataataggcaacttcaataacatcattgacctgcacgttatctcgacgaacatcatttggacttaactggattgtgaccggttttccaccctctaaaatcggttttccatcatgtaaccgtcgaacaaccagctttccctgctgataacgttccacgatgactttttttcgaacaatttttcttggatcatccaattcatttctttgaaccagttccaattccggtggcacctgattactcaacttgaacttaacaatgtcgccatccctcaagttcatccttcgaacaagtgattccccataatgataactgccaacttgtgcacctactaattgacgtttgaaacgataagtcctccctactcgaagatctggtgtaactatagtatttccctcgatggtcaatttatctttctcaaattgaccaccccttctgtttctatcggcttcacttaatgcctgatcatattcactaaattgacttacagccgccgttattgccggtaaataatgttcattcgcatactttaaaagttgattgatatcgctaaagtatgcttggtagttgatgttcgtcattttggcttcccccttctcgccttattcatgactattgctaatccggttatacatatgaaaatgattatttattacctgaaacttgaaagctaataatcacgccaaaggcgtgtggttattggcttttttggcaaaaaaataaacgcaagctctcctgcgttgtatactttagtcgaccaaaaccaagatacaaaggagactt

SEQ ID NO: 450 - DNA, 97587 bp, Unknown
  Metagenome-assembled genome
gtaatctggtcttgatccaatggcgctgagccagcggtcgcgtacactcttttttacgcgcccttgtcatgatccgttttggtactataaagctctaaaccaaaaccccccactacaaaaccccctacacccaaaaactctcttgtttggttgtgacgaactactgggaacgtaactacagactcttttactccctgaccaattgcgtgatccagcaccaccgacttcccttcctaaaatactgctcccaaaagtctctcatctgcttgctgtatcatattcattagcacatcaacgtcagcgcttaataacctccccgcgctcattttagatctccttaattgaacagtcccatcccgcgcacatacgtaattttccgttaattggtttgcgttttgcattttcctatattcatctgcgcccccttttttaattcgctatttttcaacggttcttctctcggcttctgacattccagcctaaacacacgccgaacgatattaaacgtctagtttttcatttatagcttcttttttttttttccgataacattcgataaaaaaatagtcgacgaaaaattgcgcctacgctcttctttaattcaagtttgcttttcgacgtgctttcagctcagtcttccaatgcaacgaacttcacggtttgggcaggaactcgacgaatctcagtctttcgtttatatccaatctgcaatcgtttatcatccattaatgattggtgctccgtcttacagcctcgcgtctcctccttacttttacgaatccccccaactccctaacgcttcggtcataccgacatgctcatctagattaaggtttaaactttgcgaagctttccgatacgttttaaatgattgtcttcagtacattccctgttttatcagttcattttcttaaaatggttttttgtaccccctatactcgtccatacttcacacgcctctcccaccccacacaaaagtgttttttttgtcgctcggatgaaagcgaatgccatggcccctacacaccaccccaaagacaacaccccccttcgtcctttatggcaagatgtgcaacgtggagacgtataagtgtaaccatttgttgggcctccgttaaatcaaaactgtttaactctttgatttccttcaccccttgacactccataaaataaccctataacaaacaaaaaatagcttatttaagactacgggttttgaaccactgtcagtaattttcttgactttttccctcgtctacaggtgtggaattatctacaacacacctaaccgttcttgcctcctctgcccttccactcatgaccgcccgctcatctccacctaccatcggtcgaacgtgatacattttttgatatatccaccctgtctgccgcactcactcttacactctaacatttatccccccttcctgcgcctctcccaacccccctctccgtctctactctcccacgggtacaacccccctcaatgggtgttaatgagcgccccggtaccaatctcgcagccaacacccccacccaccaacttacacacgcataccaggaccacgcccaccccacccgagacccaatccacgcccctactccccacccattagccctttataacccttactctgctgctggtcgcgccctcaatagcccaggtctacgtctcggtaaactcagttcaaaccagaagcatcccagatcgtgactgtctccggctgtgcaaacggcaaaacatggatgacaacagacaagccatggctctaattttgctccccatcacatcataattaagcccaaccaatcttactttaatacacagtgtctcatcgtaccttagagacggtttcacataaccaagtgaatatttaggtaattgaacaaaagttcaaaagagaaattctcattcattgacatcatttacgaagcatcgacaacaatgagagaacgaaaacctagtctcaagcgtcaataccaggtcccccccacgctaccacaaatctgctcttgatattctgaccccccaccctcgaaaattacgactgtctatatgtgtctcacgtgttcctgatcaaaccaatgcaacattttttttataccgactttgacaaaaatgcaccgccctctttgcctttccccttgattgacttcgcgccacccagcacccgtaccccccttggtgggtggtgtccccccctggttgactttgtcttaccgtctttgtctgtgctcaggattacaatagagcaagcacaaagaggggccgcggccccagccgcgccttctacctccccccttacctgtgatgaggacttaatgtcgtgccacgctgaagagcaacatctcccgcaacgtgggcagttcgaagtgcgtgtgcactttggtttgcgatcgcctagaaagtctcgacatgtgctcccctgcccccccaccctaccacactctagcaatcaccttccagaatatcctgacttactgggtcggcgcgcgttaacgaaacctatcagggggcttcagtcgtggcgctaatgttacgtgtgtttaacgtagttgccccccattcctttgcgccccttatgagaacaccatacacccgcgacgactcaacacccctttcaactgttgcacgttctcactccagcccattactcacatcgcccccacccccgtgccggccacaaataaccacactaatccccccaccacggggctagctgaaaggcacatcatgtcaaatgcgaaaaaaaaatcacaaacttaaacgctagctgttttgtggctttccgcaagttttgaaaatctattgcggcgcattgtactgtatccctctgccccctccaccaacacacacaccttccccactccccccttagttttggtcaaccgcccccagggggtgtgaattgattctttcaccaattactcttgcttttgtgacaagacttaaagtacctagtgtgctcacagttctttcgaatacatgccaaacccccaaacaaacacactgcttgccccaagaaaaaccaaagcaatcacacgttcatcagttaaacaatgtccgtactgaagatcctcgtgactcccgtcgcgactctctccccaaacctcccctgcgacaccccccccgtatccccgctccctctaaccaaacccacctaggaccccaacccccccccgaccccgcaagtttgctggtgtgtgcttgtgtatttttgaaccaactcacctaaaatgccgtgttgattactccgaacggaggctaccgggggggggggccacgcccctcgctctacccccccaccacaaccgaacccccgataaataattaagtgaccccatgcggattcgacccacgataaccaggcgtgacaaggcttggtgatcctaccgcgtgacctaccatggggtcatcgccaagtgaccccgtgcgggacttcgaacccccacccgactcctgcaaaagcgtcgtctcaaagcattagtgtcataataccgaagcttgactacaacacgggcctccccccactcaaccgccgcgagcccatgacacgccacgcatgtgccccccgaaaccacaaaaccccctacccctcgcccgctccgctttccgcgacctcaaccctttacatggtgctgcctctttgcagtcccgagccagctcacttttgagtattctccaattgggcttcccttaattgtggacttcgtgtaaaccccccacctcggacctgctttccccttttacaggcgttgcgtctctagacacccccaccagcctgaccgctatatgacactcccaccaatcatattattttaagcggtggtattacactaccgaatcgtccaccccccccaaacaaatcgtcgacagatcaggcggtgacagctttggaaaagacgactctgcggcccctttctccacacaccaactaacatctatacccgcattaagcagaagcttaattatcttaatggcgcgggacggaatcgaaccgccgacacacggagcttcaatccgttgctctaccaactgactaccggccatataaatacaacggtccgtaagagactcgaaccgcgtgatctctcggaggatcgtcctaaccaaaactagaccaacggaccaaaattgcggggctgatttgaaccaacgacctccgggttatgaccccgacgagctaccaggctctctaccccgcgataatgaaaaggaggaatagagatgcaactcttgcgccgctctcacgacctagcggttttcaagaccgcccccttcagccacttgggtaatcctccataaatgaaaagctgtcgagtgttatgaggcccaatggaccttgtaggactcgaacctacgaccgggcggttatgagccgcttgctctaaccaactgagctaaaggtccctaacagccagtcaatcgcggcgggggggatcgaaccctcgaccctccgggtatgaaccggacgctctagccagctgagctacacccgcgataacaattttcattgttaatcgggaaaacaggattcgaacctgcgacccccctggtcccaaccaggtgctcaccaagctgagctatttcccgaaaagtgcacccagaaggagtcgacccttcaaccttctgattcgtagtcagacactctatccaattgcgctatgggtgcaaaagatgccgaggaccggatcgaaccggtacggttatcactaaccgcaggattttaggtcctgtgcgtctgccaattccgccaccccggcattatggaattgacaaagcggaaccgggattcgaacccgcgacccccaccatggcaaggtgatgttctaccactgaactacttccgcataatattcaagatgccgactagagggctcgaacctccgaccccctgtttcaagacaggtgctctgccaactgagctaagtcgcgtaaaaattacggtattccgcatctcaaagcctctctatggcaatgagccgtgacgggttcgaaccgtcgaccctctgattaaaagtcagatgctctaccgactgagctaacggctcatgagcataatgctcaatggaggatacagggctcgaacctgtgaccctctgcttgtaaggcagatgctctcccaactgagctaatcctccgtaatgcatggcaatgccctatcctcgcagggagcgatcccccaactactttcggcgcgttaaagcttaacttctttgttcggcatgggaacaggtgtatccttcaagccatcatcaccacactaatccttttcaagattgaagcttgcactctcaaaactaaacaactatctattcttctcacgttcaatcgaaacaccctaaactggttaagtcctgaccgattagtaatggtccctccatgcctcgcggcacttccacttccatcctatctacctcatcatctctgagggtcttacttccataaggaatgggaatctcatcttgaggcgagtttcacgcttagatgctttcagcgtttatctcatccatacaagctacccagcgatgctcctggcggaacaactggtacacccgcgtagtccatcccggtcctctcgtactaaggacaggtcctctcaaatttcctacgcgcccgcgcgacgtagaggaccaactgtctcacgacgttctgaaccccagctcgcgtaccgctttaatgggctgtccccattaaagcggtacgcgagctgtgttcataacggtcgtgagacagttcggtcctctatcgtcgcgggcgtaggaaattgaggacctgtccttagtaacgaagaaccgggatgggacataccgctggtgtaccagttgttccctccaggagcatcgctgggtagctattattggatgagtataaacgctgaaagcatctaagcgtgaaactcgcctcaaggatgagatttcccatcttccttcgggaagagtagacccctcagagatgatgaggtagataggttggaagtggaagtgcagtgatgcatggagcggaccaatataatcggtcgggacttaaccaagcagcggtgaaggtgttaagaaaaagagtagatatatttagttttgagagcgcaagttctcagcacgtaagtgaggaaaatagtgtggtggcgatagccagaaggatacacctgttcccatgccgaacacagtcgttaagcttctgcacgccaagagtagttgggggatcgccccctgcaagggtaggacgttgccacgcgtttcattatggaggattagctcagctgggagagcatctgccttacaagcaggaggtcacaggttcgatccctgtatcctccatattgagccgttagctcagttggtagagcatctgacttttaatcagagggtcggcagttcgagactgccacggctcattacaattgaatattatttagcgcataatatattgtatgccgacttagctcagctggcagagcacctgtcttgtaaacagggggtcggaagttcgaatcttctagtcggcattttgcggaagtagttcagtggtagaacatcaccttgccatggtgggggtcgcgggttcgaatcccgtcttccgcttgttatgccggggtggcggaattggcagacgcacaggacttaaaatcctgcggtcagtgatgaccgtaccggttcgatcccggtcctcggcatattatgcacccatagcgcaactggatagagtgtctgactacgaatcagaaggttgtaggttcgactcctactgggtgcattgttttaacgggaagtagctcagcttggtagagcacctggtttgggaccagggggtcgcaggttcgaatcctgtcttcccgattgataggtttgctatcaaaggtatcacaccatcgcggtgtagctcagctggctagagcgtccggttcatacccgggaggtcgagggttcgatcccccctgccgcgatttagggtcttggaccttcttggacctttagctcagttggttagagcagacggctcataaccgtccggtcgtaggttcgagtcctacaaggtccattagactcagtattatatatttttttatggttacttatggaggattacccaagtggctgaagggggcggtcttgaaaaccgctaggtgggtcaaaccacgcgagagttcgaatctctcatcctccttttaattatcgcgggatggagcagtctggtagctcgtcgggctcataacccgaaggtcgttggttcaaatccagctcccgcaattttggttcgttggtctagttggttaggacgcctgcctgtcacgcaggagatcacgggttcgagtctcgtacggaccgcttttggctcggtagctcagtcggtagagcaatggattgaagctccatgtgtcggcagttcgattctgtcccgcgccactatgattaattgaatatgcgggtgtagtttagtggtaaaaccacagccttccaagctgttgtcgcgagtccgattctcgtcacccgctttttcttatgttataatgggcctatagctcagctggttagagcgcacgcctgataagcgtgaggtcgatggttcgagtccatttaggcccatattggagaaatactcaagtggctgaagaggcgcccctgctaagggtgtaggtcgcgtaagcggcgcgagagttcgaatctctctttctccgttaaatgacccgttggtcaagtggttaagacaccgccctttcacggcggtaacatgggttcaaatcccgtacgggtcattcaatgcatagttcattattttatattatcgcgggatggagcagtctggtagctcgtcgggctcataacccgaaggtcgttggttcaaatccagctcccgcaattttggttcgttggtctagttggttaggacgcctgcctgtcacgcaggagatcacgagttcgagtctcgtacggaccgtcacttaaacgaatgtttccaaagatttgagagttaacagtgttaatgctgttaactcttttttggttgttagaaaaatagagttgtactgactgctaaagggtgcaatcactcgagcagcattatcagccagttactaattggtgatttatccttttcatattaacaggcagttttaatcaaaataattatgaagtttacaattgtagttgcaattttcgattacttagtctacaattgtagatgtaggaaaaagaagttgaattgaaaggaagcataatagggccaactcattaatatgatgaagcgatagtaaaataagagggggaaatagaatgtcgaaacaagaaaacaatcatatgaaaaaaatggtaatgaactcgaatcaagaaaacaatcaagacaagaacatgcaaatgagtgaacatcaagaccatcagtcaatgtctcacataaaaatgactcatcgtaatatggaaatgaaccatgacgacatggaacatatggatcacgagatgtccggcatgaatatggggcatggcatgagtggccaccatatgaacatggatatgggagatttaaaccgacgtttctggatatccttaatattaacgattccggttattttgctttctccaatggcaggaatgggtggatttggatttcatttttcatggtctccgctattgttaacgatcattgggtctatcttgtacttttatggtggtaaaccattcttttcaggcgctaaaatggaaatgaagagtaaacaaccgggaatgatgtcattgattactttagggataacggtcgcttacttctacagtatctattcagtagttgccaacaatgtctttcacgtgacaccaacggtagatgagtttttctgggagttatcaacgctaattgatattatgcttttagggcatattattgaaatgaagtcgattgatagtgccggttctgcagttgacgcattgtccaagctattaccatcgactgccaaggttgtcagaaatggacaagtggttaacgttaatgttgctgacttaaaaattaacgatattgttcaggtgcaggccggtgagaagattcctgctgatggcgcaatcgtaaagggaacaacgacagttaatgaatcattagtaaccggagaatcgaaactggttccaaagtcaattaatgatgatgtcattggtggctccattaataatgatggcacttttgagtttaaagttgataaagcacaaaatgacagcttcttgaataaagtcatgcagcttgtgatgaacgcatcaaataataaatcacacgctcaaacaattgctgacaaagttgccggatatttattttatgcagcattaacagttgcaattatagcttttatttcctggatgtttgtgagcggtgcaaccattgcgttaccaattgcggtgaccgtattaatcattgcctgcccccacgcacttgggttggctattcccctggtagtttcccggtcaacagctttagccgctcaaaatgggctgttaattcgtgattcctcagctttggagcagtccaacaaggttcaatacgttttaatggataaaaccggtactttaacggaaggaaattttaaacttaacttttatcagacgtttaattcccattattctaaagatcaaattttggcattagccggagcactggagaaaacatccagtcatccattagctaagggcgttatggatgaggttgcagaaaagaaactgcagcttgatgaagcggaagatgttcagcaaattcccgggtttggtcttaccggaatagttaatggaaaaaagtatcagttggtttcgagtaattattttgaaaaagagtcaattgagtataatcaggaaactgtaaataaactgttagccgataaaaataattccatcagttttctaattgaaaacaatcaggttatcggtgtgattggcgaaggcgatgaaattaaagccggttcaaaaccgatgattgattatcttaaacagcaccatattcaaccggtcatgctgacaggggataacgaagcaattgctgccagcgttgcttcgtcacttggaattgatgattatcgcgcaaaattgttaccggaagataagcaaaaaatagtggcagagtatcaaaaaagggggacaaccatgtttattggtgacggtgttaacgatgcacccagcctaagtggtgcaaatgttggtgttgccattggagctggtaccgatgtggcaattgattcggctgatatcgttttagttagaagtgatccaaaggatgtcgttgatctcttcaaacttgccaaacgaacagcggataaaatgaaacagaatctttggtggggtgccggatacaacattgttgcattaccattggcagctggcgtcctcgcatttgcgggcattttgttaagcccgatggtcggtgctgtattgatgtcgttgagtaccgtggttgtctcggtaaatgccttgacacttcgcattggatagattgttaattaaaaagcaccaaattatctgaaagaaattaacctttcaaaataatctggtgctttttcgtagttaatatatagtgctaatgaatttcctttttttcaacgggggtataataagcctcatgtgaataaaagctgggagaatctcggtattcttttggaataaattcatgagtactgtttttccagagctcgaagtcacgataggactgccatgttcctagaatgacacgttggctaatatccttatgatagttcaaggagtaaattgaatgcatgccctgtggaagtccattgctgattaaacgattaattctggcatcaaagactttttgttgatcgaagtttagatccaaagcggaaaaactaatgaaactgttccaattgtctgtgccaccgtgacctaaaacatcgtaaagaactggtgaatgaaaaattgaattttctcctgaataatccaacatcatttgtttaccggtttgattcaaggctttgtaagtaacaaggtcacgatccggatattcttctttaatctgtttcattatcctattatcaccaaaggtaattgcaatctgctttttcacaatacccacctcctgtttcaaattcattatactttttttgagatgcttatccaaacatttacttttaaccgatgctaacctatactgaattcaaaaagtgggaggtattttcttgaaattaacagtcttgggattcttaggtggctatccagctaatggtaatgggactagcagttatttgctggaatctggtaattttcatttcttaattgattgtggtagcgcagcacttttaagccttgaagaaatccttgatccattaaaactggatgctttgattctaacgcattatcatcatgatcatacagctgatgttggtgttttacagtattactggcagctccatgaaaaacgatatgatcaaaagtgcttaccaatctatggtcatacattagataaaattaattttgatggtttaagttggcctgactcaactaaaggagtcgcttatgaccctgaaaaacaacttgatgttggtccattttccattacatttttcaaaatgcaccatccggttccggcttttggcttaagaataacagagaaagcaaccggtaaagtcttggtttttacagctgatacagcctattttccggaaatagcatattttgcgaggaatgctgatttattaatgaccgataccaatttctacgctgataaaaccggaacaaaatggcatatgacatcgactgagtctggccagcttgcaaaggatgccgaagctaaacgccttttgttaactcatttaccggcatatggggatctgaaccaattaaagcaagaagctgaaactgcagccggaagtggcattccgatcgatgttgcaagtcggcacttaacgattcagatataaaaattgaatttgtgatgaaagtttagtgtttgttagactattctgtgaaacttatgatttttataactttatcctttataatcaagatatagaaaagattattaggagatgagttataatgacggtaaaatttttaatgacaccaagttgcacatcctgtcgtaaagcaaagaaatggttaactgaaaataatgtggactttaaagaaagaaatatctttgcgaacccactcactaaaaacgaattaaaacagattttaatgctttccgaaactggtactgaagggttgatttcaacccggtcttacgtttatgatcaatttaaggataaaatcaatacactgacgattggtgaattgctagaacttcttgaaacacatccggaaatgattcgacggccaattatgattgatgagaaacgtcttcaaattggctttaatgatgatgaaattcgacggttcttgccgcgcgacattcgtaaaagtgatcttgagcgaatgattaaaaatgcccagtaagtaaaaagaatgatttacttgtcactcaccatttttagccgtatcatttacttggacaataattgtgttacaatgatataataattaccctcagagattgaaaggggtggctaactatggaaatggaacggatcaacgagaatacaattcgagttttgatcggaaatgatgaccttgataaacgtgggattaccgttttagatttactcggaaatcataaacaaattgaaagtttcttttatagcattctcgaggaagtcgacaaggatcatcaatttcaaaataatgatgccgtcactttccaagttcttccaaatcagaatggtcttgaactctttattagtaaggatgttgacatgtctgatgaagatgaaccgctgcttggttccggcgatgggcacgaaaaacacgaccaagtttcaaaatatattgatgaacatggcgtggacaacaagcctcagagtgacaagaagaccaatgatgaatttggccatcaaaagagaaccgttattcttgaatttgatgatttgaatgattttattgaactttcaaaggcattgcgtttggaaaatgggacttcggatttgtatttatatgaaggtaagtactttctaaagcttcagttgttcagtaatgatcctgttgatatgattgtcagtgacgaggttgcaattgcgaatgagtatggcaagaaaacgacggttactgaggatgttttaaatgaatatggtcaacaaattatggaaaatagtgcgcttgaactaagcagatactactttaaataatattgaacgataatgagttttaaacgaaagctgtcacccacaagtgttaaatgacatttgtgggtgacagcttttgctattttagaaacgattcatacatcaatacgagacctttactttagtaaatttttattcgaatacttggtttttacttggcctggcatagtacatggtcgttttatgaccatgttttgacgcatcatgaacttcctgtgttgccgattgaaacccgcttgttttagcaacaatatagagggggcgctttctggaagcttcaaaaacacgatacagatatgagccaaccagtcctaaagacaggaagacaagtccaactaataagaaaagagaaaagacggcaaattggagcgttttaaatccggtgaaaagtgtgataatcaagtaaccgatactgaaaatgattgaaagagttcccagccaatttgcgagttgtaatggaaaggctgaaaacgaggtgacaccgtccatcgcaagtcggatcattttagaaagtggatattttgattcaccggcaattctttcctggcgttcatattcgacggaagcctgattgaatccaacccaactgaccattcctctcacgtaaggatccgtttcgttcatctttgaaagctcatggactactttacgatccatcaatcgaaagtcgcctgtatctaaaggaatatttatactggtgatctttctaagtgtgcggtaaaagattgcggctgttatttttttgaaaaaggtttcgccatctcgggaaacacgtttaccgtaaacaacctcagcaccttccttccattttttgatcatttcaacaattactgagggtggatcctgcaagtcggcgtccatgacaacgactgcatcgccactggtatatcggatgccagctgtgattgctaattgatgcccgaaatttcttgaaaattgcacaatttttatattacgatgtaatttttgtgcttcagtgatgagcgcgacacttttatcttttgatccgtcgtcaacgaaaattaattcaaattcctggggttggttactgataaaggcttctaaagtatcaattgttctttcaatcccctgttcttcattaaaaaccggaaggacaatcgaaaccaaatctgtgcttttttccattcaaagacctccttacgttatttataaattgttgacaaatcatatagtgttcctgatgatcccataccgcccataccggttggcattgcggtttgtgatttcttggtagattgtttattgccggccttagcagtggacttagctgaggttgactgttttatcttgctgggaacgcctttgcctggcatgtttttgccatttctcataccttttggtgcatttggtgttgtggctgattttttcgaggattctggcttattagtcgatcctttggatgttgaagtaccaaaaccaccaaattgttgtttgctgcttgagtcttgatacaaactacttttgactttagtagcatgttttttgatccaattaataatcttggtatttccggaacgaccggagtaatagaaatactttagatcaccatttttaacgagttttttaaattgggaaagtgtaattgccggatcggttccattgaaaccacccattgccataaccgcttttccggttttaataatatatggagcagcggtagttgaatcactggttgcaaaaagatattttgcgtttccttgatgtttttccaggtaattcagtagttttgtattcaccttggaattgcccataccaccgccaccaccaggtcctgagctgcttgtggacagaagcgacggtccggcggtgggaatcatagccgattctgctgaaagagtcggtgtaagtgaccaccacccgggagcaataagaatggtaattgtcgctacaaccatgctgatcttacttgcgttattcttaggaaaaatgaataaaagaagtgaagcaacgatcacaattcccaagattaaccatgtcagccatggataataactgtaaacgtaccaagcctgcagcgctgccgtggttaaaatagcacttgggaagagataaaatttccagtttgttctggtattatctttaaataatctggctaatgaaacgacgccgattccgaaaagggctgcaattggcggtgccagcataattgtataatagggatgaaagaaactggcgaccgagaagaaaccataaacgggtaccaaccatcctgcccaaagtaccagttgcttttgctcatgggaaagggaataccatcgtttttttcgatcatggtaataggcgagactgccaattaagccgataatggcaaatggaagcaaccaactgatttgtggccctaatgatgactggaacaatctgaatggtccaattgtaccgatattaaaggcacctccgccaccaccggcacccatattttgccgtcctttttgaccgccaggagcgcctgttggcattgttgtcttaccatttttccccttcttcatggcatttttggcaccagttggcattttaccgccaccgggcatgcccatactctttgattgactcttagaagtcataccggctccaaatgttccaccggttcccgttgtttgtccgagtaggcgctcggtgccgttatatccaaatgccagttccagttccgaattggtttcagaaccgccaacataaggacgctgacttgccggggtcaaatcgaccgagacgggataggcaagggtgaaaacggctaatcctaccgttgcaaaaatgagtttcttaactttttgcttccaattttcattggctgccatccagtagaataaatacatggcaggtaaaatcataaaagcttgtaacattttaacgttaaaagcaataccaattagagaaaagctgacaataagtgcccagacttttttctgcacaatcgctttttcaaggaaccaaagcgctaggagtaagaaaaagactaaagtggcatccatattatttgttcgtgaatcagctaccacgattggcgtgatcgtcattgctaaagcagcaagccgaccggcatttttgccgaaatatggtgcaaccaatcggtgcatcaaatagacggaaccaactccaaataggacagatggcagtacgatactccaaccatgcaacccaaatatttttgcactaatagccataaaccaaagagccacaggtggcttatcaaccgtaatgtacccggccggatcaaaactaccgtaccaaaagttgctgaagctttcggtcatgcttttgatcgcggcagtataaaatgcgttggcagaacctgctttccatatttgccagccgtataaaaacaatgccagcagtagaataactgttaatatcgaatcaaatcgaaatttctttcttgattggctttggatattccgtgacgaataattattgatttccaaagtgttgagcctccttcattgatgaatttttgaatacccaaaattttgacagtaggaaattagtgggtacagtgatcataagactaaaaatcggaattagatggtcattgacccctgtgaaatgacttaaaatatcggcaattgctgtactgagaagccaagtagatagataagtggcataatacttaatcacaactgacttgaaatgagcgtgcgttttgaatacccaatgattatttaatgtcaagctgatcaatgatgtacctccataaccgatcgccattgcaattgttgcatttgtaggggatagcaacaataaataaatagcgtaggtcaaaaacgtatttgcgaatccgatgactccaaactttaataattgcttgaatccagaaatggttggtccctccttctcttagaatgaaaactattttatccaaataaccataaattaagcttaaaaatttttgtttcaattaatttcaaattgaacagttgacgaatgagaagaaaacggatagtttatgagaaggttataattggtaaaaaggagaaaatgtaaatgaaagaactgcatatcttaataattgaagatgatgaatcattagcccaaagcttacaattgtttcttggagaaattgcccaaaccaccgtttcccatgatggttttgaaggacagatgctgggtgaagagggcatttatgacttagtagttctggatttgatgcttccccaggtcaatggctacgatatcttgaaacattggcgaacagagtctcatttatcgatgccggtgttgattttaaccgcaaaagatacgcttgatgataaagtacacggttttgaacttggagcagacgattatctaacaaagccgtttcaccgtgaggaactattaatgcgagtgaaagcattacttaaacgtagtggtcacttgggaaacgataatcaaatggttgttgaaccatttacggttgacttaagtaatagaacagtgactgttagggatcagcagttagaactaaatggtaaggaattcgatttattagtctattttctacagaaccccgatacgattatcacgaaagaacagatttttgatcgtttatggggattcgaatctgagacggccatctcggttgttgaagtatatatgagtaatttgcgaaaaaaaataaagacggcaaccgacttaaaaccgattaagacgctgagaaatgtggggtacatgttcgaaacggaggagcttgattgattaaaggggatccacaaaagaaacagcaactatcattgtttgctaaggaattaattggatttgcgctattatttgcaattctaggattagttgtcaatttcttttttcaacaatcaatttatgaaaatattgatcgtggtttgaattggcaaagaataggaatactgaccaatcgacggcagccgacattcaggacgggtcaggcaaatccatcacaagggcaggtcccgcctgccaggaatacgccctttaggaccaatgtgttggtctttaacagtaaggggaaaataatgaacaatcagatgttgggcaatcgactttataatgtttttgttaatacgcgccttgatgtttcaaaagttaataaaattcgggaaatgacattaatgtcatccgataactcatggcattattttcgaacactgcttattaaagtaccaaaaactaataaaaaccctatgtatgccggacgatatgtgttgatactggaaaatattgattcggatttacttgcgattcgtggctttcgacaatccttattaatgacattgctggtattttggttcttagcgattgcagtggcttactttttgtcgagatccagcatgaagccgatcctggagtcatggaaccgccagaaacagtttagtgcgaatgcagctcatgaattgcgaacgccgctgacagtcatccaaaaccaaatggaatatatgctgaccaagcccaaagcaacaatcatcgatcaggcagaaccaatttcaacaacacttgacgaggtgaggcatttacagacactgacaaatcggcttttgatgcttgcccgttcagatgccgatattattcaaattaatcgtcaaaacgtttcattgcaatcttggtttgatcaggtcattaaaccctatattgatattgcaaacagccagacaaaagcgatggaaacttatattcgtgtttcaggtgaaggaaagattgatgaagatttaattcgccagctcataattatcttattggataatgcgattaagtatacgcccgagggtggcacggttactttcaccgctgagaaaattcgtgacggtcggcttaaaatcgaggttaaagacaccggaacaggcatttcagacaatgataaaaaacacgttttcgagagattttatcgctctgataaatcccgtaatgctaagacaggtggaaatgggttgggattggcgattgcaaaatggatagtcgatgaacataagggcaccatttcagtcaaagataatcatccaaacggtactgtttttatggttgttttcccaattaaataaaataaatgtcatctgcaataagattgttgagtcatttaaaaccaaaaagcatctgaggcaaattaagttttgctgtctcagatgcttttagtcttaacataagtcaactttttaggttgaagtgaagctaccaattctttttggcagccttctcaatagttggaaataaatcgtataggtattgtagtgggcggtcgtttactttgtttgagtaaacaacctgcgtaatattatcatatgtcagcattagcaattcttcaccatgctcgtcgcgaacgacatagtagcgaattccaagcgcaattgcatgaaaaatcaatctttgggcattgggcgttaaatgggacatagccggcaataggtactgtgaattgactcgcttgtttttccatttcttggcagtttggatgccaaaagttttcaaactattgttgttgatcttcggtaataacattgctgatgccgttaattcaggatggctcatgacttcactgaaatcatccagggcttgaagttgttctgaatgtgcatgaagttgcttcgccatttcaataaggtctctgaaaatttttaagccctcagcttctttaaaggttggctggtcaggagattccaaagccacacggttattatcatcgaatgactgttttaatttatcgtggatacgcgtttcatcgacaggctgaaccaagaggtacattaagaaaaatttcaaaaaatacaaggcatggcgactaatcccgtttggggtaaatggtgtgttgtccatgactctgaattccaaataggaaatacctttggtgcgatagtcttttagtgcgccttgtccgcgtaaacgaaccgggccgtagaattctgccggggaaaacaaacggtgccggtcaattgcatttgagatacggtcaatatagtttcctaaactggagtaaagtgtcacattaacctgatcctcaggtttattgacgtaaccataaatgctgtttcgaatactccttaccggatgggtgagtggtgccggcgtttcacctgagaaaaagcccttttcagcgatgggactggcaccgaataagtaagttaacagccaacgatgaagcacaaagttttgagcgatttggaagtaaagagcattcttaaattctaccaaagacttaaattgaccttcatagtgtgtatataaacggttaacgaccggttcaggaatactaaaattgacgtgtaatccagtgacaatttttaatggtaccttgtatttcttggttaaataatcacggtattcttgaaagggaggtcgagcaaagtgattttcaacaaaatggatatcatcgtctgaaagtgcgggcggcatacttaacggccagatatattcgtcatctttcattgaatgatagagcacggtttgaatggtatcaagctgatctaaaacgccaccgatattcgggttgggatctgtaattaattcgttcattgactcggaaaaatctgattgaagatagggatggtactttcgtgatcccaggttttcaggatagggatgctgacttaactggccatccccctcaattcgatgttcttcgatttcaataccaattaagctgtgatagagctgttctgcaacgtcttcctgtttgatgtttgctaatagattttcaagcattggtagtctcctgatggatagatttacaaataattataaacaattttgacatgattgatagcatattatctctattttgcaaaatctttgttgaaaataaaaaaatgtgtcatataacggcgtaattaacagtaaatacataaaaggagaaaaaatatgttggttgcccagctcaatggccagttgattcaagcaaatgaaattaagcttaaaagaaaggataaacatgaaaaaagacgttatgtttgtccccgatgtcaagaaccggttatgttcaagcatggtcattcaagaatcgctcacttcagtcatttttcagtcagcgagtgcccatttaacgaaaatgaaagtcaggtccatttagaagggaaaatcaggtttaagaaagagtttttatcactggggcatgaggcagtactagagcattcatttactcagatcggacaaagagccgatgtctatattccagattctcaaactgtggtggaatatcaatgcagtccaatttcattttcagaaatcaaacgacgaacacagggataccttagtgttgcaaaacgtgtattttggatcttgggagcacgttataataccggtatttaccatcgggatacggttgccagatttagcagataccatcaacaactcggcttttactttgtctgttattcagataaggatcagtattttcgacttcattatcaattaaaagaggttgccggaaaaataattggtgaaacccagaactttcttaatttgaaggccttgcttcgatttttaagaaccagccaatattcttcgaaaaagtatcagattggtcaaaatgctacccgccggctgttattgcatcagctgaaaatgattcagcaaagcaatttaaaccgtaaccggacatatctagaaagtgtgacggattgttactcatttcgtaaactgtttattggttgcccgatgatttgtcatggtaataggggtagtggcctgccgatttttaacaaatccgtgctttgttggcgaacatgggtcattttacggctatttgatagtaatcggaccctactgtcggatgaatttttaaagggtatatttaatatcagttatgagcagtttggcttggcttttgcgcaaattgtcgataacgagccattttttaaggcagaatgccgtcgactgattattcagctacatgatcaaggttatattcgtcataccgtatccggtattcaaattttaaaacagccggtttggttttctaactatgacgaaaagcggtggcatattatgacgacgacacaattcttgtgataatctagtgttaatgacgaatatgaagggatgtaatgaaatgtcagagacacagaaattaccattacgaaaagatgttccagctgacttaacctgggatttaacaaccatttatcaaagcgacgaccaatttgaaaaagattttgtaagtgttgaaaagacgttgccaagtcttaaaaaattatcagggacactgactcagggtgcagcagccctgttaacggcaacagaaacgatgctgactgctgccaggaagcttgaaaaggtttatgtatacgctcagctgaaaaacgatcaggataccagtgaggacggttatcaggccatgtacgccaaagcacaggctctagcagcccagtttggggccgcaaccgcatggtttgatcccgaactgttgaaactcaatgataaacagatgacttcttactatgaggcacaacccaagttacgggattataaacggttatatgatcaaacctttgcaaagcgcgcacatattttgagcaatgaggttgaggaggttttagccggagccgatgatattttttcatccggtgaaaagacatttggcgtgttggataacacagacctttcatttccaacggttactgatgagaatggtcatcaggttcaactatcccaaggtgtgtacggtattttgcttgagtcaacgaatcgggacgttagaagacaggcgtttcaaaaactttatgaggtttatagtcaatttcagcacacattggctgcaacactgacaacaaatgttaaaaatcataattttaaagcaaacgtacgtcaatatcattcagcattggaagcagccttgtcctcaaccgaaattccggtaaaggtatatgataatttaatttccgaggttaacaagcatttggatcttttacatcgatatgttgcgcttcgaaaacgcattctgggcttagacgagttgcatatgtatgatttatatacaccgttaatcggggaaaaatcacctaaatacacgtttgatgaatctaagaaggtggccttggatgcattacaggtgatgggaccccaatatgtgaaccacgttaaagaagaatttaataatcgatggattgacgttgttgaaaatcgttataaacgaagtggtggctattcttcaggaacgtatgataccaatccgtttattctattaaactggaaggacaatttggataatttatatactttgatccatgaaacaggtcatagtatgcacagttattatgcgtcacataatcagccataccaatatggtgactactcgatctttgttgccgaaattgcctcaacaaccaacgaaaatattttgacggattatttattggataaatttaaagatgacgacaagatgaagcggtatattttgaactattaccttgatggatttaagggcactgtctttcgccagacacaatttgcagaatttgagcagtatattcacgagcaggacgcaaagggacagccgttgacggccaacttccttgataactattaccgtcagttaaatcaaaaatattacggtgaaagtgttatttcggataaagagattggtttggagtggtcacgaattccacatttctactacaacttctatgtttatcaatatgcaacaggatttgcggcggcttcgacacttgcggacaatattgtcaatggtgatgccgaacatgttgaaaagtatcttaattacttgaagtccgggagttcggacacaccgattaatgtcatgaaaaaggctggtgtcgatatgacgcagccggaatatttggagaaggctttcagaatctttgaagagcgattggatgaattcgaaaaattgttttagatgagtcacatcacaaaaaataattgaagcaggtatacgtgaatttattagtggcactgtttgtttcacgtttcacttgttaataatagtgaccacaaaaaaggaagctgggcaaaatgatttttgtcccaacttcctttagttactaataaaagtcaatgataaacccggagatttttcgagtctactgtcatgactgaatttcagaagaaacttgattgtgggtacaagatagtcgcaccctgattattttgatgctgtttaatcaattcttcgaaatgatgaacagatttaacgctttgtgcacagaatttgaacattgagttataatcgaagtccttgattaacacgccgttattatcaactgccgagttaaacaacactgcagttgccggttcatctaccgacatttcatgaaccatccgttgatcacatttaaacatgttttccgctaagctggatcgtcggtcttcttcaaacatacgacaatccaaaccattatcttccgccaaaccgtaaaccaagtcatcattataatcgcgatcattaagtaataattctcgctgcaagtccatcaagaaatggcgccccaactttttaccttggaaggatgccgcttttgaatcaagaacaatgttatacggaagcttgcgatcaaactggtcgcctgctttcgctgccatttgattgagaatcttgatatttaacatggaaatgaatcgaacagaaaccttggtatttaatttgcgggaaatgttatcaatcgttttctcagcgtcgtaacaatgtcgatttaacggatcaatgaataaataaatttcgagaaccatagtgcccctccaatttttaatcgacaaataaaagtaatataccaattatttacttatctaagaataccaaattttgaactaaaaacaatatatttgctcataaagtgcgtaaagtaatgttggcaaccagtgaaacaaaaggcgttcattagtaaaaaacgtttttactttttactaataatctttgcgttcgaaagactattagtacaacgagccaagctgggtgcaccttattaaaaaaatgacgtttataaatgctgattccgttttggggaatcctcatttattatgttaaaatatagtctgattgtaaaatttaaaaactgagtcattaaaagagtagattaaatagtcgttagtcggcttaattcatgatattaatgaaagacaatcagatctctactcatcagaaagattggaagtgatagcttggttgaggattgggataactttttaattccatacaaacaagctgttgatgaattaaaagttaaattacgggggattcgggcccaatttttaaaattggatggccgaagcccaattgaattcgtaacaggacgggttaagcctgttgatagcattaaagaaaagatggttcgtcgacatatttccgaagaccgactcgaagaagatatggaagatattgccggtctcagaatcatgtgtcaatttgttgaggatatttatcaggtggttgatttattgaggaaacgcactgacatcaatattcttgaagaacgggattatgttcataacaagaagcccagtggatatcgttcgtatcatatcatcttcgaatatcccgtgcagatgttaaatggtgaaaaagtgattttggctgaaattcaagtccgaacgcttgcgatgaatttttgggccacggtagagcattccctaaactataaatataagggtgaatttccggatgacttgaaggtgcgacttgaaagatccgcagaggctgcatttaagttagacgaagagatgtctgaaatccgaggagaacttcaggagactaaaggagattcttcaggcaatgatgtgaggaagtcatcagatgagaatagcgatatatagtaatttgggagaagcttcaaatattgtcgcaacttccttaaagaatcaaattgaaaagtcgtccgatttagtcattgatgggcttaatcctgaaattgttatttcagttggcggagatgggacgcttctttccgcctttcatcactatcaagatattaataataaagtccgattcattggtattcacaccggccacttgggtttttatacagattggcgggactatgaagtcaatgatttaattgccagtctggaaaatgataatggtcaaagtgtgacttatcctttactggatattaaggtcaactatcccggtggtggttcggcagatattggattagcactaaatgaatctactttaaagcagattagtggatcaatggttgcggacgtttatattaagaaccaattgttcgaaagcttccggggagacggcttatgtgtttcaacaccaagtggttctactgcttataataaatctgtcggtggtgcgattatcaatcccagactgaatgccattcaaatggccgaaatctcctcgattaacaaccgggtttttcgaacactgggatcccctttaattattgcgcctgatgaatggattaaaattgtgccaaaatcaactcatcgaactatcttaacatgtgatcatcaagttatcacaacacgtaaagtagcatcagttgagttccggatttctcaaaaacgaattgcttttgcccaataccggcatacacaattttggcgacgggtcagtaactcatttatcggtgaggttaatttggatgactaagtttacctgggagtataaaggaagctcacctatcaaagttcgaacctttattatgggctacgggattacccgaacactactcaaaaagatcaagtatcatggtggtcagacattggtcaacggcgaaccgtcattggttaaccgtaaactgataaccaatgatgttgttaccgttgttttaccgccggaacccgaaaacgacaacgtaccagcttccgacttaccgattcaaattgtgtttgaggatgaacattttctggtggtcaataaatccgctggcgttgcttctgtaccggctcacaatcgagccaatgactctctggttaaccgggtaaaaggttactatcagcgtaaccattatgctaatcagaaaattcacattgtcacgaggctggataaggatacaagcggattagttatttttgccaaacatcactttgcccattcggttttggataaacagttgaaagatcatcagattaagaagacatatttggcgattgtagagggcgttttttcaacaactcattttgagatctacttaccgattaagcgtgcagctggctcacttgttaaacgccaagttgggtttccagggaaaatgtcggttactgaagcatggaccaagcaacgattgcggcaacacacacttttaaagcttcaaattcatacgggaagaacgcatcaaattagagttcatatgacggcgattggtcacccattggttggtgactggctttataatcctgaagataagtcgtttccccgacaggcacttcattgtgcaggattaaggttttttaatccatttgccgggcattttgttgactgccgggcaccgcttcccgatgacatgaaaacctatttagctagtcacgaaaggtaggcatcgtaatttttgaaaaagattgaaaaggcaactgcttttgtgaatgaaaatcggaacttgtttcgttgcccggtatgcgagcgtccttttgagcgagttgacggattcagcttggtttgtccaaataatcattcatttgatatatcgaaaaaaggtacactgtatttcttgaccaagtcagctaacaatgaatatgataagcaaatgttgatttcccgtcagcgtattttacaggccggcctgtttgatggtattatccaaaaaatcagtacatttttaaaggctgccccggaaacaatattggatgttgggtgtggggaagggacacctttggcgcggttgttgagaaaaagggccaatgcagatactgctgttggttttgatatctcaaaggacggcattaacttagcaacccagcatgaaaccagggcgttcttttgtgttgcggatcttgctcgcttaccttttaacacttctgttttttcaacagtaattgatttattttctccttcttcgtatagtgagtttaaccgggtcattaaaccagggggacaattgatcaaaattattccgaatagcggttacttgcaagaactacgacagttgctttatggaaccgatcaagcaaacagttcgtattctaatcaaaaagtattagatttatttacaactcattatccacacagcagtatctatccattaaaatatcaatttcaaattcctgccgggctacagcgtgacatgatgatcatgacaccccttcattggggtcgcgggcaagactcgcacagttcagtacaacttgagacgttgacaaagattactgttgatgtatcaattttaattaatcattttaatgatggaggaaaaaatggctaatcatattgttttatttgaaccgttaatgccggctaataccggaaatattgccaggacatgtgccggcaccgatacgattttagatttaattgaacctctgggctttaagttggataataagcatttaaagcgagcagggcttgactattggaacaaggttcaaattaattatcatcaaaatttacccgaatttttgaaaacggttgaaaacccaaaaaatctttttttggtttccaagtttgccaaccaagactatactgatccagattattcagatcctaaacaggactattatttattgtttggtaaggaaacaacagggttacccgaaccctttatgcgaaagaatccggaaaaggccattcgaattccccaagacgatgatcatattcgagcattgaatttatcaaacagttgtgcaattgtgatttatgaagttttaagacagcaaagctttaatcatttggagcggacacataaatatccacatgataaattgaaataggaaagtggtttattttgcatcagctaggagaaagtttcgttcacacccgatttttttgccttattaatgtgaaaaggggtgtaatgatcgttttcatgatgattattttttgtgaacaatttaattattgaggagaaaaaaatggcgacaaagaggactcgtaaacgtacaactaaaaaacgaggtcgcccaaccaaggccaaaaagcctgaaacctttttctcaaaatatgcagttaatattttgggagcggtggtggccgtttgggcattgttaggcctctttcatgctggtattgtcgggatattaatgattaatattctgcgcatttttgttggcatattatacccactagggctgctgactttaatagttggtgggctgtggcttgccggattttctcgtttgcccaagattaagggaagacattttttgggaatcgtcatggttgtgatcggcgttttaacctttattagtctggttgaatatgttcaaactgcccaaccagttgagtttgtagccgtaaactggggtaagttaaccgatgatatgatttcctcgaatacaacttccaacattggtggcggcattttatcggcaatttgtttctatcttttacatatgttggttggaaaaatcggtgcgggtattatcagcggcttattagttgttgctggtggctttgtattgtttaatatttcgtttggcaacgtctttttggccattcacaggacaatcgcatttatcggccatgcttttggggaaatccaacaaaaaatacatttattaagagtgaaaaaagcgacagttcaaccggatcttcaagcaaaacagcaacccctaaaagagcaaactgatgcgtcaaaggaagaaagggctgttaaacccaaattttcgacatcatctattacaatttccggaatgccggtgtcggatgaaccaaaagatgatgtaaaacagcctccaaaagagtctgatacggaaccaaagccagagcaggacaagtcaaatgatgttgatttggtaaacgttcaggaagacgattcttataaattaccaacatctgatttattaactcagatgtcgcaggatgatcaatccggtgaattgaagtctattgaccataacgcaaaggtgcttcaagaaacgctcgacagttttggggtcaaggctgaaattaagcatgtcagtctgggtccttcagtgacaaaatatgaaattcatcctgatatcggagttaaagttagtcgaattgttaatttaactgatgatatcgcacttgcactggcagcaaaggatattcgaattgaagcgccgattccgggaaaatcgttggtcgggattgaagttccaaacaaaaagattgcgacagtttcgtttagagatgttgttgaacatcaaccggaaaatcatggtcatctattgcaggttccgcttggaaaagatgtgaatggaaatgtgattgcagctgatttaacaaagatgccgcatttactgattgccggttccacgggtagtggtaaatcagtcgcaatcaacagtatcatcaccagtattttgttaaatgccaaaccaagtcaggttaaattaatgttgattgatcccaaaaaagttgagcttggcgtttataatggtattccacatttgcttagtccggttgtttcggaacccaaaaaggcggctcgggcacttcagaaagttgtttccgaaatggaaaatcgatatgaactgtttgctaaatacgggcaacgtaaaattagtacgtttaatgaatttgcggcgaaaaataataaagacaatgatgttaaaattcaaccaatgccatacatcgttgttattgtcgatgaattggcagacttaatgatgactgtttcaaatgatgttgaagcagcgatcattcgattagctcaaatggggcgtgctgcggggatccatatgattttagcaacccagcgaccctccgttgatgttattacaggattaattaaagcgaatgtaccttctcgaattgcatttgccgtttctagcggaattgattcaaggaccattattgatactaacggtgctgaaaaattgttgggacgcggcgatatgctcttcttgccaattgactcaaatacgcctattcgagtccaaggtgcctttattccggataaagacgtttcccgagttgttaagttcatcacagaccagcaatcggctgattacgatgagtcaatgatggttagtgatgaagaaatcaagcaggaagatcagcaggaatcagaggacgatttatttgatgatgcactggaatttgtgattaatgaacagaaagccagtacatcgttacttcaaagacattttagaattgggtataatcgtgcggccagattgattgacgacttacaaaatcgcggttatatcggtcctcaaaatggcagtaagccacgagaggttttcaaaaagccttaggagagcgaagacatttatggccttatcctggtttaaaaatcatcaaacggctgatgtgttggtatatatgattgatggcacaaaaaaagaccggcatcgtttttgatgtccagccttctccattgcctgatcgttttggctattgttgctccataatcgtgattacagctgaagctaataatgaaccaaccgttgcaataatcatgatccatacgaaagtcaaagttattttttgaaatgttgttctctttttacgcgccaatatttgcaccactttctgattatattcaataattagtctaactatcattatcattcattgcaatacgttttgtcaaaattaggagggacgagcgatgcaatttccttcatgggcgaccatgatagcagtgtttttcatgcaattagctgttcttttatttattgctactgtcatgatcttaattcgcaaaaaaatcatgccccacaaaaggcttaaagttgtaccggttgacctgtggccgccatttatattgttttttattcaccaattaagtgcttctgccgcatcaggatcggttatcccacaaattgtgattatttggatgacaattagcctggttgcgttgctttggcaaattttgacagataaaaaaatgacttttcgtcgattttttgttttattttggcgtttaagtgacctagtattgcttgttagctggatttacacgtttgtttatatgatcattcaagcaggttagcatgtgtacggatagtcgactattaataatattgcatatataaacttagctaaaatttggaatactgaaagtttgaggagaaatcttcactttcagtatttttttgtatcattccccactaattccccacaactgaaaatacctattctaatagtcattatgagggactgtatccttttatgaaatcgtttgtgacattctttttacaaaaataggggcagtgtggttggtagtggggaattgtggtaaaatgtgattgcaagttgaaataaaaggggatgtagggatgctgcttggtgaatttcagcacaatatcgatgccaaggggcgtatcatcattcccgctaaatttcgtcaagatcttggtaacaagttcgttattacacgagggatggatggctgtttatttggttatccaatgagcgaatggaaaaaagttgaagataagatcgattctctttcggtcaacaaaagagatgttcgagcctttactcgttttttcttttcagctgccgttgagtgtgaatttgataaacaaggtcgagtaaatattcctagtattttaaggaatttcgcaaaaatcgaaaaaaagtgtgtcgttgtcggcgtttctaaccgaattgaggtatggagcgagcctgcttggcatgcctttacaagtgatgccgcagctcattttgatgaaattgctgaaaacatcatagatctttagtcgttatgacaaaaaaatagttaactgaaaagtggtgattgtatgtctggctttaagcatgtgaccgttttattgcatgaggcagtggacggcttggacgttgatcccaacggtacatacgtcgatgcaacgctaggtggtgggggacacaccacagaaattttaaaaagaatagataaaggtcatctctattcatttgaccaagacgaggaagcgatttcatataatcaacaacatcttcgccagtacgttgaaaatgataagttgaccctgattcatgataactttagaaacattaagggcgcattggctgatcgggggatttccaaaattgatgggattgtctatgatctcggcgtgtcatcaccacagtttgatgaggcaggcagagggtttagctatcgttttgaagcccgtctggacatgagaatggaccaggataatccagtggatgcctggaaagtgattaatgaatggccatatgagaaattggttcgaattttttatcgatatggtgaagaaaagttttcaaagcagattgccaggagaattgagcgaactcgtgaagatcatccgatcaatacgacaactgacttagtaactttgattaaagaagcgattcctgccgcagcaagacggcatggcggtcatccggccaaaaaggtttttcaagcagttagaattgcggttaatgatgaactttcagctttagaggattcattggaacaatcacttgaacttttagcagtcggcggtcgaatcagcgtcattacgtttcaatcgcttgaagatcggcttgttaaaaccatgtttaaagaaaaggcatcattaccagaattaccacctaacttgccggttattcccaaggaacttcaacccaaatataagcttattactcgaaaaccaatcattccaaatgaagatgaattagcagacaatcatcgtgctcatagtgcaaaattacgaatcattgaacgaacaaaaatctagtagaaagaagaatacataagtatggcacaaaataatttagctcgtaaccttgcccaagaggaaccacaaacctacatttcaacaccgaaacgggttcaaacaccagaaataggtgcaaaccaacgtctgggattgaatgcttttgaaaaaacgctgattgcttgtggaagtgtcatgttaactgtgctaatgttagtagttgtctcgtctaaaattgcgctgtccgattctcagcatcagcttcagcatctggatacccggattacgaatatccacaataataatacaaacctgcagcagcaaattggggagttacagagtagcagtcggcttcagaaaattgctaaagaaaacggcatgtctctttccaatggaaatataaggaatgttactaaatgaaagacccatctaatcgctctgaagaaaatttaaaagcccgaaaaaatcgaaagctcgttggaatttcactgcttttgatttttttcattgtcttttttgtcctctctctacgtctggtcgtgattgcagtcggcaaaaacgtgaaacacgttaatctgaacgaaagggcagagaaattatacaatcaaacacagactttaaaggcaaagcgcggcacaatttatgatgcaaacggggatccgattgctgaagataccagtacatattcgctttatgcagttcttgataagaaccaacgcggcctgaatgataagccgctgtatgtcgttaataaggccaaaacggcgcgtgttttatcgaagtatttaccaattactcaaaaaaaggccttgaagatactatcaccaaaggacgggcatccatttcaagttgaatttggcagcgccggtacgaacatttctctcattacgaagaaaaaaattgatgctaaacatctcgcagggatcaactttgtccaacaacaagcacgtctttatcctaacggtgtcttttcatctaatctgattggggtggccacctcacaaaataacaaaaagaccggtatgtctgatttggtaggacaaatgggaatcgaacaggcttttaataagcagctagccggaactaacgggtttaggaatgccgactatgacgtttatggttataaactacctggtaaaaaacagaaggaacgtaaggttaaaaacggcgacaacatttatacaacaattgattcccgaattcaaacgttattggaaagtgaaatgaattcggttcaatcacaggttcacccggcatctttgaatgcgattttgatggatgccaagactggaaaaattgtagccgagtctcaacgaccaagctttaacgctgctactttatccggtattggcaaggcttggacaaatacatttacatccgatacatttgaacctggttctacaatgaaaatttttacgttatccgcttcaatcgattccggccattttcacggaaatgatacttatgaatccggtcgttattcaatagacggcaagattgtacccgattgggacacggccggttggggatatatcacttacaataaagggtttgccctttcaagtaacgtcgctatggcacatctggaacaacaaatggggcccaagacatggaaaaaatatattcaaaaattcggcttcttaaaatcaaccaactccgggttgccaaatgagttgacgggaaaaattcagttcaattatcctattgagcaagccgatacggcatttggtcaaggaattgaaattacgccgattcaaatgatgcaggctttaactgcggtatcaaataatggtaaaatgatgaagccgtactttatttctaaagtaacggatcccaatacgggtaaaacggttaaaaagtatggtcctaaagaaatcggaacaccgattcgatcatcaaccgcaaaaaaagtccgtgatcacatgcaggatgttgtttataaatcttatggtattgggcaggattataagattaaaggctatcgagttgcggctaaaaccggtacggcacaggtaagtaacggttacggtggttatgcttccggcgatgacagctatctttattcggtagcagggatggttcctgctaataatccacgttatgtgatgtacattacgatgaagcagcccaaattaaccggtaccaaaacagctacccagttgatggcggaaatttttaaaccggttatcgttcgggctttgcaaaattctaataccaagcagacggtggttaagaagcaagtaccttctgtggcctatcagacaacaacggaagctaagaaagtgttgaacgagaaaaactttgaagttgtatcgattggtgatggtggaacagttatcaaacaatcgccagcagcgaacacaacactggctgaacgaaagcgagtctttattctgacgaacgggacatggaaaatgcctcgaattattggctggaataaaaaagatgttgctgaattttgtcaattaaccggattgaaattagaatctacgggttctggatatgcagatagtcaaagtattaacttttcgcaaacaataaaaaagggccagacactaaaggccaattttgaataaaacaaagaagtcgttttaatattatggttaaggatgggtttgaaagaaaatggggaattggttagtctcatcaatcggggcatttgtcataacagcactttttatgcccagtttgattaagtattttagaagtaaacacgaaggccagatgattcgtgaagaaggtccaagatggcatgaaaagaagtctgggacaccaaccatgggtggtattctattcattattgcaattgtgattgctgatttagcggttgcaggatttcaaggtgggttaacaccgacgctatcaattctgctgtttgttttggtcgcttatggattgattggaatgtgggatgacactattaagctattccgtcgccaaaacgaggggctgaaggcatggcagaaactgctgggacagattattgctgcaattgttttttcaattgtctatagccatgagggctttccaatggctatcaaaataccatttgcttctgattggcgaattggatactggtatatcctattcattgtgttctggtcggtcggcttttccaatgctgtcaatttgaccgatggtcttgatgggttggtttctggacttggaactatttcctttgcggcttacggtattattgcggctgttcaacatcaaaacgatgttgcaatgttctgttttaccgttgtgggcggactattggctttcttcattttcaaccacaagccagctaagattttcatgggtgatatgggatctctggctttgggtggcgcgcttgcgtgtgtttcaatactggttcatcatgagttttcactcttggttatcggtattatctatgttcttgaaacggcaagcgttatgattcaggttgcttcattcaaactaaccggaaaacgtgttttcaaaatgacacccattcatcatcattttgaaatgtgtggctggtctgaatggaaaattgatattgttttctggagtattggattgattgcagcggtaatcagtatgataacgattgtttaagggttggtgtgagactgaggttttgctaccgacctctttgagtatctatttttaaatctaaaaaataaaatatgtcaatagctgagataaatgagttaattgatgttttaacttcttagaaacaaaaggggataaattcaggatgaaaatgattgatgattataaaggcaagagaattctagttttaggagctggaaaaagtggcacacatgcagccgagttattacagcaattaggtgcaacagttgttttaaatgatgccaagccaagtgatcaacttccggaagtagtcgagttggaagaccggggtattaagacgattacgggaaagcagactgctgatattttggataatcattttgacctgatggttaagaatccgggaattccttatgataacgaggttgttgccagagctgtcagtgaaaagatgcctattattaccgaggttgaattagcggctcaaatgaccgatgccgaaattatcggtgttaccggtagtaatggaaaaacaacaacggttacaatgattactaaaattttaaacgaagaacgtaaaaagggacatgcctatgcagcaggaaatatcggggtctctgccactgaaacggctttaaaatcaacagcagatgatacgatagtcatggaactttccagcttcatgcttcttggaattaaaaaattgcatcctcacgttgcagttttaacgaatattttttcgaatcacctggactatcataaaactcgaaaaaattatgttaatgctaaaatgcgtatcacaatgaaccaaacaccagatgacttttttgttgttaactttgactctgatgagtggcgacagttaagcaagcgatccaaagctcagattgtcccgtttgcccgtacgtcagaaattgatcggggcgcatacgaaaaaaacggcaaattatattataacgatgaatttattatgaatgctgacgatattaaagtgccgggtcagcaaaatgtcgagaacgcgcttgctgcaattgcaaccgcaaagattttggggaaatctaatctggcaattacaaatgttttggagacgtttacgggtgtgcgtcatcgagttcagtttgtattggaagctgatggccgcaaattctataatgactccaaagctactgacattgaggcgactcaaatcgcacttgagggatttgaccaccccgttgtactcttggcgggggggttagatcgtggctatacatttgataaaatggtgccacaatttaaacagcacgttaaggccgctgttttgtttggccaaacagccgacttgctggaagaatcgttacaaaaagccggcgttaagaatattaccaaggtagataatttagacgaagcagtgccagctgcttatcattatagtgattctggagacattattttactgtcacctgccaatgccagttgggaccagttcaaaacctttgaacaacgtggcgatgaattcattaaggatgttgagaaattgacacataagcaggaggaaaaacaatgagattaattatttccggtggtggtactggcggtcatatttatcccgctcttgcgattattgaagatttgatgaaacaggaacctgattcagaggtgctatacgttggttctgaacgtggcttggaaagcgccattgtaccgaagcaggggatcaaatttgtcgctttacggattcaaggatttaagcggtcattgtctttggaaaatttaaaaacggtcgcgttgttcctaaaaagtgtccatgaatcaaaaaaaatgattaaagattttaagccggacgtcgtcattggaacaggaggctacgtttcaggagcagttgtttacgcagctgccaaagcacatgttcctacaatcattcatgagcaaaatagcgccgttggtttgacaaatcgttttctgagccgatacgttgataaaattgcaattggttttcatgaagcaaaggcccagttcccggaagaaaaagttatttttacgggaaatccgcgtgcacagcaggtcgctcatatgcatagcgatttcaaatggtcgtcaattggcctaaaagatgatgaagcaacggtactgatttttggcggcagccagggggcacctgccatcaataatgccgttattgcatcagtcaatgaatttaataaacgaacctatcaggtcgtctttgtgacaggtcaaaagcgctatgatggtgttatggagaaattgggtaagactcaaattaaggataatatcaaaattttaccgtatatcaacaatatgccacaggtacttcccaaggttgacttgattattggtcgttcgggtgcaacaagcattgcggaaattaccgctttgggtattccggcagttttgattcccagcccgtatgttacggcagatcaccagacgaagaacacaatgagtttggtcacaaggggagccgcattaatgattaaagaagccgatcttaatcctaaaaatttattaaaggcgattgatcaattaatgcatgactcggatgaacgtgagaaaatgtcagaaaactcaaagaaactcggcgttgtcaattcagctgatcaaattttggatattgcacgtggattgataagataaccggacttagagtgagcagcgataaaactaatttgtttgacagaattaaatttgttagataaacggggaatccgcgattaaatcattttgattaagtcacttgctgacaagggggaacaactatgggcaggaaaaacgatcatgatgaggagctgacgccttggcaaaaagcttccggtcaatcttctttggggactaattccccaaagaagaaaattaagcgtcgactcgttaaggactatcaaattcggaactttagacgaatgtggccatttattataatatttctgatgatcatttgtgccatgggattcttgatttcgccaatcagcagagttaaaagtatcaaaataagcggtaacgaaattgtcagcattaagcagattaagcattactctcctgttaaaaagggtatgtctctttttggtgtttggggtaaaacggataaacttgctggggaattaaaaaatcggagtcaaagaatgcagtctgttaagattaacctcgttaacttcaatcgaatccatattaaagttgaagagtatccgacaattggttatctttataccgatggaggataccagcctatcttaaagagtggggttattattaaaaataaagtgcttaatcctcgtgatgggtttccggttttgaaaaagtttaagaatccccggacgcttcggcgaacgatcagacaatatcggcggatcagccccccggttcgagctgcaattaatacgatcagttattcaccggtcaaaagcaaccgggatcgggtatacttacaaatgaatgatggcaataaagtttttgcatcaatttccagttttggcgacaaaatggattattacccaagtattaatgcaaagctgaaagttaaaagcatcatcaatttggaggtgggggcatattcctatccgttaacgaagcatgaatcaaaagttaagtcgtaagaatacaggtgattattagcgtcaattaggctgtttccgtcgttatcattgtgttaaacttatgttatgttcagaaaatattctagatgtggaggttccttacatatatggataattcgggtttatatgtgggacttgatataggaactacctcaataaaagtaattgttgcagaaaaagttaaagggcaactgaacgttattggtgtggggaatgagccttctaacggtctcagccgtggcgtgatcgttgatatagatcaggccgctgaagctattaggagtgcagtaagtcaagctcaagaaaaagcaagtattgaaattaaagatgttattgtcagtgttccggcgaacatcttgcgaattgaagactgtaacgggttggtcactttggatgaccaatctcgtgaaatcacggtcgaagatgttcgaaatgtggcggtgtctgcgttaggtaccagtttgcctcaagaacgcgaagtcatagacattcaaccggaagaatttattgttgatggctttgacgatattaaagatcctcggggaatggtcggtgtccgcttagaaatgcgcgggaaactcattacaggatcaaaagggattatgcacaatttaaaaaaggcggttgaaaaagccggcttgaacattatctccacggttttgacgcctttagcagaaggtcatgaaattttaaatgatggcgaacaagattttggtaccatcattattgacctcggcggtggccaaacaaccgcttctgttattcacgaccaccaattaaagtacgcaactactgatcccgagggtggcgagtacattacaaaagatatatcaattgttttaaatacctcaatggaaaatgctgagaaaattaagcgagattacggatatgccgattcactgcaggcatcggctgataatcaatttccagtagacattgttggtcaagctgagccaacctacattgatgaaagatacttagctgaaattattgaggcccgtctaagtcagatttttgatcgaattaaaagccgacttgatcaagttcaagcacttgaattaccaggtggaatcgttttaaccggtggcgttgccgcacttccgggaattgctgagttggcggctgatcaattcaatacgaatgtcagagtttatattccggatcagatgggactgcggcatccgtcgtttacagctggactgtcccttgtctcatatttctcagatctctcggatgttgatatgattgttcgatcagccgttggtgctacatcaacaaaagttccaaagctaacagacccgcaagatactcaagttcctgtgtcgagtaaatcagacaaaccgaaacgaaaaacacagaagaaaaaacgtggcgaaggaatcaaaaatttctttagcgatttctttgattagcacttaaacggaggtaaaataattatggaatattcacttgattccaccgaaaatcacggtgcagtaattaaggtcattggagttggtggcggtggtagtaatgctgttaacacaatgattagttcagatgtaaagggtgtagagtttattgttgcaaacacagatgttcaggcgctctctacatctaaagcagaaacaaaaattcaactcggacccaagttaaccagaggattgggagcaggttccaatccggaaataggtgcaaaagctgctgaagaaagtgaacaggaattatccgaagcacttgaaggcgcagatatggtttttgtcactgccggaatgggcggtggtaccggtaacggtgcagcaccgattgtagctaaaattgctaaggatcagggtgctctgacggttggggttgttactcgtccgttctcttttgaaggtcctaagcgcagtaaatatgctgatgagggtgtttcacagttgaaggataatgtagatacacttattgtcattgcaaataatcgcttattggacatgattgataaaaagacacctatgatggatgcctttaaagaagctgataacgttcttcgtcaaggcgttcaaggtatttcagatctaattacaagtccgggatatgttaacttggattttgctgatgttaaaacaactatgcaagatcaaggctcggcattaatgggtgtgggagctgctaatggcgaagatcgaacgaagaaagcaactgagaaagcaatttcatcaccattacttgaagtttccattgacggtgccgagcaggtactgttgaacattacgggtggaccggacctatcactatttgaagctcaggatgcctcagatattgtttcgcaagcggcaaccagtgatgttaacattatctttgggacatcaattgacgaatcacttggagacaaagtgcgggtaactgttattgcaacagggatcgataagaaagcagcagaacaggggagattggaaacacgtcgtacgcggacggcttcaccttctgctcgaccacaatccagtgcacacccccgtcaatttgatggtcatcgtaattcttcccaggagactagcaatagcaattcaagtgctaatgacagtcatactgatcctttgggaaactgggatattcgtaagcagccaactactgcccgaccatctgttccagaaaatgacgagtttaatgacgttgagaaaaaggattttgatccgtttcagcctgacgtcaattcagataaatcgggcaaaactgataatgataattcacaggatgatattccaccattctttaagcaccgtcgtcgtaacaataaataatgaatctcagttaatgtagagacggcgcttatttgagcatggtgaaattcgaaaggaaacaaacatgtcagaaaagtttaattttgcgaatttttttggaatggaatcggataagccgaagaatgaggatgcgaaactagtggataatgttgtgcctttaacacgaaaagatttagaaactaaccgtaatattgtggtttttgaacccatcaattacacagatgttgacaccattgctcaaaagttattggaagatagcgctgttatcatcaaactcggtaagcttgatattaaatctgctgaaagaatggttgatttcttaaatggtgttttgtttgcaattcatggtactattgatcgtcttgataagaacatttttatttgttcacctaaaaattttaaggtcactaagtagctaagttttaaacaagagataaggggtattttattggtatctgtaatcgcgtctatcgtttggttattaaataagcttatcagcatttatatgctggcaattgttatctatgcattgatgagttggttcccaaatgcttatggtaccgcatttggtcgctttcttggccgaattgttgaaccgtttgaacgattgttcaattttgcgtccgttgggatgatcagttttgcgcctgttgtcgcactgattgtgttatccctagttcagggtggtatcacctatttggggaatctcattattggatatggttatgggtattagttagaagaggggtatttagcgatggctgttgatgcaaacgtttctcaacattttcgacctgatgaagtgccgtttcttgagtcaattgaccatttaagtgggcaggttgaaaatgaatatcggcctattttgactgagtttttaaatcccagacaactctatattcttgaatcaatcattaatcgccatgatggcattcatttctcaacttacggtggttattcaggtgctgagttgcaacgggcaatcgtctatcctgagtattttacgcctaagacggatgatttccgcatcactgcgtttgagattgattatccaagtaaatttgcgacactggcacatggaaaaatattgggatcattgatgggtgccggtattgagcgaaatgtggttggcgacattattacggacggtcttaaatggcagttcatggtgcaatccgaaatggcagattatgtcaaagcacaagttgatcacattggcaaaattaaagtcaagcttgaagatatctcaccagaaggggtcattacacccgttgatgaaagtgaaacgttaacaacaactgtttcttctctcagagttgatgctctgattagtgacggttttcatatttctcgtcaccatgctaaagaattagtcgatgctggtgatgttcggattaattgggttgatacgacgaggccggattttgaattatcgacaaaagacattatttctgtgcggggatatggacgaattgtcatcaaagaaattaccggaatgacgaaaaaagataaaattaggattatcataagtgtgtataaccggaataaataggaggattggttcatcatggtattaagtccacaggatattcacaataaagaattttcaacgaaattgagagggtacaatatcgacgaggtcaatgatttccttgaccaggtcatcaaggattatcagattattttggaagaaaataaggatttgagatctcaattgagtgaatcgaaagataaactctcgtatttcaatgacctgaaggactcgttgaaccagtcaattttagttgcacaagaagctgccgataaggttaagagcaattcgaaaaaggaagccgagattacaaatcgtgaagcccaaaagaaggctgatgacattgttaaaaccgctgacgaaaaatcgactcaaattcttgaagaggcttctaaacgtgctaaaaagctggcaattgaaactgacgatctcaagaaaaatactcgagtattccgtcaacgacttgaggtcatgcttgaaagccaattagcggttattaagggctctgattgggatcacttggtcgaagatgggcctacgacaacctatgaagatattgaaaaagttgttggagatcttgacaaccctacaaattcagatgtagaatcaggaaacaaacagggtaataatgctgacgcagttgaaagtacgccgacaaccgatgataaactgcaaacagttgtcatttatcctgacagtcaaaaataataataattaaatcgatcagagaccagaaattaatcaaccgaaacattagcgagctaaagatggtgaaagtttagcagtcaccggttgtttaacagatcagctctattacatatcgattgttataaagagataggattattaaatcctaaaattgggtggtaccacgaagatttcgtcccttgggcggaatctttttttgtatcgtttgatctgtcagggtgtacaaataacggtagtttattacgctattacttttaaaatggagaaagggagtcaaataatgcgggtaaaagacactttaaacttaggcaaaacgaagttcaaaatgcgtggtaatcttcctgtaaaagaagtggaacgtcaaaaagcatgggaagaaaatcgtgtctacgaacaacgacaaaaattaaatgagggcaaaccaagttttgttcttcacgatggacctccatacgccaacggagatattcatatgggacatgcgatgaacaaaatttctaaggatattattgttcgttacaaatcaatgaccggatatcgggcaccttacgttcccggttgggatacacatggcttaccaattgaacaaaaattaacccaagccggctatgatcgaaagaaaatgtcgaccaacgacttccgaaagctttgtcaagaatatgcgatgaagcaggttcaacgccaaatggatgagtttaaacgtcttggcgtctccggggattgggatcatccctatctcacattgcagcatgagttcgaagctgccgaggttcgtgtctttggggcatttgccaaacgtggcttgatttacaagggtaaaaagcctgtttattggtcatggtcatccgaatctgcgcttgctgaagcagaagttgagtatcatgatgttacatcaccatctgctttctatggcgaaaaagtcattgacggtaagggtgttttggaagacgacaatacatttatggtggtttggacaacgacgccttggacaattccagcgtcggaaggtatcaccgtagatgctgattttgattatgcagtggttcaacctgaagatgatgaacgaaaattcgtcattgccagtgagctgcttgaaaaagatgaaggcctatttggctggaaaaacgtcaaaattgttaagacagttaagggacgtgatatggaaggcatccttgctgaacatccatttgaccatagtcgaaaactattaacaatgttaggtgattttgttacgttggatgccggtaccggacttgttcatactgctcccggatatggtgaagatgactttaatattggtcggaagtatggattggatatctttgcacccgttgatgatcgtgggtatttgactaaagaatcaggcgaagattttgctggagtcttctatgaagatgctaataaaatcgcgttggataagttaaaaaaggctggtctgttattggattacatgccgctgaatcatagttacccattcgactggcgtactaagaaaccgattattttccgagcaacgccacaatggtttgcttctgttgataaaattaaagatgatattttaaatgctatcgaagatgtgaccttttaccctgattggggaaaggttcgtctctccaatatgattaaaaatcgtggcgattgggtcatttcccgacaacgtgtttggggtgtgccgcttccgattttctatggtgaggatggcgaagcaattattacccaggaaacaattgaccatgttgctgacttgtttgccaaatatgggtcggatgtttggttcgaacgtgagcccaaggacttattaccagatggctttaccagtgaacattcaccaaacggcaaattcactaaagaaaatgacatcatggatgtttggtttgattcaggttcatcgcaccaaggggtcttggcagctcgtccagagttgacttatcccgcagatatgtaccttgaaggttctgaccagtatcgtggttggtttaattcaagtctgattaccagtgttgccgtttcaaataaagcaccgtataaatcaattgtctcacaaggtttcacacttgatggtaaaggccataagatgagtaaatctttgggcaatacgattgcaccaattgatattatcaaaaaaatgggtgctgaaattgttcgtctttgggtaacatctgttgatacatcagctgatgttcgagttagtcaggaaaactttgttaagatttcggatgcttataagaagattcgaaacacaatgcgattcttgctagcaaacacgtctgactttgatccaaagacaaatgcagttgcgtttgatgaaatggaaagccaagatcagtacatgactgttttgcttaataagtttcttggtgaggctcgtgatagttttgaacagtatgacttcttgactttctataagaaattcctgaattttgtgacaaccgatttatcggctttctatctggatatggcaaaggatattgtttatattgataagaaggacggtcataaacgtcgctccatgcagacagttatgtatcatgctgttacgacattgaccaagctgatgacaccggtcctgccgcatacagccgaagaaatttggggattcttgaaagaacctgaagactttgttcaattgactgatattcccaagccacagcattttgacaatgaggctgatattttggaagaatggaccaagtttatgacttatcgggatgatgtgcttaaggttctggaagaggcgcgtgatgccaaagagattggcaaggcatcagaagcatcgttgacaatttacgcgacaaccgaagtgaaagatctttttgaatcgttaaatgtagatcttgcaacggttcttctggtttcccagttgacagttaaggactttactgatgcaccggataatgcaacgaagtttgatagtgatggcttggcacttctggttgagccggcaaagggtaaaacatgcgaacgctgtcgtttggttaggactgacgttggttccgatagtgactatcctactttctgtcactcttgtgctgaaattgttcgtagtgaattcccagaaacggttgctgaaggttttgaagctaaataatcagaatcgtttaacaatttgaaaaactgttttaaaactaattgtaaaccagtacaattaagaggttgaggccaggcaaatgtctggacagcctcttttttgatttgaagaagcttcaggaggaatttaaaatgctttatggaaaagtaaaaacgtataatgctaaaaacggttttggatttattacacaggatcagggagacaatctgttcttctttaagaatgcctttcatggtgaagactattcgcggattgttccagggattcgtgtgagctatgttgttgttgaaggccaaaaggggccacaggctgctaaagcacaaattgtggaagaagcgggtgaataattgcattaaggactgaatgtttgtaaaatatatttattaatggaaaatagggtgatcttgtggattttgaagaacatgtcgttgattctcaaaacatttatgatggtgcaattatcaatgttgaaaaacaaacagtccggttgccagatggtcaaacggcttttcgagaaattgttcatcattccggtgctattggtgttttagcgcttaccaaagacaataagattatcctggaaaagcaatggcgagcacctgttgaagcaacaacgattgaaatccccgcaggaaaagtggataatcgcgatacggactttcatcacgcggttattcgtgaactaaacgaggaaattcgatatacaccaaagcacgttgaggagctttttgggttttattcttccgtaggcttttcggatgaatacatgaaattgtatctcgccactgatttagagcctgttaaagataaattgcccagagacaagggtgaatttttgcaaatcatcgaaaagacgttggatgaagctgtttcaatgattacaaatggtgatattaaagatgcaaaaacaattatggcaattcagcattggcaattaatgcaaaagtaggtgattttttaagtggtaaccgatgataaaaaagaatccaaagcccttacaagagaacaatatcgaaaactcaagcagcaagaggatgacgattttaaacaacgagacaaaaaaagagttgaagtagagcgagcttatgcgaggacacatcaacaaaatctcggcgatgatgctgctattgcagatgccaatcaattcaagacgcccagatggcataaaattaataggcggctaaattggacgattggcattctagctgttttgattgtcattgtttacttggttcttttctttgttaattaaatttttaatatgatttacaaattataaaaagtgccgacactatactattttagtttaaggagaatgatcatgacttacggcgttatatgcgcaatggatgaggaacttgctattttaaaagaggcattggtaaatgaatctgctcaaaactatggtcagatgaatttctatacgggtcaaattcatggacaggatgttgtactggttaaatcaggcattggtaaagttcaggctggcattacaacatcaacgctgattaatgaataccatgttgacgcggtcattaattccggttctgcaggcggaattggcgatggattgtcaattggcgatattgttatttcaacagaaacggcttaccacgatgttgacgtgactgcatcaaactataaggtgggccaattaccaggatttccggccaggtttgaagcatccaaggatttggaggacgctatcgcacaagcagctaaagaaagcggtgtgactgcccattttggcttaattgtgtcaggtgatcagtttattgcagattccaaacggattcaacaaattaaggacaactttccagacgcgttatgttcggaaatggaaggggctgcggtcggccaagttgcctttcaaaatcatgtcccgtatgccgtgatccgagcaatgtctgatgttggggatgaaaatgccgaagtcagttttgatcaattcattattacggctggtaaaaagtccggtcagatgttgattgatttattcgagaacgaagcagcaaggaagtgaaaagacttggaagagatttatttagataatgctgcaacgaccagagtttcagatgaagtttatgcagaattaatggacaagtataagaatgtttatgggaatgcgtcgacgctttatgggctcggacgccagtccaaagaggttatggaacacgccagagaagtgattgccaagtcaattaacgcggaccccgaggaaattgtttttaccagcggtggttccgagagtgacaacaccgcagtaatgcaaacagcttttgcacgtcaatctttgggaaagcatattattacgactgcaatagagcatgaagccattttaaggcccatgcaggcgttagagaagctgggctttcgaattacctacttgccggttgatcagtacggaaacatctccttggacgactttaaagcggcattggacgatgatacgattctggtttcgatcatgacaggaaataacgaagtcggttccgttatgccgatccatgaaattggcgagattttaaaagatcatcaagcatggtttcatacagatgccgttcaagcatatgggttattagatattgacgtccaacgtgatcatattgatttattgtcaacgtctgcacataaaattaacggcccaaaaatgattgggtttttatatcgtcgaacaggtgttaacttcccaagtttaattaagggtggcgatcaggagacaaaacgtcgtgcaggtactgaaaatgtgccggcaattgctggcttcgcccgtgctgttgagacgattaccagtgaggaaaaggcacatcgtcaggctaaatatctaaaattcaaaaagtatattgccgataaattaacaaaaaatggcattgactttgacattaacggtcaaattaccgaggacaatttaaaccacgtttttaatatttggctaaagggaatttcaacctatgtgatgcaaactaatctggacttggcaggaattgctgtatctggtggttcggcttgtacagcgggaagtattgaaccttcccatgttttggttgcaatgtatggtaaggacagtccgcgtatcagtgaatcgattcgaattagttttgggcgttacaacacgtatgaggatttggacaaactggttgctgcgattacccaaacggttaaacgtttaaaaaataaaaatagggaagtgaaactgtgatggctttttccacaacggctaaggtgagtggtgattcgcatgcttacgaactgaattctgaagtgaagaaatatacgttaaaagacttgggatttacggagaccaaggctggcaattattctttagaacgctcattagaccctaattctccatacggaaccgggtataaatttaaaatgatggtttctaaagggctggacggttttcgaatgtccattacaacgggaaatggactgcaaaaagttaatatttttaaaaattctgaaacacaagaaagtgttgatcaattcaatttcttgattaataatttggttgatcgagaagtcttgaaacgaacggattaggtaaggatgctttgaatttttaaatgaaactcagttaggcaaccggttaatatcggcttgctaactgagcttttttgatttttgaagaaataattcatctcgtgttgcacatgtgttaacgacattaattagtctgtgacagggatcctttttttgaaaaatgtctgtcaaaaagatgatcactcaattgatttggtttgaagaaaggatttttcatattgacagagctttttaaaagggctaaattagatattaattaagatacaatgataaacgcactaaggataatgacttttattatttcctataggcgaagctaggcttatttttcaacccaaccaccttttaatgtcatagttgttatttttactcgattattagagtagcttgatttcaattttaaggaggtttcttatcaatggcaaaacaagatgttaaggatcttgattggtccaatttaggatttacatatagagatttaccatatagttacaacgaagaatttaaagatggtaaatggcagaacggtggcttgactactgattccacacttacattttccgaagccgccgaagatcttcactacggtcaagaagtttttgagggcatgaaggcttatcggacaaaggacggtggcatcaacctgttccgtcctgaaatgaatgccgaaagaatggccaattcggctaagcgacttgtaatggaacaatatccaaaagataagtttgttgaggctgttaaagccgttgttaaagcaaaccaagaatttgtaccaccttatggttcgggcggatcattatacattcgtccatttatggtgggaaccgagcctgttgtgggtgtttccccatcgactgagtatacgttccatatttatgcgactccggttggcgcttatattaaaggattaaatccaatgccttataccgttagcgactatgatcgagctgccggtgccggtactggtcaggctaaaactgccggtaactatgcaagtagtttattaccatcaattttagccaaaaaagccggctttgcggactgcctgtacttggaccctcgtgaacacaagtatatcgacgaatttggtggcgctaatttctatggtgtcactaaggatgggcaatttctgacaccaaaatcagattctatcctgccatcaattaccaagaagtccatcttacaaattgcaaaggatcagggattaaatcctcaggaaacccgaattgcaattgatgatttggataaccttgcagaagctggcgcaatgggaacagctgccgttatttcacctgtcggttcgttgacttataagggtaataagcacgtcttctatagtgaaacagaggccggccctgttacgcagaagttgtatgatactttgtttggcattcaagaaggcgatgttgaagacaagcatggctgggttgaatccgtcgatctataaaatgagtaactgcctttaggctatttggtattgtctaaagtaaaaacgtttcgcccttttgggagaggcgttttttgatgttgcaaaaagtaataaattaaaatttgacaaaattacaatttcaatcgggttgacattaatccattaaaatattagactattagaaattggttagaccaagccgattgatatcattacatatttttaggaggatttttatggctaaagcaaaaccagcatcagagttagattacaacaacttaggattcaactatatggatctgccttatcgtttcctagcccactattcggatggcaaatgggacgctggcaagttgactgaagacagtacattacatatttcagaagggtcaacgtctcttcattacggtcaggcggattttgaaggcctgaaagcttaccggacaaaagacggcagtattaatttattccgaccggatatgaacgcaaaacggatgcataatagttgtgagcgtttactaatgccaccataccctgaagataagtttattgaggctgttaagcaggttgtagcagcaaatgccgattatgtgccgccatatggtaccggcgcaacgctttatctgcgtcctttaatgatcggaattggaggcaatatcggtgttcatccagcttcagaatacttgttcaccatttttgcgatgcctgttggtgcttactataaaggtgggttaaagccaactaacttcacgacctcatattatgatcgtgctgcacctcacggaaccggtcaaagcaaggttggcggtaactacggcgggagtttacttcccggggacgaggctcataaagcaggttattcggacgttatctatcttgacccagctactcatacaaaaatcgaagaagccggttctgccaacttctttggcattacaaaggataacgaatttgttacaccaaaatcaccatcaatcttaccaagtattacaaaatattccgcactttacttggctgagcatcgattgggactaaaagctgttcaaggcgatgtctttattaatgatttggatcgctttaaagaggctggcgcaatgggaactgccgctgttatttcaccaatcggcggtatcgaatataaagataagcttcatgtattttatagtgaaactgaagttgcgccattaacacgtaagctttacgatgaattaaccggtattcaatttggtgatgtagaagcgcctgaaggatggattcaaaaagtaccgctcaattaaattatttaataactgaaatacagaattgagtagcggcattttgatccgaaagataaataaacgacccgactattctgtttttaggactagtcgggttatttatttatctgattagaaggttgagacttaaacatttaagatagtttagagaaatgggagataacgatatgcttaaacgagaaggtcattctcatacggaattttgcccacacggtagtggtgatgatgtagaattaatgattcaaagggccattcatctgggcttcaaagagtatagtatcaccgagcatgcgccactgcccccagaacttcagaacgagtatgcggggcaaaaaacgggtttaacggaagcctcaatgtcaatgtccgatttggatgcttactttaaaaaaatgacattaatgaagactaaatacgctgatcaaattcacattcatattgggtttgaagtggactacttggcagattttgtctcatggacgagagattttctggatgaatacgggccaagaaccgatgataatattttatccgtccatttcatgaagggaaaagatgacaaatattggtgtgtagacgataccatgcaagatttcgaaatcgggttgcttagcgagtcagaaaatgctcaaacgttatttgcgacctattttaatttggttgatgaatccgttacagcaagcttgggtcagtatgcgcctaatcgaatcggtcatatgacattaattcgaaagtttcaggatcgctttaatttggattctcaatataacgaaactaatcaaaaattaatccaagagatccttagaaaaatcttggataggggattgcagcttgatttcaacgctgcgggcctttataaggcttattgtaatcagccctatccgaactttaaaatcgccatacaagcgcaacaaatgggtattcagctgatttatggcagtgatgcgcacagcgtggctgagatcggtcatggttatcacggattggcagaattcttttaaccaaattctcagaaagaacttgacttttttatacgccgtgttatgatttcttataaattaaagattaataataaaataaagttttgattagaagaagtaatcggctctgagtgtaaagagagttccgctgctgagaagggaccattccgaccggtgaaaacacatctatgaactagttgattgaacagagtagatcaattcgcaagtttagcgttatcagggttaccgcaactgttatcgggcatttgtctgctgagtagttgttggcaacgtaaggcaatctatcgtgaggtaggtgcaaattggggtggaaccgcgattaaaattcgtcctcgagaactgactttcagttttcgaggacgttttttatacagtatgtgattcaaagcgattatcagaacacacagatttttttcaaacacaattattatcaatcctccaataaaatctaaggaagtggtcgacatgaaaaataaaaatttaccaaatggcactcgggatgagtttggtgttcaagcagaagttaaagaagcaattcagatgaaactcctaggcctctttaaagaccgggggtttcgaaaattaacaacgccggtattagagtattctgatgtttttgaaccacttagcacggataattatcgaccatatcaattcttggatgaacagggtgaaacgttggtgcttcgaccggatctgacattaccggttgcaagggtcatgagtacgacaggcgtggatttgccagttaaatggtactacagcggggatgtctttcgagttaaaaagcggctttcgggaagctataatcaaaccactcaagcggggattgaaattattggttacaaaggaattaaagctgactgggaatgccttcaggtagcattatctggatgtcagcaaatgggcttggaagatgtcactgttgaaattagccaggcaaaattcgttgatacggtcattaatcaacttgagttgcccgaacctaccagaaacagtctgaaaatggcattgttcgataaagatttaaaccgttatcaaagtctttggtcaccattggtccacacaaagtttgaaaaatttttagcagaatggccatggttgtttggggactttgatcaggtgattcgaattgtagaaacactgcccagatcagcagaactggaagcgatcattaaggatttgattgcaactaaaacatttattaatcaacaatttcccaactttcaggtcacgcttgatctaagtgttcggtcacctcagtcatattataccggcatggcttttcgaggctttaccggtaaatcagcggattatttattcagtggtggtcgatatgatgatctgttaacaaactttcagaaagtaaaagtctccgctgttggtgtggcgtttgacgttgacgctttggtggaacgaacggctttaccggccaataaacagcaaacgcttatttattttgatgatgatcaatggcagcttgccgaaaagaagctgcaggaaattccaaattcaacgctctgcctcacacaatcggttcaagcagctaagcggttggctgatagtgatggtaacaagcttttggatttgacggaaggcaggtcacaaaatggaaccaattaaaattgccctgacaaaggggcgaacagagcaacaggttgtcccattactggaggcgagtggtattaactgccagggactaaaaaataagggtcgtaaattaatttttaatgatgatccaaggtatgactttattttggtaaagggccccgatgttttgacctatttaaatagcggtaccgttcaaataggaattgttggcagcgatgtattggatgaacaggaaaattcccaatatgccatgttaaatttgagtgttggaaaatgccgatttgtcttagcctcaactgctgatttcaacccacagcaacagcggcgaaagattattgcaactaagtatcccaacattaccaaacgttattttgaaggcattggtgaagatgttgagattattaagattgaaggctcggttgaacttgctccgctgattggattggcggatgcaattgtcgatattgtggaaacgggaaataccttacgtgaaaacaaccttcgggtatacgcaaagctacagccggttaataccaaattagtcgtcaaccgtctggcccttaggcaatatcaaccacagatcaaaacattgatttccaacttacagacagcggacagacaagccgtcaaggcaaaattaatcagggagtgactagtatgagaacggcaactatttccagaaatacaaatgaaacgcaaattgaattacagttaaatcttgatgattattcaacaattcaagttgatacaggtattggatttcttaatcacatgttaacagcatttgccaaacatggtcgcttcgggttgattgttaatgccaaaggtgatttggatgttgatccacatcatacgaccgaagacgttggcatcgcgcttggattagcattaaaagaggctttgggtgataaagccggcatcgaacgattcgggtccgcgcttattccgcttgatgaaacacttagtcgagttgtcattgatttatcaggaagatcctatcttgtttttaaagcagaatttgccaatgatcacttgggaggatatgacactgaagtgacagaagatttctttcaagcttttgcatttaatgccgaattaaatttgcacgccgaggtcctgtatggacgtaatacacatcataaaatcgaaactttatttaaagctttaggaagggcattacgggctgctgtcacgctgaatcctgaaattaaagggattccatcaaccaagggggtcatttaatgatcattgtgattgattacgatactggaaataccagaaacgtcaaaaaagcgcttgattttctgggtgttgaaaataaattaagtgctgatccacaggaaatcacaaatgcggatggcgttattcttcctggcgtcggcgcttttaaaaaagccatcgatgcactaaatgaacggcagttaattccggttattcaacaggttgccaagcagggaacaccgatgttagggatttgtttgggcatgcaattactgttcgatcgaagtcttgaattcggtgacacaaccggactttcccttatcaaaggcgatgttattccaatcccaactaatttaggcgtgaaggttccccacatggggtgggatttgaatcaggttacgcaatctgatccgattgcagatatatttgatcaacaattcagttattttgtgcattcgttttatgtcaaaacgtctgcagataaggttttggcaacgactgattatggtgttcaaataccaagtatcgttagacaaaataatgtgatcggaatgcagtttcatcctgaaaaaagtggtcaggttggccttaatgggttaacaaaatttaaggagatggttgaaaatgcagattattcccgcaattgatttgaaaaaccaagagagtgtgcgactgtaccaaggggactttaaccagacaaccttgattagcgagtcacctgttcagcaggcacttgcgattgaaagggcgggattaaccaatttacatttggttgatttggacggtgcgaaatccgggcgtcccgtcaatcgggcaattattcaacaaatttgtgaacaaaccggacttgctgttgaggttggcggtggcattcgatccctttcccaaatcaatacctatcttacttcaggagtgactcgagttattcttggttcggcagcgttgaatgatcctgaactggtccaagaagcaattaagcaatttggcgcagatcaaatcgttgttggtattgatggtaaagatggactggtggcagtttcaggatggcttgagcaaagcactgtcaaaatggatgaattaatggcgtcaatggttgccttttgcgttaagacgtttattgttactgatatttcaagagacggtacaatgagcggcccaaacggtgaccagttgagccatttacaaaagcaatttacagccgcaaccgttattgcttcaggcggtatccgaaacgtcacagacctcaatcagttggccgatttggggattcgtgcagcaattgtcggcaaagcaatggccacgggagatttaccgttacagactttggcggaggtgaaccaaaatgttggctaaacgaattattccctgcttggatgttgaccacggccgagttaaaaaaggtgttaattttgtgaacttgcaggatgttggtgatcccaccgaaattgccgcggcctatcaaaagcagggtgcagatgaacttgtttttttggatattacggcaaccaatgaaaagagaaaagcaattgttgaaacaattgagcaggttgcaagccaggtctttatgccgttgaccgttggtggcggcattcatgacgtttcggatatgatgaatctgctcagggcaggtgctgataaaacagctgttaactcagctgcagttcgccatcctgaattaatcacccagggagctgaaaagtttggaagtcaatgtgttgtattagcaattgatgcaaaatttaatcctcaaacccaaacctatcaagtctacgtgaatggtggccgcaaagcgacaaatttggatgcagtacaatgggcaaaggaaggtgtcaaaaggggtgcaggcgagttactggttaccagtatggataaagacgggactaaaagtggttacgatattgatctatacagacagttaacaaaagctgtttcagttccggtgatcgcttccggtggatgtggaaagctgacagatttttcggatgttttccgggagtcagacgtggatggtgcattagccgcttccgtttttcattttggcgaactgactattagtgatgttaagcaacaattaaaaacggatggggtgatcgtacgttaaaaccagactttgcaaaatatccggacaatctggttccgacgattgttgttgatagtcaaaccaaccaggtcttaatgatggcctacgtgaacgaagaaagctatcagcgaagtttaaaaaccaggcaaacctggttttggtctcgaagccgtcaggagctatggcataaaggcgaaacaagcggcaacacgcaagagattgtttcaatggcgattgattgtgatgaggatacattattaatgcgggtgattcctgctgggccggcttgtcataccggacacacaagttgtttttatcgaaatgttttagaggaggaaaaagataatggctgaacaaaatttggatgatttatatcaattaatattagaaagaaaaaataatcctgaaaagggatcttacacagactatttatttacgaaaggattggataaaatccttaaaaaggtaggcgaggaagctaccgaagttgttgttgctgctaagaatgattcagatcctgattttatcttggaagttgccgatttagcctatcacgtggaagtgttaatggcagagcggggaattacaactacccagattaaggaagaattggcgagccgagaaggtcgtcaaagtaaaattcaggatcgaaaagatattaaaaattggtagtttagtaccaagaattggaggactcctatggtaaaagaatctgttaagcatcttaatccgtacgttcccgaacagacactggatgatcttaaaaaacaatatggacttaaaaaattagttcgactgtcagccaatgaaaatgcgtttggcacttctcccgaggttgcgcgagctttagacagttggcatttttcagatgcaaatttatatcctgacagtaacgccgaggtccttcgacggagtattgccacccggtttaatatcagtgaagatcatctgctctttggaaatggcttggatgaggtcattgaactattatgtcgggttattcttgaacctggagatgaagtgatcgatcctgccctgacgttctccgaataccagcttcattctcaaattgaaggtgccaagatcaaacgggttgcacttgatgatgccgggtatttgaacttagcagccattaaacggcaattaacgcctaaaactaaaatcatatggatttgcaatcctaataatccaactgggacttttttagaaccggccaccattaaatcctttttggaagctataccggatagcgttacggtgattgtagatgaagcttatattgactttgtgaatgaaaaaaatgtttcggttattcaattgaccaaacaatttaataacctggttgtgttaaggacactttcaaaagcttatggattggctaattttcgagttggctatgctgtttgtaatccacctttaatggcctatcttcaagccgctcgattaccttacaatttgagtacttttgccgaggtggctgctaccgcagcttttaaagatacagaatttgtcaaacgggttgtcaacacgattgctgaagagcgtattaaatggaaccgctttttaacgaaacaaaaactacctttttacgagtcatctgccaactttatttttttcaaagcaggtaattcagataaactacatgattatttacttagaaacggttacctaatcagaaatggattaaagccgggatggttgagaattacgataggaaggcctgaggacaattcagcagttcagaaattaatggcagcgtatttcaacgcgtcatttaacatgtgatcagtggcatttcatcgcagaatgcgttaatataaattttactggaaattacgaccttcactcgtggattctccagaatctaattgaaatgatggtggttttatgcaagacaacagtcaaactcgggttgttgttggaatgagtggtggcgttgattcgtcagttgtcgcttatttactcaaacaacagggttacgacgtgattggcgttttcatgaaaaattgggatgatactgatgaaaatggtgtctgtacagcaacggaagattataaagatgttgccaaggttgccaataaaatcggcatcccttattactcggtaaattttgaaaaagagtattgggatcgggtcttcacatacttcttggatgagtataaaaaaggccggactcctgatccggatgtgatttgtaataaggaaatcaaatttaaagcatttttggattacgctttggaattgggtgctgattacatcgcaacaggacattatgctcaattaacgcgtgatgaagatgggcacaaccatttattgcgtgcctcagatggtaacaaagaccaaacgtacttcttgagtcagttatcggccaatcagttggatcgggttatgtttccgattggtaacctggttaagccggaagttcgtgaaattgcacgaaaggctggtttagccacggctgacaagaaggattcagttggtatttgttttattggtgagaagaactttaagcagttcctgggtcattacttacctgcgactccgggcaagatgatgactgttgacggtgaagtcaaggggcagcacgacggtttaatgtactacacaattggccagcgtcgcggtcttggtatcggtggtgacggtgtcgataaccagccttggttcgttgttggcaaggatttaaagaagaatattctttatgttggcaagggttatcacaatgagttgctgtacgccgattatttagaagcttctgatattcattgggttaataatttggatcgtggtcaggactttcattgcacggccaagttccgttatcgtcaaaaggacactggtgtgaccgtacacttaagcgatgacggtcaaaaagtgcgggttgattttgatgcgcctgtacgtgccattacacccggacaggcagttgtcttttatgacggcgaggagtgtttgggttctgcgatcattgatgccgcatataagcaggctgaagaattgcagtatgtatagcggaacaagtgtgcggatcaaagcgtttagcacccggaatataaggcattgatttaaaatgacttgtccaagtcaaaagggaagaccagacgattttgtctgatcttcctttttgttttcagtaacattgaaataacaggggcaattattgctaatggttatccgattagccacataaagataggcattgtgatgaatgagaaaacggtgctccaaaattgaatggaagcaatttcggattcatttattttgaattggatggccaaagtagttggcatcgtagcagttggaatggccaaggtcaaaacaacgatattgatgaggccggctggtgcattgactgccaacataattagccaaatgatacatggaaaaaccacgtttttggcaaagacgctgaccccaatagataaattaatggtaattcttctggtaaagagaacaattccgattgagaataaggcaagtccaccggcaactttaccaagaaccataaacgtattttccagttccgccggcatttgccaacctgccagggcaatcacaaagccaagcagcgcgctgatgaccaacggctttttgaatgtgctgattagccgctgaccaagggacgtgacttctccctcttttgcaagggaagcaaaaacagctggtaacagtaaaatgttgataatcagcgtacacagaccgatggtaatggcactgacctgattgccaaataatagcggtaaaatagccgaaccgataaatgggaccgatgggtcggcaactgataaggcacgtaaagacgaaaggtcaagtggcaatctaaaaccgaatcgataagcgataatcaaaacaatgtaacagccaaccataccaaccaacagccaaccggctaatggaatgtcggcaatgataatttttctgggagtcccccatataccggcaaaaacgctgaacggaagtgcataattcatgactaattttacaaattgctgactatcgtgatcatcaaaatcatttcgataagcagcgaagtacccgattccgatcgtggtaataatcggaatcaaggcaaacaatagtgtttgaagcatcccaatttccccctaatgtgcttttcaattccagggtcattaacttaatgagatctgtatgagagaaaagctaattaaagtaagcttaccactgaataattaagttttgaagcgtctgaatggtgaaatgataaattttaatagtcgaggcgcaaaccacttttcacagcacactgaatttctttgaaattcagtagcaatgctgtcataataggtgagtgattaacatacgggaggaatggcttttgacacgattatattttgtacggcatggaaagactgaatggaatctcgaaagccgataccagggtgctggcggtgactcgccgctactttctgaaagttataatgaaatggcattacttgcagctcattttcaagacatttctttcaatcatatatatgccagtccgattaaacgggctcgcgttaccgccgaaacaattggcaggcgtctcaaaagtcaccctgccatttctttattgtccagattggaagaatttaacctgggcaaaatggagggaatgaaattttctgacgttgaaaaacgttatccgcaagaatttgagaatttccggaatcatcctgatctttatgatcctgctgagattggcggtgagagttacttggatgtcattaatcgaatgacacccgccattattgagataatcaacagcaatccccacaaaaacgtcatgattgtcagtcatggtgctgcactgaacgcagagatgaatcatttgttggggacatcacttgctgatttacgaaaacgcggtgggttggcaaataccagcacgactattatagaaagtcatgatgctggacaatctttctccctgattaagtggaatgatacaagttatttaaacaaaaaattggatgaaactgatctagtctaggtgattgatatgaaaaaaaataattcagacaagattaaagaattgcaaaaaaagaatcaggagaaccaacgtaaatatactaagaaacgtgaagatgaggaaaaaaaggccaatcaacttattcatcagatggtttcgaaaattgatgccaatccccatgattaccaccattactatgatttggcaactttattagtagagggtaaggattacgaacaggcagaagagctcttgatgaaagcattggggatttttgaccaatcctctgaggatattaaagatactttgaaatttgggcttggcaatgtttattacgctgctcaagagtacgataaagctatcaaaatttttcaggagataaatgatgacaagctccaggcagaagcctatatcatgctggcacaaagttatatggccaagggtgacaataagcgggcaatggtgtttgccttatctgcgcaaagtaccaggcaaaaggatccggctgtcaatgagatgattggtgataatctgctggcactcggcaatttttctcaggccgctgaattctatgatttggttttaacggctgagcctcagaatggtagagccaattttaatcgtggactggttgcgatggttgcggatgaaccctttgaaagttatttcaaaaaagcaaatcaatatgatccggcatactttaataagggccaaaaaaaattgaaagatattgaaaaatttattcagttaaacggaactaaaaaggctcatgatcagcatggcaaaaaaactaagtaggcttgctgatggattcagtgagtcttgaatcattttgtgaggagaattaaagtggaccaaccgatgggattatttgaaccccaagataacttaaatcaaaatatgtacgttgatggacggctgaaggccattttcttttctagcaatgacagtttttacaaagttctgttaattgaaattacggataccaatttgaactggccggaaagtgaaattgtggtgactggaaactttggcgatgtcgttgaagaaaacagctatcattttaccggaaaggttattgatcaccccaggtatggtaagcaatttcaagccgccaattatacgagtttaattgcgacgaccaaggagggcgtgattaaatatctttccggagatcgttttcccggtattggcaagcagactgcccagcgggtggttaaagttttgggcgatgatgccattcaacgaatcaacgccgatggtcgggttttggaccaggtgccgattacccaaaaacaacgagatgcaattttggataatctaagtgttgatgatggcttggaaaaagtgattgtgggacttaattcgtatggattttctagtaaaattgcgtcggatatttatgagaaataccatggggatgccctgaaaatcatatctgaaaatccttatcaattggtggaggatatccgcggtattagttttaaacgtgcggatgcaattgccttaaaattggggttaacagctgcttctaccgaacggattagagccggtctgctgtacgcaattcaagaactttgttttgaaaatggtgatacttacacaacaacttctgcattattgaatatggcaggtggcctgctggataacaacgctgaacatcaggtgagtggtcaacaactcggcgaatctctaattgaattagctaaggaacataaagtcgtcggtgagggagaccgaatttatttgagctatgtttataatgccgaggttcaaattgccgaacacttgaatcgaattattaaaaataaagacgatggtgaagaccatttttctgatgatgcaattaaaagccaaatacgcatggttgaaagtaaatttgatattaattatgacgattcacaaagccaagcgattatggaagctgtgaaatcaccagcttttattctgactggtggtccgggaaccggtaagacaactattatcaatgggattgtcaatacctatgcccgactgcatgagtattcattggatatcaatgagtacaaggataaaccttttccgattgtgctggctgcaccaactggacgagcggcaaagcatatgtctgattcaaccggactacctgccagcacgatccatcgactgcttgggttaaatgggcaggagtctgcggactatacttcaccaaaagatattgaaggaagcttgttaattattgacgaaatgtcaatggttgatacttttctttttagattattgatgcgtgcggttccaaaccatatgcaaatcatctttgtcggcgatcaagaccagttgccctcagttggccccggacaagtgtttcacgatttactgacatccaagcagcttcctgccatgcatcttgataatatttatcgacaggaaaagggatcttcaattgtccaacttgctcatgatattcatgcggggaaactttctgagaactttgaccaaaaccaatcagatcggtcgtttattgcttgtaatgaaacgcaactgccctcggtcattgaacaggttgcccgtcgtgctaaagacaaagattttggcttgatggatgtacaagtgcttgctccgatgtatcggggaacagcgggcattgatcatttaaacaacatcttacaaaatgtgtggcaggttaatccgactggtaaatcagtgacaattagggaccatacgtatcgaattggcgacaaagttttacagttggttaataatcctgaacaaaatgtttttaatggagatttaggcattattgttggaatggaggcacctaagaaccaagcgattcctacaaaaataatcattgactttgatgaaacagaagtcacttatgagaagaacgaatggattcaatttacactggcttattgtacctcgattcataaagctcaaggtagcgagtttccaatggttattctgccgattgttcggcaatactcacgaatgctgcagcggaatttgctttacacagctgttacacgtgccagtgacttcttaattatgttgggtgagaaacaggcgtttgaacaatgcgtgcgcagtatttcggtaaatagaaaaactagtttggtgcagcgcctggttgaagctatcagtgaggaaccgtatcaagcagttaaaaatccatcaacagacaatttaaatgattctgttagcattaaaaataatcatgatgagcaacaggaagcggtggcatcgagtgaaccgcgtcatcttcccgaccacttaactggggagatgattaacgatgaacaagttgatccaatgattggaatggatgggataacaccttatcaatttgataagtcaaatatgtcataatatgaacgaatggctggaaaaggatgatgaaagcgttaaacaaacgatttcttcttaacttttcacgttgattcgctgtatagtggaagcaaaattatggtagtatttaattaaacaagaatacttggagggtaacatggctgaattgaaatcacatcctagggttaaattattttctttaaactcgaatcgtccacttgccgaagcgattagtcgggcggtcggagtgccacttagtgatgcaactgtcgaaaaatttagtgatgatgaaataaaaataagtgtgaatgaaagcattcgaggcgatgaggtctatattattcagtcggtttcagatcctgttaattcaaatctgatggaattactgattatggtggatgctgttcgtcgtgccagtgcaaagtcaattaatgtcgtcattccatattatgggtattcacgggcagaccgaaaagcgcgctcgcgagaaccgattactgctaagctagttgcatcattcttggaaatggatggtgttgaccgggttgtgacgcttgatttacatgcggatcaaatccagggattctttaacattcccgttgatcatttaagagcaaatacattattggcagattattttgctaagaaacacaatgattccaacagtgttgttgtttcacctgatcatacgggggtgtctcgggctcgaaagtttgccgagcttttagatgctccgattgctattattgacaatcgttctcccgaagatgcaacaaccgttccagaatctgtcatcggtaatgttaaaggcaaaaaagcaatcattgtagatgatatgattgatactgccttcaaattaaccattgcagctgaaactttaaaaaaagccggagcaaccgatgtatacgcaattgcgacacatgccgttttttcggggaatgcgcaacaacggcttcaagattcagaaattgaaaaagttattgtgactgactcaattaatatttccaaagcagatcagtttgagaaattagaagttgtttcggtaggggatttgttcggtgaagcaattactttgattcataatcaacaatcagttggcaaactgtttggaagataattttttattaagggtggattgatttatgtatatgtacaaggcaaatgaaggacgttatgatcatgcagttgtgagacgagcaggagattctggacttcaagtacctgctttgtcatttggaatgtggcatagttttggcgatgatgccaactatggcgacagtgaaaaggttattttaaaggcgtttgatgaaggtatcttcagctttgatttagcttataattatgggccgacttctggtgcggcagaaagaatgtttggtgacgtttatcgtgctaatttaaaatcctatcgtgatgaattggttattacgactaaagccggttttaatatgtggcccggtccttatggaaatttttcatccaaaaaaacattagttaatgcgttggatggtagcttgaaacgaatggggttggattatgtcgacatttattacagtcatcgatttgatccaaacactaatttggaagaaaccgccaatgcgttagatggcattgtgcggtctggtaaggcactctatattggcatttccaattataattcagaacaaacaaaagaaataacgcaatactttaatgacttgcatacgccatttgtggttaaccaggcttcatataatatgttaaatcgggaagttgaggatgatggtcttctgaagacactgaaggatgagaataaagctttgattgcttatgggcctttagcagaaggactattaaccgataaatatcttggcggaatgagtgatgatgttaaagttcattggagcaaccagtttgtaatcaagcatggtaaagacgaacttgttaagaaattgaatgagttaaacgacattgctaagaaccgtgggcaaaatcttgctcagatgtctttagcttggctgcttcatgataagacggttgccagtgttgtaaccggtgcctcaaaagtagctcatttggaagataatttaaaagcattagataatcttgattttactgatgatgaattatcacagattgataaaattgttaaagaataaagtatgattattggaaaatgaagttaatagtctttgtaaagggtggcgtataatcaatttttgattagaggccactttttttgactaaaattgctggaatggcggtttatgtcctgtaaaataatttgatgaatagtgagttttagcaaatatcaagtaaaactgtttagtttaatcatgatatacttatctgtattagattatgccttgaatggagaatagttatgacaaaaaaagttactatcacggatttggcaaagcgtgccaatgtttccgttacgacagtttcacagattcttaacggaaaagatgatcgttttagtgaaaaaacggttaaaaaagttcatcaattacaaaaagagatgggatatgtccctgattttaacgctcagagtttaattcgtcgaagtggtcggacaattggtgttttggttccaaatattaataatccgttttttagtcacttcttaaggggaattgagtctgtcgctatggacaatggttatattccgcttatttttgggtctaacaacaatcaaaagttggaaagctattacttgtttgaatctatcagaagggccgcagacggcatgataatcgcttctgctatctcggatgttagttacattgataatattctaaatcagaacggcattccttatttgctgactgatcaagctccggttgcagacggggatcaggtagatgttaataattaccatggtggagagttgttagcaaattatcttatccaaaagggtcatcaaagagtgaccgttgttactgatcaacacccaaccctcaaccttaaacagcgacttaccggattccttgatgtatttcgcagccatggtttatcgattgcagatgaacaaatcgttgaaaccgaactaacaaaattgggaggatatcatgcgacaaaacaagccttggcgcatcatcctacagcaatctttgcgttaaatgatgaaattgctatcggcttatatcgtggtattcatgaagcagggttaaggattcccgatgacatttcaattgttggctatgacgatattgatttaaccgaatacgttacaccaacattaacgaccattcatcaaccatcatttgaaatgggagaaagcgcggcgaaactgattctaaaacgaattcaggacagagatcggccgtttcaaagcgtctctttgccgattgaacttgttgagagggaaagtgttaagaatattaattcttgaaatttttatttgtaaaaggatttcagatctggtattctctttagtgaaaggttttacttaatttcgattttagtagaaaacctgttattctcagggcatcgattggatgcttttgtagaattaatcattgattatgaggaatgtacggcgggcagagattgccgtgatcaatacggcgaacgggtgattcgaatctctatacttgtttgtacatatttatattaagaggagccttaaaaatgacgaataaagtggttgtactaggaagtttaaatgttgatactaccctccacattgcgcagatgccaaagccgggtgaaaccattagtgcgcaaagcaagactaattctgcagggggaaaaggtgccaatcaggctgttgcagctgcccgatcacatgcccagaccagttttatcggccaagttggtgaagacagcgcgggtgaattcatgattaatgcattaaaaaaagatcggattaacactgatcatattaatgtaacatcaaacgccggtactggatccgcagttattttgctggacaaagaaggacagaacagcattatggtttatggtggtgcaaatcaagcgatgagcacggatattattgcggatagcgaggctgtaattgcggatgctgatgtgttgatttcacaatttgaaacacctcaaacagtcgcttatgaagcgtttaaggttgcaaagaaacatggcgttatgacgattttaaatcctgcaccggcagccgatattttagatggtttgttggaagtgacagatttgattgttcccaacgaaacggaaagtgccacgttgacgggaattaacgtcactgacattgactctatggatcaaaatgctgcaaaatttgcttcaatgggtattcaaaacttgattattacagttggagaccggggcgcatattatcacactcccgatgcgagtggatttgtaccagcatttaaggtgaaggcgaaggacacaacggcagcaggagacacctttattggtgctttcagttcaaaagtgcttaaagatctttctaacattgagatggcattgacttacgctcaacaggcgtcatccattactgttcaaaggatgggcgcattgccttcaattccgacaaccgaggaaatttctgcagaatataaataaaacttattgtttccattagaccttttaggcaggtaaaagtgtttttttcaaaggtgttgatttactaaagtttatctgttaacattaccagacgttagcaggaatttaaatttaagaacttaacatattctttaggattgttaagtttggtgttaatcaattcattttatacgtttaaaggggtttatagctatgagtaataagttagaaattcttaaagattatcaaaaagcagcttccaagctaaatcgattgaaatcacaagaggctgaggtctgtcgttctgaaaatggcgaagacaaggacacggttgtgattaaaccgcaatttggaaatgaaatgaatcatcttaataaagagtgcgaacagctaaatatgattcttgaagcaatggatgcttcggaagattaaggttagtcaactctatcaaaagagatccggattaaaatatccggatctctttttgataatatcactaggttgatgtcgacataaaagttaaaaatagttagataaaagggcaaaggagacagcaatttttatttggccgcgaccttttaagtcttttaaccaatttggtgggaatgtcacaggtgcgtaaagtaatgaagctaacatagaagtgatagaaccgatggtgtcggcgtcatgaccgaggttaacggctcgtttaacagcgacaaaatactgttccgaattaaacaggcaccaaaagactgagtttagtgtatcaacaacgtaggcagaacttttaatttgagtgcttggttgccgcaagaagccagaatcgcctagttgctcgaaataggggacttgatccttaaattgggttttacccttataatagtctaaagcctcttgaatcgcccgtaacatcgcatatttgttgggattttgaatgaccctgataataacgttgattaaaattccggaagctactaggctgcggggatggcgatgggttgttgcggtgaatcgatggacaagtgatgctacctgatcatcaaattgatagtgacggtaatcggttaagatgaaaaaagccagtggcatcatccgcattagcgcgccattgccattatccatttcatcattaccaccgcaaagttctggggtgatacccttatcaaagcgtttgatagcggcttttgttgttttaccgatatcaaaggaagttccgaacggtgtatagtcaccaaaatgataccattgagagtatcttgtcatgagatcattaaggttgaacccaagcgataggctaactaaagatgcaatagataacgatgtgtcgtctgaccaggttcccttgggaacatcgaatgctcgatggcccagcatcgtatcaacagggctttcaagtaatttttcgcgttcttcaaattgtacagggactccaagggcatcgcccagggcgacagcagttaaggattgaaataaaaggtagcttgttgaatacatgagatttacctcgatcttgtgatttctaaacggtatttcataacggttttattgaaagctgttcgtttaaccataagccacttgatagtcattttcaatgctaaatcttggtagtaagcggtttatcttgatcgttttctgttaaaaattgaagttaaaatgaatttatgatttgatcttgaactttcaaagttgggaattatccgtcttctttatccaaaatggataatcctttgtttcgtaagaagcgttataagttttgtgaccaagttcttcaccatcaatttgaccatagcgagcctttttggtctttaattcgaaatgggtctcagaaaaatgatggacaaaacgaagatgcaaatgacgcttcaatagtagcataaaaataaacaacaggatctgacggtaggttggtttctcgacgattaccaaatccaattggtccttataaacagacgctcgtggcacaatatcgatgcctccgccaaagtaagggtgatttgtaactgttacgagaaatgcttttgaataagtgtgaatagtgccgttggggtgggtgactgttagctcaaaaggttgaacggtttgaatagcatgtaagacggatacccagtatgaaaaaccgctgaattgtttatgatgttttaataaggaatggttcgccaaataaacaacggttgcatctaatccgattccaaaattattaagaaaataaccatctgttgaaagatcgtgattaatgaaatgcccaatatggattttagtagggacttggcattcaaaaatatcatgaagcgcttttttccaatgacgaggaatttttaatgcccgtgcgaaatcatttccagagccgattggtaaaagcccaactgggactctagggtcctttatctgggggtgctcagcataaaagcgcatgcaaccgaggattgtttcgtgaagagttccatcgcctcctgtagcgataataattgcgtcaggatgattggtggccgttatttgatcaagaattcgcatagcgatggaaactgcatgaccgtcgtattcagtaaagtaggcgcggtaagagatgtttttctttttgagatattgttcaatttgaggccagactttacggccattgttcccaccagccgtgggatttacgataataaagtattccattcctgaaaatgcccccgttacaataagtaataagctttaatatatgtaaaaaaagcttgagaatcgaatggttaaactatccgattctcaagcttcttgtcaattatagccccaaaggttgttttgaaatgtttagtgattaccgttcatgattaacattggcagaatcattggatgacgttcggttttatcgtataaaaactcttgtaagtcatcaataacagcatttcgaatagaagcctcagttgcttttttattatgcatagcttttctgattgtcttaaatacgcgtcttctaccttcgtcaagtagttcacctgactcacgcatatacacaaatccacgagaaagaatatcaggaccggattggatttcttgattgtgcaagttgattgttgcgacaacgactacaataccttcttcagaaagtaactgtctatctcgcaatacaatacttccaatatctccgatgccactaccgtcaatgtagacatcaccggcttggaagtgaccagctaatctggcagtgtctttagataatgccaagacatcaccattttgcatgataaaactatgatcaagtgggacaccacattgttcggcaagctctgtgtggatttttaacattcggtattcaccatgaatcggcataaagaacttgggcttcattaagcgaagcatcaacttctgttcttcttgaccaccatgtccggaagtatgaatgttattaactttaccgtgaataacattagcaccagcttcttcaagcttgttgataacatcattcacgctggttgtattacctggaattgggttacttgaaaaaataacggtgtctccaggttgaattgaaatctgtctgtgagtaccattagcaattcgtgaaagagctgccatgggttcaccctgagagccggtacataagatcattgttttattagcaggtaaggattgaagctgatttgcatcaacaaatgcgtcatcaggaatatccaaatatcctaattcacggccattaacaatggcagcatccatactccggccaaataccgcgatcttacgtccccgagccaatgcattatcacaggcagttttaattcgggaaatatttgatgcaaatgtcgcaaaaatgatccgatctttcacctgatcaaaaatatgggaaatggaaataccaacccatttttctgatttagtccaaaccggtttttcagcatttgtactgtcagacattagacaaaggacaccttcagcacctaactttgccatttcctgaagatcaggcggctgattagttaccggtgtgaggtcaaacttataatcaccggtttcgacaatgacacccactggcgtatgaactgcaacacctagtgtgtcaggaatcgaatgagttgttctgaagaatgaaacttttgtcttacgaaacttgatgacggatttatcactaatttcatgaagttctacagaatttagaaggccatgttcttctagtttgtttttgataagagccattgctaacggtccggcatagattgggacgttcaaaaccttcatcaggtatggaacgccaccgatatgatcttcatgcccatgtgtgataacaagtgccttaatcttatccttattgtcaactaaatatttgtagtccggaataacataatcaactccgagaagatcatcttcggggaatttgattccggcatcaattagaataatttcatcctgaaattggacgccataggtgttttttccaatttcaccaagtccgccaacgccatagatagctgcttcgttatttttgacgttcagctttttcatttattgttaaactccgttaatttgaaattcgaactgtcttgctcgtatttcaagtgttcaccttggagcggctccacgaattcgatagcataatcagtgttatcttctactaatccgcgagcttctacttctgtatcggcctcaagatacagagagagtgtcgtttcccgacgaggtgtttgctttttgtcgggttgatataaaaccttaaaaatcataaaaaaactcctttattcatgtactttttcgaaacgatcaggtttctttccgaacaagtggttgtgagaacacaactaatggagctattttaccataatctaaagaataagtatataaacatgatatcaaactctaaaggcgttctcatgttaaaattaatttagcaaagtgaaatggaagtgaaaagtagattgactatgatgcttatcattcaaatcgttatcggtttagttgcagcttttgccgtgtataatctgattcactacttatttgttacacgtccaagtcgaaagagactactttcagcacagagaacagttaacaaagcagttgccgaagtccttaaagctttaatttcggctgataagcttgctcctataaaggaggaagaattacactcagaaatgattgccaatatttgggggaggggtgtgatggcattcgaatatcatattccaatcgaccgggtaaagggctcgattccggatttaaaggaattgttgacaaagggattggatgagtatagccagaagaacgggattcatgcgcatggaaaaaagtcgtccgtttttgtagtaaccgatatctggcaattggatgaccgcttacactttgatgtcgcctatttgataaatttaaccacaattgaatatattgatgatctcaatcgactacattgataaataggttgattattaaatccggttttggttgagaggcacagctaaaatgatcttaagaagtcgtgattgtaaaataaagagattgggcaatgatttgctccaacctctttatttttttgttttgtaaatgtcaaaaaaccagcagccataacagcgtcgtttccgaattttcagatggctttaagcacatctaggtcgacgtgactgatgatgagttccagattcaaaagagtggacaggaccacgcgcactttgattgttgaaattatgtttcatattttttgaaatgctaaaaattacttacaaaaagtacactaatatagtgattcacaacaacattatcaatttcacgttttcaagcggacaagccctgaaagattgtacaagaattaaaatgatcgacgtgtcactttttactgttcaaacaacagatttagtaaatgaatacctcgtcatcatctcgtttaaagggattgtctttgttgatgtgatcataaaacaaaatgccgtgtaaatgatcgatttcatgttgacaaacaattgcagggtagttttttaaacgaatcttgtgttcattaccgtcaacatcctgatatttcaacgtaattcttgctgatcgagggacgtatccaggtacgtcacgatcaacggaaaggcagccctcaccctcagtcaatgcaccacgttgaacagaatttgaaacaatgacggggttaataataacgtccttgaaaagtggtttacctttttcattttcatcatcattcggaactaaaacagaggccatcattttagagacaccgacttgtggtgctgctaatccgactcccgcacgaagcttgtatttttcacatagttctgggttttgactgacttcaaggtattccattaaatcgtgtgccaattttttgtcatcggcagataatggaaatttaacttttttagcttcttgtcgtagaacgggatcgccatctcgaacaatatcatccattaaaaacaaatcaaagacctccgaatatttttatcactatttacattttatcttaatatctaaaaaaatactatgcgttaaattcataagttatttaggaaattgttaaaaaaatcggcataaaaggttgaatgagatatagatttatggcatagatgcaggggcatttattaaataaataaacatgtaacatttcacaatctttactcgcacaagcggtttcaaggtttatttgcaggaaaaaagtaagcaaacgaaaaaacccttttgaaagcaatgtaagggcttgcaaacggactgaaaaaatgctaaattttaagtgtggtttagaagtgatctatttgtgcatcacaagtctagctttacaggaaaggaaagtgttatctatggcagcaaagagtaagcatgttgttgattttgagaacatcaaatcgacgatgagcgatccatacaagaaacctgttcaagtaattgatgaaactggaaagatcgttaatcaggaattgttcgatcggttcagtgatgatgaactggttactttgatggaaaagatggtttgggaacgtgcattgcacgaacaaacaatgaacttttcgcgtcaaggtcgtttaggcttctatgctccaactttaggtgaggaagcttccgaaatgggaattgctcacgcaatgaagaaacaagactacctattcccagcatatcgtgatttaccacaattaatccaacacggtgcaaccgttaaagaaggattcttatggtctaaaggtcactatcaatgctatgactatgtacgacgtggtgttcgtgcatggattccacaaattatcattggcgctcagtacgttcaatgtgccggcgcagcattaggtattaaaaagaatgatgaaaaggacacagttgcctatgtatttacaggtgatggcggtacttcgcagggtgacttctatgaaggaatcaactttgcaagttctttccaagcaccggctgtcttctttgttcaaaataatggttgggcaatttcagttccacgaaagacacaaactgctgctgaaacactcgctcaaaagggtgttgcttcaggtgttccaggtgttcaagttgatggaatggatatcttggcaacttatcttgttgccaaggatgctcgtgactttgccgctgcaggcaatggccctgcattagttgaaaccttaacttatcgtttcggcgctcacagttctgctggtgatgatccaagtcgttatcgtactaaggaagaagaaaagccttggtttgatcgtgacccattaattcgattaagaaaagtattgactgacaagaaactttgggatcaagacaaagaagacaagttggtcgctcaatacaaggatcaattcaaacaggatatgaaagatgctgaagctgcacctaagcaaaaggtcagtgacttcttgaaacacacatttgaagtacctaccccagatgttgcagcccaaatcaaagaatttgaagcaaaggagtcgaagtaatcatggctaaattaacgtatattaaagcaattaccgatggacttgaccaagtattgcaagatgatccgaagacattgattttcggtgaagacgttggtaaaaacggtggtgttttcagaaccactgtcggccttcaagacaaatacggaactgaccgtgtcttcgatacaccattggctgaatcaggaattcttggattgtcaattggacttgcattaactggttggcgtccaatcccagaaattcaattcatgggattcacaatggaagctgttgattccattggcggtcaaatgtcacgtaacaggttccggatgtcaggcgatgtttcaatgccgatcacaatcagaacaccatttggtggtggtacccataccgctgaacttcatggtgactcgctggaaaatctctttgttggaatcccggggttacgggttgtaacacctgcaaatccttatgacgccaagggaatggttatttcagctgttgaaaataatgatccggtattgttcatggaaaacctgaaactttatcgttcaatgaaagatgaagttcctgacggtcactatacagttccgctagacaaggcgaaggttgcccgagaaggatctgacattacaatcgttgcttacagtgccgaagttaatgaagcattgaaagtagctgataaattagaaaaagagaatatttcagttgaagttattgatttacgttcattatcaccaatcgatactgaaacgatctttaattcaattgataagactcataaagtagttgttgctcaagaagcacaaaagatggccggtgttggcgctcaagttgcatcagcagttgccgaagacgacattatgtcacttgatgctcctattggtcgggtttctgctcctgatagcgtatttccatttgcaatggctgaaaatgattggcttccaaatgcagatgacatcgaagcaaaagtacgcgaaattttaaactactaaaattctaagtaagaaaggaagttagatcccatggcttataagtttaaactccctgagctaggagaaggaatggccgaaggcgaaattgcttcatggctggtcaaacctggcgataaagttaaagaggacgatccgttagtagagattcaaaacgataagtccgttcaagagttgccatctcctgttgccggaactgttaagagtatcgataagaatgaaggagacactgcagaagttggggatgtcctcatcacaattgatgacggttctcccgacacgcctgatgatgctgctcctgcacccgcaaaagaagaagctgcacctgcacctgaaccagctaaagaagctgcaccagcacctgccgcagcacctgctgccgctgctcctgcaccggctggtaatccgactccttctgatccaaataaattagttaaagcaatgccatctgttcgtcaatatgcacgtgacaaaggcgttgacattacggctgttccagcgactggtaatcacggacaggtcgttaaagctgatattgacagctttaatcctgccgcagcaccagcagctcaagcacctgctgcagaagctgcagctccaaaggctgccggtggcccaatcaaaccatacaagtctgcacaaccggatcttgagacccgtgaaccaatgtccatgatgagaaagatcattgctaaatcaatgagagaatctaaagatattgcacctcacgtaacctcattcgatgacgttgaggttagtgccttgatggctaaccgtaaaagatataaggaaatcgccaaggatcgcgatattcatttgacattcctgccatatatcgtgaaagccttagttgctgttatgaaacagtatcctgaatttaatgcttcaatcgacgatacgacccaagagattgtctataaacattactttaacgttggaattgcaaccaatactgatgatggattgtatgttccaaatattaagaatgcagacgccaaaggcatgttcgaaattgctaaggaaattaccgagaatactcaagctgcatacgacaacaagttgtctgcagataagatgagcggcggttcaattactattagtaatgtcggttcaattggtggtggctggttcacaccagttatcaaccaacctgaagttgcaattttaggtgttggcaaaattgccaaggaaccatatgttgatcccgaagacggcgaaatcaaagttggcaatatgctgaaactttcattgagctatgatcacagattgattgatggggcacttgctcaaaatgcgttgaacctaatgaacaagttgcttcatgatccagatatgcttttgatggaaggatgatcgaataatggctgaagttgaaaagaaagaaacggttattatcggagccggccctggcgggtatgtcgctgcaatccgtgcttccgaattagggcagaaagtgaccctgattgaaaagtccgatacactcggtggtgtttgtttaaacgttggttgtgtaccctccaaagcattgattcaagcaggtcatcggttccaagaagctaatgatgcctcaacttatggtattacgacacaacccgcaaccattgattttaaaaagactcaagattggaagcaaaagaaggtcgttgatcgaatgaccagcggtgttaagatgcttttgaagaagcacaaagttgatgttattcaaggcgaagcagttcttgatagtgatacgcaacttcgagtaatgccggttgggccacaacaattcatgagtgctgatactggattaacgattcagtttgataatttaattatcgctagtggttctcatccaattgaaattcctggatttaagtttgatggtcgagttgttgattcaaccggtggtctcaatcttccagaaattcctaaagaatttgtcgttattggtggcggttatgttggaacagagctggcaggtgcttatgccaacatgggttcacatgtgacaatcattgaaggtacaccgtcgatcttggctggattctcaaaggatatggtttcaattgttcagaaatcattgaagaagaagggcgttgatattattaccagcgcaactgccaagtcttcttctcaagatgctaacagtgttagtgtcacctacgaagcagacggcaaagaatcaacgattaaggctgattactgcatggttactgttggacgtaaaccaaatacggatgatttgggtcttgaatataccaaagttaaactcgatgatcgcggtatcgttcaaaccgatgatcagggccgaacagattcaccacacatctttgccattggggacatcgcatcagggcctgcactggctcataaggcattcttccaaggtaaagtagctgcgggcgcaatctccggtaagaacactgccaatgattacgttggcgttccaggtgtctgctttacggatccggaaatggccgttgttggcttgactcaatctcaagctaaggataaggacattgatgtatcaactgcaaagttcccatttgccggtaatgcacgtgcggtttcattggatgaagcggaaggatttgttcgtttgatctacacaaaggatgataaaaccattcttggtggtgaagtcgttggacctggcgcaagtgacttgatcgctgaactaagtcttgcagtgaatggtcgaatgaatgttgaagatatcgctttgacaattcatccacatccaacattgagtgagccgatccaagaagcagctgatgttgcattgggattcccaacacacatctaatttttacaataaattggatgctggtatattaaagtaagatggttaaaacgacctatcgtattttgacggtaggccgttttattgtacttaaaattaaaaagaaaagaatattagacatcattatcggcttttccatttcacaaagttttgaaataatctataattgtcattaaagaccgaattctttaaaacctaattcgtaatgaaataacgatcggagacgattttatgaacgatgactattcatatccattgattgatggtttaagcaacgatgaagtcattatactcgtgaccttttttcagaaggtcgaagaggcttatgaaaaacaaagtggcgttgatcgagagtcatttatgaatgcttatcaggattttgtgactgttgtaccgtcaaaaatggaacaaaagcaattagaaaagcaatttcaagaacgttccggatacaatgcatatcaagttattaggcaatctaaacaagatgtgaaaactttgaaaatgaatgaggcgtaaaatggaaataaatgagcttgaagaaattgataaaactgttaagggatggttaagagagtcccgggataatgttttaagaaacatcgacacccgtttaacagttagtaccaaaacaagtcgtcgtgacttggtaacgaatatcgataaacaaaatgaaaagtttattgtttccaaaattcgtgaattcgaaccacatgcaagaattcttggtgaggaggggttcggagataaggtagattcgacaaaaggtcgtgtttggattgttgatcctattgatggcactatgaactttgtgaagcagaggaatcattttgcaattatgatcgctttatataatgacgggattggtgaactggggtatattttagatgtgattggtaaccgactgttatctggtgggccaaaaatcggcgtgtttgataatggacaacccctcacgccggttgccgacacagctcttaaggacggcttgattggcttgagtggaccaatggtattaaataatgaatttaatatggtagatattgctgaaaaatcccttggaatgcgcatctatggtagtgccggaatcgatattatttccgtcctgcgcggtgagttggtgggttacatttcatacttgaagccttgggattttggtgccggcaaaattctttgcgaatcggccggattaaagatgacaactattgacgggaagcaattaggtatgttatcatcaacagcggtattattagcaacgcgaaacgcacatcgagacgttcttactatcgtcggtaagtaattagtcatactgtgacatgacagtggtcacagtttttttatgcgaatatattataactggatgtgcaacattcgagactgatttaaatgaagggaagcaaataatttggatacaaaacttaagacacgggatgacattcgaaatatcgcaatcattgctcacgttgaccacggtaagacaactttagttaacgaaatgttgaagcaatccgatactttggctgcacatactcaaatcgaagatcgggcacttgattcaaacgcaattgaaagagaacgtggtatcaccattctttcaaagaacacggctgttaaatatggggataagcagattaatattctggataccccgggacatgccgattttggtggtgaagttgaacgtattatgcgaatggttgacggtgttttacttgtcgtcgatgcatttgaaggtacaatgccacaaactcgttttgttttaaaaaaggctttggaacagcatttaacgcctatcgtagtcattaataaagttgaccgtgaaggcgcacgtccagaagaagttgttgatgaggtacttgatttatttatcgaattgggtgctgatgaggaacaacttgacttcccagtcatttatgtatcagctatgaacggaacttccagttatgattctgatatttcgacacaagagcatactatgaagcccgtttttgacacaatcattaaccgaattccagcaccaattgataattcggatgaaccacttcaattccaagtggctttgcttgattataatgatttcgttggccgaatcgggattggccgaatcttccgtggaaagatcaaggtcggtgataacgttaccgttatgaaacttgatggttcaaagaaaaacttccgagtaactaagttgatgggctttattggcctcaaaaaggttgatattaacgaagcaaaagccggagatttaattgctgtttctggaatggaagaaattaacgttggtgagacggttgtttcaccaagtacaccggaagctttaccaattcttcgaatcgatgcaccaactcttcaaatgacgtttggaacaaacacatcaccattctcaggtcaagatggcaagtttgtaacggcacgtcaattgggtgatcgtctaaaacgtgaactccacactgatgtttcgttgcgggttgaagatactgaccaacctggatcatgggttgtttcaggtcgtggtgagttgcatttgtcaattttgattgaaacacttcgtcgtgaaggttatgaactgcaagcttctcgtccagaagtaatttatcgagaaattgatggacagatgagtgaaccttttgaatctgttcagatcgatacaccagatgaatatacaggttcaattattgatacactttctcaacgtaaggctgaaatgcagaatatggaaacaaccgataatggtcaaacccgtttgacattcttggcaccgtcacgtggtttgattggttattcaactgaatttctgtcattaacccgtggttatggtattatgaaccatacttttgaaaagtacctccctgttattaagggatggaaccctggtcgtaagaagggaactttggtttcaatgaattctggcaaggcaacgacttatgccatgatgggtattgaaagccgtggcgaactgttaatcgatccaggtacagaagtgtatgaaggaatgattgttggccaaaataatcgtgaaaatgatattacggttaacattacaaagggaaagaacttaactaacgttcgtgccgctggttcagatgatatggcccgtattaagacaccaactcatctaacacttgaagaatcacttgaattcttaaacgaagatgaattgtgtgaagtcacaccgaactttattcgtcttcgtaagaagattcttaacaccaacacgcgtgaaaaagaagctaagagaagaaaacattcataaaatgacgatagtcgtttatttatgaatttaaaataatagtttaaaagggttgcgttgaaagtcattttgagcgcagccctttttgtaatgtcggaaggtatttgttctttgtttaaaatctacttatatctttaagaagaccacagttaccagattctaatatgctataattaaacccaatgtttgatgatatattttaaggaaaagtggagtggacttaatggctaaggttcgtttgagacatctggatttgtttatatttttgccatacatcatcctttgtgttttggggattatcatggtgtattctgccagtgcaaatattggcattcaaaatggtggcagtccaaaaagctatttgattaaacagattatttttgttgttattagtctggtcttggtttttggaacaacggcttttaatttaaaaaaaattcgtaataaaaagtttttacgttggctgggttattgctttattctggtcttaatcgggttattggcagttggtcaaaccgtcaatggtgctgctggctggattcatatcgggggaatcaatattcagcctgcggagttcgccaagttttacttgattattttagtagcagatgctgttgatcgagatgaaaatgagttaacaatttcgacttctcattggtggcaggctttaagacacccattattaattgtagcagttatgttaatacttatttttttccagcctgatgttggtggggcagcaatcaattttgcaattgtatttatcatgttgattgcaagcggcttttcatggaaacgaggtgtgacttatcttgtagggtttggaattgccgcctatgcgtttatgatggtcgtgctagttcctttatcagagagtggcaaaatccaaagctaccagttgagtcgaattactgcatttgtgaatccttttaagcacgcaaccggcgttggtcaacaacttgtcaattcgttttatgcgattagcaacggtggtttgtttggctccggattgggaaacagtattcaaaaaaccggatatttgccggaacccaatacagattttattatggcaattttgactgaagagcttggcgcgttggcgactgttgctgtaatggctattctagcattgattatttttaggacggtcctgattggtatccgctgcaatagcacctatcagagtctaatttgctatggtgtggcagcatatttaaccgttcaagcattgttcaatatgggtggtgtggttggtttgcttccaattacaggtgtaacttttccatttattagttatggtggttcaagtatgatgactttatcactgtgtattgggatcgttttgaatattagtggtcgacagagactagaacgaagtgattatcaagcagcaactaattaatagtataaaggagatgttgatttgccatttgaaattcaaccaacgattggcctgatcatttatctgcattcgttgaagtatgtccgcaatttacgaaactacggtcggctttactacgtttcaaagcgaatgaggtatgcgatcatttatgttgaaatggatgataaagaggaaacaattgccaaacttaagacgcttaactatgtgaaacaggttgtaccctctaagctgaatgaactggtaaaagaggtccagggtaaagacccaacagcgttagacaagcaatttgatgaagattttgatgattaatgaggaacaaaagaaatgagaattgtatcaggaaaatttggcggcattcggcttaatccggttaaaagcgataaaacgcgaccgacaaccgataaggtgaaagaatcgctttttaatataacggggccttacttcgatagtggctcttttttggatctgtttgctggctctggagctgttggtattgaggcagtttcaagaggcatggataaagccgttttagttgatcgacaatttcaagctattaaagcaattaaagagaacatcagcaaagtccatgctgaaggtcaatttgaagttattaaaggatccgctgaaaaagtaatggtctcactatcaaaaaagggtgagcagtttaatatggtttacttggaccccccatataaacagcagaaactgatcgaaacgttagtggcactgagcgatttcaatttactgattaatgatgcggtcgtgatttgtgaaacggataatcacaccgagttaccggatgtgttggatggatttaaagtcatgaaacaaaagaattatggtttaacgagtttgaaaatatatacttatcaaatggagaaaaaataaaaatggtagatgcactttatgcaggaagctttgatccgattacatttggtcatgttgacgtgattcaaagggctagcaatatatttgacaaggtctttgttgcgatcagtattaatactcacaaacacgctctttttacaccagaggaaagagccgattttgtgaaacaaatatttgctgataatgaacgagtcaatgtattagtttctgaagaattaacagttcatttggcaaagcgtttggggacttcagtattagttcgcggcgttcgtggtagtgccgatcttgattctgagatgtcgattgctggtttaaatagtggtttggcgccagatattcagaccgtgtttttgccaaccgccggtcaatatcgagacttatcttccagtatgattaaggaaattgcaaagtttcatggagaggtttcggcctttgttccaccagtggtgtctgaggcacttaaaaataaattttaatagaagagtgaagaaaagatgaagaagaagggaatcaaaaaatatgttctgggggtcattgcgacaattattgtattagcagtgatcttttggccattacccaactacattgaaggccctggaggtgcgtcagatctaagccaaattgtgtctataaaaaatcatcccgataaacggaaaggcatgtttatgttaacgtctgtcagtattgcccaagcacggccgctgacttatttatatgctaaaataagcccttattactcagtcgaatctgatgatagtgtgactgatggtcagaacatgaaggaatatgataaggttcaacatttttacatggaaagctcaattggggaagccatatatacggcatataaacacgctcatcaacaagttaaacggacctacaatggtatttacattctggacattgagaaaaattccaaattttatcaccagcttcaagttggagatattgtggttaagattgatggtcatcaatttaaaaattcagatggatttgtcaactatgttcgtaaacaaaaggttggccagaaattaacaattgagtatcgccgtggacaaaaaatgcataaagtcacaaaaccgttgattaaaatcgccaatcaccagccagggatcggtatcacacttaccgatgatgtaaaagtccatacaggcgttccgatcaaagtagatccgggccaggtaggggggccttccggcggtttaatgttttcacttcaaatatatagtcaattaaccaatcaagatttacggcacggaaaaaaagttgccggaacggggacgattgattcatacggcaatgttggtgaaattggtggcattgataaaaagattattgcggcaaaaaagaatggcgcaaaaatctttctggcaccttatattaagccaacaaagacaattttaaagtatgaacctgggcaccaaaccaactatcaacttgcaaaacaaacagcgcaaaaatatgcacctaaaatgaaagtgattccagtcaaaacttttgatcaagctgtttcagcattacaaaaacaatagatatattttttaaggattagaagacggctaatcctttttttcgtatctaatcaatgaagggaggaacagtatgaataggattcgcgagtttattgatgagtatctttatcaagtattaatcagtgcagccgtcatcattattattttggtggtgattgtgttttctttagttttggggcactcttcaaagccacaggtgcaagggatggtttcaacaacaagcgtcaatgaggcttcaacaacttcccaatcgaaaggcagtgatcccatagatacagctagtagcgtcccgcagagcagtagtcaacagctttacgttgatgttaaaggggcagtgaaaaatcctggcgtttatcaagttggtgcaaatatgcgggtagttgatgcaattgatttagctgggggatttaacaggtcggctgataagaagcaggttaatttagcacaaaaattaaccgaccaacaaatcgtctatattccgatcaaaggagaaattaaaggaaatcggtcgctgggggcaacaccaagtcagtcaccgtcagcagagacgtcatccacaaatccccaaacagcggcgacttcaaatgctgaaagttcaagcggttcttccactgaaggaacagaaaaaatcaatctaaatactgcggacaagtcaaaacttcaggaactaaacggaattggcgataaaaaagcagatcagattattgcttatcggcaagcgcacggtcagtttaaaagtattgaggaactaaaggatgttcccggttttggtgacaaaacgttcgataatttaaaatctacaatttgtgtgtagatcaaatcatcaaattgagatatgatttatttcatggaaggtgaaaaaatggataatcgaattaaatgggatcaatattttatgatgcaggcggtcttgcttgcgtccagaagtacgtgtgagcgcctttctgtcggtgcagttattgttcgtgacaagcgtattattgcggggggctataatggctctgttgctggggatgatcactgtatagatgtcgggtgttacttggtagacggtcactgtgttcgaacaattcatgcggaaatgaatgcaattttacaatgtgcaaagtttggggagtcaacggataatgctgaaatctacgtcactgattttccttgcctacaatgcactaaaatgttgttgcaggccggtatcaagcggattaattatttacgtaattatcataatgacgagtacgcacaaaagttgattagattaaagaacgttgaattaaataaaattaaactcactcattccgacatggacagagttccattcaattcctatttatctgactaattattggaaactggcttatttttcctgctgctgcgatgctttttctgagtattttattatttggaaatccactaatcggcagctttcttttgtcattattaatgattcgtttatgcctgcttaaaagtgtcaaatatacgacattgacggtggctctaagcgtggtatttttattctgggttgggttgacaactagccatgaaatagcgataacggataaaaatgttcaagagacaattaaagtttacccggatatgataaacgttgacggtgatcgttttaggacagttgctaagtcgccgacaatagcacgaaaggttatttattatgcccgttttgagtctttgagccaaaagcgggctatcataaattcgtccaaaccattacttctttcgattaagggtgaacgacggatgattagcccggcgaccaacatgaaccagtttgatatgcgggattactatcaacatcaaaagatttatgaaacgttttcgattggcaccataacaactatccatcctgttaataagttgtctttgattgatatcattcatatggttcgttttcaatttgatcggtactgtgatgggttacccaaaacattgcgtatttattcgatggggttgatcagtggcaatcgggaaaatgatttttttactgagatgactggtgcccaacaattagggctacttcatatattcagtatttcgggtatgcatgtctactattttttgaccattcttgatcaggttttaaccctattgggtataggcgaccgatttaaggcaattgttaaactatgctgtcttggcggctattttattttttcgggtgggtcaccaggcttattaagggcagtggttatggctggaattgtgatagttagccagttacttggctttaaaatgtctcagttatcagcacttagtttaacgttaatagtgaatcttttcctgttgcccgaagcaatgtttatgatgagcgttcagcttagttatggattagcatttggattgattgcttctagcaaaatgacgtatttgagacaaacggttttgttgaatttactgtcactgccaatcctgttatttcatttatatgaatggcatgttcttagtttggctgttaacttgatggttttaccactgtttggaagaacaatttttccactagtcatttttggccttcttttcggtctggtcagcagtaaattggccatacctgtggaatgggtattgatggcctttaatcgttcattaaatatggttggtcgattacccgggatgattgtgtttggtaaaccacagctagttgttgtgctattgatgttgggtctaacattgattgttatgatacattcgaaaaaaagggttaggggatataaggtcattttagctggcctttatttggtgacgtttatttggattcattttcccattcacggagaagtgtcaatgtttgatgtcggacagggagatagttttcttattaggacgccctttaatcaatcagtaacgatcattgatactggcggaaaagtgacttttaaccagcaacagtggcgacgggtaacggagaattaccaggcaaatcgtatctctatcaattatttaaaaagtataggcatttcaagaattgataatatttgtatcagccatcaggacgctgatcactgtggcgatttacctgcttttattaaagaactgaaaatcaaacgcattattataccgctcgggatggatcaaaacccaggttttgtgaaacgactatcaggcaaagatcctgcaacggttgttatgccggtaaatgatgaatttcgagtaggcggcttaccactcatcatttttcatccctatcaaccgggaaagggagaaaatcatgactcggaggttcttggtggtcgctttggcggcctcaattggctctttacgggtgacttggaccgccagggggaaatggataccctacaacggcatccgagccttagaacagatgttattaaggttggacaccatggaagccgtacatcatcggatccggcctttatttcacagatccagccaaaaattgctctaatttccgcgggccgacataaccgttatcaccatccaaatgaggaaacattaaccacattaaaaagggagcacatccgagttttaaatactcagaaatcaggtatggtaagatatgtatatcgaaacaataacggtttctttgaatcgatgttaggacataatgaagggaaaaacgaatgaatttttcacaactaatgacacagttaaaacaacataagcaagacgctgtttatctgattttaggtgaccaatcttatctttccgatcagattaaacaagcttttacctcgttaattcctgatgagcaacgagctatgaatattggcgtttatgatatggaagaaacgccagtttctagcgctgtagaagatgccatttcagttcccttttttggggaacaacgactggttatgattaatcgcccatactttttgacaggtttgcgtgttaaatcaaaagtggaacatcatgtggatgattttctggaatatttaaagcatccggaaagctcaacgattatggtcatttttgccccttatgataaattagattcacgaaaaaaaataacaaaatcacttaaaaaagttgcaaccaccgttgaaatcggaaaacttagggaaagcgaaatcaaatcgacggttaaacaaaggattgcggcagagggttataccattgatgaagatgcacttgaaagaatgatgcagcttactgccggtcaattaacgtcaatgatgaatgatttgccaaagttgtttttatataataaagacggcaaacaaataacattgtcatctgtcaatggccttgtgagtccatcaattgagcaaagtgtttttgatttggttaatagtgttttaaagaagaatgctaaagaatcaatggatatttatcgtaatttggttttggaaaatgaagcaccgattggtatcaatgctgttctcattcaacaatttagattgcttctacaagttatgatcttacaaaagcatgggtattctcaagggaatttggctgctagtttgaaggttcacccatatcgtgtcaaattagctctgcagacaatccgtcattttgattataagcaattacgcgatgcttatttaggattggtcgaaactgaaagggagatgaagtcttccaatcgctctcctgaacttttatttgaactatttcttttaaaattcatgcgacctgatgtcgcttagatcatcttcggtcttacggtggggttggcgccttgccttaaaaaaagtccgtctggcaacatttcaaatgaagtgttgccggacggactcttttaattaactgaaacttgaaagctaataatcacgccaaaggcgtgtggttattggcttttttggcaaaaaaataaacgcaagctctcctgcgttgtatactttagtcgaccaaaaccaagatacaaaggag

SEQ ID NO: 451 - DNA, 4996 bp, Unknown
  Metagenome-assembled genome
cggacagatttaaagtttgcgcggaacgcgccagctttaaatagtccggttcactcacccgaaaattaatttgtttgctagcctgacgatgaacctgagtcgtcttttttgtgctagccagattttgtggttcgttcacaagtcccacctccgttgccctacgggcaatgttattcgagatatcaaaagtcggatcagccgcaggctgactacctcctaatgataatcgaataacataggattggcaagcaacccgcatgctagccacaagactacgtttgtggcagctgcggtgcttgcaagggggacagctaacgctcccccttgacccccaagttcgctgcgcaatgccaaaatggttagccggttggctagccactttttggcaaagcttcgcgttttttactcaaaattgctatcggaatttgagtaaaaaagtcttccagacgggggctgtcagccgaatgattttgcatcatgagcatgccttcagcaggagcctttcaggcggagttttgcgcaaactgctgacgggtgatattactaggataattaggcatgataacttccttttttgcaaaagtatatcaaagtttaaaccagatctcaaacagtttctaagcgaaccaagcctcgaaaatatgacctctacgaggtgttctgcgctgtcctgtatgtcttgaaaagcggttgccaatggcgtaataactgtgagcgtaagctcaacactagtctcatgatggtgtttcattagtctttatcaggctacttcttaaaagatgctaaacagcttctaaatgaccgtcaaaggttaagccagttaaaactagtgttgcatttcttatgaaaccggctaatattaatgcttgttcaaattaaatttatattcttggaggattgtcgcaatggacaagaagctggaaaagatttcttttgcgggggcacttgttactttaggaattgtgtacggtgatattggcacttcaccattgtatgttatgaatgcattgattggtgacgccggtaaaatgggaaatatttctcccgattacgtgattggatcgatctcgttgattttttggacattaatgatcattacaacgttgaagtatgttgtcattgcaatgcaagccgataataagcgtgagggcggaatttttgctttatatgcattggttcgaaaaaattcaaaatggttaatttggccagccttgattggtggggcggccattttggccgatggaacattaactcctgcagtaactgtgacttcagccattgagggattaaaaaaacaacaccttggccctgtggtgtttagtaattctcaacataacgtcttgattatcacaacagttgttctactcgtattatttatgattcaacgttttggaacaggtgtgattgggaaatcctttggaccagtgatgattttatggtttggctttttggctgtctttggaatcgttaatctaatcaattatccaatgatattgaaggctatttctccctattatgcaattaagatactcttcagtccagttaataaagttggcatctttattcttgggagtgttttcctggcaacgactggtgctgaagcactgtactctgacatgggccacgttggccgaaagaatatttacgcaacttggccattggtttacggtgctttatttttaaactatttaggccaaggtgcctgggtgattaatcacgctcaggatgacgcttttaaacggatgtctgatattaatccattttatgaaatgttacctggtcactggcgattatttggaattgtcgtggcaactttggctgcaattattgcttcccaagccctgattaccggatcatacacgctggttgatgaagcgattgggcttaaatttttgccacggttggttgtcaagcatcccagcaatgtcaaaaatcaaatctatattgccaatgtcaattggatcttatgtgcggtcacgttgggcgttgtctggtactttcaaagttcgcaacacatggaagcagcttatggattagcgatcacggtaacgatgttgatgacaaccgtccttttatccgagttcttgacgaccaaattgaaccggccgctggcactaaccattgccaccttctttggtgccatcgagacaatttttctagttgccagtttggtgaagtttattcacggcggttatttaacccttttgattatgttggcaatcttatatgtgatgtgggtttggtactttggcaataagcgtcgcgaacactatgagcgggcaagtgagtacgtgtcattattggactatcgcgatcaactcgcggaactgagtgctgatgagcagatcccgttgtttacaaccaatctggtttatatgactaagattaagggtaactatcacatcaaacgcaacacaatgtattcaattttggataaagatcccaagcgggccaaagtctattggtttgtaacggttaacgaaaccaacgtgccatacgaaagtaactatacggttgatatgctgggcactaagaacattgtcaatgtgcagctttatctgggctttcgaaaagagcagagcgttggtgtttatttgcatcaaattgtggataatcttgttgaacaaggggtacttgaaccgcaagtgccaaaatactcaaccatgaagaatcgaaaagtgggtgggtttaagtttgttattattaacgaacagccggctgacctggtcgtgagtgatcaattaaaagccctcgacaaacgactaattggtgggcggatttatctgcagaacatcacggcttcacctgtcaaatggtacggccttgaatttagtaacgttgtcgaagaatcaacaccgctgtttattgctaggcgtaaggatgattatttggtacaacggggcattattcatgcggttggagaccgacagagcaaacatcatgaactttaattaaataatttgattattggaagtcagcttcttagatattacagatgatgaccagttattaactgattatattaacagtgcaaaggcgtatctaaacaacgcatgtaataacgatatgagttcagacgatagatataaatttattattgtcgagcttgcgacactttattatcaaaatcgtggaatattaacatcagtaaaagattttccgtatagcttgcgttgtgttatcaattagttaaaatgtaattaaaacctagttttgtaagtattccgttttacacactatatgaaaacgtcattcttaatcgggtgacgtttttttattgcaatttaaagaagataagctaaaatatagttgatcttctcttttctaaactgaatgagattattgtcgacaaagaatgtcactcatagctcgggtggcttttttgttgtatttaaaaattaatcagttagaatacagtcaagcctactttttatttgttcaggttacatcaattgcatatcgaaagcactgctcattaatttgggtggtgctttttttgtatctaataaaatatggattttatgacgtgatataaacgtattctcgtgcattgcttgtttatgccggtgaataattctattgtagaagtaatcaatatagactaatctagcactataaataaaattacacattataattagtgaagtaatggagtgaattaataaatggagactatttcaagcattgcaaaaagattacaggttacaaatgggcgtatttatcaaataatacgagaattaccaaaggataagcaaccaaagaaaaacgagcaaggcaagtataattttaatgaaataaatataaaggctattgtagaacattacaatagaaccggcatgaaacagaatgacaatctaaacaatgataatgaaattataaaacaattacgtgtagatttagaacaggctagaacagaattacagaccaaaaatcaacaaattgcaaaatttcaaaaattattagaccagcaacaacaattaaatttaagcagtcagaaattacttgaaaatcaaaagtcagaacaaaatatcaagaacggcaccacacaaagccgtgagaacgattctaaggacgacaaaaacaagccagatataaatataaacgagcaaaataaaaagccctctaataagacgagagagaacttttggaaacggctatttagataggttgtgtaaatattttcattgagttataattatgtcaattaaatacgagtacgaaaaaaaggcgttgatcgtggaagtcctgccataaacttctacaaccagctaacaagtgcacataccacttgaagccttttaacgccaatctttgttatttacttgaggtttcggaaatgcgtttcctacttctttaagtatatgaaaataattggattaatgcaagagtgatacataattgcaaagttaaaagggtttcaagttaaataacttgttacccttttttcttactcctaaaaggagatatgtaattatgtttatcaaagtagaaatggattacttcaaagattcaaatttaaagggtgcgaatgaaattctaacttattcgcttctttgtgatcgaatgaaggcaagtaagaataataaagatttctttgataagaagtttggcgatagttacattatttttaaacgtgaagaattagctgaatatttagacgtaactgttaagaccgttactaaaattttgaagagtttggtgaaaaagggttatctaattgtaaaacatcaatttaacgctgcttctaaattattcttaccaaagtttgagaatgaaaaaagtacttctatgcccgttaaggaagaaaataccccttcctttgggaaaaatttaccttctaaacaaagtattttaacagataaatatatacctgaataatctctacttttaaaatttgtatgatttggtccttttgagggccatcttttatcttttcagtcacttttgattgctgacaaaacttaactggtcactaaccgtcacattttgaggggtt

SEQ ID NO: 452 - DNA, 28096 bp, Unknown
  Metagenome-assembled genome
cagttcttcacatttttgccgaaacggttagtttcgctgttaacagcaagctaaatggttaaattaattaaaatatgccctgtgataccaagggatcagtctgtcttcatactttcaagtttcagttaattaataaaaaagttgttagcatgtaagtgactaacaactgaaaagttttatttaaataaacgagcagtaagacgtgacttgtcacgagctgctttattagctttaattaatccctttgacttagcatgatcaatggcactaattgcattgatgtaaaggtcctttacatcgtctgaaccactgagttgagctttttcaaaccgtttaacagctgttctgtaagtactcaattgagctgcgttacgtttttgggctttttcattagtttttactcgttcgatagctgacttgataattggcattggattcacctccgaaagatttcttggtaaaattattaaatttcaacaagcatcattatacaaaactgtaaggatgattgcaagtcgaacccaaatggaaacggaaagatttccttgtatttaatagataaattaggtatactgtcttttgtgtgttacacggaccttcgacttagtttaccggtaccactgccgttgactcagttgttggatcatttaaagaaaaggtggaaattaattatggcagttacacaatcagaaaaagacgcacttatcaaaaagtacgctcgtcacgatggcgatacaggttctgcagaggttcaaatcgctgttttgactgcagatattaatgaaatcaacattcatatgaagaatcaccgtaaagattatcattcacaacgtggtcttatgaagaagattggtcatcgtcgtaacttgttggcatacttgcgtaataaggatgttactcgttatcgtgaattaatcaagagcttaggattgcgtcgttaatatatcgacaatatcaagttttctttgataattgtaaaaagtcgcggacaaaacatttttgttttgtttgcggcttttttcggtttacaatggaaaaattcggttgttttggaaaaatatggtaaactaatagaagctgaatccgaacgtttaaaaaagaacgataaatattttttgaggtgaaacatgaaaaacgatataaaaattatggccattggtggtgtccgcgagaatggtaaaaacatgtacgcaattgacatcaacggcgggatttatattttagattgcggtcttaaatatcccgaaaacgaattactgggaattgatgtagttattcctgattttagttatttagaagaaaataaggatcgaattgttggtgtattcctgactcacggacatgctgatgcaattggcgcaatctcatactttttgagtgagtttgatgtacctgtatttggatcagaaatgacagttgagttagctaaattaaatgtggctgattctgaagagttaagcggttttgacgactttcacattgttagtgaacgttctgaaattgattttgatgatgtcaaagttactttctttaagacgacccattcaattccaggctctttaggtatagcacttcatacttcagatggtgcaattgtatataccggtgactttaagttcgatcaaacagccgccccaatgtatcaaaccaattattctgctctaacccgcttaggcgatgaaggtgttttggccttgcttagtgattctgggaatgctgaaaacccggcacccagcgcttcggaaaagaaaattggcgagtatatcacagaaacattccattatcatgatagtcggattattgttgctagtgttgcttcaaacatcttacgaatgcagcaagtctttaatgctgctgccgaaactggcagaagggtcttcttaactggtcacgacttggagcgaattgttaaaacagcactaagattgcacaatttgaaattaccagtggacgatttattgattgactccgtgaaggatgtcgataagatgaatcctgataaagtggttattatccaaacaggtaaaatgggtgagcctatcaaggcaattcaacgaatggctaataaagagcagggcgacattaacattgaacctaatgatttagtctttattacaactaccccctcgactgctatggaaacaacagttgccaaaacgcgtgacatggtttatcgagctgatggtgaagttgagatgatttctgatcaaatgaattcgtctggtgatgcaagccaaaccgatcttcagcttattatgaatttattaaagccgaagtttttaatccctgtttcaggtgaatatcgcttgttggaatcccacgcacaattagcaaaacaaattggttttacagatgatcgcatttttatccctgataagggagatattgtttctgttaataaagatgaaatgtggattagtgggagtgcgccaatttccgataccatgattgatggtattggcattggtgacattggtaacatcgttcttcgagatcgaaaagtgctttcggaagatggcatttttgttgctgtagtaacgattgatcgaaaaaagaagcggattgtttctcagcctaagttgacatcacgaggatttgtatacgttaaagcaaacaaggacttaatgaaggaagctgcgggaattattgagaagacagttcgcaataatcttgatcacaaagagtttgattggagtaatttaaagcaggatgttcgtgaaaccttaagcgattatttgtataagcaaacgaaacgtcgcccggttattcttcctgttattatggaagttaatcagcatcataaacgtactaataaaaagcattcaaagaacgctgccaaaagtacagctaaagaagaaaattaattttaatatctttataacaaataatcagaggttgggggacagaatgttatttttgttcccccagactctgatttgtttttaaaacacctttttgtaattagtaacggagggaatatgaataaattttccaaaaatgatcaggttatcttttggagtgctgaagaggaccttgatgatcaaaaattccatcaggtattgaacaaaacggagcatctagaggcaaagtatcctgacgaccttcgtattcacttactgatggcgcaagctctttttgctttgcatgagtctgctgatgcctatcgcattatctttgattatcgtgagcagcttttcgaggttcccaaatatttaccagctgtttttcatattgtgctagaaaataatggatttatgtttgccagagaattcttgccgaatgtgtcgtcaactcaaaggctgaaatggcttgccaagattgaaaatgcagaagaaaaatatcgagaaaaagacagaaatgacttgaataacaaaatgaaaaatttagcacacttgggatcattggatgcctataaacaggttcacggcattaatgatgcgctgaagatgccattgaaagagtatttgacagcagctaaattgcttctgtccgatccatttgggtggcaggtttccaaaacccaggttttgcttgaattaaatgcagttggaagtggggaaacgatcgatttaacttggattgataaaaatagctatcatcttcctctcaatgaactgaaaccgttaaccgcttatcatgtgcttattgatgcgttgagggaaatcgataaacaatatggagccgatgatcctattaagtttcagttactcgaaaaagaactctttacgcaaagcagttatatttatcctttctttgataaggttattcaagattctaagttctgggttaaaattatcgtagctgatttatttggcgatcacttagaggcaaacacaccggctcagcgagagatgctgggatggattaaacaaattcatcaagcagaaagcttcataaaattcgtttaatgaaaaatatttcgagaaaacgataataatctgtttacaaacaaattaagtaccgatataatacttaaggattcttcgaaattagactgctttgtcttttcaagaagatgtagtataatatcatttagaaatgcattgatgcgaattgatgtaattcttgaaaacaacaggaggtttcattaatggcaaaagaacattatgaaagaacaaaaccccatgtaaatattggtactattggccatattgatcatgggaaaactactttgactgctgcaatcacaaaggtattggcttctaaaggtcttgcaaaggctgaagactatgctgatatcgatgcagccccagaggaacgtgaacgtggtattacgatcaacactgctcacgttgagtacgaaactgaaaagcgtcactatgcgcatattgatgccccaggacatgctgactacatcaagaacatgatcactggtgccgctcaaatggatggtgccatcttggttgttgctgcaactgatggtcctatgccacaaactcgtgagcatatcttgcttgcccaccaagttggtgttgattacatcgttgtcttcttaaacaagactgatttagttgacgatgacgaattaattgatttggttgaaatggaagttcgtgaattactttctgaatacgattatcctggtgatgacattcctgttgtccgtggatccgctcttaaggctcttgaaggcgacaaggaacaagaacaagttatccttgacttaatggatatcgttgatgaatatattccaactccagaacgtgatgacagcaagccattcttgatgcctgttgaagacgtatttacgatcactggtcgtggtactgttgcttcaggacgtattgaccgtggtgttgttaagattggtgacgaagttgaaatcgttggtttgaacgatgctcctttgaagtcaactgttactggtttggaaatgttccgtaagacacttgatgaaggtcaagccggcgataacgttggtgttcttcttcgtggtatcgatcgcgaccaagttgttcgtggacaagttcttgccgcacctggttcaattcaaactcacaagaagtttgaaggccaagtatatatcttgactaaagaagaaggtggccgtcatacgccattcttctcaaactaccgaccacaattctacttccatactaccgatgttaccggtgttattgaactagaaaagggcgttgaaatggttatgcctggtgataacgttacattcaatgttgaattaactaagccagttgccattgaaaaaggtactaagtttaccatccgtgaaggtggccatactgttggtgccggtattgttagtgacgttaaagactaatttcgctaattaatattgaaaagctgtgaggagtgatccttgcagcttttttatttatcatatcaatttgtctactttaaattcatttagcattttacattttgttattaatacgttaaaataacaatgttatgcaattatgaattgtaaaaaaatatgtttgtcgtctcggaggaaaaaagatgtctgcaaaatgggaaaagaagggtaccaacgatggtgaattaactttcgaaattggtactgattctatcaaaagcggtttagaccgtgcatttaagaaaaacaaaaacagtattcgggttcctggattccgtaaaggaaaagtacctcgtgccatttttaaccaaatgtatggcgaggaagcattgtatgaggatgctttaaacattctattgccagacgaatattcaaaggctgttgacgaagcaaaaattgagccagttgaccaaccaaagattgacgttgaatcaatggaaaagggcaaaccatgggttattaaggctaatgtgacagttaagccggaagtaaaacttggtaactaccaaggattaagtgtaccaaagcaaaatacccgagtttaccaaaaggatattgacgcagaacttgaaaagaaacgtcaaaacgaagcagaactagttcttaaagaaggtaaagctgctgaaaaaggcgatacggttgtgatcgactttgacggaactgttgatggcaagccatttgatggtggcagtgctaaaaaccattccttggaacttggatcaaattcgtttattccaggctttgaagaccaattagttggccataaagctggtgatgaagttgacgttaaggtaacattccctgatgattatcaagcaaaggatcttcaaggtaaagacgcgatctttaagactactattcacgaagtaaaaacaaaggaattgcctaaattagacgacgattttgctaaagatgtcgatgaagacgtagattcacttgatgagttaaaagaaaagattaaagacgatcttaagactcaaaagaaaaatgaagctcgtgaagcaattgaagatgctgctattaaccaagctgttgacaattcagaagttaaggatatcccacaagccatgcttgatgaagatattcaacgacaaatggatcaataccttgcaggtatgcaacaacaagggattaatcagcagatgtatttccaattgactggtacaaagccggaagatttgaagaaacaattttctgatggtgctgagcgtcgtgttaagaccaatcttgttctggaagcaattgtggatgcagaaaagattaatccaaccgaggatgatctcaaagctgaagtgaaggatcttgcctcacaatatggcatgaaagaagacgctgttcgcagtgctttgactgatgacatgctcaagcatgatattggtatcaagaaggctattgacttgatcgttgattcttcgaaacaggatgctaaagctaaagaagaaaaatctgatacagataaaaaagatagttcggaaaagtaaacgtcttttctttaaaagatccgttttaataacgggtctttttttgaagtgaacccttctaattgcaatttgactattatatgttaaagttacgtatagttggagagtgaatagggctaatttttactgtggtcggttttattcttggtctccattgtttgaccagaattaacttccaactctaatggaggagtgaatatattgttcgaagataacgaatcaaatggaccaattacctgttctttttgtggtaaaactcaagatcaggtaaaaaagattgttgctggtccaggcgtttacatttgtaatgaatgtatcgatttgtgtaaagagatcattgatgaagaactagcaccagagaaaacttcagaagatttattgaaggtgttgacacctgcacaaatcttggacaaactaaatgagtttgtgattggccaaggaaacgccaaacgtactttggctgtagccgtttataatcattataagcgggtaaatgaaatgattagcgatccaaatgatgacttggaattacagaagagtaacatttgtgtcatcggaccaacgggttctggtaaaacctatttagcccagacactagctaaaattttaaatgtcccatttgcaattgccgatgcaacgactttgacggaagccggttatgttggtgaggatgttgaaaacattcttttgaaattattgcaaaatgcagactatgatgttgataaagctgaaaagggcattatttacatcgatgaaattgataagattgcaaagaaatcggagaacgtatcaattacacgagatgtttccggtgagggtgttcaacaagcattattaaaaattcttgaaggcacgattgcaaatgtaccgcctcagggtggtcgtaagcatccgcaacaagaattcattcaaattgatacaaccaacattttgttcattgttggtggtgcgtttgatgggattgaaggaattgttaagagccgacttggtgataaaacaattgggttcggcacagattctgatgaagctaaatatgtcaattcaaagaatattatgcagtcagttattccagaggatatgttgaaatttgggttaattcctgaatttattggccgactcccaatcctgacagctttagataagttggatgaacatgatttggttagaattttaactgaaccaaaaaatgcacttgttaagcaatatcaaaaattgattgagctagatggtgccgaacttgaatttcaaccagctgctttgcaaaagatggcacaacttgcgatttctcgaaatacaggtgcccgtgggctccgttcaattatcgaagatgttatgcgtgatattatgtttgatttaccaagcagaaacgatgtttctaaggtgattattacaccagaaaccgttacaaatcatacagagccgcaacttgttctgaaaaaggcatcgtaattaaagggggtctgatgtaaactttaatcagtttaccgtcaggctctttttttgtctaaaatgagattttgcattatttgaaaggaaaggaacggtgatctaatggacgtacaaaacgtcgatttaacgattagtgcagtggaggcaaagcagtacccgaatacgcggtttccagaaattgcatttgtcggacgctccaatgttgggaaatcttctttaacaaatgtgttaattaatcgaaaaggatatgcacgaacttccagtcagccggggaagacgcagacacttaatttttacaatatcgaggataaacttttcttcgttgacgtgccaggatatggttatgctaaaacgtcgaaggctaatcgtgaaaaatggggtaaaatgattgagaagtatttaacggaaagagaacaattgcgaggggtcattacactggttgatggtcgtcatgcgccaaccaatgacgatgtatccatgcatgaatggttgaaatactacggtattgaaattctgacagtggccaccaagatggataagattgccaaaggcaaatggaacaaacaagagtccttgattcgaaaaacacttaatttggatgccaatgaaaaactgatttctttttctgcattaaccaaacaaggaaagacagaaatctggcaatggattgaagggagaatgcatcaatgaattttgatgattatcaaatggctgccaatcgtactttgatggggaaagagcaggtccttactaactgtgttttggggctaacaggggaatcaggtgaagttgctgaccttgtccgaaaatatacttttcaaagtacaaaattagataaaggccaactgacaaaagaattgggagatgttttgtggtatctctcgcaaattgctgaatgggctgatattccttttgaccaaattgcttctgagaatattaagcgattgaagcaacgctacccgtcatcaaagggtggcctgaatcaagttaatctgtaataattataaataaaaaaataagatgctttaaataagtagattaggtcagcctgtattttgacctaatctacttgtttttgtttacaaagaatttcggttgttatgtgattaaattcttatcgttttctaagtaagcgtctgatttgaaaaggttatcagtgtacaagatacgcgccaaaatgcatattaaacttaatatttagaaaaataatgaataaaacgcaaaaatggttgcaattaatgaatatcggtgttaacctcattactaattgataattaagaaattcgaggtatttataaatgacagaaaataaaaaagtaattttagcttattcaggtggtctggacacatccgttgctattccttggttaaacgataaaggttacgacgttgtcgcttgttgtataaatgttggtgaaggtaaggatcttaactttattaagcaaaaggcacttaatgttggggctgtcgaagcatatgttatcgatgctttggacgacttcgcagaccattatgcgtctgttgcgttaaaggctaatgcaatgtatgaaggggcttatccgttgatttcagcattgtcacgtccacttatttcaaaggcattggttgaccttgctcatcaagaacatgcccaagcagttgctcatggctgtactggtaaggggaatgatcaagtacgttttgaagttgcaattcacagtttggatccacagcttgaggttctaagcccggtacgtgactggcactggtctcgtgaacaggaaattgaatatgcaaagaaacataatattccaattccaattgatttggattcaccatattcaattgatgcaaatatttggggacgggccaatgaagccggtgtcttggaggatccatggcatagtgcgccggaagatgcgtttgccattacaaatgcattggaggatacacctgacaaacccgcagttgttgatttaacctttgttaagggacttccaactgagctaaatggtcaaccgatgaaattctcagaaattatccagcaattaaatactattgctggcgagcatggaatcggccgaatcgaccacattgaaaatcgtttggtgggtatcaagtctcgcgaggtttatgaagccccggccgcaactgttcttcttaaagcacataaagagcttgaagatctaactttcgaacgtgacttggctcattttaaaccaacggtagagaaacaattgagcgagctggtctataatgcactttggttctctcctttgatggatgctttaaatgcctttattgacaagtcacaagaagtcgttagcggtgttattaaagcacaattatttaaaggaaatgtcacaattctcggtcgtaaatcgggttcctcactttacgacaaggacttggcaacttatacggcatcagattcatttgatcaagaagctgccaaaggattcattaagctttggggccttccaacacaggtttattcacaagttcaacttaaaaataagcagtcccaatttgtaaaagcagtcactgagtcacacgccgaagacaaggttactattcaaggaaattactcttctcaaatgggagcaaagaaataatgagtacaaagaagctttggggtggtcgttttcaggagcaggcatcaaaatgggttgatgagttcggtgcatcgatttcgtttgatcaacaaatggctgatgaagatatcgaagggtcattggctcatgtcaagatgttgacttatacaaaaattcttaatagtaaagatgtggatcaaatcgtggctggtctggaagaacttcgacaggagttacacgaaggtaagctcacctttacagttgagaatgaagatattcatatgaatattgaggcactcttaactgagaaaattgggccggttgccggaaagctccatacggctcgttcacgaaatgatcaagtagcgacggattttcatttatatgtcaaaaatcgtttaccaaggatcatcgatgaaattacaacgcttcaaaaaacgctggtatcaatggcggcacaaaacgttgaaacaattatgccagggtacacgcatcttcaacacgcacaaccaatttcttacggtcattatttaatggcttattatcaaatgctgaagcgggataaagaacgctttgaatttaacatgaagcatacggatatgatgcctttaggagcggctgcattggctggtacgacttttccgatcgatcgggaatacacagctaaagagcttggattcggacaagtatatgcaaattctctggacgctgtttctgatcgagattttgcattggagtttttaagtaatagttcgattttgatgcttcatttatcacgtttttgtgaagaaatcagtatgtgggtaagccacgaatttaagtatcttgagttgagtgatgcctatacaaccggtagctcaatcatgccgcaaaagaagaatcctgatatggcagaacttattcgtggaaagagtggccgtgtgtatgggcatttaatgggactgttagccactatgaagtcattgccacttgcgtacaataaagacctccaagaagacaaagagggtgtctttgatacggttaagacgctcctgccttcattaaaggtctttaacgggatgcttaagactgccaaaccaaacgttgaacgtatgaagcatgcgactgaaaatgatttttcaaatgctactgaattagctgactatcttgctgccaagggtgtaccgtttcgtgaagcccacggtattgtggggcagttagtgcttaaggggcttcaaacgcacaaaaaccttcaagatatgtcgcttgaagagttgaaagaagcatcccctaaaattgaagcagatgtttaccatgaccttaagtcagaggtggctgtagagcgtcgccattcgttaggtggaaccggttttgaccaagtaagaatccaaattaaaaatgccaagcaggaattaagcgattcgtagattagaaaacctctgctggtttgttttaatagggtctttcaaaaattaactattgggtcacattatcattaatgcagaataaaaaaacgactgatgacaatagtggaaaattgtcatcagtcgtttttataatgaagtggataatcgatgaatcctctaatggataaaggatattactttttttctggtcgtttctcgtttttctgcttcttatctttatcgtttttcttatgcttcaaaaacttgtcccgcttatcatcgtcgagattcatttcagcaaatttgccgaagatggcgtccaggtcgtcctgtcgattaatcttgagtgccatttagttcatctccttatctcttttcgtgataatcatatcaaaattaaacaggaaagtcacttttattggttaattttgcatatatgcattatatcgaacataatatgaataaaaacgactaattttcaatttttattgcataaacaataaaaatgaggtagtatattctgtattatctgtttgagagagggaaagttgatgaaaaagcttaaagcaattattcaaatgatgctcgtttttgtgaccttactgactgttagtgccattcagactaatagtgcgtcggctgcggacaattcacttcaaagagttaagcaaagaggcgaattgattatggtaaccagtccggattatccaccctatgaattccaagtgaataagggcggcaaaagccgaattgttggaatggatattgacgttgccaaaaaagtggctaaagatttaggcgtaaaattagtcattaaaagtatgaattttgattcactgttagtggcaatccaaaccggaaaagccgatatggccattggtgggattaatccaaccaatgagcgtcgtcaaagtgttgatttttcggacatttattattcgggaggtcaaagcttcctgattaattcaaaagatgtaaataaatataaaagcgtgaagaacttgcgtggtggtaaaattggtgcccaaacaggaacgttacagtatggtttggcaaagaaacggattcccggagctacagttaaaggaatggataaatccaccgatttggttttggcacttaagactaacaaaattgatgctttgggaattgaaaagccaagtgcagaagcttatgtcaaaaatgatccaagtcttaagatgattccttctggatatcacctcaataaaaatgatattggcgctgcaattgcctttaaaaagggctctacaagtttggtgaatgccgttaataagagtattgtccagatcaaaaagaaacatttaacagacaaatacttagctagcgcagggaagtatatgaaagttaacaccgttaatacatcaatgtttcattactggaagtattttgccagtggtgttgagtacacaatcctgatttcgttagtttcaacattctttggtgttttgatcggagtagttttagctttaatgcgtttcagcagacagaggtggttgcgcgggcttgcaatcagctacactgaatttattcgaggaacgcctttgatggttcaagtgatgtttgtctatttcggaattggcgtgatcattaatattccggctttgatttcaggaatgattgccgtttcgctgaatagtggtgcttatgttgccgaaatcattcgaggtggcattaattctgttggtaaaggtcaaacagaagcagcggaaagtttgggattaactaaaggtgatatgatgcgatacgtcattttacctcaagcgtttaaaaatatttggccggcattggggaatgaatttatttcgctcattaaggaaagttcaatcgtctccattatcggggttaccgatcttatttatcaattgaatattgtccgtgccgacacgtatcgtggtgttatgccgatattcgtagcgatggtcctttacttcctaatgacattcttattaacaagattattgaatcactacgaagggaagatgaaacatgcaggataaagctgtaattgaagttaatcatttaaataaaaaatttggtgaaaatacgattttaaaagatattaatggtacagtgaaatccggtcaggtgatttgtgtgatcggtccttccggtgccggtaaaagtacttttttacgttgcctgaatctccttgaaaagcccacttccggagaggttaaatttgatggtacggatttaacccatgttgatggtaagcagttgttggatttacgtgaacgaatgggaatggtttttcagagctttaatttattccctaatatgacggtgctgaaaaatttgatgttagcaccgatgcgagtgaagcatatgacggaggatgaagctaaaaagacggccatgcatttgttagaccgagttggactgcagtctaaagcggaagcttatccaagcagcctatcgggtggtcagcagcagcgtgttgcgattgcacgggcgttggcaatgaaccctgaagtgatgcttttcgatgaaccgaccagtgcattggatcctgaaatggttggtgaggttctggaagtcatgcaggaattggctaatgaagggatgacaatggtggttgttactcatgaaatgggatttgctaaatctgttgccaatcaagtatggtttatggcagatggctatattctggaaaaaagttcccctagcgaaatgtttgataatccacaaaatgagcgggccaaagattttattggtaaaattattgaagctaaatagcttttttcgcgatcaagtcgttttattaatggacaaacaataaagtaatgtgattgttacatttgaatatgaaagccgcatcacttttgatatcggagtggtgcggctttttcaatcaacatggttgtgatatgattccttttgagagtgacaggattcggtatttaataattgaagcaaacgtacattcgagttatactcttatgttgagtattaagaaaggagtggacattttttggcaagcgagtatttagaacataaattatctttattaccaggacttccgggatgttatctgatgaaggatatcaacggtaaaattatttatgttgggaaagctaaaaatttaaaaaatcgtgttcgctcatattttaagagtagtcatgaaggcaaaactgcaagactggtttcagaaattgctgattttgaaacaattattacttcaactgataaagaagcgtttttactagaaattacactcattcaaaagcatcgtccttatttcaacattaaactcaagcaggggcacagcggttatccatatatcaagattaccaatgaacgtgatcctcaaattaaaattgttaatacgcttttaaaagatggcgcttattattttggcccttatccaaatgtctatgctgcggaggagacggttaactttttgcagaaggtttatccgcttcgacgctgcaacggattccaaaatagaccatgtctttattatcacatgggccaatgcctcggtgcttgttttaaagtagtcccagaggaagtatatgatcgtcaaattaagcgaattaagtcgtttctgaatggcaatgtcggccatgctaaacaaatgttggctaaacgaatggaagatgcttcggcgaatatggcctatgaacgggcggctgaaatccgggatttaattaagtatattgagataacagttgaaaagcagaaaattatttcgcatgacaatacacctagagatatctttaattattatatgaataaaggatggctatccattcaagtattctttatccgtcaatcccgattaatgaaacgcgaaaagcgccttttcccaattattactgatccggaagaagaaatggtcagttttatttcacaattctataaacaaaaaaatcaaattctgcctaaagagatcctggtgcccagctccctgccttccgatgttgttagctcggttgttgatgatgttccggtaagaacgcccaaacgtggacaaaaacgtgatttgttggaaatggccgggaaaaatgcgcagcttgttctggaagaaaagtttcggttgctggaattggatgagagcaagacgaccggtgcgatgaaggaattaacagatgcgatggggattccagaaggtcacaaggttgaagcttttgatcattctcacattcagggtgcggatttggtatcagcaatggtcgttttcgttgacggtcaacccaataaaaatttatatcgaaaatataaattgaagactgttgaccacgccgacgaagcagccagtaccagagaagtcattcggcgacgttatacccgactgttaaaagaacatgctcaaatgcccgacttgatattaatggatggcggtacgattcaaatgaatgcggtaaaagatgttttggttaatgaacttgggttagatattccagttggcgggatggttaaaaacgagcatcaccaaacggccgacttgttatttggcgatagtgatacgccacttcatttagatcccaagagtcaaggattctacctccttcagcgaattcaagatgaagtccaccgctttgcaattacctatcatcgcaaggtacatgctaaaaattctttgggttcccgattggactcaattgccggagtgggaccaaaaaccagaaataaacttttgcgaaagtttggatctttaaagaaaatttccgaagcacctgttgatgatttgaaggctttgggaatttcagaaacggttgctcagaccattaagttttcattgagcaaaattgatgcagaaagaaaagtcgttaattatcaagataaaaaattaattaattgattcgttatcttttaatcttttgttcttttttgcggattcctttgaccttctgatataaactcggtatacttcaaaaggtaacaactgtatgggttaaagttaagaattaatttgaaatggtgataagatgtttgttgatcaagtaaaaattgatgtacaagccggaaatggcggcaatggtattgttgcgtttcggcgtgaaaaatttgttcctaatggtggcccggcaggcggcgacggtggtcgaggcggaagtatcatatttaaagttgattcagggatgaatactttgatggatttccgctaccatcgtaagtttaaagctaaaaatggcggcgatggcggtaacaagtcgatgacaggtaaaagtgccgataatttaattgtgcccgtaccggaaggaaccaccgtaaccgatacaactacaggtgaggttattggtgaccttttgaaaccggatcaggaattaacagtcgctaagggcggtcgtggtggtcgtggtaatatccattttgcaagtgcgacaaatccggcgcctgaaattgctgaaaatggtgaacccggtcaaacagtttctttgagtttagagttacgggtactggctgacgttggcttggttggattcccatccgctggaaagtcaacgttactttcagtcattaccagtgcgaaaccaaaaattgctggatatcattttaccactctggtacccaaccttggaatggttagattggatgatggcagagactttgctgttgctgatttaccaggcttagtggagggtgcctcgaaaggtgttgggctcggttttcagttcttacgacacgttgagagaactcgggtcattttacaccttgttgatatgtccggtgttgaaggcagagatccttatgatgattatttggcaatcaataaagaattagttgaatatgatccggatatcttaaaacggccgcaaattgtagtcgcaactaagatggatttgccaaatgccaaagataatttacagatttttaaggataaattgacatcaggtcattccgtggatacagagttgcctgaagttttggctatatcatcagtaacgcatgccggtttatcggaactgattaataaaaccgccgctcttctggatcagactcgcttacaagcacaggaacagcccgagacagaaagtaacaccaaggaatacgattttgataaaactgattctccggcctttaagatatcctttgataaagaaattgattcttgggttatttccggagataaaattgaaaaactgttcaagatgactgatactgaacatgatcagagtatgttgagattcgcacgccaaatgaggggtatgggaattgatagtgcacttgagaaagccggtgctaaggatggagacacagtcactatcctcgacttctcattcacttatgtagcttaaagtaatttaattaagacagggaagatttttaatgcaacaggttcgctcacaacaaactgggaaaagacttaagaagagtcgatatataacaggttttgatggcattcgtgcactggccgtggttggggtaattgtttatcatttattgccgtataacctccaaggtggttatcttggtgtgccgacgttcttcgttgtatcgggttatttgattacggatttattgttacaagagtgggagcaaaatggcaaaattgatttttggggattttattcccggagattaaaacggttatatcctgctttagtatttatgctggtgggaaccggcacgtacataaccctttttgaacgatcgcttttgactaatttaaggtcgattattactactaatatgctgtatttatataattggtgggaagtcggtcatggacaaagttattttgacaggttcaacggagaatcaccatttacccatttatggtcattatcaatcgaagggcagtattatctgatctggccgttgattttaattgccatgattttaatcattagaagaaaaaaggtaatcgcttatattttacttgctttggcggctatatcgggactgttaatgggcgttctatacactggtccggatgcactgaaccgtgtttattatgggactgatacgcgaatgttttcaattgtatttggcgctctactcgcgattatctggccatctactcatttgcggaagaatatttctggaggatccagatggacgttaaatgtcattggaatcctttcgattggtgtaatggcagtgatgttctttaaacttgccgggcaaaatacgtttacctatcgcggtggcatgtttattatggcggttgtttctacaacgttggttgctgcatgtgcacatccgggggccgatatcaatcggtggttaaccaacccggtatttgcatggattggtactcgcagttatggtatttatctctatcagtttccggtaatgattttttacgagatgaaaattcaggatatcgcagatcatccgattttaaatgcgttaattgaagtggtactcattatggtgattagtgagctatcgtatcgttatattgaaaagccacttcgtcactatcattataagcagcttggccgttcaattactgagtttgtcaaaccaaattcacagtttggacttaaacgattgtggatgctgcccgcgttagggttaattggtatttgtttatacggaagcgcgattgcaccaaccaaggctcaaaaaaacatacttcaagaaaatattttgaagaaccaaagtaaggcaaacgcccataacaaagttgcattggcaaagcaaaaaaaggctaaaaaactagctgagaataaacgcaaaatgcacgctttaatgaccaaaaagttaacccgtaaacaatatttgattgctaaaaaatatcgtttaagcaaagcacaatatttagttgcctcacatcaaccgttgacggctgttggagattcgattatggcagataatagtcatgatttgcaaacggtttttaaacaagcatatgtttctgccaaggttggccgacaaatttggcaagcaggggacgtgttaactgctcttaaaaagaggggggagctggcacctaacgttttaatcaatttgggaactaattcaccaatgacatctgctcaaatcgccaaagttgtcaagacgattggtaagggacatcggatcttctgggtcaatacccatgttcctacaagaaattgggaaacagaagtcaacgctacgcttggcatggctgctaaaaaatataaaaacttttatgttattgattggcatagttatagtgttaatcgttcagattggttctggcaggacaatgttcatccaaatccacaagggaatattcattacacacatcttgtggcaaaagaaattgcacatcagttaatgccggcgagctgagtttgactattttacaagcaggttgatgtacacacattcaatcagtttattgttgtaatcaaaagaggtacgatcaaaaagttgatttttgatcgtacctctttttgtatggcctgttcacataattaaagtgatcacaactcaacatgactcatgggactactgtggggcatgattgatcattaggaaagtgtcacttgtaaagcatgagaaggagctgaagcaattttagttcctttagtatcaaatattggcccaaaattgatggctaaatttgatgctggatctttatcgtaatgataaagataaccgttcatcacgaattggcgggattttcccgcaggaatttgactacctgccgaagaatccgttagttggttggatgtttgaagcgtctgtccctgattagttttaacagaagatacgccatttaaagcgattgtctgctgctgttggttggtaacctcataattaatgacaaatgtatagtaagtatcaggaacactagacagattgagtacttgagaagctgcttgctttgcggcactggtttttgccgagttctttaatactcgtacgtttagtatacggtaagtcactttatcactgttgaatgttgatgaaggcgtggctttttttgccagttgctgctttgtaccaaagcgatcataactaaattgatgtttattggttaaatgaccgtcggctacataatctctgttctgcttttcactttttggaactttatatttataatgggtgagactgctgttcgtactgcttgattctgaagctgaactatcgtcgttagccattttcgcactcatagctgctttttctttgttttgatgttggttgctttgcttatttccatgacaaccagctagtcctaaaataagaattgttcctaacgccagtgatacttgatattttttcattttttcgacccctagtaaaaaacaattgatttattaacaattctaaacccaaatacaagctggtggttatttgacgttcgtaaatttgtttgtgcaggcaacagtctggttcgagtcataaattggtctaaagtaatagtagcagtgccgctttgggattttgacgctgatcctaagaaaagcacatgatcatctctggttaattggttgatggggataaagtgttcacctttagaaatgagtagtgtcaactttgaatccaaggtggcgcttgcccggtaaaattcatcaagattcatctgcttcatcttccttactaatgattattttacctaaattatgatacaattgaaattgcttttcagtggcgtgtacaaaaccactgatcgattataagagttaaggaaacgataaatgatgcaaattgaatttttaggaaccggagctggatctccgggaaagtttcgaaatgtttcaagtttagcacttaggttactggatgaaattaattcagtttggttatttgatgttggggagggaactcaacatcaaattttacgttcaacgattagacctcgaaaaatcgacaaaatttttattagtcatctccatggtgatcatatctttggcttacctggattactgagcagccgttcatttcaaggaggctttgagccgcttgacatatatggcccaaagggaattaaggagtacgtcgaagtaagcttaaaaatttcagaaagtcatttatcttataaaattcgattccatgaactgacgaagcaaacgaatggactcatttttgaagataacaaattttctgtctacgctgcaccccttgaccaccggattttaagtattggatatcgagttgtggagcatgatcatccgggcgaattgatggttgataaattgactcaacttcatattccatcaggccctgtgtatggtcgccttaaaaagggagaaactgtgacacttgatgatggacgtgtcgttgatggtaaacagatgattggtcctgcacaacccggcagaattgtgacaattattggtgatacccgtaagacggagaatgcggttaaattggcccggaatgctgatgtcttggttcatgaaagtacgcttggaaaaagcgaaaccaaacttgcaagaagtcattatcactcgacaaatgttcaagcagcacaaattgccaagaaagcacatgtcaaaaaactattactcaatcatatttctgcccgctatacaggtaaattagtgtatgaacttgaaaaacaggcaaaagttgtttttccgaatacaaaagttgtcaaagattttgacgtgattgacattccgtttaaaaaacttgattcataacggttggtttagtttaaaagatattaagtgcagtgatcttttagatgtattggtttaattaaagaatattgtacaactatgtggctagggggatgtgcattttgaaaaaacaagttacaacaataatcagtattattctgattattttaattgctgtttttgcaatgctgaatttagaaaaagttgacgttagttttggctttacttcggttgaaatgccactggtattgctaattttggtttgtttactgatcggggctttgattatttttctattttcttctacgcaaaatattcgacaaaatcgagaatataaagaacttcagaatcaaagtgatgaacgccagcaagaattgactgatcaaattaatcatttacaagatagtcttaaagcactggaaaccagattgaaaaattcatccggtaaacaagaaattggtgccaaggatcaacagattagtgatttagaatcagaaatcgagaagttaactgacaaactgtcatcccaaaagtaaggtagcgtgttttttatgattgattcaaaatttaaatggcaaattaggcagaatactgatccacagcaggttcaggcacttagcgaggcattaaaaattgatccgcttatcgcatcaattttgcttcaaagaggtgttagcactgaggaagctgcccaggactttttgacgccatcgtcgaaagattttcacgacccttatttgatgcatgacatgaaaaaggggattgcacgaatccaacacgcagttgaaaacgaagaacaaatcaccgtttatggggactatgatgctgatggcattaccagcactacgattatgtatgaagtgcttaacgatttaggagcaaatgttgattattatattccgaatcgtttttcagacggttatggtccaaacgttgacgcttttgagaaaattataaataacggtacgacgttgattattaccgttgataatggtgtcgccggaaatgaggcaattgatgttgctaactccttgcattgcgatgtgttagtcacagatcatcattcgttaccggaagtgttacccaatgcgtacgcaattattcacccacgtgttaaaaaccaagagggacgggcatacccgtttggtgacctatcgggagcgggagttgctctcaaggttgctcaagcattaatggaagatttaccaattgatttaattgatgttgcagctataggcaccgttgctgatattgtgtcccttaaagatgagaatcgcgcgattgttaaattcggtttgaatgccattagaaatacacaacgtcctggtcttttggcattgattaaagctgcggatattgacttaagcaagtttgacgagcaggatatcggtttcggcattgcaccaaggcttaattcgttggggcgaatcgacgatgcaaatattggtgttgagttgctttccacttttgacgatcaaaaggctactgaacttgctaaatttgccgatcatcaaaatgatagtcgtaagtcactggttgatgaattttaccagcaagctgttcagatggtcgagtcttcgggtgatgcagagaatcgctcaaccttggtagttgttggtgatgattggcatcagggcgtactgggaattgtcgccagcaaattagtggagaagtatggtcgaccgacaattgttttaacgtctcaagatggtaatgatcaagtaaaaggatcagggagaagtgttgagtcatttgatcttttttctgctattgaccctatccgagatcaaacaattggatttggtggtcatcattccgctgttgggcttaccattaataaagacaagatttctgttttaaaggaccagcttgaaaaagcggccgaagaccaagaacttgatttgagtcagaaaccaacgttggatatcgctgctaaaatttctgccgatcagattgataatcagtttattaaaaatttgaatgtgctggcgccctttggccaggacaaccccaaaccggtttttgagattgagtacgaccaactcattgatgtgaaaacgatgggaaaaaccggtgatcatcttcgctttagcctggtaaagaataagagccgtttaactgcagttgcttttggccagggagcagctgctggacaactttccaatggctcggcttcaataaaagtgtctggggaaatcaatgaaaacacttggaataaccacaccactattcaattaatggtgagtgatttgaagcaaatagccttaccaatcgttgatgagcggactcagaagcttcataaacaaatgtttagtcaacttggcacatacgttttttttcacgaaaatgtttttacccaattaaagggttatatcaatgacgattcttcggctctaatgtacgatcaattagcatctaataaaattgtagggacaaaattgtttattgtcgattgccccgatgttgtggacgatttggcaactgtgcttcgccacagtcatcctaaaaccacggttttgtatctgtataaaaagcgtttgatttcaagaatagggatgccagatcgaagttcttatgctaaactatttaggttcgttaaaaacaatccaaatttaaatattggaactcagttgcaaaaactagcaaagcaattaaatcttacttcaagaacggttgtatttatgattcaagtatttttagaactggattttattacaattcacgataagatcattaatttgaatcctcattatctttctaaggatttaaagtcggctccaagttatcacttgaggcaagaacaagtaaagaccgaaaaagcgttattggtctctaatacgaaagaattagtcagttttgtcaaaggttatttagacaactgatgaaaggaagaaagaatatgtcaatcgatttttctaagtatattgcgtcttatcccgactttccggaaccgggggttctattccgagacatttcaccaatgttggagaacggggaagtttatcgcgcagctaccgatcaaattgttcaatttgcaaaagaccgaaatgtcgaaatgatcgttggaccagaggcacgtggcttcattgttggttgtcctgttgcttacaaattgggtgttggtttttcacctgcgcgaaagaagaataagcttcctggtgaaaccattgaagagagttatggcttagagtatgggaaatcgtccttatacttgcgtacaaacgccgttaagcctggtcaaagggttttggtaacagacgatttgttggccacaggaggcacaattgacgcgacaattaggttggttgaaaaattgggcggcattgttgttgggactgctttcttgattgaattaaccgaacttaagggacgcgaaaaagttaaagactatgatttcttcacgcttttaaaatattagaaaataaaaagtgtcgttaagtcaacttctttatgagttgagcttaacgacgctttttattaataggcaatgagacttgttttgggctttgaatccgctaagggcttttaacatgacaatcactggaattaataatttacaagtgtcctgacaattgatataatgttatttgttgtggagagttggcagagtggtaatgcaccggactcgaaatccggcgaaccggttttgcgccggcgcgcaggttcaaatcctgtactctccttactgcagtaagcattgcaccacatagtgagttaaacacttgctatgcggtgcttttttattttattggaaatcatggcaagcgaaggaatgtgagcatcgaaattttgctgtttcgtatatgagttattaaaaaagacccatctccttgaattgaagataggtcctttgagctatttttcgggtgtcatttttgctttaatgaatccaatacatgccgggattaaagaaattatgacaattcctataatcaccattgaaaagttttctttcacaattggaatgtttccgaagaaatatccggcaccgcaacagattgcgacccaagcgatacaggcagagacattgtatttgatgaatttagtatacggaaaatcgcttgttgctgaaacaaaaggcatcaatgttctaatgattggcataaatcttccaaggaagattgccattgcaccatatttattaaaaaatgttcgtgctttatctaagtccttttctttgataaacttacctaagactttatgtctaggaattagttctccgaatttttttcctaaatagaagtttaaggagtcacctgttattgaagcaattaagaaaagagcgacaaataattcaatgtttaatccataagttgcattagcagctaaagctgccgcagcgaatagcaatgagtctcctggtaagaacggaaagataacaattcccgtttctataaaaatgattgcaaagaggattagataagtcgaatttccaaacgtgttgacaatattaataagatgatcatcgatgtgtaagataaaatcgataagggtactcacaggatcattcctttcgattgatttacatatgattttaccaaattaatgttgttttttataattaaagttagagtttaaacaaaaatcaatcttttggatagctctgttttatgtcaaaggtggttaatgaagttggttaaagtactttgagaatttttgtgatcaaaaatcgttaaacaggatgtcatggatctgtttaacgttcggacatgttgagagtcatttataggagagtgcttgatttgggattaaaagttggtatgaaagttaagggtgttgtcaccggcattcagccatatggcgtttttgttgatttgggaaatcaaaatcaagggttgatccatatatcggaatgccaatcaggatatgtagaagatatcaatcaactatttagcgtgggagagatagtcagttctttaattattgatattgatgaatatacagggaaaataagtctatctaccaggagtaattcggttaattatgaggtgtttaaacaatcagcaaatggtcggttttcaaaccaccactattggacgaactatcgtttgaatattggcttttcgacactttctaaacgacgtagcgaatggatggaagatgcaaaagactttttttgactggatttttaaatttgtacttgaccagctttcgaaatcttggtaaactagttttcgttgcgttaaagcaatcgactttcaatgccaaattcaagttttgtttctttcaaaaaactgcttgcatttcaattggaaatctgataatattaaatagttgtcaaaagcgatgaacaagcgctttgatagccaagtagacctttgaaaactgaacaaaattttcgacaaacaaattgtgtagggtgcttcgatttttgatcgaa

SEQ ID NO: 453 - DNA, 54848 bp, Unknown
  Metagenome-assembled genome
acacacgcccagtcacaccatgagagtttgtaacacccaaagccgcgtgagataaccttcgaggaagtcagccgtctaagcgtgggacagatgattaggcgtgaagtcgtaacaaggtagccggaggagaacctgcggctggatccactcctttcttaaggaatatacggtaaggcctacacatactttgaaacaatgattcagttttgaggggcttacctctcaactaaatgattttgggcgtatagctcagcggtttagagcgcacgcctgataagcgtgaggtcgatggttcgagctgccatttatgcccatgaccgcaaggtcatcttatggggaattagcctcagatggagagagcacctgcttgcaagccaggggcgtcagcggttcgatcccgctattctccattggcacgagagtatgccaaggattgttcttgaaaactagatattatcaattattttctttaattattagatcaattaacgagaaacaaatgcgtatttttgagttttttaatagtttatcgctaatactcaattaattgacgatcacaaagtgaccgttaggttaagttatgaagggcgcatggggatgcttggtgactaggagccgtgaaggagggataacaccgatatgcttcggggagcggtacgtaagctttgatccggagatttccgaatggggaacccaatcatctttaccgatgattacaactgatgaatacatagtaagttgagcgcagacgttggggaactgaaacatctaagtaccgcaggaagagaaagaaaaattcgattccctaagagtagcggcgagcgaacgggaacagccaaaccagaagactgcttgttggggtgtaggactgaacatttgagttaccaaagttggtacgagtagaagtctgggaagtcgacgcataagggtgatacccccgtagtgaaatcgtcaaccctcagttcaggatcctgtacggccgggacacgtgaaaccgtcggaatccgggaggacatctccccaaggctaaatactccctagtgaccgatagtgaaccagtaccgtgagggaaggtgaaaagcaccgcgcgagggagtgaaaagttcctgaaaccatgtgcctaccatagttagagcccgttatggcgtgatgagcgtgccttttgtagaatgaaccggcgagttacagtatttgcaaggttaaggtggaaagaccggagccgtagcgaaagcgagtcgaagggcgttcagtaattgtgagaccgaaaccaggtgacctacccatgtccaggttgaaggtgcggtaaaaacgcacggaggaccgaacccgtgatagttgaaaatatgtgggatgaggtgtgggagcgggtgaaattccaacgacttggagatagctggttctctccgaaatgcttagggttagcctcggaggttaagaatctggaggtagaacactgtttggactaggggcccgtcatggttactgaactgcataaactccgatgccacagatttaatctggagtcagcacgtgagtgataagatccaccgtcgaaaggggaacagcccagaccacattaaggtccctaaatatatgctgaagtggaaaagatgtggagttgcatagacactaggatgttggctcagaagcagccacatttaaagagtgcgtaatagctcactatgcgagtgactccgccgaaaatttacgggctaagcatgtaccgaattgtggcattccgtagccgagtgatgcggaaagcgtttaccgaggccaagatgttcttgtggttgagtaagactgtcgagttgacagtgagaggcgtatactaaaagaagaaaacccaaaaagaaatacccccccccacggattgctggaggctataccgggaacaagcaaaacgtcaggagggacctaaaaaaatccaccgcagcacgagttggtgttccccccaaaccaaaagtcattcctcccccttctgcggggaaggctcgtcctcccagggttagtcgcggacctaagccgatggccgcaaggcgtaggcgaatggataacaggtctgatatctctgtatactagttaatcatgtatgaacgatggagggacgcaggaggtgttcgtgtgcacacgattggaaatgtagtgtcaaactcaagtctgggtgctgcgcacgtgggtggcgcgcggagagtcaaagcattatcgcataggacaaggcgcgacgaggaccgaattttagtagaggaagcgccagatgtcacactgccgaggaaaagcttctagttagtgattaattacccgaacccccaataccgcaacgacacaggtagtcgaggagatatcctaggtgagcgaggaactctcgttaaggaactcggcaaaatgacccgtaacttcgggagaaggggtgctgacgcaaggtcagccgcagtgaaaaggcccagcgactgtttatcaaaaacacaggtttctgcaaaatcgtaagatgagtataggggctgacgcccgcccggtgtggaaggttaaggagagttagcttcggcgaagctgacgattgaagccccagtaaacggcggccgtaactataacgcgtcctaaggtagcgaaattccttgtcgggtaagttccgacccgcacgaaaggcgtaacgatctgggcactgttcaacgagagactcggtgaaattattcctgtgaagatgcaggttacccgcgacaggcaggaaagaccccatggagctttactgtagcttgtatgggtgcttgacagcttgtacaggataggtgagcctagagccggacgctagtttcgaggaggcgtggtgggatacaccctgctgtgtgaacactctaacccgcacctgatcgtggtgggagacagtgtaggtggcagttgactggggcggtcgcctccaaaagataacggaggcgcccaaaggtttcctcagaatggttggaaatcattcgcgagtgtaaaggcaaaggagcttgactgcgagacagacaggtcgagcagggacgaaagtcgggcttagtgatccggtggttccgtaggaagggccatcgcccacggataaaagctaccctggggataacaggcttatctccccaagagtccacatcggacggggaggtttggcacctcgatgtcggctcatgcctggggctgtagtcggtcccaagggttggctgttcgcccattaaagcgtacgcgagctgggttcagaacgtgtgagacagttcggtccctatccgtcgcgggcgtaggaaatttgagaggagcctgtccttagtacgagaggacaccggatggacatacgctggtgtaccagttgtccgccagggcatcgctgctggtagctatgtatggatgagataaacgctgaaagcatctaaggtgaaactcgcctcaagatgagatttcccatccttatggaagtaagacccctagagatgataggtagataggtggaagtaggccgcgaggctggagcggaccatactaatcggtcgaggacttaaccaagtaaaaggttgtttcgatgaatgaagaatagatattagttttgagagtgcaagaagtctcttatagtgtgggttggcgtagcctgaaggatacacctgttcccatgccgaacacagaagttaagcttcagcacgcgaagtagtggggatcgctcccgcgaggataggacgttgccacgcgattattcggcatagctcagttggagtagagcacgactgttaatgcgtacttgtggcacgccgttgagcccgcctgccggaataatcgcgtgggcaacgtccatatcctcgcagggggcgatccccaactactatcaggcggccgtgctgaagcttaacttctggtttcggcatgggaacaggttgtatccttcaggctatcgccaccacctatgagaactggtgcgctcaccaactagaccatatcttttctttaccgagacaccactcgtggttaagcctcgaccgattgtactagtccgctccgtgcatcgctgcacttccttctagcctatctacctgatcatctctcaggggtcttactttccatataggaatgggaaatctcatcttgaggcgagtttcacacttagatgcttcagcgttttctcatccacacatagctaccagcaatgcgcactggcggcacacttacaccagcggtgttccattccggtccctctctactaggaacagctcctctcaatttcctacgcccgcgacggaatagggaccaactgtcctcacgacgttcgaacccagctcgcgtaccgctttaatgggcgaacagcccaacctgggaccgactacagcccaggatcgatgagccgacatcgaggtgcaaaccctcccagtcgatgtggactcttgggggagataagcctgttatccccagggtagcttttatccgttgagcgacggcccttccatacggtaccgccggatcactaagcccgactttcgtccctgctcgacctgtctgtctcgcagtcaagctcccttgcctttacactctacgaatgattcaaccattctgagggaacctttgggcgcctccgttactttgggaggcgacccgccccattcaaactacccacctgacactgtctcccgccacgcttagtgggcgcggttagagtgttcacacacaagggtcgtatcccaccatgcctccaccgaaactatcgttccggttctacgctccgacctatcctgtaacaagttgtgtcaacacccaatatcaagctatagtaaagctccatggttctttccgtcctgtcggcggtaacctgcatcttcacaggtactttaattcaccgagtctctcgttagcagtgctcagatcgttacgcttcgtgcgggtcggaacttaccgacaaggaatttcgctaccttaggaccgttatagttacggccgcgtttaactgggcttcatttctgggcttcgccgaagctactcatccactctacgccttccagtcaaccgggcaggcgtcagcccctatacgtcatcttaacgattttgcagaaactgtgtttttgagaacacgtcgcctgagcctcttcactgcggcggcactgcgtgcagcacccctctcccgaagtacgggtcattttgccgagttcctacgagagttcatcgtgctcaccttaggatctctcctcgactacctgtgtccggtttgcggtagcggtagtagatactcactagaagcttttctcggcaggtgacatcagccacttccctacttaaattcggtccgcattcaacgttgtctactcggttgaaagcatttaactaacaccagacttgccgcttgacgcacatatccaacagtgcgcacggcttagcctttctgcgtccctccatcgctcaaacatatcttactagtacaggaatatcaacctgttgccatcgtctacccgtgcggcctcgacttaggtcccgactaaccctgggaggacgagcctccccggaaaccttagtcattcggtggatcagattctcacgatcttcgctactcataccggccattccattctaagcgctccactagtccttacgatctagcttcaccgcccttagaacgctctcctatcacgcgacctattggtcgcatccacaattcggtggtatccttagccccggtacattttcggcgcagaatcactcggctagtgagctattccgcactctttaaatttggtgctgtctgagccaacatcctagctgtctatgcaactccaccgcctttccacttagtatacactttaggaccttatttggtggtctgggctgtcccctttcgacgatggatcttatcactcaccgtctgactcccggatataaatctatggcattcggagtttatctgaattcagtaaacccgtgacgggcccttagtccaaacagtgctctcctccacgattctctttccgaggcttagccctaaagctatttcggagagaaccagctatctccaagttcgtttggaatttcaccgctacccacacctcatccagcacttttcaacgtacacgggtttcggcctccaggcggttaccgcaccttcaccggacatgggtaggtcacctggtttcgggtctacatcaacatactgaaacgcccgtttcagactcgctttcgcacggctccgactttcaatcttaaccttgcatgttaacgtaaccgccggttcattccaaaaggcgcacgctgtcacccattacgggctccaactaattgtggcacatggtttcaggaactatttcactcccctccgggtggcttttcacctttccctcacggtactggttcactatcggtcactagggaatatttagccttgggagatggtcctcccgatccgaccaggtttcacgtgtctgccgtaccaggatcctgaactgagggtaacaaatttcgtctcggggctacacccgcctggccggtcttcccaaaccgttcgactatccgttctttggtaactcaaatgttcgtcctacaaccccagggaagcaagcttctctggtttgggctgttcccacttcgctcgccgctaccattgggaatcgcattgcttttctcttcctggtgggtactctgagatgtttcagttctcccaccacgtctgcatacttagctatgtattacctaagcttacatcgactaatcgcgcatgattgggtttccccattcggaaatctccggatcaaagcttacgtacagctccccgaagcatatcgtgtgttagtcccttccttcatcggctcctagtgccaaggcattcaccatgcgcccttttttaacttaacctcatcacttgcgtgacggattaattgagtattacactcgaaataaactttactaataaaaactcaaaatacgcggtgttctcgcttaataatgaaattaattaatataaagaaaattgatatttctagttttcaagaaccaattctttgattccttacggaatcaatggagaatagcgggatcgaaccgctgaccccctgctgcaaagcaggtgctctcccatcggagctaattccccataacaacaaagtttgttgagtgggcctaaatggactcgaaccatcgacctcacgcttatcacgtgcgctctacccagcgtgagctataggcccaataaagctttattctaatttgagagtagacctccaaaactaaacaaagttttgtctcttgtgcggttccgtattattccttagaaaggaggtgaccagccgcaggttctcctacggcaccgtgttacgacttcaccctaattcatctgccccacttaggcgtgttggctcccgaaggttaccgaaccgacctttgggttgttgcaaactctcatggtgtgacggcgtgtgtgtacagcccgggaccgtattcaccgcggcatgctgatccgcgattactagcgattccgactgcgtgcaggcgagttgcagcctgcagtccgaactgagaatggctttaagagattagcttgccctcgcgggtttgcgactcgttgtaccatccattgtagcacgtgtgtagcccaggtcataaggggcatgatgttgacgtcatccccccttcctccggtttgtcaccggcagtctcgccagagtgccaactaaagtggcaactgacataagggttgcgctcgttgcgggacttaaccaacatctcacacacgagctgacgacagccatgcactcacctgttcttctgcgtccccgaagggaacgcctatctcttaggtttagcacgtatgtcaagacctggtggtttcttcgcgtagcttcgataaaccacatgctccaccgcttgtgcgggcccccgtcaattccttgagtttcaaccttgcggtcgtactctccccaggcggaatacttatgcgttagctcggcactgaagggcggaaaccctccaacacctagtattcgctcgtttactgcatgtactaccagggttatctaatcctgttcgctacccatgctttcgagcctcagcgtcgttacagaccaacagccgccttcccactggtgttcttccatatatctacgcatttcaccgctacacatggagttccactgtcctcttctgcactcaagtctcccagtttccgatgcacttctccgtttaagccgaaaggctttcacatcagacttaagaaaccgcctgccgctcgctttacgcccaataaatccggacaacgcttgcacctacgtataccgcggctgctggcacgtattagccgtggctttctggttaaataccgtcaacacctgaacagttactctcagatgtgttcttccttcaacaacagagtttacgagccgaaacccttcttcactcacgcggcgttgctccatcagactttcgtcgcattgtggaagattccctactgctgcctcccgtaggagtttgggccggtctcagtcccaatgtggccgattaccctctcggtcggctacgtatcattgccttgggtgaaccatatactccaccaactagctaatacgccgcggggtccatccagaagtgatagccgaaacatctttcaaactgaaaccatgcggtttcagttgtttaacttattagcacctgtttccagtgttatcccctgcttccgggcaggttacccacgtgttactcaccagttcgccactcatccatgctgaaaatcagtgcagcacttcaattcagcgggatcgttcgacttgcatgtataggcacgccgccagcgtcgtcctgagccagcgacaaactctcatttagattgtttgtgactcattaatattactaggaaattgacttcgccaattacatttgaatatcaccgaaattgattcccctgcacttgtgaaacaaactttggtttcagttttcaaagggttcacttctttactcgacttaattaagttagtaacacagtttccattgtaaatcaatgtcaacgatttttttgaatctttattcattcacatcaacgactcaattatgataccaactgccgaatgtttagaacgattgaatattaaatgtctgaatataattcaaataattatattgttgtgtctttacaacaggtaaatataccagctattggcgacagggtcagcacaaataataaaaataaccaatatttgcaacaactcttttagagcttcctgagcccatgcctgtcttcttttgatattgagatggctaaatccctcatgaacatacgacttgtccaattatgccggtgtcgattctcatttctgtggtgctaccgtggcaaggggcacctgagtttcttccaacatctcaacgatagcggaaattttgccagtgaattcatcaatattctaagacaaacacatcaatctcatcaccactgatgctaatcatgattctttgactacacaaaaccactaatggcattcagaaatatgaatcacaccttgaacatcattgccaagattaacaagcaccgcgcaccgtggcagggttgaatgccagtaaccgtaccagtacgtgatcaccaatacgcattactaaacctctttctactatagtatacacaaaagcttgaaggctaacatgccccagcctattatcagttcagcctaatcttcaatggagagcagattcaactcagcgtctgtgcctaatgctccaaacggtttgtcagcaagagtagttgggggatcgccccctgcaagggtaggacgttgccacgcaattattccggcatagctcagttggtagagcacctgactgttaatcaggttgtcgacggttcgagcccgcctgccggagttattatttaattggagagttgtccgagctggccgaaggagcatcattggaaatgatgtaaacgggtaaaagcctgtttcaagggttcgaatcccttactctccgtaaccgaataataagttttatgacccgttggtcaagtggttaagacaccgccctttcacggcggtaacatgggttcaaatcccgtacgggtcattatggaggattagctcagctgggagagcatctgccttacaagcaggaggtcacaggttcgatccctgtatcctccatcccataacagcctggttcgttggtctagttggttaggacgcctgcctgtcacgcaggagatcacgagttcgagtctcgtacggaccgttgttatgtatttgaaaactgaatacacaacttagtattattatctctgttaatggtttatttggctcggtagctcagtcggtagagcaatggattgaagctccatgtgtcggcagttcgattctgtcccgcgccatttatggaggggtagcgaagtctggctaaacgcggcggactgtaaatccgctccttcgggttcggtggttcgaatccactcccctccatcatagggatatagtttaatggtagaactacggtctccaaaaccgtcggtgtgggttcaactcctactatccctgttaataatactatggcggtagtggtgaagtggttaacacatcggtttgtggatccgacacgcgtgggttcgattcccacctaccgccctttgattgggttatagccaagtggtaaggcaacagactttgactctgtcatgcgctggttcgaatccagctaacccagtttggggttagccaaagttttggcggtatagccaagtggtaaggcagaggtctgcaaaaccttcatcgtcggttcgaatccgattaccgcctttaaccatatagtggccaatcaattattattttgccggagtggcggaactggcagacgcgctggactcaaaatccagtgtccgttgaggacgtgtgggttcgaaccccacctccggtatcttgtaccatcatatggaaacatgaataaaaacaacgttgaatatttttaattcaacgttgtttttttacttaaataattttagacccttcttatcggagtcgatacagccccaaaactgttcactcgccgccatctatagtcggcgagtcaaaatattagagttctaatcaacgttgtgagtagagctctttttgttttaattttaaaagcattcggaacaacctgtatgtttttaaaagtttcgattaaggacgtgatttttcttattaggttcgtctaagagaccgtttgaatataagccatacaagacatatccttctttcgctaaaaactttgatggtagctggctttttttaatgaacagacgggaagtgcctattttatatattcaataacaataaaaaaactgttgttggtaatagattaaatctattaccaacaacagatattgcaggaccatcatctgacccgtttgtgatttatgacgttacctttatatacttattaacagccatagaaagaggaaatcatttctttacgttgcttatatattaaacattcaaaatcttatttaagaaatcctgtaaacgttcattcttaggatgttcaaatatttgatcaggagttccttgctctaaaatttgcccgtcatcaacaaatacgactcgatcggcgacttctttagcgaaacccatttcatgagtgaccacaatcatcgtcattccctttttagccaaatctttcataacctcaaggacatcgccaaccatttcaggatctagtgctgaagtcggttcatcgaataacatgatgtttggatccattgccagagctcgagcaatagcaacacgttgctgctgtcctcctgatagtgattggactcgtgcgttaaacttttcttccaagccaaccgtgttcagtaaacgtttggcttgttctgctgcggcctgtttgctttctttttttaactcaacaggtgccagcataatgttttcaccaacggttaaattgttaaaaaggttaaaatgttgaaataccatgccgatattttcacgaaccgtattcatattagcgtttttattagcgatatcaacgttgtcaataacaactgatcccgatgttggttcttcaagcttattcagtgtccgaagtagggtgcttttacccgatccggagggaccaataatcacaacgacctcattattttggactgtcaagttgatgccctttaacactttgtttgtgccaaacgtcttcactaaatttgtcacttttactttttcgctcatacttttgttctcctttgaacccagttggacaaccaagttaataacgtaataatgatgagatacattaacgcaacaatcgtccaaactttaaatccttcaagatttctggcgataataattttaccggtttgggttaactcaagtaaaccgataattgaaagaattgaggtatcctttaaagtgatgatgaattgattgataaaagatggaatcatgattcgaattccttgaggcaaaataaccttgcgcatagacttaccaaatggcaagccaagactacgtgctgcctccatctgtccgggatcaacggcttgaattccgcctttaacaaaggctgcgatataagcaccttcgttaaatgttaacgtcacaacaccagcaacaaaagcaggtattttttcgcccgttaggcttggaatgccggtatagatgaacaatgccaacacaagcagcggcattccccggaagaggtaaatgagaatgcttgataaccagttgaaaaatttgccaggaacgacacccattagtccaacaacaatcccaaaaatagtggcgaagaaaatagaaacgacggttagccacattgtttcttttaatcccgatagtaaagcaccttgattttgcttgatcaatccaagaaaagtccgatcttcagaactgcctgttgattttgtcgttgttagcgcatcgctgctccctaaatacttagctttaatatcatcataggtgccactggcttttaaatccttaagcccattattaaaggcagccaacaatgctttattatggcccttcttaacggcgaatccatatggtgcactctcagccggttttgtgacaatctttaacttggttccctgcttaatagcatattgcataaccggatgatcttcaaaacacgctgcagaattcccggttgtaacgtcctgatacatattgtttgagtcatcaaaggtagtgaccgtaaaaccatacttcttttttatgctgttagcgtaatctgcaccggccgttccggtttttacagccactttctttccacgtaattgagaaagcgactttaccttactttttttattaacggccatcacaactccagaagtaaagtagggattcgaaaaattaaattgtgcttttctagcatttgtaattgacatgccggcaataacaccatcaatttgtcctgattcaactgcttgaacagctgcattaaatcccagaggcttaatttttactttaaagccctgttcattggcaatcgctctaactaagtccatatcgataccaacgtatttattttgtttgtttgcaaactcaaatggtggaaacgtgacatctgtaccgatcgtaaatgtttttcctttgacggcttggctagcattgctgcccaaatattgaccaacaattttatcgtaggtaccatttgccctaatcttttttaaaccagcattaaatttagaaacaagtgctttgtgagtaccttttttaacggcaaaaccgtaccaaccggtgtttgctggtttagtcacaatttttaatttaagtccctgtttaatgccatattgcatgaccggttgatcctcaaaacaggcaaccgaatttccagttgtaacatcttgatacatattatcggaatcatcaaaagttacggttttaaagccatattttttcttaatgctgttggcataatctgcggccgcagttcctgtctttaacgcaacccgtttaccttttaattgtttaaagttcgtaatatgactgctttttgcgacggccataaccacgcctgttttatagtagggggttccaaaatcaaatttagcctgtctgtctggtgtgatagtcatcccagcgataacaccatcttcttgccctgactgaactgactgcacggcagcattaaatccgaccggtttaatatgaactttaaatccctcttctttagcaatggcgttcataatgtcaatatcaataccaacatatttgttttgcttgtttgcaaattcaaatggtgggtaggtaacatctgttccaatttgataagtttttgcctgtgccgcaatgtttgaaaaaataaggcaagtcaaaaaagtcatcaaaaagacaacccatctctgggcttttgacaatttgtggttcataatcatcctcctaataatatgtaataaaacataacataaaaatacaataatgtgaccattctagcagaaatctgtttaaatgtatagattgattggcaatcgaatgagacggtcagagtttatacataaggaaaagatcattttttagaatgattaaaaaatcgttaaaaccacattgacaattatggggtatttactcataattaactttatatgtcttgggtaggtgggtcttaagtttttaaccttattacgtaaacagggctatacataaatgatctaaataaatgtgacatcatactggaggaatttaagttgaaatttgcagaatcaaatgtgcttcagggacttccaaaacaattttttgctaacttagtgaaaaaagtgaacgcaaaaattgacaccggagccgacgtgatcaacttgggtcaagggaatccagatcaaccaacaccggattttattgtaaaggccatgcaggagcaaactgctgtccctgataatcataaatattcacaatttcgcggagatccggcattaaagcgggcagctgccgatttctacaaaagggagtatggagttgaactgaaccctgataaagaaatcgcaattttgggaggctcaaagattggtttggtagagttgccatttgcgattttaaatcctggcgatactatgttattgcctgatcctggctatccagattatctgtcgggtgttgcccttgcgcaggtggatttgtcattaatgcgtctcaaggaaaaaaataatttcatgcctgactatcatgatttggatcctcaaattgtaaaaaaggccaagttgatgtatcttaactatcctaataatccaaccggggcagtcgcaacacctgatttttttgaaaggacggtcgcatttgccaatcaaaatcaaattggcgttgtccatgattttgcttatggcgcgattggttttgatggtaaaaagccaatcagtttcttacaaacacccggagcgaaagaagtcggtattgaaacatatacattctctaaatcctataatatggccggatggcgaattggatttgcggccggaaatgccgatatgatcgaagccattaacttattgcaggatcacctatttgttagtgtttttcctgcaatgcagaaagctgccatcacggctttaaatagtgaccagcataccgttagggatttggtggccctatatgaaaaaagaagaaatcaattctttacggctgctcgctcaatcgggtgggaaccatatcattccggtggatctttttacgcgtggatgccggttccagaaggctatacaagtgagtcctttgcagatctattattagaaaaagcggcagttgctgtagctcccggaaacggttttggtgatggtggtgaaggatttgttcgtgtaggattattaattgacgagccaaggtttacagaggcctgccaacgaattaaaaaacttgggttgttttaaaggtttttagcttggtaaattgcggttaataataaagagatcagtgacaagtcgcaagttggcttgtcctgatctctttattattaccaatagtctagttgtttagctaatttggctctatttaaatcacgctgagaaatctgagctgtttctgtgccatccaacccggttgatgatcgttgaattggtcgtttccacaaatactttgtaataacatttccatcgctggtaggcgcaaacattaagtcactttgataagctgtatggtccagaccaagggtgtggccaagttcatgggcaatcacacctgtccagtattgttcaatcgacatctgggaggctatagacggcttcatataagcagtggggtatttaggatcattaaaatgggctctgtccacgtagatctttcttccattaaatagcccatcccaattgtcctgaccagcgttaccgaaactaatggttaatgtgtgtgttctttgagatccaattttaaagacaactgtgtccaaagcgttattccacttatttgctgctatctttatcaaaggtaataatctatttgaagttgtataaatagttgctgtattagatttaaacattgcttttggtgaaaaatgaaaaacgttatatgaaacgtcaaacaacttctcgtttttaagataatcggtatgagacaaagataaaattaatggatccggattcatatccggcgtttccttgattaattttgcaatcgaatgagcagacaaacgattcttttgattagttgacgttttagtaccgtcaaattgttgattaacggctatgtaaccgttctttggtatattttcagcacttgaatggatggtcttaggcgcattgaacgctggatttagcggatttgcgcccacgtcctgattggtagtcaagatggtaagacaaagcgaaagcattgttgccatcagtaacaatagtgtgcatctaatttgctgcatgtggttttcctttcactgttacatataattgtcttaaatatagcatatatatgaagatgacatcttgttaatgcacgacttaataaaaaattgggcaaataaaaaacactgtcaaaattgacagtgttttttatttttatcaattatcatcattctagttaacgcagtgatagacaagttaatctttcaatacattcaagaaaacggcaccaagtccttgatcaaaggttgctttccatttgccatcggttaaagattcaggtaagaggaaagtaccgcttgatacgcgttgacctgcttgtagcggttgaccttgatcctccagctttttaaccaaccaatgaagtgagtttaaaggattaccaagtacttctgatgacgcaccgtcctttaatttctgaccattgtggaagagctgacatgtgacatttgccaaatcatcgacgtgatcgaataaacgggtggcctctacttcttggccataaacgacaaatccaccaactgccgcatctgccattaccatatatttggataagcttgggaaccaatcgctaaagcgtgaatcaggtacttcgacggcaggggcgaccttggttttcttcaataaatcctcaagagaatctttactgctaaggggttctttagctgtaaacagcatctctacctctgctaacggttccattaactctgctcgatgtaacgtgactggcgactggacaaagtgacttttaacttgtgcgccatataatggggaatccgaatcaaacatatcttgagtctgcttactggtcagcgatactttataaccgccaacttcctcacttttgagttcggtaaatcgtttttgaacccggtatgcggttgcttcatcggtaacaacgtctttccagtctgactcctttaacgctctatgtgattgataggcgttgaaaagttcctttgcaaatgcttttttttttgctgataattctaatgtagcttgtttttgtgtatccataagcgtgacctccataaatttagttgatttgtttgtcctcgcttataagattttgtgaggacaaatatgtgtgggtaataatacagtgtgaaactatgtcgttaaaaatgaaagctatgttaaatctaatatgtttaaaactcgatggtgcattatgttgtaaaaagtttaagttgctaacagcccctaagtgactaatctgacctggattatcgttagagttgctaatgtccgatttcatatgtcctcaccacctttaactctttcttcattaaaatccaacaaaaaacgtcctttaattacccaatcattggtaattaaaggacgttttagcgcggtaccaccttatctttataaccttattactaaggctatctcacacgtacagtaaaaattacgatacgctgacataataatgggtgctcccaatgcaacctactaaaaacatttggctacatagctcggagatgatgatcattttatatcgtaaattgcttctcaccaaccagcaactctctgattacaactacaaaatgacgtttctcttcatcgctttttctaatgtgaatttaatgattgtcattaatttacacccagtttttaataatgtcaacactgtttttttatttttgaaatttatttggattttcgcgtaaaatgcgtgcgggattgccagcgataatcacattatcgccaaatgattttgtcactgttgaatttgcaccgacaatcacattgtttcctaatgtcactcccgggaggatgacggatccgccgccaacccaaacatcatctccaagtgtaaccggtttgccaagcccggtgaaagcctctcgtccggctggatcaagcggatgataggctgaataaatttgaacatgcggtgccaacatgcagtgattgccaattgtaacgggagcaatatccaaaataacgttatcataattgcacataaagttatcaccgacatgaatattgtaaccaaagtcacaacgaaaatttggctggacccatggacttttcccaacggagccaaataactggcggatcaattgttctttttccttaccagctgtatcgtccaattcattcatcattttacataaacgacgggcttttgtttcctctgaagctaattccggatccatgatgttataaggttcgccggctaaaaatttttccttttctgtcgccattatttttccacctttaatctagtatattgatataaaaacattatatcatattcatcagtatcaattgatgcaattaaaattggtactgatgaatttaaaaattaaaacctgattgatgaacttctcattttcgggtattattaatgaaatgcgataatctcaacggatgagatgaaaggatgaatttggatgaaagcagttatcacggtgattggtcacgatcagattggaatcgttgccaaggtatcacaaaaattagcaacattgaaagtaaatattactgatatttctcaaacattaatgcatggagattttacaatgatgctaatgggagagtggcgtgaatcggaagttgattttgagaccattaaaaggggattaactgaattaggatccgaaacagggctggatatccatattcaacgccaagaattatttgacgccattcaaaaactataggaggttaatttgaaatggaaaccaagcaaatattagaaaccattcaaatggtctccgaagaaaaattggatattcgaacgatcacaatgggaatttcattgtttgattgtattgatagtagcggtgagaaagcccgtcaaaaaatttatgacaagttgactagcagcgcaaaagatcttgttaaagttgccaatcaaatcgaatctgaatatggtattccaattgtcaataagcgactttcagtgacaccgatttcaatgattgccgctgcgtgtcacgacgataactatgtcgcatacgccgaaacgatggaaaaggctgctcaaacgttaggcgttgatctgattggcggcttttcggctttagttcaaaaaggttaccaaaccggtgataaaaaattaattgcttcaattccggaagcgttgaatgaaacaacgcgggtttgcggatctgtcaatgttggatcaacccgtgccggtattaacatggatgcggtcaaacagatggggcaggtcgtcaagcagttggcggcgattgatcctgtgagctgcatgagtcttgtcgtttttgccaatgcagttgaggacaatccatttatggcaggtgcttttcatggtgttggcgaggccgataaagtcattaacgttggcattagtggaccgggagttgtgaaacgggctctggaaaaagtccgtggtgagtcaattgatattgtttcggaaaccattaaaaagacggcttttaaagtaaccaggatgggacagtttgttggaaatgtggctgcagaacgcttaaatgtgccatttggtattgtcgatctttcattggctccaacgccaagtcaaggtgattcggttgctgagattttagaagaaatcggactgcaaagcgtcggtgcacctggcacaacggctgcattggccttgctaaacgatgcggttaagaagggtggcgttatggcctgcgagcatgtaggcggcttgtcaggagcattcattccggtttcagaggatagcggtatgatcaaggctgtcgaacatagtaacttgaacatagagaaacttgaagcaatgactgcggtctgttcagttggcttggatatgattgcagttcccggtgacacgcctgctgaaaccattagcggtatgattgccgatgaggcggctattggggtaattaataacaagacaacagcggtcagagttattccggcaaccgggaaaaaggttggcgaaaaaattgattttggtggcctttttgggtacgcacctgttatgcctgttaatttaaacagtcctgctaaaatgattaacaggggcggacgaattccagcaccaattcattcatttaaaaactaaaagtcatctatttcggataggattatgtcgaaacggattgttaaaaagttggggcaaaatgttccggcttttttgtttgtaatcgttttaaatgtatgatatagcctttttaggtaaatgttgttcccctgccatcacaatcacttgatggaggcatattttagatatttaaaaggatgtgatggtatattaaggtcaaaagtgatcacggaacggaggcattttatgaaatcgtctgaggagccattgactaatcgtttgagcaagttatcatcgacggatttgattaaattaacatccggtgaggacttttggcactcttcgtcactaatcgacgatcatattcctaattttcgaatgagtgatggaccaaatggtttaaggtatcaggctgataaaggggatgctttgggaatcaacaacagtgtgcccagtacctgttttccgactgcaagcgctattgcctgtacatgggatccagagctgattaagcgcatgggtcgggcaattggtcaagaagcacgtagcttaaatgttgatatggttcttggccccggcatcaatattaaacgaaatcccttatgtggtcgaaactttgaatacttcagcgaagatccatatttagccgggactattggtgctgcgtggataaaagggttgcaatcccaaggggttggtgcctgcgttaagcattttgcgggcaataatcaggagaatgaccgactgcgatcagattcgcttattgatcaaaccgctttgcatgaactatatttggcggcctttcagattgctgtgacaagggcccaacccgaaggagtcatgtgttcttacaataaggtgaatggtacctacgcaagcgataatccataccttttaacgacggtcttaagacagcaatggcgatttaaaggaagtgtgataactgactggggcgcgttaaataataagattgccagtattaatgccggtacggatttagaaatgccatccagtaatcacttatttgataaacagggtttggcaggattgaagactggccaacttcagaacaaagctttatatcgtgcagccgaaaatgtcatcaaaattgccgaaaagaaacgacctgtgtttaaaggagaccggtcggcattattaaaggaaagcggtcaacttgcacaaaagattgaagaaagtgcagctgttttattaaaaaatgataatcaggtgttgccaataaaatcaagtgacgaggtagctgtcattggtgaaatggcagctcataccagatatcagggggctggatcatcccatatcaatccacccgagtcagttacaatccttcaaggactggatcacatgggcgttcattatcagtatcagcaaggttattcactttctaatcaaaaatcggatcagttcattacaagtgccgtggcgcttgctaaaaaggctgacaaagttatttttgtagccgggttgccggaaaatgacgagtcggagggctttgatcgaaaaaacatgcagctgcctgttattcaaaatgtgttaattgatagaattgcggcagttaatccaaatgtcattgttttgttggtagctggggcaccggtcgaactaccatggttaaaggatgtgaaaggcgtgttaaacctttatcttggcggtcaatatgtcggcaatgctgcagcaaacttattactggggaaggtgaatccctctgggaaattggctgaaagttacccgattaactacatggatgtcccttctgcagaaatctatgatcataatcctcaatctgtcgggtatgcggaaagtgtttatgttggttatcgctattatgaaaaatcaggtaccccggttgctttcccgtttggctatgggttgagctatacaacgtttaaaattagccggattgaaatagataccgatatgattcgagagagtcaatcaatccacgtgaaagcggatatcacaaacacgggcaatgtcgatggtgctgaggttatccaggtttatgtaggaaatgagaaagatcggcctttaaaaccgctaaaagaattaaagggatttaaaaaggtcgtgataagagccggtcagaccaaatcagtgacagttgaattgccggcacaggccttttctgagtggtgtgatgcctcccaaaaatggcaattacctttggggcacaagtttattataattggtgatagttcgaataatgtcgtattttcaacgagaattcaatcaaaagggatttcttttcctgataagaaaaatttaccgatttggtattcaaaaccacaggataaaccaacgcttgcggatttttctaaaatgagtggactggaaattaaaaagcaagtggttccaaagcctggtcaatatacaaagttaaatacacccagggaattatcaatgcattcttttattattcgaaaaatgattaagagaatgaaagaagctcggctaaaaggtatttccgatccaaacagcgcagcagttaaatttgaggaaacgatcataatggattcaccattaattaggttggctcaacaatcagaaggaaagctgtcattgaaaacggtcgataagttggttgaaattgcgaaccgcagatatattaaggcgcttttgtaattaaaaagattagttgctggcagtttcctgctttttaagatcattgcaaaaaatgaaacgataaaacaataaacagcttaatgtcatctgtttgcgtagagaagcaaatgacattaggctgctgttttatagatctttttttacaatgacacagggcacaccatcttcgaaaaatggcttagaggcaactgaataacccattttttcataaaaaccttcggcggtgacttcactatggattaacgattttgttaaaccaagttgtttggcatatttttccattgcggtcagaacccttttgcccaaaccctttccgcgatatgcttttagagttgcaacccgaccgatctttaaagtgttttcgtcggtttgttcgaaacgacaagttgaaacgggggtcttttcatcaaacaaaacggcataaacttcttgatcagtatctttatcatcaaattcgtctcttaaatcaattcctcgttcgatgacaaaaacggataggcgaacataggtagctgctgcgcgaataggcttagaactttctacaatcaatcgcatcaaatttctcctgttctgtaatttgttattaatctttttgtaacaaatttgtcgaaatataaaaaatgtggttaaatcatgatatgatagattaatgtaattacgaaattagaaaagcttgaagattttattaaggatataaaatcgtaaagcttataagtagattgtacgttctaatcctcgtaaaatgaagtaaaatatctgccaagggggctggctagatccatgtcacgaaaagaaaagttcagccaacaaaagaaaataaaacgcaatcgcaagctaagacggttttcagcggttgttgttttgctgttggctggtggattcattgggtcgcacgtttattttcagaatcattttaaatggacaaaaattaatgatgttaacgtgtcgggcttgactgttgcacaagcaacaaaaaaattgaataaatcaagaatcgatgaaagtggcaattatttagttgtaaaggattcacgtattaaattgaattcagacgacgttaagcaattattcaagcaccgtagttctatgagtatgttgacttcaaagcagatgaatgcgcaagctgaagtctctaataaggcgtatcattatcgaataaagacactgttacctaaatttgaaaatcgagttgatcaaatgaatatgaccagaaaaccaacgattgattcgactattaacctttctaatgggaaggtgactgttaaaaagggcactcaaggtactgaacttgataaggcatcaatggttaaggactttaagaagcaagctaaagataatttgttgatctccgtcaagatgaagaagcaggttgctgctgctcctaatagtgcgacaatcaagaatcgacagcaagcactacaaaaacggcttgataacaaagttaccttaaaaacatataataagtcgtttacgtttgctgctaagaaatggttgactaacggtgaagttactgcaaacggccattataaatttgacacaagcaaggtcacacattgggttgccaaatttgctaataaagttgatacacttggaaaatcactaactatttcaaaatcgggtaaaaaaattacaattccaagtggtggtacctatggctggaaagttaatcggcagtctttatcaaatgctattgcaaaaaatctaacccaaaagaatccccaaaatgttaatttaaaaaattatgtttctggaaccggctacggtatcaacggagttggcaagacatatgttgcagtggatctaacgaatctgcaggaatatatttataagaatggtcatttgaaagcaaaaattccggtgatgtctggtactttgacgggtggtaatgcaacgccaaccgggacttactttattatgtacaagcagcgccatgccacacttcgtggtaaaaatagtgatggttccaaatatgcgtcaccagttggttattgggagccggtgacactttctggggttgggctgcacgattcgccttggcaacccgcatcagtgtatgggaatcctagtgctcgagcccaatatcattctcatggatgtttaaataatccaccatctcagatgccaaaagtatggaagtatacgcatacgaacgaacctgttgtgatttataagtaacatgtggataaatgctaaaaaacgattagtatatgatgacgaaaataaaaatatttgattgaccaaaataaagaggctgtttcataaaagcaaaaatgctttttatgaagcagcctcttttaaatataatggttggcatgtcgtctttagtcagcaattaaaattttaatgcccaagtataaattataaatgaacatggccacgtccactaaaacaactaagacaagtagaataataagcatgatcccggttatctgtgaattctttgtggttagccctgtaataccaacaatcatcatggtaaggattgtgaggaccaaagggattaggtggagtagaaaggcatttctggcggtctcatgcatgtcttgatgatcagttgtgaccaaccatacaataaacgggaaaataaagggtgcgaagataatcgataaataggataacgcgttaactattttgttttgagacatggtaatttcctccgggaataatcagtcgtctagtttctatttggcatatgatttgtaaattggcgctctaaacaagtcgacatagccgccagaaccgtgataatctcttaaaactttaactttctgtttattaatagttcggtaagtcgttttccacccaccgtcactttgataggctttatctgctagggcattaaacgtatatttttcagaactgacaatttttgcaaccgccaattttttataacctttccaattactccggaataggccgtgggtttttcctttatatgtctgggttaccgagaacttattaatatgggtgacacacatatgaccattcacgtatgagtaccagtttccacgcaaagtttgtggcgtggagttataaattttttcagttttaaaataggaagcacttacggaaaatgaatgtgctagttctccaaaagttcctaatgttaatccgataatgggtaatgcaattaatttaaaaagagtttttgtcattttggttagtatatcctttcatatgataagctcagcttaatagcaaaattgataacagttaaacaactatataagcaatatatcgttttttgaaggttgttgtcaaattgttaacatttgtaatgaaaaaagagctgtcggttataaaaccggacaactctttttatgaagacggtatggtcaaaattgaccttaattatgattctgaatgtttacttcgacgggtagggtgatttttttcgtcttcttccaatttcttttggtacatcttatcagtcacatagggataagtccatttaatcattgcggacataatgattggtaacgcgatgaccaagatgattaaccccacaataacagcagtagcaacttgaatcaatgttaagacatttgatggaattaaagctgcaaacgtaccgcccaaaataatggcagctgagataacaacggttccaataattgtagccgaatgtagaattcggcgacgaacatctggaatagcactcgcgtcatctctatagcgcatcattaagaagatactgtaatcaacacccaacgcgattaacataataaagctaaaaaatggtgtgttccaggttaacatatctcttgccatcaggtagccggaaatccaacgagtaatctgtaaggatccaaagtaagtgacaattaatgtgccaatgattgtcagtgcttgaaccagcgaacgtgtcacgatcattagagctaatccaattccgattaacataatcgcaactgtacgtaggaagtcaccattggctgttttttgaagatcagctgtttgtgaactctgaccaccgattgcaacagtcgcatttttaagatcggtgttcttcagcctggcttttacgtcggatgaaatcgtccgaatacgtttagcagactgggtcgtacttggatcagaagtcagaacaattgtcatattagtgattttacgattcttcgacataaaagtatcaagagatggtgtaaatgaagaactttttaccgtatcggctggcatgtagaaggtattgccaagataggatttctgcatttgttttaaatagttgttaacagtattggtaccattatcaatttgtccaagagcgttattagctgaagttaagccctgttgcaatttttgagtctgggcctcgagctgcttcatcttggtattcaactcttgaacgccactattgacctgtgcgcttccactggcaacacttcttgctccggaagtaagtgtggtactcttctgctggagctgagaactaccctgattcaatcgatttaagccacttgcaaaaggtgttgattgcgaacgcaatctaccgaggcctgaagtaactgagcttgatccagctgctaatcgaccggcactttggcgaacagatggaattcggctggttcgtctttgtaattgacgaatgcctgaagtgacttgttgacttccagcttgtagttgaccaacaccggaggtaagggaggaagcacctcggctaagctgctgagaaccgctggaaagttgtccaacaccagcggtataggttgaaacgccctgacttagttgttgggcgccggcttgcaggctttttgcaccattggcaagcttttgaacttgggcggcattttgggaagcgttcgaactggcgagttgtttgttagcactcgttaaccccttttggactttcttcaaaccataatttgcctgatttaagccatttactaactttcctaattggcttttaagataaagctgttgaattttgtcaccacttggtcttgtaactgaagcaactgtcttaacgcctggctcggaatttaaatacccggtcaaatcatcaagctcagccaggtccttttgattgtcaagagactttttactttcgatatataacgttgatggtccggacataccagcaggatagtgagcttggatgacttcataaccagcctttgattggacagtatcaggaagctcatcggcattgttaaaattgagttgttgtgttccaaagaacaataatggaatagccgcgataactaatattccgaccatcacaaaggtatgagaaagtgtgattttagataaaagattccaaagaaagcttcgatcgtgggctgaaaggtctttgcttggccagaacagtttttcacccaacgtcgacataaagaacatattgaaagtcagaagaacggccagtaaaatggcgaccccgacagcaacagccacgcctgaacgataaaattcaaatttagcaagcgccaaggcggtgaatccaattaggacggaagatccgctgtacaaaatggttcgaccggcatgtttgcgggcggttctcgcggcagctgttgcatccaaaccgttttttatttcttccttaaaacgatcataaagcagaatattataatctgttccaattccgaaaaggacaacgacaaggaagacttgcgtaaagttggaaatcgggaaattatatttatctgccaagttcatgaccacgtttagggacattaagtatgaaagaccgaccgttagtaatgaaataatcgggataaataaagacctgaaaacaatgataagaacaataaagataaaaattgcagcaattatttcggttttttgcaatcctttttcggtaacagttgaaaagtcttcatttaaaatatcattccctgttacataggtccgtaaccccggtgttttaattttggttaaaagcttatccgtttgagaacgcaccttgtacttactaggtaaagtgaccataaccatttgagttgttttatcgtcggatgttagctgtttcttagcagcagagttatccccgggactggtaacgctgttggtatgtaaactggcatcactttttacagcattagctgcatcggtaatttgttgtgactgttcagaagtaatcttaccgttcttattattgaaaaccaatataaggcttcgaacagattttccgccagcagccttcttttgaattttgttggcaacttcgctttcaacgtttgatggtaaagaaattgcccctttatcacgaactagttgcgagatattcggcagggtaaagatagcaattagagctagtccaagccaaataatcaacgccaagacatgtttttcacgaaatctttgcattatttttctccccttctcctaataattaattataagcgaccgtttaaatttagacacttgtataagctatttgaaaatgataaactcagcatgaaaatgttgcaagtcacaatcggcaacatttgtttagatttagacaaaaatcaaaaagtgcaaaaaatgaatgaagcgaggccattatgaaatacgatctatccaaaaagcccacaagaggggcacagcgaacacttgatgctttttttaatacaatgctgtctctattgtctcaaaagacttttgataacattagtgttaatgaaatatgcaacgtcagtaattttcccagggcaacattttataattactttgacgataaatatgatttagtggattattgttggcatgttttggcggctgagattcaagttgacaaagtcacgaaagtacagtctgataaagctttgatggtttattttgatcggttatacgatatattcgaaaaaaatcaaaacgtactcaatcatattttaaaaaataatgatttttcaggaacgctggtgaccagctttgtgaactatcttaaaaatatgatgcagcaaattttctatgaatcattaaactattcaaagcctgaaataccaactcagttgatggcagatcattgtagtgaaacggtgctgcttattttggaatggatctttttaaaacaaaagtcaacgacaaaacaacaagcgcacaaatatttagaaacgctattggattagactttctgtcaaatgatcaagggatgacattgtggttgttgtcgccaccggcttcttgcatacctgttattataaacgttacgcagagccatctcaatgactatcatgaatcaaaacggggattgggttttcaatgtatttgttaacggatacataatgtgctagtatcttacctaacgtgaatcaactcacgagtatttttgatatatctaatagttaaggaagtgacatgatgtccctgacggcagatgaagctgctgcaacaatcgaagagttccagcagaattttgaactggccggtgtttctttagacacggcagccaaagatttacataccagcccgctgcatttaaagcaggtcatgaatttaaatgttaccagaatcgaagagccatggattttgagaaattatttggttaaaattattttaaatcatgaaagggaacccgttcccttttcaaagttaaccggtaatccaaagcgttacagatttttgaatcatcaatatattgaagaaggaaagcttgcgtagtagagaagaagcttaagtgaacttctttaatagttggaaatgaggtatcaacttaaaacgagatatttttgatcagtctttttgactgagctgaaaatatctcgtttttttaatactttcaatgattgattatttaacaacggtttgcatttttgatgtcaatttatcacctgcaaacattaagcttaacgctcgtccattcttaccagtggcgtatgtaacatttctggcggacacattaccatgaccggttaatgattctgcgtcggggacacctaatgttttgacaacctgggtatatgtttcccccttttgaacgttattaaggcgatttttggaaatataacggcgattcttaatgcttgcctcaatatagcccttaccgattgcgtgaccatttagaaattcaacggtaagcgccgaagccttaaaacttgtttttaaatttgtccaagaatattgaatggcggccttttttccggagttgttaactgtaactcgacttttagaatttggttttccaaatgatgttaaaatgacattttttgaagtaccattctttggcgaggtaacattaccggtttcaattctattgtaatctgctcgaccgattgccgatccgttacttgaaactctgaaagattgggctgttttttgactctcggatttattaggagtcttttcactggaatgaccgcatgcagcaagtgacatagttgttaaaagaatcattgatattgctattatttttttcaattaaatatcccccgattaatctatttttaaagtcggtacctagagataagcataccaaaaatattgattatagttacggaacttcaggaaattttagtaattggatcaggggatgttttaatctttggtgggatacatcataaagctgaatggcgacgtaaagtctgaagaaaaaaaggggcctgggttgcagaataatcgttaatgcaatctgtaaacagtagtacattaaataagcaactatttttttgttataaaagatgacatatatttaataaattagaaaataccagacaaaaaaacgatatttgtttcatcacaatgttatttattggtatgtataataacgtgctgatttttaagaaggatattgacaaaaattgaaataggtatatatttgtattcgtaaatcaatgttatatgatattacatgaaatgaggactgattatgagattagaaaaagattgtattggtgaaatgtttgtacctgatgatgcattgtatggcattcattcgttaagagcaaaacaaaactttcccatcacaagagaacacgttaattcacttattattgaaagttatcttcaaattaaaaaagctgcagcacttgctaatcaacaagccggcacattgaataaagaaaaagcgacatttattatttcggcatgtaatcagctgctactttcaaaggattttcgagcgatgattgttcctgccattcaaggcggtgcagggacctcgactaatatgaacataaacgaagttgtcgcaaatttagccatgaagattagtggagagggaagccaagaccccgtttcaattcatcccaatgatgatgtgaatcaatcacagtcaaccaatgatacttatccaactgccgggaagatggcaatgttaaaggctttggacccattagaagatatgttaaaagacctaacacatgcacttgaacaaaaagcggaagcctatcgaaatgcgattaaggttggccgcacacaacttcaagatgcagtaccgacaacttttggtcgaagttttcaagcgtattcctcaatgtttaaacgggatttgcagaaaatgaaatcgtttgaagcatctcttgaacaggtcaatctcggtggtactgctattggtacggggcttaacgcaagcgtgtcctatcgccaagcagttactccgattttaagccaagtttcgcacttatcattgactcaatcggatgatttggttgacgccactcagaatagcgatgtttttgcaggattttcagctattctgaaaggactggcgatcaacctatcaaaattttgtaatgatctccgcctgctggcaagcggtcctcaagctggattagctgagctttcattaccaaaggttcaggcaggatcgtcaattatgcctgggaaagttaacccggtcattcctgaggttgttaatcaggttgcttttgaaattattggtaaagacttgacggtgacaatggcagccgaaagtggtcaactagaattgaacgcgtttgagccgatgatatttagagaactattaatcagtgaagaccatttaacaaaggccattcaaacattaattgagaattgtgtgaccggtatcaaggtaaatttgacacattgtcaacaggaggttgatcattcatcgattactgcaacaatcctttcaccatatttgggttatgagcaaacgacggctctgattaaaaaatctgaagtgactcatacgtcagttaaacaagtagttaaaatggcccacctactacctgattcattaattgacagcctattctctcctgaagtattaaccaatgccaaaccaattgaacctagcgaatcgggctcttttgtgaacagtaatcgataattgataaatatcaatcaatataactttcggcgaagaatgaaaagctgccggaagtttttttgcgaataaatggtgagttaacgaatttttaaatatgcctaaggcctttatttctgcacacaattataaaaaagctctatacttaacttgtttatcatttcagcaagttaaataacttattacgggggtgaattatggcaaataatgaatctactaaagtggacgacgtggcaaagaaaagtcttgagggtttaatgactgattaccaaaccacttctcagggattagcgcaagaagaggctgataatcgactcaaaaagtatggggaaaatacgatccaagctgcaaaaaagcgttcagagatattgatttttgttgaaaactttacgtcaatgatggcgattcttctttgggcttcgggcattattgcaatgtttgccggaatgctagagctgggtgttgctatttggactgttaacgttattaatggctgtttttcatattggcaacaacatgccgctcaaaaagcaactgattctttaaaaaagatgttgccttcttacgttaaagttactcgaaatggaagcgtcaaacagattcgggaagaagagttggtccctggagacctgttcgcgcttcaagctggtgattctattccggcagatgccaggatatttaattgctcaaacctgcaggtagatgaatcctcactaactggggaatcggttcctgtggataagggagaccagtatcagcacggtgatggtgaatttgcccaaaataacattgtttttgccggaacaactgtgacgagcggcactgccagtggcattgtttttgcgacagggatgacgactgagtttgggagaattgcccaactaactcaaaatcagaaaaaggtgatgtatccacttcaacgggaattaaatcagttaaccaggcaactgacactaatcgccgttttaattggtgttgctttctttctattggcaatcttttttgttcattctccaatagcctcttcgtttatttttgcattgggcatgattgtggctttcattccggaagggcttttaccaacggttacactttctcttgctcaaggcacacagagaatggcaaagcgccatgcattattgaagaacctgaatagtgttgagacacttggtgaaacaacggttatctgttcagataaaacagggacactcactcaaaaccaaatgactgttaatcatatctggttgatatccaagcaatacgaggtgagtggaaccggttattttacaaatggaactgtgacatcagcggggcaatcggtcgatattggggaagaagctgatttaaaaattcttcttcaaattgcaacgcttgataatgatacggaagtaacggaagggaaaaaagacgaaaaatcaaagattttaggaacaccaacggaagcggcactagtgattttgtccaggaaggccggtattaatagtcgtcatgagaatcagaaatttcctcgcataaaggaattgcctttcgattcaaagcgaaaattaatgtcgacgatttcaaaaacccaaacaggaaagccaataatctataccaagggagctctaagcagtgagcttcaaatatgtgatcgcattctagatgctggacaaattagaacaatcacggatgctgatcgacaaaaagtacttgacgttaatgaaaaatattctagagaaggattacggtcacttgctttttctttccgggaggtggctggtcaggatccgcttgtggggcagaaaattgatgactataccattaaaacagccgaaacacatatggttttcgttggtttggtaacgatgtccgacccaccgcgaccggaaatctttgatgcagttaaaaagtgtcatcgtgccagcattcgaatcattatggtcactggtgacagtcctatcacagcgaaaagcattgcgacaaagatcggtattacaacagacaaagctcaagttattaccggtaatgaattggatcagttatcggatgatgaccttcaaaaggcagttaaaggtgaggttatatttgccagggtggcgccagaacataaattcaggattgtctcaatgtgtcaaaaaaatggcgaagttgtcgcttcaacgggtgacggtgtcaacgatgctccagctttaaaacgggctgacatcggaattgcaatgggcgtgacaggaacagatgtcgcaaaagatgcagcggatatgattttaacggatgacaactttgcttcaattgtgagtgcaattgaagagggccgaacggtctacagtaatctgcaaaaatttctattatatattctcaatagtaatgttcccgaagcggcaccttcggttgtgtttttgctaacgagaggattggtgcctttaccattaaccgttatgcagattttaacggttgatttgggcactgaccttttacctgcattgggcctgggaattgaaaaaagcgaaccggggattatggatcttccaccccgcccacaggacagtcatttacttaatagatcaatcgtcataaaggcgtttggattatacgggttggttgcttcaattatttctacctgtgcctacttctttgtcaatggcgttcatggatggccatcggtttctctcatgtcttccggaacaggatatgccgaggcaaccacgatgacattgggagccattattttctgccaaattgcagcagcaatgaactgcaggacacagatttcgtctgttttttccgttggcctttttagtaaccggcggatatggctgggaattattgttgaaattgtgttgcttgcagtgttgatgtatacaccatttttgcaggcagtatttaacacggggccgttggatcgtgtagaatggttcttcttgttctgtattccaattccattatttttactcgaggagttacgaaaatggattgttcgaaaggttgatagtcgtcattgatactgaaaaaaattcggccattaaattttgggcttgaaaatggtgagtattgaaaaagagtctgggtctaaattgcctaagctctttttattttctttatttttgttgcatatgcaacaaaaatagagtaatataaatttgtcaaaaaaatgatataggaagagggatgtattttggttgatattttaaggtcgatcggtgtgattgcaagagcgctggattcgattgcaaatgttgagttcaagcaatttgatctgtctaaagggcaatatctgtatctggttcgaatctacgaacatcccgggataattcaagagcgtttggcagaaatgattaaggttgaccgaacgaccgctgcacgggcaattcaaaagcttgaaaaaaacggttttatcagaaaacagtcagataacgtcaacaagaaaattcgccggttgtttgtttcaccaaagggaaaagagattgcaccgatgattcagaaagaaaaccaatattctaatcaagtagcggtgcaggggctgtctgaactagagaataagcaattggctgagctacttaaaaaagtaagctataatgttaatgctgattgggataaagtcaaaaagggccaacagagaatttattagtatggctaaaggggggaagttaattggcagtattattaagagagtgtacgttggaagatgttcaagctcttcaaaaaattagttgtgaaacgtttacggatacgttcggagatgtcaatacccaagaaaatttagagaagtacttagccaatgcatatagcattcggcaattaaagagcgaattgtctgatcctgaatcggcttttttctttatttatcaagaggatcagttagcgggttatcttaaagtaaattttggcgataatcaaaccgaagaatatggaacagataaactcgaaattcaacgaatttatattcgaaaagcatttaaacatttaggtctcgggacgcatctaatgcacaaagcttttgaagttgccaatcagctgcataaacatcatatttggttgggcgtttgggaaaataatgtaacagcccaaaaattttaccggaagttaggatttaaccaaattggtgaccatgtttttacgcttggtgacaatcgtcaacgagacattattatgtcgatcgatatctaattggaggatcaaaaaatgaaaaaattaattgttgatgaccaattttggcgtttatttccagaagctcaaatagatactctaacgcttcgtggaatcgataatcatgacaaggcaagggatcacgcttattttcagcagcttttggatgaagcagcaagggaatctgaacaatttatgacagaaggcatttttcggaagaacccggttgttgaccaatggcggcaggcctatcgacaattcaagacgaaaaaaggggcccgctcatcaattgaagcgctcttaaagcgggttgaccaaggcagaagtttctcaccaatttttccgttagtggacatctataatagtatttcgcttagatatggtgttccggcgggaggagaagatttgaacgccattcagggaaaccttcacttaggggaagcaaagggcggcgaagactttttcccacatggtgcggaagaaaattcaccggccttaccaggtgaggttatttattatgacgatcaaggggcggtctgccgttgctttaactggcgtgaagctcagagaacggaacttaccgagtcgacgactgattccgtattggtcattgaatcaatcaatgctgagcaggcaaaacgtgcagatgaggcaattgaagcgttacatcaactttgtaaagagaggtttaaagtgcctggtcacatccagaaagtaacacgtgacaatcgggaaatacaattaataaaataaaaacaatctaagattagatccagagtgggacaaaaaaggttaacttccagaatgcaattggattatcctgagattcggggcttgaatagtgggatgcgattgcacggcaggaagttacctttttctacacgtctttgctcggtcataatcgtgatgaaattaaaaaggggctggacaaaatgacttttgtctcggcccctataattgttatagttatcatgattgaactaaatacctgaaagaaaacagatgattatattggtaacgctatatagatagctcggaatcagcttatttatacttatttgcgatattataggtgacttttccctgatctactttcaataaagtctgctttttaccgtccctggcagtcactttaaactttgagtaaagttgattggaataaacgtgtttaaatgaatttgaacggcgctgtacacgtgtaacaaacgtattccaagttgtgggtttacccgcttttaaatctttgacggccttaccagagtttgagactttaatagaaacgcccttatttttatcaactttaatttttggtttcttaccaaacggggttttatcctgtgtgttaaataagtattgatttaactcacgtccgaccgttttatgccctggaccatcttgtaaacggcatgaagtggcaaagacaataataatcaaaaaagcgccgattaacattgcgatccgaccaagtggcgtatcgttccactgaacgattctttcaactcgtgagttaccgagctcgctttcactcagccaaggctgtttggcgccacaatatgggcaaaagtttgcgtaagcgggaattgttttcccacacatgacgcaaactttagttttctcctgcgacattctaacttcctccaatatgtacctaaataccttcaatcattcattatagcaaatctggcttaatacgactataatgcatccctaaaactcggcccaacaattattatacatccggttattcttaaatgtgtcttttcaacaaaaaagactgcaacctgtaatattcaggaagaagcccattttttggataaaatttaacttttaggtaaatgtttgtcaataaattccttgacgggaagccgaaaatcgaggtagtatttttcaatgtcttcacgtgaccaattccaccaggcgattttttccatatcagtctttacttcgtctggaaaacggtccttaattggttttgcagggacaccacccacaattgtgtacggttcgacatctttagtgacaacagcgcctgaaccaatgacggcaccatcaccaatggtcaagccggcttggacaattgcaccatgaccgatccaaacgtcattgccaatggtcgttctgacgtgggatcttttttccagaaagtctttgtccgggttgtcgaatccgtatgcgccgccattatataatgaaatgtgttgggcaggtcgatcatagggatggttagttggtccgattcgaatcattgcagccatactgataaatttttttaaatcgctattttgaataaaacagtattgacctgtatacgtataatcacctattgtactattgtcgatgagattacttgcaccgatttcaacccattgaccgaaagttgtgttttttgtttggctattttttccaatcgttggcttatcctgtgataatctgacaaaatcaatatgcataaagctcaacttctttctctcaaaatttactactggtatattataatattcttcaacaaaaaggaagctaaaaggagcttaaaatgatgtatcaagttaaaaaaatcgatcccttcaatgtcactgactttgccggcgatgtttttcaaacatccgatacagaaacacccgatgcagtacttgtgagaagctctcaagttgatgattctttaattacgaagcgtttattgctggtcgcacgttcaggaaccggtaccaacaccatcaatattgacgcctgtaccgaaaacggcactgcagtttttaatactcctggggtgaacgccaatgcagttaaggaattgatcattcaaaatttatttcgttgtgtgcgtcctttaaacgaggcgatctcaatggttgatcaacttcatgtgggaaatgaagaaagtcttcaagaagctgctgagtcgcaaagaaaagactacattggtcaggagctttacggtaaaacacttggcattcttgggcttggaactattggtcagcgattggcggatgcctgttatcatatgggaatgcaaattattggttataatcgcagtttcaaaaatttacgccatgttcaacaactggaaacaattgaagaagtgatggcactttcggattttgtcgttttactattgccattgacaccgcaaacagagcacttgataacggatgaacagtttaaactgatgaagaaatcggcctttttgttgaactttggtcgtggcgagcttgttgataatccggcagtggttgatgccttagatcatgacgaatttgccggctatgtgagcgattttcccaaggcagaacttcaacatcattcaaaaatcacattattaccacatttgggcggcaatacaaccgaggctttaacgcacagtgctaatttaattttacaaaatttattggacttccttgaaaatgggactgttcgctcatcagttaatttcccacgtgttgacttaccgtttatcagcccgcatcgattaaccttcttttttaaaacacaggaaaacgtgatggctaaaatttcgtcattactaaataaacgcgcattgccggttatggaaatgatgaataataaccaaaatgggtttggctacacgattgtgaatacggatttttcagatttttcagacgaacaggttacaaatttagtcgcagagtttgcatcaatgaagggcatgcttcgggtccgcaaactagaccattcaaatatagaaaattggcaaacggattagattaatccaattgctaatttgaggctgagcgtgttgaaaaggcatctcggctttttgtatacttttttcatgaatcctcgatttttgccggattattgtttcacgatccagaaatttgtttaagattgtgaaatggttacggagagtaaaagtttgtaaatatcaatctctggtttacgggggaaatgatgaaaataaccttgcaaaaatacgctaggtgcggtacaaatagagatgtaagcggttgttataaaaacattgaatggaagattcaaagatgaccaagtagtcagaacaagtgcaaagataatcatttaagtaacgactttgtgaataagcttccattttttatttgttaatgattgctcatttaataacaaatttaacgattatggagatgtgattatgcgaattaaagcagcggttgtaaacaagaaggacggcaagttcgaaatgaaggacgatgtcgaattagctgacatgcaggctgatgaccttcaagttcatatggttgcctcgggtatctgtcattcagacgaggctttgcgtaaaggaacggctgaaattggttacccaattgttcttggacatgaagggtcaggaatcgttgaaaaggttggtccggaagttaaggactttaaacccggtgaccatgttgttttgtcgttctatggctgtggaaattgtattaattgcttaaagggtattccaactcaatgcttgaattatgctgcaaataatttgtcaggtgttcgtcctgacggaagtgctcattttactgaaaatggccatgacgttgccgacatgtttgatcaatcatcattcacgacaacaacggtcgttcgtgaacgtaacgccgttaaagtttcaaaagatttggatttgcgtcaactgggacctttggggtgcggatatgtcacaggcagtgggactgttttcaatacgctgaaaccggaaccaggttcaacaattgctgtattcggtactggtgctgttggcttggcagcaatgatggccggccgtatctcaggatgcacaaaagtgattgccattgacattgtgccttcacgccttaagttggcaaaagaacttggcgcaaccgatgctattaatagtaaagatgaagatgctgttgaagccatcaagaaattaacggatggtcatggtgtcgattatgccgttgacacaacgggtgttaagaaggtcatggaagattccattcaagcattggctcaaggtggtacaacagcaactatcgcggttactgatcaacacattgatttggatacttggaacgacctttgcacaagtgatcgtaagattgtcggtgttaacatgggcgattcaattcctcaagttgatattccacgtttgattcgtttctacaagttgggcatgtttgattttgataagactgagaaattctacaagttcgatgacattaatcaagccaacgctgattctgtcagtggcaagacaattaagcctgtcttggtaatcgacaatgattacaaaccgggggactagttttagttagtcatgtttaatgattgttgacattgaatattgaaaaagcattctttcctgccatcaagtcttttcgacaggataaattggaaaggaagcacaatattatggcacaaaatgctgtagcattaaaacattatcaaatgtatattaacggagaatttaaagattcagagtcaggtaatatgttgacggtactgaatccttcaacgggagaagcaatttctactgttccaagtgcaacccgtgaagaaacaaaagaagcaattgatgcggcttatgaagctgaaaaatcatggaagaaggttccggctgctactcgtggccaatatcttcatgatgttgtgacagaagttcgtaagcaaaaggatcacttaattgaaatgcttcaagaggagcagggaaagattaagtccttggcaacaactgaaatcttgttctcggctgattactttgattatatggctagtgctgctcggacatacgaaggcgaaatccttcaatccgacaacaaaaatgaaaacattatgattgctaagcaaccaattggtgtcgctgccgggatcttaccatggaacttcccattcttcttgattgcccgtaaaatgggtccggctttggtaacaggtaataccattgttatgaagccaagttcggatacacctaacttggcacttgaatttgctaagatctgtgacaaagttggtattccaaagggtgttgtcaacattgtttcaggaccgggttcggtcgttggtgatgagttaactcgaaacaagaagatcggtattatcagtttgaccggttctgttgaatcaggcaagcgcattatggaaggtgctgccactcatatggccaaggtatcacttgaattaggtggtaaagcaccagccattgtttgcaaggatgccgatattgatctcgccgtacaatcaattattgactctcgagtcgataacaatggtcaactttgcaacaactgtgaacgggtttacgttcaagaagatgttgcggacgaatttatcaagaagttgtccaaaaagatgtctgagattacggttggcaacccaatgaaagatgagaagatcggtatgggaccattgattaatcaagcagctttggataaggttgccggaatggttgatcgtgctgttaaagccggtggcaagatcacggccggtggtcacaagctgaatattgaaaatggattctattacgaaccaactgtcattaccaacgttaaacaggattccgaaattgttcaagacgaaatctttggaccggttcttcctgtattaacctttaagacattggatgatgccattaaaatggctaatgacagtgactttggattgacttcatcaatctttactgagaatttggataacgcaatgcgtgccgcaaatgaacttgaagacggtgaaacctatatcaaccgcttcaattttgaagctatgaatggttctcactccggctggaaagaatccggtattggtggagacgatggtcgccatggtattgaagaatacttgaatacccacgtcatctacctgcagggtcatcctgaaaaggctaatggttaatttagaaacagatagttaatctgctatctcaataaaaagaagttgaaaacactgttgtgtgttttcaacttcttttgtatccgaagaaaatggtcaaaggactgatcaccaatggacattttgctatactaattgtaaaggctttggagggattttgatgtataagatgattgcgtttgacttagatggcacagtagccgaaacttttcccgtgatttttgattcatttcgcaaaatcgtttataaatatacgcacaagcgaattgatgatcaaaccattttagcgacttttggagcaaatgagattgggatgttaaaccaattgatccccaatgcgccagacagaattttaaatgatttttatcagcaatacaatgccagccacgctacattaaccgaaccgttttccggcataaattctttaattgacatgctggcagctcaccacgtgcaaacgccaatggtaaccgggaaaggatctgttagctgccggatcagtctagaaactttagggcttcaaaaccggttttcaccaattctgatcggatcctcaacgggaccgaataagagtgaaaattttcagagattactatctcaatatcaattagcatcggatcaaatggcctatgttgcggatacggttggcgatattgaaagctgtagagccgttggaattgactgttattcagcagcttggtcgaagtatgcagatgttgataagcttcaagaggcaaacgccactatttttcgatcagttaacagcttaaatgactttttgaaaaaaatgatataagtcagttaaaacgtagaatgatttctgtttgacagctttcaaccttgattaattgttttgattaaacgtatctcccaacaattgaatgaccatacttggatggtctccgggggtggctctgtaaacggcgtaatcgcctggttttaaatgattattttgcagcgttgccgaacctgcaacactaaaacccgcaatttcataataagcatggccatctaccggttcatctgttagagtgacatccacggagtcaagaggcgcaacatccaacgacgcgcgtcgtaatgctagatattggtagctgacagcatcgaccgttaaagttatttcattatcgttgcagggcatattaaaggtttctttcaatttaagtaacttccttttcaagtaggcaaataagtacgatctatctattattgtaaccgtcctattggtttaaaagtacactaacgcttaattggtgttaacgatagtgctaataaaaagcacccaattgaccaccacaaggtccgttgggtacttatcagtcaataattaatgaacaatctctttaaacattagttttccggctatatctcgaccacttacggtcattaaaaggggcagatcgcctatgattttaaagccgtattttttatataaatcaattgcatgaaggttgccagaaataacatccaggtaaataccgtgcagtttccaatcattagctgcccagtcgatgacctgttccattagtgtactgccaatgccctgattccaaaaatcctgatctactgaaacggcgagatccccgcgattgatgtagcgtggtaagttccttctggaaagctgagcgaggccaacaatctcctcattttcaaacgcagcgaagaacactgttgcattcgcatcgtgcatttgatcagaaattttaatttcatctaaatatttatgaatatctttttgactgtaactaaggttattagtctgaccactaaccttcattaagtgacggtaaattaaatcagcatctttaggttctgccatttgaattttggccatcaaaaattctccttgtctatatttattatctttttaattggtgtttgtcagttgagagagggaagcctcttctaaaagcagtcattaaaaaattcagcaatggtggtgtgacttttaactcgttcaaatcccgtaaggagaaggtatagcgaattgcctgttcatcttcagcctcaactttttgaacccactgaggttctcgaattaattcacgacccattgcggcaaaggaaacacctgaatcgattaatttttccacttgagcaggtgttgccaaatgtccaacaacaatgaggggtaaatcgtcagctaaaacaactttaattttctcaaataccggctgctggtcacttctgtccacaattgagcttccccaagcatctgctaacgaaaggtgcaggtaatcaatcggctttttgtttagttttgaaacgagtgcgattgtatctgaaatcttgatcccgggttcttcgatttcttctggagaaattcggtaaccgagaataaaaggcgagtctgcaaattgcttaatggtgtcggcacaggcatcaacaactgccaacggaaacttcatgcggttttgtaaggaaccgccccattggtctgcccgtcggttggagtggggactaaaaaattgttgaagaagataagtgttggcaccatgcagttcaacaccgtcgaagccggcttctattgcgagtttagtcgcttttgcaaaatcctcaatggtttgagtgatttctttctcggacaatgcccgtggggtttcagcgccatgtcgaagtgcggaaacagcacttgcagaaacgggttgttggccgcggagtacttttgagttagtcatccgaccggcgctaaagatctgtaaaatagctttagtgccattcatcttaatagcatttgccagtcgggacaagcccggaagcatacttttatcagcaacacttagttcgccctcaaagccctttcccaagtcattaacgttggcacaaccggtaatcaacatgccaacaccaccggtgcgcaatcggtaataattaatttcgtcgctggtaattgacccgtcttcaaaactggactgttctgtcattggtgacatgacaacccggttttttattttaacaccatttcgaagtgtatcaggttttaagaacttgtatttagtcattaaacgacccccattgtagtaatcaacaagcacaatacaattttagcataaaagtcaaattaagatggatttgaaaaacgcattatttcggcttttagtcgtaataatgcgtttaataaagtctaatcttaacaaaaagataaacagtgtgaatgattgcttgggtgcatataaaatagtgataaattatcgcttagacaatacatttgtttatgacaagatcttacccggtagtaagggtagtggctatgacacgtgaacacttttcttgacggttccttcgactaaaaaactgatatcgagtggagaaacggcatttgttaagtttccaattgagataaagtcagcgccgcatccgctaaatgacgcgattgtgtcttcggaaatccctccagaagcttcgacatggatgttgtcaggaacaagttttttccatttcttgatagtggaagggtcctgattatcgaacatgatgacatctgcaccgattgaaatagcatcttgaagttcctgtttggtttcaacttcgatttcaataggggttaacggaccagcgttttttttggccattaataaggcttccttaacgccaccggctaatgcaatatgattgtcctttaacatgatggcattcgtcagatcaaagcgatggttaaatccaccgccaacggtaacagcatatttatcaaatagccgtaaaccgggagtcgtttttcgggtatcggtaatttttattcttggatcatttagttccgtgataacctgtgccgttttggtagcaataccactcattcgctgcattaaatttaaaatcacccgttctccggttaaaagggttgcagcggccccaacgactttaccgattttttgaccggatgaaatgtgttgaccatcagaaacaagtgacgtgtaatgagcttctccaattaaattataggccagttggggaagctgttggccgcaaacaataccggattgttttgcaatgaagtaaccggttaggactttatcggttggcaggtaactgacgcttaaatcaccgaaaccgatatcttctttaagaaagccagctagtttttcgttaactaataatgggttcattgaattttctcctcatgattgggtgaagtgggcagtgcaaggacggcaacggaaccgataatcagtgaaatcataaaaataataaaaatcacgtggatattaatttgacgatccatcaaaacaccaattaaaagtggtccaaagattgcgccgattcgaccaattccttgtgccatgccggtcatggttccgcgaatgtcatttcgataaagctctggggttaacgcaatgatggcaccgtatgcgccgaggttgaagaatgacagcacacaccctgaaatgacaatcatgactgcggtagtagattgaccaaacatgatggcaccaaccgccgttccgagcatgtataaagcaaagacgtacttaacctgtagtcttttggccaaccaagcagcgcaaaaataacccggaagctgtgcaacaacgataatagttgtgtaaccaaaactgttgacaataccgtagcctttatcgaccataatgcttggcagccacataaacataccgtaataactgaacataaccataaaccaggcaagccataacattaatgtccatggtcgaaaggtttgtttaagcgaaaccagccaattttgtgacgaacttgtttcaggctgactttcatgaatgtgttttcgaagaataatagcaaagaatcctgtaatggcagtcacaattaaaagaccgcgccaaccaaggacaggggttagcaggaatgataagaaagaggctatcaaccagccaattgcccagaaactatctgctaaaataagcatttgagaccgcttaccgcctttatagatatcagcaatataagttgcagcaaccggaagctcaccgccaaggcccataccgacaatgaatctaattgtcagaaaagtgtaaaaaccaggtgatccggctaacacaaggttaccgatggaaaaagtcagtagggttgcaatcaaggtgttttttcggccgattctatcggctaaatgtccaaaatagaagccaccacaaaccattccgactgtactgattgagctaattaaaccggtttgggaattcgtgagtgcccattgtttgtgtacaatcgacataataaatgacaacaaaccaacgtccatggcatcaaacatccaagcagtgccgataattaaaaagacgagggaggttgtccgttgctttacattatccataataaagaaaaactcctttcaaggtgataaaagtatttaatacttttaaagcgttaaaataaaagtaaaatttactttaaataagagaatacgccattggctggaaattatcaagggattcttggcataaaattaaaaagaaatgtgagttaatttgaaaatatcaaaggcgatgacgtattcccttgacaagaactggtcgttcagatgaaaatggaaagcagtagtcttttgatatgacaagaaagtaggaacaatatgcaacaatcagcagtaaatttaagtcgcgatcaagcaatcaacctgctggaaagtgcaaccgggatgaccttttcgacagaacaacttgcaattctgcggcagccttatcagcagccgacacttattaatgcgtgtgcgggttctggtaaaacgaccatctttatgttatccgcactagtcgcaattatgacagggaagatctctccggaaaatgtattgggcatcacgttttctaaaaaagcccaaacagatatggaaaaccgttatcgacaatacctgatgcaattgaaagcggtgggaatagacctagcagctgagggtatgccatactttagtacttttcacgcacttttttacagattgctgcgaacgacaccggaatttcgtgaaaccaaggttctcacaagctaccgtcaattttcattgccgttaaccagactgattaagcatacgcacagtcaggtgaattctccgtctgaaatattggataatatgtttgaacttgctgaatttatcattaataggggcatttctcataatgcgtttgcagatttgtctgatcccaagcaattaaaggcgcaattgggtgaggttggagaagatgaatatgatttagatttctatactgattatcttgcagttatgacacagtatatgattctgaaacgtcaaaatagttttgttgattttaatgatatgaagattttgctgcgacaattattggatcaacctgatcacgtaaggtcgttccatcaaattatgagtcgatttaagttggtcgtgatggatgagtttcaagatatagacaaccttcaatgggatatcatgacccgacttctttcgcaagaagcgttatcgcgattaattgtgattggtgatgatgatcaaagcatctattcatttcgaggcagcaatccaaagtttattttaaaattccatggtattttaccaggtgcaaaaacataccgtctttcaactaattatcgaacaggaggtcaaatcctatccgaggccaaacctttaattaagcataactatgtgcggttggcaaaagaattgaaagctttcaacgaaaaaaagggacaggtacacgtttatcctctgaagactgcgggatttgatccgaacagcgatatgtttaccaaattagtttcccaaattcgtgatccggagattgataaccaccaaattgcggtgttggttcgatataattctgatagaacattggtcgccgactggttggccaatcaacagatatatgtcaacattaataaccgtggtgctatctttcaacatacgctgatttatcggattttggttaaccttatgcaggcgttttggcaaaaccggttccaaccatttcatgaacaagccacacggatcggattcacgacctatcggaggcatgtaacagaaattgataaggctgccggcggaattgattcattgtctgattatcttgaaatcgcaacaaaatataatttgcagcatcaacgaacggagaatcaaaaacggtttgccaaaatagatacacgtgttcgaatggcatttaagattattaaagagcagcgtcaggatgttgaaaaagccaactctgaaacgagtattggggatgtctttatgcagatttggaataccgtattggaattaacggcaacttattttgattatatgactaaaaatgactttgtttcaaaagatacattcaaggatatgaccacttaccttcacactgaaataaaacagataaccgatcccgatgtttggtttgaccaggaagatcaaaagcgtcaattattggaagccaacaatcaaaaaggggtgtcattggaaaacgatgtgcagtttttaagccttcatcaagctaagggactggagtttaagtatgtttatttatatggactctccgacaaacaattaccggttggtacaaccattatcaacgattggtttcatccggatatcagtttcgaggactttattgatcgctggaacgatttggtgacacgtcaacgtgtgaaagaattgacaggtattttagaagcagcttttatcgatataacagaagaagttcgtaaaaataaacatattgatttaaaccatatcgaaattgaaaagtgtcatgatttggatttggatttacttcataattggtacacggcaattcgtcactattcacagtttattgaagaagaacggcggttgatttacgttggtatgacgcgtgcaaaaacagttctaaatgtcagtgtcggattaaatgcgagtccgttgctgcgacaggttcccattgtatccaaagtgatgcaggctgaaaaagaaaagaagtgcaaggccaagtccgacgatcataaataagcagaaacatagacataaaaagcagctcgggataatcccaggctgttttttgtgtccgtcaatatagatgatcagttgtttttaggtcaaaaattaaagttctccgcctttttcaaaagttggcaccattttttcagcccttagcaaaaccagttgatggagaagatcttttagattatttgtgataacggctgcaattttatcattcattttagtatgccattcgggcaaatcgtttttggaaacattttcaaaagcttgatccgctttggcaacggcttttcggccatttgcaaacccgaatttacggctttcagaaacagcggtcatggcgtcccaatcgtgctcggcaaagaatggatcagccaacatagcaattaatttatttaaccagtagaaactttcggttgttgttctctccggtgtgtttttgaagttctcgggtgtatcaaggcagttggcaaagaagggaacgggtgaattgaaaatattcacaccttcagccagccagtgaattgcagcatggtcggcaggaaaatcggggcgaatctgtagaatatgcatttcctgatttcgattcatgccaattggccggtaacgagaacgtgtttccgatgttcctgttttgccgtaagggtcaaactcagtttcttgataatgactgctcaaaataaaggcgacatcttcaattgaaaccaagtgtgacggaacacgactaaaaggcatcgttcgactttccggatcctgaacgatctctgggttgagatgtttctgaccgtaccaaacccggggcgtattgtaatagtggtcgctttgaacatcttcaccaaagatatctctgaagttaaatcctttagaggctttattcagatgatatttttcggcaaatttctttaaatcatctgaaaacataaaatgttgcggatcgttaaaatcaatttcttggatgccggtttggttgggtgcgatgacataggtatcatcaggaattcgttcagcagcccagtgatgaccaccaactgtttcaaaataccaaacctcatcctgatccgaaaaagcaataccattgctttcacaagtaccatattttgttaccaaatcaccaagtcgacggacaccttctcgcgcattgtgaatataaggtaatactaccgtcagcattgcttcttcgccaatgccatcatcaactaaaggatcgagtcccagcatggttgtatttgtgaattcggtctcggtagaactcatcgcgacgttatcagtgttgatacccgattcaccccacagaccgtcactaacatctgcacaaggcgtttcagtataacgaagcggcttgtccggcaattttaaccgaaaattgttaaaagttgatatgtaatctttaggctgatcttccggctttacgacaataaaccgctttgcgttgataccgctgccggcatcttcatttcttgcaatcatcgttgatccgtcaacggtggcattcttgccaactaaaacagcggtacaacttgaaatatttcttgttgtcttcaattaaatcaatcccttcaaaaattttgttcctttctagcataaccccaatagaccattttcgggaataaaattgatctgatgaacaacaaattagggtgagttactttttagcaagtcgataaaaaacgatccaagataattttagaagcaaattaatcttagaccgcgtataggctggaaattaagaaaaaacggaagtcgtggttgtttttggaaaaatcaaagcttgcccataaacccaatatttttgaaccttctgtttagcggaagttgaatgagtcttgacctttcctctcagtacgttggctttagaaattcgataccaattatattgagttccttggaaggcatataaatcaatatgaacggcactattaacaataccatagctgctcattcttgcctttttccaagaaattgttttgatgtttttataagaactggttgggacgtgattgtaaagcttaaacgacttgtaatttgaaccgattgtcgcaaattgatctgttttgtgataagtaagggatccaggcatactttcggttgttgctgctttagcagaagtcgagatctcaacggttgccgtgaacatcaggccagctgcaattatcggtaacactaagttggatttgaacatcatcaaacactccattcattaaaaataaagactccaagtcattaaattctattttaattatatcgctgaatacaaaaaaagacaccccgatcaggatgtgatagggtccctgtcaagtgcaccgatgaaaaacaaaaatctcagaagttctatttagacgttttatgcggcttgattccgaagttccttcggagtcaggccgttattttttacagttcttcgttt

SEQ ID NO: 454 - DNA, 48088 bp, Unknown
  Metagenome-assembled genome
cttctcttaaatcacgtctcacatcaaattcctcctacactctgatgtgattcatgatacaaaaaatgtaggaaaaccaacagttctaacctgccgttttcctacattttacgggtgccttttacaagctaccaaattctaagttaattcctatcaattcaaaggaacatgattttgatagagaagtcaatgaaaccaaccttgattgttatcgaaaattaattagctggttagatgccgtaacagaacactgattagctttaagagataaacaggagtgtgaatttttatctactgcctaccatgtaaccgctttcagaattgtttatgatgaacttgttaaataagttgttcaactgtgagcatctttaccgtagattttgctaatacaaggagcggtttaaatgaaacaatatattgctagtggcaaagaggtcacctatagcgcattgggaattggtatatttacctttttctatggtcttatatccggatcattagctttctggatggccccagtagcattcatcacatcagcattttatgctggaatggacgaatcaaagaaaaatccgtggaacgtatctctaagttttggaatgggaattatttggggcttaattgcttataatttatttcaaattccaaatatgaatatgctttggtggacctcaagtgtcttcggtataatggctctcattgcaattctacttcaaggaacgcttcttaaagcaacttttattccagcttggttactagcttggggaacatttatggaaatatcactaaatataaaaatcaataattggtacgtctttgttctccagttagcttgttgtatgcttttaggtgttttcttcttagattatggttccgacttttttaaagccgttatgtatcgctggtttcccgaaaaggataaggatcagagcgacccaaaatcaaataaaaaagttaaaatagattaattatagttacggccatcaaaaaagatggctgtttttttgttgacaagggcgaatatatttagcgaaatatttttttaggaccacaataagcccacttaattatttttagttatagcttataaaataagccaacctatcaaacaataatattattcatcataagagcggaaacgccttctactgtaatacttgctctagttcacaagcactcctgtaagactaagtacctcacggattactaattacaataatgacatgctcgatccaaaccaaacattttttaagataaacaaggccctaaaggtacaagaacaataaaagcagtccttaatgtttgccattgaggactgctgtactgacttccttattctgttagctgtttatccttgaaccaaattctttttatcattcgtaaacgtgaatagaactaatccaaccaacagtagaacagctgctaaataaaatccgatttgcattgaaccaaattgatctgaaatccatcccgttaagtagggagccaaaatagaaccagacattccaataaaattatatgcactcagcgcagttgataatgatcctcttggtgaattcttagtaacaaatgccacaagaattggatcaattgctaatttaccggttaggccataaacaattaataaaacaatcaataataacttgttagttacaaaagcaattccaaacaccgcaaccagtgaaatcggcactaaaaatgcaatcattaattttgtcttttttaatttatcataaattcttgcgaatacaattgcaccagggattgaagcccatggtactagtgatgaaataaagccaacactacttccttgaaatcctctttctacctgcaaaaattggggcagccaagttaaaattacaaaatttgcgtaaatagagcaaaagcataagataaatgcaaatactaaattccgattcttgaatagatccttaagttggaccttactttcttccgattttttaacttctgcagttttttcagtgtttccttgatcttcaggacgaataaccttttcttttaatactacataaaacaaaacgccaacaataatagttggtaatgccataacataaaatggtgtttgccatgccattccgtgctggagcaccatactactcgataaaagatagccgccagatgttccgaatgccatcccactattaataatggcagttcctaaggttaaatctttagtcggaatagcctctgtagataatgcatattgaggcccatagtaagttccttggccagcaccagctaatgcacgaaataatagaaaaataccaaacgaaaatgcaaacccactaaaaaatgtcataattcctaatacaataaaaccgcccatgataactaaacgtctaccaacccgatcaccaagtatcccaaagggaatttgacaaattgcatatgttagaaagaaaatactgttgactaatcccaactgtgtatttccaatatgaaactgagcaccaatttgctcctgcacaggattcaaaatagtccgatcagcataaattaatatccatcctacgaaacaaagcgctacaactttccaccaatatcgtctcgatacgttcactgcagcttttgatttggcatcgatattttgaatattgccatccattatattcactcccataaattaatattgtaaaaatgcttcacttacattatatggaagcgctttcttgttttcgtctatgctttcagctaaatttctaatttatttttatccctgaaagagcatattctgtcataaactatttgtcatcatatccgtacaggctaatttaactatcgaacttattttcactaaacgtcatacaccactcccacacaccttccgacctcatccagttgataaactgaataagtccccgccggaaatttctgctcccaaaaattactttcaggaaaaaatgattggttaatcactcgcagcacgccaagatgagcgaccagtaagatgtgatcgtttgaagcagcgtctgaaagaatgttcttaaggcccgccaatactctggtattaaagtcttgaaagttctctccattcgtaggagaaacatgaaagggatcatcaagccagttttgccaatcctcagggaatgttgcttggatttcatcagcattaagaccttcccatgcaccaaaatgactttcctccaattttgaggatagttgactatcgctttccgggtgtgtcgctataataggccgggcagtttgccgggctcgttttaaatcgcttgttacaatgagtcctaagggcaatgcttcaaatttatctgctagtttagccgcgtctttgcgcccatttgcattcaacggcacatcagatgaaccgtaaaactttttctgttgattgtaatcagtctgaccgtgtctggcaacatataatttcatctcgataccacctacattaatttggtaacaatgacatacgccaataggaaaatgacctgcgaaatttccgcaaaaccgcccagcgtatcaccactgaagccacccagcagggccaacatataccgtcgatagccgtacgcgacaatcagtacagccagataactaataaggccgggatatcccagcaatacgccaataacaacaagagaaacaacctgactgataccaatccgccacgtcttaattccctgccaaatagtcgcaagtcccggtgcttcaccagcatacgtcattttataaaataatagtgaaatacctgttttggccatcataacgctgattagtacaagcatcgttaactgaaagcgatcaaacctgacggccaagattgcccctaccccaaaaaggatcgcataaaaataaattaacgctagggttcccatcgtacccagccgactgtctttcataattttgaacattttatccggtgtccgcgatgacataacaccgtctgccgtgtccgccaaagcgtccaaatgaaaaccaccggttatcatgccatccgtcatccaaaacaacatccatgcaaaccactgtgggaaaagatatgtatagcctaaaaataaagtggcctccaagcaccctaatatcagtccaaacagcgtaaagtactggatattatctcgaaatttatgaccggggtctttaatttcaaccgggattcgaatacgggtaaaaaactgagtatataaaataaatccttgaatcatgtcttttcggtctccaatcacaattaggttaaactcattagataactgacctgcggaaagtgccgttcaaatacccgtcttttctccggtttgacaccaatcaaggcaacggttgccgggccggcagatttaaccatttcttctgtttccattacactaccgtctactactttcagttgatgtgtcttcgccagttgattaatttcaaatgcgatgccttttgatcccaccggcaacatgtcaatcactgctgaatcagacctgagttcattaatcaggttgtaggaaaatagatcactaaaatgttgtttaacggcgtcgcctactaatggtcgtcccaattgataaatgaccataggctgtttttgaaataaatcatcaactcgtcttgtcgcgatcccaatcaccgttaccccaattgaagttgtccgggttggcatattgtcttcagtactaccattcagcgatatatccgacaatccagccctttttaattcctgcttcagtccggcaatcatattttcaccggttggggtcatttcattaccaaccgtatcaacaaccgaaatgggtgtcgccccaaaacaaagcagttccattaaaggtacccttagtgcaaatgccgctgtaacatcggccgtaacgtgtaccagatcatccggcttctcaccaataccggcactgacgtcacatgcgatcaccaacgcagtcttgtcgctaatcggcttaatcgttaaatcacgaaatttcaaaacagaaccctcctttaatccgaaccacgatcatcaatgtttcaaggctttaaaagtccttctcactcgtttcggcaatgccgcgctaaccaattcacacaaaatcaaattcaatacagtcgcaatcgttagtggtagaaagagagcaactaccgactgttttaaaatcggatacagcagtgttaattccaaagggacgtttatcaaataaccgatcgcgtcggaaatgacgatgaccaaaccacgggacaagtttaaacgctgacgaagcagaccgaacacgaacatgcaggcagccatcatcaccccaataatcagatgaaccggcaacgttaatggaaaaccggccagcatcgctgacaataaatgaccaaaaaagcctaaaaatgcaccgattgccggccctaataaaatggctcccaagaaagccggagctgaatccagcgcaattgatcccagtatcttaacgtttgcgccaacaacacaaagtgctaaaaaaatagtggttaacatcaatttcttcaaataatcatttctcataatcccgtttttgttcctccaatttgttaaaaccagccggttgacaactcgtcaaaaaagcagtggtgttgatcggtctatttagatcctttccactgcttattttagatttctatctatcattcaggcgttttcttaatttataccgctgtactttgccacccgcattcgttggcaaatgatcaatttgataaaaatgcttgggaactttatagtgagctaatctttgacgaccatatgcaactaacttctgagtcgaaagtggctttgaactgactataaatgcaacgggagattgtccccattgcttatcactaacaccaatgactgcaacctcatcaaccccgggataagccgaataaaccgcttcgatttcatccggaaaaatattttcaccaccggaaatgatcatgtcgtcaatacggccatcaacgtacaggaaaccatcactgtcaaggtgtccgacatctccggtacggtaccagccgtccgttgttttcttattaaacagtgcttctggccgactgagataaccggaagtgagtgccggcgtcttgattaaaatttcaccaccgttttctgacaatttaagctgtgtgagaaagagtggtttgccaacagaaccgattttagtatccgcatcgacatcgtttaaggcaacaatctgtgaacaggtttccgtcatcccatacgattgaacaaccgggacatgatatgtctgacacctggtcaaagtctgtcgatcaatggggccgccacctaataacatacaacgaaagtccggattataagcccctgatttttggtctctcaaatcaagcaatttttttaacatatatggcacaaccgaaattgttgtgacaggttctgttctcagcagtctatcgaccaaaacaggatcaaaatgggaaaccaatcgtaccgtcatcccataaataagcccacgcataatgattgaaaaaccactgatatgaaaaatcggaacagcacataaccagtcatcatgtgacgttaagcccagattcagtgacgaggcaattgcagatgaaaagtgattgccgaacgtctgcatgacacctttgggctcaccggttgtcccggacgtatacatcacactggcaacatcacccgagttgaattgagaaaccagttgcctcggttgtgacttgatttgctgaacctgactgaatttcataaagccattgtgaaaactgtcgcgccataatgcatcttctaccaaacatattgttggccggctatcacgcacctgtcgtttaatttcattatcggccagccgccaattaatccagacaattgtttgcccgcttccaagaacagccaatgccatttgataacccaacaatccgtttttagtcataattgcgatccggctgccttgcaagactccaacgcgacccaattggccggaaagttgttcaagtcgtttaaccaattctgaaaatgttaaccgttcttctccatcatcaacggcgatccttttaggaaaaagagctgcttgctttgtcatccaattatccaacttgcttaacctctttaaggaaatttcggaaactggtcaaaatccggtttccgcttttcattaaacgcatcccgaccttctttaccttcatcagtcgtataaaataacatcgttgcatcaccgcctaattgctgcaggccggccaatccgtcagtgtccgcattcattgctgccttgataaagcgtaacgcagttggtgattttgtcagaatctcgttacaccagtcaagggtttcggattcaacatcagctaacggaacaaccttattgatccaattcatctgaaaagcttcttctgcactataaaaatgattcaagaaccaaacttctttggctcgtttatgaccaataactcgagcaagatatccagaaccataaccggcatcaaaactgccgacttttggtcccgtctgcccaaactgcgcattatcagccgcaattgtcaaatcacaaaccagctgcaaaatattgccaccgccaactgaccatcccttaaccattgcaataaccggcttgggaataattcgaattaagtgttgcagatccaagacgtttaatcgggcaatatgatccggtccaacatacccaccattgccacgaacaccttgatcaccaccggaagaaaatgccttgtcacctgcaccggttagaatgatcacgccgattgtgctatcatcacgacagatattaaatgcatcaatcatctcttgaaccgtaaccggtgtaaaagcattcatcttttccggtcggttcatggtaatctttgcgatcttatctgcacgttcaaaaataatctctttatatttcttaactgatttccaattgactgatgtcatttaaattccaatcctttcaaattatgaggtgtgattataatgagtaacttaatggaaacacttggtattaaaacgatctccatcgacaaaactaaggttattatatcacttgaagtaagcgactctgtcaaacaaccatatggacttttacacggtggcgtcaacgctgtcatggcagagacggctgcgtcgctcggcgcaaatcaaaacgttggaccggatgagtacgcggttggtgtcagtattaatacacagcacttactgccagtgacttccggtctcatcatcgcaacggcaaccccactgcaacttggtcatcgcattcaaacctggcaggtgactattacaaattacgatcagctgacaagtaccagtaccgtgattttgaccaatcacactaacaaaaaataagaattaatcatcttgtcatcattgcagagcaaccgtttgaatacttgttaaattaacacctatgtaccaacagccattctggtttacaactttttcgttaaaggcatctttcattttcctctaatcctgttataatcttatgttaaacggaattattttataactcctgtcagagacatgttatctttgaacgaaaggaggaccattaatgctggaaacccacaactggatcaaacgctattttgacgatgcaacggatgctattctcatttttgaaaacaatgacctaattgtttgtaatcgaattgccaatgatcttcaaaaaatagtcaaaattgatccgcaatatctattggaagttgcaaataccgccgtcaagcagcgcttttcgcaaaccgatagctgctttagttgcgccattaaaaaccatatgcaggaaatttccatcccaattaccttagcacaggaatcagcccatccgctgagatatttcctggtttatcgcctaatcgataaggatgaccatgttttttcactcacgcttaaaaatcgtggcgtcatcaaacggatggatcaattagcacagcagcgccaactcaatcaatatgttaaccgagcgcacgaagaagaacgcaaacgcatttcgcaggaccttcatgacagtattgcacaaggtgtttattccgctattatgggtgttcgccgattaagtgaagatgtgctgacacatgatcaggttactgaattaaccagagaaattgagcatcagcttaacgatacgttgaccgaggtaaagggtatggcgcttgatattcgcccttcggttttggataattttggactactacctgccttacgcgttttggcaaagcggctttcagaaaattccggggtgaacatttctgtcgttggaaatgccaaaacggataatctatccacagacgttcaaagtgtcttatatcgaattggccaggaatctattaataatgcccttaaacatgctcaagccagtgaaatcaatattttgttagttgcacatgaacattatattatgttggaaatcattgatgacggcatcgggtttgatgttcccaagcaccatcgttttaatggtcgttcgcttggcttaatgaatatgaacgagcgaattaaagccttaaacgggacttttgaaatcaagtcccaacccggatccggcacaacggtcaccgctaagtttccggttgtactttcgtagtgaggtaaatgcttatgctaaaagttttaattgcagatgatcatgcggttgttcgtcagggactcgcctatttaatcaacgggcaacccgattttaaagtggtttcggaagcggccaatggtactgacgcttatgcacgtgttgaacagggcaatatcgacatcctagtgatggacctcagtatgccgcctggtgaaagtgggctggtcaccactcaacgaattcacgaacattttcccgatgtcaaaatactcattctctcaatgcacgaagaacaggaatacattaacaaagccattcataatggcgccttgtcttatatcctaaagagctcgccagacagcgaattcattagtggattgaatgccttgtcggcaaatcggcgatacatagatcaaaatattacgctatccaaatccgatattaagcaaattgaggccggtggcgttgatgcccatcttcaaggttaccggagcctatccaaacgagaacgggaagtcttcccgttaatggccctgggatatacaaacaaagaaattgccaatcgtctctttatttcaaccaaaacggtagaagctcacaaggccagtatcatgcacaaactctcattaaattcccgaccggagttggtcaggtacgctgtccaccaccatttaatcgagttttaacgttatttaacgagcatcagcctaaaaaagatcgcaggaagcggctcttaattgagtacgccctgcgatctctatttagttgttcatttaaacattactaacgtaaccatttttcaatgccgcaacccgtaattcaatgacttgattatgatttaagcgggcaaaggcgagcgcttcatccagtaattgcctgatgtcatcctcgttagctttttcatgaacggcattttgtgcggctaaaaattttaaccgcggtaaataatacgtcacgtggttttgcgaacataattcaacacctgatttaagtaatttgtcactcaaagttaaattactttttgatgcataatagttagcagtataaaagatgagcgttaaaagtcgtaagtagttatcatgcccttcctcatcatcggaggacgttttcagtgcctcgttaataaattcatgtgccttcttaaaaaagaaatctgcacgtacgggctgattgattcgcgtataagtaataccagagccaatgtaggctagttgagtaaaaattgtttggtgtttttcgtctaattcatccagaatctgtgaaaaatcaaataatacctcatcaggctttttgttagttactgcgtttaacatgcctctcagatagaaaaactgcattctcaaaggaatcgctgtgatatgagcctcgttgatctttttaagcgctgattgcacctgtagataattttccatcatcaagtctttctcaatcgcattcaaccgtcttctgataaccgtgaccgaggaagaagggtcttgattaagctcatcaaccgtcatgcccattctggaacacaatttatttaaaattgaaagcgagggtacgcggccattccgttcaaatttacttaacgttgcctgtgtacaaattcccttacaaagtttcatttgggataacttcaaggcttttcgtcgatccacaaattttttaatatccatatcattaccaacccattctatgatgtctatccgtgtatccctaaaacaacttttgcaaatcggctcattttattaatatcccaaaccgggtcccaaactaaatgaattttgcaagtcgtgatcccgtcaacagctgtcacagcggttttgatttgatccgtcagcaaattccccagtggacaccccattgttgttaatgtcatggtcacaatgcaatgtgtatcatcaacactaacgttatatatcaagcccaaattaaccagatcaaccccaagttcaggatcaatcacgtcttgtaatgatgccatcgccgcttgttcaattggtgaaagtccgttcgctgatttatccaaagggatccctccttgtaagttgatacttcattaatgacccttgcgacaagtgccaagtaacctgctggaccattgtttatgaatcgcaacccaatccatgttcataaaacatataatcaattaaaaataaatgtgattatttatgtaaaaagcacttataacgcggtttaggctctttatgtattctaattataacaaaaatattccaaaaggaaataaaaatttttactaagacacaataaggctactgttaacctgtctcatcaagatgcgtctcatccgcactggaagcttctaacctattaatatcgtcgtataataaaaactagtatagatcgtacaaggaggtttccatatggcaaaactaaacgtgattaaaggtgacatcacaaaagtcaacgttgacgcaattgtcaacgcggctaatcgggcactttccggtggtggcggtgttgatggtgccattcatcgagctgccggtcctcagcttgatgaagcctgtcggaaattaaacggctgtccaacgggccaagccaaaacaacacctgggtttaatttaccggctaagtatattatccacacacccggtccaatttggcacggtggtcagcgaaatgaaccacagctattaaaagattcctacgttaacagtttaaaacaagcggttttgcaccattgccaaacagtcgcatttccttccatcagtaccggaatttacgatttccctttagacaaagccgctgggattgcaacagcggctattcaagacttcgacaccccactcgacgtcacgatggtttgttttgattcaatgacctatgatgcctatgtcaaggccttggaagcagctaaaggctaaaatgacggaaacttatgttacagaaaacgacgatgttatatgccagctggcagttaactatgttacaaaaaaactgatgtctcataatggcatcagctttttggtatcttgacatacccgaactgcacgctatcttctaaaacagttcaacgacccaattcttatcctcgtccgaactctctaaatattccggatggtctttaagtgctacgttaacctttgcgaccttgccggctaccggcgtatgcacttctgaaaccgctttggcaccctcaatcgataaaataacgtcaccaagcttcacttccgtcaaattatctggaaatttagcaaatgaaatttcgccgatttcctgacgggccacgtcattaaacccaattcggatatgtccgttatctagtttcttctgccataaatactttgcatcatcagctgtttgtgccattgttaattaccccttttttatttagtggatgacgtttccgatacaagccgagaattttatttgttttctcaagtgcatggggaacgcccgcttccggcgacatcactttatccaaatcctgccgacttagatactttgcgatcgtgtcgtcggagtaaaacagatcctttaataatttattctcttcatccgctttaacccgtaatcgaaccaataattcatgtgcatcctgtctgcccattccttttttagccaatgccatcatcaatgcacctgaatacattgtgccatcgcccaagataaaattttcagccattcgtttggtatcaaactttcctgtcttcaatatagttgtcgcatagttaagctgaccggataaatacatggtcatttcaggcaaaacaacgtaaatatcccgccagactgcggtatccttttcgccgcttacctgcatggtatcatacattaatggcatttcatttcggataattgtcgataaattaacaattgcttcacacatatatggttcgcgaactgtcggaataacggttgatccctgacgtccgggtgcatatgcttcttggaattcgccaacttgtgtttgactcattgtcagcagattttttcccagtttcccaagcatttgtgcaatcattgttaaaacatgacagtattctgtaaaacgttcacgctgtgtatgccaatacatttccgggacttgtaaatcaagataatcacaaaaatcagtttcaacctgatcgtaattgtcaccaaccattgttgacagcccttcaacaccggttaatgaaccggcaaacgtaaagtcggacaggctgtccaaacgtcgcatcaggtagtcaagctcgtttaaaataattcccagcttaaatcccaatgtcgaaggtgaactataagttcgatgggccattgccacattaatggtttttttatatttatcagccaaatcataaagaacggaaccaaatttgactaagtaatccatgatgatcttatcagcctgctttagttgcagtacataacaggtatcctccacgtcttcactggcggcaccatagtgcaggtactgacccccgccatcctcaaataactgttgggaataactgacaaatcccgctaaaaagtgtcctgctctagctgcagataaccgaagcttggtcatatcataattctcgggaacaatcttttcctttatctcttcgtaagcagacagcggcatttttttgtttttcgacattgcataggcaacagccgtttcaaccttacaaacgattttcaatcgattttcatcggaccaaaccgctcgcattcgtgccgttgaatagccattttggttaaacatggatccaaggacttcaccactcatttatgcattacctcttcactattgctaatgatagaatttgagaagcatcttcggctttcagcctttcacgtgcttatcttcatgttaccccatacacaaaagactgtcagcgatgagcattcaaaaagttccttaattaattgttgccttgtcagcaaactgctgatcgatcaacatttcggctaaagaagcaggctcaatattgccaatattttgggcaacgtcaccctgtgtgaacgcttcggtcaagctcgcagtgttataaggcgttccgatcaactgggtttcgatttggtgcagattgccattcattttattgaaatcaccaaatactttagcatgggtaaggacaccgctatcaacagaaaaactgatttctacggtaccaactccggcaaaatgttgcaaatggtaatacatatctgtcgtttgttcacccataatccacttttgatcgccaaactttttggtggcagctttttcaattgcccgccaatcctcatctgtcatcacataggtaggaatttgattgaggttagttgtgtgaaaaagctttaaaagaaacttggtttgcaattgtgacaaagtcatattttgatagtggctgctaaagtatggccttaaattagttacccgactatgaacagacttaacgcctttagacgccatttttgactttggtggtcgtaacgctctggaagcattatccaaatcaacatcaaccattaaggttccgccggttgaaaaacgattgccgatttttagcgccgacatgccggaaaacttcttaccgtcaaccgttaaatcatttcgcccggtcatcgcggcatcaacaccaagatcttttaacgttgcaattgcattttgagcataatgtttaaaatccaaataatgatggctgtcatcattatcaacaaaacaatacgttaaattcccgggatcaacataaacggcaccgccaccggctccccgacgggcaattttaataccgtgcgctttgcaataggctaaatcaacctctgaataaacgttttggttgacaccacaaatgataatcggcgttttgggccgatagaagaagataacttcgtcattaaacttcggattggtaataaaatacgtcgacagatattgaccaatcgcaggttgtgctaaataatcatcaccgcttgagacatccacatagaggatagccatcatcgcctttcaatacgttataggaaacggttacacttattagtatagcatcgtccttatgacaaatatctgccgattcaataaaaaaagccgaacaaaatttatcttttgttcggcctgtgactattacactccgaatgctaaacgctttgctgcacacactatttaggactgctcctcaaagcagcattctgcatgtaagggattcattccaaaaatccaaacccgggatttccgaaatgaacgccttacactccgaatgctaaacgctttgctacacacactatttagatgtttgacccatttctgctgtattttttaaatgaagtttgccatccatgatttcataggttttatccgcaaattccattaaccgggtatcatgggtaaccactacaacggccttttttcgggtatcggctaattctttaaataatttaccgacttctactacccgggccgaatcaagagcggccgtgggttcatcggctaatacaatctccgggtttgcgtacaatgcccgggcgatggcaacccgttgtgtctgcccaccggaaagctgtcccggatatttatttactaaatcggtaattcctagctgtgccaatagatccttaagctcagagtcactcagattccccttgggcttaacttttctcacaaattccaattgttctttcaccttcaaatacggcaccagtgaataggattgaagaacaaaaccaacgtgattcaaccttaatttgtcccgttgctttttactaagctgatccacagactggttttcaacaatcacgtctcccgaagaaggtgtttgtaaaccgccggcaatcgttaagaaggtacttttacccgaaccggatggtccaatgactaaaatcaattgtcccttttcagctgaaaagtcaacatcgcttaacacgtgaacccgactggttccagagccaaaatacttattaatatttttcaattcaataactgccatgctttaacctccaattactcgtacaggatcaacggtcgcaatttttcgagccggaatagccgcaccaatcacacccatcaggagtaacccaatcgacatccctgccagcatcggcacattaaaggaaatcggcaccccaaatggaatcatatttgccgtgataaatgttaaaagtgcgccaattacaatcccgccagccattaagatcaatgattggctgataatggttttaacaaggactgccgccggtattccctgagcccggagtactgcatacgttggcagagcctgaatcgtcaaaatatacaggaacacagcaataatgaccaacgaaataatcatcagaaaaccaatcataaaaccaaaggtcgtattttgagcagcgtatcccggtaatttagaaatgaagtagctgtttgaataagtcttcaaagctttatcatggccattaaaattagccgtctttgaaataatcgcacttccggccaatcgtcctcccgggaagtctcgtaattcctgccaggttttaagtgacccatagaccaccggcgcgacatttaattttgcatctttaacgaaaccgacaatcgtatacttagtcgacgatgagttgaactttatcttatctcctaatttgtaaccatccgctttaaattgttcatcggcaactacttccttgttattgcgagcttgacgcccattggatggggttaacgcctttgcaatatactgatttttctttaccccaacgaactgtgcagattcttttttccgatcactgtgtttaacgaccacgggtgcttgcccaataagcgcttgattcttagttagtttggcatttttaacctgtgcgtcggtgatggttgattgggataaattaacattagcatcccgattcaaaacaacactttttgcatcccaggactcaatagcctgggtattttctcccgccagaccggttgccagtccggataaaataaagattaaatacgtaattaaaacgatcattgcaataatcaacgtatatcgtagtttttcatggcgaatttcctttaaggctaaatacatagattaactcctttcgcgtgccagttgtgtcaatacatcctgcagccgtttaaccagcacatctttttcttttggattcaacaatatttgtttgataacctgatgactcaaaaccattgcggcccattgtcggccctgcaaatgaacatcgtcaaattgatcgtcaataagagactcatttcgcctcaaatgcattttaaccaagttacgataatcgctttgacaaaccccgtcaacaaacgatgtcacttggttaacataaaaatccggttcaaaacgattatcggcaacctcccgatcgattcggccatgaatactcttcattgccaactcataaatatattgataggcatcccttagatcatcaaagtacttataaaaagcgccccgggcgattcccgcctgctttacaatcggagcgacctcggcttctgccagtggtttacttgaaaactcgtcaattaaagctttttgaattcgcgtcttcttttcattattcaaattaagaaaggttgttgataccatcctttatcccctccaattgtgacaccgtgtcatttattgattaaaatgagtatagcaggtaggtgacacggtgtcaacaattagagtctcaattttttaaaaacggaccattctttaataactgacattttgctttaaatttaattatcccgttattgtctacttcaaacaattttaaagtttcctcaaaaaattaagatacacaaaaggccaagggataccgtcagtaaaaatactaattgacggtatcccttggtcctttttaatctttttgaaatcgacttctcagctttttttcactggccatcatcaacttttcgggatcaacatcgaatttgccacacaaaatcagtacctgatccatcgtatcagccaactcttccaccaaattatctcgcaactcaggctttgatttgaccttctcaccgggatgatcccgaccaatttcaatagcccgaatggctctggataactcccctacttcttctgtcaaaaagtttaatctgataaatggtgaatattggtaccaattccgctgttcataaaaatcgattaaccagtttgtatgatctgaaagttccaaataatccatctccgtattagttgttgatgaatttaatgataccatttcagaccacaaataaaaatctgatgattaataccgacttgtcgaccgcatcaattccggatttcgattggtcaaaagcatggcgtgacctgatttatcaaatgtcatactctcaaattcccgtcccgaatgaaatctggtgtatttaatatcaccgggtttcaaactgccacgaccatatgtcttacgtgccggcaatgtctggattgaatcatcagaaaccaggtacagccgaccattatgtggattgtatcccatcgcctgctcatgcgtgccggttcgttttgccaacaattgcttggtcaatgataccttaaccgttcgtttgccaaatactccacgataaattttaactttaccaccggaaatgccccaccaataagcatgaccggaacgatcaaaggttagattatgcccagctggtaccattgcaccacgattgttcattgaaaacttaatggccttgtcgggtttcaattttgatgaactgattttttgaatggtggaagtcgccgttgacttcatatctgctcggtcacgccacatccacaatgaatgatgcttttgatcatatgccaacgattgaccatgtccaaccgtaaattgtgggccaaccttaatacccgacggacgcttcgtcaataatgcattttgtgtcgcattgaaactcatcttattcagttcattcgtatcatagcgaacaacaaatccccttccgacagtattatgcggtgcataaagtacaaataagtattttcccgcataggttgctgcttgtggatttgtcatatcatgactggatttaccgagtgctgcatgtgtcgttggcagcaggtacttggtttcaaacgcccactttgtaccgctagcgctctttattgtatcagcaccacttggattctttgaccaagcataattcgagttggctttgacaaaatgaacatgactattattcacggttcgcaaactactgcttgaatactgaatcaatgcattacttcgttgaatataagttgcagcactggcaatccccatgccagatccgactagtccaattcctgcaactgtccccaataataactgtttaactttcacaactattccctccagattcggataaaagtgtccggtttgaacacacttttatcctgttagattcagtgcctaatgttttaagcctaacccccattaagtactaacctgattttaaccccaagtggcatcgaacccacaaaaaattgattgtttttagtaagaaacactgttttcagttatttttgcaacctgctgtgccgttacactttttccattaaaaagccattctgaaataatgttgatcaccgatgcgtatttgacaacatttcgcttttagttgatgattgcgattcctactccaaactatcatactagtatcaatggaacaatgtgttcagttaatgagctaaaggggactttaacatggcatatattgatgtaaaaaacgaattcaaaaaatatcaaatgggcgatactgagattgtggccaataacaacatcagttttcaagtcaatgaaggctcgcttgccgttattctggggccaagcggtgctgggaaatcaaccgttttgaatattctgggcggcatggacagcccaaccagtggcaaaatcctggttgacggcacagatatcgctcaatttaatgaccaccaattaacgcaataccgacgtgacgatgtgggattcattttccaattctataatctcattccaaatctatccaccaaagaaaacgtcgaactggcaacttcaatcgttaaagatggactggatcccgttaatgttcttaatgaagtcggactgagcgcacgccttgataacttcccttctcagctatcagggggtgaacagcaacgggtcgcaattgccagagcattagccaaaaacccaaaactgttattgtgtgatgaaccgacaggtgcgttggactacaccaccggaaaacaagtcttgcaattgctaagcgacgccagcagaacttttcataaaaccgttatcatcattacgcataactcggaaattgccaaaatagcagaccggatcatccatattaatgatgctaaagtccgctcagtcattgacaatgccaagccaacaccggtttcagacattgagtggtaggaggtgacatcatgcacaaacttttatggcgagatattcgccaatccatggggcgcttcattgcgatttcactcattatcctgctgggcgttttgatttttgtcggggtcaaagcaacggggccggcactgattgactcagctgaaacggttcttcataaacaacaattaagcgatgttcaagtgatatccgataaaggttttaccaataaagacgttcaaactgccgaaaaagttgctggggccaaagctgaaaaaatcaaattcaagtacgttcttggaggacgtcataaagacgcagtcgcactttatggttttagtcaaaatcatggattaaaccaactcaagctggtcagtggacacctgccaaaaacaaaaaatgacattgttttggatcaacgtgcacagcgtttaaatcattataaattagggaatacctatacattcaaaaaaagtgcaaacttaaaacagcaaaattacaagattgtcggcttcgcaaattcgcctcaatacattgataatacgacccgtggtgcaaccaatattgggaccggccaagtcgcctattttgcctatatcccaagcagccaaatgaacttacctgtcgcaacggccattaacgtgaggttttcttctcttcaaagccttggaagtttcacaagccgatataaacatgctgtaaatcaaaaggtcgtacgtttaaaatctgcttttaaatcacgaacatctgagcgaaaagctgaaataatgtctgtgggggaaaaggagctattacctgctcaagaaaggttggctactgctcaaaagaaaataacttcagctaaacgcaggctttcctctcgttcccagggacgcattaaaacaacagctgcacttacagcccaacaacaaaaattagatttggaaagacagaagctgataaacgctaaaaacgacctgtccaagactgcaaccccaacttatacatggtcaacaagagaagatttggctggcttctcagcatatggggaaagtgcagatcgaatcgcggcaattgcaaatgtcttccccgtattctttttccttttagcagcacttattacctttacaactgttacccgaatggttgaggaagcaagaatgcaaattggaactttcaaagcactgggattttctaatgcttcaatcgccaggaactatgtcgcctacgcattacttgcaggcatacttggcgttatcttgggcagttttatcggaaaccagtttctacctcggtttgtgatttcaatttactcagaatatattttccacattccggtgattcattatcaatggttccaaatcctcttagcagctatcttttcattggtcgcaacggttggtgcagcactatatgtaattttgaaacaggttaacgaggtccctgcttcgcttatgcgaccaaaatcccccaggactgccaaaagcatttggctggaacattttacctggttatggtccaaactgaaattttaccagaaagtcagttatagaaatctgtttcgttttaaatccagagctatcatgactattcttggaattgccggtggtacggcgctgatcctaacgggatttggcatttcggattcaattggcgcttcaggtcaccttcaattcaaccaagtgattcattatcaggctattgtgcaggcaactcacaaagatcaattatcaaatgttaagcatactattcaaaataattctcattatcaaagcagtacaccggttggcacctctgttgtgaaagtcaggtcaacacacaaccaattaaacgacgttaatatgtatgtccccagtaagcccgaattctttggtcgttacgtgcatttaaatagtaccagctcaggaaataagctccgtttcccttccaagggcattattatttctcaaaaaatcgctaaaaccctagcgattaaaaaaggcgataaaattaagatcgttttcggcaatggaaaagctgtgtcaatcaaagtagaagcggtcactaaaaactatatcggccactttatgtacctttcaccgcaagcttatcaaaatgcttttcataaaaaagcaatcgctaaaactctctttgtcagattacagggaacaaccagcagtcagcggaccaacttgggtaaaaaatggcttgctgacaatccacacgttttaggtgttaactttactgccgatcagaaaaagaccgtcagcaatatgtcccaacaaatgactccggtcgttttaattttcatcctgttatccggaatcctatcatttgtggttctttacaacctgactaacatcaacatttcggaacggattcgcgaactatcaactattaaggttctcggtttctttgatcgtgaagtaacaatgtacatcgccagggaaaatattgtattggcaattatcggaattatcgttggctttggctttggaaacctattaacagcatacgtcctctatcaggcagaaacgccaaccgttgtctttccgttaaccatccatattcaatggtattttgtggcaaccattctaatgattctgtttaacctcattgtgatcatggtcgcccaccgccaccttaagcgggtagacatggtagaagcgttgaaatcaaacgaatagtgtgcggatcaaagcggttagcacccggaatataaggcgttcatttctcaaagccgtttcttgtttgccattaattaatagcgtacaatttatataacatcaaatcagccataaggagtgatgagttttggcaacaatttatgatttttctgaaacggaaatgagcgggaaaccacttaatttaaaagattaccaaggaaaagtactgctaattgttaatacagccagcaagtgtggccttgcaccacaattagaaggcttggaagatttgtataaaaaatatcaagaacagggcttagttgttttgggcctgccgtcaaatcaattccatcaggaacttgaaagcgacgaaaaaaccgaagaatattgtcaactgcattacggcgttacttttccaatgactaaacgagtcgctgtaaatggcgatgatgaagatccactattcacctatttgaaagaaacatccggtcacggtaagatcaagtggaattacacaaaattcttaattggccgtgatggaaaactcattcatcgttacgcaccgattacaaaaccagaagcaattgaggcagaactttcaaaagcaataaaccaacagtaatcatcattggtatgacgatcaaccaccgaaaggcatgagttggtcgtttttttgtaatatccattacataaaatttacttttccataaagatatactagtataaaatagttcacttatttttattaatgcctgagggggcatatctctatgaaattgttaaaatgttttttctttgttttggggttatctgttttctttgcatgtcggccaacaaccataaacgcaaaatttgttgtctatcatcaacgctcttccggtttgatttatcatcgtcatcacatgcgttacctgaataattcgaaggtacattatatccatgttccaaaacactatcatcatgcagcggccgcaaccaagcgtcacactattaaatccgttaaaggaaaacccgttaccttcacaactcgatatgtattgccatttccgggtaaagacggccagcattggggaaatccacaatcaatcgccatgacgggtaaaaaatatatgtatgttgtttactgccccacgtcattacataataaagggagaattgttcgctttaatactcaggaattagacttgctcggcgtccgattacatccaaatgaattgcgggacgcctatgttaaaaaggatggtcactactcatttattcaaaaacagattcataaaacgattaaggtcggcccactatttactaccggacatggtcaatcactcgcttataattggaaaagccatggtatgtatatgtggcgtgataaagaaaaagcgccacgagttcctgtcaacaattgggggtatattcaacacatcaatgtaaaaaggctgcgtccagatcatgccattcgctttcgtttaagaaaccgtggactgagcgtgccgggtgggcataacctaaccttcgataaaaacggtaacgcttatttttggtcatttcccggctggtgtgcctatatttttaaagggaaaattcatcacaaatccgtcaagttcaaactaaccaaacagaagttgcgccatttgcccggaacccgaattcaaagtatggcttacaattcaacccgaaagcggctactaatgatatcggatgcctcgatcgcaagtttccctaaaaacaagttaaaggggctcggacatttaaccaatcatagttttcaatggaatgaatttagccctaaacgtgaatttgaaggaattgcttatgatggtaaggatggcattgcaaacctgcttttgaaccacgttcccgaagtgttgacttccaaccattcatattaatattgaccaaccaaaaagggagatcagacaattatttttgtcatgatcccccctttttttgtttacgctattcaaattgtgcttcgtataattgtttgtagtaaccatcttgagccattaaactcgtatgatttccgcgttcaacaatttcaccatcatcaacgaccaaaatctgatcagcattatgaatcgtcgataaccgatgagcgataaccagtgacgttcgctgttccatcagattttccaatgcatgttggattgttttttcagattcattgtctaaagaagcggttgcttcatcaagcacgacaatttgggcatcctttaatagggctcgggcaatggcaatccgttgcttttgaccaccggaaagtttaatcccccgttcaccaacctgggttttcatttggtccggcagccctttaataaaggcatcgatatccgccaatttggcaacttcccataattgatcctgcgtagcaccgggcgttccgtatttaatattatctgcaatcgtaccatcaataataaaaatgtcttgagatacaatcgcaatattttgccgtaacgaccgtaacttgatatccttaatcgaaaccccatcaaaggtgatctgaccattgtcaatgtcatacaagcgatccaaaagttcggtgatcgtcgatttcccggctccagaatggcccactaacgctgtctgttcgccaaatggaatatcaaaactgacatctcgaatcgccggcttatgggacgcttcgggatcatctacatcataagtgaatgtgacatggtcaaataccacgcccgttttaatttttggaaaatctactgcacttggcgcatccaaaatttgcggctttaacgccataatatccataatccgcccataagaaactaatgattgttggaattgattaagtaatcttgaaaacgaactgatcggactttgtaaaataccaacatagctcagataagccaccagttcaccaagtgttaactgctttttgaaaacaaaaattgttcccagcaataatacaatggcagttcccaagtattcaataaaattaatcaacggcgaaaaaattgcttggttacgagtcgcttcaataatattgtccttgttcatattggctaacttatcaaaacgattggtttccagatcttcggttgtgtagcttttaattaattgaatctcagtcagcgtattctgtaattggttagtcatcaaagcttgagattgacgggctttacggtaagattccctaatccgggttcgaaaaattctgacaaccaggaaaataaacggaaatgttaagctgactgccaaagccatttcccaattcacaaaatacacgaaaaccaataccccgacaaacgtaaacaaactaccaattaaagaaagcatatttggcgaaatcagattttgcaggttattaatatctgacgttaaccgcaccatcaggtcacctgttttactggattcaaagaagtgcgtatccaaccgtatcaggtaacgatacaactgatttcttaaattagtgatagcgccctgactcattacgcccatccaataggttgaaagatacgtaaagatcccggaaatagtaactgttaacagtagtaaccccacaacgacaatcaattgggacacactcttgtttggaatcacatggtcgataatgtactggttaaactgtggtagcaggaaatccattaaagagaggatcgtcaatacaacgacgttcaataccaacacccatggtcgttttagaacggttccgaaaacaaatttaaacatcccggccatcgtaacattgctttggttctcatcttccgttgctttatttgctgctttattttgggtttgagtttgctgcatcatcccatgccccctattcaaatgaaacattttcatgtatttaggtacctaactttatgaattatatcgagtttatttgatcatttcaatcatttagcttgagtaccacttttaatcatgcaatttagtatgacacgtttaaatatcaaaaccaaagaaaagaactcgcagacagtcagcctgcgggctcttttgtaaatgaaattattaaagttattttgtacgtgttttttccattaataaatcagccaaagtatcggcttggatatcgcctaaatttgcttttaaatcaacggaatcaagtgcccttaccaatgccttttgagttaattcggttctcgccaaagctttttcaatcaggctaatattgcccccggtaataaaatctccataaattttaatagcagagattcgattgtcctgcgaaagggaaaaattaaaactaactgtgccaatatcataatgcttggaaacatagtaatcaaaccccggattttggccataattccattcatctgtatcgtatttgccctttaagcggtcgtcgataattgaccaatcatgatcatttaaatgataagtatcaatatcatcaagggaattcgccttgaataggtgtcgtaaaagtacctctttgaaggcctcgatatccattttttgatactgtggatccaaataaggcttcacatttgtcacccgactatgaaccgactttaccccttttgatgctagtttgtctttctcaggcgttaacaccttggtggcaacgtccatatccaaatcaaacatcagtgttccgccagccgcatacgattgaccgactttaaacatcgtcataccggaaaatttactgttaccgatgaccatatcattacggccacgcaattgagcatctttggcccccatatcatgcagtgcatcgataatcggttgcgcaaaatagttaaaatcgccaaaatgagtgtcatcattaatgacaatgttttcaaaaataatattgccgtagtcatgataaacggcaccaccgccggatgtccgccgaacaagtttaatgcccttttcttttaaatacggcatattcacctcggcataggcgttttggttaacgccaacaataactgccggctgattaacatacatgattaacccgtgtccgggaagcttcaggtcgttcaccaaataattatcaagtgattgatttacaactggatcataaaccggttggccatgacgtgatgtatcaataaagaacataatttcatccccaaatcataaaaatagttgttaccgctaccatcatcataaatcgcgtacccggtttatacaatcagcaatcctacttctgaacatacttttgactatccccaggatttgccttagcggtaaattgattgaccgtaatttggataatgccaacatgttcaactgcagcatcaggcaggttagcccattcatgaccaacctcatgtaacgcaatccgttgcagggcataacgcttctgatccaagtcatcaaccagcttagcatccccataacccatgacacttctatatttaaagcttggcgtatcgtgatcgggatcctttggatttaacacttgaccatcagtgtcaatcgcaaacccgacacgaccgtcctcagcaatcagatcacgtttatgtccaacaggcgcaccatggatatacaatgtcaattgattattagtatcaaactcatacccataattggttggaacaacgtatggataacgatccgttctaattcctaaatgaatgacctcggcatctgccaaaattgatttaatttgaccaatatctgttagttcacgatcagttcttcgcataaaatcacgctcctatcaacctattaaactttagtataccgctcatcttctgaaaagaagataaaaaaagtcgcttcaccttaacaacagtgaaacgatattaatcttctaattaacctgatgtaatgacgtcttgccttgaagaattgtctctacatcattcaacgtaatctcaaccatgttttgaacagcaacttccgtataaaaaccaatgtgaggactcacattaacatttggcattgccaataatttctccaaattatcattatgaatcggttttccggttaaatcatggttcacaattggcgtttcaccttcaaacgtgtcaatcgcggcagcggcaatctctttgttatccagtgcattcactaagtcctctgtcttaacaaccggtccccgtgatgcgttaataaagatagccgtagacttcatttccttaaagacttttgcattaatcatgtggtgggtctcatcagttaacggtgtatgcattgtgacaatatccgctgttttataaaccgtttcatgatcaacatatgtcaacgtatcgtttaaatccggacgatggattggatcagccgcaatcactgtagctcccaatgctctaaatattctggccacagcgctgccaatttttccagcaccaataatgccaaccgttaaggtatgaatttctttagcttcggtattcgtccatctgaaatctccatgttgttcacgttcgcgaacttccccaaggtggcgcaacaaatacatcacatccgcaaggaccagctcactgaccgaacgaggtgaatatcccggcacatttgtcactgccaaaccattcttggttgcttcggctaaatcaatgatttcataaccggtactgcgaagtgacaattgcttaatgccaaattcccgcagcttttgataaacaataggatccggaatcgaagcatgctgtaaaatgacaaccccatcgtatcccttagctaaatctaccgtgtcggcatttaaaggaaccgtattggtatcaatgtgataatcgggatgttgcttcgcccactcattaattggtccctgttcatccggccgaactgtgtacattaagatcttcatcgtattaaattgcctcgatttctttttgatatgatagtaatttgtcgtctaaaacgatacctaaaccttctgctcggcaaatttttgaatgcgttcaatcgccttcttcaaatctgcttcactggcagcgtaactgattcgaacatagccctcaccaccaggtccaaatgaagcacccggaatgacagcaaccttggcttcatcagctaattgattacaaaattcaacactattctgattcaaactatctgggatctttgcaaagatataaaaagcaccattaggattagggcacgagaaaccggattttgaaagcccatcaatcagtaaatcacgacgttttatatacgctgctctcatcggagcggcgtcatccataccatttttgaaagcttcttcggcggctgcctgagcattggtagtggcggatgtaatggtaaattcgcttactttaccaatttcgttaatcacatccgctggtccgcagatcataccaatccgccatccggtcatcgcgtgagacttcgaaacaccattcataacaagtgtctgctccggtaaaatcgatcccattgatacatgggtaccatcataggttaattcactgtaaatttcatcactaagtacaaaaatatcgtatttggaaatcacatcagccagtttttgaaggtcttctttatgataggtgacacctgttggattggttggataattcaaaataaccgctttaacggtatccttattttcttcaatcgcctgttgaagcttttccggtgacaaaataaacccattatcagaagtatcaacgaaaatcggtgttgcaccacccaacattgcgattgggatatagagtgggaaaatcggtgtcggaataatcactgtatctcccggattcagcatcgccgtcagggccgaataaattgctccggttgcacctgcagttattaaaatttgtgtttcgggatcatactctactccatattttttatctaagtaatgagtcgccgctttccgcaatccaagggtacctcgggaatttgtgtaatgactctcattgtcattaattgcctcaattgcagcttgttttacatgttcaggcgtatcaaagtccggttcgcccaatgtcaatttcacaatatcgggaattttggaaattttttggttgaatgtcaaaattgaggatggtgtcaatgccgctacccgcttattcatcctgcttgataatttactcatttttacttcctcctaaaaaataggtcctcccagccactattgactgaaaggacccaccttaattggttttatcccgcacagtcaatcacttgatctgtgcggcctttaaatttccatcacgaaaatctcttggcttatcacagatcagatctggaaaaaccaaaagtaataacgacaagtattcaactgagttttgcttgttcttttcatcattaaaaactccttagaataacttacgcatttatcataaccgttttaattcgtgaaagcaagtccaagttgatgactacacaagctgggaactaacggaccaatcacaacaaactaacatcacacttgcatattttaataaaatcgctatactaatgagtgaggacttactcattaaaaaggagaggtgatttcgatggcaacgaccattcaagtttcaaatttaaaacaaggttacggtaaaaccattgttctagaagatatcaatttaactgttcataatggtgaaattcttggactgatcggccccagtggagccggaaaaacaacgctagtcagcacaattatggggatgttgagaccgcaggaaggaacggtcaccgtcttgggtcagaagatgccgaacagaaaactattgggcaaaattggttatatggctcaaaccgatgcactatatagtgccctaacagcccgagaaaaccttaaatttttcggtgccatgcagggattaggttcagccgatctcaaaaaacaaattccatatgccgctggaatcgttaacttgaatccggatcttgataaatatgtaaaggactattccggtggcatgaaacgacgattatcgttagcaattgcattggtttcaaatccagacctcttaattctcgatgaaccaaccgttggtattgacccggaattacgtcagcaaatttgggccgagcttcacaatattgccaaagaaggtaaaacgatcctattaactacccatgtgatggaggatgccgagcaatcggatcaactaatgatgattcgaaacggcatcgcgattgcccagggaaccccggatcagctgattaaagattatcaggtaaaaacagtagaagacgtctttttaaaagcagggaggcagcaagatgcgcacagttaaaatggttaaacgggtattaaccgagatgcttcgtgataaacgaacactggcattaatgtttttggcaccactattgattttgacattaatgtactttcttttccaatccaacactgatcaaacagcatccctgggtattcgcaacgttgatacaacattagtcaaggcaattaaaaatgatcatgttcattttcatgacgtatcatctaaagaaagtgccaaaacgattattcgtgatcacgattacgcggggctgatttcacaaaaaggtgatcaaatcactttaaccctgcaaaatagtgatcaaagtaaaagtgccattttaaaacagagccttcaaaaagcgcaaatcaaattaaagatggaagctgccgcaacagctattaagggtcaacaaaagacaattaaagcacaacaaagggccctttctcaaatgcaaaagtctttgtctgcagcatccaaaacagcggcttcagaaaatccctcggcagccagacgacaagtaaagacacagacaccattaacaactgcaggcaagcctaaatcagcgacaacttattctgtcaatactcattacctttatggcagcagtgactccaccttttttgacacactcttaccaatcatgatcggtttcgttgtgttcttctttgttttcctgatttcgggaatcgcattattgcgggaaaggacgacaggaacacttaaccgactattggcaacccctattaaacgcggtgaaatcattagtggttatttagccggttatggtatctttgcacttatccaaacgttattaattgtcggattcaccatcctggctttcaaaattcaaattttagggagcgtttggaatatccttttaatcaatatcctattggcatttgtggcattggcaatgggcttgtttatttcaacatttgcttcctctgaatttcaaatggttcaattcattccggttgttgttatccctcaaattttcttttcagggattatcccgattgatcaaatggccaactggcttcagcccatcgcacggattatgccgctttattacggggcaagtgcaatgagcaatgtcattgaaaagggggtcacttttatggatattctacctaaattaggaattttagttggatttgccgcactctttttgatcctgaacattttttcaatgcgccgttaccgtcaagtttaaaggaggattatccattatggttcatagtgatattcaggcattattcgccgaaagtttaaatgaactcaaactgaccgaaaaacaaaaagccgttcttaacgcaagcctcaaacttttttcggaaaaggggttcgatcgcaccagcactagtgatattgcacaactggcaggtgtctccgagggaaccgtgtacaaacagtttaaaactaaagaagggattctcaccgcaataattggtccttttatccagcaggtgatgccaaaagccgccacagaattcacaaatgaagtaactcatacgtcatacccgagttttggagaatttctccatgcaattatcaaggatcgaatggtctttgcgcttaatagtatgccgcaattaaggattatccttcatgaagtcattaccaatcaagcgattgccacaggtttcagtcatctatttgaaaacctcattgtgggaccgttgggtcagacacttaaacattatcaagaagaaaaacaactggtcgattggcctcttgaccgcattatccgctatgtggcaacaacagtgatggggtacgtacttccagccgctttattacatggttcggttgatattgagcacgcgagtcgggaagccaccgagtttcttttaaaaggactaaagccagcgtgacaaagaaatcaccatttctgttaatcaacagagatgatgattttttattgtagctagttaactttttgaggcaatcgcttcaatttcaacctgggcgccaagcggtaaaccggcaatgccgactgctgaacgtgccggtagtaccttggcgttaccaaagaactgatcatagatcttattaatctcactaaaatcggctacgttggccataaagaccgttacttttacaacgtcgtcaagcttaaaaccagctgttttcacaacctcttgaagattatgtaatgcctgggttgtttgatccacaacgttggcactaactaatttcccggttgccggatccaatccaatctgtcccgaacaatatagtgtatttcccacctgtaccgcttgtgaatatggcccaactgcattaggcgcattctttgttgcaacttcttttgccatttttatcatcttctctttcgcattaacatttcccgttacacaataagtgtgaaaggttgcgcaaattatatcacaagagaagaaaactttatattagggattttaactaagttgcctatgcgcgtcccaaatgtaaggcggccgcacccattgtaaacgttcgataagtgacgttatgcatgcccgcatcctcaaacatcttagccaatttttccgctgaaacaaactgcttggtggttcgctggagataatgatattcacgatacttgttgaccgcaaactttgccataacgggaaccgtcttgaaataggcgttccaccccatctttatggccggattagtgggctgggaagtctccaagcatgcaattttgccgttagttcgcacaacccgcaccatttcacgtaacacctggtcagcatcgggaacattacgcaaaccaaaaccaattgttgccacgtcaaatttacgatcatcaaaaggaagatgcatggcatctccttcaaccaaagtcacccggtcttgaacaccggctgcctttattttttcactggcaatttttaacatttctttgctaaaatcaagtccaatgacttgtccagacggcccaaccgccttagctaatgagatagtccaatcaccggttccacaacacacatcaattgcaaaattaccgggttgaacatctaaccgctgcatcgcaatttcccgccaacgtttatggttaccaaggctaatcaacgagttcattttgtcataatttggtgcaatcctattaaaaagcgattcaactttaggttcgggcgtcttattcgtttgtgtcattttttgtttcctcacttactggttgtttgttatataatctgtatatggcgttttaatttctaacgtttaacttgtctcaaattaattacattatggaggttctaaatgagtttagcaaatttcttagaattagttgaattcaaggctaaatctgcgagtgttttcccattcattgtgggactatttttcagttggtattttttaaattcagttaatgcggttgatgccactttgttttttattgccatgttcctattcaatatgtttgtcgacatctgggataattatagtgattatcgacactcggatcaggagatctataaaatcgggactaatattatcgggcgagaacatctctcaattcaccttatccaaaccatgatggcaacaatgtttggcattgcggcctttcttggcatttatctaactattcaagtcggtttgcccttactttggatgggaatcttctgctttttaatcggattgctttacgcaggcggcccaattcctatttccagcacaccgtttggcgaactggcatccggcttcacaatgggtgtcatgattacattaatctcagtttacataaattcctaccagattttccagtggaatggtcaattattattggaaattttacttgcggcgtctccggaatttgtttggattgcaaatatcatgtttgccaataacatttgtgatgcacacgaagatgaaatgaacaagcgccatactatcgttcattatttgggggttaaaaattcggtagccatttggaatctgctgaatgttttagcaatcgtcctagtatttgccgcaatatatgttggcgtctatccaccggctctgattgccattatcatcccgttgccattcatcattaaacagatgattttattcacgcataaacaggttaaacgcgaaacgtttgtctgctccgttaaaattttaattaatggttcactgggcttgtgcttaggattcttgatgtattggatttatacgatggtccattaaaatcaaaaattatagagtgtaaaataaaaacaccttcaatatggtcagccgattacgtcttagcgactgtattgaaaggtgttttctatcatggtaaattgtaaagattatttcttataagcgtatttataactccactgtgttccggcagtattgtgaatgacatcctttaggcttgatctttgtaaataggaagtcacttgttgatacagaggagtcataccctgatcactattaaagagtcgaatggcttggaccaggtcctgccaacgtttgtctgcattatttgcatcctggttttgagcacgtttaatcaatgcatcatatttagcattcgaatattttccgtaattataagacgtattcgtctgcggaatttgaaggaacgtgattggatcattaaagtcgccaccccaaccagacagataaatatcgaagtcaccttttaaagcgttctgttgggcattttgacttgggatatttcgaatttgaaggtcaaatccagggagtactttcgcgtattgagcttttagatactgcgtaatggcactggttgccggatcatccgaactatcattggcccccataatagaaaccgtcaatttcttttgaccaatttgctttaaccctttttcccaatattgtttagctaatttcgtattataatcaacagttcccttaacgtattgttgtttggcgaagtcttcgcccgtttttggatcattggctagtccggaagccacaaatcccttaggcgtattcgaaccatttcccataaccttctttgtcaaaacagaacggtcgattgccaacgacattgcaagacgaatattcttgttgttaaaggcctctcgcttgatccggttactatccttgaaattgtattgcaaatagccgacaaatgagtatggatactgcctgaactgtgagctgttttggtaatttttaatctgttgattggaaagtggcgtcagatcaagctttccttgttggtacagctccaagccggttgtcggactgccaactaccgtgtaattaattttttgaagtttgacaacctttttatcccaatattgattattcttcacgaattgccacttgttaccggttccgttccaattttgaattttaaagggtccggaataaaccatgtactgtgatttggtcccatacttcttaccatacttgtcaacaactttttggttttgggggccaaaaagcggataagacattaagactttaaaataggcaatcggtttgtttaatttaataacaaccgttttactgtcaggtgccgaaataccaactaaatttggtgactttttaccggcattaacagcatccgcatttttgatgccgctgaacaggtaagcataagtcgatttagtcttgggatttaaagttcgtcgccacgagtaaacaaaatcctgcgcagtaattttatcaccgttactccatttggcactccgtaacgtaaatgtccaagtcttgccatcttttgaaacatggctgctcttagccagcccagcggtaggcttgcccttcctacccaatcgataaaagctttcaaatacgtttcccgtttgaccataaccggatgactttgaaatatcgattgtatccagcggtgccgttgtactcaaattcaacgtttggttctttgtcgatgaagattgttttgttgatgattttccacatgctgcaagcgtcagcactaaagcacctgcaacgaccaataataatgctgatttaaattgacgcatatttttccctccaataaattaaaatcttctctaaaagtttgcatctgacattcggaactcaaacaaccgccaccttattttaatagtcgaagtaaacaaaaagtgcccccagtttcagcattaacactgaaatcgagacactcttggtagtcattatgcagccctccccactcgtaacatggggttaattgaatctgctaaatgaatttttaccaaagaagccaccatcagcgctaatctgagctggacacattgaacaacacattcgtttagcagctgataattgcaagatgacttcctccttcgttacttagtgccattaatatagccgaattatgagcacttgtcaaactatattaaaatttagaattaaccaccctgttgtaatagcgaagatagtacgctttggtctcagacgccagcgtcacttttgttacgctgagattatccggttcttcaacaaccatcggattctttggtcgacccaaagcagcaagaacggctgctttgattgtaaaaccgtgcgtcacaacgatgagcctttgatttgagtattgttttaccatgtcggacataaattgatcaacccggtcaatcacatggtcaaaggtctcaccatgagcaattgatgcatatgatggtaatacatcgtccagaacatgatcaaagacatcaggatatttatcttccaactcggtattctttgagccgtcccactcaccatatgaaatttcgagaagtcgtttgtcataggttatcggtaagtgtgcgctctgatttaaaatgtttgctgtgtcttttgtccgttgcagtgggcttgcaacaattctatctgcaaacgaaatgtcaaattgtttgtgcaccgtttgtgcttgtttctttccggtttccgttaaatatgtcatatcattatttatagttccctgctttaagccggcagcatttgccgacgtctggccgtgacgcacaaaataaaagtcagtcatttaagattcctccgcattgttttggaatattatcgcatatttgattaaaaatacaaagtgactttcatttgcaaatcccgaataataatcctgaataagcaaattttatttacttattaccaaaaattaggttgcatttctctcaccgttctgttagattttaattagaaagagatggaggtcttaccaatgaatgttatcttaggtagtttcaaacaagttacatcatcctcctggtctacagtgacatctgtgtaggccatcttttgatatgaattaactagcaaaaggcctcacatagatgaacttcaacatcactgtgaggccataaaaaaagcattaccagccctcacagtattgttcaagctaactgtgagggctatatttttttgaaagggagttttcgcacatgacggtatataattttgcagcaggtccggcaacgcttccagacccggtcatcaaacaaattcaggaggaattgccttcacttcaaggttccggaatgagtattctcgaaatttctcaccgttcccaaatgttcgacgatatcattaataccgcaaagcaggatattaaagacctgatgcatgttcctgataattatcatattttattcttccaaggtggcggtaccggtcagtttgcagctgtcccgatgaacctggctaccacccataaaaaaattgccctcttagatagtggccactgggcaaccagagccggtgatgaagcagctaatctcggtgtagacgttgatgtccttgattctacaaaagataagcattatcaggaattaccgcacatgccacacgctatttcaagcagtgactacgattaccttcatatcacaactaacaataccattgaaggaactgcttaccatacacttccggaacatggcgatgtcacattagtcggagatttatcatcaaactttatggctgaggaatataacgtcacagattttgggttaatcttcggtggcgtccaaaaaaatttgggtcccgccggtgtaacggttgttatcgttcgtgacgacttggtgaagcacgttgatcatattccaagtattttaaattatgaactattcatcaagaagaactcaatgtttaatacaccccctgtatttgccatctatgccaccggattagttcttaaatggttaaagcagcaaggcggtattgccggcattgaagcacttaaccaaaaaaagtcgtctcttctttatgactttctggacaactcaaaattattccataataatattaaaaaatccgatcgttccttaacaaatatcccatttaaaaccgatgatcctgatttggacaaacaagttatttctgcagccgatcaggcaggactgaagaacttaaagggccataggagtgttggcggcttgagggccagcctatacaacgccatgcccctggaaggtgttcaagccttagtcgacttcttacacaattttgaaaaacaacattaggaggaatttagaatgtatcaaataaaaacatataatgcaattgctcaagcaggattagatcaatttaacgatcaataccaaataaataagactaaagacgcagatgcgtacctgattcgatcggttaatttacatgatgaatcttttccaaaaagtcttaaaattattgcccgtgcaggtgccggctttaacaacattcctttagatagagcaacgaagaacggtatcgccgtttttaacaccccgggcagtaacgccaacgctgttaaggaactgattatctcactactggttgccagttccagaaacctttttgatgccgctgcctactcagctcataacagtggtgcagatatttcgttacggactgagcacgacaagactaaatttaaagggtccgaactaacaggtaaaacattagctgtcgttggtgttggtcatgttggctcattggtcgccaacgcagccagtgctttgggcatgaacgtcattggctatgacccctacttatcttcagatgctgcatggcatatttctaccactattacccgtgcacgaactttggatgaggcgttaaaggatgccgactatgtaacggttcacgtaccaaagaatgaagaaacaactggcctaatcggtaaagaacaattagccgttatgaaagatggcgttcacctcttcaactactcccgaggcggaattgttgataatcaggcagccgttgaggcgctagatgcacaccatctacaaacatatatgactgattttggtgaagatattttattaaaccgggatgacgttgttgtcacacctcacattggcggctccaccgatgaagccgaagttaatggtgccacacagggcgcccgcacgatcatgacttacttggaaaccgggaacattcaaaactccgttaacctgccaaatcttcaggtgccatttcaagcaccataccgaattaccctcatccataagaatatccccaacatggttggccaaattgctactgcattagcaaacgccggcatcaacatcgaaagcatgagtaacgccgctagaaaagatgttgcctacacaatgatcgaccttgataacctaaagaacgaggaagataataaattaattgatacattgagtaaaattgatgccgtatttagagttcgcgttttaaagcactaattcttacagggagaatcgaagccaagatgagtcacactcgtcttggcttttttctactctatccttaattttattttgaagaatagaatgaccgatgatcatccaatcacgaccacttatcttaaaaatatttccaaaaatagccatgaccattactatcaatatcaggaggtgagcaaatgtggaagttgaaatgaaaattattaatgatttaaaaccaaatactgttttactagggtttaaaaaacgaaatgaacaaatcaatcaaattattgcctatattgaaaatcatgatcaaacagtgattggtaaagaaaatgggaaaaatcgtctgcttcatttatccgactgcttttcgttctttaccagccagaaaagcgtttatgttaacaacgtgtcattatcccaacctatcaaaattaatgataggctatacacgctccaagaaaagcttcccaagcaatttattcgaatctcaaataccgaaatcattaacttgaattatgttcaggagttcgaaatctcaaagagtggtattattttaattcatttcagaaatcattatcaaaccagttcgtccagacgttatttaaaagccattaaggagcgtatattatgaaaaaagtaattaatcgaatcatgaccggcatcgttgtcggtactttcgtcggcatgatattatccctgatattctcagcattaaacggcgcaactcagtattatccttcttcacctgcctttgtttcacattttaacggttcactgaccgcaacggctgtatcggttgtgatttggtcattaattggcacaattttctctttaagctcaatgattttttccaatactgattggagtattgccaagatgaccattatccatctactgataacatattttggcttcctgccgctggccatcttaagcggttggtttcccctcagctccccccaaatcgtcagtttcaccattatttttctagtcgtctactttattatttacacaacaatgagacgaattgctaaaagggaagtagaagccattaacgaccaacttagaaaacagtaactcactcatgatatcactaactaattggcaagtaatcccagatgtgatattctatatagtaattaaacacgactgccaccgggtagcaacttttcaggtacgctttccaattccattaggtctaagaaggaattgaggaggggtactttttttgaccacaaggaggactttttatgaattgggtaacattaattattgctggcttatttgaggttgtttgggcgatttcaatgaaattcagtcacggatttactaaattggattggacactcgtcacaattgttggcatggttattagtttcttattactggcacacgccaccaagtctttgccaattgggatcgcttatccggtttggactggtataggcgctgttggaacagtcatcgcaggcattattctgtttggggacaagctctctatgctgacgtggatgttcgtcatcctactacttatcagtattctgggtattaagatgacaagctgatcaatagccgcttttcgtatgaatgttcttattgacctcatacaaagcttaaattgagcacagatcaacaattacttaaactcaatcagcggtcaaaaatgatctaaaaaaaggctgggacaatagtcaaaaatttatattataacgttcctacccaaaagtaaaaatcccgtaaaatcagcgtttttttaaactgattttacgggattttaaaagtagacattattcaggataaaatgatctttgtctcaaaagattccaacagaaaaattatttgtaatcgcttctctttttaaagaacaaagtgtaaaccattcctgctaatccaagcagtgaaaaaacagtttctacataccaattcacactatctaaatcaacgtgtacagctgcactcacactagttacaaaaacaattaagcatacccaaaaatctaaactaagataaaattttttatttacttttgccatttaaatcccacctaaaatcggacaaacggatgctttaaattccacgtagcctttttaccttgtgtatatccccaagaattccaaaatggcgatgcccaatccccaccagtaacggcctttaaatccaaatccttaaccactttaatatttttcaatataacctactcctttcaattttcagataataataataattttaagttaaggcttcttaaatcctttattaaaccctgacttaatgtcatttcgatctttataagctgaataaccaaccttgccaatagtggtgattacagtccaccaaactccaccaccattaatccgtgataaatctttgtctgtaactttagaaaacttgcttaatttgttcataataatatattcttcctttcctttttcacctgtaaaccaacgaagcatctttaaaatgtgcctaaactgcttaaatatacctcttcaacgttcttcatatcaccttctgtcaatggaacgattttttaaaaactataggcgttacgaataattggctgaattgtaattgggtatcgatccccaaaaggcttattcggaattggaaaagtctgacccccaataacacttactaatttatgagtcgataaaatagttaaattatttctactcatacaaatctcacctcttttcaagacagtgtaaatacaaaattaagctttaaaagtcataattaattttgacaaaatctagaaaatcttgcgaaaactaattgacagtcacagtatctctccaacctgccaagaagactagctagcagcaatagacactgatacaataggatttgctacaatccttagacatcaaatattgtcttttaagtattgaaaataagtttccgttccggttaccaccgatagtttgccattcataccggtttttaataaattaatttctttatttgaactattaagcttaaccactatgccataataggtctggctatggataatttggggactaccactgattttgacaatttttcctttgatagcggatgctaatttacgatttccttgaatggtaaatctggcttcctgggaattctttagttcagaaatatctttttcattgactaaaccataaacactgttttttattggttctgtcctggttgtccgttgagacgtttgcccgtatactcccgccccggctacagttacatccattcttaaataactacttaacagaactagccctacaagaaacaagaatattggtaggacaatcaacatacaaaccggagtatatcgatgatagtagtattccgtactttctaaaacactgtttttcataagctaggcctcctgcagcaattgataatagttaccatgttcattaatcagatctttatgcgttccattttcaatgatttgaccatcattcattacaataatccgatccgcttttcgagctacttccagacgatgagcaataaagatcagcgtcttattctttatccccattaaattatttaaaattcttttttcggttaataaatctaaattactagttgattcatcaaaaatcatcactggtgcatcgctgataattgccctagctactgcaattcgctgcatttgaccgccggatagccctgaattttccgacaaattcgtcatataaccgttgggcaatttttcaatatctttatgaatttcagctaactttgctgctctaataatggtttccatattaggtgtcttacgtaatcctaaggcaatgttctcaataaccgaacccgaaaaaataaaaggcgtttgtggtaaataagtgacataatttctgaggtccttttgggttacaaacctaatatcttgtccattgatcaacacttttccggtaattggcttgtaaaagttaactaataacttggccagtgttgtctttccagaaccgctaaatccaacaattgccacggattcattacgtttaatttttaaattaatattctttaaaattgattgtccatacttatactcgaaagaaacctttgaaaactcgatttgatcagctagatcattctccctcaaggccatcggacatttttgtttttcttccacaggtgccagtagaacctggttaagccgcttattagccaccttggcattttgaagatcattttgtaaattaatgatcgcttcaactgggcctaaaaaatagcccatcagggaattaaaagcaaccaattgccccaaggagatttgacctttgatggccattagtgatccaaagtaaagaattgccaacgtgatcactaattcagctacatctttcaatgccgcttgagtgacgctggcaatgctgtaagcataatcggcttttaaagtcttaacgaatcttgtgtcaattgtatcgtacattttattttcaatgtttaaggatttaattgactcaattccatgtagatcttcaatcatctgagaactaagtaatgcgttttgttccatactttcgttattccatttctcaaagagtttatagaatgagaaaataattgcagcataaattggaactgaaatcattgataacaagaaaagtttcatactaattaccattaatacaattccaatcacaataatggttccaaagttaagcaatgtagaaatagccgttctcgctaacgttaaaataatattgttagcgtctgaaaatctagaagttatctcgccagtcttcctagtctcaaagaaagataccggtaacttgaatagatggagaatatagcttagcaaaacatcaatcgaaaggcgttgaccaaggattgttgataaataaccttggaaatagttaaagattccatggaaaacataagcaaaaaaaagacaaattgccgctgttgttagagttgttgtcataccatcaataacataggaatcaacaattttttgtagaaagagggctccaacaattgtaatgaacgtcgataaaaatgtcgatataacaactgttgcaataatttgtttttgtttcaacagaagcttagctgtttgccacaaactatcattattatctttaatattgacgtaagttggtcctggtgccataaaaactgcaattccagtccatatcttagcgaattcggtataagtcaatttagtgattccgatactgggatctggatcagcaatgactaagtcatcttttcggacttttaaaacaactacatagtgcaatagaccatgattcttattaatgtgagcaataaatggtactagtatttctttgcggtcattactcttgaaaaacgaaatatcagttttaattgcttgagtttttaacttaaaatgctcggcagcatttattaaccctaaagcggttgtgccactcttatcggtttgtgctacaccacgaattttcgcaatcgaaatatctgaatgataatattttaaaatcattgccaatgccgcagcaccacaatccgtttcatctaattgatgaacataataacgttttttaaacatctaaattccctcctacataaaagcgatctcccaattaagaatcaatatggagatcgcccaaaagttcatgacgctgaattctagataagctaacttatcagctttcagtttcttataattttccgactgacactggcccatgtgtgacaataggtgaattgataagtcccttcagaattttaataatctcagacttataagcacctccagaaatctgggtaagttccagtggtgttactaataataaatccttatctactttattcatgtaatttcctccaaatttatccgaacgtttttcaaactctttcataaagcaatcatgccaaggctctttttattttttctatttctaccaccagtaattttagctaattctgcttttcttaagatccttcgagaattatcatcaatccttttgtaactgataataagcgtcacttcctttatttttatttaaatataattaacccgaattattcatagcttcaaaacagcccaccattttaacgatttcgttaaaatggtgggctgcttttgaccttaatgagcactttactgatgcttcgatcatgtttggtgatcgcttaacgaa

SEQ ID NO: 455 - DNA, 128464 bp, Unknown
  Metagenome-assembled genome
tgccggcgataattcaccaacttggtgagtttagatagaccaatgagggaagtaaattgatgaacaatattgtgaagctcgttttctgtatttttttgtcttataatattcatgacgtaagtctcctcgtattattaaaaatgtattcaagtattgaccagcttcgctgtttggatgctgtgtgatattctctaattgttcattggattcggatccaactggtataggctttcgcctcctgtagtttatctacattttaagaatgccgcccagatgaattgtttaagttcaaaccacaagctgtagtgttagctgatgattttgatagctcgcgttctatcagcagctagtcattggatgacttgtctactcataaattgcgaggatgttctgaagattcataattagggagtatcacacagcacccaagcctatccaaaataagaacggaaaggaggtctgaatcaatgaacttgaatgttggtattgatgtttcaaaattgaagcttgattattgtggaatggattcaaataagcaagtgtgtttccaaggtgaagtaacaaacaccccgaagggggccggtcatattcgtgatgagattttaaagcggtctcagcaagctgaccaaattattatcggcatggaagcaacctcagtttataatttccacccaaccttgttctttgaacaagatgatcgccttaatcagttaaacgtgactgtggtcaccttgaatcctaaagtgacgcaccgttacagtaagttatttgatgatgataagaccgataccgttgatgcctttcacattgccgatttcttacggatcggccggtatcaagttccggttacccgcgatgaaaagcacatcgctttacaacgcttgacccgggaacgataccacttagtccatcagatcaatgattgtaaaaatcactttttaaataacctgtactacaaggtgaacaccatcgatacggtcttgcctacctcagtttttgggtcaaccatgcttagcattctgagtgatgagaagtattccctagataacctggttcagatacccttgtcagccttaactgatgagctaaatcatttatctcatggccggtttggcgatgccaaaagtgttgccaaagcactgaagaaagccattagaagttcttatcggcttagcaagacggttgccgattccgttgatcaagtattggccatgtacgctaatcagttgcggatgcttaatcaacagctaaagctgttaaataaaagcatttctgatctgtgctcggtcatttcaggtgcagactcactccaaagtattccgggaattggaccagtgtatgcggccggattactggctgaaatcggccaaattgaccgtttccccaatgatgctagtctcgccggctacgctggcttatcatggcaacgcagtcaatcaggaaatcatgagcgacaattaacgccgcgaaccaaaagtggtaaccaatacctacgttattacttagttgaagctgccaactcagtaaggcgctatgatcccacttatgccaggtactaccagaagaagttccgggaggtaccaaagtatcaacatcgtcgagcttgtgtgttgaccgctaggaagctggttcggttaattattaatctactaactgaacataaactgtacacgcctcctaaattggtctagcgcgacgaacatcgctaacattgcaagtttctaaccagtgaatttttgtacttcactgggctgggggaagtatactctcctcacaattagaactatcaatattttacgtatcacctacttgacttctgaccacaagtctttgtatcttggttttggtcgactaaagtatacaacgcaggagagcttgcgtttatttttttgccaaaaaagccaataaccacacgcctttggcgtgattattagctttcaagtttcagtctataatgtatcaaaacatggttttgaaatatttactttgtctcaaccagtaatcaaaatcatgagtgattgcctgaaataacattgactcaaagataatgtcatttttgctcttatgtgttttaagagatcaattaaatatttatatacgtattttattggtttgaagatatataactccaagggattttttatcagaaatgcaaagagtatcgaaagaaggaggaaattattttgaaaaggacagcaggtttaattgcgatatttagttttactttattcgtaaccttagctttttcatcaaataaattagctttggctaaggaaatcggacttcgcagagttaccagcagctatatcaatagaatcggtgaacaacatcagtattatcgatttaatcaaaatacaacgtttaagtacggagggagaaaagttacactgcccaaaggaacgattgttaatggggaagtcgttttggggagtacaaagaaagttttaatgtctggttgggttggggtcagctatgctttaaagaagaaattaaaccttaaagaaccaaccaaagagttcggagtttatctttcatattcgccgaagaagtatacactgattaagcggcctgcctatactttaccgtatggcaacaacattctttattccgggggtgtaagcacttttaaggatcgggcggttaaatattatcacgattcatcgtttcctagtaatgctttaagagttacatcagatggatatctggagttttataaatatggtcatacccctttgggcgacggaggacttgagtggagttacgtacaaaaaccaacaagttacgtcaaaattaattatgtactgaataaggggtcaaaaaagtacttatattttcaacgaaaactttcaggagttaaggcaactcgtttaagtggcggtagatatcgttatcgcttaacaatcaacaatctgcataccccatacaaatatactggtaaatcatatgatatggtagccagtttttatacggttggaggcgttaagtatttcgaagcacccgcacagtcaaataattatggttctgattagaagctaatagttgtttgctttctgatcatgaaaaaatcccataagggtagtggtgtactatccttacgggattttttagctaatttactcagctgaaaatttagtgttttctttggttattaatttaattagtgaatgattttttggaatactataaatgtaatgttcattcagttttccactatcgggagtcttttcttcaacaccaaaataaacataatctccatataactgaggggactcggtttcatgcttgtgaccacctaagtcgttaatggatgctgttatgttttgaggtgccggagattggaaattccaaggggcacgagcaataacagttgggtcctcagattgaccactagtcagatagacccagttataacctgcattggtccggttagatagttccattccttgccatgatccttgggggtaagaataactattaattggacggcttgatacataggcctgaccaccctttgccaggcgatcatcagtacacttaatattgccttgggcgtccatgatctgatttagttcatcggtcttaaaagctgtcactctttttttggtcccagtttgaccctcttgagtccaaactgctaggcgagtttcatcagcccgatataaagtcatatttttatccttaccggttcccatatagtttagataagtgatggagtttacatcagctggtgtcttggaggtgccatcaattggtaaacgagcgactcgagtggcccagtaatcgccatcagtactagcgtttgatccagtgtaagtcataacccaagcatacaactgattattccaagtaaacaactcaaaggtttgaccatggccgaaattagttaaatgcatctgagtcgaattattagagagattaatttcggattcatcggggtcaaagccaccatatgttaaggtcatgtccttgtgactgcgagcggtcatttgaagaaaataagctaccttgttattaaagtctaaataaaatttttgaattactttactacttggtaaagtaacgtgatagttacgtgttgcagttgtcataataattacctctttctgaatttaaagttttttgatttgaatcttctaactccggaattaaaatatttttttgtatcaaatcgatttgacgcttatagcttatcgtgaaattcaatataaaaactgccacttagctgtcaatttagtgccaatttactgacaggtttttaacgcaaaagtcccattaatcattaatactaagattaacgggacttttgtattgttttttggaattaacaataaataggcagtaaagtggaggccattcttttatatggttaatttagggaactatggaaccttcctcacaaaaatagtggtaggaaatcaaaaaaatcagaaacgctgatttaacatggatataatttagatatatttaatttttgtatcttactcttcaatagcttacaattaaagagtaaattaattgtgtgcaatagaatggtacttatatttgattgatttttaattttaagactggaggcaattttatggcaaatcaatacgattatgatgttttatatctcggcagtggtcatgggacttttgatggagcgatcccccttgcgcatttcggtgtcaaggttggtatcattgaagaagatatgattggcggtacctgtccgaattatggctgtaacgcaaaaatcacattggatgcacctgtggcattgactagggaagttgaacggcttcagggcgttgttgaaggacaattgtccatcaattggaccaagagtgaggctcacaagcaggatgtcattaagggcttgccaggaatgattggcggcttacttaaggattccggtattgacgtgattcatgggaaagggacctttaaggataatcatacggtattagttgacgggcaaccgaagacagctgaaaaaattgtcatttcaactggattgcggccacaccgtttggatattccaggaaccgaattggctcatgatagtcgtgcatttatgagtttaaccaaattgccgaaacagattgctattattggttccgggtacattagtatggaatttgcgactatcgccaatgccgcgggcgccgatgttacggttctcatgcatggtgatcgggcacttcgaaacttctatcacccttatgttgcccaagttgtcaaagatttggagaaacgaggggttaagttcgtaaaaaatgccggcgtttcttcgtttaagaaatccggtgatcaagttgaagtccattacggggatgatcatgccctaactgttgattggattctggatgcaaccggccgaatgccaaatgttgaaaaaattggtttggacgaaatcggggttaaatacaaccgacacggaattgaagtcaatgattatttacaaaccagcgttgataacatctatgcttcaggagacgtgattgataaagcacaacctaagttaacgccaacggccatttttgaatcgacttacttatctaagcgtttttcagggcaaagcaatgatccgattaactatccggttattccatccgttgtcttcacgtcaccgcgaattgccaaggcaggcctttccgtagaagatggtaaggaaaagggttatcaaattgaaactaactacttaccggatgattggtatcgtcaagttgataatgagaccatgggtgataattcattggtctttgataagcaacatcatttggtgggcgtgacagaggttagcgaacaggctgaaaatgtcattaatacgttattgccggcaattgaatttaagtttggaccggcagaactgggtagactggtctacttgttcccatcaattggttcctctgcatgggcacaattgtaatgaggttgatgtcaactacaagaggaattagttaggcctttttcttaacttggaaaggaagttgtggcgatggcactatttgataatcgtagggttgatgggatcatggcagatcgtggattaagcgatctgagtgaagaaactgaaactcatgttgaagcgattttaagcgaactcgatagtaaaaaattattgcgagacagtgacactgctaattttaccgatcgctcaaatcaagaaaaaattggttttttacgtgcaattatggaacaaaactggattttgattgcgcagaacgaaaagcttttgaaagtattgaataaaggtaaaacaagttaataaaaccagaacaaaaagctgccggtgattaacgccagcagttttttgattgaaagactgatgattataagaaatagtggttattagcggacttctttaatgacatataacagtttccgccctttgatagtaaattaaacttagagataaaatatgacgggcaaagtaagggattaccctcaacctcttttcttttgtttaagcctataggcagttctcacaatatgcggtacacttcttttaacttattatagagggagttggcaagtcttggcacaaaaagtgtggtttataaccggaacttcaacaggttttggaaagagtctggtggatgagttgattgctcaaaatgaattgattgtagcgactgctcgaaatagtcaaaaaatcgatcagtggcagggtaatccaaatgttttaatcgctcaattggatgtgaccgatcaagcatctattcaacaggcagtgaataaagtagtctcaaaatggggtcatattgataatctggttaataatgccgggtggggttatttcgggtctgtggaggagtccaatgaagatgatgttcgccagatgatggaaaccaatttctggggaacgtcggcggttactcatgcggtcttaccattaatgcgaaaacggcatagtggccatattttcaacattacgtccatggctggcatcaccggtgttccgggattcggctattattgtgcgactaaacacgcagttgagggtttaatgaaggcgttaagtcaggaagttgcaccgcttggcattaaagtaaccaacattgaaccgggtcctttcagaaccgattgggccggtcgttcacacaaggctgctactcggcatattaaggattatgaccaaacagcccatgccaatgacgaacaaattgaagaaaagtccggaaaacaaattggatcaccggaattattggcaaaagggatcgtgacattaagtcgaacggcaaatccgccactgcattttttagctggtgaaaaatcagttactcgcgcattggctgaagttgctgaccaacagcatgattttgaaacgtggcaacagttatctgccagtttggattatggccacgaggatgattggaaataacttaaattttgcgattcgtgggttaatgggttatgactagcggcaattaatttgcggccctttttgtaatttcaaatcaatttgaataagaaaatactgttacttatttcttaattaatcacaaaagcggtaaaatttaagcaagtaaattagaaaagaatgtgactcgtagtgaaaaaaaagaattgggttaatatcatcattataatcggcatgatgtcattgataataatcgctttaccaatattaactcggccgttaatgcaccaacttcaagctttggattggttttggctggtaggtttacaggagatgccaatagttattattgcgtggatacttaaccgattctacataaaacaggctgttttttatcggccttccgggtcccttaaaagtctcacttttatttcaagtcccattttgatccttcttctagccattactttgtcaatcacgtttttctatcaaatctcttttaagtctttaatagcattgtggcatattctaatcgggaccacctttattggtatttctgaagaatatctctttagaggactcatttttccccaaattcttaaggcaatcggcacttggacacataaggatctctattcagccattggtatctccagcctcttgtttgcccttatccacgttttgaatttaacgggtcaggatctaactgccacggttattcagatggttaatgctttttcgatagggtgtctgttttgtgccatctatattcgatcgggttcactattattgccgattatttttcacagtctttggaattttggtattttcggtttagacggcgcgatattgacaccgagatctattttctggatgattatctttaacaccattttattagccattacggcatatgatttgcgtgaacaaaagttgagtcaacgtgatatctggattgaaaaactggtgagttaatgattctttatatgataaggcttaatatcttcagaaaactgatccaataagcggtcatgatactgtttggaccctgtagaatgcttaacgtgatgccaaagaatggctgcaactttcatttttttattaaattcatggcttttcgagctgttacagaagtccttaacaaaattattccattgataagtctgttcttctggaaggtcctttaaccaagtttgttttgaatccgtcatttctttagcccgattaatcaggtcacctactgtgattgataaattgtgatccgcttcggcttttcgtttaataacagccatttcttttgtgaacgaaaattttttgacattaaagtaggtcgcaaaaaattgtcgagcctcattgttaaatgaaaatccggacccaaccagtggtgtatccaggctgatttcagacattttaagcgaaggcgctttttgataagttcttgctggctttatctggttagcagggatgccagataagaagcaatcaatgtagtgatttagttcagccttagttccttgggtcggcaacccgtagtttcgacaaatcctcaccaactcagctttataaaaataagtctctttaaattttttgtgtgtgagtttggtcataatatcctttcaactaatgattggcttaacagtgttgataccctattatagctttttcaacagcacaaaaaaccaggaatccgaataaaacgggttcctggttttaacacaaattggataatctgattgataaagtagactatttttgattaataatcggacgggtttcgtttaagcgttcttcaatggcttctgtgataacggggtggtcctcaagcgttggcagaaaggtactatccggttgtgcttttagcacgttggttttgatacgattagccagacggccatcggtcaagaaaagtcgttgcacaattaacgctgccgattcatctgctaaaacatcgggtaccaagtgatgaccaatatgattggcgcaaataatcggtaccttaacgacctcctgtaatcgctttgccagtgctgtcagctgttcatatggttcaggaaaatggggagttccatgagcgacaatcaagatttttcgatttggataagtctgaattgccgatttgagcgtttgatttaagtaattaaaaacagcttcggttgttgccaacggttttaatactgtaaacgagacacccgcttcaagcacatcattaattctgcggggaatatcccaacgaatgtgggtcgctgaaaacaagagaaccggtaccacaataatatgcttggtttttgattgtaaatactgaataccttcctcgagtgtctgttgctgcccctccagaaatccgatgattgacgggttatctgagcgtttcatataagtgtgtaataagtcaatatttgattttgggatttttccgcgtcgaccatgcaacacgtaaataataccttctgtcataatgatttccccttattcagttacttcggtcgtcaatttctgagccagcttttcaaggtcggcgatagcgtcatcgtctggtgaattttcaatttttaatgacggggcgataagcgttgcattgtcatcacggatctgtttttccaaaatatcaacggcaccacagaattcatcgtagcttgaatcaccggtaccgataacaaccactttcttaccggatagatcataatcatcgagatcatctgaaaagtcaataatcccgtctggcaattcaccattatcaccgtcactatagcttgcaagcacgtaagcatctgcgtcagtgaaaaagttatcaacttcaatgccgtcttcactgtccaaaacctccacgtcagcccctaaatctgttagggaatctgtcaggatatcgacggcctcttgggtgttaccggttaaactggtataaataattttaattttaattttcattttaatgcctcctgtagttgtgaaagatattggtcaaccaactcctgaaaatgaaaccttccctgacgtgaaaaatagtcatagaaagtttcttcaagctttttttggtcctggtaatctttcaaaataactgccaatgcgtcagctagctgatcttttgataattttccctttaatgcttcggtaaagtgaccgccgtttaacaaactaccaccaacggataaaacatagccttcagcgtgatcaccggtctgggttctggctttaacaccttcgataccgatatcggcaatacttcggtgggcgcaattattaccgcagcctgtcagggtaattgtgacaggcttttcaaaagtgaaacgctgatccaggttattcagtaacggtttgaaaatttcctttgtgtgagcgttggctaaattacagtattcggcaccggtacaagtcgttccgaagtccaataattgatggggggttgttgaaaaacgattgaaaatatctgccgatttaacggtttccaaatccttttcagcgatgtatggaatgatcagattttgtccatgatcaaaacgaagttcatctttaccgtatctctttgcaagatcgacgaaagcttgaaaatcgtctccggaaatccttcctgccggtatactaacgccaatgtagtaataccccttttgacgttgagggtgaatgccaagggcagtcccatttgaccaaccaacaattttactattgcccgctgtttgaagcccaggtactttttcacgaagagcattttcaaacttttgaacaccccagtcctgaatcaagaactttagcctggatttcgatcggcttcgacggggaccgttatcacgatataaagcgacaacagcttcggcaacgtcagcaacttgacccggtgtgacgaagctgttcattgcaagtcccaaatagggtaacatgcctaaaccgccaccgattttaacgttaaatccctgaacgctttggccatttatttccttgattgccggtgtaaaagccaaatcattaatttcagcatttcctgcgttatagatattactgttaattgaaattttaaactttcgtggtaggtttgaataatcacggttgccttggaatcgtttgtaaacatccaagacagtttggcgagtatcaaacagttcatttgcgtcaataccggataatggattatctaccacgtttcttgtaatatctccctcggcaccggccgttgtgagaccgacgctagcaataccgtcaaaaatatcgggtagtttttcaaacggaatccagtgatattggacggcttgacgtgttgttaaatcaacgattccgcggccatatgttttggcgatccacgcaatatggtcggcctgtttcaaattaatccgaccaccgggaatcttaattcgcatcataaagtatcctttatcttggggcttttgaaccgttaagccagcgaatttaaaatacatatagtagcttttgtcgatttctgagaaagggtgcttgaccaattctggaagatctttaaaaacatccagtccatcttcttttaattttgccttttcgtttttattaatccgttggtcggcccacgttactttatagctcattatcatccctcaattctagatattttcaatcaaaacctgatgataagcattgaaatcaagccatttctggtagaaagcagctttggtattatcatttaaagtttcctgctcatttaagaattcttgtaaatcttccggctggttaatgttgactttggcaccgatattattaatagtagggatctgccaatccaaatcatcgtccaacgctaccacgtctctaaaacgaccgtcttggacaagtaagacccgatcctgacgcggcagaatgatgttgaagctacttggataatggtaacctttgcctgccaacggtattttttcgttcagtgcaaatttaccttggtattcgtccgtttcaattcggccgccgcccgttaagctataagaatcaaaaatattaatttggtaatgattcagattatcagtgaaatcgccaccttttaaagcaacttctccctgataattttcggtaatggtgccgccaccggccacatcataaccatcaacgactacaaatcgcccagtaacatgttgttgatcaaagaaatcatagaccagaggctgttcggtttgaaaaacaacttctgccacgtcatttaagttaacctggctggcatcttcttttgctgctaaagtgccggcatccgttacctttaaaattttaagaacttttgcgttcacttgttgggtcgcaatcttaagtttataaacttttccgggtaccaatggcgcctggcccatccaaaagaggttggtttgtaagatattggtaacagccggagctgctgtttggtcctctgtcttggtaataatttcaccgcgctggttaaagaactcatctttgaccatgacaccaacggactggccggcagcagccttggtttttgcatctttgggcacccagttggcaaaagccgttacttctgtttgccggccactgggatagatcgtaatttgatcaccgattttaagtgtgccggcttcgattcgaccagcaataattcgccggtcatcgaatttaaagacatcttgaatcggtaatctgagtggcttatctacaggttgatcggcggcttcgatactatccagtgtttcaatgaaacttttgccatggaaccaagctaatttgtcagaagccttaagtagattttcgccataataagcggaaatcggcaagtatccagatggcttaacgtgtaatgtattcaagaaatcggctacttgttgtttaactgcttcaaacttggcttgttggtaatcaactaaatccattttgttaatcaggatgtatatttttttgattcccaacaatttaaggatgtaggcgtgacgtttggtttgttcctcaacacctctagcggcatcaacaatcaagaaagctacttctgcatttgaagcgcctgaaatcatattctttaaaaattcttggtgtcccggtgcgtcaatgatgacatactcacgtttatcggttttaaattgaagttgagtcgtatcaattgtgataccctgcttttgttcttcttcaaaggcatccaatagataagcatattcaaaaggttttccggtttcttttgcaattcgcttaactttatcaaaggtaccttccggcaatgccttggtatcatataacaggcgaccgatgacggttgatttaccgtgatcgacgtgaccaaccatgacaatgtgtagagctggttctttcatagtgaaactcctttcgtgcttttgtgttgtaggaccgcttctcaaagcaacgttctgcatgtaagagatgcctttcaaaaatccaaaatcgggatttccgaaaggaacgtcatacattccgaccattagccgctttgatccgcgcactgattaggacagctacacaaagcagcatcacgccacataagggatcaaatcgaaaaatccagacccgggatttcctgatttgacgccttatgctctggatgctaagcgctttgtttcgctcactacatatatcccgactgtctcaatttttgcattgcgtacgcgtcttctttatcttgtgcccgtccggctctttcactgaccttggttttctttagttcttctataatttcagccacgttttttgcgtctgattttaccgatccggtacatggtgcacatcctaaacttcggtatcgcctatgattctttgcgaagtacagatcaataatcgggacattttcgcgttgaatatattcccagatgtctaattcggtccagtgaagcaggggatggactctaatatgatttccctttggaaaatcggttttgaattcgtcccataattctggcggctgattggtgtaatcccacttatcttgtttagttcgttcagagaaaatccgctcttttgaacgagagccttcctcatcttgacggacaccgacaatgaggccgtcaaatgaatatttgtggacaacttgattcaacgcaacagtttttaatgcgccgcaacaaagcaatcgtcccaacttgggattcatcccctcatcaagggctttttgatttgtataaacgattaaatcaagtcccaattcttttgcaattcgatcccggtaatcgatgacttccggcatttcaaagctggtatcgacgtgaataaacggaaaaggtgtctgaccgtaaaatgcttttttaactaaccataaaagtacagttgaatcttttccaatcgaccatagtaatcctaattttcctaaatttttgtaggcttcgcggagaatataaatactttccgcttccagttcatccaaatgatccatgtaagcatcccttccactaatatttattagcatcttttcgtgacgttatgattttttccaaaatacaaccttccttgcaggcagtccaatcaatttctttatggttggtttcagcgattaaaaccgttcctttaccgccaatatcgtctcctaaataaaattcgattgcgtgctttgggcaaattttgacacaagacatgcatccccaacattcatcaggataggccatttctgctttgcgattttttcctttgccaaccattttaataaggtttcccggacaaatatctgcacacaggccacagccattgcatttttccttgtcaattttaatgctcatagtactcatctcttttcactaattcccgataaattatattgacttgaccattccggtaaactgaattgatgtatttttgaaaatgttgattatccggttccggatagtccaaattttcagcgaagctatgccaccgggtttcttttcgtgctcccaagtgcgcgatgacacattggcaaaccaataatcgttcccgcacttcatacagactcatcagttcatgcatgttatgggcacatgcaagttcaatctgcttttgaagctcctcaatcttggtttcggcgattgccaactgcgcagttgtataaccataatattgtgaaataccaccggcatcttgatccattaccgtttgcatggtagtttcaatctcttggattgacggttgatcatcggtatgatttaaatactgttcggcttgtttaacaattgctttagccttcgcatcaacactggtcggaattgaatcggggtgcttctggatttgtttaacggcagcttccgccgcaatttcaccttcggctaatgcacccgtcacatatttttgtggcgcaccaccggcaacgtcacccgctgcaaataaatgatgaaccgttgtttcgcgatcggtattaacccaataaccgcttgctgaatgaccgccaacgatataaggctcggttccttcgatttcaacgttttgctcacgaggaccgccattttccaaccaacgcagcgtttgtcccggtgccatattcaagtaagcatgataaagatcttgttcctgctgccgggtaatgccggttgtctttaaataacatggtccgcggccctcttgattttctttaacggttccataaacccgttccgaagttcgcaggccgtacttggtttcgtaaacgtcacccaaagcattgacctgcttggcaccgacgccttgtgcaatggttccggtgggcgcaatcgtgtccttacagcgaagcgcaatgaaccgcatttcaaaagtcgtcatttctgcacctgctcgcattcccattgcgtaaccggcgcccgtgttaaatggggaataccacattttgtgcttggaaaatccgggattgtttggtttgtaaagtcccgaagcaccaccagttgcgatgatcacggtctttgcgtgaaaaacgtaggcggctgattccaagagactgaaccccactgcaccatatatgcggttatgatcaaccaaaaaatcaacgatattgacgtgattgatgattttgacgtgtcgttgacgacgagcggctcttgccagtaatggtttgatattttcaccgttaattttgatgtttcggttaccgcgtgcaacatagtcaccattttcgtccttaaggataaccaaacccattttttccaaatctgctgtgactttatttaatcgttgactcagtgtcagtaataaatctccgcggacaattccgtcagcgtcattcgtggcataatcgacgtaaaaatccggagtctttccttttgtgatataggcatttagggcatttacaccggatgccagacaaccacttcttctgatatccgctttttcggcaatgacaatgtttaaatcaggatttaattttgctgctgtctttgctgcgtaacagccagccgtgccgccaccgataatcaacaggtcggcttcaactgtattctgttccattgagtatgccctcccttcaattaatggcgtacgattttaagggtgctgccgttgttgcaggagactgatttttcttaagtgtactggtatcctgcttaaagagaacaagttgttcaatcagcactgaaacgtgttcgccaatcaccagtccaggtttaagtgatgaccgattggccagtaacgactgaccatgtaaatccaatgtgactgttgtcgtagcacctctgaaaacaacgtctttaaccgttgcagattccaaagtaccgggggtagtagttgactcatcttttttaagtacctgaacacgttcgggtctgatttgcgtaacaaatggtttctccggtaacataaatccggccaggttgggggaacttaggacactcgaacgaccaatgaattcggcgacaaattgacagttgggttgattatatatttcattgggtgtgccgatttgtttaacataaccctcattcatgacgacaatttcatcagccgtttctattgcttcttcgtggtcatgggtaacgaaaatgctggtgattcccagttgatggatgagccttttgagccatatacgaagttcttggcgaatctgcttatccaaagccgcaaatggttcatccaaaaataaaacttttgggtgtggagcgattgctcttgcaaaggctacccgctgtttttgtccacccgataattggttaggatatcggttttcgaggtcggttaacccggttagtttaagtagttctgtcacgcgttttttaatttcattggcgggctgatgctgggtttttaggccgaaggcgatgttttgatagacattcagatagcggaaaagggcatagttttgaaatacaaacccgatgccgcgattctggggagcgaccgattcaattgcgtgcccgtcaatactggcgtttcccgatgtagctgtttcaagccctgctaaaatccgaagcagtgtcgttttgccactgccacttggaccgagtagcgcagttaaactgccttttttgacaccaaaactaatatcgtgaaggacattttgacctttcttttgaaatgcttttgaaatgtgattgatctgaatatacataaaagtcatcctttctgaaattgctttggaccaataagaagtcgttgaagaaatacgattaagaaagtgaagattaataaaatggttgcaacagcgaatgcatcaggaaatttgaattggtcgtataaggactggacaagtagaggcagcgtcaatgtttttccgggaatattacctgaaacgactgcgacagcgccaaattcacccattgcccgagcagttgccaataccatccctgtcagtaaaggggtctttattgcaggaaatgtaatttgcatgaaaatatcttttaagttggcaccaagaaaggcagccgtctgttcttcctcccggccccttgcctcaagaaccggaatcaattcccgggcgacaaacggaaaggtaacaaagatagttgccagaaagattgccggtggtgcaaagataatttgaatattcaatgattgaagaaccgggtaaaaccaaccggttcggctaaacgttaaaataaaaatcagaccggcaataacgggcgaaactgaaaacggtagatcaatgagtgtgttcaacagccgttttcccgggaagtcgtgaaaggcaataatccaagcagcggaaacgccgatgattaagttaacaaagactgacacaactgtggccgcaattgttaaattgatcgcgtgaagtgtatttggactggccaaaacagttaaataatgggaaaatccggttgaaaaagcctgggtgataactagcgcaattggcagaatgagcaaaatgatcatgaatccccaagcgatcaggactaaaggccatttaattttttttgattgaaatagttgcattaaaatctatcctttctgtcgctgaacgtgacgctgaagtgcgtgaatcgcaaagataaagcaaaaggaaaataccaacatgacaagcgcaatgacggtagcaccagtgtaggagtgggcttccagttgaaacatgatcatcaatggcgtgatttcggttttaaagggttgattacccgcgatgaagatgatactgccatattcaccgatgcttctggcaaaagctaagccaaaacctgaaatcagggctggtagaatttcagggaaaataattttccgaaaaacagtccatggacgagcacccaatgtgagcgctgcttcctgatacgtactatcaagttgctccagcacgggctgaacctctcgaacgacaaaggggattgtgacgaagaccattgcgatgacgatgccgctgaaagtataggaaatttgaacgtgcataggggctgccaacctaccaagccatcctttatttgaaaacaggtaggcgagggcaattccggcgacggctgttggtaaggcaaatggtaagtccaataagtaatccagtaattgtctacccggaaattgataaaatgtcagtacccatgcaaggattaaacctaataaggcgttaatcagggcagctaacaaagcccctttcaaactgacggcatagctggctagaacgcggtcgtttgttgcttgaagccagaatttcttaaaaccaacatccaagccttgcacgagtaaggaacaaaatggaatgaccacaataagaagcaggccgacaaacgtgatgctaaggccaagtcgatagccgggaacaagtcgattggaaactttttgcatggtgatacctccttttatataagtgtgcggaacaaagcggttaacattcgaaatgtaaggcgtctttttcggaaatcccgggtttggatttttgaaaaagatcccttacatgtagaatgttgctttgaggagcagtcctgaaatagtgtgcggaacaaagcggttaacacccggaatcatctatttttgatatatttgatcaaaaatgcccccgttatcaaaatgtttcttttgaactttgttccagccgccaaagattggatcattaattgacacgcgcttaatggttgggaattggtgcttgtattttttggcgacctgtttattggttgggcgatagaagttttgagcttcaatttcctgagccttttttgagtaaaggtagttaatataagcttttgcgattttggttgtgccacgttgtttagcaactttattaacaatggcaactggtggttcggccttcatactgatacttggggttacaatttgatattttccgggatgttctttcatggcaagcagtgcttcattctcccaagccagtaagacatcaccctgaccgttttgaacgaaggtcgttgttgcatccctggcaccggaatctaaaaccgtgacgttatgataaagtttcttaaggaaggctttatcagcggtttgactatgatggtatttcttgtccgcaaaagcccatgccgataaataattccatctggcgccgcccgaggttttagggttgggcgtgataattttgacacccgaacggataaggtcggaccaatcttgaatatgtttaggattgccctttcggacgaggaaaacaattgctgacgtgtagggggcagaattgtcagagaactctttttgccaaccagcgtttattaggccggctttttgaatactggtgatatccgatgcgacagccaaagtcacaacatcggctttgtttccttcaataactgaattggcttgtttaccgctaccgccatttgagacatcaatgttgacctttttaccggttttcttttgccaataagtttgaaaggctttgtcataagcggcgtaaagctctcgggtcggatcataagaaacgttggttaacgtgactgtatgatcactgctgccactggctttcttagattgactgatttgatgtgagtaaaatagccaataagcaataattaataatagaaaaatgccaagtacaatccataatttcgtgtggtgacgtggttttgtgtccatgtaggtccctcttttcttcctagtaaacaatattgctaaatagttaaaaagcgtcctctcccggtaatcgggaaaggacgctttgcgtggtaccaccttttatcattttagccttacagttaaaatcttatggacaccattaattaaacatagtgcccgcacgttaacgagtgctgtcgttgattgcttacacttgaactgatcattatcaaggctcacaatcaaagctcaaagaccatcttccaagctttcaattgatcccgtttcatcaaagggggactctctttacaatcgaaatacctgtactcatcttttcgttgctgaattcagttattaatgtcgtatcatagaggctattaatgcgactgacaaggggttttacatagttattctttatcaatttttttaaaattaggggatttcccctaaacaaaattgatgatcattcctgcaacaacgcggttagaggatcatagttcttttctatcagaggccttaaaatgtgacttgctgatgaagatgcgatttaacctctttaataaaatactgagcaatttccgacaacgaatgattggttcgctttagtagaatcatgctgtttttaggtgagtccttaagtgggcgtgcaattaatccctgttgctccggcttttccaaaatgccggatcctgaaccgtaggcgtcagtttgattaacgattttactaagcgttgctcggtcactggtagcaatgaccggtccgttactaggtggtgccagtggatcctctgctagttcggaataggttgcttcttgcgtaaaacgaacctgtgggtaaggcgccagatctgctaatgtaatgactgttttagatgccaaaggatggttggttcgcataaaaatatgggtttgaaagttcccgagttcttcataaattaaattgttttgatcaaaaagactgagtagacgggattgattaacttcgttgataaaaataatcccaatttcactacgaaactctgcaacatctcgaataaccttcatggtggtactttcaaaggcccgaaggtattggtaatcaggatatttctgcatgactcggcacagtgcactggcgataaaatcataatgttgcccggcaattgaaaaataacgggtatgcaaaggttcattagtaaagtagcgatgaaggttttcaacatcaccgatgatttttctagcctggcgaacgaaggcaactccggaattagtcaaaaaattaccttgacgggttcgctcaaaaagctgggtaccgagttcgtgttcgagctccttgataccatgagataaactcggctgtgaaacatacaatttcttagcggcctcgtggaaactaccgttatccgcgactgcaaggacataacgcatttgttgaatattcatgacattcacctgatttctatttattgccaattgcgtgcagaagccattcgaagtgattaccgaaatgtgtacaaaaaaacgccccttcacagtttttaccgtaaagggacgattacccgtgttaccacccaaatttgtgccataaagaatgacacctcttattcggtaccgattgatacctagtcatgtaacgatgacaatcgtccaaatagcgtgaaccattcggctactccgagctcattttctctgtcgtgatgatgatcccttttccactgaccgggttcgctggcatctgttttgacagttacttatctcttcaacatgtttgattattagaattgaattaaattgttgtaagtttacaagcgtttactaagacttgtcaagattttttttacaaaaatcgtgttaattaaggtaaaactgattcaccataatcccattatattaaaaagtgttcttgacagataaaaattatgatggtacttttagtgaaatcttgtttgaaaataaaaattataaagttgatatgcgttttcagtatattagaatagcatgacaactgagaaataaacatactgggaggtactgattaatatggaatttgatgaacatctttacgatttaacagtgattggcggtggtcccgtggggatgttcgccactttttatgcgagtatgcggaatttggatactcaattaatcgaaagcctaccagagttgggcggccaagttgccgctctgtaccctgaaaaagttattcacgatgttgcgggttttgtgcctgccaagggtgcggagctaatttcaaacctaaagcagcagttatttgaatttaaggataaactggtgattcgttgtgatgaagaagttttagaattggaaaaacagctcgatgagacgtttgtcttaaaaacgtcaaaaagaatgacccataccagaagtgtattggtagcaatcggtagcggtgcatttgccccacgaccattagcagtcggttatgatcatggtttggataatcaaaaagttttttactttgttaaacaagtcgctgattttgccaataaagagattgcaatcgctggtggcggcgatgcagcgattgattgggcattaacgttggaacccgttgctaagagggttcaccttattcatcgtcgtaataagtttcgtggacttgaagccagcgtcgatagactaaaagcttcttcagttgatctggtaacaccgtataatattaaacaagtcattgatggaccggatactggattgaatttaaacctgcagttggcaaaaagtgaagaggtacgaacgttgacggtcgattccctgttggtaaactacggttttacctctgacaatcatattttaaaagaatggggattaccgcttgaacggcgatcactggttgttgatgaaaatatggaaacagctatctcaggtatttacggaattggtgatgcagtgacttatccggggaaagtgaaattgatttcagcgggttttggagaagcgcccacggccattaatcatcttgcagaagcactttatccggaacgaaagcaaccgttgcatagtacatcaattgcttaagattgggcaaaaccctaattgacaatccaaaaaaagtaagataaatttttgagtaactttataaatatcgcgttgatgagatgagtagctgattttaatgactaaagagagtgtccggttgctgagaggacataaagttaatgtcagtgaagatgagctcggagtattagacaggttaaggctatgtctacgatcagcattcgttacgatgctcgacttccttgatggattcaagtgagttttgaggcaatccttttcgattgtaaacataggtggcaccacgattaaatcgtccttgtacaaagattatttcttgtacaagggcgtttttaattcttaaaaggttttgaaaggggttattaaagatgggtggttttgtatctttggttggtgcaggtccggggaatcccgagctattaactattttggcaaaaaggcggttgtcagaggcggatgttgttgtttatgatcgtttagttaatccggctttgatggcacccttggcagcagaaaaaattgatgttggtaaactgccacagcaccataaagtgagccagtatcagattaatgacctgctggttgaacaggcacgaaagggaaaacgagtggttcggctaaaatcaggggatccctatgtttttgggcgtggcggtgaggaaggccaatatttgcaacagcagcgggtcgcctttgaggtcgttcctggcattaccagtgccattgccggtttgggtgcagcagggattccgattacccaccgcgattttgcctccagctttcatgtcattacgggtcatcacaaagcagacggcacccaattggattgggaaaacattgcccatcaggaaggtactttggtttttctaatgggaatgggtgaactaggccacattgctgaacaactcattaaaaatgggcgagcaagttcaacgccggtggcggtcattcaatgggcaacccattggaatcagcggtcggttaaagcagatttaggtacgatcgaaacggttgtggagacacatcacattggctcaccggccctaatcgtcgttggaaatgtggtttcgcttatggatgagttaaatccagagttaccacttcaaggattgcatcttttgataccgtttaaagacccctccaaattgttttcaaaactccaggatcagggtgcggccgttaactttttcaaacgccggactcaggtaccgttaacttttgacttaccagatatgttaaaaggtggcacgcttgtgatcagcgatcaaacagcttttgacttttttgaacatcgactgttggacaccggctacgatcaacgggtactgtcaaaatggcgggtattggcattaaatcaggcaattgccggtcatttaaagaggcatggccttctggtagatggctattttgaatcagataacagtttattttcagaaccggaaattgttattggtgaggaaacggcccttggacgctttaaagaggttaaaagtcaaaaaattgcgacttatcgggcaattcctgtcaatcagacaattgaagttggctgctttcacgggatcatttttccgagttcagcctcggttgacgatttagtcagtggttgtcgggattctcaaaagcgtcagttagcaagcatgccgtgttttgcgatgggaaaacaggtggtcgccagatgccaagcatcagggattcgtaatgttatttcggttaacccttcaattgatgcagttatgcccgcaattcaatcttatttcaaatgtcgatcagtgatttgatgcaatgtattaattggaggaatagcattttggataatccatacccggtcattttaaatttagcaactaaatcggttgcggtcatcggtggtggtcatgtggccgcacgaaagattaaatcgcttctttcagccggggcaagtgtgacggtcatcagtcccgacctgtcttcacaaattgataaaaaagccgtctgttgggtaaagcgagcttatctatatggtgatattactgacatggatattgtgattgcctgtaccgatgatccggtcgtgaatcagcaggttactgcggatgcaacccattttcaattagtgaacaacgcaagcaacaaagggcaatcggatttttttaacgttgctgaagtcgaaaacaatcattttttattcactgtctcgacaaaaggacaatcaccagcaatggccaagactatcaaaaagaaattggctgcttggttggagagtcaagagtggtttagaaaggagtaatcaatatgtttgtgatttatgtaagtttaaattatcagaagttgccaatcgaaatccgggaacgatttgtgctttcaaaacaggagttaattcgagctaatcgactattgaacaatgaaaaaagtattttagaaaatgttattttgtcaacttgcaatcgaaccgatgtgtatgcagtcgttgatcagttacatactggccgatattacattaaacgttttttggccaactggtttcacatggatttggaacagattaatcaatgggttcaaattggcgttaaagcagatgccgtttctcatttattccgggtagcgacaggattggaatcgctaatggttggtgaaccgcaaattcttggacaagtaaaagaggctttttctcttgcttatgagaaacaaacgaccggtgtgattttggaccatctctttaaacaagcgattactttctctaaacggatgcataccgattatcgtgttagtgagttggctcaaacttccggtcaagccggccttcatcaaattaaggcaacgttaaaaacacttgatgataaaaaactggtcattgtcggtttgggtcaggagggggcacatgttctaaaaaatgccagcacaatgggatttaacagaattttgattagtaatcgaacagatatgaaggccgaaaaagcagcgtcccagtatggatcggtcgtccaaatgattccttggcaatttgttacaagcgcggttaaaaatgcggatgcggttatcttggcaacttcggtcgaaagggccctgttcaagggaaacatatttaaaacgcaagatgacaagccaaaaattctgattgatttgggtgtcccacgaaatgtttctaaaattggcctgccatcaacaatcatttatttagatattgatcatatcactcaaattattgaacaaaatcaactttacaaacaacgaatgctagatcaaattgcaaagaaggtcccaaaagtagttgaacaattttatatctggcaaaaacagcttcatgttgcccccgttattcgtgagttgcgagaatcttcattgaatattgaaaaagaggtttatgatagtctattgaggaagcttcccgagttggatgcccatgaacgaaaagtgatcagtaaacatatgaaaagcattattaatcaaatgattaagggaccgattaaaacgattaaggaattgtcggttcaggcagatgccgattctgatctggtctttttctgtaaactttttgggttatcgattgatgaaacaatcttggaatcacttctgctcagggaagccgatcattctcaaactactaccgaacaggagaaaatttatgaaacctgaatttgttgttgggactcgccaaagtaaattggcaatgcgtcaaacgaatttagttgtggatgcattaaaagaacgttttccgaaaataatttttaaagttgaaaaaataactactcaaggtgaccgtaatcggaaggattctttacgtaagatcggtggtaaagggatctttgtaaaagaaatcgaacaacggttaacagacaaaagaattgattttgctgtccacagtcttaaagatgtgatgccgagtcttcctaaaaacctgataatcgggggtgtcccgaagcgcgactcgccatttgactgtttgatttcaaccaagccgttttccgatattgatcaattaccaaagggtgccagaattggaacaagcagttcaaggcgtcaaggacaattttcgcatttgagacccgacgttgaaattgtatcgattcgggggaatgtcgacagtcgtatccagaaacttcagcgtgatcatttggatggtattattttggccgaagccggtctaaacagattgggcgttgatctgacaggcctttatcgtttatcattaaaaaatgatttgttgccggcagccggtcaaggtgcaatcggtattgaatgtcgggcagatgatcacgacacgttagcacttttaaaacagattgaagatgccgatacgcgtcaaagtgtcacgatcgaacgtgattttttgcgacgtttaggcggcagttgtaattttccaattggcgcttttgccagtcaaacgtcaatgggcgttcggtttgatggactggttgcatcaattgacggtaaaatcttcttttctaaaagtaaaaccgaacaaacgggtggaaatcttggtgaagaggttgccgacgaattgatcagtgagggagcattaacgttaattcaataatttatataaaaaggaagtcagtgtaatggtaatttttgatcgtcaccgtcgactcagatccactgcatcaatccgtgacctggtccgtgagaatcacttgataaaagatgatttgattatgcccgtgttcgtagatgcaacgattaaagataaagaagaaattgcatcaatgcccggtatttatcgctttagcttagccgccgtacttgatgaaattaaagaaattgttgatttggggatccaatcagtcattatttttggaattccggatcataaagacgatgttggttccggcgcctgggaagaaaatggggtcgttcagcaggccattcgaaaaattaaggcggcctatcctgatttaattgtgattgcggatacgtgcttatgcgaatacacatcaaccggacattgtggtattgtcaaagatcatcgggtattaaatgatgagtcattggtttataacaccaagacagccgttagtcaggtcaaggccggtgccgatatggtagcaccttccaacgcaatggatggtttcgttgctgcaattcgggaaggattggataaagcaggttttcagaacacgccgattatgtcttattctgtgaaatatgcttccagtttttacggcccatttagggatgctgctgatggtgcaccacaattcggtgatcgtaaagggtatcagatggatccggcaaaccgcttggaagcattgcgtgaagttgccagtgatgaaaaagagggcgctgatttcgtcatggtcaaacccgccatggcatttttggatattatgcgggatgtgaggaatcatacgaatttacctttggttgcttataatgtttcgggtgagtacgctacgatcaaggccgcttcgcaaaatggctggatagatgaggaccagattgtgaaggaaacgttggtcggtatgaaacgggcaggtgcggatttgattataacgtactttgccaaagacgccgcacagcgaattaacaaacaaaggtggtaaataattgtgttaagctttgaaaagtccaaacaagcttttaaagaatcaagtcaatacatgccgggtggtgttaatagtccggtgcgggcatttaaaaacgtgggtggtaatcccctgtttatttcaaaaggagcaggatcacatatttttgatatcgatggtaacgagtttatcgattacgtcctttcatggggaccgttaattttgggacatgctgattccaaagtagtgacagatttgcaagcagctgtcgctcggggaaccagttacggtgcaccaactgttttggaaaccgaattagcaaaaaaaattcaggctattgttccttcgctggaaatgatgagaatggtatcgtcgggtaccgaagcaacaatgagcgcgattcgactggctcgcggttatacccatcgagataaaatcgtaaaatttgttggaaattatcatggccatagtgattcgcttctggtagatgccggatcaggcgtggcaacgtttaatgatattcacgaagcacccggagttcccgaagatttagcttacgatacactgaccgtaccgtataatgatattgagggtattaaagatctttttgctgcacacggagacgaaattgcctgtgtcattgttgaacctatcgctgggaatatgggtgttatcccagggacggccgacttcttgaaaacgttgaggaatttaacaacccaggcaggatcgcttttaattttcgatgaagtgatgtccgggtttcgagctgcctttcatggcgctcagagtatttatgagattacaccggatttaacgacccttggaaaagtggttggcggcggtcttccggttggtgtctttggcggtcgtaaagagattatgaaattcatcacgcctgacggcccggtttatcatgccgggacattatccggaaatccattagccatgacgggtggtattagtacgctggatcagttggatgatgcgctttatacccaaatggttacccgtacggatcaattaacgacagggatcaaagatgcagccgccgcacacaatgtaccaatcacggttcatcatgttggtacgatgtggagctatttctttaatccgggaccggtcaataattttgaagacgttcaaaaaagtgatgtcgactactttgcaaaatttttcaaaggattgctgcaagagggaatttatacggcgccctctcagtttgaaaccaactttatgtcaagtaagcatacagaagaagacattgaccaaactattgcggcatttaacgccgtgtttgataaaatcgaagtgggttaggtattgtactgttaaaacggatatggtggcggtaataatcgctatcgtgtccttttttaaaattaagaaaagatgtgattgctgtgaattttttgattacatatcctcaaaaaagaatgagcgaaagtttaaaggaaaagttggctgatgtgtcagatccgctatattgtccgttacgtttattgcaacctgtgacgctcaccgttaccgaaatacacactattcaagaagcggattatttcgttattaccagccaatttgctttgtccatttacttgaaaaagctaatcacatttaatcggtctgcaggccttattgtgttaagtaaaaagatggcacaaagagttcgagcgattggaaagcaagccgtcatagttgccccggaagaaaatcaaagaagcctagtgccgatattaaagtctttaaccggttatatcattgttttaagtggcaatttaaccttatcagggaatagtcttccaaaaactgttgaaacagtgcggatctatgaaaataagtgggatttcgccatgcaggaaactgttgcgaaaaagctggccaataagcgaattaatagagttttggtaacaagtccttccggttatcagcggctaaaggaagttgaaaagctgcagccgaccagctttatacaaccgacttattatgtattgggagaacaaacagcgggtattatttataaggatcataaacgagtggtaaaaccggatagacatattgatgtgttaaagcagatgattgataaaatgtgccaagatgaaagaaaaaataactagaaaatatcaaaaaagcctgggcataaaattgccacagactcaagatctttcttatttggctctcgttaaactaactgttaacacattatttttagtcgtattgtaacttgccaatataccgttaacgacatcggatgccggtccatgggtcgaagttgaacggtgatacgtattaatccaagttcccaatgcatcaagtccaaactcgaatccttcgaagacctgcatgtaggttgaagattgaggagcgggtgtgataatcgtgatcttttcaacccgttgttctttaatttccatagtaagattgatttcatccgtatcaaagaaaattatttccccatcaccggacgtggttggcaatttataattttcaagccgcatgttttcattataaacacgtgaaacgtattcgtaagttccgaggtcggttgttcctaattcctgtgccattataaaggcccccttttggtgattattataagggagctaagacaaattaagggataaatcgacttctattcaaactcttcatagacatttggatcttgtccgtcaactcgaccgtcctgcttattcagaccattgatttccttgacttctgcaggtgttaattcgaaatcaaagatagccaaattagcgcgttgatggtttaaatttgttgattttggaattggcacaattccccgctgaacgtgccatcttaaaatgatttggccaacatttttattgtatttttgagctaatttttgaatgattggttcctttagagcggcactgccacgacctaacggactccatgcctcagtgagaatgccgcgttttttatcttctgcaagcattctttcctgaacccagtaaggatgaatttcaatttgattaaccgccggtgtgacacctgtttccttgataacacgatcaagatgttccggctcaaagtttgaaacgccgattgagcgaatcaagccccgcttttttgcatcgatcattgcttggaaggcttcaacgtaatgatcacgtttaggtagtggccaatgaatcacatacagatcaagatagccaacgcctaagcgataaattgattcctggattgccttggtggcctcatcatattcatggtacttgcccggaagttttgatgtgacaatgaattgcgaacggggaataccggattcacggatcgcttcaccgacaacgccttcgttatcgtaattagtagctgtatccaaagcacggtagccgtctttaattgcggtaagaatctgttggacgccttcaccgccacggatttggtacgttcccaatccaagtgccggaagcttgtagccatcgtttaatgtaatatctggaattttagccataaatgattttcctcctaataagttaatgtgtgttttttggatgattattcgaatttggatcgttgtggtcttctgatgactgatcgtcttttgatggatcggctatttttctaacagtcaaataccagccaacctgcatcgattggtttggattaatgtattcagcgctcaagtgatagtatttggcatatgggctttgatcttctaataagcgtttaacggttagcgcatctgagcgactatcgaaacgtaattcgctattagtgctgtaattactatgcttatcgggttcgttataagccttgttaaaaaagtccaggaactgttcggatttattcacaattgatcacgtcccccctctatatctaccattgtactcaacaattcaagtgaatgcgatggataggtcatgattcttgaaaacaatcttggaaattttcacttcccggctaaaataaaattgtaatcgtttttgcttaagcatagaattcaagtatgcaatagaattcataaaagcgtgttgaagcagtaccacatatactatacgaaaggggcgtttgataatggttaaaaaggggttgctattggtaaacttgggatcaccggtttcgcccttgaataaggacgttaaagcctatttacaggaatttttaagtgaccagcacgttgttgaattgccgaaatggttttggcagcctttattaagggggattattttaccaaccaggacttggcgttcagctaccttttatcagcacatgtggcgaaaaggcgggtcgccgttagtgatttatacaaagataatgtgtgagaaaattcaaaaagagcttactgattgggatgttcagtatgcgatgacgtatggaaaaccggatattggtcagcagttacataaaatgaaagaagccggtgatgaccagatcgtcgtcctgccgttgttcccccaatatacaaaaagtacgcatggtggcattattcaacaagtggccgattctgggattaaggcaacaattatcaagagcttttatcaatatccgcaatatcaaaagctattggcccatcaaatcgatcaatcctatcagcaaaaaaattacgatgcagtgattttcagctatcatggcattcctacagccatggttaaacatggagatccctatttaaaagagtgtcgtgaaacaacggcggcagttacaaaatttttacagttacctcatgaaaaaatcaggatgacttttcagtccaaattcggaccaatgccgtggctaaaaccatacctcaaaaatacgttgatgcaactagcggcgatgggaaagcgaaacgttttgattgtgacaccgtcatttgttgaagactgtttggaaacaatcgaagaaaacaatgttcagaactatcaaacctttcgggcaagcggcggtcgggtatttgatgcggtgccacccatgaatgccagcgatgcattttgtagcttccttgcagaaatcagtaagaatcagttagtgcaggatgggggtggctatgatgaacgagcaaaagaaaaagagtcttgatgaaattaatgaaagtgtcgatgtccctagtgtttatgaaacatcttttgtgcaaaagtttttggcgtatagtggtcccggcgcgttggttgcggttggttatatggatcccggtaattggctgacctcattgtcaggaggcagccagtatcgatacaaactgctgtctgtcctattgttatcaattttagtggcgatgtttatgcaaacgctggccataaaacttggtgtcgtagctcggcaggatttggcacaggctattgcggtaaaagtaccgaagcttgtcagatacgttctatggattattaacgaaattgccatgatggccactgatatgaccggagtcgtcggaacttcaattgcgttacggcttcttttcggcctgccattagtttatggtattttattgactattttggacgttttaatggtcttgttattcttaaggtttggtattcgacggatcgaatttattgtgctgacagctattatgattgtcggcgttatttttggtattgatgtttttcgggcgcatccggcgtttgctggcattttaaatggtctgattccaagtccacaaattttaacaactcaccgtgaactgatcttaagtcttggtattattggggcaacgatcatgccccataatgtttatctgcattcgtcactggctcagagtcgccgttacgatcacaataaccctaaacaggttaatgaagcattacggtttgcaaaatgggattccaatgttcatttggtagccgcctttttaattaatgctctgttattaatactgggagggacgttattctttaataaaggtaatcagttgactgcttttcgcgatgtttatgaggggttaaaaaattcagctattgtcggttcactggccagtccactgatgagtaccttgtttgcgtttgcacttttaattaccggaatgatttcttcgattaccagtacgttatcaggccaaattgttatggaaggctatttaaacattcgcttgccgctgtgggaaagacggttaattacccgatttgtgacattaattccgattttggtgattggttttattgtagggttcagtgaacaaacttttgaggcaatgattgtatttgcccaaattgcattatcgattgcactgccattcacgctttatccaatggtggcattaacgagcaatcgaaaccttatgggaagccatcgtaatccggcatggataacaatatcaggatatgtattaacaacgatcatcacggttctaaacgttgagtttatgttcagtatctaacaggtttactttgtaattggaaactgagagaattgaaataagtgactggggggattgttttttgaaagtgttaggaattctgggtgcccatcgaaaggatggtatgaccgagaaaatgttggcgactgtattggctggtgttgaggccccgaaccaaacagacattatttacttagaagattacccgtttaaaccggatcgaaaggaccagcaggatccggtattaaatgagttggaacaaaaaatgctcaatagtgatgtctgggttttggcggcaccgacttattggggtggcctggcaggaaaaatgaaagatttctttgattgtatgagagaacgactggttcgaattgatcatttaggcgggacgcatcctgaccgatttaaggacaaacattatttaagcataacggattgttacaccggcgcattcgaaaattgggtaacaggtgtgaccgatcaaagttttcggacaattgacaaggtcatgtcggcggccggtgtcattaaattacatgaactggtgctgacaaacacgtatggcatgtcagaactgcctgaaagtaaaaaacagacatgtctcgaatggggaaaacgtctgaattctgttagaaaaagagatgatagcactgtgaaaagatacattgaattattctttatgattgcatttatggcatttgtcacgatggggatccagtttgggtttcatttagttccacgtcatggcttttggataagttatctgtcatttgtgttgattttctatgttttgttaggatcaattctgcatttcttcacggtcgttaagcatcggcgccgataacaataagttaactgtatgaacggttacattcagcttgagaactgttagggggcagacgatgctttccaaaataacagattctcaggctatttatttatcgcttggaaactgggcataggataaggtatgattctcataacgggatgttactggatttaacaactaggaggggttcttttgaaaaatgtttattttgatcatgacggtaatgttgacgaccttgtttcactattgctattgcttcagatgccggatgttcatctgaccggtgttggtgtaatcgatgcagatggttatatcgaaccggctgttgacgcttctagaaaaataatttccaaatttggccgtcattcaaacgttcgggtggcggcttcgaattctcgagcggtacaccaatttccaaaagagtggcggttgagttcattttcatttgatgcgtttccgattttaaatgaacacggttctgataaggcaccgattgccgataagcctgcacatctggacatgatcgataagattcagcgggaagatgaaaaaacaactttagttatgactggaccgttaacggacttggctcgggctttggaagttgatccaacaattgttgataagattgagcgactttattggatgggcggtacaatgagaacccaaggaaatgttttggagcctaagcacgacggcagcgcagaatggaacgcttactgggacccttatgctgtcaaaacagtctgggattcaaggattaagatgcagatggtaggtctcgagagtaccaatcaggtgccactgaatgccgatgtgcagcaacactgggctaatttgcgtcgatatccgatgatggacttgattggtcaaggatatgcactggtttcgtcttatgaagctaattcaacttattatctatgggatgttttgacagccgttgccagtcaatatcctgaaattgtccagactaaagatgttaagggcgacgtaattgttaatggaccaagtgcgggtaaaacgtatgaaagccaaaacggccgaccgattaatttagtaaccgaggttaaagccaaaaagttttttgataagattgatgccttgttaacacgggaagcgtgatgttaatgaactatttacaagtatcaaaagtcattaccttaccgtgtggtgtaacgattaaaaatagatttgtaaaaacggctttaagcgagacaatggcaacggatgaccatcagcctaatcacctatttaatcgtctatatcgtcaatgggctattggtggtgccggtatcgttatcacaggaaatgttatggtcgaccggcatgcattagcagaaccgggaaatatcgtggtagatagtgaccgggtattacccaaattgcgtcaatgggcggcagatggaacgatcaatgatacacaattatggatgcagctaaatcatccaggacggcaatctcctaagatgttttcaagccggccggttgctccaagtgccgttcccattaccggaaagaaccggcgtgcgtttgagtcgccgcgggcgttaacagcaaatgagataaaagaactggttcaaaaatttgttaaaagtgctgttattgcacaaaaagcgggttttaccggtgttcaacttcacggtgcatttgggtacctgattaatcagtttttatcgtcaaagatgaatcatcgaacggatgattatggtggttcaattgaaaatagaatgcgatttttgaccgacatctatcaagggatccgtaaggcctgtggtccaaagtttcctatcagtctcaagctgagtttaacggatattgatgtgaccggttttactcaaaggcaattcgaaatggtcattaagaagatggcagctttgggaattgatatgattgaaattgccggtgatgactatgaaaattctcaaattgggttttccggtcaggcccactttattaatcagttggtaaatgtgccgatcgcattaagtggtggctttcggcacatctcggcaatggaggaagcattggggagacaagatgcctcattaattggtgtatgtacgccgatggcctttatgacggatatgccaaatcaaatccttaggtcaaggtatcagccatttgtgctgccgctgtcaacgggaagtaatcggctggatgataaattaaagtccataattgtgaccagttattgtgaagagcaaattagacgcattgctgaaggaaagcaaccgaaactttatcgaaatgcttggttatcaatgttggctggtattcaattacacggaataaaaggattgaagccaagacgcgcacaataaacgactatcaatgactttgaagatcgcgaaaaatagactgcatacgaatttcaatatcgtttaattcctttgcataatcttttaagttattagcatgttctttaacttttttaggatcggcatctgttttatagctgagttggtgctccaaacttgcccacatatccataccgatcgttcgaaactgaatttcaaccggtacgtcaaagacacctttggattggaaaaccggtacagaaacaacaagatgcaaactccggtagccgctttcctttgggttttcaatataatctttgcgttttaaaaccgttacatcagactgttcggacagtgcttcttcaacggtgtagatgtcgtcaatgtaattggtaacaactcgaataccggcaatgtcgcgaatgtggtcgcgaacgttttcgattgtgagcgtgtaccctttgcgttttaatttttcaaataaactccctgttgatttcatgcgttcttccatgtgatgaatgggattatgatcgtagttcattgaatattcgtcgtcaaggttttccagtttagtaccaatctcatttgccccggaatggcaaagctgatagatgttgaccaacttttttaagtcaggaatctggtcttcgaatttggtttgtttgagctgagcttcaatttgtttaacatccataaaatttcgtcgttcaagaatcatttgtagaccacctcattcatttatagttagtatttatttattagttaaacagttgatatgacagaagcgaggctggacaaaagtaaattttgtccagcctcgctcttttgtcattatggatttataaatttagaactgtttaaataattggtcgatttgtttgaactcatcatcgcttattgtaatgtccatggcttgagcgttgctgtgaacctgatcagctactctggcaccggggatgacgacactgatattctgattcttaatataccaagccaatatcgtttgtgcaaccgttgcttggtgggcaaccgcaattgcctttaccttttccaatgcagccatgattgctgtatattgcctgcttgagaatcgactgaatttgctgttatcggccggtgtatatttaccagttagtagaccggatgacaacgggaagtaaggaacaaacgaaatttgatgttcctttagatatgggaattcttccctttcagcttcgcgatgaacgaggctgtagttatcttcgacgatatctacttgattgtcggcattagcttctttaatttgatctaatgaaaaatttgaaacaccaattgctttaatcttaccggcttttttctcttcaaccaatgcttgaacagcctcagccttgggtgtcttgtcatccggaaaatgaatatagaaaatatcaatatagtctgtttgcagacgctgcaatgcatcatcaaccgacttctttaagaactttggatcattgttgggttttaaatcattattcggatcttgagcagctttggttgcgatcacgaattttgaacgatcgtaatcttgggtaacgttgccgataatctcttctgatttgccgagtccgtacatgtaagccgtgtccaataaggaaataccatcttccaaagcggctttaacgacttcaacaccatcttcgtcctttaaaccgtcaaataaattatgaccgccgactttgttggtacctaagccaaggggcgttgtggtaactgtacttttaccgattttaattctttgagccattttggttcctcctaatttatctgaagaattaaaaataaagagaccacatttgaaaatgccagtctctttagattgtaagccaaattgatattaatagccaaaattattaatagtttctgctaattatgatcattcgaaacggaatttattcatcgtaaggccccttgcccaaataagcattaatcatccaaatgtttttatcaatcgcttctttaaacccatttaacatatcttgagttggaaagtctttttcaatgtcagttatttcgattcccttttgatactgatcacgcaggtacttaaactgatctgatagtcgttgcataaagtcacgcatcgttaattgatcccaagtgactttctcgtcaggaaggccggtgtgttcaataaattcatgggtggttgaatagggtgatccgttaattgcaattaatctttcagcgatattgtccaattggtcagctaactgatcattataatcgtccattaaaggatgtaacctgaagaaattttcgccacgcatataccaatgggtttgctgaatattggtttgtaactgacttaaatcagctaccaattgattgagttgttcacgggtctttggaaaatcgtaattgcttgccatagataaaaacctcctataaaagtaagtcaataataaatccgtttacatacctagtttatctattattggaagtgttatgcaagtgaagtgattaccaattttaaatcgcttctgatcaatgccgctagtgtcggtttatagcgttagaattaatcagtaatgtgttcagagtcattgctggtttctgccggttgtttagttggttcattcaaagttgaatgctttgaagtttccaacattcgaacatagaccaataggctgacaaaagctgccgccgagacgtagtaaaagaaccaattttcatggccgatattttttaaccagagggcaacgtattcaacggttccaccaaaaattgcgactgttaatccataagggaagccaacgcccaacgcacggatttcagtcggaaaaagttctgctttaacaacggcgttaattgaggtatagccgcttacgattaataacccggccatcatgagcagaaaagcactgaattcattgtcaaagtattgaagccccagaaagattggaactgtgagcagggttccaccaatcccaaaccagtaaagtaatggtttgcggcctattttgtctgaaatatgaccaaataatggttgcagccccataaaaatcagtagtgccaaaaagttgatcagggtaacagatttcgttggtagccctaacgtgttgatcatgtatttttgcatgtaggttgtataagtgtaaaaggcaattgtgccgccaaaggtaagtcccattacggttaaaacctggccgggatactttgccaatttacgaagcgtaccacgggtggtatttgttttttcagcacgtttgaattggtttgtctcatccattgataatcgaagataaagcacaatcaaggcaccaacagcaccaagtccaaatggtattcgccaaccaaagcttcggagttgagaatccgttagaatggcttgaagaccgatttgaataatcaaggccagtaattgcccactaatcagcgtgacatattgaaatgaagcatagtagccgcgttgattggacgttgccatttcggaaaggtaagttgccgaaataccgtattcaccgccaagtgacaacccttgaaccatacgaatcacgattaataataacggagagaaaatgccaatggtggcataggttgggatcaatgcaatcagtaacgaaccaccggccatgatactgacggataaggtcaaagcggctcttctaccgcgttgatcggcgtattttcccataataaagcttccaaatggtcgcattaaaaaaccaaccgcaaagacggccgcggtgcttaggagctcgacagtctgattaccatcaggaaagaatgaaccagcgaaataaattgcaaatgatgcatagatataccaatcgaaccattcgaccatattaccaagtgacccttttataatattgcttgtgattcgcctttggcttaattcctgcataaaaaatcaactcccttaatggtaatgtaacgtcatgatagcgttgtcaatgatttcaatgctatatcataatcaataaatttgaattaaaaatcgttattagcataaagtttgtgaaaatctcattgttctcatattataatttaatgaaatcttgtgtgcaaatattattgttatttattttgaccacaagttaaaaaaccgccaatcaggcaacgtgtctgattggcggtcatatcgtatttaaataggtattaaaggggattaagttaattcacaattgttttcagtgtcgtcagtgaatcaatttcaaaggtgggttcagcaggtgttgaattatgaagatgtgccggattgaaccacacagaatccagtccgtaagtatttgctccgagaatatcggaggtcaatgagtcaccaataacaagtgtattttgcttgctgaaatggtcaattttttgagaaacaaaatcaaaaaatgcctgtttgggtttttgaaaaccaatccgttcagagataaacatctgacgaaaatatttggcaatcccggcttcctgaacacggcgttcctgagttttggcaattccattggtgacaatatacaggtcgtggtgctgactaagatctgtcagtaactgagttgcaccgggaatttgatcatgcccctcggctaggaaacttcggtattgcttttcgattgatgcaccgtcgatatcttcaccaaaatgtcgaaaaagcagtgtaaaacggctgtttaataactgatttctagttacgttacccttttcgtaacgttgccaaagagtcgcgtttaattgacggtaataatcagcaatctctgatgttaacggtctgttcaggtgcatgaacagtttttctaaagcccgtttttcagatgcctgaaaatccaaaatggtatcgtctatatcaaataatagtgttgagtagggcaaaacgatcactccaaactttcgcttacaattgaatcaacgactttttctatggcggaaatgagtgggctgtcaggcttgattcctgtttcactaaaccgggtttcccaccattgtttacggatattttgaataacgggcacaattttttgcccagtatccgtcaagtttaaaataattgatttaccaacaccagctgtttttgtaagataacctaaattctgcattttttttatttcgcgagctgcaagccctttatcaatgactaaagattttgcgacttgattttggttaatgtactggttgtctttaattgttagtagaatacaagccgccgtcggattcaactgatgttttttaaataattcaccggtatctttataatactgtcgatggagtattgaaatgtcttgtgcaaggtaaccgatatctttcaatgtttttatcctttcaaacaaaatgatctattcaaagtgaaactttagcatttttaagttgacaattcaacgtaagggcattaacctttgaaagtaagttgaattgtcaacatagaaaaatgaagaggtgtcaagctatggctactaaaaaacgtggttctcaagctttaattcaatcaatgatcaatcaaggaatcaagtatgtttttggtattcctggtgcaaaagtcgaccagttatttgaagatttacaatatagtgatgatccaaatgcaccaaagttagtggttgcccggcacgaacagaatgctgcattcatcgcggcaggtattggccgtcttactggtaaaccgggagttgtcgcaacaacctccggccccggtgtttccaacttaacgactgctttaatgacggctactgctgagggggatccggttattgggcttggtggtcaagtgccccgggatgatctttccagattgacacatcaaagcattcccagtaaagaactgatgagttttgcagcaaaaagcagcgttgaggttcaggatgctaataatttatctgaggcattcatgaatgcttatacagctgctgtttctccaaaagcgggcgctgcttttatttctttacctgcagatgttttaagcgatgatgttgatcggccggtcattaagactttaacaacgccgcaagccagtcaggcatctgaaaaaacactggataaaattgtcacgttgctaaaagctgcaaagttaccggttattttagctggcatgagagcctcttccgaagaagtaacaacggccttgcatcaattattggcaaaggtctcactgccagtggttgaaacctatcagggagccgggattatttcccatgaatttgaaaaggatttcttcggtcgggttgttttgtttagaaatcaaattggcgatacattattaaagcagagcgatctggttttggcgattggctatgaccctgtggaatatgaggccagaaactggaatattgagcataatgatgccgttattaatttagacagtgtggcaccggaattaagcaatgattatcaacccgacatggtcattgaagcagatattgcagaaacgattatggctttaacaaataagattcctgatgattatcgactctcagatcaatcaattgcacatttaaacacgttaaaggaagaattcgaagatgagaagttggttgaaacggaagcaaaacccggcacggtccatccactttcgattattaatgaattgcaacaacgagttgatgatgcaacaacggttacggttgatgttggcagtcactatatttggatggcgcgccattttaggagttatcgcccacgtcatttactatttagtaacggtatgcaaacgctgggtgtttcacttccctgggcaattgccgcaaaacttgttcgtccaaacgaaaaagtggtttccgtttctggtgatggtggttttcttttttccggtcaggaacttgaaactgcggttcggttaaatctgaatattgtacaattaatctggaacgacggttattatgatatggtcaagtttcaagaagaggccaagtatggtcgatatgcaggggttgagtttggaccggtagattatgtgaaatatgcagaaagttttggcgctaccggattgcgggtttccgatccaactgagttgggaaagacgcttgatcaggcgttttcaacagagggaccggtaattgttgacattccagtggattatagtgataacattaagttgaagtctgcgttattaaaagatagtttaaactaggaataaggaagttataatatggcgaaacatacaactttataccagcatggaacgctggcgttactggttcccggccttttaaaaggaacaatgacgatgggggaacttttaaaacacggtgatactggaattggtacaggtgagggactcgatggtgagttgattattttggatggcaaaccttatcaaatagatgccagtgggaaagttaatgtcgtttccaactcatttacgatgccttttgcaaacattcactacgcacgttattcaccattggccgagttggaaaatgtttcccaagatgatctcaatgaacaaattgtttctctgagtaaagcggaaaatactttcttttcggttaaaattaccggtactttttcaaatattaaaaccagagctgtcagaaagtcggaaccaccatttcacacacttgctcaaacggccagtcatcaaagtatctttacaagggatcaagttgatggaaccttaatcagctattattctcccgaactgtttgatggtgcagcggtggccggctttcatcatcattttctgtccgacgaccatcaatttggcggtcacgttttggatttccaattggataaaggtgatgtttcctatcagctgtttgacacgtttgaacaacacctgcctgttaatgataaggaatacatgcagcacgatttttcgtccgacgatattgttggtagtattcatacagctgagtagaatcggctatgatcatcaatctgactacttgattattaaaaggagtcactcgattaatgattactaaaatacactaaaaattatactaatattactaaaaaatagtttttgccttaaacgttgaggtgaaagctttttttctatatcaaataaaatatttgtcagataataatatcttatggttgatttatccgtataaatgttataatataccaacatgtaaacgctacaagtttattaaatgcataagagagaagcaatgatcaaatttgtaagcgttgttataataagctctgcttcagaaagcctattataaaaatagttaacaatttatttgatttgttatgtaacccctttcaacatttgagatgggttgagattgctaattaaggaatttatatgttaaggagaatgagaatggaaaatgctgctgctacagaaaagaagatctcaagcaagttcatctatttctttggttcgtttggtggaatcttgtttggctacgatattggtgtgatgacgggggcgttaccattcctacagatcgattgggggcttcaaaatgaagccgggatcgttggatggatcacttcttcggttatgcttggtgctatttttggtggtgcaatcgccggtcagttgtcggataagcttggtcgtcgaaagatgattttgctttcagctattgttttcacgattggttcattactttccggtatttctccaaatcatcaaggtgagtattatttaattgccgttcgggtatttctcggattggccgttggagctgcttcggcactggtaccggcttatatgtcggaaatggcacctgccaaggcacgaggaagcttgtccggccttaatcagacgatgattgtgagtggtatgcttctatcttatgtgatcgacttcctgctaaaggatttgcctgagaattgggcatggcgattaatgctagggctcgctgcagtaccggccattattttattttttggtgtttataagttgccagaatcaccacgtttccttgttaaatcaggacgtgaggcggacgcacggcgtgttttaagctatattagaacaaataatgatgaaattgatgatgaattaaatcaaattaagcaaactgcaaatgaagaaaaaacggctgcaaaatcaacttcatgggcaactgttttcagtggtaagtatcgttacttggcgattgccggtattggagttgctgccttccagcaattccaaggtgctaacgcaatcttctactacattccattaattgttgaaaaagcaaccggtaaagctgccagttctgcactgatgtggccaattattcaaggtgctatcctggttatcggctcattggtttacattgcaattgctgaaaagttcaacagaagaaccttgcttgttcttggtggatctgtaatgggactttcattcctgttgccaacaatcattaacttgttaatgcctaatgcaagcccaatgatgattgttgtcttcctgagtatctacgttgccgcttactcattcacatgggcaccgttaacctgggtacttgttggtgaagttttcccattagcaattcgtggtcgcgcttcaggggcagcatcatctgctaactggattggttcctttgcagttggtttactgttcccaatcatgacggcacatatgccacaggatgccgtattcgcgatcttcggtgtcatttgtctcttgggtgtctggttcattcttcgggccgttcctgaaactaagggccgcacacttgaagagattgaagaacaaggtacgcgtaagtaaacgatcattttgaaaaagttttcattttaataattgcaagaacgaggccgtttctgacattttcaatgccctcgttaagattaaaaaacaaaaataaagttaattggatgcaaatgaacgcgtttgcttccagttaactttatttttttctttgggagaacataaaaaccgagaataaataaaagataccaatgataattgccagggtactgataatgattgaaatcactaagtcatagaatggttggatcaggaaataaacgcctagtccattagaaagtaggccgataagtgccaggacaatgattagaaaataatataaaatttgatgactaaaataactgactcttttaagcagaccccaaagaataaagccaacaacagttattcctatcaataaaaaggaacggtgatcattccaaatagtcacaagaataccccctggttctgattatttgagcaggtctttaataacggcttcgccaacagcggttgcggaatttggattttgaccagtgattaaatttccgtcgataacgacatttgacttgaaaggatcaccctttataaaatttgcgccagctttcttcagctcgtcttccggtaaaaactttacctcgctggttaacccgtttaaggcttcttcgtcattagaaaagctggttaactttttgccggctgtaaagcgtttgccgtcttttgtacgcattgcaagaagtgcggtagtgcccacacagtttgctgatacaatgccattatttgcgatgatttgctgtgcaattttagcaagattcttattttcagggaagtcccacatggcaccgtggccgcctgcaaaataaataacttgataatcttcggcagtgacttctttcgggcttaatgaggttgccaagtagtgatttcgaaaatgattatccagataaaaatcccaatcaatattgtccatactatcacctgaaaggcataacggatcaagggggatataaccacccgtcgggcttgcatagtcgatgtcgatttcgttatcctgcatcaccttatgaaaatgggttgcttcgcgtaaccaaaggcctgtcgctcgattcacattattaaatttaggtacatttgttgctacaattaaagcttttgtcataaattatgattacctcactttggaatggtaataatgaatttgaacatatcacatatgtattttagaccttctgagtaatagagcaaggatagtttgtctacaaccaaattacgaaagggcattggcgattcttgtgaagatatgttactatcaacacagcttatcgtgattgattatagaaagttaactaataatcaatcacggtgagccaatattatactatccaggtgcgtgtataagtatgatcttgattggaggataacatggcagatacaattttagatgttgagggacttacaaagaactttggatccaaaaaagtcttaaaaaatgtctctttttctgttgaaaaaggacatattgttggcttggttggacctaacggtgccggaaagtcaacgattatgaaggcaattttggggctgtttaattatccaagcggtaaaattacgcttgatggccaaccggtttcacaaacaagtcatcaagctttggaaaaagttggtgcgctaattgaatatccgggtatttatccatttttaagcgggctgcaacatcttgaacttttttcaaatgacggtgtttctaaacaacagattatggacgttgttgataagatgaaaatggggtcgtacataaagagaaaagctaaaacgtattctcttggaatgaagcaaaagttgggaatcgcattggctttggtgaatcatcctgccttaattattttggatgaaccaatgaacggccttgatccgcaagcgaacaaagatctacgaacgattattttggatttagccaaacaaggaacgacgttcttaatttccagtcatattctaagcgaattggaaaaattaattgatgatttaatcgtcattgataagggacaaatcgtttatcgtggtgatatggcgactttggaaagcggcagcacgagatcaatggttcttcagacctctgatgatgctaaagccaaggatatcctatctcaaaacggatacaagttaatcgattctgatcatgttagtgttgttgaggatgaaacgaccaaaatggccgatattattaaattattgtcaactaataatatcgaaatcgaggatgttaaacacgttcatagtgatcttgagacttcactgcttgatttattgaagaatgacaaagtgaaggagggctaatctgatatggtaacgttagttagacaagaaatatttaaattggtgcacaaaaaaagtacgtgggcaacatcaattatcctgctggtgataatgactatctttgctgtgattagtcggaatcatccaaacacaattgaccccaagacaatatttgtcagtttatttactggttttgactggattgtattatttatgattgctgctgccagttcaattatttcgatggagtttcaatatggaacaattaaagaattgctttatcgaaagtactatcggggagaaattcttgttagcaaatggcttgcaatggttctttactcaatctactttattgcattggcatttgtttattcgttgattttaaaattaattctttttaacggaacatttcagctcagcgaaacatatggcaataagcatagtatcttagttacggccctttacacgtctttatcaggatttgtggcattgtggttggttttaagtctggttttgctgttggcaaatctgtttaagagttctgccgcagctatttcagttggtattattggctactttgcaattaatgtggtttcttcaatgttaatcatagctattaagaagtggacttggttaaagtggaatccgttaaacatgatgaattatcctaatcaggtcattagcccaagcctaaaacacatgacgcttttatcaacaaatgaattactcattggcagtctggtttatatggtcatctttttgggaataagctactctgtctttaagcgtcgaaacgtttagtcaaaggaattggccgataaaaattaataattgattgagcacttaaaccgtcagacatgtccttgggatgtgtctgacggttttattatgaaattgttggcaattttatggcacaacatgtagtgcgttggcaatgcataacacatatatattgtgttttaaagtctttttttcaaataattttcagctatactaaacaatgttaactatattttcgagtttacccaaaggaagggattctatggattacattaagactgaagcaacaaatcaaaacgatactaaacttcgcagtctaactgtgatcaaggctgacggggaaaagtgttctttttacccgtataaaattaatttggtcattgaggcacttaccgatgagacggatgtgcaggagaaattaaaacagcaaatttttgaacgactttcatccttcgaagaagaactgacgtcaaaggatatcagagatagttttaaagcagttctttcagaaatggaccgtggtgatttggttgccagttatgaccaatatcgcttaaaagatgaagccaagtggcaggcagcgattaatccttcaaccaagcttaaccagttatttgataaaagtgacactgttgttcacgaaaacgcaaacaaggacagtaatgtgttcagcaccaggcgagacttgactgccggaatggtcggtaaatctcttggtctcacgctgatgcctgaaactgttggtaaggcgcatttgcgaggggatatccattatcacgatctggattactcaccgatgactgaaatgactaattgttgtttgattgattttaagggcatgctgaacaatggatttaaaatcggaaatgccgatgtcgagccacctaagtcgattcagacagcaaccgcgcaaatgtctcaaattattgcgaacgttgcttccagtcaatatggtggctgctcagcagacaggacagatgagctgctggcaccatttgctagattgaattttgaaaaacatctggcagatgccaaacactggattgcccctgataagcaggaagcttttgcaaaagaaaagactaaaaaagatatttatgatgctatgcaggcactggaatatgaaattaatacattattctcatcgaatggtcagacgccgttcacaacggttggatttggtcttgggagatcatggattgagcgcgaaattcaaagtgctattttgagagtccggattaaagggctgggaaagcagcatcggacagctatttttccgaaattgatttataccctaaaaagaggattgaatctcaaacccgatgatcccaattatgatataaagcaactcgccattgaatgtgccaccaagcggatgtatccggatatcttgatgtatgacaagattattgaattaacaggtagttttaaagcgccgatgggctgtcgaagctttttgcagggatggcatgatgagaacggaaaagaagttaacagtggccgaatgaatttaggcgttgtcacaatcaatttaccaagaattgcgattgaatcccatggggataaagctgttttctgggaaatcctgcaagaccgattggagattgctaaaaaggctcttcttaataaagttgatcgttgtaagcaggcaaagcccaaaaatgcgcccattttgtatcagtacggtgcctttggtaaacggttaaaagatacggattccgtggatgagttattcacgcatcggcgggctacggtgtcattgggctacattggattatacgaagtcggaactgaattttatggaccggattgggaacataatcaaacagcccacaagtttaccgtatcgattgtaaaatgcctacatgattattgtgcaaagtgggaagatcaatacgactatcatttcagcgtctattcaacaccggctgaatcattgacagataccttctgtgagctggacactaaaaaatttgggaagatcaatgacattacatctaaagagtactacacaaatagttttcattatgatgtacgaaagaatccaacaccgtttgaaaagttggcttttgaagaggcttatccaaaatacgcggccggtggttttatccattactgtgaataccctaatttgaaacagaatccggctgctttggaggccgtttgggattgggcatacgatcatgttggctaccttggaaccaatacgtcaattgaccactgctataaatgtggatttgatggtgattttaaaccaaccgccaagggatttgaatgtccggaatgcggaaatcgtgatcccaagacctgtgatgttgttaagagaacctgtggctaccttggtaatccgcaaattcgaccaatggtacacgggcgacacgaagaaattgcatcccgagttaaaaatatgaggttaggtgatatgaacgatggcggaaactcgaaaaattaggttaccaaatgacccgaagcccaagcagtggttggcaaaggatcgcagccagcaatacatcgccagttacaagccctttaatatggtggatggtgaaggtgttcgctgcagcctgtatgtttccggctgtctattcaactgtcccggttgttataataaagtcgcccaaaactttcactatggtcacccgtatactaaggaattggaaaatcaaatcattaaggatatgtctgaaagttatgttcagggattgacattacttggtggagaaccctttttaaatactcaggtctgcattaagttagcaaaaaggattcgagcagaattcgggcatacaaaggatatttggtcctggacaggctataaatgggatgaattaatgaaggaatctgatgacaagctggaattgctaagctatttggatatcttggttgatgggcgtttcttattggctaagaaagacctgacacttcaatttcgtggcagttcaaatcagcgaatcatcgatgtacccaaatcattagcagaaaagaaagttgtgatttgggaaaaattagttaaataaaagcagcaatcggtcaaaaacgccatatgataatcaacactattcgttgatgctcatatggcgttttattttctatgataaatgatcatctatttgagataatcccgctttctttcaaataagaagacagaaagtgcggcaatcatggtaaaaggaagtgccattttgtatcctttcgtaaaggcatccgtcatgtgttgtttagtatctgacctaatgactttagcaactgctttgatttgagtattttgttccgcaacttctcttttaacaagtttagagattttagcatgaatcaaggctttttgcttttgcagcatcagtttggtatttggcatttttgcaatcgttttttgataattagcttgaatcagttgattggtttttgcaggagtaatcccctgtttactggttgaatcggttgtttttccattgtccgaaatggcttttctaacattaatcgcaacatccgtttttgctttggctgatagctgggttgtctctattcgggtgtttgcctgaataatggactgatgtcttgcggtagccaggttggccgtgagggcagagacaaatatcgctactgccagcaacgtaccgatttgacgaaatacgtcaaggacgctttgggatgcagaaagcagctttccggtaaagtttgatgcacccaaaacaacgagtggtccggcgataattccaaagccaccaccgattaatagtaaactgataatggtttggccataatgggcggggttaacaatcgaaagaatcatatagccggcaattatttgaaggaaccccacggaaacaagtagtcgtggcccaattttatcatttaatataccgccaattggtgaaaagatgaaaatcataaacgaggttggcgtgatcataaaagcagcagttagttcagatttattgaggatattagtgaagaaggagggcatgatgactaagacagctaccaagaagatttctgtcaaaatagtaactaaggaagcaccggtgaattgacgacttttgaataagcctaatggcaccatcggatctttagtgacgtgttcagcgacaataaaacaggcaagtgacacgataactgtcgtgaatagtccaatgataaggcggctggaccatccccagtcattacccttaaccaaggctaaagttaaagctaataatgtgctcattgaaaagagcatgccccaaagatcaattcgagctttaaagcgatgttcattttttagtggcaatagtccgcagcagagaatgaggacaattaaaattaaaggcaagttaattaagaaaacataacgccaccccaaatattgagtgacaataccaccgatggttggcccaaaggctgaagcaaatccttgagtcacacccaaggcggccaagacaccggtccggtgtttaacatcggttgttgaaataccgatggtcatacttgcgggaaaaataattgctgcgcccaggctttgaatccctcggccgataattaagaattcagcactgttggctgacccggatagtagggatcccagtgcaaaaagcactagtccaaccaagtatgtcttgtttctcccgataatatcggcaattctcccaaacgggatggtaaaaaccgcaaacgtgatggtgtaaatatttaaagcccatgataaagttcccaaatttacatttagaccgctttggattgcaggcagtgcgatattcatgacggttgtatccagcatacataagaagataccgatcatcatggaaaagatgattaatttttgtttgatacgcatgataaaaactccttttttagtttaaaataacagtgcaggtgattatgttgggcttggttattgtcgacaaataacccgggccccagatgttttcattacccttcaatcgcttgctttgtagattatcatggggtatcttaattaagaatcttttgttgacaaaaggagggattttgtaaacgatgtcacctaaggagttaaaggaccagaaattgaccgatatctttaaagctttaatgggcttgctaaaaggtcagtcattcgaggaaatttcaattacggaactcgcaaaacgagcaggcgtgtccagagcgtattactacaaaaattttgtgacactggaggatattgtcagccaatatgaaatgttgcgaatcattagctatttacgtcagctcccggatggatcgagattaacgctgcaaacgttaatgacacattattttcagctcgttttggatgatcagcgggaccagctgatcttaatttctgccggtaaagaacaagttttaattaaaacatttcataccgttttggtatatctgcttaaaaacaaactgattccattaactgatcgaacgactgattcttattggggtgactatttttccggtgcagttattaacttatcaattagctggcttaagcagggagcagtagaaccaccagagtatatgggtaaaaaggttgaaacctttgctaattaaattaaaagaggcttctagggggatttttcaaagatgattttttatacttatgattatttacatacatcacaaaatacttggcagtatgcgcgaattgtgatcacgtgtgtactggttttggcttttctcttatttttgattcagtattggcggcatcggttcgatataaagtataaggatctaagtatcatttttgggacgttgttactgttgattttggggatgcaatataacgattttagtaatattcaaaattcgattaagcagtctggtcaaatgacaacggtcgttaaagctgttgccagacaactgaaagtatccaaacaggatatcagtgtcaactcaacaaccccaaatgataatgtgttggttaaaacaccaaaagggttctttcgagttgactataataccgatggttctcaattcgttttagagcaggtaattctgcatgattcagatgctgttaaggttgagggggaaaaataatgtttacgtattctgatgttatgttgaaattaatagttggttttgtttttattacgctactgattaatttgactggaaaagggaatttagcacttacttcggcaatggatcagcttcagaactatgtattaggtggtattgtcggaggcgttatttacaacccggcaattacaatggcccagtttattgttattttgttgctgtggtcattattgatcatggttacccgatatttaaaaacacatattcactggttcggtaagtttgtggaaggtgatccgattacaattgtgagaaatgggaaattacttgttgaaaattgtttgagggcaaatctgtcagcaaaagatgtcgattttaaattaagaaccgccggcgtatatgatatcgccgaggttaaacgggcaattgtggaacaaaacggctccgtcacggtcctaagatttggggcgggaagcattcgatatcctgtgattattgacggtcaggttgatccggatgtccttgatatgatggataaggatcagtcttggttggatactgaattgaagcaacatgggattgataacattaaagatgtgtatatggcgacgtttcggaatagtaagttggaaattgttaaatatgatcaaaaggatgagtgaacgtgacaatcagttgctttaactctaggtgtttcacatgaaacagtgaagaaagcatttattaaataaggaacggagcgccttaacaaataaaacgctctgttccttttttgaatagtgactagatcttattggatatttagttaagaaaaataattaaaaactcaaccattacacgttatagttgatgataatcaagaaaaagagacgtgaacctagttgatgtaacaggacggttgctcgacaaaaggatattcccacattaaatttaagtgtatagacgaaaggagaattaaatggattttggagagcagcttcaaatacgacgcaaacaattaaatttaactcaggcacaattagcacaaaaattacatgttaccagacaaacggtttcacgttgggagaacaatgcaacgtatcctaatttggatattttagttgaaatgagtgattttttggacctttcgcttgataaattattgaagggatctgattcaaagatggttgaaacgataagtaaggatgtcaggctgaaacaacgttaccggaagtggttgatcagtattggaatcttgtttttgctacttctagtgtttctcggtgtattaagctgggggcgtcatagtcaaaatgaaatgatcgaccggtttaatccatttttgaaaacaacatatggatatgcattgttaccggagaaaacgccacccaaacgggaaaaatcaataataacagggtcagatggaaaaagacaccaaaagtggatgaacgttccacaacctgttaatgctcgtgtagtaacaaatccatttggtgacggtgaatggctgaaatttcaagtaggggcgattccggaaaaagggatgaattacgctgtggtcttgcacaagggatcatatgtaaagcgggcaaggctggtaaccaggtcggacattccgagtctgattcgatcaatcatgggacagaacgatcagtatatgccatatacttataaactgttcggtcccaaaggttcttggaacccatttcactaggttggttaactgatactaggaatcaaattgaaccaatgatgacttacggtcaaataaattaagagcatactaaggataattgaaattgctaaggaaataaggcttgaccaccaaagaggacttttgaacgttctgtgtgattgctgccataccacaaaaaaggatggtataatccccaaaatgggaattaatccaagtatcatgatgataatcgagaggtacagatctattctttttattttttcaagttctttttgttgaagaagattaaaaaagtgaagaaattcctctcgatctgattcgatttgtagatcaaaagaatgattatcttttacaaaattatcaaggggttcatcataaactttacttaaaagggttaagttgtaaagatcaggacgggaatgcccgttttcccagctggaaatcgattggcgtgtcactcgtagtttatcagcaacttgttgttgtgaatacccttttcttatgcgggcttttttcagttgacttggaagttgatccaaaaaagtcatctccttatttagggctaattgttggtttgataaagcgggggattttatgatcttggtgaaaccctacaattatgtatatacggatttatcgcttcatttttttcgacatattaaataagagtggctgggacataagtccaaaaaacattactttttaaaaaaatcccgtgaaatcagcgctttttgtaagctgatttcacgggattttcactttggggtaggaacgttgtaatattgatttttgactattgtcccagcctcttatttaatgaaagtttggaaaaatgttatagttcagaatctttgctttcagtattaggaattgagacagatgatttttcccttgacgaccaaaggccaaatccaatacaccagattaagccagcgattgccggtatggtgccatcgccattgaagaacaggcttaaatagatgataataaagaagccgattaatgccggatcaatccatttatagccctttagaacaaatccattggggtcgaagtcgatggattgacgatatttgtaatgggcgatcaccgttagaagataaacaaccagtgccaagtcacttgtcgccgaacaaatgagggtaaaggcattttcaattcccgggatactgctgataaccggagccaacatgattagagcagccgagaagacgatagcttttgccggtacgccacttttagagacagatttgaattttggcattagcgttccttgggactccgaagcgagttgataaaaatgtcgacctgctgaataaagaaaactatttaacgaagaggaagcagacgttaacacgacgaagttaatgacgcctgccgctgcctttaagccagccaatgcgaaaacctgaacaaatgggctttgattggcacttaaactgtgccagggataaatcgccataatcacgatgatggcaccaatataaaataataatattcggtaaattgtttcattaatagcttttgggagtactttatgaggatcttttgtttcagccgtggtaatgcccacaaattccattccttgaaaagcgaagaaaaccatcggaaaggcaccgataaagtttacgatcccattagggaagaatttaaagccttcgaaaatattattcagaccggcgtgtccaatcggtgttttaaagctggttgttaccataataattccggtcacaatcatcgcaatgatggcaataatcttaatcatcgcaaaccaaaactctgcttcgccgaatagtttcacggcaataagattgacggctgccagaatcaccaaaatagcgatttgaatcatccatgcatcaatatttggaaaccaaaaccgaacatacgtggaaatggcggttagttcagccattccaatgaatattaattccagccaatatgaccaaccggcaaaatatcccattttagggcccaggtatcgactgatgaacgcgataaaagtatgttctgatggatccttgtataacatttcaccaattgctcgcatcattagaaaaaagaagataccaataaccgcataaataaagataattgatgggccggtttttgtgatggaagttcctgcacctagaaataagccggttccaatcgtgccacccaacgcaatcatttgaacatggcggttggataattcccgctttgtgccatcggcattcattcggatcttagatttttctttcatacaacataatttcctttctttgaccacttatgtcagtgacgctttgcaaactgaatgttaatgaataacatataaataagtgcttaaccttatcaaaagtgacaatttcatgtcaacatgcgaacattaaaagcaactattaattggattgttttgatataaagctttgttataatttatgccataattaaataaaatgcaagcgaaagattaaaattatctcataaattattaattataaagcagccttataggttgctttaacactgttttgttagaattacacaatatttattcaggcggtccaatattattaattgacttctcataaaattgttatattattaacaataacattcactcaactggatgctgatttttaatcgagtgttggttgttgaaaggctgtcacacttttaaacttctcggaggtgtaccatcatggaattaaacgatattaatccaaatgtgttaaacgtcaaaccctcttctatgcgagaatttgaccatgaaattagtgctgacccgcaaattgttaaactaactttgggtgagccaaactttgatgtgcctgcccatattaagcaggctgctatagatgcgattaacgataattattcgcactacccatacttttggggctatgcggaactccgagaagccgcggcgaaatattatcaagaaaagtttggctatcactatactgcagatcaaattgttgtgacagtcggtgcaactgaagctgttgctgatgcggttgcaaccctgtttcagccaggtgatgcggttattttaccatcacctgcctacccgttatatgatgcttcaattgcaatgcatggcttaaagcaggttcgcattgataccagcaaaacggattatattttaacacctgaagctgttcagcaagcaattgatgacaatcccggtttaaacattcgggggttgattatcactgatccaaacaatccaacgggggttgcctatactgaagaacaactcaaggccttggtaccggttttgaaagagaatcggatttgggtcattagtgatgagatttatggtgaattgacgtatgggcaaaaacactgtacgctttcaacgtggttaccagatcagactgttattgtgaacgggctttcgaagtcccatgcgatgaccggatggcggttgggttatgtctttggaccaaaagggtttatcgacgaaattgccaaagttcatcaatttacagtaacaacaccgacctcaattgttcaatatgcagctattgaagcaatgaagcatggccaaaatgatgcagaagtcatgcggaagcaatatgaaaagcgtcgggactttgtcgttaagaatatgagagaagccggttttgatgtcgttcatccaggcggtgccttttatgtttatgctaaaattccagccagcttgcatatggatagttggacctgcgcacgtacgttggctaaagactaccatattggtttattcccgggtgcctcgtttggcgacgatgcgtctattcgaattagctatgctgccagtgatgaggccctgaaagcagccatgacggctattaagaaattagtggctgataagagtgttgttggcgataaataaaaagaaaattcttaaaaaagtaagcaagatttaagctctcaattttaattttgagggctttttattatggtatgatgaatttaaatcattaattggattacgaaaggttgttgactatcatgccatccgaagaacaaagaatgctttccggtaaactatataatgtctatgataaagagcttggcaaaaaatatgagcgaaaggatcaactgcttcatcaaattaatttcccgatacctgatgtggacccgcaagctaaattgacagaattgattggaaaaatggggcaaaactgttacattgaaccaccgtttttctgcgattttggtgacaatatcacattgggtgacgatgtttattgtaatacaaactgtatttttcttgactctggcaaaattagtattggcagtcgagttttaattggaccacgggtaaacttatttgcggccggtcatcccattgatgccggtgttcgaaataaatggttgggatttggcaaaccgattacaattggcgataacgtttggattggtggcggcacaacggtcaaccctggtgtggcgattggtaaaaatgttgttattggatcgggatctgttgtaacaacggatattccgaataatgtcgttgctgttggtaatccttgccatgttttacgcaaaatcaccgagcaggataaaatttattggcaggctgaagaaaccgattatgtagaagatagagggccacttggaagcccggatattcaatgattataaaaaacgaaagaaaagttggacaaaaaagttgcccagcttctctttcgttttttagttagtttcagcgaaaaaagactaatttatttttctttccttcatcgttaatgacaataataaagctgcaaccgcaataatcaaggtaaaaataaaccctaaatgaacgccattggtaaaagcaatttgatgagtcgttgcagacaactgttggccaaatcccaacaaagctgtggcgattgcggtggcaatggcgccaacaatttgttggaaggtgttcatgattgtactgccgtcgctggaagtgcgttgatcaagcgcacttaatccaaatgtttgagatggtgacatcgaaagcggcaccccaatcatcatcacgatgtgtgctagaatgacataccagatcggtgatgttgaattggcgaataagaataggacaattccaatgattgtcattgcgaatccggaaacgcttaacagacgtttactgattaaatcggaataacggcccgcaatggctgaaacagctgcattgacgataccaccgggcagcataacgataccggttaatacaaccggtattgcaaggccattttgccagaacattgggagcaggtacatagacgataaaatgataccgaaatccatcatcactaaaatggcaccggtccgatactggcgatttgcgaaaatgtgaaaatttaaaatgggctcagtcgctgatagctgacgtttaatgtaccaagctaataagatgattgctgcaattaacgtcgcaataacggttggcgatccccatccctgatcactggcaaggctgacaccggtaaccaacccaccaaaacctaaagtcgaaaggataatcgaaaagacgtcaattttgggttttgtgatgtgaccaacgtttggtaaatacttcatgacaagaatcaaggcaataattagaaatgggacgaacatccaaaaaatccattgccaagataaaacacctagaatcataccggacagcgttggaccgattgccggtgcaaacatgatcactaagccaattaatcccattgctgcaccaagtttatatggtgggaagattaaagtagcgaccgtaaacatcaatggtaggatcaagccggtcccaattccctgaatcatgcgaccgattaataaaaccgggaaactacttgctaaagctgaaataatggcaccgacaataaaagcaatgattgcaaaaacaatgatctgccgcgttgaaaaaatacgagacagtaaacttgagagtggtagtacaattccgataataagcatataaccggttaccagccattgaatggtaccaatattaacgtgcaaggcagtcattaagcttggcagtgcaatgttcaaggaagtttcgcttaacattccgacaaagccgccaatgagcatacccagcattgcaataaacggatgtgtgacgggtttggcagcctgatctttcttttcttgcgccaaagcgtcacgagtttctaaagatttttccataagtaaaaaacgctcctaattctaattctctatatcgttatcgtgtcaacaaccccttagggcatttgatcatggtagcataaataaaagattctcgtaagttttattttcaaacataggtgaattaacaaataatttagaaaggaaaaaaccgattttttcgtgtttaaagtagttctcataaatcaaaaacgaaaaaaccgtttattgatcgtgtgatatgcttaaaagtaataaaatgttttataataatttcataaaatgtgaccatttatcattaaatttctggtagaatgtaacataacgatgtaattttaaacagcttttctagtgctgagtggatttatatcaaaaaatattttgacagaaagtgggtcgttcttgtgagtaatgcaaaatcttacattgaatcagttaaggatacaattcaacgtcgtgatccaaatcaaacagagtttcaggaagcggcttttaccgttttggatactttggagccggttttagataaacatccggagtacatcaaagccaatttattggaaagattggttgaacctgaaagggcaattcaatttcgggtgccttggcaatctgatgatggtcaattccatgttaaccgcggttttagagttcaattcaattctgcaattggtccttataagggcggcctaagattacaccctagtgttagtttagatgttgtaaaatttttggggttcgaacaggttttgaaaaacagcctgactggtttgccaatcggtggtgctaaaggtggcagcgatttcaatccgaagggtaaatcagactctgaagtgatgcgattttgtcaaagcttcatgaccgaattgcagcgccatattggtccggatttggatgtgccggctggtgatattggcgttggcggacgcgaaatcggtttcttatttggtgcttataaacgtttaaacggttaccaaaatggtgttttaacaggtaaaggactgacttttggtggaagccttgcccgaccagaagcaaccggatttggccttctgtattacacgcatgcgatgcttaaggcgttgggagacacgctaactaataagaaaattaaagtgtctggcgctggaaatgttgcgacctatgcgattcaaaaggcaactgaatatggggcaaccgttattacctgctccgattctgatggttatgtgtacgatccaaacggtatcgactttaagcttgttaagcaaatcaaagaggtagaaagagggcgcatcaaggaatatgcgcaacgggttgaaacggctgagtatcacgacggatctgtctgggactttgatatcaactatgacattgccctgccttgtgcaactcaaaatgaaatcagtaaagatcaggcaaaattaattgccaaggatcgggtaaagtatgtctgtgaaggtgcaaatatgccaagtgttcccgatgcaattgcaacatatcgtgataataatatttattacgggccggcaaaggctgctaatgcgggtggtgttgctgtttcagctttggaaatgagtcagaatagtgaacggctctcgtggagctttgaaaccgttgataatcggcttcatgatattatggacaatatcttcgaaatatctgaagctgcagataaagaatatcaattaaatcaggattaccaagcaggtgcgaacattgccggctttgaaaaagtggcacaaacaatgatggctcaggggcttgtttaagggtacttttttcctgcattcaaagtttggtgcgataaaataatagcggtcaggcaagtttactatttgcctgaccgctattatttcgctgactatttagttaagataggctatcgcgacttgtttgaatagttgttgcatatttaagaatgttgcaatttcaacatattcgtttgattgatgggcagttgtgttaccgggaccaataattaagaattcgccagttgaattatgccggcggaactctgaagcatcagtacccattgatgatccaatagttggtaaagggagtgcttcacgaagcgtggcttttgcgtgtgcttgcagtatagtcgctaactggttcgtgcccctgtttgcaacggggttttcgctttgctccacgtccagcttcaaatcaaagttaggcttcttattgagttcacgaacaagttcttgaagtttgtgaaccaacttttcgtttggtagttccggaattgttcgaaccttaactttttcgtaagcaagatccggaatactatttacctgcttgccgcctataaaaacatcgggtgcataaactgtttttcccaagtttggatttcgttcggttagggaatgataaagggctttttccgcaatatagtattgaactagattgtcaattgcgttaatgcccagttttggcattgaactatgtgccgcttttccgtgagaagtaaccgtataactcatccatcccttatgggcgtttataatgaagtgctgttcaggtgcacttgaatcttcaagcgccgtgtataactcatcaagctttttgggagagattatggcagcaccgctcgaaaaataagtatccaactgatcagtcgggacaccggttggttctgaaaaaagcatggcatcgagatcatcgccatatccttcattagataaaaaagcggccccttcttcggttaattcttctgaaattgttgcaagaagtcggagtgttccgtgcttaggaaggttctgatcgtgaaggtcaatcattgtgatgataaattgagccagcccggccttcatatcagaagtgccccgcccgtaaatccgtccgtccttaagtgttgcctcaaaaggcggtgttttccaagtacttaattggccttcgtgaacggtatccaaatgaccactgaaacctaatttaggatgttgaccatcaccaatttcggcgacaacgttgcttcgcccagggaattggataattgatttggcggcgattccgtgtttatgaagcaggctaactaaataatcagctgcttgttgttcattatcattaacggtgcgaatggcaatcaggtcacggacaatttgaattttatctttttctttcataaaaatatcgactccatgctttctatgatatgtgtcatcgttaagtggcatataatattaggtgttattaggcataaaaatcttagaatttgattagagaacagctttcgatcattgtcccaatttctaaccggaatgtcaattaagaaagtcagacaaagaccatgcggcgtttaaattaatgtaacaatcgtccgtgcaacgttgcattctggttagggtatggtatgtttattagcaaacaaacacaaggaggaattgcgatgacatggattatactgggtgtcattttaatcattattattttaatgattgtagttttatataacggcatcgtttctcagcgaaacttggtcgatgaagcagcaagtcaaattgatgttcaattacaacgacgagccgacttactacccaatctgcttgaaacggttaaaggttatgctaaacatgaacgggaaacgttagcaacagttactcaaatgcgagctgctatttcggatccaagtgccagcttgtcagataaagttaaagctgacaatcaattaaccggtgctttgaatcatttgtttgcggtctctgaaaattatccggacttgaaagcaaatcaaaacttcctatcgttacaggaagaattaacgaataccgagaacaaagtcgccttttctcgtcaaaactataacagtaacgtgatggcctacaataataaactacagacttttccaagtaacctggtttccaaattcggaaacttcccggttcgtgattatttggaagcaccagagggctctaaagaagttcctaagatgaaattctaggttttaagaggggtttcataaaatggaaacgattaatcaacaaattatacaaaaccgaagacgcacttggctggtactcgcagggtttatctttttaattgctgtgattggctttttacttggtttgatttttgcttaccaaagcgatcaagctgatataatggtgccaatatataccatgctggggtttctggtcggtgctgctatttatacatttttcgtctatatgagtgtcacaaatatcttgatgagatccagcaaagcccgtcagcttcaggagtcagacgatccaacgttgtttaacattgttagcgatctttcattggctgctcatattccgacacccgatatttacatgatggatgaacaagcgcccaatgcgtttgcgaccggtcgtgatccgcagcacgctgccgtagctgtgacaagcggattgcgagaaatgatgaatcgagaggaacttgaaggcgttttggcgcatgaaatttctcatatcaaaaattatgatattcgagtttcatcgattacagttgcattgacgactttcattgccggtgccggtgccgttatgatcattgccggcattagtatgatgcggggtggcaattggcttggattctttggaggtggtagtcgtgatcgggattccaaagattccagttatttttggttggctgttttggcgtttggatttatcgtgtggcttggtggttggattgtcaaaatcattggggttccaattgctcaaatcatgcaattcgcagtttccagacagcgagaatcgttggccgatgtttcaggcgtcaaccttacccgggatcctcaaggattaattgacgctttagaggcgttaaaggatgattcaacaccgatgaaaaaccctgaagccaaaggtgccgctctttatatcaatgaaccaaccaataaacatgggcaaacaccatttttagttaaactatttgatacccatccgccactagatgagcggattgatcggcttaagcggctattaggtgaacattaactcgattttatttttaaatcttttttcaatttatcttgacagtctctctttgacgcggtaatattcatggcaagaaatttaattaaattctaatacttacttgcgacgaagagaagagtagagaaattagtagtgttgtagagcgaccactgttggtgaaagggtggacaggaacatttcttgaagatgaactctgagcaattatcaaaagtgaaagcttgcggtacgtgggaaacacgataaaattccgggcatgtttgtgccttagaggcagcgatggtaacatcgatgcgaataaacgggtggtaacacgattaaaagtcgtccctgtgcagattattctgtacggggacgacttttttgtttggaaagcgaggaaatcatatgtctgaattcgatacaaagttagttcacggtcaatcgcagcatgataatcaaaccggtgcggttaatgtgccaatatacaattcatctacttatatttttccaaaagttgattctaaaataacctgggattatgcacgctctggcaatccaacacgaaactacctggaggatcagttggcagcacttgagaatggtactcagggatttgcattttcatctggtttgtcggcaattcatgccgttctgtcaatcttttctcctggggatcatattattattggtaacacgatttatggcggtacatttcggttaattaaccagttttttaaacgttgggatctgaagtttaccgaagttgacacgcaaaatttggatgaggttgaaaaagcgattcagccgaataccaaagcaatttattttgaaacatttacaaatccattattgaaagttactagcgtaaaggctatttccaaggttgccaaggcacatcatctgctgacgattgttgacaacacatttctaactccttatctacagcgtccattggatcttggtgccgatatcgtggttcattctgctacaaaatatttaggtggccattcggatgtggttgctggaatcgcggttgctaaagataaagccattgccgatcggatttactttaaccaaaacggggttggtgctgtgctttcccctgaagattcgaatttaatccggcgagggatccaaaccttggccgttcgattggaccgccatttgagtaatgctgccaaaattgttgcgtttcttcaaaatcgaccagaagtttctaagatttattatccagggattgaagggtcaaaagattatgaaattgcgaccgctgaaacgaatggttatggtgggattgtgtcatttgaattgaaaaagggactaaagactactgagtttgtcgagaatctgaatttaattcaactagctgttagtttgggcgctgttgaaagcttaattgagcttccttacaaaatgacccatgcggaattatcgccggaagaacagttggaggcgggtattacccatcaactggtcagactatctgttggtattgaagatccaaaggatttaattcacgacttatcacaaagccttgatcagctgtcaaaagacaaagtcatcgaagaatcatccggtagatagttgatgctattttgcagaaaagattgattgacgtgttgagcgaatgagtaagtttttattggttttaagagagccggagttgctgaaaaccggtatctgataatgactgaatatggttcgtgagcgtatacaccatatcgactagtttaggtatgatcggctgccgccgttatccggtttgagaaagttaatttcttactgaggggtttctttgtgaaaaggaacccgaacaaaggtggcaacacgtgaaaaacgtccttatgtcgtgaagacagagggcgttttttaaaacataaaatgagttggggagatcgttagtcatgaattacaagaaagtattgggaagtatcgttggtgtattggcagtgacattaactttggcaggatgtgggagcaattctgctaaacaacaggcaactaaagattacaaatatggatcagtgacgattcctgcaaaggacgggtctatctgtaatgcaccaaattacattgcttatgaaaagggatttttcaagaagaatggattaaaagcaaatttggttgccaatcctcgagatattagtgatcttgaagctggttttgccagtggtaagtatgatgctcaaaatggcgattttcagtatttgccggctattcaaaatggtgcccagattaaggctgccggcgggattcatcaaggttgtattaaattattggtaccaaagaattccaatattaaaagtgtcaaggatttaaagggaaaaaccattgggattccggcacaaggatcaacaccacaatatgtgacatcgattgcactacagcatgcgggacttgatcctaaaaaggatgtgacatggaaggtctttagtaccgatttgttggcgaaggctgcccaaaaaggtgaggttgatgccatcggaacagttgatccatatgcttatcaagcacaaaaacaagatggattcaaaaccattgtcgacaacaataatgataacggcaataatgctatggccaaaatgggtatgaagaaaaaagggtcttgctgttacctgtatctctctaataaattaattcaatccaatagcaaaaaagccaaggcaattgtgaagtcatatcaggaagctgcggcatggattaacaaacatccggaagaaacagccaaaattgaattgaataagggatatgtttcaaaaacgaaattcattaacgtcgccaacgtatcacaaatcattaaagacgaacatttcgatttaaatttaaccaaaggtaaatcggatttgaattattatatcagtcagttaaaacaggcgggttacctgaaaaaagataccaaaaatgcacaattattgaaacaagcttactggaatccaaaattaggaaactagattgggggataaatgatgttagatgctgtcacgttatctaaaaagcagcgcagtaaagctgttaaacaggataaagcagaaactaaatattggaagccatggcgaaccagctggaatattttgagtttggctgccgttatagctgcctatgttgaaaaccaattggtaccatcccaggagttggttaataacggcgcgtacaaatggtttctgattgcttactttatttatttagttgccgtctatgttattggggccgttgttcatggcaggattagagtgtatggcggacattttgcacagctaaatgcagttttgggtctcttgcttattgggcaagacttattaacagagaaatttgcagtcattaaattaccattttttgttagttttgctcaaattcttgatcagataaaaacagatcaaaagctattgatcgaatcaacgtggtcgtcacttggattatggctgattagttttattatcgggacgttgattggtgttgtcctggggctctttatgggacgttatagacagtttaattactggtcatttcccttcctgaaagttattgggattattccggcggctgcctggatgcccctaacgatggtcatttttccgaccagttacatggcagaaatctttttaattgcgtttgcggtttggtttccggttgcgtttatgacgattggaggcgttcagagtatttcaacggattattttgaatctgctaagacattgggcttttcagaatttcaaattcttcgaaaagtcgtaatccccggtgcgttaccaaatatctttattggtatcttcacagcgatgggcctttcatttacgatgttggttatttctgaaatgattggcgcaaaagttgggcttggctggtacatcaactgggctaaaggtgtcggtaactatacgcaggtgtacgcagccattgtcattatggcggtgttgttctcagttatttttagctttttaaataaattacaagagtacgcacttcgttggcgtcaacgatcaaattaagaagggaagatgtcctatggttcaactctctgtccaaaacgttaatcgaatcctgcatgataatgccggtcagcggattaatgttttggaagacattaatctaagtgtcggatctggtgaattcatttcaatcattggtccgtctggttgcgggaaaacgacattgctacgacttatttcaggattggatcggccggaggaaggcaaagtaacaattgatgaccagttgattacccgtcccgatgtatcaagaggttacgtctttcaacatggtagcctttttccttgggaaacaatcagggaaaatattagttcaggtttaaaggctgtccatggtaggcattatgataaaaaattggtggaccactacattgagttaatgggattgaaagggtttgagtcggcttatccccatcaagtttcagggggaatggcacagcgggcagctctggcaaggtcaattgtcttaagaccggaattattattactcgatgagccgatgggagcattggatgctttcacaagggccgatgttcaggacgttattcagcgggtatggaagcagactaaaacaacaatgattttggttacacatgatattgatgaagcgatttatttaggaacccgcattgttgtcatgacaccgagacctggcagaattaaggaaatcgttagcaatccgcttacctttccaagagatcgaacaagtaatcagtttttggaatttagaagagaaattcaagataaattgaattttggggttgcagagaactaaatacattatttgaggagtggcgtatttgaaagtaaaacatatcattatcagtgcattagggttgttactggttgccggtggtcttgcaggctgtggcaataaacaaagtgctgattcaacgaagggttataagaacggaacaattacaattccggcaaagaatggatctatttgtggtgctcctaactatattgcctacgaaaaagggtttttcaagaaaaacggcattaaagcaaatctggttgccaagccaaccaatattgctgatttggaagctggttttgccagtggtaaatatgatgcattaaatggagattttcaatatttgccggcaattcaaaatggtgctcaaattcaagctgcaggtggtattcatcaaggttgtattcaggtactggtcccaaagaactcgtctattaaatccgttaaagatttgaaagacaaaaccattgcgactccagggcagggatcaacacctcaatttgttgcttcgattgcgctccagcatgcaggaattgatcctaaaacaggtgtcacatggaaaacttacgattatgacttattagccaaggcagcccaaaagggtcaagtagatgcaattggaaatgttgatccatacgcctatcaagcaatcaaagaagatcatttccgggtaattgttgataataacaatcatgccggaaataatgaaatggcaaaaatgggcatgaaaaaggatggttcctgttgttacttataccttgctgataaactgaccaaacaaaatccgaagaaagctaaagcgattgttaaagcttatcaggaggctgctgactggatcaacaagcatccacagcaaaccgcttcaattttattaaacaagaaatatgtttcatccagtaaatttgttaatcagaaaaatgtgtctaatttgattgccagctaccattttgggttgaaaaaatcaaagggtaaagccgacgtgacttactatgcaaatcaattaaagcaagcaggatttttaaaatccgatacaaatgttaagcaactggtaaataaagcatattacgatggctaaatattgatggaggtgaccagtgtgagaataaaagtgtcaaaagaaaaacagtttattgaacggatatacaacggttatggcttttcacgcaaagacagtgctttaattgccgataccctggttgatgccgatttacgcggcattacatcgcatggtgtccaacggcttgccatgtatgaccgaaaaatcagatcaaagtatattatcccttacaataaatggacggtgctcaatcaaacgaaaaccagtgttttagtagatgccaatcacacaatgggtcagctcgtatcagtatttgcgatggatcatatcattaataaggcacagcgtcatggccttgcaattggaattgtacggaactctaatcattttggtgctgctgggtattacgccagaatggctgccaagaaaggactgatcgggattacatctacaaatactaacccgttactggtaccgccacatgcaaggcaaccattcttgggtagtaatccacttgcgtttgcgtttccgaccaggacggggtcgtttgtatttgatgcggcaacgtcaaccgtttctcttgggaaaatcgaggttttgctgaaaaataaccgacaggtacccggagaatgggcgattgatgggaaccgtgaacagcaaaatgatccgcagacaattcttgatgaactttcacgagcgcatcgactgggtggcattttgccattgggaggacttgatgaggccaattcaaactataagggatttggtatttctttaatcgttgagtgtttaacatcgattttggctcaagggtcgatttctgccgatcttgggaataagaatcatgatattagtcatttttttctggcacttgatccgacgttatttgggagtcttgatgatattgaaggatctttatcagacatgctggaaagaatgcgtcatttagaccatttacctgacgacgagattacaattcccggagataaagaaattcaaaactatgataaaaatcagactaacggtgttgttgttgacgaaaaaacgttaaacgaagtgaatgaaattgctgatcggcttggtgtttccgagttggtaacttcaaatacaatcagggagtgatcaggtttgactgaagaaaaatttgatacattacgaattcacggcggatatgatccggccaagcataacaattccgcaacggttccaatttatcagaatgtcgcttttgcactgggttccgcagaaagaggcgaggccgtcgctcagggaaccgttcctgatgcttatatgtattctcgggttggcaatccaacggttggcgtccttgaaagacgactggcggcattggatggtggcacggaggcagttgctgttggctcaggcatggccgcaattacttatgccattttaaacgttgcagaaggcggtggtagaattattgcaccatatgacatttatggtgcggcactggatgaatttgaaacactttttccaaaatatggcattaattttgatttggttggcaatattaatgattttgacgaggtaaagtcattgattcaacctgatacaaaggcaatttatgtagaaagtgttgcaaacccgacaacagagatttcggatgtggaaaaattggcccgaattgctcatgaggctcatattccactcattgttgataatactttttcaacgccttatttgttcaaaccaattcagtatggtgcagatattgtcgtttattcatctacaaaaggaatcagtgggcatggcaacgttgtgtcaggtgtgattattgatggtgggcattttgactgggaaaatagtcaatttccacagttccaggaaaatgaatttattttgaaaagtgcggaacatccagaaaattatagttatacgaccgtctttaaaaaccaagcgtttatcaaacgaattcggatgaagtatcttcgcctaatgggcgcggttttaggaccattcgatgcttatctggagttggtcgggttggaaacaatttccgaacggctggataaggaagtggcaaccagcttaaaaattgccaactatttggagaaaaatccacatgtaaaagcggtttattataccggattacctgattcatcccagtattctttggctaaaaagtactttccaaaaggaatcggaactgtgctgtcctttgagttgaacgggacagctgagcagacaaagaaagttgtcgatgcggttaagttatttctgtatttaccaaatgtaggtgatagtcggtcactgattgtcaacccaattaaaattacgcatcgagaggtgcccgaggatcgtcgagcagccagtcacattacggatcaattgcttagattgtcaattggacttgaggatagtgacgatttaatcagcgacttggatcaagcaattaaaacagcatttgaatgaggtgaatcttttgacgattgacacaaagaccaatattctaccagaaattattaacctgagacatcaattccatcgtcatccagaactgtccaatcaggaatttgaaacaaccaagcagattgcggcaattctttcaaattggggaatttcaattgttccaacggatttggataccggtttattggctgaaataaaaggcggtcaacccggaccaatgattgcgctgcgtgccgacattgatgcgttaccggttcaggaacaaaccgatttgtcttttaagtctgaaaatcccggtgttatgcatgcttgtggtcacgatcttcacttttcaagtttactcggtgctgcttatgttttaaatgcacaaaaagaaacgttgaagggaacggtcagattattgtttcagccggctgaagaggctggtcatggtggtgatcaggtattggccaagcatgttttggatggcgtacgggggattgtcgggttccataacaaccctaatctgccggtaggacaaattgcgttgcaagccggtcctttgatggcgggatgctatcgattcctagtgaccattcatggtgcgggttcacatggtgccagacctgaaaaaggaaaggatccaattattactcaagcggcaattatttctcagctgcagaccattgttagtcgaagtaataatccctttgatgcagtagtcgtgagtgtgacaaaagttcgcgccggtaaaacctggaatgtactacccggcgttgcaacgcttgaggggacagtccggacattctcagatgaaaatacggcattggtaaaaaaacgattttattcaattgtaaatggtatcgctgatgcctatgagcaaacggctgatattgattggagcgttggcgcttacccgattaaaaatgatcctacaattacagccgttgttaagagtgggttaaaagctaaggtcattaagcccgagttgacaatgacaggtgaggattttgcaacgtttgaagcacaaatccccggaacctttgcatttatcgggtcaaacggccgtccaaatgcttcggatttacatgatccgggttttgttggcgaagatgaaaccatttctgctgcaattgattattttgtccaaagtgcaaacagtttattgacttactttaattcaaaatgaggtggttggatgattgatatttcgtccttaattaaaaatgatctgcataaggttgcaccatcactgattcggcaaattaacaatcggttcggacaaattcccgatatcgttaatttaacaattggtgaaccggattttcaaacgccggaccatattaaactggcggcggtccagagtattttaaataatcgcacccactatgcgcccaatcgggggaccaaagaactactgacagcgattagtaattacctggcaagccgatttggattggattacgatcctgatgatcaaattgttgtcactaacggtgctagtgaggctattagtaccgtttttaacggtattatcgggcctggggatgctgtgcttattagttccccggcgtttagtttataccatacattgacattgttgagcggcggaattccgattgaagttgatgtttcatcaaccggctttaaattgacacctgatgttttggaccgctatttgacacagtatggcgacaaaataaaaatggtagttctcaattatccaaacaatccgacgggtgttacgtacacaccaaatgaagttcgcgaactggcagctgttttgcggaattaccaagtggctattttgagtgatgaggtatacagtgaattagcttattttgatgaacacgtttcgatcgcaacctatcttccggagcaaacccttttggtgaatagcgtgtccaaatcatatgcaatgaccgggtggcgaatcggttacctatgtggggacaggacagttattaaagaactcgccaaggttcatcaggctaatgttgctaccgttggcacaccgaatatggatgcagcaaccgaagcctttctatttggcgatcaggatattcggcgaatgaaaggtgtctacgatcggaaacgggattatttatgcaaagcacttgaaaaaattggctatgagtttgtttctcctagaggggcgttctatatttacgttcaagtaccgaagacgtttcaaggaacggcgatggcatatgctgaacagttggctcaagatgcacttgttgccgtagtgccgggtgaagcttttgaaaacggtcattcgacctactttagaattagttatgcgacaagtatgaaaaaccttcagctggcagtccaaaggttagccgaatatgtcaaacggcagtcagaaaaggaggtattaaaaccatgacaaaaattcttgcttaccacgttcgggatgatgagcaattctttattgatgaatgggcaaatcagcatcatattcaagttgacagtgtgccatatgaattacatgacgatacggttgatcgggcaaagggttatgacggtatcgactataagcagcgaagtattctgagtagtcgaccggatttatatcgaaaattacatgattttggcatcaaacaactatcagcccgatctgcaggcattgactcagctaacttaaattgggcaaagcaaaataatctgcgggtgacaaacgtgccgtcttattcaccgccggccgtggcggaactggtgctaacccaagtgatgcagttgattcgtcatattccccaatttaatcaacggcttaaccgtaacgattatgtggtaaacgggttacggtcacgcgaattatctgaattaacgattggcattatcggggtgggtcgaattggcggtacagttgccaaaatctttcatgcgttgggcgcaacggtacttggaaatgatatcgcgtctccaagagatgatttaaaaggcattttaacgtatacctcgaaagaagacctttatcgtaaatcggatattgtaacggttcacgtttactatgccaaacaaaattaccacttgattggtgaaaaacaatttgacctgatgcgggatacaacattctttattaatgattcaagggggcctgtcgtaaatacaaacgccctgttagctgcccttcatgaaaaacagctcgcaggagcagcacttgatgtcgttgagaatgaaactaatatttttaatttaaagtttgacgagaaaacgccggaaccattatataacgcgttaaaagaactacccaacgtgttattaacgcctcatatcggtttctttacggataaagccgttgaaaatatggtcaagcagtcattggatgacacacttgctattattgagggtcgacatagtgaacacgaaatcttgctttaggattggagttaaagaaatggttcaaattagaaaaatgaaggtgacggattatgctgcggcatatgcactttgggagtcggtaccggggatgaatttggcctcacttgataattcagagcagggcattgctcgagttattaacaagaatcccgatctgtgttttgttgcagttgatgatgagaaggttatcgggaccgctttgggggcaactgatggccgaaaggggtatctgtaccatgttgcagttgcaaaatcctatcaaggtcagcatctctcaacccaattaattgatcgggtcacaacgggatttaagaataaaggcattgataaaatcggcttatttgttgtcattggtaatgaagagggcaaaaacttttggaagcatcagggatttaaggaacgaccagatataaaatacttagatttggacttataaggttgatacttaaaacgtcgaaatagtcaacttgacaattaaaattcaatgagttacattaaaaccacattaaattgatagaaaaaatgcattgaaaaggaaagtagaattgtggttgtaatcaagtgaattccgttaagtgtgaaggaacagtgcaaagcaatttgaaaatcacctttgagcagtaaatccgaacagtgaagatttacggaaacgcacgccttattgtgccaacgtatcgttcagataatgaaccgtacgcataaaggcaacttttaaagttgcgaataaaaggtggtacagtgcaaaagcgcccttggttttgaatagaagccaagggcgcttttttctttcaaaataatagtaaacggaggatgattgatatgaaatttgtaatggttggtgcaggcgctatgggactacgatatggtgttttgcttcaagaagctggtaacgatgtaacatttgtagatacgtggcagcagcatattgataaggtccgccagcaagggggcgtttatgttatgcgtgatcataaagaccgtcatctagtgaaaatcaaattggaaacaccggaaacttaccatggtgatccggacgttgtggttttctttgtaaaacaaatgcaattaaacgattatttaaagcgctgtgcccactttttcaatgaccgtcaatacgcctttacttgtatgaatggcatgggacacattgaaaaactccagaagtattttgccgacgacaagatcattggtgggaccgctttaattgcaaccgtccttccaggccctggtgaagttgattttatgggcaagaggggtgccggcatgatgaatatgtgcccactcaacgaaaagcctgacgagatgtgtcagcgcctttacaatgaattggaaaaagctcaaatgaatccgacacttacaaaagattttactggaacattaatgacgaaggtgattttcaattcggtaatgaactcgctttgcaccatgtttgaaattccaatgggggaattcggtaacttctccggtgcccgtgaaatggcgcgtcaattaattgatgaggcttatgatatctgtgcccgtgcagacattaagctggtatcgacacgggaacaagaattagcttctttggatcataactcacgaattgatatgcctttacattatccatcaatgtgccaggacatgtttaaggatcgtccaaccgaagtagattacataaacggctacattgctaaattaggccggaagtatcattatgaagcccacacacatttatttgtcactcaagaagtccatttggctgaatatcatcggcaaaatgaagcaaaaaagcgtcaaatgaaagaatcaacacaagcaagtgtgaaatctgcgtaagttttgagaagaaaagcatagaaaataattaatctgttgagtctaaacatgagataagcgaaatgaatttttatgcatgtttaacaaacctcatgaaaataaaatctgatcttgacacctttactataaaactgttagtatcactctgtatatataatcaatgtgttgatgagaagagtaggctagttgttcttggatcagggaccgtcggtaagtgagaagatggctgagaaactaatcgaagatgagctcggagcagattatcaagggtgcaagctcaagatacgtgggaatcacgataccattccggacattaaaaagtgtcttaaggtattgatggcaacatcaatataaattcgggtggtaacacggctaatataaaagggtcgtccctctgcatgtttatatgcaaagggacggctcttttgtgatatcatagaatgccgttattattagtctggtcatagtgtcagaagcaaacttcatttttaaaggaggaaatagttaatatgtggcatattattcaaacgtcaacgcctcagctgttggaagcaggctttaaatacacaattccaatcgccattatttcttttgttattggcttgatcattgctctatttacagcattgattcgtctttcgtcaaaacgaggtgcttttttaatgctaaaagcaatttttcgcttttacgtttggcttttccgaagcacgccattattggttcaattatttattgtttactttggactcccatatttaaaaattaaaggaatcttcccgaatggcatccagctaaatccggttattgctgggatcattacattttcattgaatacaggtgcatactgttcggagacgatccgggcgtccattttgtcgattccagaaggccagtgggaagccgcatattcaattgggatgactaaatccgttgttttaagaagaattattttaccacaagcaatccgaatctcgttaccgccattggcaaatagtttcattagtttggtgaaggatacatcattggcagcttcgattacgattgttgaaatgtttgaagtgagtcaacaaattgctgcccaaaattatcagccattaattatgtatagtttggttgctgtttattatgctgtcttttgtaccgtactgacttggctgcaggggtatttggaaaaggtaacgtcacgatatgtaacgacaaccagatagggggtggattgtatgttaaaactcgaaaacctaacgaaaacattcggaaaccatcaggcattaaagaatatttcaacaacttttccggaaaatcaaacaacggtcattgttgggccttcaggttcggggaaatcaactttattgcgatcgctgaattttcttgaaaaacccgagtccggtcattattattttgatgatttggacattgatttatcaaaaccgatttccaatcaaacaattttaaatattcggcgtcatactgaaatggtgtttcaaggctataacctatttccacatttgtccgtcatcaagaacgttatggaagggccggttcaagttctgcacaagaataaaattgaggcaagaaaacaggcggctgaactattggcaaaagttggcctggaagagaaggcggatgtttatcctgctcagttgtcgggcggacaggcacagcgagttgcgattgcccgctcattagcaatgcaccccgactatatctttcttgatgaacccaccagtgcgcttgatccggagcttgaactggaagtattgaaagtattactgcaaattgccaaagaaaagcagtccatgattattgtgacgcataatttggcatttgcgagacaggttgctgataaaatgatttttgttgaagatggccgaatcttgtttgacggttcggagcatgatttctttgctactgataataaacgaattttagattttatttcggcaatgacattttctgatttggaggaggattcataatgaaaataggaaaaggaattaaacggtttgcattagctttaggtgttgtcgcaacaggggtattattgactgcctgcggatcaagcaactcatcaagtaagggtggttatacatcagaattaaagcagagcaagcaactaacgatcggattggaaggcacttacgcaccttattcatatcgacaggatggaaagctgactggatttgaagttgatttaggtaagacggttgccaagaagatgaacttgaaagccaacttcgtgccaactaaatgggatagtttaattgccggtcttggaagcagtaaatacgacgttgtgttgaacaatattgctgaaacaccggaacgtaaaaaatcatatattttctctacaccgtatatttattcacgatatgccttaattactaaagccggtgacaagtcgattcagaaactttcagatgtcaaaggtaagaagcttgccgaaggaacgggaactaataacgaagctcaggctaaaaaacttggtgccaaaacagttccctcaggagactttaccacaaccttggcattgattcgtcaaggtcgggttcagggaactatcaatgcacgcgaggcatggtttgcttacgcaaagagtaattctaccaagggattaacctatcataaggtttctgattcccaagcagagccggttaacatttctgcaatgtttaatcaaaaggataccaagctaaaggctaagttcaataaagttctacaacaattgcgtaaggatggcaccttgactaaattatcacagaagtatttcggcgcagatattaccaaggaatgaaataattttgaactttgtgttgacaattagaattatgtgcgttagattaaagacacattaaaatttcgattgaaaatgcaatgaagaggagagtagtttcgccaagtcatttcagggaatcccggtaagtgagaagggataatgatcaccgaaacgaaagtagcctttgagcagtaaatgcgaagtaatgagtgtttacggagagcacgccttaaagtgccagtgtatcgttgagtaaaatcagccgtacatgataaggtaatttgtgagaacaaattataaattaaggtggtacagtgctaaagcgcccttgatcttttataaaaagatcaagggcgcttttttaatcgaaatgattaatggctttatgaaatggtaatcaatgatagtcaaaattggaggatgattgatatgaaatttgcaatgattggtgcaggcgctatgggacttcgttatgggattttgcttcaagaggcaggaaatgacgttacatttattgatacttggcagccgcatattgatagaatccgtgaacaaggtggcgtttatgtcatgcgtgaccataaggatcgtcatttaaccaaaattaagttggaaacgcccgaaagctacaacggcgatcccgacatgttcattttctttgttaaacaaatgcaattagatggctatcttaagcgatgtgcgcacttcttcaacgatcgtcaatacgcctttacctgcatgaatggcatgggtcacattgaaaaactacaaaagtactttgctgatgataagattattggtggtactgctttaattgcaacagttctaccaggaccaggcgaagttgactttatgggtaggcgcggtgccggcaagatgaacatgtgcccattagatgagaagcctgatgaaatgaccaacaagcttttcaacgaattggacaaggctcaaatgcacccaaccttgactgatgattttactggaactttgatgacaaaagttatctttaactcggttatcaatacgctctgcacaatgtttgaaatcccaatgggcgaacttggaaactttaagggcttttactcgatgggccgacaattgattgatgaggcttatgatatttgtgcccgcgccgatatccacttggtttctactcgtgatgaagaaatgacggcccttgatcgcaatgtccgtatcgatatgccgctgcattatccatcaatgtatcaggatatgattaaggatcgtccaaccgaagtcgattacatcaatggctacattgctgaattaggccggaaatatcattatgaagctgcaacccatctatttgttacacaggctgttcacttggctgaattccatcgtcaaaacgaagctaagaaacgtgctgcaaagaagcaggctgagctacagcgccagacagcttaatgatttagtcggcgtaaaagccaagtagatggacgttatattttgaagccatgtcacgaagcgttgcgaatatgacctcctgttgatcgcgagttccggaaacttcaatataaaacgaatattcacctaattgggttttagtcggtaatgacattaaggtaatgaggttgagatcggctttagcaaagtatcccaaaatatcgtaaagtgttcccggtttatcatttgacgaaggcctgataaagagcggagccttaaaatgattggttgtgagcgtcaggcgtgaaaggtcatccaattttgcaggctttgctttaaaaatgataaatcgcgtgctgttatcatcctgatcagcaacgttttccaacatgaaaggtgcggattgatccgccatctgtgattgaggaataatcgcggcatcacccttttcaccacttaaaaatttctctaaagaaatcatattggatgaggttgtgatgatttggatgccgggcattcttgatagcagtttttgacactggccttccgttttaaattgaacatatagccgcttaatatgagttaagctatcagcgtttgctactaatccaaagttcaccggaatagtcatttcaccgatttccgtaacgtcggcgatttgtaaacgttgaagagttgcggacacataaccgtcaagctggttttctaatggcaataaaccgatattttcgccagttactgcttgatatacctgatcaaaagtggggtgatagtcaaagataacgttggtatatggctgggtttttaaataagcttttgcggctgcatcggcaaaagttccttcaggaccaagaactgaaagtttcatattttttctcctttataaatgattgttagttgattaatacttattgtactttcttaaaattatctcataaatgatatgggttatgatgactaaaaatgaaattagaaatatttctttgataagctattccgtcatgtcgcgcgagtaacttgttgaaggaattttttcttttttaaagttaagcaaaacaaggttgattatttcggaaagttgttataataagtaactattaattccaaattggtttttgttcaagatgagaaccaatgtacttaagaggttataatttattcatgaaaagatcaattgttagaccattgttaattccattaacggcagttactgccggtagtttcttactcagttatcatttgtttaagtttgcgtttgagcgtgttgatcacgttccaccaacttccaaggagaaacaaaagtacgctgatgcttattacgactacgttgattggatgaaaaatgtgccttcaaaaacctggatactaaatgcaaattcaccggagaacaaggtggtggccagttttattcctgcggacaaaccgtcaaaaaaaacggttatcattgctcacggctataaaggaaatcgtgaaacaatggcaaactatgtcaaaatgtttcatgaaatgggatttaacgcgttggttccggatgatcgcggacatggtgaaagttccggagaatatattaatttcggctggctggatcgtttggattacttgcggtggattaagcgagtgatcggttatgttggtgaggacagtcgtatactgctctttggcgttagcatgggtggggcaacggtagaaatgatttctggtgagaacttaccctcacaggtaaaagcactaattgctgattgtggctattcaagtatccgagaagaactaacctatttgttaaagcaacagttccatttacctgaatacccggttgaaccgttggtaagccagattaatcaccatgttcttggcttttcattagacaaagtatcgtcaacgcatcaacttgctaaaaataaattacctattttgtttattcacggtggtcgtgatacgtatgtacctgtaggaatggcttatgaaaattatcaggcaactaaagcgccgaagcaattatggatcgttaagaacgcgacccacgcagagagcttttggtacaacccggaagcttatagagatcgtgtgatgacatttttgaagacgtattttagatgatttaaatcggctaactagataatttaagattaggttcagttagaaatgacaaaagtcggcttctgactggatctttttcattgtaatcaggaatgaaggctgaagcaataataatttcactcagtcttttttgtatccttacggttattatcaagcaaaaatgtgaaaaaaaagcaacttcctgctatgcaaccggattatccccaattgtgctttggaagttaactgttttttctctttttttaaaacaaatttgctatagttttcaatgcactaaagaatatggcaacagcatacgaagcaatggcactaaacgacatccatactcatctccatcctatctgggcactattaaaataacttcgaaccaatatcatattacctcgattttagggccttatgccttatgaatgtgataaataatataagcgaattactttgacgcataattgtcatgttgtatattgagtgtggaaggtctgaggaggctttgaatatgaaaaaaattgcaacttttgtaacggcactttcgttggcactaccattcgcatttgcagccgcaccacttgctgctaatgcctcggtaacatcgtctcaaacagttgctgcgaaaacagctggtacgacatatacgatgacaaagaagggtgcaactttctttaagaaggcaaaattctatcacactaaggataagtcacctgtttattataaaggggcgtttgcagctgacagtgcaacctttaccatgactaaatacagtacacttaattcagcaaagacttataaggtaacgcgttctgttacaggaatcgccaagaagacccacaagactcaaacatttctttatgtaaagggatatggttgggtgaagtcttatagtttaacaaagggtatttttaagcaagcagactaaaatgctgaattggtaggcatcttttatcaatctgctaattagaaatgataagatttagatcaggaagacggatttgttttcttgatctttttaagttgaaattttttgttttaaaccctttacttactaaaagtaactggtataatgttcttatacacattaactatttatcgactataacaattaataagggagtttaactttaccatgaaagaacaattactgaaccttgccaagaaccgtcgctcaatctatgcattaggacgtaacgttgaccaaacacctgatgaaattgcaaacttgattaaggagaatatcaagtgggcaccaacaccatttaataatcaaacgacccgtgccgtgatcttattcggtgacaatcatgaaaagctttgggacatcgttgccaatcgtttgaagtccgaggtaccgactgaggaagcctaccaaaagactttgaacaagattaacgggtttaaagctgctttcggaactgtgctcttttataccgatacggatgttgttcaccggtttgaaaatgattttgctttatacgctgacaacttcgctgattggtcggaacaagctcaaggaaatgctcagttctctgtatggacatcgcttgctgaaaacggtattggtgccaacctgcaacattacaacccactcattgacgatcaggttaaggaagcctttggtattccagacagttggaacctccgtgctcagttagatttcggttccatcgaaggtcctgctggtgaaaaagaatttatgaatgatgacgatcgttttaaggttcttaaataattaacgaattagtatagtttaagatacatccttcaaagaagaggctgggtcaaagatcatttttgattcagtcttttttgctgtcttcatattttggtctacgatattggagcgtcaatcaattcaaaagactgcaaatgagctattctatacttagtttggaggaaacggttatgaaatcaaaggaagtcagcaattttgagctattttatgatttgatttttgcttacgctatcagcaggattaccagtgttttacatattattaacagtgaaagaattccggttttggatgttgctgagtttttaatgatgatgctggttttttggacgatttggacgtatcaaacagtgtttgcaaatcgcttttatcacactaatttgagtcatgttgtctttttagttttcaatatgttttgggttgtcatactttctcaatctattaatacaaattttgagcaaacacatgctaccttcgcaggtgcaacgtctgttctttttatgagcttggcagttcaatatttaattcaagcaaagagaaataaatcccaagaagtgcgtcatctgtgcattcaattaggatcactgttaacatcaatcgcagtgattggcgcgcttacaatgattcaatgggggaattatggtttgcggttttcgatttatgccatcactatttttatggcggcgtttgtgccaatcggcatgaaaaaaacgttgcggcattttccaacccattttgatcatcttacagagcgttacaacttgtttacgatcattttgtttggagaatcaattatcagtgttgcaggaacgattgatagtctcaacgttcacattgatagcttgctgttctttatcatcattgcactgttattttcaatttatatcctaacatacgatctcggtattaatcgacatttaataacagctggtctcgtattgatccatgcacattactttgttttcgtcggtattgaattaataacggcatcgttagagttgttcatgaatcaagaactaacgcaaacctactttatttggttgttaattattggcttgttcttttttttggttcctgaaagtgttgttttgtttgtctatggtcaaaaaggtcggcgatctgccggcaacgtgttttttattttagcaggattctttgttttgctggggattattgctaacttcaaggttgaaatatcgatgatatatggcttgatagcattatcaatattggtcctttgttatctttggtggcgggtattgcttaggggacaacgctattaatcatttaatgataaagtcgatttaggcttggccaggttaaacaaaaaagctcgggaatttgcccgaactttttgtaaaaagaattaaattttattcaacaccattgatcacgtacttaggcttgtcacccttgtccatagcgaccgtgttctttgcaacaatttcagccatagcatcacgggcttcgacagtggcattaccgatatgtggtgtcaaaacaacatttttaagtgacttaaagccatcatcgacatgcggttctttttcgtaaacatccaaaccagcaccggcaatttcatggttaaccaatgcatcgtaaagtgccgcttcatcgataattgggcctcgagcagcgttaatgagcatggcactgtttttcatttgcttgaactgttcggcaccgatcatgtgatgggttttaggagtagccggtaaatgaagtgtaatgatgtcggcattcttaataatatcatccgttgtggtgaacttggcacccagagttttttcggtttcgggatccaattgatgacgttgtgtataaagaatatccatgtcgaatgcatgcatacgttttgcaacggcttgaccgatttgccccattccgataatacctaatgtcttatgggcaagttcgtggcctaagaagaatagtggagcccagccgctgaacccttcgtggcgcatcaacgtgtcgccttccatcattctgtgagatagtgcaatcattaatccgcaggttacttcagctgtcgaaacagtcgaaacttttggtgtgttcgtaactgggattccttttgattttgcataatcgacatctatgttattgaacccggcgccatagttggcaatcagttttaaatttggtgctttatcaataacgtctgagtcaacttgagttgaaagtggtgtgatcaggaaatctttgtcagtgattcgtttactgagttcgtcctttgtgatcaaagatttactatcatcgtacacgtcgatgtccaatccagcatctttcaaaatgtttaatgcatgttctggaatccttccagcgattaatacctttgacatatgctcacgtccttatataaatttgtttgtacaactctattataggagcaatgttcaagaaatgaaatcgctttcggagctaaaacccggttcttttttgttcaaaatgactaatgcaagtgacaatgtgttaaattgatgttgattgggaggcatatttctttttttagttatagggtaaaatagtcaacaccaaattaaatagatgtaaattgtcatttaacgccgatttattaaaaatccagtcgtttttggaaataatcattacaaaacaagttgacatttgcatgaaaggttactattataagaaccaataaattataaaacgctgcgagaaagttgagtaacactttcgaaaccttaagcgagctttagttggtgagagaaagcaggcaagaacgtgtgaaaatcccttttgagcgatgcatcgaatttgtgaaagtaacgtgcattggtaacacccattaacgtgttagcgtatcgcttcttcaaggccgtacgtgagagaggcagaattagcaataattttgcaaaataaggtggtacagtgccgtaagcgcccttagttcagtgaatactgaatgaggggcgcttttttgcgttgagtaatttatttaataatttaaaaggggagtggttgtcttgaaatctcagattgacattggtcagattaggttgcagttaaaaattgtattaataagggagtctattgggcatgaaagatttacaagatttaaatccaaatccgttaactaaaaaagaatattttgttgtgagttcaatgttgttcggcttgttctttggtgcaggaaatttaatttttccaattcatttaggccaattagcaggttcccactgggtgttggcaacagttggcttcttggtaacggcagtcttgttaccgcttttgtcagtgctggccgttagtgttacccgatcagaaggcgtttatgatatcggggtaccgcttggttcggtttttgcgcttgtctttatggtattaattcatttaacgattgggccgctgtttggaacccctcgtactgcaacggtaccctttacagtcggtgttcagccaatgttgccggcctcgtgggcccacgttgggttgtttgttttttcggttcttttctttggagctgcttttctggtttcttatcatcagtccaacgtgatgaattcggttggtaaacttttaaatccactatttcttttgctattattttcagtatttttaatggggctgttcatcctatgggttctgcctcacaccaggcagccacggctgcttatcaacatgccggcttttttaatggctttcttcagggttataacacaatggacgcgctagctggtttagcttttggggtaacggttgtaacggctgttcgtcaattgggcaagacccggccaagcagtaatgcaaaggtaacagcaaaggcaggggtgtttgcgacatcaatgattggttttatctatgttgttctaatttggttaggtgccacaaccttggctaattataaagtatccgcagacggtggtgttgcttttaatcaactagttacttattaccttggcggtattggtcacgcacttttggcaacgttgattacggttacttgtttgacgacagctgttgggttggtggctgcctttgcacaagatttccataaacattttccaaaggtcagctaccatacttggctggcactaacatgttttgcatcattctttaccgctaacttcggccttgatcaaatcattctctggtcaacgccaatgctgatgttcttatatcctttcgcaatggtcttgattttgctatcagtcttttcgccattctttaatcgcgatccattagtgtatgcgttggttgttggtttcacaacagttccggcactattggacatggttgctgcatttccgccagttgttagtcaaagtgcatttggccaaacattgggtgccttccaacataatgtcttaccatttgcaagccttggaatggactgggtagcaccagcagttgtcggtgcggttctcggtttgggtttgcacttcttgagaccggtttttgcccgaagcggtcaaactacatctgagcatgtgtcaaaataatagtaaatatctcatctaaaaaatgcctggtatataatttatatatcaggtattttgatatgagtaataaagtgcttttattcaaccttcttagctttcgaagcttgttttaaatttagtgcagatggggggactttaatgaattggtggaagatgaccagcattctttggttggtcctttttatagttggagccgcttttctttggttaaggaaaaccgatgcgacaggagcaatcaatacaccggcttatcagatgacatcgctggcaatttggtgtgtgctgtttgggtttatattaattatccagttgatatggtttgtgatcatgcgcgttaggcatcgaaaatgatactaagttaactaaacaaaagagcttccaacatccttaaatgatgttgaaaactcttttttgacgtactcaatgagaattattgaagcggtgtaaaagcaccatcttcaaatagatcttggacgaatccaggaacagtatcagttctgttccagtcacgttggtactcacaaattaattgtggaattgtaatgagatgggcaccagcttgttctactcgacgtaaggcagtttcatgagacagaggtgatgtgccgccgaccgcgtcaacaaccgggtaaacgtcgtatccttccgcaagcgcatcaatcgttgggaatgtgagacatgcttcagtccaaagaccaagcataataatctttttacgtttcgttgctttaatagcgtcgttataatctttatcttcccaagcattgatggatgttcggtcatatgacggaacgtccccaattgccttttttaatggtgagatggtatcttgattcctacctgtatgaacgttaacggttgagagaacgatgggaactttatattggttggcgatcttggcaactaaaacggcattgtgaacaagatcggcatgtttcattgacccaattgaattgatttgagttgattgataatcaataaaggtaattaatgaattttctggtgaaagtaggcggtcatcagcaccgcgttttggaaaacttgtcataaattaaaacctcccctagagttaaatcaatattactgaatccggttacataatacacctgaaaattgtaagcaaccattatttgcactcaaaacctcatttcttaaaaagcagttataaagctttgttatagttgcttgcaaggggcgcagagaatgattagcatagagtttgaatacaaaattgtaagtaaagtggcgacgttagtagtgaagaaacaaattaacagtctttttttaacggttttaactgttcttatcatgttgataatagttaatgtagctgcaaatgcagcttcagttaaccattacatttctgcacatcattattcgccatctacaattaccaaacaaatttggaagggattcccccattataagtaccgccatggtaaaggtaagccagaaggcgttgttgttcatgagaccggcaatccaaactccacgatttttgatgaaattgcgtatatgaagaagaattatcgaaatgcgtttgttcattcatttgtagatgacgatcatattattaatattgccaatacagactacctatgctggggtgttggttatcctggaaatgccaggtttattcagtttgagcaaattgagatgcacagtaaaaagagttttgcacatgaggtggaaaatgcagcatattatacagcttatttacttgatgaatataacttgaagcctaacgatgctgtttacgacggcaagggaacagtttggtcgcacggttcagttgccaaatacatgggtggttccgatcatacagatccggttggctattataaaaaagcaggtaagaagtattttcataaagcttatacgatgagtcaattttatcaacttgttttgacaaattataagaatatagagtgatatgaaaggatttaattcacaattatttctttgataaggggactgaagttacttgaaatcatgaaaagttttcaaattcatgtttacaagtaactttttttatattatcatcgtaagggtaatcgttactatttaaaaaacggaagaggtagacaaatgtttcgaaaaatattaagattcaaattcgtgttacttgcattcttaattgtaacgcttggcatagttgctgcgggttgttcaagtcattcatcaagcagcaatggtaaaatcaaaattaccgcaaccacggacttttacggtgaagttgccaaagcggttgccggtaataaaggcgaggtgacatccgttatcactaatcccaatattgatccccatgactatgagccaacaaccaaggtagcaaaaaacattgttgggtcaaagatggtaattgctaatggaattggttatgacggttggatgaataaattggtttccagtaacaaaaaaaccgactacataaaggttggcgaggatttaatgggtaaaaaagacggggacaatcctcacctttggtataatcccaaaacgatgccaaaattagcaaatacgattgcaactaagttgggaaagattcaacctaaaaataaacaatattttaagaaaaatgctcagaagtatatcgcatctcttaaaccggttgagaaaaagattacccagttaaaacaagtttctgccaagagtaagaacaaggatgtttatgtcagcgaaccggtctttgattacgcacttgacgcaatgggctttaaagttggcgattctcaatttgaaaatgatactgaaaaggatgtagatccatcaccaaagacgattaaggcaatgcaagacggtatcaaaggacgtcagattgcattctttgtttataactctcaagttgatgataaaacggtcaacaacttggttgcacttgctcataagaataaagttcctgtattgaaagtaactgaaacgttaccggcaaataagaattataaatcttggatgctaagtcaatataatagtttgctgaaaattttagaaaaataaatgcaggttgataaaatagagtgaagaaaaggcgtatcagttaggcaataggtattaatcaaaacgggtcgaagcaatttttgcttcgacccgttttaattaaaataaagaattgaaaataacctttttagtcatttaaataataactgttattaagttgactgacatctaatttacctgcctgaccggcaaatttaaagttggatgtccattgccaagcattggcagcaacatatttctttcctgttggattatttggatagttggcaagccacccgagattagcggtgttcatgctgacataactatcaacccaattagcgttggtataaatatcggttttgctgaaaccggcagctttaacgaccttgttaaatgccttgatatttcgatcattggttgcaattgaaagatgagctagtttgggagcctcaaaatcaacggccatgacgacatttcgctgactggttaccccttttactttttttacaaagtattttgcctcttttttagcttggctcttggtagcgaattgagcataatgataaaaattaatgcttaagcccgatgattgggctgtggcagtttgctgacccagtaatggattggtgtaaaaagtgccttccgttgctttaattgtcatggcctgtacgccggaatccttcatattttgaaggccaaggtttgtttgagccccttgataagccgagatgtcaaccatatcagcgtttgggtgatttgacgaaaaagtgttggcctggacggataagctggcattaccagcaaatagtgcaccaaaagtagctagtgccaaagcggcaagttttagggaatttgattttttcatttaaattgtactcctgtgattggattctaagttgtcggtaatgataatatagtccgaatcgtatcacaatagttgtctttttaaaaatagctcttatgtagcctttctcaatagtggcgcggataaaagcatttatttacagtcatacaacaatcaggtaacaggctgtaatatctaaaaaaatgagactggaacaaaattaaattttgtccaacctcattttgggtttctatagattatttattcaaataaccgcgccaaatccagccaccatgctggccgtctgcactcttaacgtgataataaatagcgtaatgtccggaattcttcatatataacttttcatgggcgtcggtgtaccaagtgatgtcgggcatatccgaattgtaaccgtaacgcatgccaagatgcttggagtaacgggcaccatccgttgttttgtaggcatgacggcccatattgctccgccatactagtttaacggatttggaacggctggctgaatactgtttgccggatggtcccggtactttaacaatttcacccggtgttgatgatgttgaaccgctcgttgtcgaacttgacgagctggaaattgaacttgatgaacttgataaactcgatgaacttgatgaactgctggagccggttgttggcgtcgacgtatcagttgttgagccagctgttgaattcaagtaaaaatcgttgttcatttggctgacatccatgttttgattaattgacgggaatcgataatcggatgcccattgccatgcgttggcagaagtatatttactgccggttgggttatttggatagtctgcaatccaaccattattggaagtgttcgtatcaatgtgtacacccaaccaacttgccattgtgtataggtcggttttattatagccggcctggttaagtgttgcatcaaaggcggccaggttggcatcgttttgcgatttggaaacgcctgctaattctgatgattcaaaatcggcaaccatgacgacgtctttggagttggtaacaagttgaactgctttaataaagttttgagcttcactttgagcctgatcggttgaggtgaagtggacaaaatggtagaagttgacactcaggcctgcctgttgtgcatattgaacctgttgtgacaggtagggattcgtatagtaggtaccttcggttgctttaattgtcacggccttaacaccgttgccagccattgtttggtaatcagcggcagttaggtttccctgccagctggaaacatcgaccatatcggtttttggtaaagtacttgatggggacaaagcagcgtttgctgttacagaggttcccaacaagattcctccggcaatcattccaaggattgccaatttggtttttttatgattaaatgtcatctgattctcaacccctcatattcgttgtgttcacttgcgatactaacatgaatacggggttaacaaaagcgaattcacttgttgttacttctttttcgatcaagtgaaaaactccagtaaattgctagtaatataacggctgcaaatgtaatagttgttacattgtttggcaacgtgccgttatggactgcccaggcaatccaaattaaaatgatttggaaaaaccaagagataattgattgaccggcaaatttttttgtgaagatatgcattgtaaattcctcctaagaatttttgtgttgtaatggaaagtatgatcgtttgggacttattcagggatgtcaccattttcaggaatgtaatcgatagaatccgcaattcgttttggaattggaatttgaggatcaacgtgtggattattgaggtgaattaagttatatgatttcctgtattcactgggggataatcctgttgagcttttgaaacgtctcataaatacttttggatcattaaaatatgaattataggcaacctgtttaaccggcatttctgttcggattagaagcaaggtagcaacttctattttaatgtggttaaggtactgaagtgtggtcatacctgtacaatgtttaaagagtcgggttaaataatccgcgtttaaactgacattatcggcaatttcctcaaccgttaacgtactggacatatttgcccggatccattctttgattgaattaattcgcgagctttcttcatttgaatccggatgattaaagtaagatttatagagctgaattaaaagagctgacactagataatcccgttcttcaataaatgaaagttcgttatgaattgataaaatctggtgaattaaaatggtggcttcttcgtagtcggacaacttgaattgcatcggtaagaaaatctttcgcttggactgtttgtttgtcttgatctcagaaatcatttggtcttcttcggattcaaaaatgtcttcccggtattgagagaaaaagtgtaaccagtaaaaatcaacgtcattctttgaatcttgatagccgtacattgtggtgaatggtggaacaaacaagacttcatggtcattcaaagtgacacgacgatctccgatttgtaaataaatgggccctttaatacatagtattaattcgtaatctcctttgtgatacatcctgcggtgcttccacggcccgtgcgcaagaaattcgccacccttataatagagaagtgtttttgcgatattaaatgtagagaacaacatttctatagcctccgttctatgtcggaaatgatcaccataagtacataaatttgttcaaaaaaagattaaatcaatgaatgtcggaaatcgtcaccaaaagtatcaaacttgatacaaagccctttgtgaagtgctatttcaaccgaataaaaatgacaactagtcggaaaccatcacttcttttgctattatagacctttttttcttccttgcaaacgcttactatagaaatcgtaaatgagatacaaataaatattcggagacaaaggtctgaagatatttattactcgcgagttgtatcgacttttcatttatcgattttgtgcaataaattcccaaatattgtaagcgtttgtatttataactaattggaggtcagaatcatgagttcaaatgcaagtcatgtagattcaaatacggccagtgcgcaggcactcttggccaatgacacattgccatggcacagaaaaattacctatggctttacggatatgtctggtaacttgctttactgtattatcagttcatacatgctttacttcttcaccaacgtctttggtttgacggttggaacagccggtgtcttactgttgatcggtcgtatctttgatgcgattggcgcaccggtcatgggaattttggttgaccacacccatagtaaatatggtaagagtcgcccatggttcctctggatgtccttaccattcgctgtctttgtttggttactgttcactacccccgctttgagcggcacggctaagatcatttacgccggggtaatgtatatcctggctgacttgtcttataccgcaatgtcaaccccaattacctccgttctgcctaacttgacttcaagtaccgacggccgaatgcaagccaactcagttcgtttggttcttgggaacgttggtaacttcttcgccgttacgttcatcattccattcgccggtctcttaggcaatggtaaccaacaacgtggctggtcattagcagttggtatttactcaatcgttgctttgattttgctcttaattgccttcttcgatatgcgtgaaaagaatatcgaatctgaaaaagtgattacgattaaagaaagtttgaaagccactaagggtaactggccttgggttctgatcgtcgttgccaacttggcttactggaccgcctttatcgttcgtaacgcttcgatgccttactacttccagtacaacatggggagcaccggtttaatttcattcttcaacggctttaccattatccaggttatcggtatggcttcggtaccattttttgttaagtacatgcacaagtggggcacgaccgtcttcatgctggctttgaccatggttggtcaagcttggatcggttttgccggtgccaacaccacgtccgctttaatcggctggtgtattgcatgtatcggttccggttctgcctgcaccatgttctttgccatggttggtgacacggttgacttcggtgaatggaagaccggcgttcgtgccaacggtttcttaacggccattggtgcttcattctgtatccaaatgggttccggcttcggttcatttatcgcttccatgttgttgaaaggctttggctttaacgctgctgttaagacccaaactgcttcaagtctttcaggtatcagctttaccttcgtttgggttccggttatcatttacgccatcagtttgattttgatgattgtttaccgtaagtgggaaaatcatgaaccagttgttaaagccgacttggcagaacgtcatgcgcaagatgccaaggctgccacagccaactaagcagttggttgaatcaccatgcctttaatcagtttatttaatcgatttatctaaacagctaattactaactaatcactgtattttcgagaggaaggtccatttatgcaagtctataccacgccgaagttaaataaagtcaaggtgacatccgacttttggaaacgctatcgggagctcgtcgttaaagaagtcttaccttaccaatggaaagttatgaacgacgaagccgacatttcgattgccgaagatccacaaaacaacggtcaggacaagaacagtcacgccgttgccaatttgaagattgccgccggtgaaatgaccggccatcactatggcttcccattccaggacacggatgtctacaagtggttggaagccgctgcctattcgtttggctaccatcccaacccggatttaaagcagattaccgacaacctgattgatttgattgccaaggctcaagatgatgacggctatctgtcaacctatttccaaattgatgccccggaacgtaaattcaagcgtctccaacagtcgcatgaattatatacaatgggtcattacattgaagccggtgtggcttattacaacgccaccggtaatgaaaaagctttggacattgctaaacgcatggccaactgtatcgataaccactttggccttgaagaaggcaaaatccccggctatgatggtcatcccgaaattgaattggctttgtcacggttgtatgaagtcacccaggacaagaagtatcttgacttggcccactacttcctcacccaacggggtcaggatccggccttctttgaaaagcagatcaaggccgatggcgacagcactgaccgtgatttaattcccggcatgcgtgactttacccgtgaatattacttggccgcagaacccattaaggaccaaaaggtccctcatggtcacgcggttcgggtggtctacctttgcaccggcatggcctacgttgctcgttatacaggtgataaagatttactggctgcctgtgatcgcttctggaacgatattgttaagcgccagatgtacatcaccggtaacattggccaaaccaccactggtgaagccttcacgtatgattatgatttacccaacgatacggattacggtgaaacctgtgcctcagtcggcatgtccttctttgcccgtcaaatgttgaacatccatgccaagggcgagtacgccgatgtgctggaaaaggaactcttcaacggcgctttaagtgggatgtcattggatggcaagcacttcttctacgttaacccgttggaagccgatccggctgccagcaagggtaaccccggcaagtcccatgtcttgacgcatcgggctgactggtttggttgcgcctgctgcccggccaacctggcgcgtctgattgcttcggttgatgaatatctctataccgaaaagggtgacaccattttgtcccatcaattcatcgccaacgatgccgaattcgatgacggcatccaggtttcccaaaccaaccacttcccatggagcggtgatatccactacgagattcaaaattccaaccaggccgcctttaagtttggcattcggattcccagctggtctgccagttacgaattaaacgtggatggtgctgccaagaccttaccggttaaggatggtttcatttatctcgatgttgacggccagtcattaaccattgatctcaagttggacatgagtaccaagattatgcgggccaacaaccgggtcagccatgacttcggcaaggttgccgttcaacgtggtccggtggtttacgccgctgaacaagccgacaaccaagcaccgctttggttataccaggtttcaccggatgcccagacagactatcactttgatgagaagttattggacggcgttggggtcatcaaggtggctgccaaacgtgagaagcttaatgccgacgatgctgatctgtataccgaagctaaaccggcggatacggaaacggttgacctgaccatggtgccatactatgcctgggctaaccgtcaggacggccaaatgagggtttggttgaatagataagtttattcaattaatgatgatgacttttaacgaaggagaattggaaccgagttctggttctccttttgtttgaaagaagatgtaagcgcactctagcggaatgattgctgtatggaataagctcgatttaaaaatatcgaaagtaattgaaacttatttcaccccatgttacactatccgagttatcgaaatgaataggtaaacgttatttctgacatagcgttaatcgaaaccccattcgatactattcgtgataataatgcgccccggtagttgttatttatatgacaattaccggggcctttttggctctgaaagtgattgcagaaaaatgtaagtcattatgaaaacatatagaaacaccctaatgtacatattttgaaaatgttttgtaataatccttaattgactttcataatcgtttatactattgatgagattgcgaagaggtgagagaccttcgcggaattgattggaggaattgatatatgaaaagtcgatcaggattgatggcattttcgattttaatgctgtcgctattgcctatgtctacaggtgccagtgctgcgacaattcccggtttaatgaagcagtttccgggcttagcgattgaaacagcagaactaacggtaactattccgtcatttacaatggctttgttaatcgttattagcagttttttagtaaaacgaattggtacaaagaaaatagtcatttctggaaccgcaataacagcgattggcgctattatgtcaatgctttcaccaaacatgactgttttgctgattgcccgcgcgttaatgggtgcaggaattggtctgttcaatacactttgcattagtttaatcgacctgctttatcatggtcagcaacgtgaaaggctacttggttttcaaaatacgtttcagggacttggcgcagccggtggggccttaattgttggaatcattttaatatattcaaaatggaatgtggcatttgcattttatctgattgcaatcccaatattaattttatatctattatttgtgccagaggttcgttatgataatgcacaatttgatactattgaaggtcaagacaggctatctaaatttgctaaacttcagttcggttactattgggttgttttgtttatggtgatggttttctatatgaccgttaatgttaagattccaagttatattttgaataatcattttggatccttatcaattggctccagcgcggttgtcatcatgtccgtcggaacaatcgttggcggtatgatttatggcaatattgaaatggtttttagaaaattgacattatttctggctgtcctaattgaagctgtcagtgtcattgtgatcagtacggcaaccaatgccattgcttgttttgtgggtggttttggagtgggattcgcatttggcttgtttatcccctttatcttttcgaagggactttcacttgtccccaaaaggtacggtaatgatgcgacaaccgtattaatgattgcaacaaacggtgccaattttttaagtccatatattagtaaagcaattaattttggtgggactgatcaaagcttatttatgatttccggcgttattgctgcaggaatttctataattgaactaattaaatcattaagtgcggaccactttagaatttccagtcaaagggtttaatggaagggatcttttggtgcgaggatagagtcagctctcatatctgaattgggtcatactgacggggattagatgatagactaaataattttctatttttaagtaaaaactacttgtattttagtaaaatgtaaggtatcctttatttgttgaagcgctttcaaaaaatttaatgaggtgactttactttgaagcgaaaattatttaatgagcaaattaaggataatccattacgtagtaaggccgatgtcaaggctgcattgacagatattttggcgccggcaatgactgtattggcacagcaaaagcaaaaaggccgtttcagaatgagtgatagcggtgcagtttacattcaagaaaagacagaaattgaagggtttatgcgtctcctgtggggattgggaccattttttagtgataaaaagcgaatctacgagtatccgcaatggtacgaattggtcactcaaggtatcttggcaggtgtcgatcccaaagatcctgattattggggtggcgatttaggagactatgaccagttgttcgttgaaatgggcgctttaaccgccttcctatacgaaaccaaggagactttttgggagtcactttcccatcaaaagcaacagcaaattgttgattggatggaccaggtaaatcataaagtgattcctaagaccaattggctattcttccgagcaatggtcaacaagtttattacagattccggttatcacgacaattcgacattaattgcagatgattacgccattactaatcaacattatcttggtcatggttggtcgtatgatggttacaagaatcaaattgacaattatattcccttcgcttaccagttctttacaattttgacggttggcttggctgattggaaaggcgaccaggcagagctgcttcgtaaacgagccactgcttttgtgccaagttatgctaactggtttgcggctgatggtgctgcattaccatatggacgaagcttagattatcggtttgctcaagctgctttttgggcagcgagtgcctatgcccatattgaccttccggagggttatacattgggtgatattaagcatttattactgaataaccttcgctggtggtttaaacagaatatctttacaactgacggtttgattccaattggctattcatatcccaacatggtctttgcggagggctataatgggcctgcatcggcatattgggcacttaaaacgtttattttctttgcattacctgatgatgatccattctggacgactcccgaaaacgatgaatttaaatttgaaccggttaaaaagcagcctgaaccacgaatgttggtttgccacagcaagcatggactggaagttcagtcatttacggctggacaacattctcatgaacatgcaaatggtgaagcaaaatatgaaaaatatgtttactcaacaacatttggcttcagtacgccaaagggttctgttcttcttaaacaaggggcttttgataatactttagccgttgctgaatcagaagattggtggcagactgcctttaagtatgaggattatgcgattcatgatgactatgtttattcggattggaagccatgggacgatgttgaaattaaaaattatgttgtaccggctatgccttggcatgttcgaatccatcagattgataccaatcgtcagattcacgttgctgaaggaagcttttcggcaccggattatggaaagtcttatcaaaaacaattgccaacaaaggtagaaaacgccattttctatcaaacggaggtagggattaccggtattgtgggtctttccaaagaattgacggctgagttatctgagccggaaccaaataccaacatttattttcctaagacaaagattccactgcagacaggtgttttaaaccctggaaaatacacactggtatcgctttatttaggagaccgagaacttgacagcttggatgataatggtcaattagtgattcctaaagtaaaacttaataataacaaagtatcgattatttttaaggatcatactgtcagtgttgaattgaaagaattctaatataaatcttcatttttaaggaggggcttggacaaaaaatatttcgtccagtctctttttttgttgatttatggaggctaacttggccgtttattgtttatttgttaatttttacccaaaaaatgatgagccttagtccttatcgtttatcaaaccttcgggtagtggtaaactaaaacagtatattatgatgaaagtaagttgaactgaacctagtaaaatttacgcaaaaaatcttaaaatttagtacgttaataggtgatagtaatgacaacgattaaagatgttgcgaatgaggccggcgtttcaatctctacggtttcgcggatcttaaactttgatgataccttatccgttggggaagatacacggcgacgggtcttagaagttgcagaaaaactacagtacaaaaaacgtaacaagcgggcgcctaaattaggaaagcaaattgcaattgttcaatggcatactgataaagaggaactttccgatctatattatcttcaaattcagtatggaattgaaaataaagcagctagtttgggtgcttctatcgagcgggttacatatgagtcaatcgataagaatcggattaagaactttgacggcattattgccattgggaagtttgatactaccgaagtcacccaattgaagtcttatgggttgccggttatttgtattggagagaactaccttggatataatttagattgtattcgtagtgatttcgaaacgccggttagaaagattattgatcggtttattcgaaatgggattgatgatattggtatgattgccggtaaggaacttaccgtcactgaaaaacaaggcgtccgtgatccccgagtggcaacctttaatcaatatttaaagagtaaagggctttataatgataaatttgtttatcaaggcccatttggaccggaatccggttttaatttaatgactaaagctattaatgaacttggagaggcactgccccatggattcatggttgggagcgattcaatggccgttggtgtactccgcgctttgcagcagcatcatatcgatgtaccaaatcgcgtaagcttgatcagctttaatgatgtggcaatcgctaaatataccagtccggcactgacaactgttcatgtgcatactgaattgatgggtgaacgagcaattgaaatgttattggaacgggttaaaaatcccaaaaagattccggaattgattattattggaactgagttgatggaacgggaaagtagtatttaaaaataaggggatttgtttttatttcgcattttaacctgttaatgcttatgattaaaaagacgagggcaaagaatatttttgctttcgtcttttgttgttttttgaaatgaattgagtggctcgtttccagtgattagaggctaactaatcaattaatcgattaaattcgttttgtgtaataggaagtactgttccatgtcgtgcccggcttggcatatgataagcgtcagttggtaatctattgaatcggccacttgtgagatccgtcgtttccaatggataataacctcccttagcgtaattgtcgactaataaaagccactttttctttccaattaacggatagcaggtaggaccttctacgcctaaattatctgttaaagtaggtgataagatctcggtcggctttgcttccaacgagtttaactggtcttcaatgatgtatttttctgcttcgtttttagtgaatcgaaaataacggttattatttttgatgattgttgtgtcaatcgcactaaaaggacgatcaatataaattttaggagatgagaagtgcgaaaagtcggatgtgtgggcacaataaattctttgtttggcatagttatcgaccgccgttttagaagcccaataaaccaggaagtcttctgtttgtgaggcataggtagcttctggtgcccacacacatccgaaatttttaggtgccaccggaattaatttcggcgcagaccagttgattaggttggatgatttccaaactaatagtgaggtactgccgcttcgttgcgcgttgtaccaatcgttattgccgtgaatcttaagatcggttgccagaatgtagtagttgttgtttttagggtccttgatgatgaatggatctcgaatacccttagtacccaagtttgagtaaaggattgggtgattatggtttaaatcatgccaatttaaaccgtcctcacttaatgccatataaatattttcaccatcttcgtatttttcacctgcaaagtagacaaacaggtagcggttgggcaaagattcgtccatagttaaatatcccttctttaaaaaacataaagttaacgcttacaatataatttaaagataaatagtaaaaatgtcaacgattcattttgtttttagtaaattaaattaacgagataacgttattttgtttagaaatagacaatgaaaaccagtatttttaatgatttaaaattagtcagaagtcttgttgcttaagggataatgataaatccaagaaattcgaagaagaaactttactaaaaaacattgattatttttcttaaaatagtaaaattaagatgtaagaaaagaaagcgcttgcgtaaaaataatattgagaagataaagagcaacttaatggaggacttataaatatggaaaaaggactattataccccgtcatcaataactaccgctctgatgaaaaaatggatggactctggaattttaagtttgatcctgcatatgagggtgaaagcaagggatggcaaaatggttttaacgacggtgttaaaatgccagtacctgcaagctttaatgattttttcaccgacaaagacgcccgtgaatatacgggtgacttctggtattctaaaaccttttttgtgccagaatattttgaaggcagagacgtgcaaattcgttttggtgctgcgactcatcgggcagttgtctatgtaaacggacaggagatccgtagtcatgaaggtggctttttaccatttactgcagaagttacaaatgcagtcaaatttggtgaagaaaatattgtttcggttaaaattaataacgagcttcatcgggatgcattaccagcaggtgatacggcaacgttgaaaaacggtaaaaagatggctaaaccgttcttcgatttttataattattcagggttaaatcgaagtgttcatttattaaccgtaccaaaaaatggtatttatgattattcgacaagctatgaagttggggatgcagaagcaactgtgcattattctattcaagcagattccggagatgacgttaaggtcagtttaatcaatgaggacgatcaaattgtcgcaactggtgaaggcaacaccggtgatttgaaagttgatcatccaaatttgtggaatgttcgagatgcgtatctttacacaattaaatttgagttaatgaacgacggtaaaatcgttgatgagtatgcagaccaaattggattgagaaccattgagatcaaaggacatgaaatcctcgtaaaccataaatctgtttatttacgcggatttggtcgacatgaagacagtatttacgctggccgtggtttcgatttaaatgttgaacgtcgagatatgaatctaatgaaatggattggtgccaactcgtttagaagttctcattatccatatgatgagcaggtatataaatttgctgatcgtgaaggcattttggtcattgatgaggtgccggctgtcggatttaagatggctgctgcaagtttcttgggcggtttaaatcaatcattttttgatggtgattggacacacgaactatataaaaagcatcttgaccaaattatcgatatgattaagcgagataagaatcacccaagtgttcttgcatggagtctatttaatgagccggatacatccaatgaatcagctgttccgtattttgagaaactatttgcagcaactgcagacctggatccggaaaagcgaccacgcacgtttacactgaatgaagacgatacttatgagacgtcaaaatgccttaaattccccgatttttatctgttaaatcgttaccctggttggtatcataaatggggatatgaaatttccgacggcgaagcgggattgcgtgctgaacttgatgagtggcaaaaatcagatattgataaaccaattgtcttctcggaatatggtgcagatactgaaccgggtcttcacaaactgccttcaattatgtggagtgaagagtatcaaattgaattattggaaatgtttgatagggtctttgattcatatgattttatccgtggagaacagccatggaatttggctgacttccagaccgttgaaggtaatatgagggttaacggaaataaaaaaggtatcttcacacgagatcgtcagccaaaggcggctgctttctatttgaagaaacgatggactaaattaccattaaattataaagccggtaagtaaagagaagtgccaaagattttagaaaacgctgtaatctatcttgaataatctgggtggattggggcgcttttttcgaaagcgacatcaatgaatgtcgtttttgacgttcattaattgataaggaggattatcatgaacgaaactaattttattattgacggagataaattagacttaaacgctttaaatgccaatacctttaaggggtttggatatattagttgtaataactcatcacggttattactggattataaatgggagcatcgtgatagttatgatcagattttgaccatcttatttggtggtcgtcatcctctaatgagactgttaaaagttgaaatgggaattgatgccaatacatcttccggaacggaaccggcgacaatgagaagtcttgatgatgaggcaaatgtccgtcgaggagcagggtttcaattaattgccgatgcaaaaaagattcaaccggaattaaaaactgcaatcctgcggtggggagaaccgggtttcctgagaaaaaaatgggctaaagttaaaacaaataatccggataataacgtttcggaaaaagtctatgaagatatgtatcagtggtacaagaaaaccatcgtggcagcttatgaaacatatggttatctcattgattatgttgatccagatagaaatgaaacaaaacatccaatgtataactggattaagtggtttgcagatcgaatttcaaacgatcaatcagggtttccgaatgggtttccgattcagcaatatcaacagattaaaatgattgcggctgatcaaaattacgagcgggactttggcgatcaaatgattgctgataaagcacttagagttagagtacctgcagttggctttcattataatacggatgatagtcggaataagtcatttactaaattggctgatgactaccaccatgaagtttggtacagtgagggaattgccccgatgacttttggaaagtatcgcgtaaaggccagcaatggtgatggtataggcggtgttcaaagcggtctggatgttgcaaaccgattgattaaaagctatgtgaattctcgtcgaagtttgtatctgtttcagccggctgtttccgcttattatcccggtgtcaattacagtcataaggaattaattgcggccagccgtccatggtccggattctttgatgtcgataatgtcggaatgcaatgcatgaagcactttactgattttgccaaagccggttgggatgatgaaaatgcttggcggtacttaacgagtgcgtgtgacagcggtatcggtggaacggaaaacctggaccatcatacggaagctccaagctacatgactttggtatccccggataggagaaactactccgttatctttgtaaatgatagcgctcaaccgcggacttatcatttgtctataaaaaacattggcagccgggctaatcagccgctggacatatgggaaagtattggtcccgagaactcgtcggatgcttatgacagtcgaatgaaacgaattcgggaaacaattgtcccaattgatcataaagcaagcatatttgttcaaccacattcgatggtaacggcaacaacccttgatttaaaacatgatgaagatgtcatttatcaccgaattgagagccttcataatgatcaggtacttgaagacggcagcgatattttatatacagacgattttcagtatagggattatccaagcgattacctggcatcaagaggaaacacacctcgttatacagctgaccagggtggtgcgttcgaaattgttcaacgacacgggaagaatgtcttgcagcaaatgatttcggaaaaatatcgagctttggattgggagtattcttttgcaccgagtttaacagttggtgatgatcattggcgggactacgaggtagccgtttcaatgaagtttgatgatcatacatggcaaaattcaccaactggaaactatttcggaattggtttgcgggaattaaccgacgttaaagggcgattggagagtgcaccatacgtctttaaggtatcgattgatggcgcatgtcagcttattaaagaagataaggtcgttggcctggcttatgtcgatggactcgatctttccgctgaacatcagattaaattctcagcggacggcaaccatttacttgctgaatttgacgggaaaaaagtttttgatttcgtagataccgataatccaaagttcagtggtcgagtgaagttgggaagtggttattatcatacccgtatcaataagattatgattaaaaagatagctgatcatccagtaattagttatcgtttggacaatttagatgatgcgctgaactatagtggcaattggacccacgtttgcggccttggcaacacaaaatggaatcggacgctttctcacggagaggctgatggagaaaagacgcctaagttgaggttctcgtttaatggaacgggattctcattgattggacgtcaggagtcaccatccaggttaaaactgatcgttgatggtcaggtgattgattggaactatcaaccacagattggtgctgatcgaacagagaatacaaagattttggggttacaatcagagactcaccaggttgagatttcagttgaaagtggcaattatacactagatgcagtagacctcatcgactaaaatagttattaaaatacgatgtggtgtccaccgtaacaggattgatacgtgttacggtggacaccacacttttgcttaatgactggatttataggtacggatctttggtggaatataagttgtcatgaaagaatagatttcctccaatgaagatgaaaagagcaatttgtcatgatcagtttgagttaagaagtcgcttgtcaccattttatcaaacatggtttttagtgagtcgtagtaaccggcaacattataaaaaacgcatggattaggattatttcctaagcgagcccacgaaaaggcctgcgacatctcttcaagtgtcccaataccgcctggtaatgcaatacaaccatcagaaagtatcatcatttgttcttttcgttcggacatatctttgacaacggttaagtctgatagcttagccagttcgactagttccgcacccctgtcaacgagttcttgaggcataatgccatgaacccgaccaccccgcttaataacctgtttggaaattgttcccatcaggccgataccaccgccaccataaataagttcaagatgatgatcgaccagccaatttccaagtctaatggcagcctgtgtgtaaataggatcattacctgttgacgcaccacaatatactgcaacttttttcattcttaactctcttttcttttaagtgaatttaagcgataaacatattatatcctaagtgtccatttatcaaccgtcggtgtttattttgtcaggttgttttataattaattaaattcaatagtttagaggagtgatgacttggataagcgagtgaaaaaattgcaggcaacaattcaagagttgggattagacgcatttttaatcactaacgaatttagcttaaaatatttaagcggatttgatggtcttgatggtgatggctgtttagtggtcacaccaaaccaagtgacattgatcacggatgccagatatcaagaggctttggagcagtcattgcctaaagatgtcagtttggaaattacccgggattattatcaaattgcgaaaaaggttttagatgatgaagcctatcgaaaagttggttttgaaacctcggtaagttatgaattatataggacattatatcagttattcggtgatcaattagttccggaaaataatattgttgagaaacagcgggaagttaaagacgcaaatgaggtttccgttttgaaaaagtctacattgcttgcaagtgagggattctcggcccttgtgaattatgtcagagttggtttgacagagcgtcaaatttccaattggttgaataattggatgttggaaaacggcgctgaaaagccaagttttgacacaattgtagctagtggctaccgatccgcactgccacacggttcggcttccaataaaaagctgcagcgtggtgaagttgtgactgtagattttggctactatgttgatggatacacgtctgatattactaggacaattgcgctgggggatccaggggatgaactaaaaaatgtttataacattgtacatgaagctcaagaaagaatgtttaagactatcaaaccaggggctgatggacaagaagtcgatgcagccggccgcgattacattcagcaacaaggttttggtaactactataatcatggaagcgggcacggtattggattagatatccacgaggggcccaattttggtccccgttggaaatcaaatgtcatagaggaaaataatgtgatgaccgttgaaccgggaatatatcttcccggaaaaggtggtgttcggattgaagatgatttgctcattacgaaaaatggttacgagcaaatcacaacagctgatcgggatttgattattctgtaattaagattcaagttaaaataagttgacgcaatgagaattggcggtacaatataaacaatctatttatccgactgtgattgaatgagtagttggtcttcttttgtatagagagctgtctaattggtgaaagggcggtcaaaagagctaacgaatatggttcaggagtcgattgatgccgaatttttatgaggctgtcgtggttggctcattatcgcctatagttatgaaagtaactaagtgagggaatttccgtgaggaagttctaaatgagggtggtaccgcgacttgatcggccctaatataaagctaattgtagacaaaaccagcttgtggagacaggctggcttttttatttgattagttcttttggtgacagtccggatgtattttatattttataatttgttggtagtttgctatttttgaaaggaagttttttatgaagtcaagtaaacgtacaaaaggattgtctgttgaggcagtcgtcgcaaccggggtcggaattgccattgtgtttttgttaaagaggttcttgccaattccaacgggagttcctaatacaacgattgatttgggcgaggcgtttattggattcttgggagcggtatttggtccggcagtcggcgcattggttgcgttttttgcacatttatttaatgatctttcatggggtgatccttggtggacatggattgttgctgatgcaatctttggatttttgattggatttagtcgcaactttttgaagttacggactgaaccgcttaccaagaaaaagttgattcaatttaatttattacagattgttgcaaatattatttgctggggaattattgccccacttggtgatattttggtatactcacaaccagctgggaaagtgtttttacaaggagcaacggcaacaatcacagatattctgtcggttggaattgttggcacactgcttatctctgcctatgctaaaacgcaagttcagaaaaaaagactcacaaaggattaaatgatgcgtgaacaaccgattattcaattttcagatgtttcctttcaatatcaaagtcaagaggaagcaacattacacaatattaatttatctattcacaggggagaaaaggtttttattacaggaccttccggatctgggaagtcaacacttggaaacattattaacggtgtgattcctgaagaattccccggtaaattaacaggtaaaataacgattaacggccagtctcaaaaggacctggatctaaccgacctgtcttttattgtagggacggttcttcaagatccggattcgcagttcgtcggcttgacagttgcagaggatgttgcctttgccttagagaacgatgccaagcccgttgatgaactacatcaaaaagtggctgaatgggcgcagaggttaaatctggggcctttattgggaaaacatccacaagatctgtcaggcggacaaaagcaacgggtttctctagccggcgttttagtcgacaacgaaccgattctattgctcgatgaaccgcttgcaaatttagatccagcgtccggacgcgactcgatgaaactattgaattggcttgtggcacagcagaatctaacggtgattattattgaccatcgaattgaggaagttttgcaaattccgattgataggatgattgtattggcagaaggccgtgtgatcgcagatgacacaccagacgggattcttcagcagaatttattactgaagaacgggttgagggaaccgctttatgtcactgctttaaaggattcgggaattaatgttagtcaagtgacgcatttaagtgatcttaccaatcttaagctgagtcgggatgattatcataagttggtgacgtgggtcaaacaacaaaagcttcctgataaacccgtttctttgttaccaataatctcgcttaaaaatatgtcgtttgcgtatccaaatgaggcagctatttttaaagcgtttaatttaacgattaaccgaggtgaaatggtagcgctagtaggtaaaaacggtactgggaaaacaacgttgattaacttaattaccgggtttttaaagcctcaaaatggtgatttgttttttggcaaagaaaatatcagtcacgattcagttaagcagcgtgctgaccgaatcggctatgttttgcaagatcctaatcaaatgatttccaagacaatgatctatgatgaagttgcgcttggacttcaacttcgaggaatgaattcggaaactataaagaaacgggttttcgatacgttaaaaattaccgggctttatccgtatcgaaactggccgatttcggcattgagttttggacagaaaaaacgggttaccatcgcgtctgttctagtattacagcctgaggtcctaatattggatgaaccgacagccgggcaagacttggctcactattcacaaatgatgaccttcttggaagaacttaatcatagtcaaggcacaacggttatcatggtgactcatgatatgaatctaatgatggcctatgcaaataggaccattgttttggataagggcggtgttttggcagatgcatcaccagcaaaagtgttaacagacaaggatatcattgagaaagcccatctggcgcaattaagtttacaagtattggcagaaaaggcacaagtttctgatccaattgaatttgctgaaaagttcatttcatatgagaggagacaagccagtggtaaatcaacagttgtcttatgatgtcagtgggacacaaaagggtcattgggtgactcgtttaaccggaatgacaaagatcttggtattactcagtttgtctatcattggaatggttagctacgatacgtggtacttggtagcactaactatttttgccattactttttatcaatcggcacatttaaggtggcatcaggtacgggggttgttatatgctattgcggcatttaccgcacttaatttggtgctggtctatgtttttaatcctgcatatggttctcaaatatacggcaccagccatgtgctggtaggccatggctttttcgtattaacgtgggaagagttattctatctgttgaacatgctgttaaaatatgtattcatcgtgccgctaatcctagcctttttatttacgacaaacccgtctgaattggcttctggaatgaatcgtatcggtttttcatataagatcagttatgcggttgaattatcgttaagatatattcccgatgtgattagagactttaaacaaatcagtttggctcagcaggcacgtggcttggaaatgtctaggaaagccggtatgtggaaacgtttaaaacgtagtacgcaaattttaattccgctggtattttcgtcaatggataaaattgaagtcacaaccagggcgatgaaattacggcggtttggaacaaacaagcaccgaacatggtatatgacacaaaagttggccaaaatagattatctcattttgattgtaacagtggttctaattatgattggcattggtttattttgggtagatggtggcaggttctataatccgttcagataaaacgtatgcgagtccagattatgatagtaaccgaaaccttgatttcaatgttgagtaaggaagtgaccgtgcatgactgttacaatcggtatcgcaagcaaccacctgattcacccgacaaagcgttggggaaccaattatgtggattatgtgcagcgtgattttgttgatggcgttcgatgggcaaatgcagtacctctgattattccgttaacggaacccaaggatgctaaagtttacgttgaaaaagtagatggtcttttattaactggcggtcaggatgtgacttctcttctgtatggtgaagcaccactgatacaatccggtgaaacagatcgttaccgtgatgaatttgaaattgctttggtcaaggaggcggtgcgggttcacaaacctgttttaggcatttgtcgcggtcagcaagttattaacgttgcatttggtggttcactctaccaagatattcaatcacagttgggtaattctacaaaacatgagcagtacccaacctcatgggaaattccgacccattatattaatacaattgcccattcctggctaaatgatctgttaggtgatcgatttgctgtgaacagttttcaccatcaggctattcacaaattagcaaccggattaacagttattgcaacaagtgacgatgggattattgaaggtattcagtcaaatgacggtcaggtaattggtgtccagtttcatccagaaatgatgattcgttcgtatccaacgtttaggaagatctttgcgtattttgcaaaattggttgaaacagttgagtaacaataatgaatctatggttggcccttcgcttaactgtaagttcattatttttttgttgccaaattgttatataattatctagatcagatcaacaaaggagctcgtatttaatgccaagtagaccaaaagtcagtacatcggatgagtatattaaaatggcggcaccggatacccagccgattttacaaaaattacgcaccttgattcatcaagaactgccgaatgcagaagaaaagattctatataacatgcccttcttcatttttaacaataaaaaaattggaattgcggcttataaagcacatgttagtttacaaatttcggatgatttaagttcggaagtggtaaagcttgctagaaagttaggctttgaaaccggtcagaagcgtttgaatatcggtttggatcaacaagttccggaagagctggtattaaagattttacaaatgattgaagcctgatgaatgaaagggatggcgagttttgcgaaatttaaaagtcaggggcattgtacttgcggtggctggtcctttgctttggggcgtatccggaacgacagctcaagcattattcactcatgctgacgttagttcaaattggctggtatcggttcgaatgttgatttccggaatattattggtactatatggcttgttgacagaccgcaaacagaatttaatgatttggcatcattggcgggacgctttatacttactattttttagttttgttggcatggcagcttcacagtatacatactttaaagcgattgattacggaaatgccgcaacggctacgattcttcagtttctatctcctgccattatcattatctatttggcattgagtacccggagctggcccagaagaatcgatattttatcattggtaatggcactaacgggaactattttattagtgacgcatgggcaactaacgacattggcaattcctgcgagaggcttttcatgggggttactgacggcaatgagtgcaactttatatacactgttgcctcgtaaattattggggaagtatggctctataccggttgttggttggtcgatgttgattggtgggattgcctttagtatctactatcgggtttggacgcacatgcccgactttaatttagctacctatggcagaatcgggtttgtggttatttttggaacaatgtttgcctatttgttttttctgggaagtttgcagtttattaccgcaacaactgccagtgtgctcggttgctttgagccgttatcggcaacttttttatcgattgtttttctgggcgttcagtttggtattccagaaacgattggcgcaattttaattatcggaaccgtttttgtgcaatcctgggcaacgatgaagggaacgttacacgcacgggaaacctgaaagtcgggataatcgcatgtaaatgggactagacgattatgccattcgataatagttaagacgcaaaaaggagacagcatcagaactcatttgatgctgtctctttttctatcaattattgaaaagctatttttcggcacataaggccaacatttgaagaacactaccctgatagccggcaccaaattgtgataaatgaaacattaaataatagagttgatagaaaggaatacggttatctgatcccttctctaacggatattcatcattatatcctttataaaaatcggcattgaagccgccaaaaacatgggtgatacccagatcaaattctcgatcaccatagaatacagccggatcaataaatacgggatgaccatccggattgaacataaagtttcccgaccaaagatcaccgtgaagtaatgacggtattggatgataggcattcataagtcttttaaagactttgattgcccgtgcatataatacttccatttcaggtgtccacaaaccacgatctcgaattaaccgtttcaaatcttccaatcgttgatcaacaaaaaaagattcccaatcaggtcgccacgaattattcgccgtgtacgtccccattgtaaagtcctcattaaaaccatattgtttattcggacttctacgtttgtgaagtgttgcaagttgctttcccatttcgtattggtcgccggctggctggtggttgatgtaacttagtagaagataagcatcggatccaaaggtaccccagtcgagaacttttggagttaaaacggtttgcgatatcaactgcaaaccggtaacctcatgctgaaagaaatctttagaatggtttggctgaataagcaggaagtaacgggcaccatcttgatcatccagctcataagcttcgttgatatcgccaccgcctaccgctcgataattggaaacatgattgatcggtaattttttaaatagttcaggattcaacttaatccctccttgtctagctatcatgactttatgttaccacggaccaaagtctcatgctgagttaaccatattaaagttttctttgaattgttggatgaagtgcgttagagtatttgtaacaattaaatggtgtgaagggggatgcatcaatatgtttgatgaaattgggcagattatatttaacaatgaaatagttgcaaaggccagcgatttcaatatggggattgaagttgagactattcggattgattcatccggtagactaactaaggaagagtacccaaaagcgttgggaaatcaacgcaagaatcattttattaagacagatgtttatcagattcaaagtgaagtgattacaccggccgcaagaaagtctttggatgcgatgcattatttaatggcacttaatgatacgctgcgtaatgcgttggagcctaatgagttattgtggccgctaagcatgccgccgattcttcctcgggataaaaaaacaattccgattgcgaacgttgatcctgatcaacgggcatattatgaacgttggattaatactcgaagcgatacacaaggcatcccagttggtgttcatttaaatgttagtgtcaatgagacagttttaaaaacagtttgggaagccgaaaaagataagtttgattcctatccagaatttgttaactatatgtatattaaaattgcacaggggttcgtttactaccgttggttgattacatatttgtttgggaatagtccgattgcggaaaagaacttctttaaagctgaagatgatcaaccagcacatgctgttcgaagcattcgttcttcaaattatggtttaacttctgatattaaaaaagattatagatctgtggcagattatgtgcataatatcgagtctcacattgaagatgggactttgtttagcgaagccgaatatcatgcaagtgtgaggttgaaaacggttcatggagatttgacgaagatggttaagaacggtgttgattacatcgagttgagaatgctggatctggatccgacaactgcactaagcatccgaacaacaactatcaggttctttcgaattatgctgagctatttcatgatgacaccgccaatggaggaatcggataaggttaatttgaagcttgcccagggaatctcaatgaacgaggtagtggcacttgagagcccgtaccagcaaacgatttatcatcatgaagcacagaactttttggacaagctgcaaatgtttggcgctacaatccaatggggacctgagtatcaggaggtgcttgacaccatgcaggatcggctggataatcctaatttaacgccagccgcaacgctttgcgatcatgaagttgatggatcattaatgtcatatgggttggcaatggcaaaccggtatcaaaatcgggcacatgaaaacccgcacccatttaccggttttgaggagcagcctgatatgactgccaatgaattaaggcaacgtttatttggtgttatgggtaaaccggaaaatttgtaaaactaaatgattgacaagcatatttattctgactaaactttttgataattataagtaataaatacagtggtgtgatgcttatctgacgactgactataaagcgatttccaataggtgagagtggaaaaagtcgagtcagaaaggtaagtggttaacaattgatggttagcgcccattatcgtgtatcgtgcaattaagcacgtattgaggcagattgagtgattaatctgtgaacccgggtggtaacacgtggaaacgtcccgcaaagtaatttcttgcgggattttttggctctttgtcaaacatcctaaagtaagaggtatcaagattgtgacgacaatcttgatacctcttttactatacttaaattgaggttgaggtcgtcaacatcagtggaatatacattccgagtgtcaactggcccacaacacgtagatgaacaagttagattgaggatgtggtcttgagatcgaatgttagaaaactgtgataccgacatcttcgcaagtgtttcccctcaaaaatatatggatgcgattaaaggtgcacgttttaagtgaggtattgatgtgagtacgtggacagagtaattgtgctcttttaacgactcatacggtttaaggagttttcaagatttccataataagctggattgcaaagctcagtcaataattacgaggacctgccagtcatagtgacgtatttgaaacgacttggtatttattctacaagttctactcgtttttatcgatgaaggaaggaattacttgaaataaatccttggaggcactcattcgcatggcggggtttgagaaggcaaaacacaccagcccgttcagatgcagttttaattagcgtcctgggaattgatcagaaagatcactgattcatggtccgtagaccattcgcatagccaatatgagccaacttcatttaatggcacaccgctatctagaaataactaagagagatcccggattatcactgcattacatgacgcacgatccaaacatattccccgattagaaacgagagatgaaccccattcgatccatgctcggcttaacttttgttagtctcttcccacctgatttttttttaacaggagatagtccaggaacgatggccaaaacaatcattggctttggagtccttaatcccttcggataatcgtacgtcgattaatgaggtctgtgcat

SEQ ID NO: 456 - DNA, 73426 bp, Unknown
  Metagenome-assembled genome
aaaatagtgtggtggcgatagccagaaggatacacctgttcccatgccgaacacagtcgttaagcttctgcacgccaagagtagttgggggatcgccccctgcaagggtaggacgttgccacgcaaagataaaggttgaaacaatgttaaatttgtttcaaccttttttgtttccttttgttttaatcaacaataaaaataaaattagcgctgacttaataatttttaggacaccgcttgttttatagatgttgacttgataagatattatgagtaacagtgtgaacacacaatcgcttattcagtaatagcatgccgttttagctcagaaggtagagcatttccatggtaaggaaaaggtcccgggttcaaatcccggaaacggcttctatagtgttttatcattcagaaagtttcgaaggtaatgaataattcttattccttctttaaaggcttatactttacgatgagagggataactccaaattaaaaaacctttgccattttattactttcctgctataatattttgtgaacagatgttcgacaaaatgttattaaggggaagaggtcttatgtgcaaaaatactcgcgtcaatttaatgaagaaggggaacaataaacgttatcgattttcaggaacattcgaaaaatatgggtttaaatacacagaccgatatagaacacatgctgctggaacggttctactgattgatattaaagatgaagatggaatcgttgtgacagaccatttatggtttaacttaacaaaaggatttaggtctcttggcatcctcagtcccggagatgttgtcagctttaacgggcgagtgaaaccttatcaaaaggggtatctcggacatcgttttggtaagactcaaagctgtacaacagactacaaaattgatcggcccaccaaagtaacgttagaacgaacgaatgataaagcgactcgagaaaaattttcaacaaaaaactggacattatgtaatcaaatttacgaaatgtataaagaagactatcaaaaacgtggtatccctaaaccgtatgtttaagcattgattttatagacacattgaaactcgcagaaatattttagacgattcaaaagtttacaatttatttgggaaacttttaacaaagttattaactttcgttaagcagtaatgtaaacttattttgtatcataaattatgtttttgggggagtttatatgaagaaaaggaataccaatctcattcaatggtttgtaactgctttttttgtttttttgattggattaacagtgacatctccagtgaaggctgatcaagctaatcttagtgacggaacgtatacggtaccggttacgttactgaaagcaggaagtagttcaacttcaattgcaaacatgttttttacacaaactgctaacgttaaagtcactgggggaacttatcagattcagttacaaacaaacggggccgattacattacatctgtgacagttggtggtcaatccgtaagtgaagacaaatccggttcaaacgcaaatttgactgtcaatttgacaaatccaagtgacctggtaccagttacatttggattacaagtgccgcttcttgggacaatgaatcaatcagcccaatttcaatttaaatggtcaagcgccacacggactcagggttcaacacctgaagcagcaacaaacagttcttctagtgcaaccgcaagtagcaatacaaccatccacaccggttgcaacttcttcgtcagaggcaagctcaataagttcatctagcgcgtcaaatgtcgttaccagggagcctaatatggtaccctcaacaacttctgggtcaaaaaaagctgttagcaaaaaatcgggttatgcttggaaatatgttgtcctgaaagctgattcaaatgcaaaatccattgcaaacaaatattatacgcatactgctcgcgtgaaaaaagttaacaaacactataacgtgctattaaaagtcagctacaagaaggcacttaaattaggatccaaggcagtccgtccagtttctatcaatggacgaaagccactatcggtgacatatggggctacagccaagacttacaacttaacctattcatttaacattagttccatcaatagattaaagaaaattgttgctggtaagattcatgtaactgtcccgtacgcaaatattagttcaaacttcggcattaggttgaaattcggccatgcgagggtttcaaaaactggcaaaaaatcatctaatcatcaatcaggggccaaagccattgccaatacagtgacaactaagcctaccccaaacgaaaaattacctcaaacgggtgatgatcgtggaaagtctacttccattattggagcagttcttggaagtggtctcttatttgcttgggggctaaatcatgaaactaattagaggaaaaggttttttaattatactcagtgctttgttcttttttatttgtttgagtacggccagtaacgcaaaatcaatttcatacaaagcactattatatggcacgaataaaacctcaatggcaagcggatattttgtaaaaccggcaactgtgcgtatttcgcatcagaaatatgtggtcacaatgcaaataaaaacggctaaaagcctgtcttcgtttccagttgttgtgaactgggtaaatggagagaaacccaaaaatgttcgtaaagctaaagatcgtgcaggaaattcacattattattactcatttactacgacaaatttaacgaagcgaattaacgctaaactagcaatagatgtgccaaaagtttataaagcacaccacctgattagttttaaattcagtacagctggactgcctaaacttagtcaacaggggttaaccggtacacacaaagttaaagcctcatataaacatacaacgaccacagcgcctggtaaaagcgccgtggtaagaccggcgagtaaaagaactcaggtaaagaaaagtaaagtgacttcctcgccaaagatcaacaaggcaaatgctactcagccgaaaaaactaaaccatgtgacaaagcataaacaacaacctaataaaaagggcaagcaacaggttaagccgaagaagaggcccactcaaaaggctgcaacaaaaaagagtgacaagtcccctaaggctaaaacaaatcatgataaaaatcatacgccattagtgattggcggtgtgattgcggttattgcagctgtaggtggcggatcatggttggtttataaacactagggggttgcttaatcaatgaaaggttcacgaaaagttggtctgattgttttaggactttttgctgttattggaatcgggctggggttgctctttggctttcattcaaccaactctaaacagtcacatccaagaattgttgcaacgacatatgcagttgttcaaattgccgataaattagacttgccattagtcggtgtaccaacaacggcaaataaaatgcctgttcgttataagaatgtgacccgtgttggcagtccgatgaatccaaatgtcgagaaaattgcaagtttaaatccgacggttgtttattctgtgacaacattaaaggatcaatttgggaaggcattttcaaagcggcacattaagccatattttttaaacctaacgagcgttaaggcgttagagaaaacagttacgaatatgggctacagatatcaccgtgtttctaaggcaagagcggcacttgaggaaattaattctgctaagaataaggcgcatactttggctgtccatcatcaaataaagccaaaagttttagtattgatgggtctaccaggagcttcctatatgattggtactaatcattcatatgttggtaatttggtttctcttgccggtggaaaaaatgtattcccatcaaaaaatcaagagtatattcaaccaaatgatgaagcaataaaaaaagcaaatcctgatgttattttacgtttggaacacgcacttccaaaaatggtaaccgctcagtttaatcaggtctttaaatccgattcaatgtggcagacaatttcagctgttaaaaagcatcgtgtatacgatcttcaggaaccagattttgatgcaacagccaatatgcgggcggcaattgcaatcaataaagtttcgagatggctttatccgcgagatggaggaacagctcaatgactaagcgtgaaataatctggtattcattggctgttttactgttaattgtatctatttgggtatctttgatgatgggtgcaacacctttttcatcatcacaaatcttctctgccttttcaggccataatgacgccgacttgaatattcttgttcaaattcgggcgccaaggattctggctagtttggtttgcggtggaatgctggcagtagcaggcgccattagtcaatccacatttcataatcggttggcggatcccagcattcttggcgttacgggagcaggaagctttttaattctgattgcaggctttttggtgcctgcatttccatttgataagatgatttatgcctttattggtggagggctaacgttacttttcttatcttcaaaatcacttttacagaattcttttaaattgattattattggtgtagcgttaagcttaactttttcaggttttcagcaattattctctggcgattctttggttggaaccagtacgtttaatggcattacatggtcggacacactgacgctgttaattacgggagtgatcggattggttgctgcaatgatacttgctccttgggcaaattatttgaaaatgtctgaccagcagcttgcattgcgcggtgtttcagcaaggtttattcgtttttggctgttggctgtcgttgtctatctttcttccggtgcgacagcggaaataggtgttattccgtttgttggcatcatagtgccgaacatttcccgttacttggtcggtcatgactatcaaacaattattccgttgtcgatgttaatcggatcatggttgctgttgacgattgatacaattggccgaacgattacgctgcctggtgagattcccgctgcaaccattatgaccgtagtgggagggccctttctggtctggatgttatgggggcaaaaatttaatgaagttagataatgtgagtttttcatttcatgcaggtcagccaattattcaaaacatttccgccgatgttgttcctggttcaatcctgtcaattattggaccaaatggtgccggtaaaacaacattgctgaagttaatggctaaccagttaaagccaaccagtgggcaaatcagtcttaatgatcaatttcttgcaaaaatgactcgaaagcaattggcttcaaaaattgccgttgtcagtcaacaaaatcatctttatgatgatatgcaagtgatcgatgttgtgaaaatgggtcgattagctaaacatcatttgttggcaaccgttgaagataaagaagtattgccatatcttgagatgacaagaacaagctcgcttgctcacagagcgatgagtcatctttcaggtgggcagcgacaacgggtgtggattgcatctgcaattgcccaggagcctcagtacttattgcttgatgagccaaccacctatttagatattcgttatcaaagtgatttaatggcagttattgccgagcttcataaaaaaaagaatatgacgattgtgatgatccttcatgatattaatcaggcgtttaaaatgagtgatcagttgtggctaattcggaatggacgtttaattgcccagggtgcaccaagccgatactatgatgagaaacttcttagtgacatttttaatatttcaattcacattgttactattccgaattatgggcactacattattgaattaccagctgattcattttaaattttcaggttattaaaagtaaaagagcgggctattcgatactttgacaaatattattcgagacaaaataaaagcgggtcgggatattattatcccaactcgcttttaatcatccaacgtttttaagcgattagatattattttttataaatcgattgtggcacaccgtaacgtgaacgaccccaagtcttctgtaaccatggaacgaaccagtaatccaatccaaatgaccggccggaaccgttcattaaagccagtgcgacgaagagtgtccatgttgttggccatgtgagcatcgcaaagaagaataggatgatcacaataagatttgccagccaagtgaacaagcctaagaagataagcgctcccagcactatttccaatgcacctaatccgggatgcgcagtgaccaagaaactgactgagtcattaacattggccattccatccaggaagagagcaagcccaaagaacaatcttaacggcacactccacagaacgttacttcgttttgacgtattgtatccaaagacggtccggccattcttaaccctaaagaactcttcgagaatatatttaaacatgaagtagccggaatggattctcatgaagtacataatattggtaaaatgcttcataattgttgcaatccaaccccgaacacgcttaccgccgaagacctgggcaatgccgtagtatgcaccaaatgaaactgtgaagcccatattcttatctttaaattccatatagttttggttaccgtcgatgtcagctgccatgtttgttgaaacgacaattgcttcgttttcagcctcttgagcagtttgcggaacagcacgttttgcgccttcttcggtcgcatttgcgttatcaccggctacatagatacttttatcttcaaacccttttgcctgtaggtatttattggcgaccaaacgaccaccacgtccagcttcgattccgaaactgtcagcaacatggttcgtttttacaccagcagtccaaattaaagtatcagtcgaaatgggatcctgatccttaatttcaacggaatccgaattaacctgggtaatcatcgagctggtccgaatttcaacattattctttttgaaataactttcggcatgtgctgcatttgttcgatcaagcatattaataattgttggtgcagcttcaaccaacataatcttgatttcgctagggtcaatcttattttcccgagccaaaaccttcttatagtcaattaactcaccaacggtttctgcgccggtaaaaccggaaccacagacaaccaaggttaacatcgcttgacgtttttgcggatcacgctccaaagcgccttgtcgaataatgacgttgatgtggtcacgtaaggcaatcgcatcttccatagaccaaagcgtataaccattttctttaacaccgggtgtcccaaaatcgttaggttcgccgcccatactgatcaaaagactgtcaaagggataagtgccgttttcaccgacaaccttcttgccctctttatcaacttcactgatattgtcagtgactagttggacgttcttctgtttatggaagatccgctgtaagtcatactgaatactatcgggttccacacgttcagttgcaacctcgtgcaaacgcgtcatgtacgtgaagtatgaatgacggtcaattaacgtaatgtgaacatcaggatttcccttaaaacgttttgccaactttttagttgcgtaaacacctgaaaagccagcaccaatgacaacgatattctttgccataattaattccccccttaaagtttaacgataagttaagcaactaaaatatataaaagaatgaataatagcataacctattcttatcactcatattataaaagtacatcggctgattgtctaatgaatgccattacaaaataaaaaaatatttaaaatacttttttcataagtattaatatgcctaggattcaagcgttttcgggctcaatttgattaatcacaatcttctttcacaaaacataaataaatattcatgtttagccgatattttcatttgaatattaggcaatcaatagatacaatagaagcatatggggaatactcataatttgttagttaaggggggatacagcaatgttgaatataggtttgtcagtattaggtctatcacgttttcaatttgcgatgaccactgtgtttcacttcttctttgtaccgttttcgattgggttagcatttatcgtagcgattatggagacggtatacgttgttaagaaggatgagacttataagaatatggcgaagttttgggggaaaatattcctgtttagtttcgctgtcggtgttgttactggtattattcaagagttccagttcggaatgaattggtctgagtactcacgtttcatgggtgatatttttggcgcacctttggcaattgaagcgttagccgcattctttatggagtcgacgtttattggtctctggatgtttacctgggatcgattcaacaaggttgttcattgtttgtttatttggctgaccgcttttgggtcaacgctttcagcactttggattcttgctgcaaatagttttatgcagaatccggttgggtatgtgattaactcacagactcacagagttaacatgacgagtttttctgcggttttaacaaatcgccaactgtggaatgaatttccgcatgttattttcggtgctttcttaaccgcgtcattcgttgttgcaggggcttctgcatggcgattacttaagaaagatcatgaacatttttatcgaaaatcacttaaagtggggttgattattggattgtgtgcctgcttaggttcgatttggtcaggtgacacccagacgcgttacttgattaataatcagccaatgaagtttggagccatggaaggtctttataagaattccacacaaaagggtgactgggctcttgcacagggaaatgatactcaaaatcataagaaaacatggtcaattgaaattccttatgttttaaatatcttgagctaccacaaattaagcggcaccgttaagggtcaaaatcaagttaacaaagaattgaaggctaagtatgacgatacaaaacagggtcaaaagattaagaactattacgttccgacaaagaccttgttctggagcttcagattgatggccttttcagcaggcttgtttgctttgattgcaatcgtcggtctgtggttgaatcgagaaaagtccaatgcgattatgaggcagcggtggttcctgtatattatgggattatgcctctggctgccatttatcgtaaacacggccggttggttcatcactgaatttggtcggtatccatgggttgtctatggtctgctaacaattgcggatgcggtttcaccaacttcgacagttttggggttgttgtttaccaacattgtttacttcctgatttttgcttcacttggggctgtcatgattattctcagtcaccgggttctaaaatcaggaccggattcagtcatgacagatggttactcgagtaaaccggaaaagtcttctgataaagatccttatgaaatgggggcggctcataatgactaatcttcaattactttggtttttactgattggtgttttgttcagcggcttcttcttccttgaaggatttgattttggaatcgggatgtcaattcgtttctttgctaaagatcgagatgaacgtgatgttgtgattcaaacaattggtccgcactgggatggtaatgaagtttggctgatcacggctggtggtgcgatgtttgcatcgtttccaatgtggtatgcatcattgttctcaggatactatatcgttttgttccttatcctggttgccctcattttccgaggtgtttcctttgaattccgtgcaaatatgcaaactgatacttggcgtaatttctgggaatgggcggcttcgatcagtagtttctgcgcagcatttctatttggtatgatgtttacaagtatgattcaaggggttccactggatggtcaaggaaatatcttcgggagcttcaccacttatgtaaactggttctcattggttggcggtgttgccgtttcacttctttgcttcattcacggtttgaatttcttacgtctaaagaccagcggcggccttagagaacgcgctcaaaaatggagtaggattctttatcctgttttacttgcaggtgaagttgtctttgtcatcttgctgttcttgacaaccgatttctttaccaaaaagccggtaactacttggagcatcttgattgcattggttatttttactttgattgcttggtggggcgccattgcatcccacgattgggcatcatttttggcaagtgggttgtctttaattagcgtggttgtcttaatctttaacgggttattcccacgtgtcatgattggtaaagataatgttaattcaattttgatcaagaatgcatcaagttcaccatatacgctgcatttaatgacaattattacgttctcaattttgccgattgttctcatttacttcatttggagttattgggtattctataagcgtttgagttcaccaaaacaaactgcataatctttgggtagggacatggcgttaattaacgttagtgcttgtttttaccaaagatcagttaaataacgatccatcgcgttttattgaagtgatggatcgttatttttgattttaatattttgtagatgacggttccattgtgtgcaattattcactatactagtccgtgtagttaataaaattgggggagtgaacgaattgattgataaacgattactggcactgccgggaatgcgacgataccttgttattttgggaattttggtatttgttcaagcggttgcaatcattgttcaagcaagatacctatcggttgcgattgtaaatttgtggaatttacaaccgttaaaatcgattttaataccgacagttgtatttgccgttgcgttcttatgtcgacacttattaacggtagcgcaaaatcgtgtcttttttccgtatgttgaaaagaccagcggtgagatgcgggaacaattaatgtctaagatatttcatctgggacctgccgaaattgaaaagcgtgggactggtaatatcgtgacaatggcacttgaaggaattgataaagtccaaacctatttaatgttggttattattaaaatattgaatatgtcgattacaccatggctgattttactttatatcctttttttacgatgggaacaggctatttttctctttattatttttccagtaattattttatttatggttattttgggattagcggcacagagtaaggctgatcgtcaatatgaggggtatcagcgcctttcaaaccactttgtcgatactttacgcggcttgcctacgttaaagcaattggggctttctaagcgctatgcggataatgtctttgatgtgagcgaatcttatcgaaaagaaacaatgtcaacattgcgaattgctttaacttcgacatttgcattggacttttttacaaccttgtcaatcgccgttgttgcagtttttcttggttttgatttgctggacggaaaggttatgctgctgccggctttaactattttggttttggcacccgagtattttttgccgattcgaaactttgcaaatgattatcatgcaactttgaacggtaaaaatgctttatcggctgttttagaggttttaaacgaaccggagatgaaccaaaccgatgagctcactgactttaagtggcagaaagatgcgacacttaaatttacaaaaatggctttcacatatcctaatgctgacaaaccggctctaaaggacgtttcggttacgattcagggaatgaagaaaattgggatcattggtgcatctggttcgggtaaatcaacattgattaatattattggcggctttttggcaccggacaagaaggggcagattgaaattaacggacagtcattgccccatttgaatcaaaaggcctggcaacgcaactttctctatattccacaaaatccttatctttttcatgccacacttgcacaaaatattgcattttatgttgatcatgtcacgccggaatcaattaaccatgctgccaggcgggccggactaaacgaatgggtcaaaacgttgccggacggtttggatacaatgattggtgagggtgcaagaacggtcagcggtggacaggcacaacgaatcgcacttgcccgtgcttttcttgatacaaatagaaaagtgcttttatttgatgaaccgactgcgcatttggacattgaaacggaagcggcattgaagaaagatattttacctgtttttgataatcatttggttttctttgcgacgcatcgccttcattggattagtgaaatggattatgtcttagtgattgatcatggtcaaattgttgagcaggggacgcctgaagaactaaatgccaaaaatggcaggtacgttaaattgcgttcagaaatgggggctgcagagctatgaagcaattaagacaaacatttgcacacgatacttgggtcatgccttatttgcgaaaatataaagggctgctcatcctggttctttttcttggctttatgacatttttctctggtggtgccctgatgtttaattcgggttatttgattagtgaagctgccaggcggccatccagtattatttatatttatgttcccgttgtgttagccagggcatttggaattgcccgaccggtttttcgctacgtggaacggcttaccagccataattgggtactgcgaatcgtatcggattttcgtaagaaactataccaaacagttgagagaaaagcgtcggccattagacgttctcatcaaactggcgatattttaagtattttagcagatgatattgatcatattgaaaatttatacttacgaaccgtttttcccatggtcattgggtggctcttgtatatttttgttgtcatcggtgttggttgccttaattgggtggtcggtttattactcatgttgttactggggatcatcgtcattgttatgccattaacctcggttgccaccaacggtgttcgtgaatttcgtcaacatcagattcagcatcagttctacacaaatctaaccgatgaagttcttggcctgggtgactggttgatttcgggccggtaccatgactttatgacgttacagaagaagccaattgatgctattgccgctttgcgaagaaaagatcattattatcagtggtggcggtcattttttgttcaagtggttgttttattgacgacattggtacttctgatttggagtggtcattcattaacagcgtccaaatcattagccgattggattgccgcgtttgcattagctatttttccagcggtttcaccctttctgaatatgagccaagggatgagcgaatggccggtttatcgacgctctattgagcgggttaaccaattggatcagggaaatgctaagatggatgatcaactgcgtttatctgaacgatttaaagaactcaacattgatcacctgacgttcaagtatccagacggtgatcgtcgtgttgttaatgatatttcgatctcggttcattcgggggaaaagattgctttgcttgggccgagcggtactggtaaaagtactttcttaaaactaatggttggcgaccttaaacctgttagcggccaggtaaccattaacggcgtacccgtgtcttcactgcagcgcgaccgtgcgtcattatttggaattcttgatcaacaaccctatctctttaatacgacagttatgaacaacgttcgccttggtaatatcaatgcatcggatgaggatgttaaaaaagcacttgaggcagttgggttaaaagacttaattgaatcacttcctgagaaatatcaaacgcatgttcaggaagccggcaaacgattctccgggggagagcgtcagcggttgtcattggctaggattctacttcaggacgcaccaattattattctcgacgaaccaacagtcagtttagatccaattacggagcgtcaccttcttgatcaggtctttgatttactgaaagataaaacgattatttgggtgactcatcatttagcaggaattgggcacgtagatcaggttcgtttcttggaaaatggtcattttgatatgcagggaacacccgaggcactatataaaacagaagcccggtttagacaattatatgatctggatcggggaaaataatgaatataaccaatttgttcccaatcaagtgaaagggatatcgattttaaaagaaccggaatttctagttattactagaaatttcggttctttgtgcactaggatattgtgaaattattatgaaatactttcaaagtggataattgactcacaatttatttttaataggttgtcagtacctgttatcaagagcgttggtcctgcttttaggtggcgacctgaatgatgttttttacaataaaaatattattttaataataattagtgatatttattttaaaatgatatataataagtttatatttgaatattcgatataagaattttatacgatgatcctcaagacgtttgttaaataatatgcagctttcgatgttaattgcgttatgatggagacgcaacagaatgtgcctgcggacaagcgtcactagataatcagaatttgtgaagggatgacttttaatgagaaaatttattggattagttggtacgaacaccactcaatcaaccaaccgtcaattgttacaatttatgaaacgtcattttgaaaaacaagcagaactggagttgattgaagtttccggcctgcctatgtttaataagccacaagatatgaaagtacctgagcgggcaactgaaattgcaaaaaaaatcgatgccagtgacggtgtcattattagtacaccggagtacgatcatgcagtgccggctgtgttgatgaatgcgttagaatggctttcttatggtattcatcctttattagataagccggtcatgatcatcggtgcatcatttggatcacttgggacttccagagcgcaagcccatttgcgtcaaatgttggattcaccagaaataagtgccagagtgatgccgagttcggaatatttagttggtcatgtgttggaagcgtttgatgacaaaggtgatttaactgataaagacaaagttgaacagttagacgcactatttgcagactttcaacaatttgttgaaatttcaaaggaactttggcatacggttaaggttgacaaaaaagaagttcaaaaacttggtaaagaagattttaattaaaaggagtgctcacttatgaaactagttggaattgctggtactgttgaagataaatcgtacaataaaatattgcttcaattcattgccaataactttagcaaccttgctgatatcgaaattttaagcattgatgatattcctatgtttgatcaagacaatgatcaaactgaaagcggtgcgattcaatatttaaatcgaaaaatttcgggtgccgatggggtgattattgccactccagaacataatcacacgattactgcggcacttaaaagtgtgattgaatggctgtctttcaaggttcatccgttttctaacaagccggttatgattgttggtgcctcatactatgagcagggatcttcaagggcacaactaaatcttcgtcaaattttagaggctccaggtgtcaacgcaattgtttttcctggaaatgaatttcttttggcaaatgtaaaagaagcttttgatgataacggtcgcctgaaggatgaaaaaacaaccgcatttttgcagacaacattacaaaaatttcttcgatttgttaaggtgattaacacgatgaatcaagccacaggtgggcatgatgatgctgccggtagcgaagacttgaattcaaaagggaaaatttcgacaaccatcgaaggtgtcgatatggcagctgatgattgggtagaaaaggcggcagagaaggttaatgcggttgaaggaaatacctatgttaaattggatcgcggcattttaacggttgaccagcttaattatttcttgaattcaatgcctattgaattaacatatgcggatagtaataatcaatttatttactacaataaaatgacgtctactaaaaaaatgttggcaccaagacgtcccggtcaggtaggagatccactgtcacttgtccatccaaagagagccattcagggtgttaagagtgttattcatgcattacgtacaggaaagaccgatatggtcaaaatgccggttcccggcaacggcccggataaatacattatgcatttttacaaagctatgcatgatgaaaagggcgagtacgttggtatcaacgaatttgttctggatattatgccgattatcaagtggtatctaaacaaaacagggcaaaagcttgctgctgatccgaatgccaaagtagatgccaatacgggtgcatcgtctaaagatgatgaggccgccgataacagtgctacggatgctgatacaagcgcatctacccacgatgagccggaagcgtctactggtgatactgatgcaacgaccggtgcttcagagagttaacgtaattaataatcaatcgttagtggcggttaattgataaccatttacggtggcaattaaaaaagaaacaatatcaagactccagtagtccggatattgtttctttcttttgtcactaggttaataggtcatcgaaaataaaggacctttgtcaaggggatttctcattgctctctttgcagcagcaagttagttaaacgacgtaattctttttttgaattttgctcaggaagtctattgattagcgccaatgctttttgtgtgagctgatttgcaatttcatgtgcccgttttaaaccaccggatttgatgacgatcttttggatttttttgatgtcggcttccttcaaatcctgttttttacctaacaagggggccaactgtgtcccagcagtttgatttgccaagataagtggaagcgtgtataccccggattgaaggtcttcgagaaccggctttttagtttgactcgaatcaccgccataatccaaaatatcatcttgaatttgataagcctgaccaattgccagcccgatttcgccaccaagtgtcacgatattacgaggagcgtgggttaaaattgccgactgttcaaagcttagcttgaataactcggcagttttaccggtgatttcgtggaaataatctttttgagacatatcttgccggtagttaaaggccatttgatccagttcgccatttaatatggtttgcatggcttcaatatgacgttggagatcggttgcatcatgtgtggattttaagacctgatcaaaataacaggtaaataaataatcgccagcataaatggcatttttttgaccatattgtgtgtgaatggtttgaacgccccggcgaagtggtgattggtcaatgacatcatcatgaataagtgtggcaacgtgtaataattcgattgcagcggcacctgcgcggagtttgtcagctgggattttttcaccaaattcagaatatatgtagaaaaaaccgggtcgtagaagtttaccgccggattttaataaggctaaaattcttgaatgaactggttggtttgataaagtgaccgcctttaaaagatacggttcgagttgaattaattttagttgaatacgtggaaactgacgccaaattcgatgaaccataggttataacctcaagtcttaagaaaattttaattacctttctaagatacaaattactaagtcacttgtcaatcaaagttgtgcaatcgctaaatgaccaaagaaaaaagcctcggccgctacatgattaaatggcggcgcaaggcttaagtggtgactacttgtttaaaaccagtcatcttattcttatgatcaatgttggatagaaaattatacttttttatttttaatcgtgtgttcaattttaattttactgttagtgagagagtcatcagtaattaaaggcgtcacatctccaatactgattagtgttaaatgatgcatcgctctggtaatgatcgtgtagagagtccccaacaatgatttttcgggatagttgatttcagaagtgtcccatgcaatcactgaatcaaactccagtccttttgcaagatatattggcagtaccaagacaccttttggtaaggttcggtcggcatctttaagcagtgttgcgcctgtttcgctgtggatcaaaccataaaccgccttggcctctgccatgtttttggttaaaactgcaaccgtggcatacttttgtcgttgatctgcaatgactttgagcacttgattggttgcgtcgtttgtattgggagatacaatcaattcgggaatgtcaccatcccgattaaatgcctcgatagcatcgccattaggcaaaattgattttgcaaatgttgtaattggataggttgaccgataggaacgcattaaactgatgagtctggagtggcgaacgtgaaaggcgttatttagtttgttcaaaatttcttctggttcttcaacgtctttgaaaagtgcttgttcactatctccaagcagggtccatttagtttgcggaaaggcatattttaaatatttcagttgagctaccgagtaatcctgcatttcgtcaacaaataaatatttcattgtgttattttgaccactttgacaaatatagtctctcatataaaggagtggcgcacaatcatcgagtttaattgaatggaattcgatttcctgattaaaatcggaaatagattgtttccattgaaccggattgacggtttcaggtaaatcaacacgctgtaaaaaggccgtgtactggacgtacggatctaaaaagttgttattaaaaatggcatcgtaaacaacctgcaagcgggcggtaacaattttttttgcaatgaagaaacgctcgtcatcttcgttttgaaaatcacgaaggcgtttggtaccgagcagatcatggtatttttcttcgctgagctggtcaatttcttcattgacccaatcggccttggtttcagtgacgatccgatgttttaaccgcttaattaaagcattcttggttttgaggaaacgatcgggaactttcattgcacttggaaaagatgagaagagttgttcaatttcatgtttgctaaagaaaatcgattcattgaagatgatgtcactaaacttaatgtcagttggctttagtgaattgcagtagtgttccacggcatccataaaatctgccgattccttaaacgcacgaatggccttttgctgggatgtcagttgaccatctgtttcatatcgatcaaataaactttgaacatttaaccccttaagacggttatcgatgaattcatcgaatgtaacctgtctcatatttcgctcgccaagacttggaagcacctcggaaatgtaatgactaaaaagcttattcggagagaaaagaataatctgatcggcttccagcgtgtcgcgactatgataaagtaaaaatgcgattcgctgtaaaatggccgatgttttaccagagcctgccaccccttggacaacaagcaagttgctctttgtatcgcggataatgtcattttgttcatgctgaattgttgcaacgatattttgcatataatcgtcgttctgggcgcctaaagcggtttgcaacatctcatcgccaactgtttcgttggtatcgaacatatttcggatttgaccatcgacaatttggaattggcgtttcttcattaaattagtttgttgtttgcccattggggtttcgtaagccacttttccaagtgtgccattatagtaaacacttgaaattggagcccgccaatcataaaccaaaaagtcaccatcatcgttttcaaatgatgcaatcccgatgtatagcttttcgtcctcggattgatcatcatccttgatatcgattctgccaaaataaggcgatttttgaagatctttcatggttgagagttggtgttttaaaatgctttcattttctgttaatctggaaaccagaccacgctgctgttgtagttcggcactggtttcgattcgatcatcgacttcaaaatagttgactgaggtgttgtctgaataagtttgttggacctttttggtttctgtgtgggcacgattatactcattttccgtgctggtcattttagtgccgatttttgaaacgacccagtcaacccgttgctgttcttttttctgttctttgttttccaaaagggttcctccagtctgtccgctatttcatgtcattgattaaagtattgtgcattaaaaattaatggtacttttcgtaaagtcttagaagaaatcaggatcattgattttggtgtccaaacatatttgagatcactttaaaaattggattgaatcgatcagtataagctgattcaaatctgattaatttctaaaacttcctgcacatttatatcttatgcttgcacaattttagtttgatttcggtctcctgtcaattgaatgagtcgaccttgataaatgttaactgagcctttgacatttcctatttttatcagtaaaattaaaatgttattagtagatgagtagaatcgtccaaaacagagaggttatcaaggctgaaagtgaccacgacgaaacgaattggtagtttaaaagggtagcacccgtatcgcttagagaggtaactacacttacaacttagttacaatttaggtggtaccacgtcttagcgtcctattgttcaatcaatagggcgttttttcgaaaaattgtgctattcaaaattcggatattgaaaggatagttgcaagatggcaaagaaaattattttaacaggagatcgaccaacaggcaagctacatattggccattatgttggttcattgaaaaatcgggttgaattacaaaattccggtgattacgacaccttcatcatgattgcagacatgcaagccttaactgataatgcacgtgatcctgaaaaaatccgtcatagtttgattcaggttgcattggattatctagctgtgggaattgatccggaaaaatcaacaattctagttcaatcgcagattcctgcactcccagagttaacacaacattattcaaatttggttacggtctctcggcttaaccgaaatccaaccgtgaaaaatgaaattaaacaaaagaattttggtcaaagtgtcccagttggatttgaaatgtatccgattagtcaggcggcggacattaccgcttttaaagcgactactgttcctgtcggtgatgatcaggaaccaatgcttgaacagacccgtgaaattgtgcgttcatttaattcaatttacaaagcagatattttagttgaaccggaaggctatttcccaccaaaaggaatgggacggattccagggttggatggcaacgccaaaatgagcaaatcgttgggaaatgcgatttatctctcggatgatgaggacaccatcagcaaaaaagtcatgtcaatgtataccgatcccaaccatattcatgttgaagatccgggtcaagttgaaggaaatacggttttcacttatttggatatttttgatcccgatcaatcaaaggtagctgaattgaaagcccaataccagcacggcggattaggtgacgtgaagatcaaacgctacttaaatgatgttcttcaagcagaattaaaaccaattcgtgaacgccgaaatcaatatgaaaaagacattgccggtgtttacgatatccttaaaaagggtagtgaatatgcaaacacggttgccaatcaaacccttaaggaagttcgcgatgcaattggaatcaattactttggctagaactgccggaaaggatggcagggatgcaaaaccttgtaattttggatattggttctaattcggtccgaatggccatcaatcaaatcttaaacgacggcagttatcgtgaaatcaaacgtgttaaaagtgatagtcgactttctgaaggtatgggcaaagcaaaggtactgcagccacaagctatggaaagaacgattcaggcgttggcagattttaaggctatttaccaacaataccggtcggattccgtaatcggcattgcgactgctgcagttagacaggccaaaaatcaaactgattttttacaagcggtcaaaaaaaggattgggattacaatccgtgtcctctcaggtgttcaggaagcttattatgattatttgggcgtcattaatcgattgggaatcaaaaactgtctgattcttgatattggtggcgcaagctgtgaattgatccgggtagtcaatggtcaaagcaagaatttaaccagtatcccgattggtgctgttaacatctcggaacagtttcatttgaatgacaatgtttcaggtgccaatttatttaatgcccagtttcatattcagaaattatattcccgaattaaatggcttaagcattcccaacgcgagccgcttgtccttttgggcggggctaatcgaaccctggccaggattaatcgaacacgtcagggaatgaagcgggttgactcgattcatgggtatcatttgagctatgaacaggttaatcgtacttaccttaatcttcttaggggtgatgttaaacgtcgtcgccaaattaaaggcttggagcatgacagagctgatattattgttggtgggctgttgccgttaatggtgttaatggataaggttgatacccgaaaggttctattctcagagagcggcgttcgtgaggggattatcacagagtttgtagaaaataaaagtgagcactaagtgattttgagtatgcttggaagtttatcaataagaaggctggaaccaggattattcctgcccagctttttgtcgcttgtatgaaaagttattttggaggtggggcaaatggatgctcgatgggcacatttctatcaaaaatcatatcgggaacgacttgatttgattgcagatttctcaggcttaaacagtgatcaagtagctttgcttaaaacaaccaacgctaaggtctttggacatttgatagaaaattaccttgcagactatgcgctgcccgaaggaattgtcaccaacatgaaagttaacaaccgtcagtatcttgttcctatggtgactgaagaaccttcagtcattgcggctgccagtaatggcggaaaactgttatcgggggacatgggtatcaaggccagcgtaaagcagcggcttttgagtggtcaaattattttaaaggacattagtgatgcaagacaactaagggaatttataagtgatcgtcaacaagaacttattgagattgccaataatagtcgtccccgaattcttaaacatggtggtggtgcaaagtctctgtcagtaagacgactggatccgcaattctattcagtggacttacaggttgattcaggagaagcaatgggggccaatttggtcaataccatgcttgaagcagtggccaatgaattgcgttcatttggtttgcaggttacaatggctatcctttccaattatgccgataaaagtttggtccatgtcttggggaaaattcccctctccgagttgacaacttctggcataaccggtcagcaggttgcttctcaaattgtggacgcgagtcacattgcacaggttgacgtttaccgagccactacccacaataaagggattatgaacgggattgatgcggcggtgatggcaacaggaaatgactggcgggctgtagaaagtgctgcccacgcgtatgcggccaaagatggtcaatacaaagggctgagtacttggcgtgtgaatcaagcctacctgatcggtaagatgacgataccaatgccgattggtttcgttggcggtgcaaccagtgttttgccaatggctgccattaataaaaaaattacccgaatcaaacgagtccgtgagatgatggaagtgattggggcgatcgggttggctcaaaatttggctgcactcagggcattagtgactgatggtattcaaaagggccatatgaatttacaattgaagtcgcttgcgatggctaacggcacaaaagagtcggaattaccgacggttgttaaacagcttcgacacatgacatcgcctgattcaacggatgttaagaagattttaaaggaattacgaaagtaggatgaaataatggataacgaaattaatattgaattaaacgatcaggtacacagcttaattgatgcggtcaacaacttctttccgggaacggtaaccgttaatttccttgggaaacttcagtctggatacgttcgacacgatcaatcccaagttgtccaggatggcaaaaatattatgattcaaattgctgatttaagcgcaccaaactatacggcctcccatgaattattacacttattaatggttttaagaggatttccgcaggttttcttttctttaacaaccggcaatgccgatttggatgatcagttaaaaatgatggggactgagctttacgacatggtgtctcactttgttgtcgtttccgaacagagaaagcatggtttgattgacgatgaaattgaagctatgtatatgaaaggggtttatgcaacaattaagccggaacccgatccggttgacgatcaaatgacgcttcggttaatgacattattggatgcaatggtgttttacggtgatcggtttagtcaggtagccgataaattaaaaaaggattttccgatttcattagcagctgctgaaaaattgtatcagttgattacagagaagccgactgattcaccttttggccttcgtcgaaatgttgtcaaattgtttaaagcctttgatgaacagatgaaacaatgggcattgccacccctgcacaataccgagtttacaaccttaaccagtgttctttcgaaacgccagcttggattgcaggtcaagcaactattcgaagtatttcattctgaactcattgaggtgaacagcaacacgcgggcctatgttggctttaaccgggttgacgatcaaaattcgtttgttttggcaaatccgaaaggagaacaggataatccagagtttttccaggaaatttatggtaaaacggttaaagccttgttcgacagtctaaaaatgccttatattgaacgtaaatagatttttttattatccgaggagtgagataaatgattgatcaaaagattcaaacaatgtttgacactgcaaaaaagatcgtttttctgaccggggctggggtttcaaccgcgtccggaatcccggattaccgttctaaaaatggcttatataccaatgacaaaacggataaaccggctgagtattatttgagtgtggattgcttacgcgacgagcccaaggtattttatcagtatgaaaaatcaaatatgtattatcccgatgccaagccgaacgttattcacgaccgtcaggctgagttcactcaaaagagggacgccgttgttgtcacccaaaatattgatagtctgtatcggaaagccagcaccaaaaacttagttgaatttcatggcaatttatataatgtgtattgtcaaaaatgtcgcaaaaaagttgactacaaggattatttaaacagtatgtatcatcgaaattgtggcggtgtcctgcgtccggacattgttctttatggagagggactaaatccaaacgcaatttctaagagtattaaagccgtttcggaagctgatctgatcgtgatcgtcggtacgtcaatgcgggtctatccttttgcaggacttattgactatcgcccccaaaatgcccgggtcttggcggttaatgaagagcaacttagttttacatttccgtttacaatgattaaacaaaatgccgttgatttttttgatgatttgaatgtgaatgtatcatcaaagaattgacgtttcttaatgggggtgacgcgagatgattacaattggattgacgacattttctgagcatccctcactaattgatgattcaaagcgtaaagttcgattgtcagaatatagtgctcattttccagttgtggaattggatacgcctttttatgggatcccaagaactgaggtcattgagcattggcaacaacaggtttccgataattttcaatttattttaaaagctaatcaggtcatgacaatgcatgatcagggaagtggggatccggttagcaatgaagaacggtttactaaattcaatgaatataagcgcgcaattacaccacttgttcgggcgggccagctgaaaacaattctttttcagtttccaccgtattttgcgaggaaagtcgaaacaattgaatatcttcgccgtatcagcattttcatggaaggatatccggtgtcggttgagtttcgaaatccgtcgtggtacggcaaaaatataatcgatgatgttgccgggtatcttaaggaacttggactggatttggttgtggtggatgaaccacatacgaccaatatgggggttccgtttgaaccacttgtgaccaataaagatctttgcatgctaagattacacgggcgcaacatcaaagggtggacggatacaacaggtgattggcgcggtaaacgaacactttatcgatattccactgaagaactggcacgattaaaagatgtcgtcttaaagttgcaggatcaaaccagggaagtctgcatcattttcaataataacgccggtcgggatgcggctgacaacgcactcgaattgaaaaaaatgctggggatttcttttggcgggttgtcacctcttcaaatggatctgttctaaaggccccaataactagaagaatctacacgagaatgaagcaaaagaacctcagcagttggtgtcagttttatgggtaaacttttcctgctggctctcgcacacagtggctttttttgctatacttgactgtaatattatcaaataatcatagattaattcgattggaaaagaggtactttcatggcagaaagtaagccaacattttatataacaacaccaatttattatccttcaggaaggttacatatcggtaattcatataccaccattgcttgtgatgccgttgctcgttacaagcgtgcgatgggttacgatgttttcttcctgactggaaccgatgaacatggattaaagattgaacagaaagcggacaagctagggatgacaccccaggcatatgtcgataagatggccaagggcatcaaagagctttggaaaaagcttgagatttccaacactaaatttattcgaacgaccgatgattatcacgaaagggcagttgcagacatttttcagcagcttcaagatcaaggcgatatctatcttggtgagtatacgggctggtattctgtatcggatgaagaatacttcactgaaagtcaactggcggaagtttatcgtgatgatgacggtaaggttattggcggtaaagcacccagtggccatgaagttcagttggttcacgagcagtcctacttctttaagatgagtaaatatgccgactggctgcgtcaatactatcaggaccacccggacttcatccaaccttcaacgcgaatgaatgaaatgattaagaactttatcgatcctggccttgaagatttggccgtttcaagaacgacctttcattggggtgtgcctgttaaatccgatcctaaacacgtggtgtatgtgtggattgacgccttgtcaaactatataaccgcacttggttatgatggtaaagatgacagtgatttcaagaagtattggcccgctgatgttcagatggtgggaaaagaaattgttcgtttccacaccatttactggccgattatcttgcatgcactcggattaccactccctaaaacggtttacggacatggttggctgttaatgaaagacggtaaaatgtccaagtctaaagggaacgtgatttatccagagacgttaatggaccgttacggcttggatgcactgcgatattatctattgcgggcaatgccatatgcaaatgatggtatttttacgccggaagattttgttgaccgggttaattttgacttggccaacgacttggggaacttattaaatcgaactgtttcaatgattaataagtatgaaggcggtattattcctgagtttaaggctggtgtcaatgaagctgacaaggaactggaggaagtttctaaagagtccattgccggttttaagaagagtatggatgacctgcatttttcagaagcgttatctgaagtttggaaactggtttctcaatccaataaatacattgaccagacggaaccttgggtcttagccaagaatgatgctgataaggaaaaattagcttctgttatgtcccatttggcagccagcctccgggttattgctgaattaatcagcccaatcatgacacatgcacctaaagagatttttcaacagcttggattagatgaagctattgatattaaaaatcttgatatttcggatctccctgccggtgccaagacagtcgcaaagggcacaccaatctttcctcgggtggatgttgatgaagaagttgcttttattaaggaccagatgacaacaaatacaaaagccaagggacgagccgcaatgaaagccgcagccgaaaaaaagttcgatcctgaagaaaccgagttgaaattgactaaaaaagaagtccggtttgacgctttcgaaaagattgaacttaaagtggctgagattcttgatgtcaaaaaagtcgagggagccgacaaattgcttcagttccgattggatgccggtgacgatggcgatcgtcaaattctttcaggaattgcacagtggtatcccgactatcaaaaattagttggaaagaaagttattattgtttctaacctgaaaccacgaaagatgcgtggacaggttagtcagggaatgttattgtcagttgaacatgatgatggtaacgttgaattagttacagtagattcacatcttgaaaatggattaactttggaataagtcatcaatggaccgattttctcatctttcatttgataagaaaggcggtccgtttttgtgatttttaatgaaaataattgagggggttaccatgaaaatttttgattctcatacgcatttaaatgacgatcatctttattcacaagccgatcgttatgccgagcatgccaagagtctgggtgtggttaaacttgcaaatgttgggtctaatcaggtattaaatgaccggtcacttgctttaagtgccaaatataacgatatgtattctattatcggttggcaccctgaagattcgattcactttcacgatgagcaaaagcagttgctgattgaacagcttcaaagcccaaaggttattgcagttggtgaaatcggattggattattaccaaaccacttcgccaagatccattcaaaaacgggtcttcaaagaacagattgatatcgcaaagcagcttcatttgccgatttctgttcataatagagaagcttttgaagacacttatgagattctaaaagaaatggatattcatgatattggtggtgtgatgcacagctttaatggtgatccggagtggcttaagaaattccttgatttgggcatgtcggtttcatatagtggtgttgccagttttaaaaaaaaccatgatgttcacgatgctgtcaggaatacgccgtttgataggatgctggtcgaaaccgatgccccgtatttggcacctgagccactgagagggaaacaaaatgaaccagcgtatactttatatacggttgaagcaattgcccggttatgcgatgtcaatccggatgtgattgctgctcacacttatagtaatgcattacgattatttggaattgaggataatgaaaaaaattaaagaagtcattgtcgttgaaggcaaagacgatacaaaacaaattttaagggcagttgacgccgatacaattgagacccgtggttccgctatccctgatgaaaccatggcactgattaagaaaattgccgagacaaggggcattattgtgtttaccgatccggatttttcaggcgaaaagattcgtaaaacaatttcggcggaaattcctaacgccaagcatgcatttattactaaaaaacaaggggttcccaaacgttcagaagggtctcttggagtggaacatgccagtgtggaggctattagagaagcgcttagccatgtctatacggaagatgatcagacagaggaattgattagccgggaaacgttaatgaaatttgggttgatggggtatccggacgctaaacagagacgtgaaaaattaggtgaacttttaggaattggttatgtaaacggaaaacaattgcaacaccgactgcgaatgtttgggatctcccagcaacagtttttggatgcagttgagaagatagatggagataaataaaatgagtgattatccagaaattgcctctcctgcaaggacacaggcaattttaaaccgatatcggttatcagcaaaaaaaagtttgggacaaaattttctgattgatctgaatattctaaacaatattgttgaggctgcagagctgactaaaaatgataatgtgattgaaattggccctggaattggtggattgactgaacaattggctaaggccgcaaatcaagtactggcttttgaaattgatgaaaaattacttccggttttagatgaaacactatcaccgtataacaacattgaaattattaatcaagatattttaaaggctaatttgcccgaagttgtcgcaaaaagatttaggactgacaagccgcttaaagttgttgccaatttaccatattatataacaacaccaattgtgatggatttattagccaatccggttaaattcgaatcaatagttgtgatgatgcaaaaggaagtagccgagcgattggatgccaaacctgggactaaaccatatgggtcactctcagtcattgttcaacagcaaaatgatgttgacatttcttttgttgttcccaaaacagcgtttattcctcaacccaaggttgattctgctattgttaaattgtctccgaaaatgcaggttgacaagcgtccttttgatcacaaaaagttcgttggctttgttcggggatgttttatgcatcagagaaaaacgctatggaataatttactgggtgtttttggaaagcaggaaagtgttaaagggcagataaagaaggttttggatgacttgtcaatcaatgccgcaaatcgtccggaacagcttcaggtagaacagtttgtggcattgacgaatgcgtttcatgaaattggggtattaaagtaattttatattgccagataaagtgatttgtgatataatttgcggttttattacttttatggtataatgctttatcgtgaggtgagtggcatgccaataactttatctgtgatcaaacacagaatggatgatcatattggtcagcatgttcttgtaacttctcaaattgggcgtcgtaagacaaccaaacggcacggaatattgagggaaacatttcatgctgttttcattgttgagttggatccgggaaaatccagcttcgagagggtttcgtatagttatactgatattttaaccaaaaatatcgcagtgaattttgatgatgaacaagtcgattagtatgtttacctatgtctaggggcgagcgcaagttggaatttgtgtttggcctttttttctgctctttttgaatattgataatgatgcattagtcactgacaagtacgatataatttagtataattttgttaattatggtgtgtcacatttagttaaacatgattgatgtgttaaattgttttaaaaagtgcacgaaaagaggtgtcgtcgttgaaaataattgttcgagcgccggcaaaactgaatctcagtttggatacaccttttacgcattcggatggatcaattgagtggcgaatggtcatgacttcaattggtttaagtgattacgttcaggtagaaactaacgataccaatacaatcaaggtttattccgatagcggatttcttccagaagataatcgaaatctggcgtataaagctgcccaaatttttctcaaagaaacccggattcaaaccgggttaaaaattttaattgaaaaaaatattccgatagctgccggactgggtggtggttcatctgacgccgctgctgtgtttaaagcgctaaacaatctttttgacgttggcttatcacttgaagccttggccaagatggggcttcaagtcgactcggatgtgccgtactgtatttatggcgatactgctttggtaagcggtcggggtgaaatcattacgcccttaaataagcttcccaagatgtggtttattttggctaaaccacacgttagcgtttcaacgccgcgtattttaaaaaagttggctaggacgcctgtcattcatccgaatacagatgagcttttacgaggtattgcggataatgactattccgcgattatttcaaatatggggaatgcattggaagcaatcacgatagccgagcatcctcaaatattgactttgaagcaacgactaatcagatatggttgtgatggctcacaaatgagtggaagcggaccaaccgtttttggcgtttgtcgtactgaatcacgggccagaagagtgtataatagtatttcaggcttctgtagtgaggtttatttaacacaggttacttcagaaaaaattaatcaatagtcttgataatagataaaaaattcaaaaatgaattgctttataaaaataatttttgttaaagcaattcatttttatttggaattgaattgagaaaaagcattttttattttacactgtaacagtaataattactttttacaaagcggaggtaatcgtttgagtgacacattaatttcagctgaaaacttatcattgagttttccgaatcatcaagtgctttcaaaactaagtttcaaagtaaatcgtggagattttttaggcgtgatcggtgaaaatggcgttggaaagacaactttggttcgccttattttaaaacagcttcggccgtcttccggcaaaataatccttaaagaagggttgaagattgggtatgttcctcaatttagaaacatcgatgttgaatatccactttctgtcagagactttgtttcgttaagctataccggtattaagttaccctggctttctaaaaaagaacgaacacgtgttggagaagtcatgaatcgggtcggtctgacagccatttccgatcggccgcttggattggcatccggtggtgaaaaacagaaggcatatcttgcccaagcacttcttaatcatccggacctgcttatcttagatgagtcaacggctagtttggatccaaataccaaaaaagaactgcttgatgttgtgacgatgcttaataatgatatgggactgaccattctgtttgtttcgcatgacatgcagctgatccatgaatatccagatcgctatctttggcttcgcagagacggatacagtaccggggccatttcagaccttcataatgattcaaagggggagttgtatgtttagttttgaatttatgcagaacgcctatcttgccggaacgttaattgcaattgtcagtggcattatgggcgtttttgtcacagcccgaaatatgccatttatgacgcatacactttcagaaatcgggtttgccggcgcagcgtttggaatttttattgggtggacgccactaaacgggatgctgacgtttacgacaatcagttcaatccttgttggggaactgagtgggaaagttgagtcccgaagagaagctgttattagtgcgatttccggtttctttattggtttaggcatcttatttctgtcactttccaacaaaaattctagttatgcgactaatattttgtttggtagtgttattggaatcagtcgccaggatgttttacaaatggttgtgttatctgtcattgttttattaattctctttgttatttttagaaacttgaaggatgattcctttgatccggtgggagcacagaccaaccatgtgcatagttcactcatttcaattatttttttggtattattggcttttagtgtgagtgttgctgcccaaattgttggatcacttctaatctttgttttgttaacactgccagctgcaagcgctaagtattttacgcatacggttttaaaaatgatgatgctgggtattgcctttgcgttgttcggagtttggtttggattatatttggggtacgtgacaaattggccggttactttctttattgcgacaattgaagcaggtatttatgcgatttcattggggtataattacttacaaagcagaagtgagtaattatttatcaaaatgctaagaaattgatgataatttcaccaaatttccctaaacccgaacatttatgataaaatcaaatagatattacataaactagaggtgggagaattgaaagtacgaagaagcgacagattgattgatatgactaggtatttgttagagcgcccgcatacgttggttcctttaacattttttgccgaccgttatgattcagcaaaatcatcaattagtgaagatttaacaattttaaaacgaacatttcaggcacgaggaaccggactcttggaaaccattccgggggctgcaggtggtaccagatttttgccttatattttaaaggaagaggcgcagcaggttgttggaaaattaatagacgaaatgtcctctgataaacgctatttacctggaggatatgtgtatatgtctgatttactgggaagcccagcaacgcttcgacaaattggccgcatttttgcaacccagtatttgaatcaagatgtcgatgctgtgatgacaattgcaaccaaaggtgttccaatcgcccaaagcgttgcgaacttcttaaacgtcccctttgtcattgtccgacacgatactgaaatcactgagggttctacggtgaacgtgaattatgtttctggatcatcaacacgaattgagaagatgtcattatcaaaacggagtttaaagccggattcaaacgttttgattgttgatgactacatgcgtggcggtgggacaatcggtggtatgatttcaatggtcgaagagtttgatgccaatttaattggtgttggtgttgtggctgaaagtacggttcaaagcggccgggttgttgaagactatacatcgctcatgcgtgtcgatgcggaaaataacacggttgtttctcaagctggtaactatcttgagaagatttttaattaaaatggctcactgaggagaaattagaatggcaacaaaaaatacaatcatattagcagccggtaaagggactcggatgaaatccaaactctataaagtgttacaccgactttgtggtaaaacaatggtagaccatgttttaacgcaagtagaaaaagctgatatggataatgtcgtaacggtcgttggatttggtgctgatgcagttcgggataatcttggcaaacgaacgcaatatgttgttcaagaaaagcaattgggtaccggacatgctgttttgcaggcggaagaccttcttggtaaactggatggcatgacgatggttgttagtggtgacacacctttgtttacggctcatacttttgaaaatctgtttacttaccatgagaataaaaaggctaaagcaacaatcttaacgtcaaatgcacctgatccgacgggatacggtcgaattgtcagaaacaatttaggaattgtggagaagattgtcgaacaaaaagatgcgtcgactgaggaacaagccattcatgaaattaacactggtgtttatgtattcgataatcaggcattgtttgaggcactgcataaaattaataacgataatgcccagggcgaatactatttgacagatgttatcgaggttcttaaatcagaaggagagactattgcagcttatcaaatgtctgattttgatgaatcaatgggcgttaatgatcgggttgcgcttgcacgggcaaccaaaattatgcagacgagaatcaatcgtcagcatatgcaagatggtatttcgatgatcgatcccgaacggacttacattgatacagatgttaaaatcggttctgatacagttattgaacctggagttcagctgaaaggctcaacgacaattggtcatgactgttaccttggtgcaaattccgagattcgcaattccacaattcatgatcacgttacagtgacatcttcacttattcaggattctgaaatgctggattattcggatattggcccaaacagccacttgcgtccgggtgctctaattggcaaacacgtccatcttgggaactttgtggaagttaagaaagcttcaattggagagggcactaaagttggccatttaacttatgttggaaatgctaaattaggcaaaaatatcaacgttggctgcggtgtcatttttgttaattacgatggggctaaaaagcatgagacaactgttggggatgatgcctttattggaagcaattctaatttgattgcacctcttgaaattgaggatcactcctttattgctgccggatctacaattaatcgaccggttaataaatatgacatggcaattgctcgttctcgacagactaataaaccgggatatttcaagaaattaccgtatcaaaaagattaatactgatttttccgcctgaaacattgtataattaatttagaaaaaacaatatggaggatcatatggctcggcaatattttgattctaaactgaaaatctttgcactgaattccaatcggcctttagctgaaaaaattgctaaaaccgttggcgtaccgcttggaaagacatctgtcgatcgttttagtgatggtgaaattcggattaatatcgaggaaagtattcgcggcgataatatttttattatccaatcgacttcagcacctgttaatgataatttgatggaacttttgattatggttgatgcacttagacgtgcaagtgctggcaccattaatgttgtgattccttattatggttacgcacgacaggatagaaaagcacgttcacgtgaaccgattacggctaaattagttgcaaatatgattcaaaaggacggcgttgaccgcgttgttacacttgatttacatgcagcgcaaattcaaggattttttgatattcctgttgatcatttaatgggggcaccattgcttgccgatcattttatcaaggaaggatttggcagtgatgatgttgttgtttcaccggatcatggtggtgtttccagagcaagggcattagctgaatttttaaaggcacccattgcaattatcgataaacgtcgtcctcgtgcgaacgttgcagaaattatgaatattatcggtgacgttgccggtaaacgttgtttgatgatcgatgatatgattgatactgctggaacgattacattgggtgcacaggcattgattgatgccggtgctaaagaagtatatgcctgttgtacacatccagttctttcagggcctgcaattgaacggattagaaaatcaccaatcaaacaattagtggttacagatacaattcaattacccgctgataagcaaattgacaagattcagcaagtatcagttggtccgttaattggtgatgcaataaagagaattaatgaaaataaaccggttagtccattatttaataatcgatttcgtggtgataatgattaatgaatgatttaataaaacagaagcctgctacaatgggaattgctctcgctgctattattaacttggtaacgattgttattggtctgccgatgatgggaattggaaatatcgattttttggttggcttgtttctgttagtactggcctctatttttatcgtcggatcgggacatttatttaccggatggcggttctcttttagaaaaaagagtgatttggaagcagagaatgcaccaaagcatccagcggctaaagacgttgcttctattaagaaccaaccgattaaggttaataagtatgcgcatttttgtttgcgggttggcgttttcttaattgtgttgggaattgtattaaccagtattgccccttaggtggtaggttatgacaacattaatttaatagattatacaaaaaaagactagaacaagttttgctccggtctttttgtgtgacaactattaacaatagagagacgaatgctaagcagtctatcaaagaatccattttttaatggcataggcaacgccattttcagcatttgatttcgttacaaaggatgcggcctccttgacgtcatcgataccgttttccattgcaacacctaatcccgcgtatttaatcatggttaagtcatttccctgatcgccaattgccatgacattttcagcggaaaagccaagatccgttgccagtgcgtgaagggcgttacccttactagcttttttattcatgatttcaataaagaatggttcactttgaacgacatacatttgatcccgtaggctttgtggcagctgattgtttgcagtggtaatcagtttcggaaagtcgacaaacattgcctttgaaatgaccaagtcaggtttgatttcttctggggttctgtatttgattggtaaacggacaagataactttcaccaacactataagggcttaggtctcgattaaaagcatagattgcgtccattgtttcaaattggtagtggacacctaattttctggcgagcatttcggtttccaaaaactcatcataagttagtgtctgatgggtaatgactttgccatccaagctttgagacattgcgccgttaaaagtaatcgcgtattcatccgctccgctgatagacaaagcatctaaatatggtttgacgccgcttagagggcgaccggtacaaagaacaaccttaatgcctttttgacgtgcggcggtaatggtatcgattgttggttgggcgagatgatttttttcatttaagagggtgccgtcgatgtcaattgcgattaatttgatatccataaaaaagttctcctttaagctttaattgattaattttccgtttcggatgtggctcttaaattcttcgtattcgggttcgaataaatcaacgtttttttccggtcgaaggacttcacgagggaagaagaatcgattatctcccgtttgacgatcggaaattgcagttacaagtgggctaactgatgaaagatcgaccaagctgccatcgtcctgcatcagttcgatttgttttttacccggtgtataagcatcatagggcagatcgaagctgttatccgtagcggtataatattcgggattgaagccggattgttcaatgatttcacgtaagcgcggcagcaagttttcggtgcttttatcgtacttgactgattttaaaggcttacgatcaataaatcttgttgccaaactgctgagtatatcatccggataccgtttccagtgaatgaaataagtgtttaaaacaccatcatccaactgaagataatcgtccagattaaagtctccgcgtaaaaagggtaataacaggtaaggcgttgacggttcattttgagtagttgctccaaataagactctggcacgcttcaaaagcctgtttaaaacgacttccatcgcacgtgagacgggatgaaagtagacttgttggtacatttgaaagcgactgacgatatagtcttcgacggcgtgcataccactcatttcaaaacagatgccctctttataaggccgcataacttcaaggatcctcgaaagatcaaaagtaccgtatttaacaccggtattgtaagcatctcgcaataaataatccattctatcggcatcgagttgacttgaaatcatttcaacaacctgtctattgggataggttttattgatgacacttgcaacctggcgcgggaaatccgggctaattcgttgtaagacatggttaatttcagttgactctgacgtaataatgtcttgggtaatctgttcgtgatttgtgccgaaaatatgctcaaacgtgtgagagtacgcaccatgaccgatgtcatgaagtaatgcggcacacagaacaactaattcttcggaattatcccataacccatcgccaggacggatagaaggaaaattcttttgaaatgattcagtgatccgtcgcgcaatttcataaacacctaaagaatgtgcaaagcgtgaatgctcagcgccgtgaaatatgagtgatgttgttccaagttgatgaacgcgtctgagtcgttggaattcagttgtattaattaaatctaaaatgacctgatacttaacgtagacgtagttatggacgggatctcgaaatactttctcccgctttagttgctgatgtgcataatccaaaaataagcctccatggaaaatttatatgagtggtaattgttggtttcgcagctgaatctttcttaattgttttttccgtaagtcaatgaatgtgtcggaacgaaaaagctgagcttgactgtccagatccaaagacatcatttgctgactgacactctttaaaaagtgttgctcaaccgtcagaagatcaatatttggaaagccgattttttcaacagttgtcattgttgttttatcgactttgggaaaggcccaacgtgtttgtgaataagcatctcctgcttgatagaattccgaaacaacattgcttcgggcatcttgatcgccttcaacgcttagatacaacattaatacgacggcaccttttgaacgacgttgtgcaattccggcaattttttgaccattgacacttaaatcatatttaccgggacaatatgaatgagtgacctcaaaggtttgaatagataatgttggaaaagttgccatcattaaatctgcgataatgtcgtaagaatcgtcaacgtcaagttttcgatctgcgtccggaatgaagagtgaaatgtttaatacacccgggtcactgataacggcaagaccaccagaattgcgtaaaaagtaatcgtacttattggcggtgagattttgaaggccagctgttaaatttggcaaatgacggtcgttgattcctaaaattaaggttggctgatctgttgtccaaaaatgaataaaaggtcgttgaaattgatcacaataatctaataatgcatttgtatctgcgaacgatattaatttatttgccggtgagtaagcttgcttaatcacggtaatcggcgtattggtaaaagacatttttccacctcattttacaaacaataacacaattaattataacagaattcgttccttttttcgctttacccgctatacttgatataatggttgtgagttaaaaaatgtgcataaacgtattgatggttatataataaatcgttagaccaagaaggattaaagaaggtgcattatggataatttagcaactggcgttccggttcaaatccaccttgaaacaaatattttacagaacggtgagacatcaaactttgtgtttgatgctaccggtcagttggttcgagtgggaacttcaatttatattcgttatcaggaggaaacggatgacggatcagttccggttacaatcaaactaatggaaaatggcgatgttaaattaacaagatcagcagggaatcgactgcaattgattttttctgccggcaagcgaattgcagcgcgttatgcaacaccatatggacaacttgaggttcagacggtgacgtcttctcttgacatggagattctcaatcaacccttgcgtggtaaggtcggaattgattatctgctgtatgctggaagtgatttattagggaagtacaatattagattgcaatttacaatttaatcgggtatagtagtttttagactgttgaaaggacgtgtaccagtttggaattagaagtctttaaaggccaaaataaaagtgaactatcgatgattgaagttgcccatgcaattttagcaaaacgaggcgacactatgccgtttgctgatcttgctaatgcggtacaagcttatttaggtgatagtaacaaagaaattcgagatcgcttgtcgcaattctatactgatttaaacgttgacggtagctttatttcacttggtgataatctttggggcttacgaacatggtacccatatgagtcaatcgatgaggcaactgtccacgctgaggatgaagatgaagatcgaccaaagcgcaaaaagcgtaaaaaggttaacgcctttctagccgatgcatcggatgatgatgacgtgatcgattacgatgatgatgatcctgaagacgatgacgattttgacgatgatgataccgaagatgacgatgatgacgaagatactaccgcatcttcagaagacctcggtaaatataataaagatcttcaagatattgaagataatacagatgatcctgacgattccgatttacctgatggcatcgaaggtcagttaaacgaactcggtgacgatgatgatgattttgacgatgatgacgacgatgacaatgataactttgattcaaagaaaaagtaattaagtcattgatgattattcttgactaattgtcttaatgtatgtattatgttttttgggctccttgagatttcaaggacatctgaacgatgataaatagttccctattcataccggatagggaattttttgttttttcattccccggctaactattaagaggagaggattatataatgaccaaatatatatttgtaactggtggcgttgtttcatccttgggtaaaggcattgttgctgcatccttgggtagattgttgaaaaatagaggattaaatgtcacaattcaaaaatttgatccgtatatcaacgtagatccaggtaccatgaatccataccaacatggtgaggtttttgtcacagatgacggaactgaaaccgatcttgatcttggccattatgaacgattcatcgataataatctcaataaatattccaatgtcacaactgggaagatttatgatgaggttctgagaaaagaacgtcatggagattatcttggtgcgaccgttcaagttattcctcatattacgggaatgattaaggaaaagattatgcgggccgctaaggtatctgatgctgaaattgtgatcacagaaattggtggaacggttggagatattgagtctttgccgttcttggaagcaattcgtcagatgaagaccgaggttggcgatgaaaatactttctatattcatacgacgctggttccttaccttcatgctgctcatgaaatgaagactaagccaacacaacacagtgttaaagaactacgcagtttgggtatccagccgaatttattggttgttcgttcagaaaaaccgattacggattccatgcgtaaaaagatttcattgttctgtgatgttaaaccacaggctgtggttgaatctttagatgtaccgacattgtatacgattccgctaaatctccaaaagcagggaatggatcaacaaatcttggatcatttcggtatttcaaagccggcagcggatatggaagagtggaaagagctggaacaccatgttcaacacttgaagcgaaagatccatatcacacttgttggaaaatacgttgggcttcatgatgcttacatttcggttgccgaagcattaaaacatgccggctataaagttgatgctgatatcgatttggaaatgttggattctgaaaagattacgcctgaaaacgttgatgaacttttagctccggcagatggcattattgtgcctggtggctttggtgatcgtggtattgaagggatgattacagccattcgatatgcacgtgaaaaggatgtgccgttcctgggtgtttgtcttggtatgcagatggcatgtgttgagttcgccagggatgtccttggggataaggatgctaattctacagaaatgaatccacgaacacaacataatgtcattgatttgatggctgatcaggaagatgtccatgatatgggcgggacacagcgtttgggtgcttatccatgcaaattaaagcccggaacagtcgcagcagcagcttacaacaatgctgatgtcatttcagagcgtcatcgtcatcgctatgaatttaataatgcttatcgtaagccgatggaagacaatggcatggttatttctggaacgtctcctgataatcatttggttgaagttgtggaaattcctgcaaataaattctttgttggttctcaataccatcccgagtttatttcccggccaaatcgccctgaaggattgttcaagaattttgttgcggcagcaaatgaccaatatctttcaaaaaacaaaaaataatttttaatatcaaataataaaaatggttaactgacaaggcgatgtaatccttcagttaaccatttttgttgttcacaggtattttaatatcaatgtcgcaatcgaaacatggtacactattcttaacgatcatttaggcattcagaaattgtttataatgttacaaattgtataattcaattgagggtattgtattttacagttattttctataatatgtttcatgacatgaaaaatgttcgaatggaaaaagtgaggaaagtttcgatgagtaaattaatagtcaatggagggaaccgcctttccggagaggtatcgattggcggagcaaagaacagcacagttgcactaatccctgctgcaattttggcagataccccggtaaggttcgactcagttcccgacattttggatgtacacaatttaatgctgatattaaaatctatgaatgtatcgtcaactttcaagggcgatattttaacaatcgatccaactaatatcgttgaagcaccattgccaagcaaagcgataaaaagtttaagggcatcatactactttatgggcgcacttcttggcaggtttcaacgtgcggttgtcagtttccccggtggtgataatattgggcctcgtccaattgatcagcacattaaagcatttaaagcactaggtgccgaggtcagtgaagttgatggtacagttactatcaagacggggccagacggtcttcacggagctcaaatattcttagacattgtttcagttggtgcaactattaataccattttagcgtctgttaaagcgcctgggaccaccatcattggtaatgctgctaaggaacctgaaattattgatattgcaacatttcttaataacatgggtgcaaatatccggggtgccggaactgatgttattcgaattgagggcgtcccaacccttcaagcaaaaaacacgcatacaattattccggatcgaattgaagccggcacatacttatccttggctgcagcaatgggggatggtgtgttaattactaatattattccagagcatttagaatcttttgtcgcaaagttggaagaaatgggctgtgacttaacagtatacgaagatagcgtttacgttgggccatcccacaatttgaaaccgattcaaattaaagtgatgccttatccgggatttgcgactgatttgcagcagccaatcacaccgctgcttttcaaagctgatgggcaaagtatgattattgacacaatatatcctcaacggatcaaacatatttcccaacttaataaactaggtggcaacattaaatccaaagataccgaagaggggattattgttgtgaataaatcaccgcatctaacaggtgccaaggttgacgccggcgaaattagagcaggggcttctcttttgatagctgggttaatggctaatggcacaaccgaaattgcacatgctgaaaatattatgcgcggttatggcagtctggttaacaagttaaccgggttgggtgccgatgtgaaattaaaaatagaagatgaagaaagagtttaaaagatgattgattggtataaataattgtggtaaactaacaaggttgactaatcgataatctctgggccatcgtattggttcagggcaaaggagcgatatattatgaaaaagggaattcatccagattatcatcaagtagtatttcaagattcaagtacaggtttcaagtttttgtcaggatcaactaagacctctgatgaaactgttgaatgggaagatggcaacacatatccattgattcgtgttgaaatttcatctgattctcatccattttatacaggtaaacaaaagtttacccaagccgatggtgctgtggatcgtttcaacaagaaatacggcctcaaaaacgactagttttattagcgagacacattgtgccccgctttttttataccctttttctgaatttgagaataaaaaaagtgagactgaataggttactttttgtttcagcctcaactctgtgtctatcattttctaatgatttgatattatttatctaaaggctaggcacgattctttcgcataacccgtgtattgttgtaaactaaaatcaggttaagtacgacaagaactgctgtagaaataaacacgccggcataatcaaattctgaagaaatgacagaaccgatcattggaccagcgacgttccccattgcctgaaatgactgattccaactaaacacgcgaccggtgacctcaaacggtgtatttttagccaaaatagcttggactgccggcaacattgatgcgtttgcaattccgattaaaaagcgtagcgcgattaactgccaaatgtttgtgacaaaagccattggaatataaacgacaatggctaagaaaaagccaataataataatacgatccgtcccaattcggtctcctaattttccaagcattggagcggctactaacgtggcaattcccggaacggctgcgacaataccactataaaaggttgttgtcgcactattatgcataatttgacgaacgtataaggccaaaattggtgcaattgaattgttggcagcttgaataatcattgttgttataaacatgccgaaaaccagtttggaatttgtcagacgctttataacacctcgggtgcttaacatcattgttttggcaactggcttgaagtcctcgtgaactaaaaagagcgttaaaaagaaaacggataacagtaagaatccggtaatgaagaaagtaacccggtaactaaaaagagaagccaaaataccaccaagcagtggaccgagaagtgttccggaaacgtttccggttaccagagtcccaagtgcctgaccgcttttgcttttaggaacttgagttgcaattagtgcgttggcattactgatatatccggagaacacgccttgaagcagtcgtagcccaataagctcccaaacatttgtaaccaatcccattaagaaaaaaacaattgccattccagctgaagcacgaaccaacatcaattttcgaccggtgcggtctgctaattttccccaaaagggagaggcgagagcagtgactaagtaggttgctgcgaacgcaaatccactgtataaacttagttggtcatgggaaaaatttcccaatgtgtcgacgtaaagagataaaaatggcatgacttcactaaagccaattcccgccatgaaagtgccaaaccataaaacggttaggtttttgcgccatgaattcggatgatcatttatccttgccaatgcatttcctccttagtgtcaatgaatttgataatcgcttagtccacccaatttcgggagataaacatgaaaaaaatttactcaaaaaaagtatcattaatattatttttgggctactggtcatagttgccctggttcttatttttaatcgccccattaaaaataaggtgatcgggtcgtatcaacctaaggttacccgtcaagaggttgctgccacaaatcgtcgaactcagaaaaaaagtaaacggcatcaacaaaatgtcagttataactttaaaaaagtaaagtccctagattttgaaacagcacttagatcacggctgaattcgcaacaaattgaacaggcagggcaaatcctaattcctaaatctggtattcatctgccaattggtctgggggtttctaacagtacgctggcccttgcagctgggacgatgagagccaatcaaaaaatgggaaggggaaactatccactggctggtcatcatatggttaaccgaaagatcttgtttggcccattatactttaaaacacgtgttggtcagactatttacttaaccgatatgaacagggtttatcaatatcaggtgtatcaacgtgcctttattgccgcaacacgcgttgatgtcattaagcaaactaaaaaaccgattgtgacattggtgacatgtgatgcgactggcaaaggtcgactattgattaggggccggttggttaaaacttttaaacttagggatgcaactcaaaaaataaagcgagcccttttgaggcccgccaatagttaatgcagatttgatttaacgtaatctaaccatttgggtaatgcgcgtgacagttgctgataagttctaccaaatttatgatcataccatggatctggaatatcttgaccagcttctttttcaacaatatctaaacagagatgaattttcttttgatcggacgagtcggccatttgttttaaataataaatattctggctatccataccgataataaggtctgcccaatgaaaatctgcggttgtgattggtcgggaacgaagatttgaaatatctaatccatgcttggccatttcagcttgtgcaccggggtggggttgattaccctcttcttcgtcactaattcctgcagagtcaacattgattttagcttgtagattttggtcactgattagttttttaaataatccttctgccattggcgagcggcaaatatttcccagacagacaaataaaacgttagtcattttaacaacctcaaattaatagtatattaacattaatcataccaagtattatcttaaagggcaaacttatcaattttgaataacgcaagacaggagctttaaaccggagtacaataaaattgaaacatcaagatggagaaatgaacgatgaagggtaatttcatatttattaatactaatccaatttcaaacatgattttatcttcggggattacagctgctgattacgtcaatgggctggacgaacttccggataacatcatattgcttaatagcgatgaagatgcagcaaacgggtataactcccactctagatttaatttgattacaggagcaggggaaattaggcgttacctgctaagaaacccatctaagcaaaaaaagtttatagattttaatgatgaggacagtgttaacgggctgtctccctttgaaattgctgaacttctttacttgggtcacatggggacgccaatggggcgaccattttcctctaagctgttaaaccattacatttatcttaacttgggaaatggtgcgacaagaacctattaccgtcgcttttctgatgttaaccatgttttggagatcgctttaaaacgcaatttaagagaaattcataatacgttgcgggtctttttacggccattggctattaaagacgttgataactcgattttaatcaagttaattacacgcgcaaatgacggactctttattgtttttggggcacttcgtgaaaaaaatcgggtttatcatattcctctaagggttttaaaggatccggatcaggtctcgattattttaaaaactaaggagattgaaatcaatactgactatgttggggatttaacttatgatcttcaacactcaaagtgggatttacaatggcacagtcaagcgacggatgtttagtcgcttgttttttgttataataaaagataattatatttttatattggagcgctaaaaaaatgaagatgacgattggtgaaattgtcaaggcaattaatgccagtattgaaaatgaaactgacaaaattttgcaaaccgaagtgaatggtgtttgttttgatacacgtagactgacaccgggccagctttttattccattaagtggcgcacacgatggccatgatttcatagagaatgccatcaaaggcggggctgtcgcaacgctttgggcaagtgatcatactgatcgattaccggttgctatcccggctttggtcgttgatgatcccttggctgcctttcaaaaattaagcaagtattatttgacaaaaatcaatccaagggtgattgcggttactggaagtaacgggaaaacaacaaccaaagatatgattgcttccgtgttgtccggggaatttaatgtgaccaaaacatatgataactttaataatgagatcggcgttccttataccatcttacaaatggagtcaaatacggattttttggtggttgaaatgggaatggatcgaccgggacaacttgattttctatcgaaattggttgaacccgacgtcgcaatcatcaccatgattggtgaggctcatattgaattctttggcaccagagataaaattgctgacgccaaaatggaaattacccatggtttaaaagcggacggctactttatttatgatggtgatgaaccgttgttaattgaacgtgccaaacaggtggatttctccaagatgacatttggccgaagccatacagatgatgtatttgcaacaaagacaagtgatgggcaatacaacacttcttttgaagtgaatttgtggccggataagaaagtgacaattccaatgatgggggactataatgttaacaatgcgttggctgctattacagtaggcaaattgtttcagattcctcagattgagattattcaaaagttgtcgcactttgatttaactaaaaaccgtacagaatggctcactggtaacaaaggtgaaaagattttgagtgatgtctataattccaatccaactgcggcaagggaggttttgactgcttttagccaaaccgatgttatgggacgccggattgttgtcttgggagatatgttggaattaggtgataaatcgcctcaaatgcatgcgtcactagcaaatgacattgattcgaacgaaattgcagctgtttatttggttggcaaagatatgcaggcgttgtatgaaaaattgaagccggtatttgcacctgaaaatctacattactatcaagcagatcagcttgatcagttatctgatgatttaaaaagggatattcagcccaatgatgaagttatgctaaaggcaagtcatggtattcaccttgaaaacattgttgagaaattgacggcttaatcattgaaagatgagttttccttgcgtatttaatgtaaacgatgtaaacttaataagttactttttgaaaagtagatatattttgaaaaagaagctatattaatttaaagaaatctagtcaagtagttaacgcattacggaaaacggacttttttcagttaattacggaactgttactgttccaatttaggaggaaacatatttgaagtttagtgaattaggactatcggacagcttactttcagcaatctcaagcagtggttttgaagaagccacaccaattcaagctgagaccattccaatggttcttaatggagaagacgttattggccaggcacaaactggtactggtaagacagcggcatttgcattgccgatcttacagcatttggattttaataatccaaacgttcaggcattgatcatttcaccaactcgtgaattagcaattcagacccaagaagaagtttatcgacttggcaaagacgaaaaagctaaggttcaagttgtatatggtggtgctgatattcgtcggcagatcaattctctgaagagtcacccacagattattgtcgggacgccgggaagaatcttggatcatatcagtcgacacacattgaagttggagcacgttaagacattggttcttgacgaagccgatgaaatgttaaacatgggcttccttgatgatattgagtctattatcaagcaaacacctagtgatcgtcagacccttcttttctcagcaacgatgcctccacaaattaaacgtgttggcgtgcagtttatgaaggatccccatcaagtaaaaatcaaggccaaagagttgaccacagacttaatcgatcagtattatgttcgggttaaggaatatgagaagtttgatacgatgacacgattctttgacgtacaggatccagaagtaacgattgttttctgtcggacaaagcgtcgggttgatgaagtttcaaagggactcgaagcacgaggctataatgctgcaggcctccacggcgatttaacacaggcacgcagaactcaaattatgaatgagttcaaacaaggtaaagttgatattctggttgcaaccgatgttgctgcccgtggaattgatatttccggtgtgactcatgtttataattatgatattccgcaggatcctgatggatatgttcaccgggttggtcgtaccggtcgtgccggaaaacatggtgtttcaattacatttacgacacctaatgaaatggattatctgcacgaaatcgaaaagttgaccaaagtgcggatgctgcctttgaagccgcctacagaacaagaagcctttgtaggccaattgaataatgctgaatctgatattggagagttaattaaacgaaccaatactgaaaagtatgaaaaaatggctgataagcttttagacgagtatgaagcaactgatttggttgctgctttgcttaacgatgtgactcgtgattatgttaaagttaaaattacaccggaacgtccattatctcgaagacatcatggtagtggcggccgtcgtaacagcaataatcatcgtggtggtggtcattggaataatagacgtaacgatgatcgtaattcctcacgaaatcggaatcgccgtagtaatggtggtaaccgtgaccgtaagagaaaagatgatcgtcattcgaacagtaaacatcgatttacgatcaaaaacaaataagctcgatatcgttaaattgagccgttagtaaaagctggggcaaagacttttttgttccggcttttattacctacatagagaaatatggtattattaattgtaactttgttagtttgtgaggactttatttatgattgccggacttggtattgatattacagatatttaccgcattaaagcggctattgcccacaatgcccattttgtggctcggattttaactgcgtcagaaatagaacaactgactgatttttctgagaaaagaaaagttgaatacattgccggtcgtttttccgctaaagaatcttattccaaggcatttgggtccggattgggttcagccgttcgctttcatgacctgacaattattgatgattcgaaaggaaagccgattgtgttggaacatccctttaatggtaaggcctttgtttcgatatctcatactgacgacattgtgatgaccgaagttatcttagagagagtagaggataaaaaatgactgttggaactttgcggaacgcaagattaatcattaatcaaaaagcaatttataacaacgtcaaaaacgctgttacacatactcaatcaggaacggacctatttgttgtagtcaaagcaaacggctacggccatggtgcggttcaggtagccaggattgctgagaatgctggtgctaaaggcttctgtgtggcattgcttgaagaaggattagaacttcgacaagcgggctttactgaaccaattttagtgttggggattacagagccaacttttgcgcccattgcacgcgatagtcatatttcactaacggttagttcggaagagtggctgaaaacagctggtattattcttaatcagcaggattctaaagagaaacttcatgtgcatttggcaatggataccggtatgggaagaattggctttcagacccctgacgaactgcaagaggcaatgctggtattgaaaaagtatcaggatacctttgattttgagggaatttttacgcattttgcgacggctgacagcaaggacgacacgtattttcaataccaatacgaaaattatcaaaaaatgttggcagttgttgacaagaggccgaagtatgttcatgtggccaatacggcaacaagtctttggcataaagtttgtggtgcaaacatggttcgatatggtatctcaacgtacggactaaacccttcaggtaaagaaattacaaggacgccttatacactatttcccgcaatgagttttcaagctggtcttagttatgttaagaaggtgccaaagggtaagtcgatcggttatggggctacttatcaaaccaaagaggacgaatggattgggactgttccaattggctatgctgatggctttcccagaaaaatgcagggattttcagtattagttgatggtcaatattgcccaattgttggcagggtatgtatggatcaatttatgattaaattaccgaagcagtatgggactgatacggtagtaacaattattggtaaatcaggtgcacatgagattaccgttgatgacattgcggatcagttaggaacaatcaattatgaagttgtttgcggttttagcgagcggctacaaagaaaatatgtttgacaatactgctttatttacagtttcatggtatattagaaggtaaagtaatcttggaaaataggggatattacgatggaaaaggcaactaatcacaagcaattttcagttatgatcaacgatcaggttgcagatagattggatcagttctgtacaaacgttggtatttcagaaagtgcagcggttgaaattgcaatcaactatttttttgatgatcctaaagtaattagtggattaatgaacggatatcgtgaaatggcaactctgaatcgtgaaatcagccatgatttttcgtgttgcgaagaagatgctgacgttcatttagcacagtatcgacggagattacggaatttttattaaataaattaacatgatgcgatgatgggaggtgtgagggtgactgacgttatttttaaacgtggagacattttctacgctgatctatcacccgttgtcggttctgaacaaggtggaatgaggcctgtattaattattcagaatgacattggcaatcattacagtccaactgtcattgtcgctgccataaccgcgagaatctcgaaacctaagatgccaactcatgtcggaatatctgccaataatggcattgaaagagactcggttatcttattggaacagattagaacgattgataagcaacgattaaaagataaggttacccatttaaataattcgacgatggctaaagtagataaggcaattcgaattagtttgggattaggcaaaaacgcgtgaaagaccagaatacatatagcaacattcaagaatcattgaatgttactagggaaaatgagaaaaacgcgatggtttatatctctgcttggattattagataaactttcaacgagatgtatgaaaagtatatatagaggcagcaatttatttggcttttaaactaaaatagctgttctttatttgtcataaattttgaaattaattaagaataatgaattagaagtaaatggaacaataaaatcgccttcatgatagttactattgtaactgatagcatgaaggcgattttattgatggtcatatttagcgaagattatttattttcttcttttagattctcaacttccggcacacgaaattcttttcgttccaaagctgcaataattcggttaaggcgatcttggtcaacctccgcgggtaaagtaaacataattcgatgaacgagttcaccctcttgagcatccaaagaaataacacttgcaatattagtatattttgtgatgatttttgcaatttcttcaaggtcaccgcgttcgccacttgaaacaacggtcagaacatagctaccgatattaacattccaagattgtgacagcatgtctagcaatcgggtatgggttaaaataccatagaaatggttttgagcatcaaggactgcaatataaggcaagtccttaatggaaaagaacacttggaagaacgcagaattgacgttaacaaatttggttgcattttttaagagtgtggtaacgggcaatgacatgtcaccaccacgagatttgtgacgataaatgtgcattttgtagatatttccccggaaaatagaacctgtttcatcaagaattggcacacaacgatagcctgaatcctcaaggacttttagggcttcctcaagagtggcgtcctctttaacggtaactagacgttctttaggcttaacaagtgtttttaatagcattttttaattcctccaacttaagctgtatatgattatgataccatagccgcattcagaacagtactaataaaaatgataaattctcattaattgctaaccaaaataccatttggttattagacaagaatgaggttaattatggtcacaaataaagatggcagcaaaaaagaggttgggcaaaatgtcttttatcccaacctcaactcttaatccaaaaacgtattaaagttgatccataccatctttagttgtcttttggagtgtttctgcagaggccttcattgcagccttttccttatcgttaagaggtacttcgatcactttttcgatgcctgaaccgttaataacagctggactgccgatataaacatcatttaagccatattcaccgttcattggtgcgccaacaggtaagatggcattttcatcacgcaaaattgcacgtgaaattctcatcaagcaagtggcaactccataaaaggttgccccttttcggttaatgatttcgtatgctttatgacgtacttgatcttcaatagttgccaaatcatcatctgacaagccggtacgttttgcaacgtctaagaatggttcaccaccgacacgtgcagcggagtatgcagcaaattcagaatcaccatgttcacctaaaatataagcgtcaacggattgtgaactaatgtttaacttcttgctgagagccactcggagtcgagctgaatctaatgatgtcccactaccaaacactttgttcttagggaatcctgagaacttttgagcagcgtaggttaagatatcaactgggttagcggcaaccacgataacacctttgaagcctgaagcaactaacggtttaataattgcctgcataattttcaggttcttattaaccaagtcaagacgggtttcaccgggtttttgaggtgcacctgcggtaataatagctaagtcagcatcatgacagtcttcatagtcaccagagtagacgtgttttggtgaagtaaatacttgagcatcttcaagatccaatgcatcaccaacagttcgttccttcacaacatctacaatgacaaattcttctgcaagaccttgttgcatcatggcgtatgcataggaagaaccaactgcaccgtcaccgattaacgcaactttttgacgttctaaagccaaaataatcatctcctaatcattttttatcgcttttaattataccacatggtagttttgattttcacaaattactttataataatttgattagagggtgatgaatggcgttgcaaggatatacaaagcttgctcaattggtatctagaccaatttgatgaaagacctgtcttgcatggtggtttacctcatttatcgtttctaacaagaaaaaaacctttctgctgctaaaaaatggggcaggttgtcaaaaagcagaacagattaacctgtttcacaacttccctcacgtaacgacaattatgctataatttatgctacaggcttaatttgaagctcaatctgacttgataatttaatgtcaacaactgctgaactaactggttcagccttttgtgttgtaagaatgtgaggataatgatagtaatgaaaatgattgttggtttaggtaacattggaccacagtatgatggtaccaggcataacaccggttttatggtggttgaagagtttgccaaaaaacatggcattagtattaaaaccagaaagatgaatgctaaaatgggatccgcattcgtgaatggtcaaaaagttttggtcgttgaaccaacaacttttatgaatgattcgggaatcgctgttaaaccgctaatgagctattttgaaattgaaaataaagatgtcattgttgttcatgacgatatggacctgccgatcggaaaaattcgaatcaaagataaaggttctgccggtgggcataatggtattaaaagtcttatcaataatttggggactgaacatttttcaaggattcgagttggcattgcgcaccccgacaagaacaatactgttgtgaattacgttttaggccgtttttcgaaatcacaacttccggaatttaaaattgcgactgacaatgctgtcaatgcacttgaagattggcttgacgatgtgaccattcctgaattggagaatcgttacaattagtgaaaggacgataactttgcaattcgatcaattacttactaaaatgcctcagtttacccagattgcatcaaatctcaaagttgatagtcgacagttgatcacaggcattagcggttcagctcggacactcttgattgataacctgcttaagacaacgacgcgaccggtagtgatggttgttgatacgttatttcatgcagatcaactggtcagtgacttttctaatttgctggaagatgatcaaatctttgaatttccggttgaagaaatgggtgcagccgagcttgcaacaagttctccggaatataaagcacaacgggttctcgcactgaataagctgatcagtggcgaaccagcagttatcgtaacgtctgtttccggattaaagcgattgctgccgtcgcctgatcaattttcagatgccgagctaacaattgatatggattcggaatatgatttggaaaagttaaagctgaagctacaccaaatgggctacacgtttcagaagttggtggctgcaccgggagatttttcaattcgtgggtcaattttggacgtatttcccttaaataaccaggatccggtacgaattgatttctttgacactgaagttgattccatgcgactctttgatgtttcaaatcaacgtagcataaaaacaattgataccatccagatacttcctgcaactgatttactgatcaccgatcagcaaaggcaaagggtcgctggtgagttaaaagaccaattagcatctgaaaaagcaaagctggatgatgagtctgccaaaaaaatcaataatgctattgagcctcaaattatggatcttgaaaatgggttaaatgatcctaaatggttattgttcgctaatttattttatgatcagtcaaactcgctgctggattacttgtcagatgacggtgttgtggtttttgacgactattcgagaataacggattctcaacgccaactggaaagtgatgacgatgtttggctgaccgataaaattaaaaatcatgaattattgccatcgacgaattataccaatgattttaaaaagatttttaaagtaaacaaaaaggcaacgcttattctctcactttttcaaaagggcctcgggagaatgcggttagatgcaattgttgatattaccgtgcgaccgatgcagcaattcttttcacaaatgccgatgcttcgaactgagattgggagatggcagaagcaaaaacagtctgttattattatggttcaggatcaaaatcgaatgcaaaaagtggcgcaaacactttctgattttgaaattgcagctacacaaaccgagatgtcggctattttgttacaccaggttcaactggttcacggcaatttagagaatgggtttgaactcccgattgcgggattggttgtgattaccgaaaaggaaatgtttggaacgattgttaaaaaacgtccgcgacaaacaaccttcaataacgcagaacggattaaaagttacactgatttaaagcctggcgattacgttgtccacgtcaaccacggtattggccgttatgaaggcatgaaaacgatggaggttgatggcaagcatcaggactacctgacaatttcttatcgggacagtgccaaactttttatccctgtcactcagttgaatatgattcaaaaatacgtttcttctgaagataagaagccgaggattaataaacttggtggcagtgaatggcagaaaacgaaacgtaaggttgcatcaaagatcgaagatatcgctgatgatctgattgaattgtatgcaaaacgggatgcagaaaagggctacgcttatccacctgacgattccctacaaaatgaatttgaagcacgttttccatatacggaaacgccggatcaattgcggagtgccgatgaaatcaagcatgatatggagcacaataaaccaatggacagattgttggtcggcgatgttggatatggtaaaaccgaagtggctttgcgagcagcttttaaggcagtcgaggtcggtaaacaggttgcctttcttgtaccaacaactattttggcacagcagcattatgaaacgatgcttgagagatttagtgattatccaatcgaagtgagggttctttccagatttcaaacgactgctcaaattaaggaaactttggaaggcttgaaaaaagggactgttgatgtggttgtcggaactcatcggcttttgtcaaaggatgttaaattcagtaaccttggtttactgattattgacgaagaacaacgatttggtgttaagcataaagagcgaatcaaggaaatgcgtacggatgttgatgtattgacgttgacggctacgccaattccacggacgttgaatatgtcgatgatgggtgttcgagatttgtctgtgattgagacaccaccttcgaatcgttaccctattcaaacctatgtgattgagcaaaatgccgggaccatccgtgaagcgattgaacgggaaatggctcgtggcggccaagtgttttatttgcataatcgggtagcggatattgaaaaaacggtttctcaattaagtgaattggtcccagatgcgagaattgcgtacattcatggacaaatgactgaaaaccaaatggaagatattttatatgattttgtcaatggtgaatacgatgtcctggtgacaaccactattattgaaacgggagtcgatattcccaatgtgaatacattgtttgtagagaatgccgatcatatgggcctttcccaactttatcaattaagaggacgaattggccgaagcagccgggtagcgtatgcctattttatgtatcagccaaataaggttttaaccgaaattggtgagaaacgtttggaagccattcgtgattttactgagctgggatccggttttaaaattgcaatgcgggatctttcaattcgaggtgccgggaatcttttaggtaaacagcagtcgggttttgtggattcggtggggtatgatttgtatacgcaaatgttatccgatgccgtttcgaaaaaacgtggcaaaaacgtagtctttaaaacggatgccacagtcgaacttgatcttgaggcttatttgccaagtgattatattcaggatagtcaacagaaaattgaaatttataaaagaatccgtcaaattgaaaatcaagatcagctaaacgaagtaacggatgatctgattgatcgttttggcgattataatgagccggttgctaatttgttaaaaatttccgaaatgaaaatgtacgctgataaagcaatgattgaaaaagttcatcaggacgggccgagggtaacacttacatttgctaaacaggcaagtgaagaatttaccagtaaggaattgttggctgcaattgcgcagaccaaatttcgagcaaccattaatagtgcggacaataagtatcaagttgtgttgactgttcagcccaatatgaaagattggttggaccaaattattgcattaagtaaatcattgacgaatacaagaaagaagcatcaggccaataaggtaacctcaaatgacaaataattcacggcgaaaacaagttttagcagggacttttttgctaacgattgcatcgtttgttgcaaagtttttaagcgctgtttatcgggtgccgtttcaaaatatggttggaaatgttggcttttatgtctatcagcaaatttatccaatttatggaattggcatgacggtggcacttactggactgccgttatttatttcaaagttggttgttgacgttaagaatccagaagaccggattgccttggtttatcgaattcaagtgattgtgaccttcttatcagtcggtttctttttactccttcaatttggatccggttttattgcacaagcgatgagtgatagtcggctggcaccggtcataagggcggttagctggatgtttcttttaggaccgtttttatctacctggcgtggttattttcaaggccaaatggatatgcggcccactgcttattcacaggttattgagcaagtcgtacgcgtgactttcattttggtatcagccggttgggctgttcgacactttgcagatccatatactattggaactctggcgatgctgtctgctccgattgcggggctgtgtgcgttagtgtcagtatactatcatgttgtcagggcacgcctgcccaaatcgagtcatcgacaggtttaccggcgactttttacaaaaatattgtttgaaggtgggacgctgtgcttggtttccgcagtgatgctgctgcttcaattagtagattcattttcggttgtttccggtctccgggacttcggtctttcttttgtcgaagcacaaaatattaagggcatttatgatcgttcccagacgttggttcaattgggaatggttgtgacaactgcatcaattacagcggcgctgccaagtttatcgttggcaaatgtcagaaaacaggatgttacttttttacatctgtcaaagactaatgtacgagtaaatctagcaatatcgatggcgatgagtgcgggattatttgtgctgatgcctgatattaacgggctgcttttttcgacagcccagttaaatttgacgattgctgtgtattgcttcagcattgtactgacaactattattttaacgtacaatatggtacttcaagcacgcggctattatgcaccaacaatgcttgcaattacttgcggctttgttgttaaacttatcattaataaatggctggttgcgacctttggaatcattggggctagtgctgcaacattaatcggactgattgtcatgatctttttaatgaagttgatagcttcccggtatttatcacatttaattgatggcgttcagctaataaagttgaccagcgttttattggctatgatgatagttgttggaggattaagtcggcttgttgacaatatcggattgtttgcacctggtcgcttgcaatcattaatagtggttgtcatttgtattccaataggcattgcgatgtttttctatggttgtaaacgattaaaagttttctcgatacgagaatggtttgccattccactgcttagtaaattgatgagaaggattaaattaagataggttaaaaggtgaaaaaatgagaattgataagtttttaaaagtttccaggattatcaagcgacgctctgtggcaaaagaaattgccgataagggacgtattacgattaatgatcgaattgcaaaatcttcttcggatgtcagtacaaatgacacaattgtgattaagtttggaaataagacgctgacgatcttggtaaaagcgcttttagacacaactaagaaagatgatgctcaaaaaatgtacgagattgtttcggaagattatgagcatgattttagaaacgaataaataaatttattaagaacccttgaattgtatagacaaacgcgcttttgttgttataatttaaaattagaaagtgttttaattcagggggattgaacatggtgcaacaacagcagaaaatcaaaaaattagaaaatgattatactagaaaacgcgagcttgagtttcagacaacgaaagcgtctctttctgttcgtcgtcgacgaagaaagcgggcctgtatcatcttttctgtctttatgatttttgcattaatctttgctgttcaaattgtgagggcaaaggttaactatgcggctgtcaatgttcaaatttccaagcaaaagcaaaaggtaaaaaaagagcaggttaatcataaacggttaactgcgcgggtttcacaacttaatgataaagattatgttgaacagcttatccgtgatcggtattactataccaaacccggtgaaactgtctacagtttcccgaaccaggcgcctaaagatgttaataacggaaacgaataagtcaaataaaattgattattgaataagatatgaaaaaagctggggttgattgatcgttataccccaacttttttgtaccaaaattctcgctggaaaagaaaagttgtgttttacttatattagggaaataaaacagaattaaggtaaacttcattaatctttaatttgttttcccgttgtaaaactatatatgctatactagttgtacttagaactaataggaggaacaatttttttaatggcaattgaagttggggaaaaagttaacggtaaagtttccggaattacaaattttggtgcatttattgatttaggtgatcatcgaactggcctagttcatatcagcgaagtttctgacggatttgttaaagatattcatgatgttttgaaagttggcgatgaagtgaccgtcaaagttttgaaaattgaaggaaataataaaattagtctttcaattcgaaaagcaacggattcgtcaagccatgagggggatcacgaatcaagtcatggcaattattcacaccacaatgaacatgagcatgaaaattctcatgattatcatgagaaccacggtcatcattccagaggcaaccattctagcagtaatcgcggtaatcattctggaagtcatccagaaagctttgatgatttgatgtcgggctttcttaaacaaagcgaggatcgtcttgctacgcttcgtaaaaacacggagggtaagcgtggcggtcgtggtggtcgtcgaagttaaaatgagtgattgatttttaatagttgaaaagctggagcaagaccaaaattggttttgagttcggctttttattttgaattgataagttctgtgtcctacaagaaaggttattataaaccagtgagtttacagcaaaaattcaaccaaatggttcttcaaaataattggtggaagactgatcaacctgttgtggttgcggtttcgacggggattgattcaatgacgcttctttatctattggaacatttggatcaatgttcaccacagatcattgtggcttatgttgatcattgcttacgggaacaaagcaaacgggaaacggtctttattcaacaatattgttctgatcatcacctaaagcttgttcaagcagtatggaatcgtaagcaacatccccaacacggaattgaggcagccgcgcgcgagtttcgttatcgtttttttcgacgcgttttgaaagaaaatcaagcaacggtcttattaacagcgcatcacggagatgatttagcagagacaatgttaatgaaattggttcgtggtggacaaattgagtcattaatcgggattgctgaacaacggccaacttcatttggaagtgttgttcgaccgttacttcacttcagtaaaaaagagattcatcaatttgcatcctcagtgcatatcaaatggtttgaggatgagacaaatcgggatctgaccattcaaagaaatcggtttcgacatcaaatcgtgcccaaaatgaagcaagaaaatcctcggatgcttaaacactttgtggactattcaaagcagttgaaaacattaattgaggttaatcaagaattgatgcgaccaactgcagaggaaattctttcttcgttcaagccagggcgtcagctcactttgagcagaaaattaatgacatcttattcagatgatgttcagataagcctggttaaatttttgattgaaaaaaaactaaagattcaaaatataccgctaaatcaattcgaggaaatccatcgattaatgacaaataccgcaaagccgcaagggacactttctttaccgaacgggtggttatttataaagagctatcaaaaattaacgattgtaaaaaaagtcgacaatcatgttataaaacctaaaaatgacgagcaatttatggtaatattagaccgatggtattcgttaaaggacggatcaaggtttggtgtttttacaacgaaaattttggggaattataagatcaccacattccatttatcagaaaaagattttccattaattatccggcattggcgtaatggggatcgactgagactgaaaaatggtggtcatcaaaaagtgagtcgcgtcttgattaatgcaaaaattccgcaagaagatcgtttagataccaatgttttgatgacatctcaagacgaaatcctagcggtccctggtttgaaaagtgcctttttttccgaaaatttgggaaaagtgttttatttgatcgaggacaaaaaacaatcaacttcagaaagaaaaggaattgacaatgaataacgacatcttaaaagttctttatagtaccgagcaaattgacgaagcctgcaaaaggcttggaaagcagattcaaaaagtctatgctgacaaggtgccggttgttattggggtattaaaaggtgccacttttttcatgtcggatatcgttcgtcaggccgatacttacatggaaattgattttattgatgtatcaagttatcatggtacgacgcaatcttcgggaaaggttgatcttgtgacagatatttcgactgatgtttccggtcgggatgtcttgatcattgaagatatcgttgatactggacggacattaaaattcttgatggataatttaaccaagcgtggtgctcgttctattaaggtatgtacattgcttgataaacctgctggcagacaagtggaagcaaactcggatttcattggttttgaggtcccaaacgagtttgtggtcgggtatggtcttgattatgatgaaaagtatcggaacctaccttacattggtgttttaaaaccagagatttatacaaacaattaatggtcaaaaatagtcaattgtggtagtattttgactatcaacatgaataatttttttgaggaggacgttgatgaactcaaataaaaatgggctttttaaaaatagtctattttacattgtcattttcttactgataatgggtgttatctactttttcaatggaagtagtacaaatacacagtctcaggaagtacaatcaagccaatttgttaaggacttgaagagtgacaaagtaaaaagcttttcaattcagccttcaggcggtgtttacaagatcactggccagtatcgacaaggtcaaaaggctaaagtgaatagtggtttcttggttggcggcaatcaaagccaatcaaagaatgtcactaaattcacgacaaccgttcttgagaataactcctcaattgctgaaatcaccaaggctgcgcagtctaatgatattaagatgaatgcaaagcctgaagaatcaagtggtttttgggtaaacttattagtttatgtcttgccactgttactgtttgtttggttcttctatatgatgatgggccgtgctggcggtcagggcggtggaaacggcagagtgatgaactttggcaaatccaaagccaagccagccgatagtaagcaaaacaaggttcgcttctcagatgttgctggtgaggaagaggaaaagcaagaacttgttgaagttgttgagttcttgaaagatccgcgtaaattcacaaccctgggtgcaactattccacatggtgttttactagagggacctcctggtacaggtaaaacattgcttgctaaagcggttgccggtgaagcaggtgtcccattctattcaatttccggttctgatttcgttgaaatgtttgttggtgttggtgccagccgtgttcgtgacttgtttgatcaagccaagaaggctgcccctgccattatctttattgatgaaattgatgctgtcggtcgtcgtcgaggtgccggaatgggtggcggacacgatgaacgtgagcagactttgaaccaattactggttgaaatggatggatttagtggcaatgaaggtgtcattgtcattgcagctaccaaccgtgccgatgttttggatccggctttgacccgtccaggtcgttttgatcgaaagattttggttggacgtccggatatcaatgggcgtgaagcaatcttaaaggttcattctaagaataaaccatttgcaaacgatgttgatcttcacgaaattgccaaacaaacgcctggttttgtgggtgccgatctggctaacctgcttaacgaagctgcactattggctgctcgacgtaacaaaaccaagattgatgctagtgacattgatgaggctgaagatcgagttattgccggtcctgctaaacgaaatcgggttatctcgaaggaagaacgggaaacggttgcttatcatgaagccggtcatacagttgttggcttggttcttaatgatgctcgggttgtccacaaggttacgattgtgcctcgtggtcgagctggcggttatgcgattatgctaccgcgtgaggatcaacaactaatgtccaagcgagatgcaatggagcagattgccggtttgatgggtggtcgtgctgctgaagaacttgtctttaactctcaatcttctggggcttcaaacgactttgaacaagcaactaatattgctcgggcaatggttacccagtatggaatgagtgaacggttgggcaatgtgcagcttgaaaacccggctcaagatacttatgggcctcgttattctcaagagactgccgctgctgttgatgaagaaattcgtcgattgactaacgaagcttatgcatcggctaaaaagattattggcgaacaccgtgataagcataagttgattgctcaagcattgttgaagtatgaaacacttgacgaaaagcaaattctatctctttggaatacaggtgaaatgcctgaaaactcaaagacaagtgaatttcctagcgaacgtgcggcaacttttgaagaagctaaacgtgagttggaacgtaaagaggccgaacgtcaggctgaacttgaaaaacaacatacaggcaatgaaacttccgaagatcaatccgaaagtaacaagtcgaataatgattccgacaagactgaaaagcccgatgatgtttcaagtaatgatcaaaaacaaaatagtgatcagtccaatcaggatgatcatcatgatgatagtaagtagacgatttattaaagatgagtttagggcgatttcgcctctaaactcgtttttattatgaacgaacggagagatagtttatgaaagattatttggtaaaggcaacaacaaccgatggcatgtttcgtgcttatgcagttaatgcaaaagacactgtgactacagctcaaaaagatcatgatacctggagtgcgtcatcggctgcattagggagaacattaattggatccgttatgttggcagcttctgttgataaaagcggtgaagcaattacggttaagattaatgggcagggcccggttggcggaatcgttgccgatagtgattcaaaaggtcacgtcaaaggatacattcaaaaccctcatgttcatttgcctttaaatgacaatcataggattgatgttagtaaggcagtgggcgttaatggtttcttggaagtcactcgagcttcagcaaatgaggatccttatacaagcagtgtacctttagcctctggtgaaattggtgatgactttacattctacctagctcaatccgaacagattccctcagctgttggcgtttcggtgtttgttaatgaggatcattcaattggtgcggctggcggttatctgattcaaacgcttcccggtgcaagtgatgaagcaatcaccaaagtcattaatcgcattaaggaaatcccgatgatttcggaattattgttggatcgacaaaccccggaagagattcttgatttgatttttggtaagcgtaatttacacattttggatcagatgccggttgagttttactgtgattgctccaaagaaaaatttgcaaaggatctttccggtatttcggttgatcaattggaaacaatgttgacagaggacaaaggcgttaacgttacttgtaacttttgtcaatcaaaatatcgatataatgaagatgaactaaagacaattattgatgtcgcaaaacaaaagaaaggccaatcaaaatagtcgctctcattggttgctttttatcaaatcaaatttcataaagatgatttctctgattggttgtgaactatttatttatgacgagatgtgataatatagctatcggacttttgaagaaaattgagaattgagctttgaggtgaatgttatggaatggaaaatcggtgatattacaattccaaaccaagttgtcgttgcacctatggcaggtgtaaccaactcggcttttagaattatttgtaaagagtttggtgctgggctagtggtctgtgaaatgatttcagatcgcggtattatgtataaaaacaaaaaaacgcttgatatgatgttcgtggaccctagagaacatccaatgagcattcaaatttttggcggaacgaaagaaactttggtacaagctgctaaatttgttgatcaaaatacggctgctgacattattgatattaatatgggatgtcctgtcaacaaggttgttaagaccgacgctggagcacgatggctgcttgatcctaaaaaagtatatgaaatggtctcatacgtgacagatgctgttaaaaagccggtgacagtaaagatgagaacgggctgggatgaagatcatatttacgctgttgaaaatgcgttagctgctgagcgagccggtgcgtcggctcttgcaatgcatgggcggacccgtaaacaaatgtatatgggacatgcaaactgggatattcttaaagaggttgctggtcaattacacattccttttatggggaatggggatgtcagaaccccacaggatgcaaaaaagatgttggaggatgtgggcgctgatgctgtcatgatgggacgagctgttgaaggaaatccgtgggtcctcagtcaggttgaacattatttggaaactggagatattttaccggaaccgacccctgaaaaaaagatcgcaacagcaaaagaacacctgcatcgccttgtagaacttaaaggtgatcacgttggttcacacgaatttcgtgggcagtccggttattacttaaaaggtatttctcattctgcaaggaccaaggttgcattggtcaatgcagatggtgaacaggcaatggatgatatttttgatcaattcttggaaaagaatgcccaaagacaggcacgtcatcaacaaatggcccaataaaggaagtcgttttgtggtatcataattagtagtttattatcgtaggaggtttgacattggccaaagataaagaaatgaatgatcaaatgattgttcgtcggcaaaagatggacgagttgcggaaggaaggaatcgatccttttggacatcggtttcagcgtacctatttagctacgcagcttcatgacgagttcgacaatactgacaaagatgatttgatgaatttaaataagaaagtcactgttgcaggacggatgatggcaaaacgtggtaaaggtaaagttggttttgctgatttaaaagatcgtacaggcaaaattcaaatttatgtgcgcaaggatatcgttggtgatgatatctatcatattttcaaacgctcagatattggcgatcacctaggtatttcgggacagattattaaaaccgatatgggtgagttaaccgttcgagctgaatccgttactttcctttcaaaagcactcagaccattgccggacaagtggcatggacttcaggaccaggaacaaaaatatcgtcaacgttatcttgatttgatttcgaaccaggatagctttgatcgcttccataaacgaagccatatcattacggccattcgtaattatttggattctcatgattatttggaagttgaaacgccagtgctgcataatcaagcggggggtgccaacgctcgtccatttattacccatcacaatgctttgaacattgacttgtacttgagaatcgctcttgaattacatctgaaacgattaatcgttggtggcatggagcgtgtgtatgagattggtcgtgttttccgaaatgaaggaatggataccagacataatccggaattcacgatgcttgaatcatacgttgcctactatgatttccacgatgttatggatgaaacagagggcatttttaaggccgctgccaagactgtaaccgatgatgggatgattacttatcagggtcatacaattgatctggataagccatttaagcgtcaacacatggttgatgcaattaaagagtatactgggattgatttctggaagccaatggatgatgatgctgcaaagaaattggctgatgagcatcatatccattacgaaccatggtggaaaacaggccatattatcaatgcattctttgaggaacttgttcaacctaagttggaacagccaactttcatttatggtcatccggttgaaatttctcctttggcaaagaaaaatgcagaagacccacgtttcactgatcgatttgaactgtatattttaacaaacgaatttgctaatgcctttactgaattgaatgatccaattgatcaacgtcagcgcttcgaagctcaagttaaagaacgtcaagaaggtaatgacgaagctgaaggtattgatgaagattatattgaggctctggagtatggtatgccgccaacaggtggtttggggatcggcattgatcgtttggttatgctgttgacagatgcaccatctattagagatgttcttcttttcccaactatgagaccagaagataactctgaaaaagaatagaccgtatacttaagttaaagtttcaataggcttgctttacgcgaggttattgaaactttttctttttgtattcaaaaaaaatcgaaaaacaaaaagacgaaacactaatgttagatagttgacttttaacgtgtataccacttttatttccgaattaatttgccgtatgattcttagttgttcggctttagcttcactatcgtctatatgcagaaacaagcccggtaccttgtgagtcgttaatcctatttttttgaatttatgccttgacgaatcgcgatttattcggtatatttatttatgctgtttcagtgagtgaacaagccaaacggattcaatcaaaaagttaattcaaaagttttgttgacaatcacttctcagcatggtaatattaaatagttgtcaacagcgagggattgctgctaacaactcaggtagacctttgaaaactgaataaaattttcga

SEQ ID NO: 457 - DNA, 213449 bp, Unknown
  Metagenome-assembled genome
tttgaccattatcgaactaggattcaaatggaattatttgcttaattcaattaatgcaaaagaaaaagcaaatcctttcggatttgctatataagctgatatcaacctcagttgacaaagagccaaatcgaatcgagggcttttttatattaatcattctcctgattgaaaagtaaatgggacgggtaggattctccagtatagattgtttgagttgctttaatgccgtcaatagaatctgctccggcacgtgtgttgctgtttggaaaaaccaaattttcagcggcgctggcaatgtccaacctcagacgatgaccgatcggtaatttgatagaagtcttttgggtttcgacagtgaattgataaatgtttcccggtgtcattaaatcgggtgttgacaagtcattgcgaaattttgcgttgaggacaccgtctgcaatgttaacagactgaccgttgggcgttacatccgtcagacggaccacccaatctgtatccacggctgaactactggcgtaaaagattgctttgaaccagccggtaatcgtcattggtgttgttaacggactggttgtaaaagaaatcacatcggatcgtttttcaacttgtgtataatcgtttggaaactccaactcattggcggaaacgtcaattaaatgaggtgtgggggttgctgggtcgtaaacgtaactggatgattctgttttctttgacggtttccaatccagcgtttgtttcttggcattcaggaacaatttagaaggttgtggattgaccggaaagctgtctgccgttcgccatttgtcggtgttaagcgtgtagtagtccaaaaggggctctttttcaataccgtttttgacaccatttaagaagtgatcaaaccagcggacatgctggagatcgatatcgaatcgaagcgcatgttctcctaaatgatacggtcccaaatcatattgggcattaccactgtgcacccaaggtccgaggatcagctttcgggtaccggcggggtaatgattggttgcgcggatagcttcggttgtcccgacaccattatcatcgaaccagccgctttgaatcagggcaggaacgtggattttatcagaacgggctttccaatccatattttccataaaagtgtctgctgatttgtgcgccataaatttgctgaagccgggaatttcatgtcccagtcccttaaccggaatttgagaaagtggccggactttcattaagtcgttccaatcatttctctgcatattcgccatgttgagttttttttcggctgtggagaagaaccaggcaaggctgcctgaaatcggggcgccgtttttataaatggtgtcattaaatgggccgcccgctgttaccatgctgacaagggccttgaggtggggtgttgccgaagaggcagccgcccattgaacgtatccgccatacgaccccccgatcatgccgacattaccgttggaccatggttggttggccagccagttgatcgtatcccgaccatcatcacgctcgtagtacatcggcagccattcgccctgcgagtcatttctaccacggacatcttgaatcacaagaacgtacccccgctgaacaaaacgttgttcgtcatcataatacatttcccgaccgtaaggcgttcgttccaaaatgacgggatgggttttctggccatcatcggggatgaaaacttctgttgcaagctgggtaccgtcgctcattttgaccatctgggtagtctgactggcgattgggaatggtttttgcattaataagtgattatcctgccacatctttaggatagtcaggttttcataacctggacgaataagaacagcaataatatttctcacagcaatttggcagccgaccaatttgccatcggacacgacgaggttgacagccggtttttgacggtgttgaatccataggtgcccatcttgcctcttttgaaagtgttcaccgttttgggttctcaacttatttcctgaaaaatccaaaggtgtgaagagatatttttcaaaaaagtgttgtggtgaagtgtgtagtttggactggtagcgtttatccagttctttggttaaaaccgatctgggctgttgaaaactctcaacttcgattgttttgtcctgtacatagaacgtggcttgtttaatacctgattgatagaaatcaaattgcaatggtcatcatgcctcctatttccaataagctgttgcgtaagtgaatggtgcgccgaccatgtggtgagttacccctgccaacttgggttgttgaaggattgaataaacttgctggttaagcggtaccatgacctgctgatccttaacaatcagtttctctgctgcgtggaagtcggcaaaacgtttagcgggattattgacatctttaccattggcagcgttaatcagttgatcgtattttggattatcataaccagctgccctgcccggggtgttggtataattggcaaggtaggttgttggatcttggaagtccggcccccattgagcaaggaccatttgatatttaccttgagcaaccaggcctaattcctgctgttgggggagaacacggattgagactttcagtccggggagattcttttccagttcagactgtagaaactctccggttgatttttgccaatcctcatcatcaatgagtagttggagggtgagggatttttgaccgagttgtttttgagcttgtttccactgtgaagcagctttggctttatccgctacgtaaagtttgccgccttcttgtctaaaatctttaccggtagctgaatttttaacaaatttcggtgggatataaccgcttaatggtgaagaaccgtcttggagaatcttgctggcaagctgtttggtatcaattgaatttgcgattgcctgcctcaaagctttattttgaaatggtaatttggcttttttccgcatattaaactgtaagtaggtaatcatcgaatttggaattgttttaaatccggcccgatttttattattcttcactaaattatttgttaggaaagtcatgtccagtttattagcttgatattggttcaaacccgttgtcgagcttttaacaacttggaaattcagtttgtccagcttggctttaacaggtcctcgatacttagtgttcttggtaagtgagagtgtgtttgcacccagtgaataggaagaaaccttgaatggaccattataaatcatcttacttggtgaagtggcatactggctgccaaccttttcaacaaaagctttgttttgtggaaaataaggattgaaagtcaataatgatttaaagtaaggcgttggtttttgcaaagtagcctgaagtttatattttccgagcgctttaacacctaatttactgggactcatctttccggtagcaatttgggtaccgtttttcaaaatggtttgaatgataaacgcatagttgctcttggttttggggttggcacctcgttgccatgcgtagacaaagtcgtcggcggtgacagattttccattggaccatttagcattgtgacgcaggctgatggtgtatgttttgttgccattggataattttggcatgccttttgcaatatcgtcaacaacctcatccttgctgttcatgcgatataatccgctaaaaacggcggcttggacgtcaaaactattgggatcctgtgcttttaaggtatccatcgaggctacttcggtattgagaccgaaactagcgctcttcttgtcctgtgatgacttgctttgcttaccacaggctgctaataagactgtactcgcgacagcgactgttagaaaaatttttcgtttattcatgatatgtacacccctcagtgtcagattaaaagttaacgttaatgcccaatcctggtttatcgctcaactgtagtcgatcctgttcctgtgtaaatcctttgtccagtaaccattttggctgtttaaacatcataaaactgtccaggtcgcaataggccacatttgaatgtgctgctgcaaaatggaccgcggcgcagataccgatgctggtttcggccatgcagccgatcatgcagtttaaaccggcggcctcagcaatcttattaattccttcagcgccaaaaatgcccttggacttcattaatttgatgttgaccaggtcagcttcaccattttttatgacggtcattgcgtcacttggtgaatgaacgctttcatccagcatgagattttgactgattgattgacgaatcagcttgttttgttcatgttgccaatagggtaagggttgttctactgcatgtaaattagtgcccttgaatttttccattatggcgattgtttgttttgctgtccagccctggttggcatccactttaatttcggttgtcggagtaaccgtatttagaatggcttgaatggcttgttcatcggcatgaggatcaataccggccttaactttcagttgtgagaagccactagaaacgtattgctgtgcttcagttgccatttgtttgggggcatcaattgagatcgtgatgtctgttttaattgaatttgaagcaccaccgagtaattgataaacgggtagtcccgtatccttacccaaaacatcatatagagcaatatcaatgccggctttaagtgccgtatgcccaagaatggcttctgccattaaaccgtggtttttttcaatatttcttggatctttgccacgcaatgaatcaacaattaatggtaacgctgccaattcactgtcgatactttcaccggtaaccggctcaaacggacaggcttcgccataaccgaagatctccgtatcggtcgaaattttgatgattaatgtttcgacgtcggtaatttcgccaaaagtgactttaattggttttgtcaacttaactttcactttgtgagcgatgatatcagtgatttccatgagaaaaataagctcctttcaaattatcttaattgaactctaatcataactaatttttaaaaaagttgcaatcaaatatgtgcttgataaggtaagaagcgcttgttctaaacgcgggttggataatataagcaagtcatatcggcgaaagattataaaacatacatatatgttgtaaatgcaaagcgagttgattaatcgactatttaactttcgtttggattaggagataatagagatgtaatcgcttacgatgtcatgctcattttgtaacaatcgggaataaaacgattaatctaacatgtttttaaaaaagagaggtcttattgatgaatcagacaatcgatacaaataaacaaagcaactgggcagccacttacgatgtcatcgtgattggatttggtgctgcaggtgcgactgccgccagatttgcggcggataacggtgctaaagtgctattgacggatgcggcacccgaaggtcatgaaggcggtaatacccgatatgccggtcaagtggttttaaccggatatgattttgataaaatgaagcaatattttaagcaattattcggaccgattaaaatagacgagaaaatgcttgatacctatgttcatggattgaccacaattccggattatttcaaacgttatttggaaatcaagaatccggtgtcttacaacaaggttcatcgtgatccggattttgaagcctttgccaacggcctgtcaccggagtatccggaatttgaaggctcggagacggttgatttgacaacggttcacgatggttactttgatgcctcgttgtggaaaacgttgcgtggccaagtaaccaagcgtgaaaatcaaattgatgtttggctggcatcacctgctaagcatttaattcaaagccatgaaacaggtgtggtcgaaggtgttcagattcagagacatgatcaattggttgatatcaaagccaataatggtgtcgtcatggcaatgggtggttttgagaataacaacgatgatattcagaactttatcggagttcccaaactgaaagtgatcgggactttatacaataagggcgatggcttgaagatggcccaggaagttggcgccaaactttggcacatgaagtcctttgaagggtttggttttaataccggtttcacatttgaaaataccgccgaagccaggggaaagtttattttgagcccatggccggatctgtcgaacggaagtatctttgtggccgccgacgatggcagtcgctacgttcgtgaagatgaaaacggccggcacggacacgcgtttgaacatggcagctggaagaatccgactgtctattcccatccacatctgatctttgatcgggaacaatacagacagatcaaatcccgtggaaagttaccatatgatgatttctttaagattacggtcaaggctaatacaattgaagagctcgccagaaaaattaaagcaaatccaaagacactggttcaaactgttgaacgattcaatgtcttttcagaaaacggcgaagatttaacattgaaccgttccggtgacacgatgcgggcttttggtgacggcccgtactacgccacgcctttggcaactgccatgctcaacacgcagggcggtgccaaacgaaacgagcaggcacaggtactagatgcgtttgatcagccgattccgcatttatacagcgccggcgagtttggcggcatcaatgccaatcagtataatggcggtggcaatttggcagaatgtctgatctttggcaaaattgccggagaaaatgccgctactgtcaagcatgatattgaagttacgccggaatccacatccacaaccgttgaccttggcggtaacgatttgtcgagtgatcaggcattaagcaattattcagttggaaaagatcagtaccttggtgtcagtgatgccggtatcggcggtcgggtcatcgttcgggtcacctatcgtgacgatcagcttaagaatgtagaggttctggaagaatccgaaagtgaagatgtcggccaaaaagcaatgacagaattgccaaaagaaatggtgacccaaaatacttacgacgtcgatgccgtttccggcgcatcatcttcaagtcgagcattgaagagtgcggttagaaatgccattcaaaaagcaactcaaccagctaaaaactcagctgactgattcgaaaacaacaaagacaacatcaatttttaagtgccgatatgatggcatttataaagaagatgttgtttttttgaaaatatagatgaaagcgcagtcatccatgataaaatgaggttgaaaaacatttaacatggtagggggttcttaaaatggcagttggagaagagacttattggcatgcatcatatgacgtgatcgttttgggatttggtggcgcaggagcaaccgcagccaggtttgcggcggatgccggcgcgcacgtattattggtcgattcagcaccggaaggtcacgagggcggcaatacccgctattcagcgcagttaatcggtacgggtgacaatttcgatgaccttaaaaaatactatcaggcattgaccgcaccgatgcatctggatgaggagatgattaatacctacgtgacagggatggtcaatacaccgaattatgttcaaaaatatttgggtgtgaaaccgttcagttggaagcgtgaaaagaaagacgataccggttttgtagattcaattgtccgggaatttccggaatacgaaggatcaaagagttacgattatacgaccgttaccagcgacttcttcgacgcagcgctctggcgcaatttgcgtgaacaggtgatgaaacgtttggaccatatcgatgttttatttgaaacacctgctaaaaagctgatccaagatcccgagtcaaaagtcataaaaggcgttgtcatccagcgacagcagcacgacctcaacgtacaagccaagaacggtgttgttttagcaaccggtggttttgagaacaatcaaaaagatgttgaggattatttaggcgcttccaaattggcaccgctcggcacgctttataacaagggtgacggcattaaaatgggccgggaagtcggtgccgatatgtggcacatggctaattacgaatcactcgggctgttgcacggcatggcgtttgcggttaaaccgggtgaacgcgggcggcttatgattggcaaacaaaacgatttggtcagtcacggaagcgtctttgtcattggtgacgatggttccaggtactttaatgaggcggaaatgaatcggcacggtcacctgtataatcatggtcagtggaaggtaccgttgaatcaggatcatccctatttgatttttgataggcatcagaaaaaacgattggataaggaccagatcatcggtagttacgcgccatacaaagaaaatgtaatcaaggctgattcaattgatgatttagcgaagaagctgagtgtttcggctaaaatccttcatcgaacgttcaagcgcttcaacaaggcagccgataaaggaaaggatcctgaatttcaccgggcagcgaggacaatggccgaatttgccaaaccgccttactacgcagtgccactggtgcaaaccatgttgaatacacagggtggtccaaggcgtaatgtgaaagcggaggttgttgacacaaacggtttgccgatccctcatttatatagtgccggtgaactcggcggtatttgcgccaaccaatatcaaggtggcggcaatttggcagaatgtctgatctttggcaaaattgccggggaaaatgccgcaaaacccaaggatgacacaaagaacgttgagccaaaccaagaaccggatacgatgacatcagcttcccagtcaacagacacaacgttggcaagtgatttaacgaatgatgaagaaaatgaaacctttacaaccactgatcatcaatttattggcgaaaacgatgacggtattggcggagaagtggttgtcagaatcacgcttgacgatgatcatcagttgaccaacgttgaagttttgaaacaaagtgaaagtgaagatgttggtttgaaagccatgaccgatctgccaaaagagatggtcaagaagcatacggctgatgttgatggtatttcaggtgcttcagcttcaagtaatgcgttgaaagctgccgtgaaagacgctttagaaaaagcaaagcagggaaattagatgaaaaatcattcaaagtcaaaagactctggatgatttttttacggaactataggtttcaattaattctcgtagatgtggtttaaccgtccaccatcgttccaactcccaatcattttatgattttgacaggcgttagcaaattttgttagacgtgaacgaaatagttctgggtgactttcttttatttgaatagtgtctactcttacccgttgataaagaggtggacaagaacagaaaaaatgccatgcaccgggtcgtctttttaaggctcgtttaattttaggattaatcgagaagtgtgccggatccatatccgggagttctttttgaccagacggagtcattcttcccagctcttccatacggatacatcgagctttatttaattcagaccaagaactgttaggccttcgaggaacaaagcgttgagcagctggtttgcctggctcaataaccttataggtactatcaatccatccaaaacacatcgcttcttcgactgcatcaacataccagaagtggtcattattctttggaatgccccttttgacattgacccagcattctttagcggtatcgtggtttgagcttaaccatatgcgaaattcattacgatttttgacagataaatagttttgtggcgttttagtcgtcatggtaaccccttcaatttattaatttgcatgattgacgcaacattttgtcaataagctaagttacttctagtttatatctaaaaagataaaaaaagtttttttcagaaaaaaactgatgtcagaagatattacgtgtataatacgcagtaagggaacccaaatcaaatatttaggtattccgaattaatgacttttcagggggcttttgatgaagacagttgatgatattcgtaaattggcaaaggatgaaaaaattgattatttgaggatgacgttttcggatctaaacggtgtgctaaaaaacgttgagattccggtcagtttactggacaccgctttgaataacaagattaaaattgacgggtcctcgatcactggattcttgccaattcaaaactctgatatgtatttgtatccggatttggatacttggaccatctatccatggatcacgacgggtggtaacacggcttcactcatttgtgatgtttacaatcgtgacggaacgccgtttgccggtgatccacgacttgcactaaaacaattggatgcatcattatctgacatcggttgtggacatttgaacgttggtgccgagatggaatacttcctattcaaaaccgacgagaatggccatttaacgactgagttaaatgatcaggcctcctattttgatgtgtatccgagcgatgccggcgaagcgtgtcgacgtgatacggtcaatacgttaaagaaaatgggcttttcaattgaagcaaaccatcatgaagtcgcacccggacaatgtgaaattgactttcggtttgacgatgcggttcacacagctgatcgcattcagttgctgaagctggctaccaaggcaatcgcggttaaacacggattacgtgcaacatttatgccaaagccgcttgccggaatgaacgggtcgggcatgcatttgaatacctcactgtttgatggcgatcacaacttgtttgatgatccaaaggctgatcacggcttatctgcccttgcaacaaattacctcgccggcattttgactcatgcgagagcctttacagccattactaacccaaccattaatagctataagcgtttggttccggggtacgaagcaccaacctatgttgcgtgggctatcgcaaaccgaacggcgttggtacgggtaccggatggcaggggccccgcaacccggtttgaattgcgaagcggtgatccgtccgcaaatccttatctggcaattgcttccgttttatcggccggactggatggcatcaaaaacaaattaacacccccaaagaatgtggaggacaatatttataatatgtctgcagagcagcgaacgtctcaacaaatcattcagctacccggttcattacccaaggcattgacgactttaaaaaatgatcagacacttgcccaaacgttgggcatcattgtaccgaagtatttggagattaagcataaggaactggctagtttccagatgagtgtcacggattgggaaaaagagacctattttaatgtttaaatttggcaattaaaataaaagagctgccgttcagccaatcacttgaattgactaaatgacagctcttttaacatggaaaagcagctgatgatccgatggtggataaaaatgggtgcgataatcagcggaaatgttttataatcgacgttaaagacaaacataagcgaaggtgaaagaatatgtcagaacagctcatctacatgtttcatggttatacatcatttgcacacgatcactggtttccctggcttgaaaagcaggtagaggatcagcttgacataccgtttaaaaagctcaattttcccgactccaatcatcccaacgaggctgcttgggatctctattgcgatcaagcaattgacgccagggatgggattaccttggtcggacatagcttgggctgcattcaggtccttcattatctggcgcaacatgatatcaagcatgtcaatgtcttattggtttccggctttgatgaaccgatttggacattaccggagctggatgcattcacgcaacacccagtcgattataccgatattcttccaaagattgcgcatgtcacggttatttccgcgattaacgacaacagtgtcccatatccttacaccttaacgatggctcggcatctacattcaaagtttgtcttaatgccgtccggacatcattttaccgatgaaggaaaagataagaagctgccgattgtatttgatgagttgaaagccatgctgaaaaacgactagcaggaatagctaatgacgatttttaagcaacacgaaaatctaaaataaccttaaaaagccacggtgctcaaaatacgcccgtggtttttattgatcaaacctctgatttaaaaatttggtagattggtgcaccttcacattgtgccggaatcctggttccgagtagtaatgcgattgtcggggtgacgtctacttggcgaataacccgatctgttgtgaattgggacttgattccttttcccgaagcaataaaaaccggtgagaccgatgtttcaaagtaaccttcagccgttgtcaaaccgtcaccatgtaatcggttgaatccttcttcaacagtgaaaaagatatcgccacattcgggaccgctggcacctagaataatggcatccttatttcttagtgcaataccaacaacacgtttacctgtccttggatcgcggtaattatagagatctgaaatgattttttcttcaaggtcgtatttatctttagggtctacgatgccgtgtttatcacggcctttcaaattgacgtaaacgtaattacttctgatttgaacagcggttgtcttttcccaatcaacttcgtcaatcttttgaccattctcatctgttttgagagtggtatagcctagatcttccatgacctgggtgttaaggccgccatactcacccagaataggcgggacgttttcaccaactaataggccgtgatctgaaacgaccaggatggtatagccttcatccaaataatgcaggaagcggcccagataagcatcggtttgttggtagacacgctcgataaatctctgatagactttctcatcggtatccttccaaggagccaaagttttcgctaaatgccagagttgatggccggcacagtcgacgttgtgaagatggctgaaaactgcgtcgaagtgttgattgtctagtaagtaggcaatgctgtcagcctgccattggcaataaatatcccaagagggcagaaaaactttttcaaccaattcaggatcttcaccgccaattaagcttaccggtggcaccggaccaacgtgagcaatgacttcatcataaagggcactgggctgccaaagcattttgttggttgtatccaaggcgttgctgatccacagacggagtgttttgccatccggacttaattcaagcagtttataagaacgacagcttggtttggtacggcctttttttgtggcattatcgatgatgccggataccattttgtctttgggaattgtcacaaatggatcggcgccatcttttgtatgatagagagtgacggtatcgtaactatcgtggtgactttttgtgatcagaccgtaacgggtttcctgaccgccggaaatcagcactgtaaattgaagactgtcttccggtacatgttgccaatcatcggctggtttgatgggtgtcatgacgatgtcatatgcaacttttgcgccgatcatcatttcagtgtcctcaagagacttgacgtaagtccgaatttcaccgccttttctggattcgtctccccaccaaatctccatcatttcgtcctcatcgtcagaatggtcctttgccggttgatttgaaacaacttcttgaagattggtgatgttgcagccgacgccggcagctttttcggtatgtggaatatagcggggcttatcaagttctgatgagccataaataatcttttcccaatccatttgagcaacgcccatgttaacagaaccgggttgggtgccgtcaacaacgtttagcaacggattatctgaagaagccggccaggaacatcccggccagtgccaaaccagcgtttttaaattattttcgacggtacaattccagatttgctcagctttacaattccgagaatccatattgtagacaacggcatccaggctatccggagattggcgccagtaatcggtaatgccatgggtacccggataggcaccggttgccaatgttgtccagcagggtggggtgatggtgggatgtgctccaagcatttcctgtccggcccttgatgatcccgcttcaaggtacttcttgatgttgggcagtttgccctccttaaccaaacggtgggttgttctggcgtccatgccgtcgattcccagtacaattagtttgtttgttcgtgcatttcttgtcattgtgatggcctccccgatacataaaaatcagaattgatttcttgaatgacacccatgataggtggggagtcggtcttttagtacccctcaaatatcgatggggggtatggttgatttcgatagtgaatcgaaggatagttattctttatcattggaatttgtatagctgatattgttttaactcacaaagccaccggaattaagatgcttttgataggtaaagactatgggaaaatgattgccttttatcaaaaaatccagtatcttttttccaagcaaacaaattgcgttgaggagaagagtaactaaacagcctcattcaagagatcccggatgatgagaaagggaattgggttgtttggcgaagatgagctctgagctatcagttggtagatttagctggctggtcggaaaagtcgccgttatcagaccgggttttattttagaaccgttgaggtattatttgtgagaataatacaaagttagggtggtaacacgtcaaagcgtccctttatttgtcaaatgattgacaggtaaaggggcgcttttatttttgaaatggagtcgtgattgatatgaagttagagcaattatatttactgaacgaagccgttaagtacgcgtcgatttcagatgcagccaagaataattatatgtcccaatcctcgattagccatgccattatcagtttggaaaatgaactgcagtcaaaattattgacccgaacgtgtaccggtgtttctccgacagtggtgggacaggcggttttaaaacaagtccagacaattattaaaagcgttcaaaatattcaagcgctatcaaaaccgggacgatttatcgatgaaatcaagcttgcctgcattccgtgtttgaacgactggattgtcccgacggttctcagtcaacttcaaatggccgatggcaaggcttctgtgtccgttagtaccgaggaaagcggcaggattgttcgtgaaatttcaagtaggcaatccgattttggcattgtgattaatcatcgcgggtcggggaaggttgacgatcttgtgtatgaacccttatttcatgatcaatatgtcttatatgtcggtcgtcattcaccactgtttggaaaggaaaacgtcacatatgaaaccttgttggcgcagccctacattgcttataaagatgagtttcgaaaagaaaatggtggcctgaccaatctgatgaggtcaggtcaacaacctaacgttcagtttagaacggatagtcttgatgcgattaaaagcttaattgcaaatgaccgctacgttgcgttttttccgcagtacatgtcacaaaatgattactacttgcagtcgaaaatgattcgaaaagtcaggattatagatcagccgttggactttgaggttggttccatcagcaataaaaagtacccgcttaatgaccagaacaagttatttctggcaacgttaaagcaagtggttaattctcggacttttatgttaaatcaatcaaaagaaggtgactcattatcagtaaattaaaaaatagatatttccttagttcgacaacgggaatcttgattttgctcatgtggttgttagtgacttggcatggtcgcatctcaagtttaatcattccggcgccgaatgccgtatggaccagttttatcgatttgctgcaaaacggctacaagggacatacattgtggcagcatttgtgggcaagcctgcaacgcctgttcattgcctattttgcggctgtcttatttgcaattccactgggtttggtaagtggttattcacgaaaggtcagggcgatttttgaaccggttattacatttttgcggcccctaccgcctcttgggtactacacgattatcattctgtggatgggtactgggaatacatcaaaaattgttctactgtttcttggcgcgttttcgccaatatatgtctcatgcgttgccggtgtcagtcgggttaaaattgattaccttaatcgggcaagaacacttggcgccaaccagtttcaggtatttagtcacgttgttttaccggcatcgctaccggatatctttgttggtttgagaaatgccatgagcgttgcctatgcgacttctgtagctgccgaaatggttgcggcaggatcaggtattggctggctggtattggatgccagcaaatatttgagaagtgacgtggtctttgtcggcattattatcatgggtgtcaccggcattttattggataccatattgttgcttttagaaaagaaagttgtcttctgggaaggcaaagattgaattggaggaaactgagatgaaaaaggttaagggatgggttggcatagcaattgttttaacgggcgttttactggcagggtgtggtcaatccaaagcggattcggctaaatcagcaaataaggatccacagacgggacaagtctatccaaagacggtgaaggttgggttaattgaaggcggtcctgaatcggctatcttacaaaaagaacattatcttaaaggcattggcacaaaagtaaaaacgaccagttactcaactggaacggatcttaacaatgcttttgtgtcaaaggaccttgacgttgcgtcgtttggttcatccccttatgcactcggtgtggcaaacggtgtgccttataaggcagtgggcgtaccatatgtagaaagcggtaatattgaggctttggctgcgaagaaatcggcgtctattaaaaaagtagcagatttaaagggtaaaaagatcggtgttccctttgcaacgacttcccactatgctttgttaaaggctctcgcattggcaggattaaagcccagtgatgtgacattgaaggacatggacggtcaaagtattgttgcagcctggaaacgcggcgatatcgatgcagcttatatttggagtccggccttggatgagattgcaaagaccggcaggattctgacaaatgatggtcaattgaagaataaaggtgtcatcattccggaagttgccgtctcaggtaacgatttttctaaaaaatatccgacactggttaaacgttatgtccaagctttgatcaaagttcaaaatcttgtaaagacaaatcctaaaagggccattcaagacgttgcaagttgggaaggcattccgacagcaaatgccaagagtcaaattaccgaaaatgattggttatcaggaaacgagcaggctgattacctcggatcggacgggaaactagcggacattgttaaaacaattaccgacttccataaagcgcaaaaaaacatttcccaagccccaactaaatccacgattaatgatgcgattgatggcagttttctccaaaaagctttgaaataaaattagttgattgattatgaaaaaatgaggtgatgatgatgctggaagaacaaacagaatcaggtcaacagttaatttctgttgatcaagtgactttggattatggtggtaaaggtggcacatctcccgcaataaaggacgtgtcattagatatttacccgggtgaatttgtgtgtgtcatggggccgagcggctgtggtaaaagtacactacttaaaattctggcgggctttattaagccaacgagcgggtctgctcaactcaatggccaactcattgacggtattgattcgcaaaggggtgttgtctttcaaaatgcgacattatatgattggtattccgttagaaaaaacgttgcctttggacctaatatgaagcacgtggccaaaaagattattgatgccgacgtgaaaaagtatctggcggaagtcaagttaacggggtttgcggataaaaaagttttcgaattgtccggtggcatgaaacagcgggtcgcaattgccagtgcgctgattaataaacccgaaattctgttaatggatgaaccatttggcgcactggatgcgctgaccaaaacccaaatgcaaaatttaattcgccgaatttggtttcgatctcagaacacaattttctttattacccacgatgttgatgaagcacttttgttgggaagtcgggttgttgtcatgtcaaaacatccaggccgagtgatcgctgatttcccggtgaactttaccgaaaccattttgaacagtcagaccgactcgacacgttacagcaaatcgtttctacagcggcgaaagtatatcttgaacctgatcagccaggatgaagaggcgtccttttagcagttcatattcaaacaagcgtggtattcgagggtcacaatagaagaccttcgagtatcacgcttgttttgaatgcgatggttaaaaaagatggtttaattaaagtttgagttcaatagccgttgaaatggcttaattcaaatcttcggaaatttcttttgccaatgtatgggtatagtagaccgcaccggttaaatcaacgtggacgcgatcactggcaaaccagccggcatgccctttactggctttgtaccaattgacaacgtggacatttgcatgttttttagccgttttcttgattaaatgattagtcgtattttgccattttcttggaacccgtgtgttgatccaaaagatttgccgttccttgccaacggttttgagaaccgaattaatgtctgcctgggttggcggcccatttgtccccaaattaatcaccacgtacctggcaaggtggccggttgcccttaactggcggacaattccgggaagtgaataaaattgccggccaacagaaccactaacggcactatgtgggaagacgtgtttaatgttcggcttaacgtctaccataaccgagtcgccaattgccgttaaatggattttactggcggttcgagtttggagctttgttagatgataattgcgggagacacttttctcgcgagcagttaagtggagtttggctgtctttgcctggactttagttgttgaaaagatgtgattatgcgccgcctcactattccgatgattgccggttcccaagaacccgacctccagcaggacaactacgagcgcgaatccaagtagtgagtatgtcatgaaagcccctcgtgatttttgcattttctctccttatgaagataagctatttctttaatgttattatttaaaatctatgatttagtatacaatatttcgttcatttaacaagtcacttagacgtgcaaaaataaatcattctttttaaccatgttataggatattacattgagaaacgcatacccccgtttaaactggtcaagtttggcaataaagggcctaatggcattcttttgttgactatttggttaagaacgctataatttagacaatcaatgttagaaaaagtcacacaaagtgatatttggtctcataaatcaaggaaaaatagcctcaaaggggggatcttgaaatgaaaattcaagtggcaagtgtccaatttcaaccgcagcttaaccgggtcgcctttaacttaagggcgatggcgaagtgggttaatcgaattaaaagtgaacagatcgatattaagctaatcgtctttccggaactcagtacaaccggctatgagtgcgggacaggcttttatcaattagccgaaaccgttaccggtcagtcggttcagtacatgcaaaacgttgcaaagcggtaccacgtttatctgatcttcggctttgcccaacgggatcaaacaaacgctggaacgatttataattcaaccatgttaattaacgatcaaggacagattgtgggtacttatcagaaggttcacttatttgatactgaacaacgttatttcacaccggggaaaacgtatccggtgttcaaaacaaagatcgggacaattgggatgatgatatgttatgatacctttttccccgaagtggccagaatattggcacttgagcatgctgatcttttgacaatttcaaccaactgggaacgacccaggattcaagactgggagctctgtgttcgggccagggctttggacaatatcattccaatcgttgctgccaatcgaatcgggtttgataaggaattggacttctttggacacagcaagattattgatccgcttggaacggttatgtcaagtttggattctgaacgaccgggttatcttcaagcaacaatcgactatgaacagacaagggggcttcgacatggttattactcgatttatcaggatgcacaccctgaaacgtattctgaaaaatggcatctacaaggaaacatggattcgaaagatccgaaaacagccgtggtaaaggcggaagatgcaaactgaatgacatttattttttactttaataatgatcagctagcaatctaattgctagcaatatataaatacgtattaatttatagataatcgttaaataaacattaataaactaacgcactatacctcgaaaaagtgataaaatatctttgttgtgaaattttttaattacttggaggtatcattatatgcgttctcagaaattaattgttctaggatttctattagggggagcgtttctactgaatcccactgcaaaggcgagcacttatcacagtgggaccccaaaggcattaaggggatgctggtatttggggaaacagtcttatttggaatattggtcaagacataccggtatgaacaatcttcaatattcatcggcatacggaggctacttaagaccaaatccgtacggcctaacctacgttaaatataagtatttagggtatcatacctatcgactgaccggttggacgtattcaacatcacaagatttcagagtgattgatccaaccagtgaaaagtacacgtacaatgttaggctattgaatagcaaacagttgtatctatgtgatcgaaacgtcacatatacgaagtacacgacaacacccggatgggttgttgattaattttttcacccgattattggttagggatatccctagtttatttcatattaaaagtcgctattggataccaagtccgaggcggcttttttgatttcgtcattacttaatgtgtatattcttttattgagcgataaagataaaaatacctgttctaccagtattggaatcgcaaccattattcaacttttaagaagagagagttgttgattgggataatgttagtgttatcatcattgatgagaatgacacgtctaaaatgtgaaaacaaaaagagaatgattaaaatacgtgttgacaatctatgaaaatcctttgtatactagcaccaatcaatttgatgaacgacgtgttaatcacatgttcagtaacaaccagcgaattttaaagaaagcatcgttgatgagaagatgtatcttcctggtaggtgaaagtgcatgtgagcgaaagtccttttcgaggggcttgggaatgacttcccttaagaatgtcagggtatcagcttaaacggtacccatagaggtcatgcgtgcgaacgtgtgatgaatttaggtggtaacacggtaaaacgtccttttcagctttagctgaagggggcgttttttgttcatcaaaataaaattgatcggagatggttaacgtgcatcaaaatcaaagaacgtcaaatgtaagttggccacatttatggctgacggcctcaaacttataagatttaaaaaattccgctaacatcattaattttaaccacatatcttggccttaacccaagaataggtccataccaacacatatgtatcatcacatagatccaaactattaataaaacgaaaggagttgtttcaaatgacgatcatcaaatcaattgcaccggcaaaagttaacaaggattcatttgaagcaactgcgttattagccttattactttaaaaaaggactcggacatattagtcgggccctatttgagaagcaatggggcactgcaggtaccccagaatactggtggtactatttttttacaactttttcagattaaacaacaaacaaattaaggagatctttattatgacaaaacaaattcaatttttcgatacaacattgcgtgacggcgaacaaacaattggtgttaatttcagtgttgaacaaaaggtagaaattgccaaagagcttgagagatggggcgttgatgttattgaagcaggctttccggttgcttctccggaagattttgaagcagttcaagctgtatcacgggcagttaaacgcacccgagtgacgggccttgcgagagcacgcaaaggcgatatcgacgcctgcatcaaagcaacaaaggatgccgcacacaaacaggtccatgtctttattgcaacaagtcctattcaccgtgaatcaaagcttcatatgaccaaagaccaagtgattgcctcgattcgtgattcagtcacatacgcccatcaattctttgatatcgttgagttttcaccagaggacgctaccagaacggaacctgatttcctggttgattcgattgaaaccgccattcatgccggtgctaccgtcattaacattccggataccgttggttatacgaatccggttgaatttgccgaactattcaagaatcttcgtgaaaatgttaaagaatttgatgacattaccttctccgtacattgccacgatgacttgggaatggctgtagccaacagtttggcttctattgaaaatggtgcaaccagaattgagggcacaatcaacggtattggcgaacgtgccggaaatgccgcacttgaagaagttgccgctgctttgtacgttcgaaaggattattacaatgcaaccagtaacattaatttgaaggagaccaagcgtgtgtcggatatgatcagtgattttgccaacatgccggttcctcataacaaggcggttgttggtgccaatgcctttgcccatgaatcaggaattcaccaagacggtatgctgaagaatccacaaacctatgagattctaacaccggaatcagttggcgcaaacaagacaacattgccactcggaaagctgtcagggtcacatgcagtgatggctaaactgaatacgattggttatgacgttgaccgcgatgacatgaagaagatcttcccgattttcaaacgggtagccgatgatgaatcgatcgtaacagaagatgatcttaagaaaattatggacaaagtcaaggaggccgttcactaatgagccattcaactgcaaaaattacggttttaccaggagattacattggcccggaaattatgagtgcggggctgtcagttttaaaagcggttagtgaaggtgaatttgattatcaaatcgacgagcagccctttggcggggccggcattgatcagaaaggcgatccgcttccacaacagacccttgagtcagctaaagccagtgatgcggtactcttggctgcaatcggtggtcctaaatgggataacgcacccaagcggccggagaagggattactcgcaattcgtcaggaattgaacttgtttgccaacattcgtccgactgcaatcagtcaggccatgcaaaagtattcacccattaagcaggttgaaccggtagatttcgtgattgtccgtgagttaaccagtgggatttactttggaaagcccagagaaattgatgatcaccatgccattgatacgatgcgctataccgatgaagaaattcggcgggttgccaaagttgcctttgaaatggccgaaaagagaaagcagcatgtcacactggttgataaagccaatgtactggcaacaagcaatctttggcgacggattgttgaagatgtggctgcggattatccgacgattacttacgataccagttatgtggatgcggcagccatgaagattatcagcgcgcctgaacaatttgatgttattttaaccgaaaacatgtttggcgatattttaagcgatgaatctgcagaaattaccgggtcattagggacgattccgtcgatgagccgaggcacaaccggtcctgcactttacgagccgattcatggttccgcaccggatattgcaggtaagggcattgccaatccgctgtccatgattaattcggttgccttaatgctgagacattcatttgatcgaccggatttggcggatgacattgccgacagtgtcgacgccgtgatcgaaagtggcaatgtcactcctgacctgggtggcggttcaacaaccgaccaagtgacaagtaccattattaataaaattcgtgaaagaaggaacgcatatgtcgaaaacgatgttcgataaaatttgggataaacacgttattaccggaaaaaccggtgagccacaattaatttatgtcgatttacacttacttcatgaagtgacttcacctcaagcttttgagggattacgtgaaaatcaccgaaaagttcgccggaccgataaaacctttgcgacaatggatcacaacgtgccaactgtcgatatttttaacattaaggatgaaattgccaaaaagcagattgatacccttcagaaaaatgcggatgaatttggtattcgcctcgccggaatgggtgataaggatcaagggattatccacgtcatcggaccccaattaggattgacacaacccggaatggtgattgtttgtggcgattcgcatacagccactcatggcgcttttggatcgattgcttttggcatcgggaccagtgaagtcgaacacgttttagcaactcaaactatttggcagaccaagcccaagacgatgggcattcatgttcatgggaagctgcccagaggtgtttatgccaaggacattattatgggcattattgcccggcaaggggttgcgtttgggacaggatacgctgccgagttttacggcgacaccatttccaacatgggtatggaagaacgaatgaccctatgcaatatggcaatcgagggtggcgcaaaaatgggaagtgttcatccggatcaaacaaccttcgattatgtaaaaggtcgtcaatatgcgcctaagaatattgataaagccattgactactggaagcagttcacgactgatagtgaggatgcttacgatcgggtgattgattttgacgtcagtgatctggcaccttatgtcacctgggggaccaatcccggcatggcagtacccgttgatcgacaatttcccgagattaaggatgacgatgatcaaaaggcttacgattatgttgggttaaagccgggtgaaaaagcgaccgatattccgattagatgggcattcttcgggtcctgcaccaatggtcgtttatcagaccttaaaattgcagcagccatattgaaaggccatcatattgcaaagggattaacagcgtgggtggttccgggttcccgggcaatcagggaacgcgccgaagaaattggcattgacaagatttttaaagatgccggttgtgaatggcgtgaacccggttgttcagcctgcttggggatgaaccccgatcatgttccggctggtattcactgcgcgtcaacctcaaacaggaactttgagggtcgtcagggagccggttcaagaacccatttggccagtcccgcaatggtagcagctgcggccattcatggtcacttcatcgatcttcgaaaggagcaggtctaaatggaaaaaattaatgtgattaagagtacgtcaattccgattatgagggacaatatcgatacggatcaattaattccaaaacagtttttaaagaatattttaaagaccggctatggcaaaaatctattctacgattggcgttatcaaagcccgaataaaccaaatcaggattttattttaaataaacccgaacgtcaaggcgccgagatcttgattgccggtgacaacttcggctgtggttcttcccgtgaacatgcggtatgggcactaaaagattggggctttcgggtcgtcattgcaggtggttacagtgatatcttttatatgaacagtaccaagaatggtttcttggcgattaaactgcctaaagaccaacgggaaattttagcccaggcagcaccggacgaaaccattaccgttgatttgccaaaccagacagtcagttatcgggacaatcaatttccctttgaaattgatccgctttggaaacataaattcgttaacggattggatgatattgctattacgatgaactatgaaaaacaaattgaagaatacgaagcagaaattcccgactttggttaggaatatggatgtttttaatttgagaaaacaaacatgattagggggcagatgcctatggaaagacaaattagtttgcagggtcgaattgaccgaaccaaagaatcacctttattttatgagatatttgccttggtagccggtggtatgtttttggatgccgttgatgtttacttggcaagcgcggtggcaacaaccgttttaaaagataattggtccacgttacaattgaattcctattttctgtcaagtggctttctcggattatttttaggatcaatcattgccggtttcattggtgatttaaaaggtcgacgggtcgcctatcaaattaatctgttgatgtttggtggctttacttttcttggtgcatttgcgcctaatatgggatttttgattttctgccgtttaatgtcgagtatcgggttgggatctgaaatcgtaaccgggtattccatgattaatgaatttgcaccaatacatagtcgtggtaaatggtgtgcaacaacctcattggttgccaattgtggtgcgcccgtcacaatgattctgtgcagtgcgattattccgcgatatggctggcgggtgatgtttatggttgtcgggattgtggcagcaattctctggtacctgcgtcgaaacattcctgagtctccgcgctggttaatggcccatgaccgggatgatgaagccagggcaattatcgaaaagcttgaagttaacggtgtgaatgacgatgttgacgagacaccaaagaagcatgaagttgttcatcattcactatggattagtttgtttgttgctacagttgccgcttcggcaactattatctgtcagtatacgtttacgtcctgggtaccgacgctgcttagcaatcggggcattaatatttccggttcactttggatgtcggcctttatgatggttggtgcaccggttggatgtgccgtgggtgcttatctggttgatcgaatcggtcgtaaaaagaccattgcaccggcattctttatgactgcaatctttggatttatgtacggccaacagtcgactgtcggcggggtgcttgccattggttttatgcttgaagtttgtttctatattttgatggcatcggttattgcagtttatgttgccgaacttttcccgaccaaattcagattcagagggtccgggattgccaacggggctgccaagcttttcacggttgccatgccgattgtggttgcttggatgcttaaagttaccagtgccgatatgattttctgggcaatcggtgggattgcattatttgccgggattgtcgtttgggtatttggtgatgaaacaaatcaaaaggacattggctaagtagctgtattaaaaattgatttgttattgaaataaacgagttttagagcagttactgttatctcaaactttcaaaataatcaaaaagtcctcaagatgaggtatgaggtataccgccaaagttaaaaaactttagcggtattttttgtttaagtatgttgtaaattaacacttgagaatataatataggtggtaattagattatggcattaaaatttaaataccttattattgttttgatgcttatttttgatatgatgtttttaaactattttgaaagcaaaggggacctctaaatgaaaaagtcacaactctctgatcgaataaatgaagcatttattgcttttaaccgtgaagcttcgcatcatgcagacaatacctatgttgctcggctggataacaatgacgctgtctctgtgattgctattccgtatggagatcctcataaaccgtacttgattccacaagacttttcgaaattactcgatgatgttgcagataaagcatatgctgctgaaacgggtgcgttttcacagcttaaagcattggaattggaaatttcgaaacagggtgtcgaagaataaggcttactcaatagaccacaaataatagcgtatcactgattataacttaaaaagtaatcagtaatacgctattttaaaatggtcataaagattggcgacttcaactaagaacgagttttcaaattaatcgttgagtgtcttaatcggctttatctcggattattgcttgttatacaaatactttaaggtatttatgtcagcttctgtaattttctgggtataaggatctttttcgtttggatacatcacatcattttcgtcggtactatgggcaagtcctaaagcatggcccatttcgtgaacagcaataaactgtgtataggcatagtcaaaattaaacttgattgcctgctcaggcagaatgccgatcaccgcggatttcatcgcgtaaaaacctgctgggtttctggtagtagcacgttgaatataggaaatgccaaccgtatgagcatcgacaccatccgaattcgatgccacattggtgatcttgatgtttgcgttattataatcagaagtttcggacagattaacaacattgacactgttccattcttgaatggccgaataccaaagtgccttttcggaattgttcatttttggatagaaggcataggtaatattgcttgatgcccagctaacgccctggtcaggcgtgtaagattttgccggatctttgacaggggttttaaccggagttgtcgtacttgaactgcttgagttcgtgacgctggtggtcgtttcggttgttgtaggtgtcgtcgtagttgtggttgtagcagtaggtgagctggcctttgtcaggtagctgcttttaacccaaccctttaagttattacctttaacatagcgataggtctggtatttgccactcacctttattttacgttgatattgactggtgaaaacaactttttgatgggtttttagtttgaataatttcttgcccaacttggccgtataagcataagccttatttgaaacgttgggcttaacccaatattttgttggctttgttttgacgatctgagttgtttgtaccttggtttttgcttgaacaggctgtgttgaatgagccgttccaaacgttcctaataatgttgttgctaaagtacctaaaatgaaataaagtaatttattatgcttcatctttttgtgcagtcctttcttgatgttagaatttcgagcacgaaaatgattagaaatgatctattcttaatgccccttatataataataattatactcaaaatctgttaaagttgcgagaacgaaaccgcggttctgcaaaaataaggacaaactaaaaactgccggcgattgaacacggcagtttgaccacattaggcgtttaaaatgatactaattgattgggtctgcacactttaggactgctccgctaaccataaacctgcatgtaagctaacagccatcaaattccaaaactaggaattagctgcctgtcaacttacactccggtttatcccggttagctccgaacactgatctaggactgctcctcaaagcagtattctgcacataagggattcttttcaaaaatccaagatcgggatttccgaaaagaacgccttatgctccgaatactaaccgctttgctccacacactggattaggactgctcctcaaagcagtattctgcacataagggattcttttcaaaaatccaaattcaggattttaaaaaaggacgccttacactccgaacgttaaccgctttgctccgcacacttttaggactgctcctcaaagcagcatcactcctcataagggatcaaattgaaaaatccaaagtcgggatttcccaatttgacgccttatgctccggatgctaaccgctttgatccacacacttgttatttgcttacctttacccacctcaccgggtggctcaattctgttaattccgtcagtgatagttttagtgcatgatactcgtcaccggcagccggatatagccacaaaagtcctcttagcgacgtatcgagatagaccggtagatcgttttccaaaccgatgggattgacaccgcctacaggatatccggttgattgttgaacttcatcaggtggcagtaaatgtggtcgaacgtgaaattcttctttgaaatgatgattgtccaagcgggcattgccgctaagaacgatcacgattggttgatcattaacgtttagtaccaatgatttcgcaattgcatccggatcaacgtgcaaaacttcggcagcttcgttgactgttgcgccggttgagggtaggtcgatgtaacggtctcttaattgatgataacttaactcgtttttcagatcgattaaactcatgttaataacctcctataaggaatcctgggaatctgccacatccaattttttttgtcgataagccagcaatacgttaaatccaagggcccacacgagtgctccgacagccggcaaaatcgaggacgggttgaagaacagactggcaaaaattgctaggaaaaaggcaatcgtgagtggatttgaccagcgatattgtggcattttaaagccatccagtttgaaatcaccggagtggcgatacctataatgagcgaccattgttaaaatacataccagaatataaatgtcacttgaaaccgaagcgatgaatgaaaaggccacacccaaagaattaaatgaactaataataggtgccaaaatcatcatcaatgccgagaagagcacgctcgtaatcggaataccgtttttggagacttttgtgaagaatgtcattccttttgatggtgattcttcggctagttgatacaagtggcgaccggttgagaaaattgcgctgttcaaagtggagcaggctgccgcaatgacaactaaattaatgatttgtgaggcagcaggtaagccggctaatttaaagatttgaacaaacgggctttcattaggattcaatgtgttccatggggtgatggccataatgatgattaatgagcctatataaaataggagaattctgccaatgatctggttgacagcatgcggtaatacttttctcggctgtttggtttccgcggttgtgattccgacaaattccatcccttgaaaagcaaagaagaccattggaaaagcattaataaattgatgggcaccatttggaaacagcgagaagtggttaaaaatatttccccaggaagcttgagtacccgccggatttcggtgattagtgactactaaatagattccgatgacaattaaagcgataatggctaagatctttattccggatagaagggtttcggatttcccaaatgaactgaccatcgccatgttaacggcggttaggatcaacagaaaagcgagttggataatccaggcaggagtaccgggaaaccagtatttgacatatgtggaaatggcagtgagttcggccatgccggctaaaaccaattccagccaataactccaagcagcaaagtatcccagccttgggttaacgtatttcccgataaaagatacaaaagtatgctgttccggatcagcgtacatcatctcaccgattgcccgcatcataaggaagaaaaagatcccgataatgagatacacaaacaaaattgatggacctgttcggtgaatcgtgcttccggcccctaaaaacaggccggtaccaattgagccgccaaacgcaatcatttggacggccaggtttgaaaggccccggattgtaccatctttattaacttcaacttcatttttagccatgacttatttctactccaatctacagtgtcaaaaacaaacaaaaacgcccctacagaaaatctgcagggacgtttaagcgcggtaccacccgaattcgtgataactttacagccatcacctcagaaactcgttaacaatcagtgtgcggaacaaagcggttaacgttcggagtgtaaggcgtccttttttaaaatcctgaatttggattgttgaaaaggatcccttacatgtagaacgttgctttgagtagcagtcctagaaaagtgtgcggagctaaccggttagtacctagagcgtaaggcgtcaaattggagaatcccgaatttggatttttcaatttgatcccttacgtggcgtggtactggttagcggaacagtcctagaaaagtgtgcggaacaaagcggttagcacccgaagtatcacctaattatctactaaagtctgagacggtaacgtgtcttaacgtaggcatcgctttcacgtgcctaatgctctgagctcatcttcgcaatgaccatatctactgcatttcaccaaatagcagttctctttaaagaaataggcaattgttactcttctcatcatcacatttgtattgaacttttacacattatactatcatggtattttaatatttcaagtcaaatcgataaaaaatagacctattggcgatagaaattctctatggtcaatagccgatcattgaagtagaataatcctataaccgttatcgaatgtcaaaggacggttaatgatcaatatctgaggggatgggtttttatgaaaaaaagtatggtaaagggtgcattgcttcttgctcttggggttacagcgtatatgggagtatcaatgactggtcaaaccgcttctgcaaaaaggcaagtgaaggttgtgaaaaccacaaaactgacaggggcggattatcacgttagtggcggctacctgtattcgagtgttaagctaactaagcgcgtacatagtgccaaaaactatcagagaacattattcttctcgaatcggcgggtaacggtcagaaaatcaaacggacatcaagcaaattatcaatatattgtttcccggaatggcaggattcatggttggatttggacaggaaatttgaaaaaagtatcgaatatgtcaaatacgtctaaaaagggagcaacaaccccaaccagcaccggttcgaccgctaatgatcagacaaattcttcgagtgccgattcggcttcatcagccagttcaacagtaaccgtaacggtgacaagtccgtcatcgaccagttcaacctccaagaagtcggctaatccgacaaacgcattttcattgaccgattatcgggcaagctttatgaaatatttgaatcaggaaagagctaataggggacttcaaccgtatattgaagatccaaatttggatgcgttggctcaacagcgatcgacacagttgattactaatttcagtcattttgatacacagggcaatgccattgcggatgaatccgccacgcaatttggtgttggcaactttggtgccgaatgtattgcccaaaatgtttgggatgacgacagtaccagtgattcagtagctaaaaacgatgtccatgagtacatttatgacgatgctgcctcaaattggggacatcgcgatattttacttaataccgacttgaagtctattggaatgggtgccacattacatgaacacactgatggctttatggcaacatggacagctgcagattttgggtattgaggttgcttaacttaataaaaaatgaccaattgtttatcagccgattaataacggcaaaaacaattggtcatttttatactgaatttacgtgaatgattagttggcgctctttttcaaagcagccttttgacgcatttccatttcgatatcttcaagcgtcttgccacgggtttccggtaccatatagataacaaagaagattgacagaacggcgaaaaaggtaaagacagcgaatggaccaccgacgttgttatggaacatgcttaacaataccaagaagaattgagagacaataaagttcccgatccagttggcggctgaaccgattgagttaccaacgccacgaacgttcaatgggaagatttcacccaacatcaaccagcaaatcggtccccatgaaacggcaaagccaaagatgtaaatggcgattaggatcatggttgggaccgctgcggcttgaacagtcaatgtgaagttcaaaacggacagggtgccgattgaaacagccatgacgatagagccgaaaagcaaaattgttcgacggttaaatttgtccatgatctggtaggccaagagcgtgcagaggaagttaacaacccctatgccgactgaaatccagatggcgtttccttcagcaaatccaaagcctttaatgaagacttgtggtaaaaagtagatcactgaattaataccgactaattgttgcaaaagcattaaaccaatcgcaacgatgacagccgggcgagcaaaggtaaccagctctttccagccgcctctgggttggttggcgactttttgaatatcggttaattctttatcgggatcttcattggtgttcttacgtaattcatgcagaacgtcgcgagcttcatcaacgtttcctttttcaacaaggtaacgtggtgattccggtagaattaacgaaccgataaagagaatggcagcagggatcaaagcggatccaagcatccatcgccaatcacgaatgcctaacaggttgtgatgaagaaaccccaggttggaaacatatgccagtaaaataccagccgtaatcataagctgaaacatggtcccaagcgatccacggtgaggggcgtcagctaattctgccaaataagcaggcgttaaagctgaagctgacccaacggcaaatcctaaaatgattctggccgtgaccatcgaagcaaatccaacggcggtcatcgaaagaccggagccaagcaaaaataggatagaagcaaccaataataatcgtttacgaccaaacctatcagatagtgtcccaatagatagggcaccgattgatgagccaattaaaacggatgaggtgatgaatccggtttgctcaatgtttaaactaaagtcattttcgattaatgaggaggcaccagaaataataccagtatcaaatccaaataaaaggcctcctaaagcaccgaaaacaaagatgaaaaagatgcttaaatgtttcgcacgcatgtaaatcccccctaaaccagaatgtaaaaagattttaacgatttctaattgtaaaccctctcatcataaatgcaagcgcttgcaatagtaccgcatctgacaatgaaagctaataaccgctagtgacgcaaatcatttcccttcttttgaaaaatagttagttacaattaattagcatttacaggattattattgcacagatgcctcttttttcaattaaatagattgggaatttattagggaattattttgcgcggtgataatgattcttaaataagtatgattttaacaatctgccttcaccgcgtatgcgaaaagtcaggcttagttcatcagatttacagttaatatttgttaggagaaacacccttacttttatagtggggtaattatagggtcaatgttcaagcacgaaagcgctaaaacatatttgaaccggcaaagatacctaacaatgggtagggaagaatacgttaactgtgagtgattagtcataacaataccccggtgaaccattaacatgagttgtgttatcaattttgcaaatgcgataatgtggcttttcgtatgattaatcaaaaaatgccgtgaccaaatcgagttaatgaattcgatttgataacggtttttatcatggtgtgattttctgttaattatacgaatcaatgtaaacgataacctaaaatagttgtatagaaattccttttggttaaaggattaaatagtagttgactttatttaggtaatcgtttaccataactatcgtgaacaattgatagttgggtttaaccagtaaaagttaacggaggaaatcgtgatgacgctgatcttaaacacatggatttttgaacaggatgttaaaaatgggacacctcaggcagagttggtcgacaggaccgctaagctcggtgcagatggtattgaagttcgacgggaatattttacggatttggaaacagaaacagcggccgttggagagagggctaaggccaatggcttaatggtgacttatagtgtaccggacgaattattttttgaagatggtcagtttaaccccaagttaaccacctattttgatgaggctaaggcgatgggcgtttcaaaaattaaatttaatacaggacgatttgatcgctatcagggaaatctaaaactggacttgagtcgtttacctttgaatgagattgaaatgaatgttgaaaatgatcaaactgaggcttcaggaaatgttgcaccgattaaggctttccttgaggcaactggaaaagttgcttttaatcagattggttatgtatacgatcttggaaactgggcgtttacaggtaatgatgcgattcaaagtgccaaagctttggcggcttatacaaactacattcatctaaaaaataccgtgagcgatcatggggaactgaaaacatcggcagatctgaataccgggatttacgattggaagcgtatcttgaatgagctacctaatgatgtgccgatcgctttggagttcccgatggcaaccgatgaaaaaattgcagcgcagatggccattttgaaggccggagcggagggatagtcatggtttcaacaataagtgcgattttattattaatgacgtttgcaatttttattgtttacatcgttaaaggcggcaacctgatgatcggctttttcgtcatggcaattgtctggtcgattgttggcatggttcccgccgatcaagtgattcaaaaagtttttgccgaaccggcgttaaattatgcgccaacaattatttatattgtatttggttcatggtttggtcgggtattggtagacagtggtattgccccagcgatttccgaacaaactaataaagtcggtaaaaagcatcctttcttggctgcaatacttgtcctattggtcacggcattcatatttgtcagtgcatacggtgttggttcagtgattgcgattggcgtgattttactgccgattatgttatctgtggggattcccagagatttggcattatcggcttttacaatggcgattggtgcaccaatgtatttaaacgttgttttgtataaccagattaaagcattctttccaacagctgtctatggtggtaaatatcttgtctttggttgggcagcaactgcagtccagctagctgccgttattatttttctcttctttaaccgcaagcgctttgatccgactaaggcacaggaaaacttggaaattattggtgcggaagataacacagcttcaattgttaaagtaccgaaaattgcctttatcgttccggttattcctgttttaatgaatatgctttttagttgggatgccattccggcactcatcttggccacactgattgcaatgctgttcacaggaaagttcaaagggtatcagaagtttgttgacttcttgaacagtacgattcaacaatcaatttcagacattgccggtctggttatgtttttaatggccctaatcatgttcagtggggctgctcagatggatgccggccggtttaaaccgatttttgccgctattctaccgcacaaccatttgattttagccgttgcaatcggtatcttggcaccgttggcattgttccgtggcccgttacatgtttggggtgccggtgcggcaacggctgccgtactttccggaaccggtcttttcaatgatgcctttttactgccattgttgtatgtaccttcaattatggcggtgtcaaccgatttgacccaatcttggaatgtatggggactgaaatatatgaaagtcacatcaacagcattccttaaaaatggtgtttttctaatgtgggtggtgtcgattattaacgaagtccttgtctattacttcttcggataagccgttaatggaatcgtagtcaattaacttaaagtgaggaattaaaatatgagtgaattaataacaattggtgaaccgatcgtcacctttgcgtccaagcaaccggatgtgtcattgattgatgcaaccgaatttaccaaaattatgggtggtgccgaattgaatgttgccattggggcgacccgtttgggtcattcaacggattacatttcaagagtgggaaacgaaccatttggtgattacgtcatcaaaacgattttaagtcatggtgtcgggacaaaatatatttcccgtgatccaaagtattggaccggtcatcaactgaaagagctggtgacaaaaggagatccgcaaacgtacaattatcgaaaagggtcggctgcggctcatctgtcaaaagacgttattgaaaaagtggatttgaatggcgtcaaaatggctcatatgtcgggaatctttcctgctatttcagagatggccgaagaaacttttcgaacattgcttgagaggctgattcaaaaagagattaccattacgtttgaccccaacttaaggccggcactttggtcaagtcgggaaaaaatgattcgcacaattaatgagttggccgggtcagcagatatcgtgttaccgggcgttgaagaaggcaaaatattgcttggaacggatgatcctgaaaaaattgccgatttttatttaaaaggacagagaacaaaagcggtcattgtgaaagttggatcagccggcgcctttgtcaaaacggctgaaggtgaacggtatgatgttccgggctttaaagtgaaacaagtcattgatacagttggtgccggtgacggctttgcacttggtgttattacagccttactggagggactgaacttgagatcggctgtggtacgcggcaacgctgtgggtgctctgcaggttcaaacgtatggggataatgatggctaccctgaccagaaacaattaaaagccttttaccaaaaagaaggagtgacggaatagatgaaattacaagttgcaatagatcgtgtctcgttggattatgcattggatttagctgctaaattggatcaatttgtcgatattgttgagtttgggacttcactcgttaaagattacgggttggttgaaattggtaaaagaaatccggatttgtcccatgcacaattattgcttgatctaaaaacgtttgatgaaggtccctatgagtttgaaaagggatttgatgcaaaaggggacattttgacggttatgggagcagcttcaactgacacgctcaagggcgtttacgatgttacccgtaaaagacagggtgagatgtttatcgatttgatggaaaccagtgatgaaaagaccacccaaattgtcgactttgaaaatgctgtttatgggattcaccactcgcacgatgccgcaatcgggtttgatgctgtttcaacggtcgcagattttcataaaaagttcccggcagttaaacgcatttcagttgctggcggcattgatttggaaacggccaagaagcttgctgaacagggaattgcagaatcagtgattgttggcagtaagattattaaaacagatgatccggtagctagtgcaaaacaatttatggaggtcattaaatgagcttagtagaacaggttatgggcgaagttaatcaagtaatgggcatgattgacgaacaacaattgaaggatgccgagggcgttattcaaaaagacaaacggatttttgttctgggtgccggacgatcaggattaatggctaaaggatttgcaatgcgtttaatgcacattggctacacggtgtatgccattggggagaccatcacaccatcaattcaggccggtgatgtcctggtggcagtttccggttccggtaaaacatccagtattttggaattaaccgaaaaagccaagaatgacggtgtcaaagttgtagccgttaccagccattctgattctccattgggaaaactgggcgacgtgacaattgtggttccaggtgcaaccaaagccggcgatggggttaaatcaattcagttattaagtacattgtttgatcaaagcgttcacattactttggatgtactctgcctcatgttgagccgtcgagatcatgtttctaatgatacggcaaaggcaactcactcaaatttggagtaagatcctttattttacgaagaacagtcatatctgatcattaagcgattaggcggattttagatgctaatcgcttttttcatgataaaattaaaaacgaaactggtttgaaactcaatcttaggcatacttgaagcaaatgaaatggtggtttaaatggcaaacaatggtagaaaatctgcgaatattaaggacgttgcagcgttagcaggggtatcagtcgcaacaatttcccggtatttaaacggggagttggatcggatgtccaaaaagacggcagaaaatgtccgaaacgcaattgaaaagttaaactatgttcccaactccgttgcacgtcaaatgaagacccgttccagtaaaatgatcgcagttatcgtttcaaacgttgatgattacttctcaactgaattatttaaaggaatcagttcgattttggaaagcagcggatacattggcgttctttttgatgcggattccgatgatgatcgtgagcaaagattattaaagactatcggcagtcagctgtttgacggtgtgattatgcagccggccaataatccacagacaattacggaggcacttcggcggtcgatgccaatcgtgacggttgatcgagagattgatgacagtccatggccacaggttgtgattaataactatgaagttgcccgctctgttagtcatcattttgtgcaggaagggtattccagagtggccgtcttaacttctgaaataaaaaaagcccgcacccgtcaggaacggtatcgcgggattacggctgaatttaaacatgtagatgtattggaaatttccgaagttgcccataatcatcagacaacctatcagcagctgcttcatttaattcaaaagaatgatgaaaagacggtcatctttagcctgaaagaacgttggtttttggagtttgtcccacaattggtatttgatcgggttattgataacaaacgggtgacggcaacaggttttgcggatacggattatgcccggcgattagagccgagactaaaactcatttctcaaaatccgtattttatgggtgccagctcggcggaagttatgctcaatcagttgcaggataaaagtcagaaagcagaaagaattgtgattagggcgaaatttgaatagtgtgtgaagcaaagcgggataaaccggagtgtaagttgacaggcagctaattcctgcttttggaatttgatggctgttagcttacatgcaggtttatggttagcggagcagtcctaaaacagtgtgcgtggcaaagcggttagcattcggagtgtaaggcgttcttttcggaaatcccggttttggatttttgaaaagaatcccttacatgcagaatgctgctttgaggagcagtcctaaatcagtgtgtagaaaaagacgtttttgattccagagtaccgtgtgcggaacaaagcggttaatatccggaacagcactgacaccgcagacagctattcgatcgtatttttttagttaaattgatcatgttaatgattaaaaatcaggtcgttaatgccaaagtaattgacgacatacataaaggtcatgacagcgttgactcccagtgacatgaggacaattccaaagcggatggtggcactgaaccaaccaaaaagccacgggtttcgataacgtttccctttgtaagtaagcgtcatccacagtagaacaattgtgataatggcctgaagaaacaatcccaagagataaatgattgggccaccgctatatagttggaaataatagccgccaagacaaatgacgtctaataaaagtgcaaataaagtcacgttaatttttcctccactaaaatgattcgtgaattaattctaacacaagttctgttgatatatatttgtgatattatttgagtaacataaatgagaagggatgcgtacttatgcttgattataacgcacaatcacagtggtcaaatggatttggtgggcagcagtcaccaattgatttaaaaggttcagaagcggtccaacataatggatcacttttatttgaaataaagaattcgtatgatttgaccagcgaaattgatgatcaaacgacaattcgggttttgggagatgggtccgcaacgatctttgatcggttatttgattttgtacaggttcattttcatgtgccggccgagcatttagtagatggtgaagcaaagccctttgaaattcatctggttcatcaaaacaaaattggccagcttgtggttgtcgcattgctggtttcagaaggaaaaggggatgccacccttcagcagatcattgaccaatttcaggttgggcaaaccaaatcagtgaatattcaattgggagactgggtgccggctcgaccaaacgggtttcattatttgggctctttaacaacgccaccgctaacggaaggggtggaatggctcgtgatagccaacccgaatgttagtatcagtgcagatcagttggcttggttcaaagcacattttcagcccaataatcgggaaacacaagacttgaatggccggttgatcggttcatatttaaaataggatgaccatttcggttagtcataggtggaatcatgattagtatttcaaagttgataagttggtttattattgtgaatatggataagcagaggcagtatcccggtactgaaaagctgacacaaatgaagctgatgtttctactatactatgtacagggaacgtttcttgcattgtatgggcaaaaggcattctccaatgatgtcgttgcctggaagtacggaccggctattgcagtcgtccaccagcggttcaggggaaaacgatttgtgacaggaacagtgaccaatgaagatgacgtcaattacagagacgtcaatcaggatgaccgcttgttaaaaattgtttttgaagtacaggaaacgtttggcaacaaaacggcagcggaattgagtcggcaaacaatgcgtgaacgtccttggaaagtgacccctcaaagcggtgtgattgatccggaagtattggcagattattttaagaaacacatcgttgaaatggatgattgaagtttatacggtaaatagaaaaagcttgggcagttgccgaccactctgaaagtcaatcagagttgttcacaactgcccaagctttttctggtcacgttatttttcccaaccgcaaagtctgtaatggtgtgacttcgcccagtgcaaagtgacatggacttttctgcccgcattgtttaacccacgacaattcttggaataatgatactttttaccgtggtttggcgcgatccatacataggtcgttcttgcgtttgattgaaccggtggctgaacaactgcgatgccaccaaatgtaaaggttgccgcaatcataatcgcggctgtttttaattttgtcatcatactgccccttttcgccctagaatataatatgtgatttatttaacaatgttatcatagcataaatcggattatctaaatatggttatttttatataaatatcatttaatttttccgaataataatctgacaggtttgttgagccgcttactcgtgataacttaatgccaacaaatccgcgaagcagtggtgctggtgattattttaaagagcagcatgcgtttaatatatggcatacacttgtaaggtgaatcgtttttttaatagaatcaattaaaaatgagccccccggcttctttctttgaaatagaagagaccgggggctcactgtaaaaattatatttccattttatgccaagcaccctttgagtactggtacatcgtcattaaattgtcatttttgccatggtgccaaatccaaggatgccttgtcggcacgattttagttccatatttaaaaataacttttgacttttgggttggtcgatatttggataaaatagcgtgttgcttaacattgtattctgaattgtagcggacataattcctggcttcaattcgatacccgtgaaatgatttggttcgatacctgccgatggataatccactggtagtggttgggatggcattagcgcttgtgtcagcgaccatgagtcccatccccaaacaaagtgttgccaaagcaatataaatgcagctgcttactttcaatgaatgacgctcctcaatcgtgcttgtgcgacagtaacttgatgaacatggcatttttaaactaaaaaacgcttacttagttaaaagtaccatgttttgttttcttaaacaatgactgttacagaagcgtcatgagcttttaaaacaactgtattaatgtgtgcacatggttaactaattagtgacctggctggtaccggttttgtaattcaatttaacacctgcttgaatgttgcgaatgtagatattgaagcgaacccgattactgccgatagattttccctgcatctggacaccgtttgccaagaggttattagatttgaaaacaggccgaacctgatatcggatgtaatgcttgcggctgcttcttaggtaggctgccacttgattctcataacgttccatacatggtgtattcaatgagcgtgtaccggtaatcaagtttctaagattattgttttgaccggtcaattgatagccgatcaaatgacaacgattataaagccaaccactgctgatttttttattatgccagccggttggatcgacatagagaggcgctcgttgttcggtcggcatgagtcgtttgttaagcattgcgttcgcggtggttgcacgatttaagaaatcaagccggccatatctttgccaagcgccatgttttcgggtgagcgtcgcttttgaaaattttggccgattttgattgatgataataatttgccgaccaatctttatttgacgcttactgactttttgagcttttttacctgcggcttttgcctttttgcgtgtcgtcttaaccgtttttttgcgcgttgaacttggcttgtaatcggtcttggccaaagttaagccacgctttttggccgtcgaaagcttgacgcgataaatttttttagcattgtttaagccacggttatgtttatgataaaagtaatgtttaccggttcgggtaacgtagacgtaagatgatgcttctgcagtctgagtgggctgctggtaagacgcaccgcttacaatcaaaaccgtaaacaggaggaaataaatgaattttctgatataaaacaccccttaaaataaagtcgaatgccaagcaaaacatagtgtgagttccttcacaaataaatcttatcactatttttaacagaaaaataatttaaaattcgtatggtagtggtagcaaggggtttcaaatgtttgctaaaaaaagaccaaatttccctgttgcttttatgaacgctcgttcgtataatgagtatttgtcaggagggggattttgcgaatggataaaatagcagaagcaacagttttagatatggcggtaaaagcgatgcgccgtggtcgaatggttcgactgagttttggggatcgccaagaacatcaagtgacagacatagagcctgtagtcgggtacataacggggattaaggatgataaactcacttttaccaatatgctgaatcaaagccggtttgttgacgtatcgacgcttgacaccatcacgtttgtcatgaactcataaatgaaatgatacataaaataacgactgatcattagcttgttgaagcgatcttgaccaatcgtttttttgtctatttaaaatggctaatgggggttaatagttacctctgttattactatcgggatattatttcattgaaaatgcaaacaatagtcacatctaattcaaatatttcggttattcttatggtatcgataaggataatggagggattacgatgaaaaaggaaattaaacgcggaggcttatggatcggtgcctgtgctgtgacgttcgctagcatgttgttgttagtcattcagccggtccaggggtccaaggtaaaagtgacaagcaacaaagcgttgacaaccaaagtgagtaaacgaaatgtggaaccgactggtaaagccggtttgtataccaagccaagcgccttaaagggtgataagctggttttatccagaaaaacgatgaaaaaaatggatcattccgagaatgccaatcattatttgcgtgcttatagagttgcaaagacgaatcaaaatcaggtttactataaagttgtcagttttgacggtaaacatcggggatgggtatatggcggtcaaaaaacaaatcgcttttccggaggcctacacgcagtcaaaacctatcgtgaactggcgttaacagctgaggaaaagacagctacttatcaatttaccaatcccggcaccggacatgttacctggcgggcaccatatgggacaacctataaaccgacaaaagtcgttaaatcattggcgccatacgtgaacgatactttaacggtgaaaagtgtggttgaacgggaaaagggcgacgagatttactactacattgccagtcaagaacatccaggtattaacggatggattcagggtaaggctgtcgaacctgcatttgacacttcgagcaatcagcccgggttaacgttgcctgaacaatcagcttcaggtcaaaaaccgaccgcaccaacttccacgccgagtccggacacttctagtccggaaaaaccaggagggacacttaattattcagggacattcagctctactgatgccaaggtttacaaaaatgccttttctcaagaaacagatcaatctgtgatttccaaagtccagaagagttataaagaacaggtgattaaggggctttcggaaccgtttaattacgatcaaaatatgtccttggtcgaaattgcaactaaattgggacatggtaaacgatttacggctgagggtggccgcaactatgcggtgattgttaatccaaccgggagttcgttggtcacattaataccgtattcacaaattaagtggattaatgcgaaggcagctgtatccgggctggatagtggtattttagggatgcttataaatgatgagttgaaggctcaaattcagtcggcagccaatctttactacaaggtcaattatctgggatcgctggtcattatgtcgccaatgtcggatagcaccgttaagcggttgttgggtgatggtaagcagcttagtattaatgtcgaacaattctttgaggaattgccaattacagtgaaatttgatattggcgttaaaatcgatcgggatgataacggtattacagcagtcaatgttgacttgaaattggatccggagtcattaaaagtgcctgatccggaaaatccagcgaaatgccagttgaacgttgatgtcaagcagttgggattaggtacatttccatcgattgcagcgcaggcagcaattcgggttttctatccaatcagatatccttattacaataaaattgaccagagcatgagtcccgataaaatcaagcgggttttaggcaatgggcaaaccattcaggttaatcagtcaggtattaaagcaaatttaacgatggcggtagatgtttcccaagaaaatggggtttcaaagaacgtgacggttaaagttgttgcgactaaactgacggaataaaagcttagaggaagttttgctgcgacgcattgaaggatgtacagcaaaacttttttgcttttgaaagcaaccggactttgttgagtttcaattgtcttgcgcttatactggaacgaatggaagtaattgcaacgggagatgaatcccggtataatcgttttttaaagatgtagaggttggacaaatgggtcattttccgaatacggatactggtttagtatgtgattttgggaaatggccttgtgaaggagaagtgtgatgtcacaatcattttcaaatcataagtttacaaatttgccggacaatattgtagatatcgcaacgggtattcttgaacggtcaactgaatttcagcagcgaatgacaccgcctcggaaacaaggggatgaacgagacaaggcgttagcgataccaggcaacgtgattttttacgttccgacactgcacatggatgatgctcagtatcagggacatggccttttaccccacttggttaaaaagagctacttggatattgatgtgggggttgtgccggtaaaacaggaagtcaccgtccgtcatgcaaagatggctagtcattttacgtatgaggacgcccatattgacctgtttaatcgtgttcaccacccggcttacattattggcggctatgatctcaacggtaatcgattacggggtgtaacgatcccactgccggatgttaaaacggaaaaggtgtttgtcagaattgatgaacattggaaaattgcgacggataataatggttatgtgacctcggtgtttcatcgttatttcctgattgatggtattggagctgagaggaaatcggttcctaaaattgccacgattaattcggatttatcgatgctgagtcctaattggggccgtcaattaaaacactcgttggcagaaacccagtcgtttcattctttgctggatacgccgcaatattatgaacatctgggcatgtttaccaactaccaagggtcgattcaattcggaaccggtttggatgctcaaagcggtagtcatgaacaagttgaattgcaaaaatacaatgcaaaggttttgggaaaccaggagaattggcatattgtgccacacttaacgttgaaaaaattaacagaataatgatatgacagtaggtctcgcttcaacgatgtttagttgaaacgggatctttttattgttttccagtaaccgattttgtttaaagtaaacggcggttattcaacttagtaccgaaatgaaatgcgattggtagcgctaccattagagaattgatgttctgctttttaaataaggcagatgaagaggacctaaatttagttaactaattagtaaagaacgggatatgcttcgagttgccctcattgaaagtatcagggagtttattcaaaatcggcgtataacagctttttcttttagatagtgcacaatcaaatatgagcagtagtgttattaaaataaatgattggtgaatgtatatttgaaatattcaaccaattaggttatgagaatccttctcattcgtaagcagattcttggaaagcgcattcataatgatttatacttaaggtgttgtataggagaagatatatgtattaggggaggttttaataatgaggtttgatctaaagaagtcattgtttgtttcaatggcagctcttggattattcgcagcaactgcaaccattaatgcaaatcaagcagacgcgaagacttatgcacgtgttacttcaaatagcaagatgtcatccgatccgacaactcgaaatatttcgtttaccggtggtaatgccatttataccaaagccggaacacttcgtggtgctcgattagttgcatcgacggcaacactatccacgttggcaaattcaaattcgtcatcggataatttccgtgcttatcgagtagcaacaaccaatcgtggatctgtttactataaggttgtatcatttgaccaacagacacgtggttggatttatggtggtaaaagtacagctaattttggcggtggtactaagcaatttacaacgtttagcactaataatttaagtgatgcccaacaaaatagcttgtacaaaattgcgagcccaggaattgccaatgatggtaagacggtcacatataagcaacctgcatggactcaatataaggtagggcgtcaggtccttgattcaacgccttacgcaaacgcaacctttaagattattcaagtgggaacacgtacccgtgaaggtgaccagtgggtacaggttcaagcaaccgataaccaatacagccaggcaaatggttggatcttatatagtggtttgacattaactcaaacgccggttgccgataatgccattcgaattaatctggtagattcaagcaataataacaacgttgtgaagtcatttgactacactaagacaggtgctcaaaagggtacgcgtcttggaacacaaaatggggctaactggacgttggctgcaagtgaccagacacaacttcagaaccaaattaataccaacttaagtggtaccggatactacgttggcgctttgaaccagacacagattaatgcgttgggtgccgcaacgtttggcggttcagttaatattgcagttacaaagcaaaccgcaattgcggataacgccgttcgaattaatatggtaacgccaaatggcacattcttgaggtccgttgattatcctaaggctaatgccacaaagggcaattatcttggatattggaatggtaacgtttgggcattatcaaatgatgacattactaatattaacggcattgttaataatgcgttgaccggcactggttacttcttaactaatgggcagttaacatcagcccagcaacaagcgattgccgctggtcgattcggggataatgtgacgattacggtaacgaatacgcaaccggttacaactactacgacagttcagccgatgttaaatggttatcttggatcgttaacagctcgacagatgaatagcatatctggtccgactgttaacactgacattgcgattcctggattcgctggtggttctggtagtgataagactattgtgagtgctagtgacctttatcagtggtctaagagtagcgatacaacactgaaacaaaaacttgctgatgcaatgactgcagcaaataagttaacatctgatcaattgaataatgcaactacaggtattaatccacaggctaaacaagctgctaacttagtatatctacaacctaataatatgcggattaatttaggtgccagtggcgcatattactcgggtgatactgctttagcacaagcaaagagtaataatcttggcactatttactcacctatttatccaatcattactcaagatacgactgctggcgcaactcaggccaaactaacttggggcagattaacctatactgctcagagtgcaaatcctggtcttagtggtggaacggtgaatgtttattacaatgctgataatggtacgacggtaacaaacccataatttaatccgttttttatgagaaagtctttcaggttttatttaactaacttgaaagacttttttactttactaatttatatgacatccatattaaaccccataaacaattgtcatgttatatagtaatgagaactaatatgctgtaaaatacaagtgaagtttcaaataatatgtattggggataatggaatatgaaaaataaccttaaacggtcattacttatatcggcagctgcattaggattctttgcagtcgctggtgtaagtaatggacaaactgcaagtgcgaagacttacgccaaggtaaagtctaatcaaacgctttcgatgaatccatctgatcgaaacgttaactttacaggaagcagcgcactttatacaaaagcaagtacactcaagggcgcaaaactagttgcatcagccagtcaattaagcagttttgcaaattcgaattcttcagatcataatgtccgtgcatatcgaattgctaaaaccaatcgcggttctatctattataaagtggtcacatttaatggcctgtatcgcggatggatttatggcgggaaaagtaacgctgactttggcgggggactaaagggatataatacattaactcctgctgcactaacgactgatcagaaaaacggtacctttaaaatagctaatccagggaatgcaaacgacggcaagacagttacttacaaggaaccatcttggacgcaatataaggttggccgtcaaatccttgactcatcagcgtatgctggtaagacattcaccattgatcaagccgcaaatcgtacccgcgaaggggatttgtgggttcatataacagcaacggattctggcaattcaggtgctaacggttggattttatatagtggattgactgctgtttccagtcccagttcatcgagttcatcatcttcttcaactacaccgacaacaacggcaccaactaatccagcagataaaattttgagaattacattcgttgatccaaatgggaatacaattaagagtatcaattatacaaacaattcagctgttggcggtaatacattgggaaccgcaaatggttccacttggacattaaataccagtgatgtgacttcgattcaggatcaagctgctaaagcattagctggaacaggttatacattagcaaataataccctgacagatgaccagaagacgtctttggcacaggctaaattcggaagtaccgttcaattgaagactgttgctggtaattcatcatctactgcaactaagcaggcctcaagcgtgattgtgccctctgcagttaaccaaagtacgacgtacaactggtgggatattttacatttgttccagataaatgattccagtgttaatgctatgactgcattcagtgaccaatatgataatactaaggttgatttccctcatgtttggaatcaagatcaatggcttccgacatcttcagatcaaaaatattctgctcaagatttggcaaatatgaaaccagatgatcaagcatataagaacattattgcatcgtttagtggagttgcgttcaatctagatgcaaactcattaaatcttgcgttccgtcaagccgttgctggcaagtatattgcaccaagtaacttctcgatctcaggtaatcaaggagcgacatttacaaacggtgacgcattgtcggcggtttatgctaataatgcattgctaactcttaagtcaccaatgtatccacaatttgtacaaaagaacggtaagtggactatcgagtgggatcaagtatcctatactgctcaaagtgccggaaatggtacttatggtaatcctgttcaggtaatgtatagctataatttagcagtcaagtgattctaggacaaagcattttagaattgatggagataatttaattggttaaagcgactctaccttgaaagaaatgcaaggtagagtcgcttttattatgtaaaaaagttgattcagatctaagattttttatgtagtaagtaatacctttttattcttcgggaaaagacagatgattttacttctttttttctatttttactaataagtgattgccgaaatcaatcctaattacttattattaatattcatattttcttcatactttgtacacaattcaaaaataacatcaaatcccaatttagtcacgatccaaccgattgcataattctatgcttccattaaagtatgaagatttgaatattctgtgaattcttagcgtattttgaaaagcttaatttttaatttctacttttgttacaatgttgtttcaatgtaactttattgtaataaaagtccaaaaacgaaaacttttcgtaatttcactaaaacctcagagcggtatactctaatcattctttgtggatgcacaagaaaattggaggaatatattttgacaaataatttgaaaaagtcattatttgttggcttggctgcattaagctttgctgccgtagcaggtactgctactacacaagcaagtgcaaagacttatgccaagatcacatctaataaggctttatcttcagacgtaaatactcgtaacgtgaactggactggttcatctgccttatatactaaagctggtacattgaagggtgcccgcgttgttgcaggtaagtccgctttaagtactgctgctgcatcaaaagacagcaagagtaatgtacgtgcataccgtgttgctactactaaccgtggttcagtatattataaagttgtttcatatgatggccaataccgtggctggatttacggtggcaaatcagcaacaagttttggtggtggtgttgaatcatacgcgacaactaagcctgttacgctagacagctctgctgcaaacgctacttatactttggcacaaccaggttcagacgctgccaacttagcatatgaagcaccggcatggactcaatacaaagtcggtcgtgccaaggttgatggtaaagtgattacaaccactgctccatattctggcgcacaatacaagatcgttagcgctgtaaccaactcacgtgacggccaaacttggtatcaattatctgctgcacctgccagctcagctagcgcatcaagtgctaactcaagtgctgcatcttcagcaagtacatcaagtgccaactcaagcgctgcatcatcagcgagttcatctgcttcagcatctgctgatcagttgaatactaagtgggtacaagcttcagctgttaaggctacttcagcttcatcatctgcaacaaatgattttgacgctaacaagagcgttaagatccaataccgtgatgtaaagaccggtaagactttggataagactaatacttggacaactgcttcaagcgacacaaagcagggtcaaactgttagcgattccaacttaaacagtgccggctacaaacttggtgactacatcttcaataccaaggcacctgctggttacacttggactaatgcaaatgcaaagagctttagcgacttgaccattgcaccagccgtttcaagtgcaacctttggttcaactttgactgttgatgttacaccaactgccgcaacgaccaaagtttcattctatacacaagataaagatggaaatttagttgctttaaaagcatctgatttctcaggtaatgctttccctgcattgactgatgctgatcaaaaggctgctttaccagatgttaacagcaacaagacaacatttgctaccgcagattattttggtgaaggtaaggcatttgaaaatgttcttaataccaaggttgctactcttgttcctgccaaaaaaggcgaattgaccgatccatatactaaccaagtaacaggtcttccaaaggttggtttcttcggacaagcacttaataatggcagtcaacgttacttctacgtttacagcgcacaagatactcttaacaataataatccacaacaatttcaaggtgctactgtgaaagttgtacttcagaagtttacaactaaccttccagacacaacacctaccaaggatgctaacgccaacaccaactatattgctcaataattagtggttaggcattaacggatttgatcatcaaaatagaaattttttcattttaagttaatagggggttcgggggataacaatggttatttcccgaaccctcttatacataaggcatcttgacgaagatgaccttattaatcattgataatcaatatattgactatcttgattctccataattgatttgggtgattggatgtgatgattcaagctcattgcattcgtcatttagcggataaaatgattcaagctcatttttattggctcactaggtaaacaacataaataacgggatcgacggcttactccaaggctggcgatcccgcttttttataaacaatttaataacaaattgagttgtaatgagtaatcaagaaacttacctaaagagataattttatagtaaatataatgcaaaatccgttatgttcatactttcttcacatttataaagcgtctgagaatgttgctatattaggataattgggctgttaacaatcctttcagagcctattattcggccaaaatatgaagaatatgtgaattttttaaatttttatgagttcctttgccagattgttagattgttatcatttggcaaaacagttgtaaaagtagactgtttttgtggtcaattggtaatgccataaaccattttttgacgctatactacttatattctttgtggaaacacaatagaaaaatggaggaatgcttttatgacaaataatttcaaaaaatctttgtttgttggtttagctgctttaagttttgttgccgcagcaggcacagctaatacacaggcgagtgcaaaatcttatgccaaggtgacatcaaacaaagctttaacttcagacgctacaacgcgtaacgttaactggacaggatcaagtgctctttataccaaagccggtacattaaagggtgcaaaagtcgttgctaccacaacaacattgaagaatttatcctcttcaacaagctctcagcaaaacgttcgggcttatcgtgttgcgacaacaaaccggggctccgtttattataaggttgtgacttttaacggcaactaccgtggttggatttacggtggtaagagtaccagcagctttgctggtggcctgacgtcatacgctactacaactactgcttcgtccgctccttcttcatcagcaacctttacacttgcaaatccgggatcagcttcaaccagttcattggcttataatgacccagcctggagccaatataaagttggccgggcgaccgtcgatggcaaagttgtttctgatacttctgtatactcaggcgctcaattcacggtcactaaagctgcctatacaactcgtgagggctcagatgcactctggtatcaaatttcagctgctccggccagttcggcaagtacttccagttcgacttcaagtgccagttcgagtgcgtcatcatcatcagcaagcgcttcgtccgcagctcaatcagctgccgcacaacttaacggcaagtgggtgaaggctagtgatttgaaagcgacatctgcttcttcatcatcgtcatcatccgctgcgtttgatgctgataccagtgtcaaggttcaatatcgaaatacgtccactggtaaccttgtgagcgatgcaagtagtacttggacaacatcatcatcaaattccaagcagggcgagagtgtatacaatagtggctcgagctttaaagatagcaccggtcgtgatttaggtgcatacattgttaatgcgggtgcgccatccggctacgcatttacgactaccgacggcgctgctgcttcaagcaatgggacaaccactaacttgaacgttagcccaacattatccaatgcaacctttggcacaacgattacagttgatgttgtacctgttgctgcaggcacaaaggtttcttacaactatgttaatagtgacggtgggttgacaagcttgtcggcatctgactttgcactgggatatcccgggttgaccacttctcaacaatcagctgatttgccttctggtggttctacaaccggatcattcaagcttagtgattactttgcttcaagtggtaaattcgaaactgctcttgataattcaaataccaaagttacccttgataataagaatctatacaccgatacatcctcaggtcaacaagtatcgcttcttggccaatcaaccggattctttggcagcaacgttccgggatcagataactggcgttacttctatgtttatgatgcaacaagcactgcaagcaacaatgcatcttcattgactaatggctcaactgttaaggttgttcttcacagatacgtgacccaagtttctgtaaacagcaaagatacctcaattaatgcaaacacgaattatatcgctaagtaactttagaaatagttagttctggtttaattatcagttttactttcgaatgatgatgcttcagagagggaagaaaggaattttctttcctctctacctacataaagtgtgttttacctgcacactttattaaaaaatagatatacattccttcaattaaatatatctaattccatataaattgatttttctgcaggtagttgttcaagccggctgcatgcaggactgataagggttccttcaagcttgcccgtatcggtttactaggtaactaaaacgtctcgagaacgcattcgaggcgttttttctatgttgtttaaagaaatgacttccaaccacatggtaaactgttatataattacagtgtgattatcaatgaattcatgaggaggaaacgggttatgaataagaatttacataaaacgttgtttatcggcttagcagctttgggattattcgcggctgctggtttttcaagtgctcagactgcaaatgctaaaagtaaagcggtaaaggtcacacgtgactatgccgcaagtgcaaaaggatcggacagaaatgtggtaccaaccggtcaatatgccatttatacaaaaccgggtactgttaaaggtgctcgtctggttgcaagcaaaacaactttaggggcattggcaaactctgaaaactcaaaggattactttagagcctatcgagttgcccggacaaatagagggtcatactatgcaaaagttgtttcttttgattatcaacatcgtggctggatttatgttggtaaaagtaatcctgacagtgattggtcatcggttggttatggcttgaagtataccgaaacaactaaagaagctgcaatgcctgataccagaaccgttcaattaaccaatcctggggttattaattcactatggtctgcaccgtatcgatcacaatatcgagctcaaaaagtcctgactgacacaacaccatatggtggggaagactttactgtcactcaatcagttgagatgatccgtgaaggcacaccatattactatgttgttaatgataatgatccgcagattcatggctggatttacgcaggggccgttattgaacaagtacccacgcctacagtgagcaacgacaaaattgtttacgcaaaaatcattgacgcagactcaggattagttgttgcagatcaaacgttgacaaatacccgggcagatttaaccaacgcaccagcctttgctgctactgaacttggaaatgggtcgactgacgaggcaaaacttggtgcatatgcaccgggatatgtttatgatacgttaagtgctgctgacaagagtgctaattacagtgccattgcaggtgccacgtatggttctacggttactgttaaggctcggttggcttcaactgcattgccattcagtaccttgactgacgcaaacctaacttcaaaatagattgatttgattcgttataatatgtaagaaaaatcacttaagataatatatgaacgtccaaggcattgtgacttgggcgttttgtaacgttaaagacagaatatgttttatttgtgacgaatatgtgaaaatataatgaatatgatatgatttgaattaagttggaacaaagtgtgaatataaatcgatgttttccttaaaaaacaattaaatttttaaaagatattacgaagaacaatcctaatgaaagctaattggatatgcagacaaatagatgcctaaccgccgttagaataggtgttccaagtgataaaacagtgattggtaagcgctattagcttcattaaagtgtggaatagcagtgcctatttatcgttctttttgtttacaacttatagccgagatgttattataatgtctgaaggggcgagagaattacataatcgcgtctaatatctttattacagagaggggaaattcgaattatgaaaactaacatcaagcgttcattattcgtaggtttggctgcattaagttttgtagctgttgccggtgcatcatctaatgcatctgctgcaaagaagagttataagattgacttcaaccaagcttcaagtagcgcaactgctactagtcgtaactatgttcctactggaacaaatgcattatatactaaagctggcgtattaaagagtgctcgccaagttgcttcaactgcaactttacaatcacttgccagctcaaagaagggtaatgactacttacgtggctaccgtgttgctaagttaagcaacggttcatactacatgaaggttgttacttttgacaaagcttaccgtggctggatctatgttggtaagactgatcctcgtagcaattaccaaagtgttgccggcggcttgaagtacactgatactactacagatgtaacttcaactttaactgacgcacaaaagaaagctacttatcaattgaacaatgctggtacttcatttgaagcacaaaccttcaaagaacctgcatatactcaatataagattggccgtaacacaactgataccactaattacaagaacgatacctttacagttacaaaggctgtaaagcgtaaccgtgaaggtgatacttggtattacgtaaatgatgctaagaacccatcagttaatggttatgttctttcaacatcacttagagaagctactggatcaagctcatcatcatcaacacctacaactccaactgtttctgtaggtactagccaaactactattgacagtactttcaatattgaaggttacagccaagctactggtggtaagcaagtagcccatgcacaatggacaattcctctatggaacggtaacgttaactggaacaacgctgttaacaagttcaaccgtgatcgtactgtaatgggtaacaagaacgatgttatccctacagacactttgaagactgcattgaagaacaatggcttcaatcaagtttacatgaagatcacaccaactatcttacctcgtcttgcaggtggatggcttgataacgttgactcattaactggtgtttacatgaagttcaacttggatactgacagtattccaagcaatgctcattatggtgatacacttcgcttaggttacactgttgatgattcagcattgtacaccaaggctggtggaagcactaagaatgaaaattcaagtgctaatgctgatggttacatcggtatgactatctatcgtcaatgggtaaagaccattcttgatatgtatgttgttaacccatacctataatctttaattagattgttagatatgtaaatggaaaaggcatctccattgggggtgctttttttatacatacgtttcgtttaaatgatttggaatgaaattataacgcctattctaattagataatgatacacaattttaacttttgtaatatggcattaattgattaaggggttataatgaatgtgtagataacggattatagtgattcgttttccttacatatagatataggaggggatcgtattgaataacaaatttagcaaagccgcattgttaagtgcagcgttgtttggcttaggatttgcggcagtttcagcaaattcaaataccgcaagtgctaaaagttatgcaaaggttaagtctaatagggcttataccactaactacactgaacggaattatctgccatcaggatctacggctttatatacgaaggccggtaccctaaagggtgctcgaaaggttgctagtgcttcgacattgaacgcattggcaaataaatccgataaaggacaaagctattttagagcttatcgaattgcaaagactaatcggggatcatactatttaaaggttgcgtcatttgataaaacttatcgtggctggatttatgcaggtaagtcaaacccgagtggtaagacatctgttggcggtatgaagaaagtttcaacctttaatcaggggaacttaaccaccgacatttcaaacacgacttattattttggtgcatcgtcgacaacttacaagcaacctgattggacacagtataagatcggccggaatatggattcactttctggtgactacacaaaggatgctttgagagtgactggcgttgggactaaaactaatggtcgcgacaataatgctacttattattttgttgaagattcagctcatccaacagttaatggttggatcaaggcatctgatttgaagtctggttcaggtacaggcacttcatcatcttcttcatctactaatattggtgccaaccaagtattggttaactatgttgatgcttcaactggaaactcagtgacaaccaagctattaacgaataataattcatcaactcagaccgctgcaagttacttgggtacaaacttatccggtcaggcatattcaaatattccaaccggttattcagcacctggcgacagcacccaatatggtacgtctaacacaagcgcgttagcagcggcatcatatggcaagcaagttaattactatgtcattgcaacgtcaagtgataacttgttcagcacatctccaaaatacacatcaaaagcaaataatcgaacttacagtggccttcctggcgatcctgtaagtaagaatgcctttacttcaccacaaggggttcagtttagctcgttgctttccaacttagccaagagcagttacacgagtggtaatggtggacaacgtaccactttcacttctacggacgtctttaatgccgttcagggtgcaaagatggacaccatttactatttggcatactgtgatccaatgagtaatatccttgatggtactaagcaggcaattttgactgcatcaagtactggtacaccaagtgtcagcggcttgtttggaacaagttcaagctctagtacgagtgatacaacggatcaactttccgcaatcttaggtgcttcgggaattgattccacaggaattttgagtggccttggtaatattatcggtagtggcttggatggcattgcaaacagtttgtttggtggtcgaatttgctacagaatcgttcaattaacgacttctcaagatgcaatcaagactgctaacggcgacagcattaagatgggaactcaagtaaccattccttatactgctacagcttcaaaagtggttactcaagatgctattacgggataccaaaatcaattggatgttggctttactaaagctggcacagacgcaactgaccaaggaaacgcctttaacgataagactttccaaagcagcacaagcgcattatcaggcttgttaacggatggtagcggtacgacttcaactaccagtagttcggccttaagtagtgattccagtttaagcaatcttttatcaggattgtttggcaattaaatagactgatttaatatgagcattaacaatccgatttcgattctgaaatcggattgttttttgcattaaaaaagccctgtggcatctatcgtagatgaccaaagggcttggatgaaattaatttattttgttgttgtggtcttagcaacctttttagtgaccgttgtcggtgtcgttgcttttttcgtggttgttttagctgttttcttggttgtcttaattttatcttttggataattgttaatcataaactgggcgatctctctacccattaattgataagtcttggcagacggatgtagtcgttcatcatacaagcggtattcatgattgctgtctgtaattaattgtgtggtatctttgcgccaatccaggtaagggatattgaattccttatatacctcagcctccgcatcacgtaggtcgttcatggtgaagccacctttgccgataatgttatcggagttggtatttgaatcataccgggtagttggcagaataccatagataataagcttcttattgtcagacttcattttcttaatgttttgtcttaacgtggtttgaatatcggagatcgaatttgacacatgaccgtaatcattagtgccgtaagcgattgttgcaacatcgtaattcttaaagttatgtgagttaaccgtcggtgtcagatcaccggttgtttcctgttcgccgccatcacacaagaatgcgccattgtatccggcattcaaaacggtggtatctaagtatcgatttaaccaattagggtagcccatgttatctaatgtttcgtaaccgtcataacctttagtaatggagtcacctaaacagataatattctggtttttaaaatagtcactgtttttcattgcaatatcaaaagtcccttctgagattggttcgagatttccttgccaaatccagccggattgggcgccagaaccgcttttaacataataccaaaccgaatttccggaaccttgggctgaccgatcgatgacagcctttttctcagtataccaagtaacctttgaaaaatctttagctgggccggcttgcttatttagtttggaagatgtataaacataacctttatcaatatggtatggtaattcttcatcaacggttgtgctgctgaccaatgttgcagctgggattggttttgtggatgacgaacttgctgttttggaactggatgtgctgctttgacctgacttagtggcaggtgcggtcgtttttgtaggcgtagccgtcttactggctgcttgagtggtgattgtcgtggacatccccaataacgtcgcaattgcaacgacgatgactctcttatttttcattctcataatctcctcaaaatattgttaacgcatttaagaataccacggtaatgttacgaacattttacgggcgagtgaaaacctcataactaaccgatggcggttcagtttcccgatttaagttaaaatgacgttcttttacataacacgcttgaaaaagaatcgcaaataatttatcatagaacatgtatagtacgactactttaaagtcggggggaatgtaccatgaacaagaagttcaaatttagatggtctcttatggcatcgtctattatgttggctttgttcggtttcggcgttgggggcaacgctgaagctgactcagccaatgtatcaacacctgcgcaatcgcaggtaactgccgtcaacccttcttctgcagattctaacgatcaaagctcattacatactactggggataatagtcaatgggcgcttcaaagttcgtctcaatattctgaaagtgtagaagaagccgcttcctcggatggcacgcaaagctccagctcagcagtaactggttggaacagtgttggctcatcaagtgcagccgattcttcagacagcacatcatcgagtagttcaagcagcaatgggggcacgacgactacttatgacaatgctaatagcaataacgttgatccaaatagtgacagctcgtcttcagcttcttcaagtagtgctgatgcgaattcgtcctcttccgaaccgatgctcggtttaggggataaaggatcagcaggcgcaggttcgggtgccgataaggttgttaagaagataatcgataaggttgttccggggggtggcttggataataccaaaccaaacgtaccggccaatagtagctcttcggcaactgctgggcaacaagcaaatactgctactggtgcaacggacagcagccgtgtttcagatacacagcagtctgacactaatggccagggaaatgcttacgctgccaattcagctgttgctgcacaggccaagcgtcaaacagcaattgagaagcccagcgccaatgatgctatgacacacaattcatttgccaaccgggtctctaagagtgactcagctaatgcacaaaagaatacaactaaactggttagttttaatacgtttagtaatttattttataagcaggcactcaataacaaaaagaatcctggtaagtttacaacttcaaagggtaaaaaggtgacaattacgacaccggtttccagtgtgaaatataccgatcacgatgttaacggcattgttgaaacattgccggttattattacattgtcaattattggtatcgttgcgttatcgtttatcatttttgatccattacggtttatctttagataatattgaacatgaacactaaaacagacttgagacgtccagtatgggacattttgggtctgtttttgtttccaaaagctcggtcattcatgactgaatagttcacagataacatcagtttgtgagcatggagctgacacccaaatgagtgagagtgatcgcatttggacaaatgcttcgtctcaacatagccggcggcccctttttggtcgaaaggtgagtaaaaagctgttttatcaaggaatcggaggagaaagtcacaaatgagtcttaaaccttgcaaacgctttcagatatggtattatatagttaaggaagggaaagaagttcgaagcattaagggttttaaacctactttgagcgttcttccaccagcaagtacttgttggaaacgtaactttattttcaaatgtttgtaatttgaagtgatggatgattaatcttggtgagtatgagttttaaacagtaacattggttaggatgattacaagcgaggatgacaaaattaatttcaggtgattaagtgtttgaatataaaatgatccaatcatgcgaaaaggatttaaagatcgactattaatactcattgaagtaatagaatagatcattgtacaggggtcgcttgtagtagatcgatgaatccgataagctgtcaaattgatgtgatatcaaattgacgcatagataacagattcacagatccgattatcaagaattaaatctttacagcatcagtgtttcagtaccaatcatttacagttttaaaagttccaagttccacgaaacatcaaaattgatcgcacggcaaatttatcaaaagttaaatgttaaaactgattcaagtttgcggcagtaggtcaatttaatgagttaaattgaggcgataaaacattagatttaaacaagagtgggcattaacccttagttataatatcccttccgatcaataggcactcaggttgaaacgcatagcaaacctgaggcctatttttgtgctcaaaataatgatttcttgtgaaagacctgtgcactttccgctagggagtgggagatgttatttttatgacgcactaagttgtgtcaagaaatcgtttttgctataatgtaagcgcacacaatatagtaaaaggtcttacttccgaaaaatgattgaccaattgatttacaggtttcagaatattcggtattctagtcaatggaatgagtttttctgctaatttttgtaaaagaggggaatcgtttatggattttcaaagggtcatcgtgattgatcttgcgtcactgggtattggtgaggcaagtgatgctaatcgttatcattcgattggcaccgatactctggggcatgttgcaatcagagttggaaataggctcaaactaccgaccctgggaagactgggattggggaatattcgctttggaaatccggttaacgggttaccaccggttgatcagccgcttggcttttacgggaaaatacatcttgagggattgagtaacagccctgaaggcggcattcgagagatgcttgattatcaggacggcattcgggtgacaagtgtgattgatccgattgtcaaatacagtgatgattacgcccgctcgattatgattaccgattataaaagctacatctccaatcagaacttagccgatattgtagcagttaacaaagattctctggcttttcagacacttcaccatgaagtgatatcaccggttaagggactgatttatatgtccgttcagggattgccaagagctgccgagaacggaagtgtcgatcagtaccttgaaatattgcgtgaaaccgatcaacacattgcccaagtgattaacgagatgagtcgaactgatctgctaatcatcacagcgacatttgctaatgatatgaccgcggctgtttcacctactcgagaatatctaccgctgattgcctatacaccttcaaatgaagatgggcgggcactggggattcgtcattcgttagccgatattggtgcaacgatcgctgaagccttttccttgagttactcaaaggaatcggtcggccacagctttttgggcgagctattatcataacggggtttaaacttttaaaaccaaattcattataagggggatcgcgggtgttaaatattatttttggccatagtcgttttagccattattgtttcgttattcgtaaaaacagaaaagaggatttccgcgtatgtcgttaacttatttattagtcaatatactgggtgtcattgtttacctgggtattgcgatattattttccaaggatcgaaaggccatcaattggcgttctgtccttgtcgtgttggtcattaaccttgtcattgccttcgttctaaccgagtttaaatggggtcgtgacggtgttaaagccgcagccgatgggttcaactggctggttcaggtttcctataaaggcattgcgtttgcattaccgaactgggtgacacctgattttggcggaacagccaaatcaatgaacttcgttaccagtgcgttgctgcctattttgatgattgtgccattgttcgataccttaacttatattggtgtcctaccttggatcattaaatgggttggccgtggcttatcatttatcacgggcgcacctaagtttgaatcattctttgccgttgaaatgatgtttcttggcaacactgaagcacttgccgtttcatcactgcaattaaagcaaatgtctgctaaacgaaacctaacgttggctttgatgtcgatgtcatgtgttaccgcgtcaatcatcggggcttatacccagatggttcctggacaatatgtattaactgctattccattaaacgttttaaatgcgcttattattacgagtattttgaatccggttaaggtgacacctgaagaagataccattgccaagatgggtggaagcggtgctgcaagtgaagctgccgaagaagccggcgaggtttctgccgatggcaaaagagaaccttacttctcattcctgggtgattccattcttggcgccggtcgtttgattttgatcattgctgcaaacgttattgcctttgttgctttggctgccttgattgataaaattttggcattattcaacccatggttgtctctcgaacatattttaggaattattatgttcccatttgcctggttgatgggcctggatgtcgaccatgccttccagtttgcccaatttatgggaatgaagttagttaccaacgaattcgttgttatgggtaagatcgctggaacaattaacaatctcagtatcttcccagctcactatcaagcccaattaacggtcttcattacatcatttgccaatttctcaacaaccggtatgattatcggtgccttcaagggcttggttgacaaaaagaaaaatgatttgatcagtaagaacgttggtattatgttactttccggtattttagtatcgttgatgtctgccggaatcgttggactatttgtatggtaaacttgcaaattcgaaagctaggtcatatttttggataagttacaaagagcagaagccgtagccaataagctgcggcttcgtgaggctatacgagataaaaacctgataaaacgtgagattattgccggtgttaccggtttcttcgcaatttcctatattattatcgttaatccgatgatcttaaaggatgccggaatcccgactgatttaagtgtttttgcaaccattatttcgtcattgattggttgtttgattatggggttctgggcgaatgcaccggtgatcttaacaccggggatgggcgtcaatgccttctttacctacacggttgtcgtgtcgatgggattgtcatggcaggaagcattggcaatttcgatggtagccagtgttatttacgttttaattgcattcaccaagctgagccaggtgttggcggatggtattccggatacgttaaaagcaggtataactgccggtattggtctatttctggttgaaatcggtttggaaaaggcccaattaatccaggccggtaagagttcaattttggcacttggcgatttaacacaaccagctacgttattggcaatgtttggcctgctgctgacactgttcctttatattcgaaatgtaacaggtggtttctttattgggatcttcgtgacctcactattaggtatcctgttcgggattaaggatcaggcatcgccctctgtaggaatcggcgacattgccaaatactcacagatcgttggaaaaggtgactttagtcatgttttcagtgtggcatttgtccttgctgtcttttcaatgacaatgatcttggtgtttgaatcgatgggactattggaaggcatcatgccaaatcccaagaagtttaagaaagcatttcaagcaagttctattaccagcttcttgtccggtgctttaggcacaagcccaacggttgctgccgccgaaagtgcttcggcaattgaaagtggtggtagaaccggcataacagctattgtggccggtctcatgtttgccgtttcaatgtttttcatcccattgctatcatttgtaccacaggctgcgattgccccggtgattattattaccggagcgctgatgatgaatcagttgagcagaattaatatgtttgatttttcggattggttccctgcatttttgattgttgtcttgattccatttacgaccagtatctcaactgggttggcatttggatttgtggcttatccaatcctgaaaattgcagcagggagggcaaaggaattaacggttgctacctacgtgttaggcggtttattcctatgtgatttagtcctttcggcgcttctataaacgcaaataaaataaaaaggggaagataaaaatgaccattaaaattgtaatggatactgatccggggattgatgatgcagcagctctaaccatggcgctgaacgatcctcaaatcgaggtcaaactgattaccagtgtggccggaaatgtaacggttgataaaacaacaaaaaacgcgcaaaaaattgtgcgtttctttaacaaggacgtaccggttgccgctggtgctaaacaaccgttaatcaaagaatttgaagatgctgccagaatccatggcgaatcggggatgcccgggtatgactttcccgaggacctgccgaaaccacttgataaaagcgctgttgaggcattgcatgatacgattatgagtagtgatgaaaaaatcacgctggtaccaacggggtcatataccaatatcggactgttattcagcgagtatcccgaagttaaggatcatatcgagcggattgtggcaatgggtggctctcttggtaaagggaacatgaccagtgctgccgaattcaatgtcttcacggatccggatgctgctaagattatgtatcaatcgggtattccaatcaccatggttgggttggacattacaatgaaggcattgattacgccggcctcactcagcaagttggaaacaatgaatgagacgggtaagatgcttcacgacatcattattcacgatggcgataacagtgatgagggcattgcgatgcatgacgtgaacacgattttctatcttttgcatccggaagcaatcaaaacacagcctatgtgggttgatattgtcactgatggtcctgcaatcggtgaaacggttggtgatattcggggtgcctatcatgatggtaagaccaacgcagatgtttgtgttgacattgatgcacaggcctttaatgactggttcctggatgaagttgcagccatcaccaagccataaagagcgttaacggttttgaaaaatgaatcagcttattaaaatcaggagattgggacaaaacgattgtttattccagtcccctttttataatggggtgaataagcatcatacttattctttaagaggattgtttacaatttcataatggtattttatgattgaagttagttttaaaagagtggggaaatgaagtgggtgagttatttgagtgagtttgatcatgatttaattgaatcacttttcataaagtacgcgaaggtcaacaccagatccaacccgaatagtccaacggtaccgacaacgccgggacaagttgaactggcgcaaatgattgtcgaggatttaaaaaaattgggtatcaaaaaggtgacatacgataccgatagtgggtatacattggcggagctgccggggaactctgagaaagaactgtcaccaatcggttttatagcccatttggacacagcggattataatgccgaaaatatttcgcctcaggtccatgcggactattcaggggaagacattgtcctgaatcgtaagaaaaacatgattttaagtccaaaacaatttccgaatttgaagaagtttattggtcaacgactgattacaaccgatgggactaccctgctgggagctgatgacaaggcagggattgcagcaattcttggcgccttggatgacctgttgaagcacccggaaattgaacatggaccggttgaagtagcgtttgggccggacgaagaaatcggcagagggtcaaaacgctttccggcaaaagcctttggtgccaagttcgcatatacgatggataatggtcagcccggtcaaatcgaacctgaaacttttaccgcctctcaagctgaaatcagcataaaagggacggctgttcatccaggtgatgcttatggattgatggtcaatgccgttagtttggccaatgaaatcctttccgcacttccaaaagatgacgtacctgagaaaagccggggtcatcaggggttctttttggtaaccgactttaacgcaacaatttcagaggctcacttaacgatcattatgcgtgattttgatgctgacaagtttcacgaaaaggaacgattgcttgaagaaacggttcagcaaatcaatgaccgtttcgacgttcccagagtggcacttaaaattgacgagcaatatcaaaatattggggatgctattcaaaagtatccatatgtcgtgaatctggttttggatacttacaaacgtttggggattaatcccagaattacaccgtttcgtgggggtacagacggtaatgcgattacggccaagggcattccgacacctaatttatttaatggtggggataatttccatggtccatacgaatatattacgacagaggcgatggcagacgtttcaaggatcattgtcgagattatcagggaacatgttcgccaatatggtcatgaaaatcaaaagccagtgacattcagtgattaaacgggttttgatcaggttttgttaccagaaatggtttttgccttattaagtttaatttttaaccacaaaggtcggggttctcccggctttttcttttcgctcgaaaagtgatcgtcaacatattataattttaaataggggagtttaggattttagacaacttcttacacagtagtccttgtcatatcaacgattttaaggtaaagtagaataagacgtgaaacagaattgtttcacatatcaggagaatttatttaatgaatatcgatcaatttatcagtgcgcttttagcgcagaacattcaagtaaccgatgatcaactaggccagtttgatgcctatttcaagctattagtggcgacaaatgaacatgtcaatttaacaactatcaccgaaaaatcagaagtttatttaaaacatttctatgattcgataactcctgctttttttgtttcacagattcgtgaacaaccggtttcaatttgcgatgttggtgcgggagcgggttttccatcaattccgttaaaaatcctgttccctcagctaaaaatcaccattgttgattctctgaataagcgaattcattttttaacagaattggttcaacaacttcatttaaaggatgtcacattggtccatgcgagagccgaagaatttggcaacaagaaatctgccagtcgacaatcatttgatattgtgactgcgcgggcagttgccagattaagtgtcttaagcgagctgtgtctgccattggtaaaagttggcggccaaatgatcgctatgaaggcagctaaggcggaagatgaacttgaagatgccaagcaggctatttcactgcttggtggtcaggtgaagcacgactttgacttttcactgccgattttagacgaaaaacgacacattattatcattgaaaaaacaaaagatacaccaaaaaagtatccacgtaaacctggaacccccaatcgggaaccaataggaaaagtaaataagtaaggagggaagacatgtcatatgtgattgcacttgccaatcaaaagggcggtgtcggtaaaacgacgacggctgttaatctgggcgccggcctggcttcacttggtaagaagattttacttgttgacgccgatgcacaaggaaatgcaaccagcggtgttgggatttccaaggccgatatcggcaaggacatttatgatgtattggtgaacgaagagtcaatgcaggaagcaatcgtacatacagctcatgagggcttggatattgtaccggctaccattcaactgtctggtgccgaaattgaattgacaccgcaaatggctcgtgaaacgcgattgaaggcagcgttggatgatgtaagggaccagtatgattatgttttaatcgattgtccgccatcactgggattaattacgattaatgcttttaccgcaagtgattcgattctgattccggttcagagtgagtattacgctctggaaggactcagccaattgctcaataccattcaattggttcggaaacattttaatccggatttgaaaattgagggtgttctcctgacgatgtttgatgcccgaacgaatttgggcgttcaagtcaatcaagaggtccgcaagtattttaaaaacgaagtttatgagaccgttattccaagaaatgttcggttatccgaagcgcccagttacggcttaccgattatggattacgatccaaagtcaaagggtgcggataagtacatgaaactggcgaaggaggtgctggccaaccatggtgaataagaaaaaaccgactggattgggaaagggtattgaagcactttttcaagacaacaccgtagatacgagtaaagaaaatgtgattgatattaaagtgagtgaaattaagcccaatccatatcagccacgacaccgatttgaccagaaagcacttgaggatttggcattatcgattaagaattccggggtctttcaacccattattgttcgtcaaccggatcctgaagttgagtcgtatgaactgctaaccggtgagcgacggcttcgggcgtccaaaattgcgcagcaaaaaatgattcctgccattgttcgagatgtcaacgaagaacagatgatggaaattgccgttttggaaaaccttcaacgtgaggatttgacaacacttgaagaagccgaagcgtataacatgttaatgactaggcttgatctgactcaggcacaagttgcccaaaaacttggaaagagccggccatacattgctaattatttgagaattcttgggttgcctacggaagtcaaggaaatgcttgaggatcataaattatcaatgggtcaggcccgaaccttgctttccgttaacaataagcaggaactcatcaagctggcccgcaaatccgttacggattcaatgacggtccgccagttggaacaggctgctgcaaagattaatggtaaaacgggcaataggaaaaaacgggttcaaagaaaatcaccgtttgttcgggcttctgaaggccaattacaggaaaaattcggaacgccggtttcgattgtgaactcttctcgcaagaagggaaaagggaagatcgaaattgaatatgtatcaacggaagatttgaatcgtatcttggaaatgttggatgtgaacttggattagttgagttgcagctgtatgtcatggtttaagacataaggttctacaaccaccttatccgaaaagctgtcacctttagaaaggatgttcaatatgtacggtctccatgatttagttgaaatgaagaaaccgcatccatgcggcactaaccgttgggaaattatccgaatgggtgctgatattaaaattcaatgtacgggttgcggacacattgtcatgatgccccgaagagaatttgaccgaaaactgaaaaaattacttcaaaaagcagaaaattctgaaaaatagactagaaagaagagttgttaagttatgtcactaactgcaggaatcgttgggttgccaaacgtcggaaagtctacgctgtttaacgcgatcaccaaggcgggcgccgaaatggccaactacccatttgccacaatcgatccaaatgtcgggatggttgaagtccctgataaacgtttggataggattcaggaattaatcccggctaaaaaagtcgtaccgactacctttgaatttaccgacattgccggaatcgttaagggtgccagtaagggtgagggacttggaaacaagttcttggaaaatattcgacaggtggatgcgattgttcacgttgttcgggcatttgatgatgataacattacccatgtttccggaaagatcgatccgattgatgatattgaaacgattaatctggaattgggaattgccgatctggacgctgttaacaagcgactgggaaaggttcagcgtgctgccaagggtagcgacaaggaagcaaaagccgagttggcagtccttgaaaagattaagccggttttggaagatggtggttccgttcgctcgattgcgttcgatgaagatgaagaaaagatcgttaagggcttattcttattaaccagtaaaccggttctgtacgttgccaatattgccgaagaagatatggctgatcctgagcattccaaatacttcccgcaaattgccgattatgcggcaaaggaaggtgctcaggcaatcggtgtggcagcggcgccggaagaagagattgccgaattggacgatgatgaaaaagctgaatttttggaagcagaaggtgttgaagaacctggcttgaatcggcttattagagcttcttacaagctattagggttggagacattcttcactgccggtggcaaagaaacccgtgcatggacctataagaagggtacaaaggcaccacaggcagccggtatcatccattccgatttcgaacgtggctttatccgggcagaaattatggcttttgccgatctcgataaatacgagacacctgcagccgttaaggaagcgggaaagcttcgtcttgaaggtaaagactacgtcatgcaggatggcgacattgttgaatttagatttaatgtttagtaaaagtatttgaaaaataagtaatggggatgagatgcgagtgagtagtagtgaagaaacaaaacaagaacgtaacgcccgcaaaagaaatgccaatgttcaacaggatcgggatcgggcaaagaaaattgttcattctcaatttgacaacattgggttaacaaagcgaaatgctgagtatatgttcaaatttaatcaagaaattgcaaagacaaaactgacgccgcaacaacaggctgataccatccaccaaatggtagaagaactcttggcgggacaaaagtccggtaagacagcccgtaatatgtggggaaccgttgaccaaagaattcaacgggttctgaatccaccgaaacgtaagccggatattaagcgtgattattggccgaatgcgttttataacatgcttttattctttgttatctttacgtttttatatgggattacctttttcttctcaaagaacagtgcccgtggcatgatggggattacaggaattgtcctcagctcaattattgccggtttggggattcctgccttaacaatgctgattcagccgggtgttaagcataagtatcccttgtggttgagaatcatctttatggtgcttttctttgtcgtatggatgggtgtattcttctttgccggtttgatcccagcagttattaatccggtactcaatccatacgtttatattgcacttggtgctgtcggcgttgttggtgcgttctttgttaagcggaactttcaaattaccggtggcctgttttagcagacctgatttaacatggtctatgatgtgaacggaatatgaatgatttaaggtaaaagtctgatcaaaaaaggggacgtacgttcacgatttgatcagaaaatagagttgaataacggtgcatcacgaacgtctgttttgtgatgtgctgttatttttttacgtgaaaatgtaaaacacgaacattgaattcaattaaaaatgatcggtttgatattgtccgtaaaaaaaataacttttttccttttattttttaaaaagttcgtgtataatgaatacaatttttaacctatcaatgtctggtaatcatgatgttagattaaatcatcattagaaatctttcagaaacgttgattttgtgctaacaacatgataagttattaggcaatcaaattttaaaaggagcgagatagatggttagttgggatgaaaagttcggaaaaaagggttttacatttgatgatgtgctgttagtacccgcagcaagtgatgtattgccgaacgatgtggatttatcagtacaattggcagataatttgaagttaaatgttccttttttaagtgccggtatggacactgttaccgaatcgaagatggcaattgctttagcaaaattgggtggcttgggcgttattcataagaacctcagtattgagtcccaggcaggagaagttgctaaggtaaaggctgttaagaagacgactgatacacctaaggcagctgttgacaagaatggttcactgttagttgccgctgcggtaggtgtttcctctgacacgttcgatcgggcatccgctcttttggaagccggtaccgatgccattgtcatcgatactgctcatgggcattcggctggtgttttgaggaaaattgccgaaatacgagatcattatcctgacacaactttgattgccggaaacgtggcaaccgctgctggaaccgaagcactctttcaagccggcgttgatgtcgtcaaagtaggaatcggtccaggttccatctgcacaacccgagtggttgccggtgtcggtgttccccaactaaccgccgtttatgatgccgctgcagttgcccgcaaatggggcaaaccgattatcgctgatggcggaatccagtactccggtgatattgttaaagcgttagctgcaggcggaaccgccgttatgcttggcagcatgttagccggaacagcagaagcaccgggtgacgtgtatgaagaaaacggtcgaaagtataagtcttatcgtggcatgggtagtgttgcagcaatgagccagcagcatgggtcatccgaccgttacttccaaggtggtgtcaatgaagccaataaattggttccggaaggcatcgaaggagaagttgaatataaaggcagcatcaacgatattgtctttcaaatggttggcggccttcgctctggtatgggttataccggttctgcaaccgtaaaggatttaaacgacaatgcccagttcgttgaaatttcaaatgccggtttgcgagaatctcatccacatgatattacaattacaaagcaggcacctaattatgaaccggaatcataattgtttcggttattaaaatccggtagtcaataaaacgaaagggagtcactaattgtttagtagcaattggtgactccttttatgatgccaaacaaatcaggcatcaaacgataactttttcttgtgtttaaagaaactacatgatatcataatgatatcaaaaaatgatgcatcatcttttgacaatcagtttaataaacgaaagcggttatgttatgggggatacggaaaaacgcttcttactgcgattaagtcagcaactttacgaaaagttggcagctgaagcaaccgaaaaaaataaaagtgtcaatgcatatattgtcagtttattggaagacgccgagggagataccaattttgagcatcgccagtttatcggtcgagcaattgccggtaaggatatctatgtcgaaagcggtttggtcatggtttccgggatatactaccgttatttgattgatgacaacagtcacgttgataaacgtgctcgatatactgtgattgaggctaatggaaacattttaaccctacgaaaaattaaggagtgatcatcttgcctttaggtataaaaattgtcccgcaaaataatcagggacttgttgaaacatttggaaaatatcgtcgaagtgtggcctctggatttcatttttatctgccaatcattcaaaagattcgcaccgtcagcttggcaatggaacccaaagcattgccgaattattctattatcacgaaagataatgcggacgtttccgcgagcttgacgttgaattatcatgttacagatgcagttaaatatcaatatgaaaataccgattctgtcgaatcaatggcacagctggttcgtggtcatttgcgtgatatcatcggtcgaatggatttgaatgaagcgctgggatcaacagctaaaatcaaccaggaattgacgattgcgattggggacctgaccaatacttatgggatcaatgttgaccggattaacatcgatgaattgacaccatcatcagcgatccaggaagcaatggacaagcagctgacagccgatcgtgaacgggttgcggcaattgccaaggccgagggtgaggcaaagtcgattgaattaacaacaaaggctaaaaacgatgctttgaaagcaacggcaaaggctgaagcagaagctacccgaacacgggcggatgcagaacgttaccgaatagatacggtccaagccggcttgtcatctgcggatgataagtattttcagaatcagtcgatcaacgctttttcggaattggcaaattcaccggcgaatatggtggttgtgccatctgataagacgggtgatttaggtcaacttcccattgcgggaaaacttctaaaaaagggcgccgatttataggcgttcagcaaaaaaacgggtctccatttttggaaactcgtttttactatggtcgcttaaatgtgttaatgaaacttgacttggtggctgtggacctggcggacaaacggatcttgaaacagcgtattctgggttaacgatgcagttgcgtcaagcgatgctgcatacaagttacgaacacttgcgatatcagctggttgaatagtgtagaatcggtttgctgcaaacatcacactttgtttgatcggactatgataaagtccaatggcgtgacctaattcgtgttcagctacgttggtttcctgtgatggcaggtagccaacggatgtcatcactttgggattcagggtgctgtctgcttgcgtaatcacaccctgattgttaatcgttaatttagtaagtccggcataacctgtaccaatactggtgtttgaactggcaatgatttgggcagttgaactcgtcgaaagttcgaaattaaaagccccggtgttattccaagcacgaatggcattcatccagatgactttgtaactgctgctattgttattaatgtttatagttgcgtttggtgattcaaagcgggcagttccatggggcgtgattgggtcagccagtgctgaaattggcaaaaaagtgaatagagcggtgagcaatagcacatacaatgaaagaagactcttttttcttaacattgatctcacttccttaagtaactaaatcagaaacgagaaagtttaactgacaaacagcttgcgtatggttgaatcagcagcataatgtttccttaataccaacttaattttatggttaaacagactgaatagcaatcaaatacatttttcaaatttaatactaaatttattgttttctgttctctgttttggaaaaagagcttatgataatgaagtgtagataaacgttttaactgtcaaatgaactgacgttggaacggaattttaatcataaaaattaattcgttaatgagggggactgacatggactcagaaagtattttggagcaaccatacatcaatatcacaaatatcatctggagcttcgaccaaattaccagtaaagttaatattttactcgttaagcgaagcaacaagccatataacggatactgggcacttcccgagacctttatgcggactaatgaaagtgctgatgaagctgcacttagattggtaagggcaaagattggcatggcactttcgaatagtcatacagagcagctggcaacgtttacgaatcggttgcggacacctgagcagcgaacgctatcattggcatatatgacctttttaccggataagccgatgctaaaacccgggtatggggcttcggatgcccgttggttcagtatggattatacggaaaacgggtatgctttttcggatggcgagctgaccttttcaacggcacaaagtcaaacagaatcccaatactatgcaaaattggctaaaagcagtctgagcaaagcacatttggcctatgatcatgagtggattttgaaggtggcctgcgagcggattaagaataaattggattatcagccaaatattttattggttctggggccacagtttactttaaaggatgcccgcttggtttacgcgcctttcttaaaaatgccgtttgaactgattgacaattccaattttaaaaaaagtcaccgtcatttatttacggacgttggcacatcaatgtccaacagaccgggcaggccggccagggtttacaaactatcgtacttattcccttgaaatttttgccgatgcgcgttaccttagaataaaagttgaagcgacttttatttataggtacataaaagtaaaaatcacctttattaatcaacaaaattgagaggaaacgtgtaatggataatttatcaatgttaactgatttatatgaattttcgatggcaaacgggtatcgtcaaaccattgatgatgagcagggcgtttttgacatcttttttcgaaaggtaccggataacggtagcttcgttatttgcgcgggtctgcagcagattgttgagtcgttaaaagactttcatttttcgaaacaggatgtcgattatttgcggtcactgaaactatttaaagagaacttccttgattatctcagtgactttcattttgattgtcaggtatcagctattccggaagggacacctgtctttccccgtgaaccgttattgaccattcagggaccgttgcttcaaacacaactgtttgaaacgttattattgaatatcatgaaccaccaatcgttaatcgctacaaaagcgcgtcgaattacctttgcggctggcgataagcccattatggaatttggtgcgcgtcgggcacaggggccaagcagtgccacgtttggtgcccgggccgcggtcattggtggttgcgcaagtacatcaaatgtattggcggcggaaaaatttgggatcccggcagctggcacaatggcgcatgcctggattgaagcctttccggatgaattaacggcctttgagaagtgggcggatgtctacccggataatgcttcgctgcttgtcgacacgtatgatgtattgaaatcgggtgtacccaatgccattacagtctttaccgaattaaaaaagaatggtcacaaacctgtgggtattcgaattgattccggtgacattacccaattggccaagggcgcgcgaaagatgttggatgatgccggttttcctgatgcaaagattactgcatccaatgcgttggatgagcatgtcatccaatcattgttaaacgaaggggcaccattggataacttcggggttggagaaaaactgataacaagttcaacgtcgcctgttttaagtggtgtttataaattagctgccattgttcaaaatggaaaaatgattccaaagattaaagtcagtgccagtcgtgaaaagttgacacttcccggcctcaagcaggtttatcggctttatcggccaaataccaatcaggcatttgcggatattattgcgttaaacgatgaagtgttggatcggccaatggatgttgtaaaagcaaatccgatcgcaaccgagcgccaacaatcaattgaaaattatgttgccaaaccgcttcaggagaaagtcatggacggcgagaaggttcaggctgaattgccggatgttttcaccattcaaaagcgatccaaacaaatgctgaaagaaatcccatccgctacacaacggttggttaaccccgacgagtatccggtttacatgaccccgaagcttgctcaattacaggaaaacttggttgccgaagaaaagaagtagtttaggattaagtaccttctttgcttcttgaaatagcagataaaagcttgtcaaagattaagtatgataaaatacaggcagtcgtaaaatgcatgattcattatataggagaaaaacatgatcaaaccgattaaccataatccattaacgttgtctcaaagggcgcaaccggcaacgtcggctgattctcaaatcataaccgatttgttggacacactgcgtgccaatactcaaatttgtgttggtatggcggccaatatgattggcgtaaataagcggattattgttgttcagatggggatgcttccggtagctttggttaatcccgaaattgtcgaaaaatcggtaccgtttgcaacaaaagaggggtgcttgtctcttgaagggcaacgatcaactacccgctataaggaaattacggtgacctatttggaccaaaatttcaggtcacatcgacaaggcttttctgattggattgctcagatcattcaacacgaggttgatcactgtgagggcattttaatttagtaaccggcctattcttagttaaaatcaaattgcttttaacaaaagaagcccctaacgttaaacattctgtgatgagatgttgacgtcagggacttctttaatttttgaatgatgtggaaactaataatagcgacgccccagaatatccagatcccgtctttgatcatccagctcagccacttcgggtaaatgtccccaggtttgaaagccgtttttcttgaacagacccaggctggggaggttatgggcaaaaataaaggagacaattgtatcgattttcaaatcttttaattgtgtggcaacaaagtcaagtgcctgttgaccaagtccgtgatgacgaaattcggcgccaatataaatgctgatttcaacggtatggtgataggcgggacggccgtaaaagctttcgagacttacccagccggctatttgatcatttagaatgatcttccaaatagggcggtgttcgtggttaaacgcattgaaccaactgcgtttggaggcaaccgaaacgggttcaagatctgcggtcaccatacgactggcaatcgtttcgttataaatatcaacgatttttggtaaatcggttatttcggcatatgtaaaagtgggcttcatttctggaaatcctccatagaattttattatgatctgtattatagtataatttcaacttacatgcagtgccatgtagacgtgacaaaatgaaagctctcggcttattcaattcaacgaggttgtcaaaatggatcgcttaattatcttttaagttctgtttcgcgttagttgtcgttttgtccaaatagtgtagaatcaatattgaagtctttaactttaaaataacttacaaatacaataaatttatattaatagtaatgaggtaggtaaaattatgaaaattttagttgtcgacgatgataaggaaattgctcaactacttgagatttatattcgaaatgaaggttatgaaccagtttcggcatacagtggtaatgaagctcttaccaaactgcgaactgaaagtgatattggtttgatgattttggacattatgatgccggggatgaatggtatcgaagtgattaaagaagttcgcaaagattcgcaaattccgattatcattttatcagccaagacggaggatatggataaaatccaaggtttgatcagtggtgccgacgattacgtgacaaagccatttaatccacttgaagttatggcacgggttaaatcattactgcgacgtacggaagaacacgttacaaacgatacgccggatgttctcgatattgggccattaacaattaacaaggattctcatgaggttaaaacaatcactgggacaccgatccaattgactgcacttgaatttggcattctatacttgcttgcaagccaccccaaccgtgtcttttccgcggatgagatttttgaacgtgtttggcgacaggaaagtattgtatcggccaaaaccgtcatggtccacgtcagccatctacgggataaaattgaagaagctaccaacggcgaaaaggtgattcaaaccgtttggggtgttggttataaaattgaatcacattaattttggaatttacaaagataggatggctaaagcttgaaattaactggtcgtgaaaaaaccgaactctttttggaaggtattgtcactgtcattttactgttgatgttgaacctttcaatcattattttgatcaatcagtctattcacacaaatcctggccttcgagacggtatctttattattaaaaaatcaattttgattggtcccgatcattatcatttgtggagttgggaaaacatttttattacattgatgctgctgtttgatgccgccgttgtttattggcgcctcattcgtcgctatcatcagatgcagttaagacacatcatcagtgaacttcactatatcgctaatggtcacttggatcatcgaatcggatttaagcttaaaggaaatacccaatcggttgttgaaagtattaacgctttggttgatagtgtcattaaatcaatggatgaggaacgggcgattgaaagttcaaaggatgaactgattacaaatgtcagtcatgacttacggacgccgttgacctctattttagggtatctggggttgatccaggataaacaatacaagagccaggaagatttgttgaaatacactgagattgcgtatttaaaagcaaagcaaatgaaatcgttggttgacaatttatttgaatatacgaaagtcaagcagaccggaacgccactgtcgattaatcggattgacctgagccagatgatggaacaattagttgccagttttgaattggaagctaaaaaaagcggccttcagatttcggctcagggcactgaaaagccactgtatattgaagcagatgccgaaaaattaggacgtgtctttaataatttgatttccaatgccattaaatatggtaaaggcggaaatcacatctatttaacctgtcgagttggcaagcccaacgaggcggtgattcacgtgtctaacgatggacctgaaattcccaagaagtctctgaaccagatttttgaacgattttatcgggttgaaggttccagaaataaggataccggcggatcaggtctcgggttggcaattgcacaaagcattattgatctacatggcgggtacatcgtcgtcacgtccgagtatcatctgacaacttttgcaattcatttaccctttaagcacggcgataagttaacccgaccggatgaggtcgatgacaagtcaatttctaaatagaaaggtttatttgctcaaatgacgtttaaaatcaaatggtttttacttgtattaggtttatttgtgttaccggtaagtgcacagtcaggtgcttatgcggcgacggtttcaaccagccaaccagtgatttatgccaaatcggcaatcgcagttgatgctgataccggacaaatcctgtatgaaaaaaatgcccatcaaccattggcaatcgcatcaatttcaaaattgatgacagtttacatcgttcgaaagcagatccaggagggaaagctgtcttggaacgatcaggttaaaatctctcccgctgtcgctaaactaagcacagcatccggattaacgaatgtgccattaaaatccgggaaatcttacaaagtccgcgatctggtaaaagcagctttgattgtgtcggcgaacgctgccgcaattgcacttggacaaaaagtgtccggaaatgcgcagaacttcgctgacaaaatgactaagaccgcaaggggactgggtattaaggatgctaaattttataatgctgccggtctaaccaataaattgacaggttctttgatgttgaaaaaagatagcccgaatgcagaaaacctgatgtctgcaaaggatattgcacttcttgccagtcggctcgaagaatcgtttcccggattgactaagataaccggacaaacgcaaatgacctttgcaggcaactcgtatgctgggcacaatcagcttcttgatgatcgccaaattgccaagggcgctgttgtgaacggtttaaaaaccggcacttcggatgaagccggtgcctgttttgcaggatcggccacttatcatggcagacgcattgtgacggtcgttttaggcgctcgaaacaacagtgcaactgatcctgccagattcattcagactgctaagctcatggggatcgtttttcacaaacaacatccggttaagcttgcaaagcatgttcatattagtggattggggacaacaaaggtgcccgatggtaagctgacaaagacaaagcttgtcactaaaaagacaacttgggtctgggtaccaaaatccatcagccaaaatcaggtgaagggaaagtttgtcaaaacgcccaagaaaattaatgcgccggttaagaagaataagtcggttgcttctgctaatctggtttatgatcatcatttcttaaaatatttggataccttcccaagccgggttgacttggtaacaagtaaaacgattgaaaaagcaaatccttttgtactcttctggagagcgctttcaagacttttttagcaatcaattcgctaaaaagtgtttattaattgtccgatttctcatataattgaatttgaattgtgtttacattatttttacacgcgttatcataagcgtgtaaatttcgagtttacgtttatttagatggaggattccttttgggtaagttcgcagaacgatcagacgcaggggcaccatattggaagagaatattggatgcctctttgccggttgacctaagttacataccaattggtttggcgtgcggtatcttattaaatgcttccgggtttaatgtctggacaacactgatggtatcagtcatggtgttctctggtggcgcgcaatttttaattgcttctttattggctaccaacgcaccgatgttatctgttctattaatgatgttcttcttggagttacggtatgcgttgctcggttcaagtctttcgaagtatctgcatgatcaatcactcggttttacgatgatttttgcggcttctatgaatgatgaaaactacgcattgaattatctgaagttttcgactgataagaaattcacaccgaaagaggcgttacatgttgaacacacgacgttaatcttttggacaatcagtaatcttatcggaagtttgattggaagcgcaattaacattgatttaacaattgtgcattttgctttaactgctttgttcttatatatgattgtgatgcaattaaagaatggtttaatcattgtaatatgcattttatcaggcttcttggcagcattcttcatggtactcacaaaatcaactttggggctggttatttcaacactggttgcttcattcattggttttatgattgaagcagcgattcgaaagcatcatccgaagagtggttggcttaagtcgatgaagaaccctgccggaacacctgaagaggacgtagacaacgagtagctaggagtaagagctttatggaatggacgacgacacaacatgtttggttggttttagggtgtttctgcgtggctttcgcgccacgtttaataccactcttattttttcgtacccggaagattccggattggtttaatgaatggatgaggtacgtgccgatttcattgtttacggcgttggttgtaaaggacatttttatcacaccaacgtattcggtcacaattcaccagattccggacatgatcgcagcaattattgtgattggcgttgcctactggacacggtcgatggccatttcagttattttgggattgttggcagtctttttactggcaatgtttctttaattaaataaataaaaataatccgttctacctgtcagtcatagacagatagaacggattttgagtttaagcgtgtgactatagtaaaattcggcgtttgatcttgtttttaggatcagcgacaactaatccaaaatcatttggaccagtgggttgatcaacacgcagaccgttttgaaccaggatggtgtattgatagcgatggtcaatagcgagtcccatataatcatcaattaaagactgtggcattttaccattcaaataagcccggtattccgggtattgatcaaaaattttggttaccatttctttggtttgagattggcccaattgtgaaattgtgagagcaattgcgacccgttcccgaaagttgcccagaaaagcccgcttttcatcgggtttgagttgtggattgccaaacatatgttgtttgatgaaatcttcggaatcattagccatgaataaaatggcctcctttggaatgaatatagtcgactatagtgaaatgccaattgcactcatcatactatgtttgagctgttttcgaaagggaaaccctttatagattttgagtgtgtgcacgccttttttgaatgactttgtaacgtaattgtaacaatcagttgcagtacaaataacgaatcgtatggttaaaaaacgtttccaaatcttaatataacagtgtttctttgatggaaaaattaagaaaccattaagctgaaataaaaagttgccttttcctttgaaataattctgtaacagaatataatttggtcatcaaagtttaggaggcttttattatgaaaaagatgacaacatttatcgcaactgcagcattggcatttcctttggtatttaccgcaccgctggctgcttcagctgcaactaaacctgcacaaacaactcaaacggctgccaagagtacgacttatacaattgcaaaatcgaatttctttaaaaaggcaaaggtttatcatacgaaagatgcgactcctacagtatataaagctttaattggtgccgacaaaccgacatttaccacaaccgcaaagggtaaattaaagtccggaacgacttattatgtgactaaggttgttaagacagctgccagcaagactgccaaagctaaaacattcttttatgttaaaggacagggctgggttgttgcttctgcattaacagccggaaagttccaacaagctgattaaggtttattttaaaaaaatctaaaaataaaaaaatgagtccggtaagtttacgtaattacattatgtaggcattactggattcttttttattgagagacaaataattagaaaggaggagcttgaaaaagttttgagattttaaagtgaatcagtaatcctaccaaataaaattttggaggaatttcgatgaataaatatgtattgtcagcactagtcgttccagtcgcactcatgggtgcagttaccgcacaagcaaagacgacgttgctcaaggcaactgttaaccaagcaaagtccggtaccaaggtcgtttcaggtaaagcaacccggggcgcaaaaatcaagatttcccgggcaggtgttacctatggggttgccaaagccaataagcatggtcattttgtgatgaagttgaaacgggcagttaaaggtggctggacttataaggtgacggttactaaagcaggctttaaagtaaagtcaggtcactttaaggttaaaaaaggtaagaaacaggtaaaagctgtcaaaccatcaacaactacgccagttacgccggctccggcaagtaagccaagtagcacgcctgccactcaaagtgcgcctacaaaaccaattgttccgaatgcaccgaagacaagtgtaaacacgcgtataagttcaattgatattgaggctaatcaaatcagtggtgaaatttttgggctaaacagacaactggatgctgtaatctttggacaacgaaaacttgatgcaacacaacgtgcatttttgagtaatcagatttaccagttgcaaaatcgagttaatgtctttgcgactcgatcaggagtcagctcagcaactattagcagcatgaacaatgaattaaccatgttgcgtcaaaaatttaatgggctgtcaaacacggttgtgttgagtgggagtacaggaacaactaaacctgcttctgacgtacacttacaaaatgtggtaaagactgacaaatcagccagtcaacaaattgctgaattacaaaaacaaaatcagttattaaatgaaagtgcttcaaagctagatattcagattgccaatttgaataccaagttagaaacggaaaaatatctagatgaatccatttcaaagtttttagaaaaggtttccgatgaactggccgatgcaaaagaagcaaatcaaaagcgtccgagtcaaaaacacgaggaatatgttaagcagattcaacaagagtatgatcaagcagtttctcagcaagagattaacaagcggaattgtctcgatgctttagacgatgcaaaatacaaacgtcaagaattgcgtgatcaaattcaaagtaatgaagtgcacattaaatctatccaagaagctcaaaagcgagcagtaacaaataattagaatcattaaaagtagctttcatccttattgaacatcatatagtaggtgtgaccaccctgaaaaagatggttgcgcctttttagcacagtatgttaaaaaatagattttcaagcggtaaacactgcttcagaatataatctgttttaagcccccgtcccaaaatggtataataaaaatgaataattaattcctaggagggcttactttgaaaaagtggatttggattgtaatcaccattgttattgccgcttcagtgggtggttacgcatacgcccgtcattctcaaaatgaaaagctatataatgattcgatgcagcgggccagccttcaaatttctaataaaagctatattgctgcggaaacttcttttacaaatgcgttaaagagaaaaccaagtgataaaaaggcaactcgactgttgagtcaaactcaaaactatatggcagccaatgattcgtttagcgaccgtgattacaacagtgccaaggatggttatcaatcagttgttgatactaagaatgggaatgagactctgaaagatcgttcaaaggataagctgtcaacgattaaaaccattcagggaaatctcaagaagtatgacaagatttataatcaggcgttaaatgagaccggtgaaggcaattatactgagtctaacagcacactggataagattctttcggaccaaacagccaagcaaagttactacaagtcaattttgaataaagctaaacaattgcgctcgaagaataatgcttcactgtcgggaaatacaacaactacgccaagcagtagtagttctacgaatgagtttgagtcctctacttcaaacagtagtacccaaaataatcctaatgttgcgcctaacagcagtgatagtttgacctcgtcagaaaagaaggcagcaaatgcttataaagggtcaaatgagtttacggttaacccgaagaaaaatagaattaatggtcagcagatcactgagtcccaggttaatagtgccagaaaagagatcagcgctgccggagtcgattctaatgcgatgagtgaccaagatattaagaatattattaaaggcgctcacgacaatcatgagacgattggccagtatgtcaaagcaagatataagtgatgttggatttaaaaaaataaatttctgaatcgttgatgcaagaatgactgtattgacggtttttttatccggtgttttcaagaaattgtcttatttgaaggaaagcagtaagtgattgatgggttaattcgtgagaaaactttaatttgtgtttaattatgtgtaaattcttgtgagaaaatggcgtgaacgtgtaagataaatgccagagattagaattatttgaaggggtggtggttctttgtcgaattgggccaaatttgtgaacaacgtcccacttaggagatttactgttcttggggtagttgtcttaatcttgtattttgcacgcagcatgatgagtaccttgctgttaacgtttattttttgtctgttggtcgttaaattaacaaatggcattcgcagatttgttaaaattccatcggaagtcattgttgtgattgtttatttgttggttttagccgggctgtactttggcgtaaccgtctatattccacaagttgccgaccaggcaatcagctctacaaaagatattgtcgatttttattccaatccaagtaatttacctgatgacaatacgttaagatgggtcaatgaactcataaaacaaagtaatgtgatggcccaaatgaagaacggtgtttcacttatttggagatatattacaggtgttgggacaatgggtatcacattgtttttatcaatgatcttaagtttctttttcgcaatagagaagaagaccatgtacaacttttcgcatctatttttagatagtgatttttcatggttctttcaagacctttatttctttggtaaaaaatttgtggcaacgtttggcgttgttatcgaagcccaatttttcatcgcaattgtgaatacggttttaaccacaattgtcttagcttttatgcatttgccacaacttgcagtattagcgctgatggtctttatcctgagcttgataccagtagccggtgtgattatttcgtttataccattgtcattagtcggctattccgttggcggtttacaggatgttttgtacctaatcattacgattgttgtcgttcatgcactggaagcttatgttttaaatcctaactttatggcttcaaagactaatctgccgatcttttacacgtttgttgtcctcttagtcggcgaacatttctttggggtatggggactgatctgtggtgtgccggttttcactttcttactggatattcttggtgtgaaacggcataatgagccattaccgccagctaaacccgacaccaaaacctttaaatattgatgttcaatcacaaagtgaaatcagtgattgaaatcattaatgatttgtatgttatttcacagacttttttctgaatactgatgaaaattattctgatttggtgtaaaatcaatctgatagagatatagaaagaggtaatgatattggcaaaacttgttttaattcgtcatggtcaaagtgaatggaacctttctaaccaatttactggttgggttgatgttgatttaagtgaagaaggggttaagcaagccatcaatgctggtaaattaatcaaaaaagccggtattgaattcgactatgctttcacttcagttttgacccgtgcgatcaagacactgcactatgctttggaatactcagaccaactttggattcctgaagaaaaaacatggcgtttaaacgagcgtcactatggtgcattgcaaggtcacaacaaggctaaagctgctgaaaaatatggtgaagatcaagttcatatctggcgtcgttcatacgatgttttgcctccacttttggatgcaagtgatgaaggttcagctgttcatgaccgtcgctacgccaaccttgatccacacattgttcccggtggtgaaaacttgaaagttacactcgaacgagtaatgccttattgggaagataagattgcaccgcttttgcttgatggtaaaaatgttgtgattgctgcccatggtaactcacttcgtgcactttccaagtacattgaaaacatttcagatgaggacatcatgaatcttgaaatggcaaccggcgaaccagttgtttatgatttcgatgataaattaaacgttacaaacaagactaagttggactaattttccaatttaactgagggtctcactagaaatggtgaggctctttttttcatacataactaagcatcaggcacctcgtcatgatatgggcaataatcaggccaacatggatgatcaaagtccatgctggcctgattgggtaaaatataatggtttaatttaatgatactggacttcagcggctttcttatcatttccgagatcttcaaatgctttcgcgatgacatttggatccatatgtcccggttttccttttcgaatataggtgttaatggttacaattccagcaaaaacaccggatttacttaattccttatttaatgcaatgacatagctatgcaggccggctttgccaattgattgttcaacatcacttgtaccgggtttggctgctacgatgcttcccgtgtaaagaaagacaccgtcaccggtctttttgacgtaaggcaaagctaaatttgtcaccgtcacagcgccaagaaggttacttgccagactttcagttaacaagtcgctggttaagtcggcaggcttgtttttggtccgcgttgttgctgtataaaggacgacttgaaggtctcccttttgggcaatttcttttaaagcagttgagacactagccgggcttgctagatcagcggttactgaaaaggctgaaatattggaggccgtgagagtcttgactaaatcatttaacggatcgggatttcggccgagaagggcaatcgtataccccttctgaccatatcgattcgctaaagcttctcctaagccggcatgtccgggaccaacaattaaagcaattttatttgtcatttgaaaggctccctttctcttaggggttaatatgcttaagaacgccggtacccaccagtagtaattcgatcgtagtggggccgacaaatgtaaagccgcgtttcttcatatcccttgcaaccagagcgcccagggtacttgagtcctgaacaagtgcgccttcaaccaggttgtctttgggtttaaatgaccaaagataatcggctaagtctttaaactccgggcttaagtttaaagtcgcccgtgcatcctgtacgactgcccgtatttttcttggattgcgaatcatatccggattttcttctaacgcttccagatccatttcgtcaaacttggcaatctctgccacttcaaaatgcttaaacactttatcgaaaacagggagcttgctggcagcaacccgccagttcaatcccggttgaaaaatattgactgtcagcatttcaaacataacacgaggatcgtgaatttcggttccaaataatgaatgataaaggtcaacaccgtttgtacttttgaccatgtaagttctcctttcgaactttcttttgtttagctgcatgtagaatagcactttttgaagaaaagcgttcatgaaatgcttaaagtgactgtaaaattttacatttgtaaacgcttaatgtgaatactttttccgttttttaatgtgaatatgcgaaaatatcttcgttgttaggataacaaaattatttataataaacgcatttaggtttattattttcataataataaaagtcgtgatattctagttatcattataaaaggtggctaaatattttttgatttaaatgggtttggctatttatgaagattgaattaggactgctcctcaaagcagcaccactccatataagggatcaatttgaagaattcaagttcgggattccccaaattgacgccttatactccgggtactaaccgctttgatccgcacactgttattaggactgctcctcaaagcagcaccactccatataagggatcaatttgaaaaatccaagttcgggattccccaaattgacgccttatactccgggtgctaaccgctttgatccgcacactcagaaaggacatatcacatggaaacacaaccaaaacaaaaaggtaaacctggcggtataggcctcacagccttaaccgcaatggtcgttacatcatcaatcggtgccggggtattcgctttgacatcggatctcgcaactgcagcatctcccggacctgttctgattgcctgggggcttgtcggctttggcattttgatgttggcactctccctgaataatttggtgttaaagcgcccggatttggaaggggtttttgcttatgccgaagaaggatttggtcaatatgccggctttattagcggctggggttattggctgtcttcgtggatgggcaatgttgcctttgcgactgttatgatgagcgcggtgggatactttattccgatttttaaatcaggaaataatgtgcctgccattatcacggccagtattatttcatggtgtttaacttatattgttaaccgtggtgttgaaagtgcagctattttaaatgcaattattacaatatgtaaactgattccgttatttacgtttatcgttttctccattttattatttaaggcaaatgtgttcactgctcatttttggaacaatgtcagtggcaactttagcggtggcgcgggtgtcggttcccaaatcaagaactgcatgatggtcatgatgtgggtcttcgtcggtattgaaggcgcgacaatgatgtcatcccgggcaaagaaaaaatctgatgccggcaaagcaactattctcggattgatctgtttattatcaatttacgtgttggcctccgtattgccatatggttatatgacacgtgcagagttgacaaccatccaccaaccagccatggtttatatttttaagagtatggttggtaattggggcggtgccttgatcagtttgggactcattatttcgacccttggctcatggctgtcatggacaatgctgccggcagaaacggttatgttaatgtcgaagcgaaagttactaccgccgatctttggtaagaaaaataaacatggtgcaccaaccttttcacttgtaatgagtggggctttaattcaagtattcttgtttacactgctgtttacggatcgagcctataactttgcctactcattatgtacagcggcaattgttatttgttatatttttgtggctgcctatcaggttaaatattcctatcagcatttaagtgagaaggggaatttaattcaactctttgttggtgctttcgcttttatctttgaatgtgtcggaatctatatggcaggattacaatttgtacttttgtgtgctatcgcatatattcccggcttcttcctctttatgaaaaccagaaaagatgccggttatgataaatggttctctagaatcgaatcaattgttacagccgcaattgtgaccggtgctgtattgggaattgttctgttaacaatgggaagaatcagtgtttaaattgaatgatctacaaggttgagtcaaagttgggtttgattcaaccttttttgttggcgtttttgtcaggaaagtcgtgttgaaaatctttgatggatttatcggataatgccatgtgttaattaatatcgaatagggtaaaaagaatttttaaataattagtttgaaagtcaaattttcatgctatcattagtctatgattttaatcatacatagcagttacatttgattttcttagaaagaagtgtttatcatcagacacccacggaggacccgcagagttaatcgttggtataagcaatggtgggtcataatagccgcatgtattgtaattttattgattggcctatttggcggacaaaccttaatgaataaggtttatgatgattcagcggccaatcaatcagccaacgttaacgtcaaaaaacaaagcagtcatcatattattcagcataagcaggatccaaatgatattgatcatgcgccattatacaaaattggtcaatattataatagtcccagatatggacgaattaaattaaccgggatttcaacagaacggaatttggtatttatgcgaaatcaactgacgacaaccatcaattgggctaaagtatgtacgaacacaccgaaaacagcggctcaacgggcaaattcagcgagtgactataatttggataaagttgataatccatatacctatctaaaagttcagtatacggttcagaatcattcttcaaacgcaatgacgtttggcggtgttaaacaagttggttttgccaatggcaatgttttgggcggaacggatgaattagtcattgatgatgggcagtctgagcaactagcaccccattccaagcgggttttcaccattcatgtccttatcgataaatttacggatcaggctcatcccaaaagcgttcacttgtattttgatgattcaaagggtgctgttacgttgaaaaaagtctctcaaggctttaattgcctattgccgtttacgtatgatcgaggaaaagacgcctaacaaaaacgtgacctttagtgtggtttacttatagcaagtaatcacgttaaaggtcacgttttgcgtttgttacattttgacatggcttttttagaaggttgaattgtcaattcaatgaggaattaaaaccgtcatagcaattgaattaaatgagtaagggtgccgctttcccatagaatataaatgcccaagccgatgtagacgactgcggtgatgtaacgtgaccacttttcaagaatatttccgatggttggaattttgcttaataaataccccagataacagaaaagtgtcatcatgatgaagaaagtgacgagtaagatcgggatgttagtaggcgaaatttgcgtgaataatgggacatatatgccgatattatcggcgccacaggttgcgatggtaataatagcaacttttaaaataacatttgtttttttctgaatttcgttttcaattaagtcatcgtcttccttttcaccaaatatcagtaatttgactcccattaaaattggaatcaggcctagaaatcccaggagccactctgctggtacgaagccaagaataacggccattaaataacttgtaagaaccagaatggctgtcccaagaaaatcacccagatagactaaaaagcgatgtcgtttaggcgtggcaccgaaaataaccattaaaataatcaggtaatcaatgctggttgagatataggcagtgataccggttaatattgttgtcagcatgttattttcctcctcaagtagttgaccttcattttacatatcacacatgttaaagtcaacatatgatcaagacaccattttactaataagatagttaattctcttgctatttcaagaaagttagtcgagaatataaattaattaatgccatgaatggaggaactgaaatgccaaagatctatttcttatgtacaggaaattcttgtcgaagccaaatggcggaagggttcgctaaaaagttgctgaatgatagttggcatgttgaaagtgccggtattgaaaaacatggcttaaatccgctggcggttaaggtaatgtctgagaaaaagatcgatatctcaagaaatcaatccaagttgattgatagagcgtatttaaatcagtgtgaccttgttgtgacactttgtggggatgcaagggaccgttgtccggtcacaccgtcaaccgtagaaaagcgtcattggcctttacgtgatccggcgcaggctcacggcagcaacctggaagtgctggatgcatttcggcaggtgagagatcaaatcgaaaaacgggtagcggcgctagcgaaacaattaaacgcgtagttgatcattctacagatttaacgttggctgccaaaggggtaaacttaaagggagtacaaaacataaaagtggggatgagatgatggttaaacgggttttgctggggatggccctgatcttttcgtttattttaatcgaccagtcagtggcgtcagcagctaaagtgacaaagaattcttttttaacgaccaagcgggtgattaaaacatacaacagttccaagacaattaaggtcaccattcccaaggggacgactgttttggttaacggaaccaaaaatgacaatggtcagaagtacgtttcgttaaacctgaatcgccttcgttatcaaattcgaaggccattgataacggctcaaaattcaagccgggtgagtcgctggatcttggcgaagggccagaacttcagcaagaccaacaaaccggtttatctttcttactattcattaaccagaagtaacaaaggacatgcgctattatcatatgttgcgaatggtgatttgtggaaaggcagtacgctgcctgctgattatgcacagctgaccgggacaaggtttacgatcaccacggatgggtatctcgactttttttcgagttctccctacaaatatacgatcagtcccaaaccaaccagttcaactgaaattcaaaaatcatattaccgttcttcacgtcagttatacttatatttcaaaaccaaattaaaggggctgccggtgacgaaagtgtccacaaagggcaataatcgttatcgtttgagtattaatcgaacgacacagacaacatcaactgccattcccaatgaggatgatgcaacgcgggtaacacttaatgaaatttatcagatcggaaaaaccgactattacatgcataccgaaaatgcacgctttctgggggaagattgattatgaaacaaacacgacgtttggttaatatgatattggcattaattgcgacatttgcattacaaatgaccgttgcccaggccaaaacaacttacttatcagtttcagcccgtgactatttgcagactacccaaaaattaacggtgactaattcgtactataagaacattaaaatgacgctgccaaaagggacggttgtccaagttgcttcggctgctcgaagtcagaaaacacatcatcctttctttacaattgatatggatacgatgagttaccgacttcgcaaaccgttttataatgccaaaagcaagccaaatatgacggcaggcatttgggcaacaacagctgattttaaaaaagtcgactcgccacaatacttacgttattatcaggtgaccagtccggacaccaggtcggccggggattatgttgcggatggaaatttatggcagggggataaatggccagccaacgaaacaacagcgaaagccagtggcgtaaaggttacggtagatggttacctggaagcctactcaaaagtgaaagttttccaagcctatgctcctaaaccggttggttatgccaaaatccaaaaaacggtgactaatgggaaaacgacggatttttacgtcgcatcaaaaataaagggcatgccattaacgcgggtcgcaaaatccgggaaggatcagtatcggttatccattaccagaaccggtgaacacggggtcacgatgattcccgaggatgagcatccacagtacattgattctgttgaagtttcagagaagtatttaatcgacaatcaaaattactatatgcatactgaagttttattttaagtgaatgaaccgtatgtacaaaaagtgagtccaaaacgatgatcgacattcgttttgagctcactttttttaaaacatgtgtgtttatccgcgacctgatgaagccgcaacaataatggctgtgataaaatcatcaacccatttcgcaaatttgaagaaggtttcgtattcgggattgtgtcgaaggtcttttacctgttgtgttaattgggcgcgttgatctttgtcaaaataattttttaatgttctgcttctactcagatttgcgactaatgcgataatttccagtgaagcagtgtttgatccaagcaattctgctttaatttgattgacaactaattttttggcttcagccctgggaatgtatttatcatgactaaatattaagccgcgactgcttgtctttgtagccctgttcttaaacaaaagcttttcgccaataccatcgtatacgatccgattgattttacgatttaagacaacgtgacgcaaactgtttttgcttgatttattttcacggtcattgaggatatccaatacaggatttaaaaagccgtagtccttggataatggtgcgataacctgcatacccttgtccgttaacttaatgatgccgccaagctgcaggtcaaataaaacgctggcagaaagataagcacgttttctcattgaacgcatgatagcactacggttaccgtccgtttcgttaagcagaaggtacatttccgaaatatcacttttcatcgtctttcctccagaccgaattgttatatgaatacctatggtgtaaccatagcattgatattcctgatagtaaattgaaacgaaagcaattttttgtaattacgggaaacctaaaaaataatttgttgtccttaaattaaatcttgcttaatgtctaaaaattgatatgataagaagcggggaggtgataaaatgaccgaactgcttgttcacaatactaatgtgccacaaccgattaagttatcggatggtaagccggggtatttgagcgtcaaacgcgaaggtaatcattttcgatacttctttaagttcgaagcgcatgaacatcatgacttttggtacgatgcacctgcattgccaaatgatcttgtcattaaggttgcatcgattgatggtccggaaagctttaggattaagctgattaattaatatatgaagaaatattaatttatgtctctatatataagttaatcaacagataaaagagaaaaggtaacatgtttgttcggtttagtcgttattaattgaagttgttgataaattaaaagctgactgcgaatttgatttcgcggtcagcttttataattcagaacattgttagcaggttaatggaaaaacatgatttggcaattagtttgaaatcgggctaatcttagttgaaatagaaaggagttaacttaatacactcattgattaactagataacaatattctgaattattttgattatatcataaatacacggtcacgctaaaaagaaatttaattaatttggtttactctgattactatacatgttagtatctacatatgaaatagttaccatatcaaaacaatcgttatttttgaaagaagtctttatatggaaaatcaattgcaaaagcgacatttagtttcaagcagcttacgaacagaatatttttcaactggctggatggcctttgaattcctggttggctttatttccgggttggaggcggggtcaattctgctgattgcctttgggctggacagttttttggaaattatttccggaagtacgttgatttggcggttacgcaaggaagcaaacggtgcgtcggccgaggaaatccaaagtgccgagaaacgatcgtcgttaattgttgggacgattttactgctattatctgtttatgttatttttgtgtcattatttaatttagttaatcaccaggcagctgatacgagttattctggaattgcgattgcgcttgcatcggttgttcttatgccaatcctaacctttaggaaacgggcacttggtaagcaacttcattcggatgccctggttgaagatggtatgtgcaatatcacatgtgcctatatggctgccacggttcttgtcggtgcgctactgaccttcttcttcaactggtggtgggccgattcggttgccgccctggttctggtttactttattgccagtgaaggatgggaatcttttcaagaaggacgcgggcaggattaagcttgcgtaaatgtgcttgaattttcggtctgcttcagtgatataataacaggtaataactgcaaatttcatgattggagtggcgtcctttgactgaaaaggattcattgaccgatatcgaattgatagatcaaaaacgtttggctgaatcggaacggatttttaaattattaagtaacccgtcgcgtttacagatgctgaaagtgttggagcagcgtgagttaaatgttggcgaacttggtgacttgttgggcttggaacagtcagtggtttcccatcagttggctttgctgagaaaacatcaattagtcagttcggagcgggttggcaaagctaattattatcgtttggatgatcctcatattttggacgtggtgaacgagatgttggaacatgccgatcacgtgatgcgtggaaaaacgcacggtcattaatgaaacaacgttaaacaatttctgaaaaataaggaggctggatgctaaaggtaattttggcgttcagcctttcttggttaatatgacaactttatggatcagcgggtctgcaaagcgtatataataaaaacgtcagtttaatcaaaaagtcgggaaggcgttgccatgttaaaattaatggcggttgtcgacacgcaatcgacattttcttataatcggatgcgacgatattgcagttcacgagtaggtgtcccgttaaaaaagaaggggacaactatagaaaacgagaagttttatccagatgaaataacaggggcttcttttagcgatgccaaaacaggcgtaactcaaaatagcaacaattggggataaaaaacaacccgactttgcagataacaaacaagatggcaaaaccggtgcttcaaaacattagtatataaggaagaattggggatgatagcttatcgaggaaaatcttgcacaaaaaaagaccacaaaaaattattatggactgggaacgcaaatcagattgacattattcggtgatgtcatggccgaacagcttgacgcgactaatcgattgattgcctattatgaaaacttgttaacagtcaatcggccacagtctgaagtgatggccattaatgatgcggccggcaaacatccggttcaggtttcagacgcaacctataccttaacaaaacgggcacttcaattgagtcgtcaacatttcggctttaacgcgacgattggaccgctggttaaattgtggaaaatcgggtttaagggcgccaatgtcccatccgagtcagccatcaaagagaagttggccttaattaatcccgatcaaaccgactttaatgatcaagcgttatcgattttcttgaagcaatcaggcatgcaattggatcttggaggcatcgcaaaggggtatattgccgatcggattgctgattattggcgggcctatggcaaacgttccggaataatcgatctaggtggcaacttgttgcttgtcggtgattcacccgcacatcaagatcggcaatggcgaatcggtgttcaggacccctcttcagaaaggggacagtcgattctaaacgttaagatcggtccatgctccgctgtgacaagtgggatttatgaacggcatttggaagtaaatgggcattcttatcaccatattttggattctcaaacggggtatccaaagcaaaacgatcttgcaagcatcacgattttttcaaaatactcaattgacggtgagatcgaaacggccagattgttttttgccgggaaaccacttgccggctgggcacgtgatcggccggatatttatggcgctgttttcgtaactcgagataggcacgtgaccattgtgggccttgaagacgcgacagtgacgttgttggatgagtcctataaggttcaaaaagaatctaaaggttaatttgagcgattcaaacaaaaaatgagtagggacgttgcccataaggcgatgtctctactcatttttgtgttaatgaaacgttttcgaacggtaattatcccaatccggcagcggtgtgttggtctgttctgcggtgcggatatcttgatagaagtgaagctttcgtttgatatgctgctgattttgtttaagcagggctaactgctcatcgacttcttgacagtgttgatcgagcaggtcgacaattttgtcaaggtcaccgccgtgctcactataactaaatagtgtctgtaattcgctcaatgtcatcccagtatttttaaaacagcagattgatcccaaacgatccaaatgttgttgggtataggcacgccgattgccctttcgagggatgtcgtagagtagccccaggtcttcataatatctcagcgtggtagtgggtaaatgatacatttccgaaacctgactgatggagtaagttttcataggtttttaacttctttctttacttcaagttaacttgaagttgtatgctatagctaagcatagtagagaagatcaaaaaagacaactgttaaataaacgggaggttttaaaatgtatcaggcaaatgacaaacgttatgaaaaaatggtttataatcgcgtgggaaagagtggcttaaaactttctgcattgggacttggactttggcacaatttcggtagtgtggattcctttgaaaatcaaaaggccattattcaccaagcgtttgatctgggaatcacctattttgatttggctaacaattatgggcccgtacccggaagtgctgaaaagaactttggccaaatcatggcaggggacatgaagccttatcgggacgaaatgattattgccagcaaagccggttatgagatgtgggatggaccatacggtgattggggttctaaaaaaagtatcattgccagtgccaatcaaagtttgacacgcctaggcttggattacgttgatattttttattcacatcgcccagatccggagacaccggtggaagagactgcactggctttggatcaattggttaaacaaggtaaagccttatatgtaggcatttccaattacaacggccaacaaaccgaggcaattacaaaaatctttaacgaccttcacactccatttgtgattcatcaacctcgctacaacatgtttgatcgaacaattgaaaaggatttattcccggtcttgcgaaaagaagggaaagcagccgtcagctttagttcgttgtcacagggcctgctaacggataaatatttacatgggattccagaaaattcccgtgcagccaaatctaccagtccgtttttgcatccattgcaggttgaagagacaattaagacagttcaacaacttaatgaggttgcaaagaaacgcggtcaaacgctggctgaaatggcgcttgcatggaatttacgcgaacccgaaattgcatgtgtactggtaggggcgagtcgaccgcagcaattgttggataatgcaaaagcactggataacttaacctttagcagcgaggagctggcagagattgatcagatcttggggaatcagtcaaacattaaatggggtgcccattaacctgtcgtgtcattgatcagagtttacggtccccgtggttaaagttatacttaatattgaaagtcgttagccaggtaatgacacttgcttttttacgattacaaatgtagactattaaatgtagaaagtttacgtttgcaaattaaaaagatgtcgacaccaattatgatcgttgaatacgctcttgaaagttggatcaacgtacgggaatgataagcagttatttatttgacgactaattttgaacatgatattaaaggggactccaaaatgattgatgcaaaagatgtggcaatctctgattcagagtgggaagttatgcgggccatttggacgttaaaacacgtgaccagtcgacaattgattgatgtgatgtcttcagccaggggatggtcggaatcaacgaccaagacattgcttcacaggttaattacaaaggatgcggttgtgcgggttggtgatgggcggccttttgaatatgaaccggccgttgatgaaagagactcaatgggagcggctgccgtcaacctatttgatcatatgtgtgccatgcgtgcaggtgacaccctggttaaagtgatcgactctcgtgacttgtcacaaagtgatatcaagaagcttcagacaattcttgccgagaaagcaaagactgctcctgaaatggtcgactgcaactgtctgccacaggaaatgatgagtggcgatggttgtcagtgatgattctttaataatccttaaacaccgcttaatgcagtatttacaagcgattggaagcgttttagaaaaagagggtcgtcaaatgtcttgactctttgatgattgaaggtaaacttagtgtcaattatcaagtcatttttgataatcagcgacgcttacaaagcgttttaaatcattctagtagacaatccaattgagagaggttttttaaatgattacattacttttactggcatcaattgccgtttattatgtcgtaacccgttcgtccaacaaccaaagcaagacaacacgtgatcaatttggccgtcagcacgcttatgcccgtgccagaaatgatgagcccgaaatcttggataagggccaaaccaacggcagatccagacgaaacgttaattaaagcgcctgtcttttaggctgtgtgtctttaaaaaagtggcttaaaaagaagtggcgataacaaatttattttgctatcgccacttctttttatgcggagaataattgattgccgatactaaaacgatttctgttgattagtcaaagtggcgccattccttgtccatcaatgctcttgccacgaatagaccaagaggtaggaacatgataatcaaagatgccttcgttaaccagagagccccaaccgcaatctgattagtgccaatattgtaaatggcccggtaaatgtaaaggccggggaccatgatgacaattgaagggacggttagtgaaattcttggatagccgttataacgattaactatagaagcaatcagtcctgcgaccaaggcaccgaagaaagccgctgcagcaggaggcatagaagttaaatcgaccaattcaagccgcagtgtgttggcaactgcgccgatgcatcccgccaccatcgccatcttttgggaactgttaaacataatcgagaaaccaaagacgccacagaaactggcgggaagtcttaaaagcatgacgacaaacggtgataagccgagtggcagaaaatctgccgggcgaaaattaaaaatcaatgcaaccagccaaccgaccaaggtggcaattaacgtgatcatgattgcgtatgccagtcgttccaatccggatcgcatgtccagcttggaaatatccaaaatactggtaataaatggaaacccgggtatcacgaagagcattgcgccgatgtagcctgcctcatgttgtgctaaaacctggaagtaaaattcgaatattttgaatgtacacatgtaggtcaggcaggcaacggccacactgattgaaatgctggctaccgttgtcattgaatgctttcccatcattgcccgggtccaattaccaatgccggcaccaatgaaagagcaaatcatttccggaataccgccacccagcaaaaagatgaaggcactgcaggccaatgcggctgccaaacccgaaatcaatggtgaatattgtttcggccgtttttgaacgtcgtcgatgatgttatgaatctggcgaacggttaatgatgagaaatcatcgtcaaagttcttgaccagattttccagaatgtttaatttgtctgtattaacgccggtatttggtaacgacagtacctgagtataactgtgatcattactaaaacaggtgaattccaaagaaatcaggccgatatcagcggagcacgtcagctccaattttctggcgaccttatccattgcatcacgtacccgccaagccccggttccacatgacaacataatgatcccaatccgaccgacaattgatgcccgttcgcgtaaacttgcctttcgagcgggaaggttgtcgttttgaataaagctgttccatggaattgtcatatgatggcgctgagaaaggtgaaactttttgggcgcctttgggttacttttgttatccatttgatcctccaatagtattatgtatcaattcgtaaagcccacaatttcttcattataggcgcaatctcatatggaattcaagatgccaattgtatgaaatccctttcaaataacagcaattctcattccgattgtaatcttgccattcttttgttacttaattcacagacgttttttaccagtaacttctatactattttttggtaaaaagtgacatatttataaaattggagcgttaattaataatgaaacataacaaaataaagacgagtgggcttgtcttaatgatcatttcaacgatcttcgggtttgctaatacgacagtagcctatgagcagatgggatatgccagtatcatctggtatgtcttggcagcggtcttcttcctgcttccgagttcattaatgtttgccgagtatggggcaacttttaaggatgcccatggtgggatctattcttggctggccggctcgattggtgaagaatgggcctttatcgggacctttatttggttgtcgtcctggattatttggatgacatcgactgcctcaaaagtttggattccgttttctacaacattgtttggcagtgacaagacacaaagctggggcgtaatgggcttaaattcaaatcaggttattgggattctggccattttttggattttaacgattacctggtttgccgttcgcgggatggactcaattgctcgaattgcttccatcggtggcatctttacgatcttgttgaatgtaatctttgggattgccagtttgatgattctttatttaaacggtggtcattttgcccaaccaattaacggcatatccagttttattcaatcacccaattcccagtttcaatcaccggtgacactgatttcgttcattgtttacgctgttttcgcttatgctggaaccgagtccatgggtggtgtaaccgataatatggataagcccgaaaaaacatttccgcgtggtttgattatttcggcggttatcatcacccttggctattccctaaccatttttctttggggaatcagtaccaattggcaaaaggtcttgggcaatgaccaggttaacttgggaaatattacttatgtcttaatgaataacttgggctattccttgggggaaggattcaacctttcggcttcggcaagtgcctttttgggtggcttattcgccaggtttgccggtctggggatgtttatcggatatctcggctcattcttcgtgctggtttattcaccacttaaatcgtttatcatgggatctaatcccaacttttggccaaagcgaatgaccgaactcaacaaaaaagggatgcctgcatttgcgatgtggacgcaggctgccgttgtggttgtgattatcttctttgttagttttggtggttccagtgcccagcagttttacgttattctcaccaacatgggcaatatttcaacatcattcccgtacctcttcctgattgcggcgtttccgttctttaagcgtcaaaagaatttgcagcgaccatttgagatttacaccaatcgtcgctggacggattttatcgttggcgttgtgttatttgtattggttgccggtatcggcttcacagccattgcaccggttttggcgcatgattatcagacggcgttttggaccattatcggcccaatcttctttggctttgtcgcttgggtatttcttcagtatcaaaataaaaagaaaagcaagtctcataattgggccgaaaacccgaatcaaaattgataagttaagaaatgattaaagcatccggtggtttgggtgctttttgtttggtttaaggatcaattaaggtattcttcgtaccatgaggttagtgattcggaaataaccaatatgagcatggaggcttctatatgcaaacaattaatgacaccattcaaacatcactgtttcggcacctcagagtttcagttgtgatttcggaaatggttaatcacaaagtcaatcaatttaaaaataaatttacagcaattaccggtcaaatcaaagaaaaatttgatcaggtagatcaggtcttctcattacaaaattcaggttcacttgttgctaagtttcaaagaggagatagacagcagttgcttgagtcacctgattttcagacggtttattcgttggcaaatatatcaaaaaacaagacaaatggttattttgatccctttgacggcggtcgctatacgccgtctgacctcataaagagttgggcggtcgaccaggtattcaatcagtatctgaggccgttggtagaactcccggtagcagggatcatgcttgaggcagatggcgttattcaaactgcggttgccaccagttcagcctttcattggccggttttggttcatgattcatttaagggagagggcttattggagaaataccagctgaccggcggtggcattgtcacggttaatgcaaagacgtccaaaagaccgcaaagcccgatcaagcaactgacaatcattagtgaacgagtcagtgaggcgacaatatgggcgatcgctgggttgaatgccggtactgctaaattcctcagactgatcaatcaaaagcatcttagtggcattcttattgacagggcacttggtgttatagagtttgagtcgggaaagttggcccagaagcaagtcttttaacgagtggtagggtcttagagattaatggttatcagtgttaaaatacgggtgaggtgatttaatgcaggatattaaccccgtttgcctttatcacaaattatttgatgagatgggtccacaacactggtggccggccgataccaaaatggaaattgtgatcggtgcgattctggttcaaaatacaaattggaataacgttgatttggcacttcaaaatttacgtacggttacgggactggatcccaaacaaattttgaacttatctgcggtccggcttcagcagttgattcgaccaagcgggttttatgtgaataaaaccaaaagccttttgagcgttttgggatggtttaacgatcatcaatatgatttttccggaatggttcagcagtatggaccgaaactacgacatcaattgctgaacttgaccgggattggtgaagaaactgctgattctttgttggtttatgtttttgatcagccagcgtttattgcggataaatatgccagaaatctgtttcaatttttaggctgtcgccacattgagacttatgccaagctacaaaaacgcattcgattgccggttgattttgattatcgtgatgctcaggaatttcacgggttaatagatgagtttggcaaattatgcaaaaccagggaacagtttcagaaaagctttcttaatggcttttcgctacagcaaggattgaagtcggaaattaaaaagtgatgctttcaagttcacaagtattggataatcagaccaacttgccaagatttaaattttggcaagtttttttcgtatgaatgagtttttttatcaaaaattgaaaaaaatttacaggaatccgtttacatttaagtcttttgactttatcattaacacataagtttttttagcctgaataagatggtcgattagagaggatgtttgttttgagtattttactattgttgctaccagcgttgggatggggtcttttgccgccgattgttgctaaaattggcggtaagcctgccaaccagatttttggaaccgctgccggacttcttctagccagtttaattgtgtttgccgttgtcagaccgacgactgatatgaagagcttccttctggcgggattagcgggtgctttctggattgccggtcaggttggccaatacatcggatataagaaaatcggtgtgtcaacgacgatgccgatctcaacagggatgcaattaatcggaacgtctttaatcggtgtgtttatctttggtgaatggtcgacagggatcgaaaaagctgccggtattacggggatcattttattaatcatcggtatttggctcacatcaattaaggacaaaagcaaaacggaaaataaaaaggttttgacaagtaccattatcatgctgatttttacgacaatcgggtactgtatctatgaatccattccaaaggggcttcaaagttccggcatcgccattttcttaccggaatcgattggtatgtgtgttggtgtgttgatttacctgcttttcagtggacagatgagtgtctttaaagagaagacgagttggttaaacagtattggcggcattgtcttttcgttcgcggccgtttcgtatatttactcagttcgctataacggcgtgaataccgcatttattgtgtcacagttatccgttgttatttcgactttgggcggcatgctggttatgcatgagtctaaaagtaaacgtgagctgacttttacgttaatcggcctggtattgatcattggcggtgcatttattacatctgttttctaaaaagacttgtcaactaaattaacaatgctataataatggttaattgggggattattcttaattgtgttggcagtgggggcttccagcagatgacgttccgattgctttttatactagtcagtatgaaggctacttggaacaagtcatagctggtcgttaaaatagccgatacatcactaatcattagtttaatcagatttgaaactgaaatattatccttcaataaaaagaatagagaccggaacatccttcaatttaccgatctcttttgttgtatttgcaagtcgctaggtgcaaaaaatcgtcgaacatcatgtccgacgattttttgtgtttaaaataagtcattactttgtagctgctaattttgtatcgtgatcaactgtctttttggattctcttggttcatcgacggtttctgtttccggacgatgatcgcccataaccaggtttaggataatggcgctgaccgccgcgatggtgatgggggaccctaagagatattgaatcatctggggtgtgctgctaacaaggtgacttggtaccaaaataacagccattgtcaggacaattggaattcccagaatataaatggcactttcgtttgtgtcaagataacgaatgacattcaagccgttcaacatgataatgacacagataattgaaaagatcccgccaataaccggtgccggcacagcagataagaatgcggataatttaccgaaaaagccgagaatgataaaccaaatgccggctgaaacaaatactcgacgactggcaacacccgtgatggaaataacaccggcgttggttgaataaccggtcattggggtggttccaagaatagcagcaaagaaacagctgagcccttcaccgataataccttgattccattgcttcttggaaatcttttcaccgacaacggcgctcatggcaaaccaggtaccggtcgtttcagtagttagtaccatataaatcacaatgaacgttaaaattgcaggtaatgaaaagtgaaagccataatgaaatgatgtgaactgtggaatgctgaaccatggtgcgttattaacggatgaccaatcgaaacgtcccatgaatgaggcagccaccgttccagcaatcaaagcgataatgattgaactgactcggaatagtcgttgcaattgaggaatccgaataccgatggtaatagcaagcaacatgacaaagccggttatggcagcaatttcgatattttgaccaacgttaccggttgctttaaaaatattgtcgtttaatgcggaaggaagcaaggacagtcccacgcaagtgatgatcgtgccgccgaccagtgcgggtaccaaggtattaattattttttggtagataccggataggcccagcaggatcaataaaacagcaccgataattaatgaaccgagtacggttgccattccgccgttaggaccgccatttgccagatataccccagcgacggcaccgattggcacaaacgacggcccttgtgatacgggcagcttcataaagaatttggtttgaagaatggtaccaatgccacaggctagaaaggcagcttgtaaaaagccggttttctggaccacactcattgatagtaaaccagcgataatcaatggcggcacgtatacatccattgccaaaacatgttgaaggcccaaaagacctgattgaaagtatgaaaccttatcttcgggaccataaagtaaaccgttatctttgcgtttcatagtgaccttcctttgcgagttttccttgaacaaagacctgtttaatgttgttctttgttgtgtgataaataagtttttcaaaaatatcatccggagtttgatctgtaaaagtcggatagggtgctttaaccacttgcagatccgccaggtacccgacttttatttgaccggttttgaggtgtagactttgagcaccgccgacggttgccagataaaagccgtttttagcggtaattgcattaatactggtaccgcgttttgctggtggcagtgcctggtcaacaccatcatgaagcattcgggatgacacaatcgcctgatcaatgtttcgataaagacttggtgaatagccaccggaaatatcagtgccaaggccaattttgttttgttgagccaggattttagcaaccggcagaacagcattgccgaaataggcgtttgagattgggcagtgggcaatggcaaccccacgttctttaaacaggtcaagatcggattggtttaaaagggtgccgtgagccatgatggccctatccgtcagtaatccaaattgatcaagaacttcagcgtctctcttatggtagtgagtcaacgcgtagctattttcccaatcactttcactgcaatgtgactggatgggtagatcatatttttgggccaatgcaccgagacctgctaatgattcaggggtacaactcggcacaaaacggggtgtgatgacaggcgtttgttttaagtcggcggttcgattcaaatcgattacttgctggataaatgtttcggcatggctaatggcctgttttgctgaagcatctcgataataacttggtgtttgatcagggttatccattgttacctgaccgataaagccacgctgttgatggcgaatacaagcttttgccaactcaagattggcttcgttatgaatagtgccaaagtaaagtgccgaagttgtgccattatcgaccagttcctgaattaaatgattataaactttcttggcaaaggcgacctctttatacttggcttcaagtggaaaggtatagtcgttcagccattcattgagcggcttgtccaacgcaagcccggcatttggccattgtggtgcgtgaacatggaggtcaataaacccgggcagcaggaagtcatcttcgtttaaagaaatcagttgattttgacgttttgcggcatttcgagttgatgaatagtccggatctgtctgatcaataatgcggctaatgtaaccactgttatcaatacaaatcagttgatggggtaaaaaagaaatggtttcgggtccggttgatgtaatggtggatccttcaataatagttgtaatcgaaataaagctcacctcattaaaaagtaattaagtaaaacacgaactttattgttaatgtttaattcataattcgtattactgtatagccgttattatagactgttgacaatcattgttcaatacgaaagacaaaattaaatttaattctaatgttcgtgtttaagcgataaatatttaaatgtggcgggtataccttcatgattgttggtggaagccttttttactgatttaagaactgaacgattcaccggcatataaaatgaagaaattctatattaaattttttctaaccgtttactaatttttgcaaacattatatgctattaacaagttacaactgaaaggattgataatcgtgtctagagagaatgtgcaacaatatttcgagcatttagggctttcagaacggattaaagtattggatcaatcaagtgcaacggtggcagatgccgcggcagctttgggatgtgaaccggaacatatcgctaaaacgttatcgttattgattgatgagcagccgattttggtggttatggcaggggatgcaaagattgacaatcataaatataaggaaaccttccataaacgcgcggagatgattcatcgccaagaagttgaggcatacattggtcacgcgccgggtggtgtctgcccgtttgcggtgaaagcaaatgtcttaacgtacctggatgtttcactgaaaagatttgacactatttttccggcagccggagatagccacagtgcagttaagttatcactcaaagaattggaagcttgtgcaaaagctgaaaagtgggtagatgtctgcaaaaactgggcataatacctccacttaaacaataatataattgtaatatttatgtacgctttatttctaccgattttcgattaaatacttaattgaccgtgatttttaataatccggtcttcttttttattgactaaaatcataactagtatatactatcttgtggcaattggttgataaaatagttgattaaattcctttatttttatggaatttagtcagacgaagggaaggctaaagatgaaagatgatgaggagaaatcggataaacagaaactgttttcctttgatgagcaggaaggcaaaagtctcgatgaggtaaacggcagtatcgaagttcctgataacgccggtttctggaaaacattatttacttatacaggtcccggcattctaattgcggttggctatatggatcccggtaactggattacgtcaattgccggtggtgcccagtttaattacaagctgctgacggtgattctgatatcaagcctgattgcaatgctgcttcaagcgatgtctgctcgattaggtattgtgagtggaaaagatctggcacagctaacccgggagcacacttccaaaagagttggctttttcctttggattatcacagaattggccattatggcgacggatattgctgaaattattggttctgctattgccattaaacttttatttaatattccgctcattattggtatcttgattaccagtgccgatgtgttgatcctgttacttttaatgaagatgggttttcgaaaaatcgaagcgattgtagcgaccctggttgctgtaatcctattggtatttgcgtatgaggtcttcttatccggacctaaggttgatcaggtgttggccggttattttccatcttcggatattttgactaataaatcgatgctgtacctttcccttgggattgttggtgcaacggttatgcctcatgatttgtatctgggctcttcaatttctcagacacgggcggttgatagaagtgatcgtggtgcggttcgaaaagcgattcgatttacaacgattgattccaacattcagttgacacttgcttttattgtgaatagtttgctattgattttaggggcagccttattcttcggcacccacagtgaacttggacgatttgttgacttgttcaacgcgctgagtaactcaaagattgttggtgcgattgccagtccgctgttgagtatgctgtttgccattgcactattggcatccgggcagagttcgaccattaccgggacgttgtctggacagatcatcatggaaggcttcattcacctgcatatgccattatgggcacagcgattgttaacacggctgctatcggttacaccagtgatcatttttgctatttattatcacggtaatgaagcaaaaattgaaaacttattaactttttcgcaggtttttctgagtattgcgttgccgtttgccatcgtgccactagtgatttttacaagtagtcaaacaattatgggagaatttgccaatcgggtgtgggtcaaatatgcagcctggattgccacggtagtcttggtcgtgttaaatatctatctgatcctacaaactttccatgcattttaatcacagaaacgccattccttttataaaaaatagtcacgtttggttggaatgttctttataaagggacttggcctaaatgatacaaaaggacaattgatccggaatttttttccgagtcaattgtccttttatgatgaatgatgctttgatattgatcagttatcaaagcatctgttcgcaatcggtttatttaggttattttcaattagttactgtatgacttggtaattgccatcaggaatgtagatggtggccggtttgatttggcacatgatgggtaggcctggatctggagccaccgaagtgacattcccagtaggtacagccctcgatgattaggccggcacccatacttagtccacaaaaaatcacaattaccaataattccataacttgacagtcccttcctttgattacccggtcattgcctgatctggtaccatcttgttaacttttacactgtaatcataatagaaaacgttataaacaacaacccctgcggaacaaattaatcaaccatcttctgacttaacgcttttgtgagcgcgtctaccgtatggttgatttcagtgctggtaacgggttgcttaaaaaataaataactaacagccaagcccgcgaccacggaccacataatccttagaatttcagtgtttgcccaattaaccaggaactggtttgctttaaacattgaaagattccggttgatattttctaagtaaaatgtggctgatgaggcaaactgatcctggaagtcggctcttagttggtcatcgtaaatcatttcggccataaaaattttgaggacatctgcgttttcttccataaaccgaacccgatcttttaccgatgcttctataaaggcgtgtaaagttgtgtatttatcgacgatttgggcatcggtaaatttattcagggttgccgggaaaatcgattggataaccggatcgatgatcgcttggagaagaccgcgtttgttggtgaatcgactaaagatgttgccttctgcaacaccggcttcctcggctatttccttggtacttgaatttgaatagcctttttcagcaaacaccttaatagccgcaatcagaatttttgactgtttatcggttaggtcatcaaagacgtgattctctgtgaatagtttatatgaaaccttggttaacaaaatatgggaacaccaccttttttattgaaattgactttacattttttagtataccttttaatcgaatttttacaataaattgattaaaaatttatgtatgccaaacttatcagcaactatttcaataataaaggcgttttcaaggaaataaaaggttgacgaatttcacaaagccactataataagcagtgggaattaattgagtactcactcaagtaaccaacctgaattcaagacaatgaaagagggcttcaaaatgcgtgaaagcgtggtatcatcaaaacatcgtttctttgaaagcacagaaggcagtaataagagtttagacgaagtaaatggcagcatcaaggttccaaaagacgcagggtttttgagaaccttaatggcatataccggcccgggaattttaattgcggttggttatatggatcccggcaactggattacgtcaattgccggtggtgctcagtttaaatacagtttactgtcggtcatcctgatttccagtttgattgcgatgctgcttcaatctatggcagcacgattgggcattgtcactggtaaggatttggctcagttaacccgcgagaataccactaagagagttggttttgcattatgggttgtgacggaacttgctattatggcaaccgatgtggctgaaattattggttcgggtattgcgttggaactattatttaagattccgttggttgtcggaattttaattaccagtgcagatgtcttgctgctgttggtattgatgaagttgggtttcagaaaaatcgaggcgattgttgcaactttggttttggttattctgggggtcttctcatatgaagtattcttgtcaggcccacagatgagtcaattgtttgcaggctatctgccaacaacgcatattgtgacaaataaatcgatgctgtatctggctcttggaattgtgggcgcaaccgtgatgcctcatgatttgtatctggggtcatcaatttctcaaaccagggcggtagatcgaagcgatcgtgaggatgtggccaaggcaattaagttttcaacgatcgattcaaacctgcagttaacaattgcctttattgttaactcactcctgttggtattgggtgccgctctattcttcggtacccatagtacggttggccgatttgttgacttgttcaatgcactgggaaattcaagtattgttggttcaattgcaagtccgatgttaagtatgttgttcgctgttgcattactgtcatcggggcaaagttttacaattaccggaactctttcaggtcagattattatggaaggtttcattcatctgagaatgccaatgtgggctcaacggctgttaacccggttattgtcagtcacaccggtactgatctttgcaatctattatcatggcaatgaagccaaaattgaaaatcttttgacactatcacaggttttcctaagtgttgcattaccgtttgcgatcattccattggttaagtacacgagtgataagaaactaatgggggaatttgcaaacaaggcctgggttaagtactgtgcatggactgcgacagtcgtcctgatcggattaaatgtctatctgattttgcaaactttgggacttatttaaggtaatcaaatccatttataaaaagaatttgcgagatgaaaatgctctttataagtgaatttgacagagtgtgaaaaaaagcgtttaaactccagagtataacaacaaaaacccgatatccctggtttggggatatcgggtttttgttgttatatggccggagtctggcttttttcacacgtttcgacatattaggaaaaggataaacatgaaatgatgattatttgtgtgtcagcttgattcacatagggtaaaatgagtgtaacacgaatgaaaacgaaaggtacggggattggctgatgataaaaccagaaaaagaagttgccggtatcaaatggattgaaaccgaaaagcttactgccgaagaacgggagcatcttcaggaacaatatgcaatcgatgaagacattatgacttatgtgaccgataaagatgaaagtgccaactatgttcatgatattaacgagggggatcaattgtttatattcctggcaccttattcaatcgatcgaaaaaatttgcgttacattaccagaccgtttgcaatgctgttgcatgagggccggctgtttacttttaacgaaagccgaattcatgaggtgactgcttcattgcgggatgcgatggataatccggaagttcatacggttgatgcttttattttggaaaccttattctcacttgtggacagctatattccaatttccagggaagcttccaaaaagcggaatcgtttggacaaaatgcttaatcggaataccaaaaatgctgatttaattgccttgtcacatttgcaacagacgctgacgttcttgtccagcgcaacacaaattaatttaaatttgttgaatcgattaccgagaacttattttggcaataatgctgatcaggacaagaaagacctgtttgaagatgttcagattgaagccgaacaggttcaacgaatgattgaaattgaaacccaggtggttgatcgaattgaccatacctttaataacattgccaataataatttgaatgacacaatgaaattcttgacaatttggtcattaacgatggcggtaccaacgattattacaggcttttacggcatgaacgttgctttaccgttatcaagaatggaagacgcgtgggtactggtcattctgatctcagtgacgttgattgtgtggctgttgataatgttgagggtgaggcacaaaatgtagcgtgtgcaaagagacgtttagttcccagaatataagcagggagctgtctcttggagcacgtttcgtgaccaaaagcaaaaacggttcgccggaattaatagtgttaatcaacttctatcatctccgtgtcagttaatcgatacttaacttttacgcaatctttacgggtaattcaccaaaccaatcactgaacgaattacaataatggtgttacattaaaggttgtgagactgaaaaaggggtgtgattagaatgaagaataacagtgcagcatttgctacatcaacgtcatcatttgaagctggtgcaatcccaatctccgagtcccaaggcgttcaaattaagacattagcaccaacaaaatcagaggcggatcacgaaattaaattggaaggtgcattcaacgttcgtgatctcggtggcttcgtcacaaaagatggtcggcgaatcaaagaccatcttttactacgttcagcgcggttaaaccatttgactaaaaatgatattcaagtacttactcatcaatataatgttggcatcgactttgacctgcgacgtcctcaggaagtggcggaagcacctgatatgaagatgccgggtgtcaaatacatcaatgattcggtggatacggacgaaagtttccattatcacattaatgaccgtaataatcggaaacattatcgttcctatatttccaatcagcgtgcaagagaagcctaccatgatttatttatgacgcttcttaacgccaatgataaagcggtactttggcattgtgcttccggtaaagatcgaaccggcctgggcggtgctttgattatgtacgtgcttggtgttgatatggcaactatttttgatgattatgatgcttccaatgatttcttgcgagcacataatatgaaacgtcttgaagccttgaaaacggccggtgccagtcgggatgaacttgaattggcccgtgttgatggtggcgttgatcgttcttatcttcatgctgcttttgatgaagttaagaaggagtttggctccattgatgcctatttggtcaatggattgcggatttctaagcgtcagcaacgaaaactcagaaaacagtatttgatttaaatcgtttaataaaaattaagccacttgggtagaagatgattcctttatccaagtggcttttatcgtgataagggttgttatttgtatactgcccggggtatgataaagatgggaacacaaagaaagaaggtcgattttaatgatgagatcatggggttgcggttcaggctggtctggttttggtcacatgggctggatgggttcaggtatgagctatctaacaattgcattaattgtgattttagtagtcgtgttgtacatggcctttcgtaccaatcgtcagtcaaatcagcaatcgtccgcaatggcaatattggatgaacaatatgctttgggaaaaattagtgaagatgagtatttgaaacgcaagaagaatttgggcaaatagatgttgattgcgcctgacaaaagaagcccgaatctacctttgaaatcaaaggaggttcgggcttctttatttttatttaaataaatactgaacaacaggtttacgatgtgtgtcataagaatatctaatcaaagcggtcttgccatttttcttggttcttttaaggtacattttgtcatgactaacggttaacgtgaatttccaatagcccttcttgtttggcttattgctcatgataaaaccggttgaagattttgaattccgatctgattgcatattaaacttgatgccattctgtgtcaaacgatatttagagacggtcaatgtaaatgaataaccggcgtccgttgttgtgtaggcgcctttccaggtcccacgtaaagtagatggaattggctttaacgctgtgtcttttgccagagcggtcgaaccggaaaataaagcaaatgagaagattgctgttgtgatgataccggatttaagtaatgtcatcaaaaatcgcttccttttctaacgtattgatcattgtgttagtttgagtatacatcagtggattgataaagtggcgtgtttttacaattagcattcttgatggcgttggttacttagaatcatgctatctgaatgttaagatttcgatttaataacctctgttaaggtctacctgatttacagcgactgtaccgtcagccaggtatgattgtagatttttataaaaaattgaaaaggctgcttcattgtaagttgaaaagctaccggagatatgtggtgtaatcaggacgtttggcatatcccaaagtatcgattctttgtccaacggttcttgatcaaagacgtcaagaaccgcaccggataattgatgattttttaacgctgtcttcaaagcatcggtatcaacacttgggccccgaccaacattaataaagataggttgattggtaaaggcattaaaaaggccttggttaaagtaacgagacgtttttgatgtgagtggcattgtattaacaatgaatttggctgactgaatttgttttgaggagatttgagtcggcagaatgtgatcaaatccgggaactgtatgcccagaggtatttataccgatggttttcattccaaacaaatgacaatagtaggcaatttttgatccgatttttccggtgccataaatggcaatcgggacgtttttaagattatagacgtgctgacgcaaagaatcactcagccatttatgatctttttgagcattaaggctcgaaagaatgcctctggaaaaagccagtatataaccaataacagattcggcaatcggctctgcatgaatgccgctcgtatttgccagcaggatatgttggtcctttatctttgccagtggcatgtaatcgacgccggcggaaacggattggataaagcctatttggtttggctgattgatgacacgttcaccaaattgattccaaccataaataatgttgacgtccttccaatcgtttatcgattgatcatttgatgtgttatcgatgatttctaaattcgacatcgcattaagttgttgacgctccttcgaattaatggcaaagcataatcctagtttcatgatttgtacaattcgtcctaaaagtcgttggctgttaatgtcctaaacgatagtcagtattagagagcagttcctatcaaataacccaagaaaatattagctatagcaaactgatcatttgagtgacctcatctattattttagttcatttaccaaaatttaaggagaaaaaaagattaagctctcactaaaacgagcctaatcacattggcaattgttttataaatccgatcaaattgaaattggaagtttaggacaccgtcattaaatcgtgaactagcggttcatagctgcaccgccgcgctcagccaatttggagatttcatcactataagccagattaaaatcacccgagatagtcagctttgtcacactagctgcaataccaaagttaatctgtttttgaggatcgtattgattcaggaagccatgcatgatgccggccgcaaaagcgtcgccacctccaacaccctcatagacatcaacggggtatacaggactgtcataaaagtgattattttgtaaaaggatagctgaccattgacttttttcaacggtataaatgtttctcagcaccgaaccaaccgtttccaaattcgggtaacgctcagtcattgagtcatagcagcttcaaattgtttcttttgagcaatgccgtttgtcatatcgccatcaaaggctttaataccaaaggaagattcaaaatcttcatcgtgggcaaatacgattgagacataaggcatcatcttctcggaaaacgcttgtgattcttcaggggaccataatttgccgcgataatttgcatcatagacaactttaatgtgatgttgttgacaatagctggcagctttcaagaccgttttttgaagttcggttgaaagggcaggtgtgataccggaaacataaaagtaatcggtatcctttaaagtcgtcttccagtcgtaatcattgctggttgacgttgcgaatgagctgtgggcacggtcgtagatcacgttagtcccgcgaatactggttcctttttcgaaataatacgtcccgattcgttgaccgcctcgaagcactttggttgtatcaacgccataaccacgaaggcggtaaagggctgcctcaccgagcatgttttgggggagttttgtgataaagctgctttgatcacctaataaagaaagtgagaccgcaacgtttgattccgcaccaccaaatgaagcctcaaaagaagtggcttgaataattcttgtacaatctgcaggtttgaatcgtaacatcagttcaccaaaagaagttaatttcataatcaagtcgtctcctaaattcgaatggttggttccgcttacacctaattgtatattaatatattagtttgtcaacaactgtttaaaaagcctcttttgaatgagcttatcaaaagaggaggataggtggatgagtttaaaatcaccgcatatggatttctaaaattaatcgataaagtagtccgggaattctgaaacaagtgtcttcttttcagcaagcatcagattcagatggtcaaaggcacgttgaccgcttaattgctggttgtgactttttgtcgcgtcaaggatgccttgatgctgctcaattaattcttcccatggcatttctgttttctgaattcgaagaaagcgataacggtctagttgaagtgtgagtaccttcaaccaattccagacttcatctttgccggttgccgtataaaactttttgtgaaagtcattatccaagtagaagaaatcaacactgtttcggttcttggcagccagtttttgcttttcgatcacattttgagcatccagtacatcgaaatcactcatttcttgagatgcttcctccacgacgctacgttccacactttgccggacaaaacgcgcatttaaagcactttttaaactgatcttggtgacatatgtaccgctttggggaaccgtgtccatgaggccgtcgtttttaaggcgtaaaatagcttcccggacgggggttcgactaatatttaatttgtctaccaggtttttatcctgaacccgttcaccgggagttaatttaagttttaaaatatcatcaagaattgtttgataagcaatttcgttaaggctttgcattggttaattcctcatatctttattttattaaaatcagtatactagtattattgtatcacgacaatcatggcggaatagaaaggatataatattatttgacagcgttttccgggcgtggtaaattagatttaattgatatactagaatattagttttattaggttgaaaattcctgtaggaggaaattatggcaaatcttaaaatggggtttcgttggtttggtcaaaaagatgatccgatctcgttagcagaaatcaggcaaatccctcaaacaaaacaggttgtgggtgcattatttgatgtccctgtgggtgaggtgtggccacaagaaaagattgatgcgttaaagaagcaggttgaggatgcgggcttaaagcttgaggtgattgagtcggttaatatccatgatgatattaagatcggtctgcccagtcgtgatcagtatattgcaaattacattcagacaattaagaatctttcgaaagcgggtattaaggttatttgctacaatttcatgccggtgtttgactggttgagaaccgatttacatcatcaattagctgatggttccaacgctatgatgtatgaggaaagcaaattacccaaggatcctaaagacctgatggcagaaatgacttcaggctctcacggctttagtttacccggttgggaaccggaacgactggcagctttaaaagacctgtttgcagcttataaagacgttgatgcggaaaagctgcgggaaaacctaaaatatttcttggatgccgttatcccggtttgtgagaaatatgatgtgcgtatggcgatgcatccggatgatccgccaaagcctttatttggtttaccacggattttcaaagatcgcgacgatatgattaaaattgaacagcttcatgaatcacgttataacgggtttaccatttgtaccgggagtttgggagaaaatccgttaaatgatctaccgtcgattatccgcgaatttgtccccaaagaccgggtcccgtttatgcatgttcgtaacatcaagtatgttggcgaaaatgcatttcatgaatctgctcatccatcgtcagaaggctctctggacatgtttgacattatgaaagcacttcatgataccgattatgacgggtatattcgtcccgaccacggccgaaatatttggggcgaggatggtcgtcccggttatggcctatatgaccgcgccctcggcattacttatttgttgggactttgggaagcgttagaaaaaacgtctaattaagtttgcgagtcattattatagaagaaaaaaattggcatctaccatgatgaaaatgggtgagatgccaatttttgtgcttgatgaaggtgttagctgctttgcctctcggtaattttaataggcgtataaagtgacttgaattgtttaatagattgactgaggagggtttcaacacccttgacgcccatttctctaaatgattgggtaacacttgtgatttggggtcgcatgatcgtacacagaaaagtgccatcgatactgataacggcgaaatcgtttggtactcggataccgagtttttgggcctgattcaacatgccgatggcggcgaggtcactggaagcaaccgctgctgttaggtcggtgtgttgttcataataggacattgcggcaatgccatcgtcatatgtaaactcgccatcataaacccaatccagttttggcgtgacatgattgctggacagtgccttccaataaccggctaatcgtaactgaccgataactgtttcgggatcagctgccgcaaagccgattttggtatgtcccttatccatgagatatttagttgcctgatagccgacttgaaagtcgtccgatgagatgaacgggaatcgtcctttgagaaacccgatggagagaaatagaaaggggatgtttgctgacctcaacaaagcatcgttctttgtattcaaatcgatcgctaccaacaagattcccatgacagcacgttcaataaccgtctccagcgcacgtctttgtaagtcggggttcttctctccagcatataaaataatgacatccaaaccgttcttcattgctgtttcctgaatgccgtcaataatttgatcggcagcgttggtctgaattgtactgataatgactgccagaacatggcttttttgagtgaccaattcaacggcactggtgtttttttgatagcctaatttttttaccgcttgtttcacttttttagctgttttttctgagtaaaaatcggtttgacctgacaaaactcgcgaaacggttgccggtgacacccccgctaattttgcaatatccttgattgtggtgcccattttcgccgcttcctttctaaagcatgaatcgtattaataactattctaccatataaatcctgttatttttgtaaacgtttgtgcaagtgatataaaagggttgcaaccgtttgcatttaatgttagtatcttcagtatagaagtgaatgaaaccgttttctatcaatttatatcaattggccaagtgatataaaacggttccgtaacaaataatatatcttgatacctgtatatattgggggagttcatatgattgctaaagaacaagttggtaagatcgccgggcaggcacaggttcaatccgaagccaagccacagcataaaggactgccaacgttaaaattaagtactatttttgccatgacattcggtttcttcggcgtcaacatggcgttttcattgcagtcttcgcaaatggggcggatttttcaaaccattggtgcggatccgacaaaattaggtttcttctttattctcccgcctctcgcgggaatggttgttcagccattaattggtaagtattcggatcaaacctggaatcgatttggccgacggatgccatatctgatgattggcgcaccaatcgctgcgttggtcatgattttgcttccaaatgccgggtcgtttggttttggctatgcatcgcttgctgcattgatgtttggtgccattacgattctatttatggatttatcatcaaatgtctgcatgcagccgtttaagatgattattggtgacatggttaacgaagatcaaaaggataaagcatggtcttggcaacaatcattttccaatcttggcggcgtacttgctacgatttttccattcctgttaacctggattggggtttcaaacgttgcgccaaagggtgaagtacctttgtccgttaagatggccttttatattggtgccggcgtcctgcttttgacatctctatacaccatctggtcggttaaagagtacgatccaatgacttatgcacgctatcatggtatttcagaagataagaagaaagaaaagcagccaagtctttggcacttggttaaaacagctccccgttcattctgggaagtctcatttgttcaattgtttgactggttcgcttttcaatacatctggacttacggaacgggtgcaattgctaaaaatgtttggaataccagtaatccagcatctgccggttatcaggcggccggaaactggtttggtattatgacctgtgttgaatcattggctgcagttatttggggctttttggttctgtcgcacacgaaacccacgcagcgtaaattctggtttagaattggtttgattatgggtggtaccggtatgatttgggtattctttgtccattcacaaatgctgctgatcgtgccgtttgctctaatcggtatcagttacctgacaatgcagactgaagcattatcattattcacggagtcacttcatggtgaaaatgaaggggcttatctgggactattcaattgtgggatttgcttaccgcaaattatcgcatcggttgccagctttgcccttttcccgttgatcggaaaatcaatgcccggaatgattgtgattgccggtgtgatgatgtttatcggtgctttggcagttggaatgattcatccggcttattctgaaaaatcagcaactaattaataaatgaaggattttaaattaaaaaatggaggatgtttagtatggcacacaagtggtggcaggattcggttgtctatcaaatctatccaatgagttttcaagacagcaataacgacggaatcggcgatttacccggtattcagagtcgattgccctatctaaaaaagttgggagtcgatgtcatctggctgaatccgatttatcaatcaccgaataaggataacggctatgatattgctgactatgaagcaattaatccgatttacggcacaatggatgattttgacaacttgctcgaagcaacgcataaaaatggcatcaagctgttaatggatcttgtggttaaccatacctccgatcaacacgaatggtttaaggaaagtaagaaatctcgtgataatcagtatgccgactattatatttggcgcgatccggttgacggtcacgaacccaataattggggtgcggcgtttggtggacctgcatggacatacgttaaagaacggggacagtattacttgcacctttttgcaccgggacaacccgatctcaactgggaaaatccggaagttcgacaatcaatctggaagctgatgcgtttctggttggataagggtgttgatggtttccgaatggatgtcattaatcttatttccaagcctgatgggctccctgatgcgcctgcacccgcaaattacgccactgttgaaagcatggttgccgatgggcctagattaaatgattacctgcatgaaatgaatgatcaagtattgtcgcattacgatgtcatgacggtaggggaaatgccaagttccaaaccggaagatgcgattgaatataccggcctaaagagcaatgaattgaacatggtctttcagttcgagcacgtttccctaagtgccaatccggacaaacggctgggaaaatggaacgatgccccagttaaattaacggacttgaagcgggcattatcgcgttggcaggttgaattagacggcaaaggctggaatagtttgtattggaataatcatgatcagccaagagccgtttcgagatttgcgaatgatgatccgaagtatcgggtacgtgccgcaaaaatgctcggtaacacgcttcatatgatgcaggggaccccctacgtttatgaaggcgaagaacttggaatgaccaatgttcactacacgagtttggatcaatatgaagatttggaatcgattaacagctatcatgagttagttgatcagaaccacgatgttgatggtcagacgatgctgaagtatctggcaaacgtttcccgagataatgctcggacaccgatgcaatgggatgatcaggaaaatgccggcttcagtcaggcaaaaccatggtttgcattgaatcccaattataagagcatcaatgtcgcaagtgagcttgaagatccgcaatccgttttctactactatcagaagttgattgcattaaggcatgattccgaattgattcgctacggtacttatgaggaagttgatccggaagactctgaagtgtttgcttatcggcgtcattatgccggtaaaacattgctggtgatgagtaattttactgatcaaacggttattcgagactatgatcaggccagtgccaatgagttgttgatcagtaactacgatgatgatcagggcgttaaacttcgtccttatgaaagtaaagtttatatcaaataaatgcaacagagacaaaaagacagtgtgctcaggttttaccggttggtaggcttaagacactgtctttttgtgtaagcaatttttatttcaatgcgtgatgatcatatttatggttattgacttgggatggtttcaaaggcctgttttacttgtttctaatagcgttgagcttcttcatatacgccttggcgttttctgtaacttgatcataatcgccggcagcacccgggccaaccaaattaccgcttgcacctgcacaaactgcaccggcatcgaaccagtcttgaagattatccaagttaacgccgcctgttggcatgacgttcatttgtgggaacggtccgtgaagttctttgatcatgcttgggccggcaacaacggcaggaaatagtttaacaatatccgagccgccttcaagtgctttttgcatttcactcatcgtactacaaccgggcaggtaagggacctggtataagttacatagtttagcaatatcggcgtcaaacgttgggctgacaatgtatcctgcacctgccataatggccagccgggtagaagtcgtgtccaggacggttccggcaccaatgacgccgttgggtaattctttggtcaatctgccaataacctgatcagcgtggggaacagtgaaggtcaattcaataccggtcacgccgcctttaatggcagctttactgattgcttcggctttttccggcgtttctgcacggacgacggcaataatcccggcgtcgacaattttctttaaactgtttaaacgattcattgacatcaagaaaatctcctttgatagttttaaaaacagaattcaagaacattagtatatcagtttcatatattaatatattacttttgaattgaaaacgcaaccacctgaaaaggttatttgtaaatactgtaagcgggtgatggcgtttatatagtaagaattaaattctatgcaagaaagtgcaaatatcattaaataacattaaatatttttaatacaatttaataaggatgttgacaaaaatgtgtgaagcgcttacattagtgttggaacttaaatttgcgtatgggagtgtgagtgatagatgagtcacgaaaaaatagctcaagcagatagtcgctggttagacgacccggaagtctttcgggttaacgaattaccagcacacagtgatcacagattttatcgaaatcaagatgaaattaaacgtgatcaaagtagttttgttcaatcattaaatggtgattggcgattttcttatgccaaggatccaatgagtcgtcaaaaagatttttataaagcagattttgattccggcaattttgatacaattcgggttcccggattaattgaatttgccggatataataagattcattacattaatacgttttatccatgggaaggaaaagaattccgccgaccagcgtttacaatgggaccggatcaagatgaagccggtatgtttagcaagggcaaagataatcatgttggtgcctacgttaagaaatttacgttgaatccggatttacagggccatgatgtccgcattcgttttgagggcgttgaaaccgcaatgtatgcttggctgaatggccattttctgggctatgccgaagatagttttacccctcacgaatttgatttaacaccttatttgactgatggagagaataccttggctgtagaagtattcaaccgcagtacggccagtttcttggaagatcaggatatgtttcgtttctttggcattttccgcgatgtgtcgttaatcgctcaaccggctgttcatattgaggatttatcaattaagccaaccgtgaacgatgattttcaatccggacgattaaaggttgaagctcagttttccggtcagcaaagtggcgttgttgcccatttaaccgttgttgacgcaacaggcaagcaggtctatgaaaccagaagtgaggttgacagcgatgttcaattagccgatacaccgtttaagacaattcacctctgggacaacgataacccgtacttatatcagttaacgattacattgacggataaagatggtcggacattggaagttgtcccataccagttcggcttccgtcgaattgaaatcaatcaggataaagtgattgtcctaaatggcaagcgactgattatcaaaggtgttaaccgccacgaatgggacgccaagtccggccgggttgtcacaatgtcggatatgaagcaggatattgaaacgtttaagaaaaacaacatcaacgctgttcggacctgtcattatccggatcatatttcctggtactacctgtgtgataccaacggtatttacatgatggccgaaaataatttggaatcccatgggacttggcagaaattgggcagtgtcgaaccgtcctataacgttcccggatcggttccacaatggcaagcagccgttcttgatcgagctaaaaataattatgagactttcaagaatcataccagtattttattctggtcacttggtaacgaatcatatgccggtgatgatattgaggctatgaacagctactataaggaagttgatccatcaaggcttgtacattatgaaggcgtctttcataatcccaaatataaaccaaccatttcagatgttgaaagccgaatgtacgcaacaccgactgaaattgaggcttatttgaaggataatccgcaaaaacctttcctactatgtgagtacatgcatgatatgggtaattcaatcggcggtatgaaatcgtatatggaccttcttgataaatatccaatgtatcaaggtggcttcatttgggacttcatcgatcaggcggttgcagtcaaagacgaagtgaccggtcaaaaggtgcttcgatatggcggcgattttgatgaccgggtttccgactatgaattttccggagacggcttgatgttcgccgatcggacagaaaaaccagcaatgcaggaggttaaatactattatggcaaatactaatcagttaaaggtcatttacggcgatgggactcttggtgttggtggtgatgatttccattatatcttcagctattcacgaggtggccttgaatctttggtcattggtggtaaagaatggttatatcgtgaacccaaaccgactttttggcgggcaacaaccgataacgaccgggggaatggcttttcaaagaaatcaattcaatggttgggagccgatatgtttatcgatgttaaatcgattgatgttaaagtgaataatcagctgattgactttccaggtgctccgttaaataatcggtattccaacaatgagtttgcggatcaaattgagattatttaccattatgaaacgttgacgactccaagcacgacggtggacgtgagttatacagtgacaccaaatagcgtcattaaagtggctgttcactatgccggacaaaaggcgcttccggaattaccggtattcgggatgcgttttgtattaccaaccaaggcaattgattatcagtatgacggtctttcaggtgaaacatatcctgatcgaatggctggcggtgtccccggggtttatcaaattgatggcttaccggtcacaaaatatttggtaccggaagataatggtgtccatatggagacaaactgggtcacggtcactcgaaacagtactaaaaataacgcggactcatccagtgtcccgtttagcctgactttcgaaaaagtggatcaaccatttgcgtttagtgctttgccatacaccgcagaagaattggaaaatgccacgcatattgaggaactgccgcttccaagaagaactgtgatgactattttaggtgccgttcgtggtgtcggcggtattgatagttggggtgcggatgttgaacctcaatatcatattccggcagatcaggatatcgattttggctttgtgattaaacgagggtcgaaataagattcggattgcgaatggggtttctaacaactatgtaaacttattttgaaataaacgagggcctccgagatttgtctcgggggctcttttgtcgttcaccgtaaaagttaattctcttaccaatcgggtcatttaaccgaaattaatctgacttaggtggctgccataggttagataagtattaatggaaggtgagcatctatatatggatctcaaattgtgatctttttgctatgaaacttaatgctttcttcctgagtggaatcttctcactagtcgtcactgcttgaacctgaaaaaatatcaacaactagtgcgatgaagattaaagaaggtgcccaagtgagggtggcaccgaagaatgaaagtaagttactacttttgggtgcccacttaaataattcgaaaacaaattgaataaacaaacagtctgccaagccaaatgtgatatcaaacgagtatctaaacattaaagatgtttttcttttgaattttatcttttgtcgtaagctacacattggcattctccagtccttaataaatttggtaatcccaataatcagcagttttgttagttcgggaagagtctgaataaattttgacgtgatatcgcacgcaaacactttctgaatctttgtctttccaagtggatacccactaatttttgttggttattcgcgaaatacctttattaacgatgcatcgttgaaattaggctatcatgcaattttgattttaacaatggatttatgaacttttcataattttcacaataaatcaattcttatttaaaaaaatttcatctttcaaattactatcattataaatccagaatctcaattatgaagacgctttaattgatttaagtgccttctgggtagatacttcatgtgatgaaacatcgagcgtttgatttctatctagggggaatttaaaaatggcaaatttagttgttaaaacggatgttgaatatgattcgatcaaccatcaaaagacggacatctactatgatggggatgtgaaacaagctaagggtgcaatcatcgatatccatggtggcggttggtttcgtggcaataaatccaaggatgccgattcatccaaacgtttcgttgaattgggatatttagtcgttacaccagcttatcgtattacaccggttgcctattatccggcaccgttagaagatatggatcatttgtttgagtggctgaaaaattctgatttaccgttcgatcatgatcatatcggcgcatttgggtcgtcagccggcggaaatatggtggtcgaattagccattaaatacggcattccaatcgtatcgctttccggaattttggatattgatgattggttgggcaaacatcaggacgtggtcgctgcagaaggcgataccagcggatttaacgctacagccagtgcaaatattaatcagaccggtgccaacgatccattttacaaatggtttgtgaccaactatttcaacggccgaacggatcagtatgaagcagcaactccttatcacagagtaaccgatcagaccggcacaatgtatttggctaattccttgaatgagtttgtgccaaacagcggtgttttaacgatggcaaagacgttatccgaccaccaaatcccatatacgaccagaatgttgactggcagccgacatgcaaagggatatttggatgatgtatgggatgatgttgcggcattctttaataggacggtttagcttgttgttctataataggcaatcttttattaaaaagcttgaccagatacaaaataacggttcaataacttctaaagccagttttagaatattgaaccgttattttttgcctaatttgataaattgatccctttgtcatcttaataatagttaaattgccatgacaaagaatctatccatagctgaatgttcgccattgtttagaggatgacccaattctgagaagccgtattcctgataaagatgaatggctgtttttagattatggtgggtttcaagatagacttccttgtaaccggcatgtttagcaaagttaattgctgcatcaagtaacttgtaactgagatgttttcctctggcattctctgttaaatataatttttgcaactcggctattctattttttgcatcatattcagcgatgccgttaccacctaaaatatcaccgttgtcagtggaagctacgaagtattgacgcttagggcttgactggtaatactgacttaggttagagagttcgggatcaaaataggctgtcccggggatatctaattgatatgcttttaatgaatgttgaacaatatgagctaaagctgaattgtcgcgactttcaatgggtctgatttgtgtcatttgcattactccaattcaaattaatgatatgttaggcatatacttctccaattgagtaaagggctgctttaccgctcagtatggttcgtgctccttggtactcgcagtaaaggataccgcttcgtttggaagcttgataagcggtgatcttatttttatttagtcgttttgcccaataaggaacgaggtgacaatgtccgcttccacaaacgggatcttcatcgacagccaactttggtgcaaatgaacgggaaacgctatcgtatttttctcctagtgctgtgatgtgtagtaataacccatcgagctgacgaaccttttctaggtctggtttagcgttgatgacttggtccggtgaatcaaggacgcagaccagatcccgggccatgtaagcggcaagtggttttgttccgattgcatcagtcatttcctgggtaaccgcaacgggtttgagatcatatgaaggaaagttcatttcatataaatcaccgtttttggcaacctccaatcgaccgcttaaagtttcgaaggtcacccgagttctgtctttttcaatgaagttcataatcacgtaaccggttgctaatgtggcgtgtccgcagaggtcgatctcaccgcccggggtaaaccaacggagtcggtagccagtattttccttgacacaaaaggccgtttcggataaattattttccattgcaattttttgcatcaagtcattctctggccaactatccagaatgcagacagcagcggggttgcctttaaatatttgattagtaaaagcgtcaacaatataacttttcataggctagtcactccatttcttattgcatatactttaaaacaagttatcatataagtaaaattaatttttgtaattgccgaattaggagagctgatatattgatgaatcgtttacttgcacttcaaaaagtcgttgagttggggagctttacaagggcagctgaagctttaggattcactcagtctgcaattagtcaaatggtcacatcgttagaagaagaaatgaagattaaacttttagatcgctccagaaatggcattacgttaaccctggaagggcgaaaaatcttttcttttattgaaaatattttattacaataccaaattatggaagaaaaagttgacgaaatcaaaggcctcgaaacaggcgttatcagaatcggaaccatttcaagtatttcatgtcactggctgcccaaactaattaaaacatttcaagaaaaatatccaaaggttgaatttatccttcaccagggagattatacaacgattcctgaatgggtgaaaaatggtgaagttgatttcggctttattaatccggacgttaaaaccgggttggatactgaatttattaaaaccggtgaattacgtgcggtcattcctcaaatcagtgttttagcaaagcaatcctatgttagattatcagatcttgcacaggagccgtttttacagttggaagagggcatcttaagtgaaccaatggaagctttccatcgagctggtctcaatccggatgtgaagttatgtgttcatgatgattattcaattatgtcaatggtcgaatcaggaataggtgtcagtattttgcctgagttggtcttacgaaaaacaaattacaatgttaaaattttacctatcaaacctgttattaaaaggaaaattggcattgttaaaaaagacaaagagtcattatctttagcaagccaaaaatttattaagtatctatttacaaaagtagatacgttaccatgaaaacaaacgcatttaatcaattagtcattacataatcaatacaaatcaacgagatggctactctttttccatttttaatctggttcgaaatgcattgtacttgtcggcaatcatcctgccaaaggtttatgaaccattctgatgtgcggcgtggaatgaaagataaatgggtcgccttgagtgataaaaccaaacttctggtatagggattcgacttgaatttgggcttcaattttgattggcgtatttgggaaatcagtttgaattgtctgcataatatggtcgattaaggctctgccatatcctttccctcgatattccggtgcggtaacgacacggccaaacgtgacttggccatcgtcctcgaatatccgggcataagctgcgatgttgccgtcaactaatttgaaaacgtggatggccttaagatcgttggtatctacttcctgatagatgcgcttttgatcgaccacaaaaattctggttcgaagatatagtatatcgaatagttctttggtcgttaactgattgaatggtttgataacccacatgatgaacgcctactttctggaaaataataattgattaatggtttcaacggcttgataaaattgagcctgtttgtcgatagacaattttgataataattgtgctacctgttcgtttgacctatcatccaggttctgggtcatttgctgaccggaagcagtcagcttcaattgaacggaacgggagtcttcaggtgagggcactttttcaaggaagccctgcttgaccagccgattaatgattcgactggtatagcttttatcgatttttaaatgggtggcaatctcgttggggttgatgaggtggttaattttaatttccaataagatacgtccttcctgccaacttagactggtattgaatacctgtctgttcagtaatccaagaagctccgtataatcgcgattaaattcgcgaatcaaggaaatttctttttgtgaaagcaaaacggtccctcctgatgattaaaatttggtgaacgtgattctaattataaatattttagtggcttttgtccactatttttaaaggcgattcttctgattaaatcaaaaaaacgattcgaaatttctaaaatgaggttagaaatttcaaaccgttatcgaataagcttaaaatgaagactgccaaaatttattttacataagcgttcttataattatagtttggtcctgcggtattataaatgatgcccttgaccttaggattaattaaccatttctctcctgattgataaagcggtacgatagcttgatcctttaatgccaagttctgtgcactcaccatatcgttccaacgggcctccggtttatcggcatcctggccgttacttttagcaattaatttatcataagcagcgtttttccattttgaaatgttactggggttcttagacgttaagatgtttaagaatgtgaccggatcggaataatcggcgaaccagtcggcaacggttgcttgaaattgttgatcggcctgacgtgacaggacaactctggcaggaatgttatttaaggaaaccttcaagccgggtaatttttcaagggcgctttggaggtactctgtcaactgtttagtagaataatcatccccagccatcagcgtaaagctaagtgattttaatccctcttgttttagtccttctttaaatagtttcttggctgccgacagattataggtcattgaggcaggtgcggttgtgtcttcagtgaagtcctttccagtctttggcgaaacggccaatcctttggaaacaaaactatcattttggatagcaccgccacccacgactttgtttgtcatgacttttcgatcaatggccattgagattgcctgacgaatttttagattctgaaagacctttttcttttgattgaaagcaatgtagtaggaagatgactgatttctggtcacaatgtgtttattcttgctgtattgcttggcttggtcgttggagagaccgtccatatccagcttcttttcgttatatagattcaggccggttgtcggatctttcacaacactgtatttaacctgattcaatttgacgtttttcttatcccaatagtaaggattcttctttagggtccatgataagttggttcctgtccattttgttaatgtgaacggcccgttgtaaacctgtttgtcagatgacgtgccatattgactaccatatttttgaactgctttggcgtcttgggggaagaataccggaaagcccatgagtagtttaaagaatggcagcttatcttcgagtgtgacggttagtttatacttgccgtctgctttaatgcccagggatgacacaggggctttattggcttggatcttatcggcatttttaatccctgagaaaagatagccatactgtgaagaagtctttggattcagtgttcgacgccatgaataaacgaaatcctgtgcagtgaccggatcaccgttactccattttgcattttttctgagattaaacgtgtaggtcttaccatccttggattctttgtaggattgagcaattccgggttcaatcttactattcttgcccaagcgaagaagaccttcgtcgacgttatttaatactgtaaaactgttaagcgcagtcgttttcgataagtcgacagacgttaattcggagtcgattgatgttcggataatttgcttgtctgaagactgcttggattttccacagccaaccaatagtactgaaaaacaggtgatgccaaccaataatttaagttgttttgatgaccccatataaaatcctccctaagtgccgtttttgttcttcgtaaaatattagaaaacggtaaactgatgttagaatatgtaacattttcattaattatactttaatcaaattttaatgcaaccttttttgataaaactaaagcttataaacggattttattcaaataagaagggatagggatgggggatcagtaaaggtgacagcagtttaagaaaggttgatttttagacataaaagagcgattcagttttcctgacattaatccaggaaaactgaatcgctttttaaacgaaccttatttaaaataacggatacaactctaattgagcggttctaattctttgagtggcgttattgccccaccgtttgagtttgataaccttacttaaaataaaaagtttatcgacaggacaaacgcaatataaaggatgccgtatgccaatacgacaaagtgtaaggtatctgtcagtttaagcagtcgggtggttgcgtaatctttattgaaaaatatgtggaaccaccccaatggcagtaacacaagcaggataccatagccgatttgttcatagaagtgagccattgtcaaaatcacaggtgagaaaagaatcatcatagtgacacccaccaagtacataatggcaaacgacttcataaattttggattgattaatcgttttaaattcgagttcatcaaaataaatcatctccgtttgagtggcttacactggcattataacaagttaaaaccgttaaagccaaattgatttaaaaaacacaaaatttattcaggggctaaaatatgataccctgtcagtatgcattaagaaagtagggataatttgatacaaacacgttggtcttggcagaagcttcttatttccgctgtcattttatttggattattatttggtatcagctttgtttccagagcgatactgttttccggtcacagtgagacggcgatttatcttcgagcagttgtcaggtttacatacgctgttatcgcgggtggcattgcctactatggattgggaggcaatcggcttttaaaatcggtgccgccattaaacctttttcttaaaataatgataacggttattggtgtgttattaatattactgttgctcgtaagtggctttccatatcggctgttggcaatggtccattcaaatctgtttattgcaaatacattagttgcattatcggccggagttcttgaagagtttacctgtcgggggctgttactgtcggctttcgcgcaagcatttgaacgaaataagtaccgttatacgtgggcggcggtggtttcaggcggttgttttgggttactgcatttatttaacttacttgccggtcaagccttaatgaccacacttcaacaagccatctatgcatttgttttgggcatcctttttgtcgcaatcagattaacgactaattcgcttgtttgggtgatgatcatccatttctttattgactggcagccaaccatctcatctgaagtcatgaccggaagtgggtcgccatggggcgcattttttattgtttggacgcctgttttgttgatcggattggcatttatgattggttttgacaagaacgttcgctggcattcggggttatcatttctataaattgacgtgaaagacgatcaattcacccatttagtggtcgctattttgctgactatcgattatgtcaagcaacaggaatctcaagcagatatggacagtacaacttactgaaaatcaatgaatggcattagaagtcgagctgaaagacttttagtgtcattttattgtgcatgtgggtattttgaagttatataccggtctttcagaaaaaagagtcctgcaatcaagggccccagtagtgcataaagcaaactcagactgatgttgatgacgagcccccactggtcatcgtggagctgcatcatgaattgccactgcgataagcgttcttttcgtcgattgatgaatccccattcatctttaggagatcgttttctgattctttctgattttaattctgatagtccctttgtcggcagtgattgactggttaaataaaatgttttgcgattaactaagaacaactgagaaacccatgaacaaaaaagccatacattgaaccagttaaaattaaacacgaaccgcatcctaccatctgcattgaagaagtagagtaacccgatcatgattagagattggcagatgaagcggcctgtctttctatagatcattgttttgtccctccagtttttgaaaacttgcctatggtcaaaagtatagcgaattatggctaaaattaaagacattttctcagaaatacgacatatttctgagaggccctttaattttaagcgattgtctttataatggaaaccagttaaaagtttgaaggacctaattggaaacagtgaggatgggaggcagttagatgacaatggcttatgagattcgtggccttgaaaggggaacgctaagtgtcttgctcattttattttttaacgtaactaactttagcgtatcggcatttcatattaattttaattggtatgtggatctggtactcctaagctttatcacggtttatccatatgtcaggtatcgcctgcatcgcctttatcaatggcagttattttcgaacagaaaatcgcggttaaccacaaatgttaatcaatatcgtgaccggtatctggcgacggcacggatgcccgaatcaaatttgagaacattggcttattcaagtgatggtcattatttgtggttcttcgcaaagtggttgaaaaactttttgttggatttgatcgttatgccgctgagtattgtactcagtgtctattttatttttcggagtcgattcacaaatctttaagattataagcagaaataatggtcgcaaatataaatagacgcgtttcaatataaaaataaaagtcctgtaaggatcgatgattttacactgatcttacaggatttttttaaatgtatcgcctgagaaagggatttcttttggtcatttgagatgaactgccattaggaaaaaaataacgtacatgacaacagctattggtccgaatactctcgtggatttaatatacatttttttgctgtcttgattcttaattaacttatcgcctattaagttaagcgatagcgcaaatatcaatggtatgccgatcattaaaagaatataaagataaatagtcatattcaaaactccttgctaaccagtacacaccaaaaatatgtctaaagtttgagtattttgtaaatatagtgtgaatagaggttgatctttttgtgaaaaagtttaagtgtttggagtattaatctttgtttaacaggttttctttaaaaatataaacaatcaaaaacgaggtcggatttttccgacctcgtttaatagggcatttaagctgatcaccaatatcccaataatttcgttaatttagctctattaatatcccggttcgataatttgttggtaaatcccgcgaaagaaccattgccggttttagacgtcgtccaggaatatttaatactgccggcactttcgcctgactgagcgtacataatatcgtccagataaggtgtgtgatccagccccaagctgtggccgagttcatgggtgatcgttgcttcccagaagccgcggtaatacttatcgtaggcagctttgtcagcggcggtctttggtttggataccttttttccgctaacggcttcaagtacggtcaagatgtaactgttgctattgaagtgggatttattgacccaaagtttattggtcctgtacaggccatcccacagactgccattttgaccacccgttccaaagccgactctgatcgtgtagttggtgctcgttccggttttaaaaacggttgtccccaaagcttgattccaggttttcatcgagacagacaagtatttacgaagctggggagaggcagtgtaaaccaacgcttgatgatggttaaagacagacggcttgctcattaaatcaacattatattccttgttgaatgttgttttgtattgactgtaagtcgctttggaaaatgagcggacgctgcttgtcggatttagatcgggtgtcttttgaatccgtgagataacagtcttttttgcggttgttttggcgtaagcctgtgtttggaaatgggatccaagcgaaaatggcagtgcggtggcgactgtcagggatgccaataaactggcaagtaaacgtttcttcttcattatcaaatgatagctccttacatatagtccgttataagttattggaatcataacaccatctaagaaccggttcaagaaatcgccatcaaaggttcctgtttattatgaaattttcatcattagaatttatagtgattatatatagaatgatctcaatatgagggggagtttgaacgttgaaaaataggaagcgtcatgaccgaaaggggttctggtggcagttattcagaagtctgattgtttcaccgttaattgtcggattcattggtgtttttggactcggctggtggtgggcaatgataccggcattattgctgaacgggatttattggtatcggtacaataagaaatatcaaatcaccaacttttcaaatgaaataaaagcaatgatcatttctttgatctattacctgggtattttttcgcttattatgattgtctatcgttacaattacgttgctatgtcggagtatccgttaattgcatttgcctttccatacaacttatccagtctgatagccggtgcttttttaatgtatgaccttttcccatggttgattatcgggacattttggtcaggggtattgggtgctgtttactaccaaagtgtggttggacaatttccaaaactgggaaagaggcagatgacttggttaattgggctctgtttgattagcttactgccgctttaccaacaatttgccaaaaatttgcgatacgttcatacatatagcgatacttccagtgaacttaatttaaaacagtttcgaccgtttatgaaaaagtcacatctggcgagtttgggccattcaacaaacttgcgatttgtcagtcactatccccgtttggatggggctacggctgcgtatcccatttattcagcgatcgcacagacattgtataaggggatgacggcaaagcaggccgctaaaatagttcgggtaggaacaaccccacaggcctttgatcgactgattcataaaaaagctgacgtcgtctttatggctcagccgtccacaaaacaattagcagctgccaaaagggccgacgttaagttgaagctgactcagattggcagtgaagcatttgtgtttttcgttaacaaaaagaatccggtgaacagtctttccgtcaaacagattcaatcaatctatcaacgaaagaccattttttggtcaagcgtaggtggtcgttttgaaaccattttgccgtttcaaagggcagaaaactccggcagccaaacggccatggagaagctggtcatgcgcaatcatcaattagctaaaccattgaaatatcaggaagttgacggcatgggtggcattattgatgacgtagccggatacaacaatcgtaccaacgcactcggctattcgtttcgattctatacgacaaaaatgaagcgaaataagaacataaaattattgaaggttaatgggattacgccaaatatgacgactattcgtcatggcagttatccgtttattgctaaaatttatgcgattagcagatgccatcagactaaaaatacccaacggttgattcgttgggtacaaggcagggacggccaacaattgattgatcgaaccggatatgtggggttgaggtagctctgctgaattgatccgaatacgggtgtgaagcatcatcatgatgctttctataaggtaagcaccatattataccaaatttcatcagcgtgatcggaatccgccacgccttcgtttttgtagccgtggctttcatagaaaggaatcaatttctttaaacaggtgaggctaatggcggtccgtccttgttttctagctacttttgccaattcatccagcaattgaccggcaatgccgttatgttgatatgaagggtcaaccaccaaactgagcactgtttgatagctttcacttggattgtttggtctcgccttttcataaagctcgtcggttaagtaacgttgaccaaaggaaggtcccacaatgtagccgacgacttggccttgatcattcttggcaacgataaatgtatccgggtaaagttggattcggtctttcatagcttcggtagtggcagcttcagcgtctgaaaagccggtatgttcaatccgcatgatgtcggataatgcttgtggttgggcgtgatcaaaagttattttcatcttaaaagctcctgtctaattgattgtctgttctcattttatctgataatggtagacttttctatgtgaacaattttgagagaagggattcgggtttatgaatcacaaaacagaaacattggataagcagcaaggtcctaataaacggtggatcattatgacagcggtttttatcgctacgttcatgacatcggttgaagtgaccattgtgacgacagctttgccggccatcatcagtgaattacacgggctggcttttcaaagctggattatgagtgcgtatttgctcacaacggccattacaacgccgatttatggcaaattggctgatatgatgggtcgacgaaacatttttcaatggggtgtctttgtctttaccgtggggtctttgttaagcgggttatcaccatctattttattattaattatctctcgggcgcttcaaggaattggtgcaggcgcagtcatgccactgacgtttaccattattgcggataattttagttttaaagaacgcgccacggtgttggcctttaataacacggcgtgggggttatcagcgttggttggaccgttgatcggcggctttctggttgatcagttatcttggcactgggttttctttgttaatgtaccgttgggcattgtggttatgctattcgtctggtttggctaccatgaaaaagttaagttacggaagaaattgacaattgactggttcggtatcctttggcttgcggtctgtttagtcggcttactgttagctatccaggttttggataatcagcctgtgatggcgctgggactgtttatcattgctgcggttagcctatggctgttagtcagacgggaacggcatttttcaaatccgttgttatcaccaaaaatgtttcgttcggcgacctttagcattcaaattatcaccgcaacgatattaagcggggttctgattggctatcaggtttatttcccgatttggctgcagtcgctttaccgggtttccgccacgacagcggggttggttgtcacgtctagttcggttatgtggttaattgcctccttcttcgtcggtcccttacttgccaaatacgtgccaaaacggattgcaattgtcctgattatcttgatgctattgggatatgtcgagttgatagttgcaggtcagtcgtttccggtttgggcattctatgtgattgcgatggttaacggcaccgggatgggcattgtgatcagtatgaatacgatcctcagtcaacatttggttccgccgacaatggttggttcggccacctcaattttaactttggggcggtcattgggccaaaccgtcatggctggtgtctatggcgcaattttaaatttgatgattcgactgaatctacatgacggcataaccttttcacaggttaatggtgtgatcagctcaaaccacacgcatgaggtggctaatcgggcaatggcagatccaattattttaatggcattacatgcggttttcgtttctgttgttttgattttgctgattgtgatcgtgattaattggctggatccgaataaaaagatcattaattaatatcagttgttaaatagttttaaaaattgcttagcctaagggttgtctttaggttaagccttttttatcaaattggtcttaatcaattaggttatattcaaaagagtgactcaacacatggttcgacatcagcgtccaagcttcggttagaaagtgattaattatttaatcaacggggttgctttatttgcttttttggcatacgattcatcagtattaatttttggaaaatgttggaggccactgaacatgaacaagcagctggaacgtgtctcgtttgcggggatgctggttactttaggaatcgtttatggtgatattggaacatcaccattgtatgtaatgaacgcattgattggtgatgccggaaaaatgggtaacatttccccggactatgtcattggatctatttcattgattttttggacattgatgatcattacaacgttaaagtacgtgattatcgcaatgcgggcggataataatcatgaaggcggtatttttgccctttacgcattagtacggaagaatgcaaaatggttgatttttccggcgttaattggtggagctgctattttggccgatgggacgttgactccggccgtgaccgtgacgtcagcgatcgaaggtctgaagaatcaacatctgggaccagtgacattcagcaattctcaacatgatgtgttgctgataacaactgttgtcctgcttttattatttgtgattcagcgtttcggtaccgggacaatcggtcaatcatttggtccggttatggtcttgtggtttggctttctgtcggtcttcggggtgatcaatttgttagactacccaatggtgctgaaagccttgtcgccatactacgcaattgaaattcttttcagtcctgtcaacaaagtcggtatctttattcttggtagcatttttctggccacaaccggtgccgaggccctctattccgatatgggtcacgttggtcgaaagaatatctatgcgacatggccattagtgtatgcagccttatttttaaactacttgggacagggcgcttgggtgattaatcatgccaatgatgctgcttaccggaatctgtccgatctgaatccgttttacgaaatgctgccgggtaactggcgattgtttggcattgtgattgcaacgttggctgctattattgcgtctcaagcattgattaccggatcatatacgctggttgacgaagcaatcggattaaagtttttgcccagattgatcgtgaagcatccaagtaatgttaaaaaccaaatttacatttcaaatgttaactggcttttgtgtatcgtgacgctggcagttgtctggtattttggcaattcccagaagatggaagcggcatatggtttggcgattacgatcacaatgctcatgacgaccgtactattgtatgaattcctgaaaggatcccttaggaaagggattgcactgacaatcgctttattctttggcacgattgaagccatttttctgattgccagcctggttaaattcatccatggcggctatgtcacattaacgattatgttggctattttgtacattatgtgggtatggtatttcggtaataagcgccgtgaacattacgaacgggaaagtgaatatgtctcacttttggattatcgtgatcaacttaaagaactcagcaaagatgaagacgtcccgctttttacaaccaatctggtgtacatgactaaaattaagggcgattatcagattaaacgcagtaccatgtattcgattttggatcaggaaccaaagcgggccaaagtgtattggtttgtgacggtaaacgaaaccaatgtgccgtacgaaagcaactatacggttgatatgcttggcacaaataatatcgttaatgtccaattgtatttgggctttcgtaaatctcaatcggtcagcgtctatctgcatcaaattgtggatcatttggttgatcaaggaattttagagccccaggtaccaaaatattccactcaacggaaacgtaaagtcggtgattttaagtttgttattattaatgaacaaccggcagatttggttgcgaatgatcagatcgggtcattggataaacggttgatcagtggtcgaatttatttgcaaaacatcacggcgtcaccaacatcatggtacggcctggagttcagtaatgttgtcgaggaaagttcacctttatttatcgttcaggaaaaagatcagtacctggttcaacgaaagatttatcattatgttgacgataaaacgcatcaataggaatgagtgcttaacatggctttcttttggctccttttcggtagactgattaaaattcttgaaatgattttttccgagatgggaccaaaaaaaggattagtgttagaacctgtttgaagacttaaacaggttctgatgctaatccttttttgaaacagttattttattaggagctaactattctttcattgcatccggcacaccggcaacggtcttgaagacatctgccagtgaagtgtgcatatcggcgaatttcttgttaagaatcagttgacggaattgttcaactgaaagcctttcaacgtccttgaatggtacggggctgacacccaagttaccagtggtattgatacctgtggtaagggtaatgatcaaaccggctttactgtccaaacgaacggtatagtattcgtaatatgacgtgttttcataattaccagtcagttcttcatgttttgcaaagtaatcggtaataaagtttttgaaatcttcttttgagttaagtgctgctttccaatcagttgtatttgtcatcgtagtacttcctttcatatcttatcactaggttgtcacaaattgagaattggtcaactaatatgttagacactcattccctatctcaattacaattatcattctaaacatatttaatttaattgcaagtgaaaaagcctatgaaaacgttgacaaataaggatcttttacaattatttattgtaaacgttatcttatatttgttttacagaataagtgattcaaagcttcttatatatcagttttgaggacgatccatcccatttccgttcgatattcgtatttctccgttcaagaagccgtgttgccgtacttttgtattttcttgggattgctatttatcatttatatgataaaactgatgaccaagatgataatccttttgaaaaatagtttaaaaagagactgtaattaattattcacaataattgttaattagtaggtggttatagaaaataataagcaagcatagtaataaaagtgttaattaacaaaaaacaatttaaataaaataatataaatgctatttacttatttccttgtaagcgctatattcatactaacgaaagatatattaacccttttgcgaaaaaagcaacgttatatcactgaataaagtgtatgcgttttattatataaaataattaatccattttttaaggatttctggaggaaattaaatgtcagcttatctttttgttcattttaaggaaaaaagaacgcctgatggcgaacaggtttattttggcatcagtcgtgatggttacaaatgggaaaccgtcaatgatgctcagccggtcttatggagttattacggtgataagggtgtccgagacctttcgatcaatcaaacccaagatggccgctatattattttggcaacggatctcagcctatcttacgggatgttaaaccaatatcacaattcctggactgaaatcagtgagcatgggagtaaaaaactggttatgtgggaatctaccgatctgattcactggagttcccaacaaatgattagtattgaaggcgctaatgattttggtgtcatgtgggcaccggatgttgtttacgactcacaaaataacgattacattgttaattggtcatcttcaactatgcaggacaactatggtccaaaagccatttattatagtcgaacaagtgactttaaaacattttccaaggcgcaactcctgtatcgaaaatcagacagtgaagtcattgattcagctatgtacgaagaagacggctggtactacctgttcgttaaatccggagctaatccggaaactattattcttttaagatcacagcagtcaaccgggccatttgaaagagtatcaaattttgatgacggtatgaaccggattcaacgcggtaaatatgaagcaccaacagcggttagggttgaggatcaatggttgttatttttggattattatggcacgggcgcagaggggcagggatatgttcctttcattggaaaaacgttgagtgccggaaagtttgttcgcagtgaccagtcattcagttttccttatggattcaagcatggcactattttaaagatcagtgatgctgattttgatagactaaaggcctatcataagaaaccttccgagtattaaaaaccaggatataaatagatgatctccacgcactcaatcagtgtagcccttgaacagcgattggccgggtgtggatagtccggccaatcgcctaaaattttctatgttcactccataggaataagaaaaataattgcataaaagcacctttgagagcatgagacactttcaaaggtgcttttattgcgatgataatcactgatcttcaatatcactaaaataaaaaatgcctttaatgccttgatcgtgattaccgaattttttaccgaagattgtacaaccaccaacgtttttagctgtatctttaacctcaaacctaagtgtccaagagtttttagtaggatcaatatctgttataagtgtatcggtggcgtgctggccgtcaatgaaagagccatgtttagagattctgaaggatttgagcataccgtattgattcatgtcgttatagacccattttggggtgtaacgtccgcgaatatcagaaaaatcaccgggacttgtccacgtaccaatctcatgaccatccaggctgaccgtgatgtcggaaggccagttattgtttgaaaatggaaattcagaactaagctcggccgaaagctcaatcatttcgagctgctgattgtcttttaggtagttcggaatttggtattctacaaatccctttgagaaccacaacatacctgctttgtaccgttcgggatccataaagtagctcggattgtcgactttgcctatgaaaccatcctgacctgccaaaccgcatgaaggctgaacatcataatcagtaaactgaccgatcggcaattcgatatcccaattctcataaggaatatataactgctgtgggaaagaaacgttgatggtatcaacacgtaagctggagatgcgttgattacctttcttttcagttctaataatatttgcctcttgaagtttattgagatgcataatagtgattgggctgcttaagccgattgcctttgaaatttcggaaacgttcattttcttttccgaaagtaatttaataatatgaacccgcaccttactgtccaatgcagcgaatacgggaattgatttatcagatatatcgagatccatagtgagtatccatccttaattgaataaattaacattttagctagtatgttactgctaatgagtgataaagtccatatattagtaatgtttttatatctttacaaagctaatgtcttttattagctaacaaaatagttgtggaattctgattatgacagattttttggattaaaaaattagaacttttcatttttaagtggattagcggatgataagtattgtttttgttaacaaggaaaggtgttaagatgttttttactcaaataagataatatttactaatataaagcgaaataaagtctcacttttagtaaaaatgttatttacttttgccaatgaaagcgctatatttagattgttaaaacttctaccggtgaaagttaacaaatttcattaatgtttatattatgtatgcaattatttattcaaaataggaaaggttttagatacgatgtcaattgaactattaaatcaaaaaaagggacctgaaattagtaaatatatttacggtcagttttcagaacatttaggccatggcatctacggcagtttgtatgttggaaataattccgatattcctaatgtcaatgggatgcgaagcgatgttgttgatgcattgaagcaaattcacgtgccggttcttcgatggcccggtggcttatttgcagatacgtatcactggcaagacgggattggtcctaaagacacgcggaaaaaaattgtcaataccaactggggagacgttacagaagataattcatttggaactcatgagtattttgaactattacgtcaacttggtgcggatgcttacattaacgccaatattggaagcggtaccgttcaggaaatggctgaatgggttgagtatatgacaatggccggtgaatcgccgatgtcaaagctgcgtcaaaagaatggccggcaggatccctggaaactgaaattctttggaatcggcaacgagtcatggggtggcggcggtaacatgcgccccgagtattattccgatgtttatcgtcaatatcagacattcctaccacaatatgataaggatcatccgatttataaagttgcttgtggtcctaatgaagccgactataactggacagatacggttatgaaattggccggtcaatatctggatggcattagtcttcactattatacgttgccaaccggtaagtggggctgggacaaaggtgatgctaccgattttcctgaagaccaatggcagtcaacaatggtccgtgccgaacatatggatgagctaattacgaaacactcaaccattatggatcactatgatcctgatcataaggtcgatttaatcattgatgagtgggggacttggtacgacgtcaccgaaggaaccaatccgggctttcttcaacaacaaaataccattcgggatgcgatggttgccgccattacattaaacatcttccataaacatgctgaccgggttcacatggccaacattgctcagatggttaatgtgcttcaagcaatgattctgacgaagggtgacaagatgatcaagacgccgacgtactatgtctttgatatgtatcaaaagcacatgaatgccgaattggttgaaggtgtcggcgatgttcccgaaaatgtcacctacacggcttctcaaaagaatggtcagctaacgatttcaattaccaactatgatttgactgatgagaagacggttgatttcactgcagccaatgcatacaaccaaattgaatcagcgactatcttaactgctgaagaaatggatgctcacaatacatttgagaatccggatgttgttaaagaagccaaatttgaaggtgcaacgcttgttgatggtaagttacttcttgaactccctgccaagagtgttgtcacaattacacttaaataaagtttggaataaggccaaactggcgggttggtcttggtacaaatgtcaatggttatgatcacgaaaagtcgtcacaatttaatttgtaatcctattggagggattttacatggcaaacaaaaacgataaagagaagaaagaagcaccggttgagccgacaaatgcgaaagttaaaaatgcggaacagccaaaatttccgaaactatttggtttagcaatgttactggggccgtttgtatggttggcccctgcaagcaacgttcgtaatacattactaccgcaatatttcagccaaatcgatccaagcggtaaaattgctgcaattgcgctaatggcatctgtttcatctattgtggccgctgttgcaaatattttattcggtggtttatcagatattacccgaacccgttgggggaaacgtaagccgtggattcttggtggaaccattgtcgaatccggtttgatttgtgtggttgccaacttacatgatatttgggcaatcgtggtcatttggggattcgttgctgcagctgaaaacgctgttgccgcagcaatggttgctcaagaggcagatcgaattgcgcctagatggcggggaacaatttcaacactttacggaatcggttatactgctattcaagttgtcacaatgattgccgcacaattcttgggtaatcctaaaatgggtatgtatgttatggccgcaatcgggtttgttatgggaattattcatgttttgtttgctcatgaaggtagtaatctggatgagcccagagagaagttttcatttaaatccttatggcttcatttttcactgccaactaaaggtgcccgcgattactggtacgccgttgctggcaagttaatgatggttatgggtggtacaattgcaactgcttatatgctctatattttgaccgattacatgcacttggggcaacaaagtgccggtaaaacactttcagaaatttcactgattaatttagtctttggtgttgtttttacggccatttcaggtcctgttgctgataaaatgggacgtttaaaggcgccggttgctctttcaactttgcttattggtattgctcaattcttcccgttttttgataacaagccatggacaattttgacatacgctgttttggctgccattggtaatggcgtttataacgccgttgatggtgccttgaacttggctgttttgcccaacgcagaaacttccggtaaagatatgggattcatcaaccttgccaacacattgtcacaaatctccggtacggttgttgcatcattgattgtcacatatcttggtgggtacaaagcaatcttcccggcatcatttgtgattgaattgattggtgctatcttaatctttagaattaaatcagttaaataatattgagataccaagtgtagtaaaaatacgctgtatctaatcaagacgagcgaattttagatagttgataccaaaaattttgttcgtcttgttgttataatgaacaaaaaagtaaaaaggagcgataaccttggcacgctgtaagctaacaattaaaagtgactttggtgtaccgctgaacgacttattcggcattttctttgaggatttaaatcatgctgctgatggtgggctctatgccgaaatggttcaaaaccggtcttttgagttcgaaccggtcgaccacgagggctatcatgaaacctatgcgtgggaaattaatcatcctgatcaggcggtcatttcgtcggatcaaccgttgaattcaaagaatttacattatttggcagtcaaatcaggtgcagaagacttaacggttaccaacaggggctttaatcaggggatgtttgttcaagaggatcacacgtatcttttttcgatgtttgcatcagctaaagaaaagggtatggttcaggtctttttagaaaatagtcagcaccagcaactttccccgacggcagtgattgcggttgacgtacctggatggaaaaaatatcaggtcgttattaaagcgaatcaggacagtattgaaggtcgcctagtggttaagatattacccaattcccaccttaatcttgatatgatttcactatttccgaccgatacttttcatcatcgagaaaatggtgttcggcgagatttaggggaagctttagccgccatgcatccaaagtttatgcgatttccgggtggttgcttagttcatgacgggactttggatccgaatgatcgtgaatccatgtatcgttggaaaaatacgattgggccggtcgaaaaacgaccaacccgtcggaataaatggggatataaccagacgttgggccttggttattacgaatatttccagttggccgaagatttgggagcaaaaccacttcctgttttgcccggtggtcacgatccccatcataagcgggcagtacccatcgatcaattacagccttggatcgatgatgccttagatttaatcgagtttgcgaacggagatacggataccaaatggggcaaaaaacgggccgagttaggtcacccgaagccatttggactggagtatctggcaattggaaatgaagaagtgggtcaggctttctttgatcggtatccttatttccataaagccattcgggaacgctatccgaatattaaattgattaatacgagtggtccatttgcttccggtagtgaattcgaccgcggttggaagagtgccaaagaaaatggatctgattttgttgacgagcattactacatgtcaacagactggttcttagccaatcaacaccgctatgaccattatgatccaaaagggcccaaagcatttctgggcgagtacgcttctaaagaaaataaatggtataacgccgtggtagaagccagttatatgaccggtttggaacgcaatgccgataaagtcgggttggcttgttatgctcctttgcttgccaacgttgattatattgattgggatccggtgttgattttcttgaatcagcatcagatcgccccgactgtgaattattatgtccaacaactatttatgacatatcagggaacccataacgttcagtattcaattgacgggctttccgatccagtagttaaagacgatcagccaattacggggcaattcgggtttgaaggtgatttggcagaggttacctataacaatgtgacctttacagatcgtaagtccggcaaccaacaagactttaatggtggtcagttgttggagagaaagcgacagttaattggtcaaactgatagtgatgattacacattgagctttgacgctaccaaaacgggtggccgacctgataaaggctttcatcttattttcggtcaagcgtccgatccggattactttatgtgggttctcggtggttgggagaaccaggattcaattattaagcaacgaggtgcccatggtatggagagtgattgggaccagtgtcaatggacgatggaaagtgatcatcaatatcattttgatattcatgttcatgatcgacagattacgacgtctattgatggtcatcaatttaatgagattgaaatcatgccaaccgtcattcaaccactatatagtaatatgacctttgatgaaaagataaagtcatactatctcaaattggtcaatgtgacagacaaaccggtaacaattctgttaaaagacacacattttcaaaacggccagtatcgtgaactgtcagccgatccagaaactgaaaataaaattggtgaatcaaataatcttaaaatcaataaaaccacggtagatggatcgtcaattcgggttcaaccatactctgtcaatgtgttaatcagtaaatgatggttaaggaaaggaagaaaaataatgagagagacgattcctctaaaagatgtccgaatatccgaccctgagattcttaacgctcagcgcaacgccgttcattatttattaacattggatccaagcagattcctatatggatttaatcaagtatcgggtttgaagccggttgcagcaaagccttatggcggttgggagcgcttggaaggtcctaactttcgtggtcatttctttggacactatctttcggcgttgtcacaagcaatcgattcagtgagcgatgatgataccaggagtcaattgctgagtaagctaagaattgggatcgaaggcctttttcgagcacagcaggcctatgctaaaagccatcctcaaagtgccggctatgtgtctgctttcagggaggtcgcgttagacgaggttgaaggcaaacgggtacccgaatccgaaaaggaaaacgtgattgtaccctggtataatctccataaaattttggctgggttaattgacggatatgaacacctgaaaaaaattgatccacaattatccaagttgtcactgcaagttgccgaacactttggatcctacgtgtatcaaagagtaagtcgattagacgatcccaagtatatgctgaaggtcgagtatggcggtatgaatgatgcattgtaccacttattttcaattaccaaagacgaacgacatttaacggcggccacttattttgacgaggtggaactgtttaaagacttggcagctgccaaagatgtactccctggaaagcatgcgaatacgaccattccaaagcttttgggggccattcgccgctatgaaatttttgatgatcctcagatggctggccaatatctgtatgaaaaggatcaaaaacaattgccgatatatttaaaggctgccgaaaatttctggcggattgtcattaatcaccatacctatgccactggtggtaacagtcaaagtgaacattttcatgatcccaatcagttatatcacgatgccgtgattgaagacggcgcgacaacttgtgaaacctgcaatacccataatatgttgaaactgagtcgggaattgttcagggttaccggtgataagaaatatcttgattactatgaccgtacgtatagcaacgccattttgggttcccaaaatcctaaaaccgggatgatgacttattttcaaccaatggcggctggctatcggaaagtatttaatcgaccttatgatgagttttggtgctgtaccggtaccggaattgagagttttaccaaacttggcgacagctattacttcaaagaagggcaaacgctttatgccaccggttacttttcaaatcaattaagcttaccgaaagaaaatttaaaactggatatgcaggttgatcgaaaggtgggcgctgttaaattaacggtttccaagttgattgataacaaaacatcagagccgcttaacgttaaattccgccatcctgattggagccatggcagattatccgttaagaaaaatcaaaagacacaacctaataatgaaacgtttggttttgttgaggttaagaaattagtccctggtgatgtcattgaaatcaacttatcgatgacactaacggttggttcaacaccagataatcaacaatatatttctttgaaatacgggccgtatgttttagcgggtaaactggatcggtatcaaatggattcagacaggcccaacggcatcttggtacgaatatcgacgttaaatcaaacagcgaccagcaccttgactgctcacatggattggccgagctggcagaaaaaagcacatgcagactatcagttacaaaccgaaaatgagcgatatttggtcaaagttggacttccgggagttgatgagaagattgaatttgtgccatattatcaggtttatgatcagcgttatggtgtctattttcagtggcagcaggcaggtagtttggcagccaagcaacgacaagaaaaactggctgctattgaggcctaccaaaaccgcattgttgatcaattgactaactttgatcaaaataactgggaatttaataagcatcttcaggccaaaaactccgaagtcggcaatgcatatggcaggcgtttcagacaagccggcgtcacaggctactttagctacaggtttgatatcaaaaaggctcaacctaaaatgcatatgattttaatatttaacaaaagtgatgatggtaaattattggcaacacatatcggaaacgatccggacaaccagttccaaagtcaaattgtcgttgattcttcaaacgccaaatcagttgataaagatggcttctttgagttggaaatcgaattaccaaaggatatttacctagatcaaccgtccttaaaaatttgtttctccgggttacaagatacaagtgccaggttatttggtattcaatttttgaatgcgtagttgagagtgaatgattgttaacatattactagaaagaagcgattaataatgacagaagttaatgcaaccgaatggcgaaatgcaattaaatcagaaaaagcttttgaggattatatcagaaaatactttgaagcaaaccaagagctggttggaaattacgaaacaccaagctattatgagtactatactgtgacgctgaatagtaaagaggggttggtagtaactttgaaaaccggattgaatcagcaagccaacgcggcagcattaccatttaaagatattgaacatctttctatcgaagagttccgtcagcttattttaaataaaaaatttgaggataagacggaaacgttaacggacgtttttgcaaatattatggcgactgatccgactgcccgattcaataaaaaaggtcgaaagtaatcaggaaaaacgtactaaataaaaccagttggaaactgacaagatcagatttcaactggttttatttagtatttattttgatcgattagtccgttggtattttgaagatcaaagaggtcagttcatgatcggcttttgctgttggaccagcgtaaggaccggcgctcacaatcagtacctgactgttaccaagaggtgttaatgatcgtgaataggcacctgccattggcgtttgaaccgttgcccactttccatcaccgtttttatcgttcacataaagttcattaccggtactgttggcaacgacgcgaccatcgctcaacacagtgacatatggcgaaccaccattggcgaattcagttccaggatcggtaggttgccagtccaatccattttgggaaattttaaagtttgagcgattacgttcgccgttgaccacaatggcaccttcagcgaccatttcaaacgtcataatatagttgccatttgccattcgggcgaccgttgccatgccagggcgggcttcagggttggaaacagcgacatcgtcgatttctgcaccccagtgacgaccatctcgagataatttatgagacaatttttgactatgggcctttttgtcccgttcatcagagaaaaaacagactaattgatgattaatcacaattaggaatggttcccaaacaggcttctggtcttttaccgaagctgttccaccttgaacaacggtactaagatattgccaactttgaccgtgatcgacacttttataaagatcgattttggtcgcactcatatctttggggatggaattgcctgcgcatattaacgtgcccatcggtaaatttccgattttttcaggcagttcatacaaaaatggttgataacgcattccccagccattgacctggtcggaaacatcactaatatgttgccaggattggccatggtcgatactttcaaaaattggaaaattagggacaccgttaacataatgttcgcaggttgcatagagtcggccattatgctgttcatcggaatgggtagttaaaaggcccttaccgtaaagaaaatttggttgtcgagtatcggaaaatatggacttggttgcaattgtgatcatttttatacctccatctataccaagttgattaatgtcttcaagcgtttactttaaaataccaaccagttttttactccctgatacatatgaaccgttggataattgaaaaactgttttgctgccccgtctcaggaaccgcctgattttcaacacggcttttttcttatggtgggcttccttctttgttaagttttttgaataaaaactgttgacaccatcagaattgataacgattagtttgggtctgaaacgttgccagtatagattggtaacgtactttggattagcagttatataatagcctgttgataatttgtattttaatacaccgttcactgattttgccgttgcgacaactttgaaagtaggtccgaagactcgggaggaaacgtgatatttctttatgcggttagatttgtggaatgtcgccgagttgtagagataggcactttttttgagataaagccaaaatggtttaatgtcatggatccttgtctcggacggtgctgcagaaggactagtcgtttttattgaagaccttgatgaggatgagggcgtaacaaccggcattgatgatgaaacggaagcggatggtgttaaggttgcctctgtttgctgactgggagttgaggggattgatgtcgaaacatccgatccatagacggttagctcattgaagccggctgcccagttctgcaatgaatcatctgaagccttataagtccccaacacctttaggcgaatatatcggtaatcgtttgaagaagatatcacattttcgttgaagccaatgatccgattttgaatattatctttaacggttgtaaagcttttaccatcattactgccttgaatcaagtattttgagtatgtctccgaaccgccaatatatttaaatgagatgtcaacttcattaatgtgataggatttccccaaatcaaccgtccaattatactgaccatcggaagtctgtggttgataggcgttagtcgaatccgcgacgattccgtcattggctttttgagggccacggtcctttacggcggaggtatcacctgcgacctggccagctggtttgttcaccgacaaaatttcgccattttgaaccggtacaattttgtctttaccgacatcgtatttaactgttgggtaataatcgaaggcagcaaaaccgttatccatatcgactaagaacatccgggatgcgttcttattatcaatggcaggatcaggatatttccatccggctgaccagcgattggccatcgtaaagtaaggtgagtttggttggtcactgagctgaccgacaccgccggattgtgcgccgtagccggaagtattaccaatcggctgcaattttgaggttgccaaattggtaatgctggttgcggaattgtaaccaccttcactggggtaccaaccgtttgcttttgaagtaaacaagtagtaccagttatcttttttaatcatcgatggtgcttcacgacctaatcccttatttgcaataatcgggttaaattgaggatcgatacccgtccaatccgaatttagtttgtaaatgtttgtattttgatttgcatgaccggatttactacttgctgcagaaatgaggtaagcatcttttccgtttggatcagcaaaaaaagacaggtctcgtgattgatattcagttccatcaggagttttcggtcggaaactgccgtgattgatgaagggctgtccgggctttcctgaaatgcagatcatacgaccgagtgagtagtcagttgcattttcataatgtccccaaacaataatgacaccattatgcatttcaatgctgactgattcaattttacatgcgcctaattcactatcattttttatcgtaacaggtttgaagtctgtaaaatgggtgccgtcgtttgaagaagcctcttccaatagcgccttatggctttcgaccgttagtttgtagcgataataaacgtcattgactttaaaagctgcgttttttccatgaaactgtgagattccggtgttgctataagaatctgacagcgtgatatcttgttgaatactttctttaatgatgtttgattgaccaatttgctggttattgttgttgaatgctcgaatcctgtaaaaaacagctccttcattaacatgattatcatcgctggtggttgccgttgtcgtctgaatttgattaaagtcggttccattgacggacttatcgataacgtaatgatcggcgcccggctcaacttgccaatggagtttgacattgtttgccaattgggttgtcgagttgataaatatgtttccggttaaagcaaaactgttctcaccactggcggataccttaggtgctgtaataaacgtgattgctaacagtaaaatccccagtgctgttagtatgattcgattgattgcttgtttctgtgtgtgcattgtcatcatcctctctatggatcagtaaaatgattgcaattttagtaaaatacacaactatcacaaataaaataatagtctattatttgttaatttgcaaacgctttctaaaaacgggtatgaaatgtgttacttacttttaagaaaacgcttgcactctcgtatagcgacgtagtatagtcaagtaagcgttttagtataacctaatttgttgcttttggtgcgtagtaggtaatacaagtactaatgatcgaaagtagggattagttgccaacacgcgactatcacttgtatctgaggaaaataggggcaatattttaagtagtttggaaggagtttttctaatgtttggtaaaattaaaatggggtacaaaatagggttaacattgtttgctttaacgatcggtaccttgatctgcagtatcccaatggtgtcagctgctgaaagttccccagtgacacaggtgaccgcatcaaattcgaataaaacggttattgataaatcaaagttagttcaggctgttgctgacgctcaaacctacaaatcttcaattgggaatgatgctcaaatcagccaggacagatataatcgggcattaaatatggcaacggcactagaaaagcagccctcagccacccaggatcaaattgattccgccacaacattgctgaattctgccattagtgaaaacagtttatttcctaaacaggagaatcctaaccgttatacatctgtgccggttgggcaaaaatggttggatacgcagggtgctccgattcaggctcatggtggtggctttttaaagcagacccaggcaaatggtcggccaatttattactgggttggtgaagataaaagtcaaaataatagccgttttaacggtattacattgtactcttcaaccgatttggtgaattggacctatcggaaaaccatattggccccaagcttaaccgataaagggttggaaaacgcgacaatcgaacggccaaaaattctttataacgcaaaaacaaaagaatacgttgtatgggcacattgggaaagtgccggtggttacagctcgagccaaatctgtgtggcaaccagtaaaacaattgacggggattatcaattcctgggacactggcgtccaggagcaaatgccaccaatcgtaattggcgggtcactgaccagtcggccacgtttgataagacgggtcaaccgattagtgattacagtgatgaaagtacgtgggggactggttcgcgggacttcacgctgtttcaagacggcgataaagcttatattgtctcaactcaagacggttcgaatatgcgtatttatgagttgaatgctgattttacagatgtcgataaaaacgcgatgaaatcgtatctggtctttccgggagcaagaagagaagctccggcactggtgaaagacggccaatactattttatgattaactcgtctcaatccggatggtatccaaaccaggcccgttattcgtacactaagaatttgagtgatgaaaatggttgggaatcttcaacaacgccaagtggtgcaaaagtgccggcaggacttctcggtaataattcgacctactatagccaaccaacggggattatggcggtcaacgggactaagcaaactagttatatttacatgggtgatcgatggaacccggataagttgggcgaatcgacttatgtttggttgcccttaaccattaaagatcccagttctgacaatccgtcgatgtcgatggcttatacgcccggttggcaacttgataatgccaccggtgaaattacaacaggcaatgatcagttgctgtcccaagggaaaccggcaacaacggatgcagcaggtagtgtcgcgactggtgattttgggctgaaccaggctaataacggcgatgcaatgaatttgaatacatctgggggcaattcaacctatttcaaaccaattggtaaagatggccaaccacaagtgccatttacctatacagtggatttgcaaaagtcctataatctttctcacgcagatgttagtttcaatttatacaacggttcagagtcatttagtcaatatacaattgaaaccagtctggatggcaggacatggcaaaaagctgccgatgagtccgcaaatacgatggtcggttttgttagcgataaactatcaggtcgggcacgttatgtcagactcaacgtttccaaggttttaaaggttggaaaatcccctcaaaatgcggcctggacggctggacttgttgagttccaggtttacggcacaccaattgagacgggcggcaccacaacaccggcaccttccaccccacccgctaccgaaacgggtgcgagttcttcctcaagcaatatcggcgcaagcagcagttctgtgtcgtcaacgagtagttcggctgcgtcttccagcacggacagtggcagtacgaccgttaccactaagaaaaagagaacaaagtatccattcaagatatatgctaaaaagtcgatttacttgtatcggcacacggattttaccaaaaagaatcagctaactcattatcagaaaaagagtcggatcaatgcggacacgttcacagttgtcggtacagcccggtccagaaatcatgcattgaggtataaggtacgtgatacaaacaataagagcaggcttttcgggaaagtcgggtatgtaacggcccgtccaagctatgtggcacgactttattatcagaccttgccgaaatcaaaaacgattacggttattgcaaaaaaaggtgtagatgtttataggtcaaccaagcaatctaatcgaataaatcattataaacgcggtacaattttaaagattaagaaaataattaagaacaacaaggtgaccaactatcagttaagaaacggaaattacgtcactggcaataaaaaaattgtgattcaaggaaaatattaatttatttttctaatgattaaagcgagtcattcacgagagacaagtattttgtttttacgatggctcgttttatgcttcatttaaaagctaatgaaaatttcaaaagtttcacttgacttcgagtatacttgaacatctattgttagaggtatgggaaaacagcagaagttatgttcacagtactgtagtagaaggtcagtttaagccatttgtatgtaataattaaagatgcaaaaaaactgttttaaggaggaaatacaattatggaattccgaaaatttggtaaaacaggtttttcaatcagtgacgtttcattaggaacttggcagcttggcggtaaatggggaacaccttttgatgcaaaggatgcctatgatacgctttcagaagcttatgatcacggtgttaacttttttgataccgcagacgggtatcaggatggtaaaagcgaaaaaacggtcggtaagttcattaacagtcaccccgatgttcatttcaccactaagattggccgtaaagaagaaccgttgagtgttgaacatttcgatgcagcacatttaacacgctatgttgatgaatcacttaaaaatatgaatcttgaaaccttggactgtgtgttattacattgtccgccgatgagtgtttattatatgccggaaactttctttacgatggaccaattgaaaaaagaaggcaagattaagcactacggcgtcagcgtcgagcgtgttgaagaagcaattaaagcgatgtcttatgatatttcggcagtcgaaatcatttttaatatgttcagattgcgaccggccgacctgttctttgatttagctaagaaaaataacattggcgttttggctcgggtaccgttggcaagcggtttgttatccggtaagtacacagccaacacaaaatttgcccctgaggaccaccgtacaaacaatcggaacggccaacacttcagtaagggggaaaccttctcgggggttgactacctgactggtgtgaaagccgctgacgaattgaaagagcgactcggaacagataacctggccgcaatggctcttcgatttatcttaatgtatgatgctgtttcggccgttatccccggtgcaagtaatcctaatcaaattgaacgcaatacaactgcagctgaattgccggctttaagtgatgatcagatggcaattgtgcgtgacgtttacgacaaatacattaaagatccggttcaatatctgtggtaaaaatgatctgacaggcatttagcggttttgctatgaagtcgactgttttagggattgtggctaacttgtttatttccacgtattggtcaacaaccttttcatccaagtaaattaaaagggcgcttattgagacgactattatgtctctgataagtgccctttcgttatgaatttaaatgattgttactataatagtactggcctatgcatcatcactaacaaccaatacctgaacagttgcgtttctaacaacgtaagcagttgttgaaccaataatgaatctgtcaatagcaccccgacctgatttaccgataacgattaaatcaatgttgttttgctttggcacatcggttgcaatgactgattttggatatccttgagtgacgattgtctcggcatccaaaccattttctttaacggttttcagcccgtcgtcaacaatgtcgtgagcataactggttaattcagaatagctgctgtttggcgcagcggctgcagttgccggcattgcaaaattacgattatcaacaattgatagtaatgatagtttggatgagaaggtttttgccaatttaatggcgacatctaatgcttttcgagaattttcactaccatcaagtggtactaaaatgtgctcatacattaaaatcactccttttaaatgactattaaccgcttacatctttagtttaaagcattgtctgatcgacatcaaatttaagtctctttttgttatgaaaattgatcatttggtgtctttattaagactatatcttgatatcagtcaaaaaatcagctatttatttaaaatgcattttactaaattttttaaagcatgtatccttaatcataaagaagtgtcgataataaatacgagaaggatggatgattaatggcaatagattacgtttcgatgattcgctcattagttggtcacacaccgattataatgaatacggctgccggtatcctgctaaatggcgaaggccaggttttattgaacctgcgaaccgatacccataactggagtttaccgggtggttatttagagtacggtgaaacctatgcacaggcctgtgttcgtgaatacaaagaggatagtggcattgacgtggacattatccgttttttaaaaatatttgacaagggcgaagtgcgatacccgaatggtgacgtcactcaaacaatttcggcactttatcacgtaaagcagattggtggacagcccttacaatcggaaacggacgaaacggtcaaactggcctatttcgattttgacaagctgccacctttattaaaccagcaaacggcagatatgttagactatgcttcaaaaaatattgatcattaatgggggatttaacatgagtaaaaaggttgtagtaccaaaatcgttatctgaagacggaaaaaaatttttaacggatcggggaattgacatcatagaagttgatggcaactttaccgatggccttttggagcatggtcgggatgctgatgggatgattatttttctggatcacgttggagaggctgtattgtcgcagatgcccaacctaaaaatcattgcccgacatggtgttggctatgacagtatagacttggatgcaagtgcccaacatggtgtctgggtgaccaatacaccaaatgcaaatgcggcaacggttgcagaaaccacgttggctgaaatatttgatttatccaaaaatgtgaccaaagcttcttctgaaatgcgaaagggcaattatacgtacgcattggcacatcggggcttcgatttggcgggcaaaacgttgggaatcattggatacggccacattggccagcaagttgccaaaaaagccagcgccttggacatgccgattctcatttataaccgatcgaaaaaagaatctccttatgggaaatttgtcgatttggacacgttgttgaaaacagctgatattgtgacgctacatttggcttcaaatccggctacccatcacattattggaaaggatcaacttgccgaaatgaaacggtcaagtgtcctgatcaatttgggacgtggtgggttgattgatacaagtgccttaatcaatgccttaaagactcaccaaattgccggagcggccttggatgtttttgaagaagagccgttaccattagatagtgacttatttcaatttgacaatgtacttttaacacctcacatcggttcaagtacggttgaaagcttttcgcggatggccgttgacgcggcaagtgaagtggttcgggtactgaatggggagaaaccccagtggccggtgaatgagccgaaaaaataaacagttgatatttcatttagttggtaagaaaacaggttgtcctttgcagagtttctctctgtgaaggataacctgtttttgttaatgatgagttataaaaggctaatcaactgattttaaagcgcccagcatgtctactcgttggattttgtaagccatgattgccattacaatcattgagaaaagcaaggtcatgacaccggaagttgtaaaattagtccataaaagggtcatgtctgccattgcggtctcgggaggtaatgtttgcataatgtagttatgcagccacgatcctcccacaaagccggacagaacacctgccaaactaagaataaaagtttctcggtagacgtacatgacaacttccatagggtagaagccaagcactttaatagtcgaaagttctcgaatccgttcggaaacgttgatattggtcagcgtaaacaataccacgaacgctaatagtgaagcagccccgataatgattaggaccaagtggtttaatcctgccaaaatatgattaattgtcgctttggcatcgtccgattgaacagcagtgacggaagcatccagtcgggttaattgacgtgagacccgatcaatattcttggatgatcggtcttttaacatgagcatttttgcattataagttgcccgtttatcaaacgccttatgataataatttgcgttcatataaagcgaatgaccagcatacatctcagttattccggcaattttgacctgatgtttttcgccgttggtttcctttatggtcagtttatcgccaacttttaaatgggacagggttgccattttacgagtgatgatagcgcccttatcagatagtttgagtgtgtttccggtatcggggttctttaaggtcacaaatttatcaaagttatgagcagattttggcacaatcattgaaatgttttgattattaatcattccctttggtcttgaagtcacggactcataataaaccgttgtctcgtgtttaaccccggatagattatttgcagcctttttgtaatcattttgttttgtttgggaagcgtgagaattaaagatgccaataacatcgtaatgaataatattctgatactgggtattgacaatgccatttaaagaatcccggatgccaaaacctgttatcagaagtgcggtacatcctaatacacccaaaattgtcataagcatgcgccctttataacgagcaagattccgaacggttactttgtagttgaatgataaatgccgccagataaatgggacatgctccaacaaaactttcgaaccggattttggcggtttgggtaacatcagtgttgccggttgatcctttaacattttagaagtgacccaaactgcaggcgtgatcgtacagattaatgaaatgagaatggaaataccaatccaaaagccggatggtggcgtttgaaagttgggtataacgaaatttgctgcatacgcgtcgaaaatctttcttggaagtaagcccgtccccaaccaagcacctatgatcgatcctagaagaccggctaatgtgccataaatcaagaagactttcatcgtatcgaattttgtataacccaaagcccgctgtgtgccgatttcttggcgcttttcttccgccattctagacattgtggttaaactaacaaaaatagccacggcaaagaatataatggggaaggtgtttgaaagcacgtcgattcgtttggcattttcaccaaattgattatatccggcattatagtcgttccgactttgaatctgatagataatagccggaaaacgattaattgcttgacgctgatcaatcattatttgacgagcacggttgattttgttttgactaattgcaagttgtttgtaactggctttaagttgtgcggtttgggtagccaactggttttgttgagcagataattgaccaacaggaatccggcccgtcgattgggcacgactcagttgatccttcgacgactttaatcgttttgaggctgccgataattgctttttactttgattaagctttgtttgctgagtggccaactctttttttttattttcaattttctttaatgccgaagatcttagctgatttctgcgaccctttgcacgattgtttaatcggctttcggcattatccacattagactgaacttgtttctcatacttatctgtgtagctttttccatgaacattattgtaactgagtcgtgcaatcgttggttgggtgcttgtaaagacatccttgacaacgacaccaaaagtggatagttgaccggttccggctgaagtggcacccaggttttccttcattaaataatcactggaagtcacaaagccaacaattttataggaagcatttttcagtcctgaaatacgtgattggttatgattatttaccaaacgcaatgtttcaccgatcttgtaacgggatctttcattgctgcttagagcgatttcgttctttgtttttggtaatcggccagaaattgtttgattaattgaaaggttatcggttttggaatttaaccgaatgctatcattggttcctttgataatagcgtctttggaggtgccgaattctatttttttgacgtgcggtaattgacgcatatatgcttgatctgctttggtaatgccggtattactgttaatcactgcatctgccattttatgggcagtatagtagtcatttccggtggtacgcatgtccgggccggttacctttaggccgataagcacaaaaacgccaagccccagcagtgtcgctattgaaatgaagcgggcaaatgaaaagcgaaactcgcgaaaaatattttttcttaaaattgatttcattttggctcacctaccattcgatttgctgaatcggtgtcggtttgggatttagaacgtcttgtttgactttgccatcaccaatttcaatgacatggtcggccattggtttaatcatgccgttgtgggtgacaataatgacgtttttcccggaacggcggctgaaattttgaagtaatgttaagatactttttcctgttttgtaatccaaagccccggttggttcatcgcacaaaagcagttcgggattttttgcaatggcacgtgcaattgcgacacgctgttgctcaccacccgataattgggcagggaaattggccattctttggtttaacccgacttctgccatcacgtcctgaacattaagtgagtgaggtgatatttgagccgccagttcaacgttttccgctgcggttaggtttggaatcagattataaaattgaaaaacaaacccaatggatttacgacgatacgttgtcatttgccgactggagtatttggaaatatctttgctattaatgattacctggcctttcgtgggagaatccattcctcctaaaatatttagcagggtggatttcccggcaccggaagcaccaacgataacggtcaattctcccttttgaattgtaaaattgacatcatcgttagcccgaacttctcgttcaccgctgccatatatttttgattcatgaataatgtcgatatatgccatcatattctctcctttttaaccaacaggttgttgtttacgattactataatcggtcaatcaagattaagcaaccatcaaaaatgcaataagtgttggttaaaaacaatcaagtagatataatatgatcacaaaatttgcggttaattagcgggtattgttggcaccggcaatgtttgaatgagagttttgtgaatagaaatcgatcatcatcattattgatttaaaacgacaatacgttgatttcaagtatataatcgtgtatgcttaaatcagttaattgaaagggtgggataggtgatggccgttcatcagaaagttattcagacagaaagaaagattcgttcagctttcatttacttggctgagaccaaaggtgtcgatagaatgacggttagtgatattacgaaatatgcgaagattaatcgcagtactttttatgctcattatcaagacaaatttgcgatgatcgatcattttgaaaatcaaattttaactgatattcaaaatctcatgaaaaacaatttaacagacacaatgacctatcaggacctatcgtccggcaaaccacaaacctacccagttgttgataagatcattcaatatattgatcgtgagtttaacctgattcgggttttgctgggacctaagggggatggtcggctggaagaaagggtcaagcaagtgttaacggaaattatcgatgccgatctttttcgacttaaaggtgaaatgggcatgacaaagcagattccagcgaactttgctcacgaaattatcgtatcaggattgatgagtattattaaagtttggctggctgaaggaaatccggagagcccgaaggaaatctccgaaatcattatgaaaacgagatatatgagcccctttgacatcttgggagttgaagagtaaatgtcatttttggggattgacattttttgcatttatttaacagagtggcagtcaattttaacggtgtggcttaatggccattcttttcaggaaggtgagtgattccattattttgcgaagcattaactaattggggtattaagcactataatgatcttggaggtgcaggttatgacaacaatctatgtcaatccagataaaaagcaagatcaaattgtgaaattgtccgatggtagttatggtgtgatgaaagcaaagaaagaaagggctgggattgcctatcagtttaattttaccagtcatcaacatcccggatttgtgatcagccacgcaccggttaatggggatgttgaaaatgttgattcaattgatggtaagcagacctttaagattgcttggcgttcgtgagtttatttattaggtcataatgacattatgtatgaataaataagcttataaacaacgattataagatatcattttgattattgacgtaccaaaggagttggggacgatgaacccagctctttttttgctcaattaaatttagaagaatttgacaaatgcacaagcgttcacggccaaactaaaacactttcggaatataatatagacgtagcctcatgaaaggggaagagtcatatgaaagcagcatatattaaggaaaccggtagtagtaaaaatattattatcggagatttaccggaaccggaaatcggtgctgatgatgtcctggttaaagtttcggccgtttcggttaatcacgtggatacgtttgtaagagccggttcatatcaaacaaacttgaattttccgtttgttattggccgggatgcggttggtgaagttgaaaaagtcggcgctaacgttgaccgctttgctattggtagccaggtttggaccaatagcatgggatatgatggtcgacagggcacaacaagtcgttatgtagctgtcccagctgatcgcttatttcatattccatcaggtgtagatccaattaagttggtagcctcggtgcattcatccgcaactgctgctatcttgattaatcacgtttttcaggctaagagtggtgacacgattttagtagaaggtgcagctggacacgtgggaacaaaattggttcaacttgcgcataccatgggattgagggttattacgacctctaatgaagctgactttgataagatggatcgttttggcagcgatttggcattggattacaagaagtctttaaccaagcaactggaaaagcatgccattgacggtgtggattttgttgtggatacttcaggaaaagttgccctacaggaaaatattaacgcccttaatgagcggggaacaattggattaattacagcgccagaggataataagtttacgtttaatgtgcgaaagttctatacaaccgataaagcgattcgcggatttgtcttaagccatgcaacaattgatcaattcactgatgctgcaaagctgctcagtcaacgaatggttgacggcttcttactggatgatgacattgttgaaaagccgatagaagatgcagcacaagcacagcatgcgttggagacaaatgcggttaaagacagacttgttttgaaattctaaatattcctaaacaaattgtttaagataatgataccggtacgctataatgaaattggaaacagtaaccgattacattataggaggccttattatgggaaaattagataataaagtggcaatcattacaggtgcatctcaaggaatgggtgccagccatgcaaagctgtttgctaaagaaggcgccaaagttgttatcaccgatattaatgaagaaaaaggaaaccagttggctaaagaacttggcaatggttcgatcttcattaaacaggatgtctccagtgaagatgattggaaaaatgtcattaagacaacattggacacatttggtaaattggatattctggttaacaatgccggtatcagctttaataaatcacttgaagatatcacaaccgatgattatatgaagatattcaagatcaatcaattatccgtctttttgggcaccaagtatgcggccgaagccatgaagaagaacggttccggcagtatcgtcaacatttcctcaatgaacggtttggttggcggtgcagttggttataccgacaccaagttcgctgtccgtggctttacaaaagctgccgcacttcaattggcccacagtgggattcgagtaaattccgttcacccaggtgttatttcaaccccaatgattcaccaaggggatagtgaagcggttattaaggaattcgccaaggctattccactacaaagagttgctgaaccggaagaagtttccaagatggttttattcttggcatctgatgattccagttactcaaccggatcagagtttgtgattgatggtggattgacggcacaataaattttaagtcattatagtttgagaaaaggaaaaagcctatctttttcaatgtgaaaagataggctttttgtgtacgctgatcaatttacaaacaagttgttttaacaaaaagcaattaagtcgattaaagtggttttgtgctactttatctgacttaattgttttttagcttaatcgcattctaaaaatgaccttcaaggttggtgccgaatgcttaaattgttgaattggtccgcgttttttaatcgagttatcttcttcacgaagttcactttctctaattgccaaaagcattttagcttcaccgtcgccgttatctgcccgccgttctaattcttcttttgcgtaatgggcaaccattgcttcggaaaagcaatgggggtgaagtctctgaaacaaatcgtagttactgttatcctccaacataatctccttgatcccccgtattatttgaaatgactcaaagaaaagagtatgccatttttgagaagatgtcaatggaagatcggtgctcaggttggtttggtggtagttaaaatcgcgaatttaaatttattttttcagaaaatttcttgacaatgtcatcagaagtttgcataatattaaacagtaatgattacgatttgacaaaatggaggcaaacaaccatggaaaagcaagacttggcaagtgcacgtcgacggatgaaaagtccaaacattaaaactcgaaagcgggcgttgagaattattcatgagtataagcggcatcaaaaggggatcagataaagacaggcctaaaataggggcgtcgtcggtgaaaggagagcttgatttttgatggaccgtggctatttggatgaacaagaattgacggatttaacttatggcaaagtttttataggcaataatggtgtgttggcaagaatgccggatgatcctgtagatgatgaccgattgtatttgcatcataatggtgcgaattttacattgtaccaagcatcaaaaagtgacattagaattctcattaatacgattgatggtgtcacaacagcaatatcaaattatccgattaaggaaaaccaatatggttgtctctatgttgatcatccttctattcaaaataatttaacagtaaggcaagctcaggatttatttattcaataaaatccttttaacagaaaatgcgtctcaactaccggacaattgtctaatagttgagacgcatttttcatattcattgatccattaagccaaattcttattataaacgtaattcatcaatgaacgtgtttcagtaaactcattttcatcgtgaaggacaaccgtgataatccggtcatgtccggatttacggccggtaccaacgaagcagtaacctgcgggatctgtataaccggtcttcaagccatcaacattcaatgatttttgatagtattttcgaccaggcaacaaattattataattataaagcttctgaccgtccaatgacattgaaccaattgaggcatctttcaagacgtcgttatagtctgtgatcaagtgacgggcgatttgagcaacatccgctgctgaaaccatgttggcgtttgcaccaccgatgctgtatccgaatggtttcaaactattttgttccattccggatgccgagacaaatgaggtgttggatagattccaacttttagcttgagcattcatcatggaaataaacttcttattgtaggtaggtgttgaaccgccggcaacccattgtccaagcgcaattgcggcgttatttgaagactcaatcaatgcggcaagatagagatcgcgaaccgtatatgaattcttagtgaatttaaagccgccgaatgtgctgtctttacctaatttcttaagtccggcattgctggtattgacctttgaggtccacgtaccgccaccgttactgatcttttgttgaaccaggtaaagggtcattaatttagaaacagatgcaattgggcgaggggtattggcgttttttgaccaaaccacaccattcgtgttcacatccaaggcaacagcgcctttagcgtatttcaatccaaatggtgctttaccgggtgtgacataattatgccatacgtagccggacacagacccggaaccgttcttaacttgatagtaaagcgcagttgagccaccactcttttttatagatgcttttttggtggcgtaccaagtggtataaggataaccctttaacgtggccacctgcttggtgtgtgacgcattccaaatggcacctgcagaagatttcttatgataaggtgcctttgtcattgaagtagttgatacaaccttgtatgtaggcgtagcagcttctacttgtgttgattgagactgaagtcccaacccaattccaaaagtaagtgctgttgcacacgagatcatcacagtgcgcaaccatttattgattttcattatatattctcctcccagcttctgattcaaattgtaccatgctgtgaggaatctgctcaatgttttaatagatttgtaaccgatttgtaggccgcgtgttaattaattctacggatcttaatggttgacatctttcttcagctggtcacacttgtttttttaagcagaaaattgagataagattatatttcttgagatgatcataaagttgtgtatggacaagttgggggagtcggtttataatgcaaaaagtaaccattactattaacactcgacgatttattctatctaaaatgatcagccttatttttaaacaagtggtcaatcgcatctttcatctgctttcatggaggattgttctttctgtacggtacacgggctgagtggcaggtttaataagtttgtcgggtgttttttatttttgctcagtaataatcgtgattgcactaaaaggagatggataaagtctcgtctcagcttttaatgtagcgaaaaagatccagttagaagttgatttttgtcaatttctaactggatcccgctttagattattttggctgataagatttgataatcggaattcattatttagcacttgcagccatttgaacggcagtatcaatatcgacgcccttaagtgtataaacacttaaaccatcctgccatgtaatagattggtcacgggtgtgatcgctcgaactgtgaacattcaattcaatagcaccgtatttttgaggtgccggtaacatgtagtgatcgaagaggttaaccgcatgaatggcagtctgcttaggattagtgttattgacaacactaccatgaaccgcaattgaccagcggccttcatgccaggcaatataacgttgaccgccaccggcattctcgtatccggtaattttactgcttaattttactttcggtaaacctttatttgtagatgcttgtgagtaatcaacagcgctggctgcggtactttcagatgaataggtttttttctggaaagtggcgtagggtgtttcgtttgaaacaccgctggcattaagatccaatgcttgatttcctacgctgtaatagattgtataatctgattgcgtaccattgtagcgcatattcagattgttgctgccggaactaagcccatcatcgcttggcagcgtgatgtttccaattttattgataacttgattattgagattactgatccgtgaaccggttgttgcttgagtcgatgaagaacctgcagatgttgttgaatcggattgtgcgctacttgactgagcctgacttgaatcggatgatgatgactgactactggcattctgcatatccgtctttgaggatttagaaacagtggaatcattatcattgcttcctttgctttgcttattggaattgcatccgcttagcccgccaatgaccaatagtaatccagcggccaaaccgattaattttttgtgacgcataaaagaccctccctagttggcatgatgacttaattgaatcgctaagttactttgatcactggtaacttggtaaacacgtttatttgcctgccatctgacagtgttggctaattccgattcattagtggggtataacacgattgcaccgtgattaacattctcactgggaagtggatattgactaagttggctggcaacttggctggcaaatgttgcgggatttggacctcctgcagcttctgaaggcgtgacagttgtaatagaccagtttccttggttccaatgggtgtaaacgtgtcccagagttccttgagaggtggcttgtttaccgtccttcaatttatccttggtaccgtcctgctgaccgaaataattaagagaatcggcagctgattgggcatcgtcataagtttgcatttcaaaggttgcgtgacggttgttatttgaatcattgtaatcaagtttataatctttgggatccgaattggtgattgaagcagtcagcttattcccatcgaccgttaagttttgcggtgcaggggtctgctgggttgaactaatgccgatatttgcatgaaaaacggttttgctgacagccgcatatccgccaaatgtgagagaagcggtaccggcaactgcgattaaagagccaattaatttctttttaaatgtcatgtcgataagcctccttattcattgacatatgagcggttagcagtgatgtattgaccagtcgtcgttgtaaagtaataggagcccgttgatcgtttggtaaccgattggatactgactgaatcaccggcagacaatgttttcacgcgattggctttagaaaaagtcttagaatcgtaaagatagatttttttattaaccgtgacctgtttggcagcatttagagcatgataatactttggtgttgtgactgctgatgtgtcggccaacgccgtgcttgcgatactggttcccgtccaccaagaagcaggatgtgtgacaactttactgttatcaacgtacttgcctaatgctgccagataatacttgttggtatattgccaaaggtcggttgcaatcgttggcttggcagaatagttggcaatccactgggcgtcgaaattattacgggcgcttccggcatattgagtcgcaaatgattggtatgagtagaagaccaacttcttattggtcagagaacgcatctcattgtaccaagctaaaacagcggctttagaagaaccggatgtcacattgttttgttcataatcgagtacgtaaaactttgcacttttatttgaacgattatagaagtttttggcttccgtcttagcactggcgggacttgtaaacatggcgtagtcgtattcaccgaacgggataccatatttaacatagagagcagtgttattagttgcgtatttatcaacgtaactgctgccatattgacggcggttaatgacgaatgaaacttggtttttcagattttgtgcttgaagactggtcatcttaccctgccattccgaaacatcggggatagcggaagatgctgctttagaattagtggtagcagcgccgatgataccaatactgacgccgagtgtcgctaaacagtaggcaatttttcgttttatcatgtgggtcctcacttttatgtaacttttaatttgtttgaaaacaacttcaccatataaactatgccaaaccggcaccaagagcaaccggtagacggccgtcaatttgtaatattacacctgttaaaacgatcattgcgactttcaacttactttttatcaaaaagattactatttaatgacatcaacgattgtcgattaggttgtcaccatctaatgacttcaagcatacggtaaacccatttgggcgttgaagaaagtaggcatacattgaaggcggttgaacaaaaaagggtagagacaaaatgagattgaggtttacccccaaagtggcctcattttcctctgcacccgttcgctttaaagatgttttgtgaaagttacaattgatgtccggtggctatcttaaaatgttttggtcacctttgttgatgacggctttgatttctttatctgaaagtagggcatagtcgcctgggattgtgagcttaagaatggcagctgctattgcataatcaagctgttcctgtccggagaacccattgatgatgccgtgaataatcccggctccaaaggcatcgccacttgctacctcgtgatctgttggcacgaggtagctcggactttgataaaaatgacgatcctgacagagcaaactggcccaacgactcgaagtggtgccggtatctcgaacgatagttgcaacggtctggaggtttgggtagttggcagtcagttttttcagagagcgtttgtattcggttatccgattggcaaaggtcgtggcatctgattgttcaatggagaatccgaatgcagggccaagatcctcatcatgggcaaaacaaatatcgacgtatggcagaatctgtcggttaaatgctattgcggcttccgaggtccaaagcttgccacgaaaattagcatcataaacgactttaatctgatgctgatgacaatatttggcactgtcaagaacagtttgcgccagttcatttgaaagggcaggcgtaatgccggaaatataaaaataattggttctcataaataacatatcccaatcgtaatcggatttccgagaggtcgcaaatgcactaaaagcgcgatcataaatcactgagcttgggcgaatgcctgtaccacgctgtaagaaataaagtcccatgcgatccccaccgcgtgcaataaacgaggtatctattccgtatcctctaagttggttaatagctgtatccgcaatgtcattttctggtagtttggtcacaaaagtcacttggtcgcctaattgattcagcagaacggcaacattagcttctgcaccgccaaaattagtttccaagtgcgttacttgactaaagcggaaagtatcaggagtcgtgagtctaagcataagctcgccaaaagttgttaccaacataataagcgcctccatttaagttataaacgttagtatcgcacttattttaccatttttaatagggctgtgtgggctttcacaagaatatggcgggaacctatcattaagaaaaaatagcctttaattttttggcggtccgaagttgttttttaacccattcttgctgggaatgatcgtgagcatactaaaagggctggacaaaatgatttttgccacagcccattgttttgtttctacacaatagtcgatttaattgttttccgatgcctcggaagttggtgcttggtgatcttcaacgtgaccatccttggcattttgttcacgtgacagttcattgtaataatttgcgaaacttaaggacatgtaaggctgaacccagattgccgcaattccggcagtgacactcaccaatatcagccagccaataaaacttaatcccatgacaaaatattcccacttgtggccgtccatcatttgacggcttcgggtgattgcatctgtataagagatgtgttcaccatgatcaatcgcatcccggtagatgaaaaaagactgggaataagccattgatttgataatgccgggaacaatcagcaggattgaccacaaaatgacaaagatatattgaataatactaattaacaatgtccccagaaagtaatcgccattgtgaaaaagaaacattgacttttgaagcgggttttcgtacgtcagcttttcgcgcattgcgtcaagacagacaaatgacataccaattgccagaagggcagctatccaagtgatcaaagtgctgacgccatcggacggttcaaggtagtcggtagcgttgatgccaaagatgatgccaccaatgacctctaaaataaaagccggtaaaaatagcaaaaaataaaatgaaaaatgagagttgagaatgcttttggcatcctcctttaatgcagctcgattcataatatgacctcctcctaattttgacgatcgtcaacaaaaaaacggtctctcccttacataaaggatacaccgtttgttaactttgcgtcatgatttaacctggtaatttagttgcttcattgtcagtgttaagtgcacctttggtcacttttacgctttgaatccatccgtggcccttaacgtagagaaacgaacggatttttttggttgcattacttttggcttttacgtaacgagtcacatggtagttggtacttggtttcaatttgccctttgcagtaaaagagatacttggattatccgcgccgattgcagcacggtaaaccgtgacggtatgatcgttagtgtggtaaacaggtaaattatcataaaaatcagctgttagaatagagaatgaatatgtttttgctttagcagcgcttgccgatgtagatgacactgctgcaaaaaggggaagtgccagaataatagtggcaaaaatgatcccgagttttttcatgggaatacctccagttttacttttttgatggtcatggcttttattttggatgcgtcaccagataatccagaatttgatttaaaagcagtgctgcatttggatcgaacgtttgagacagtacctgctgggcattgtctgcgtatgttgaaccggggatgaagtcagtgtccgcacttgcaagcgccgcgagtgtctccggggtggattccaagtgaaattgtaagccaattgctgaacctaatttaaatccctgatattgccaataatgacttgtaaacaataaatccgcttgctgtggtaacctgaacccttcaccgtgccagtgaaggacttgataagtgtcggcagcgttaaaaagtgattgagctgattgagtagcggttaccggaccaaagccgacttcttttttggtggggacaatggcttctccataggctttggcgagttgctgagcacccagacaaataccgagcattggtttgcctgaatcaacgatgtccttaataagttgacgttccggttcaatccacggtaagtcatcattggcgctcattgggccgcccaaaacaattaagaagctgacttgctcgggttggggaagctggccatcatttttaaatagtttgacgacgttaagtttgtgttgatgagttttggcccatttggtcaccaaacccgggacttcaaacgatacgtgttggatgactgttatttccataaacttaccttctttaaattaaagatctttattgaccatttcctcaaccagtaacttataaagtaatgatcgaatggccatacgctggtaattctcagcgttcaaatgttgggactgtgttttggtcaactcatcgttaaaagcgtgaatgaactggtcatatgctttatcaaccggatccaattttaatgcaatggcgattgcttttttgattgtatccagtgacagaattggtttcattaagctgacaaccaggatctcagccagatgctgcttggaataacgctttttttccggacggtcaaccagtccctgcttaacgtaactattaatcattgatttagtgattttggtttcggttagtggaacgaggaattgattgacttcgtcgattacctgatccatatagagattcaaactcggcagctccgcatatagcggtagtgaaagcctggcaaatcgttttactgtatcatctttaatctttatcaactcctttaacctaagtacaaatattatcgcacagatatgaggattcacacaaatagatattgattctagataatcttgactcttggtttattttatcttatgataatggcaaggaggtgtcgaaatggcaagtcaattaattcatttgaagcggcagcagattgtttatgaagtattaaatgctgttacccatggtgtgtcgtttattgctggtattgttttaaccattcttttgttgatgagggcatatcatgatcatttgtcatcggtagcgacaataagcttgattgtttattgtgtcagtgtattaatgctgtacttagcttcaacgttattgcactgttttgtttttacgagggcaaagcgggtctttcaaattttggatcatagtaacatatttttattgattgcgggcacgtacacaccttattgtgtcatatttattaataatttagccggcaatattttactggccggtgtgtggcttttagccatttcgggaatcgtcagtcacgttgtgtttcatggaaaataccaaaaaacagaaaccacaatttacgtcgttatgggatggttgtgtctgcttttaggtaaacagctttatgttaatttgacaccaagtggcttctggctgttggtaagcggggggatcatttttactgttggtgcaatcatttacagttttccacgaatccccggcttacatttaatttggcatttctttgtcatggccggaacgttgacaatgtttttatcaatctatatgaacgtttaataagcggttggctgggataaatcagtcacagaaaattaaaaagagtcaaagttgatttatgaaattaaaaaataatgttgacattcaaaatgaacatggtattgtaatggtaatcacaaattaaaaaacaataataaatatgaagttacgattagaaaagtaagcaatcatttgatataaagagaatcccgatggtgagaacggatcgtcagggttgctgaaaacacatctatgaactgggtaattgaattagagtaggttatcccgctagtgagcgttaccacggctgctgtaactgttcttcatcttgaatggacgactagttaaaagcagtgtaaggtcgtttcatcgtgagatggcgacgaatatgaggtgggaccgcgagaaatcgtcctcagatattgcaaatcagcaatgtctgaggacgatttttttattttcaaaagtcctaaccgtaaccgactatttattggaaacggagtggcaaatatgcaaattattgaagaatctttagatcagatgttaaagcaggtcgcaattcgaacaaacaaagtcgcaaaccgtgcagaggtagaaaaatcggttcgcgacattatcgcaaatgttgctcaaaatggagatcaagcggttaaggattatgaaaagaaatttgatcgcgttgaattggataatttggctgtcagtcaatctgaaattgatgatgcttatgataagacagatcaagacgtcatcgatgcgctggaacttgccaaacgaaatattacgtcttttcataagatggaaattgaagacagctttgtagatgccaagcaaaaaggggttatcagaggcgagaaaattgcaccgttggctgctgtaggcgtgtacgttccgggtgggaccgctgcttatccttcttctattttgatgaatgttattccagcaaagattgcgggtgttaagcgggtagtcatggtcacaccgcctcaaacaaacggattgaataaggcagtcttagccgccgctaaaattgcgggtgtcgatgaaatttatacagttggtggtgctcaggccattgccagtttggcatatggcactgaaactattccacgtgttgataaaattaccggtccaggtaatgcatatgttgcaactgccaagaaacaagtttttggtcaagttgatattgatatggttgcaggtccttctgaaattggtgttatcgccggttcccaagctgttgccagtcaggtagctgcagacctattatcgcaggcagaacatgataaattggctcgaccaatcttggtcactgacgataaacaattggcgatcaatgtaaatgcggaaatgaatcgtcaggtcaagctgcttccgcgccaagaaattgcacaggcagcgatggataatgaagggtttatcgctgttgttaaaaacattgatgatgcgttcacattgatgaatgccgtagctccggaacatttggaagttcaactgccggatgcaatctcttatttgaatcaaattcaaaatgccggttccgtattccttggcttttctgcatcggagcctgtaggagattatgttgccggtccaaatcacatcctgcctacgggtggaactgcaagattcttctcaccgttaggcgttcaggatttcgttaaaaggacgcaattcgtctcatatactcgtccagctttaaagaaggaagcggatgcaatcacaactttggcaagggtggaaggcttagaagcccacgcaagagcaattgaaagcagatttaagtaagtgtgcggatctaagcggttaacacccggagtataagacgtcgatttgggaaatcccgggtttggatttttcaaatcgatctcttataaggagtggtgttgctaagagaagcagttctagtaagtgtgcggatctaagcggttagcattctaaattgcatccaaaaatttctgctgggctgatactgttatactatagaagaaaaagagtcaagacgtctcaaacgattgccaattttttaaacggcaatcgtttttttgtagtctgatggtaatattaatgcaacatttcgaaaaaactaatttacttgttaattatcagtattggttagtccactattgcaataacgttgacagggttattacaagttgtttagtttgtaaaacaattgtagtccgatggttaaattgaattgtcaaatggcatgttatacttttaagcaacggaggtgtatatcgatcaatgaaaaaaatacaacttattttggctactttactggttgttttgggtattgaaggagcaactaataacattcaagcacatgcaagttcttcaacgacaacaccgaagtcgcttcgtggaacctggtacaaatatacgggcgatggtaaatttagtacgatcaagatcacaacgcacagcctcacatataacggtagcatttactcgccttctaaaagtggggcacataaactcaaagttagtaagtgggggtcttggtactcatttaataaaggatcctcatcatccaatctcggtcagtttaaaactgaaaaaagactaattaaagggtcttataaaaaatctttggttcgctatcacagtattggtacttattatgtcttcacacatcataaatataaccaggattattcatttaaaatattggattaatatccagaaaaagtatttggtaatggataattgtaatcaaactaactgctaacaggacaatgggactttttgtgaagctttgattagcgtttgggttaaatattctttataatataaataagaacatttgtgaaggacttaatttgaattcatttaatgaactgccattattgcagatggtggttttatgacgctaatcagggggtaatcacatgaaaaagacactattgactgtctgcttgatgggcctgctaacaatagggctggcgggttgttcatcaaactcaagcgattcatcttcaagcagtagttccaaggcacaagagtctcagtctcaggttcaatcttcaagtgaggtgacgagttcatcggagacaagtgccacttacgcttttaaagggcaaaaagccattcggattcgatacgagaatgttcattatacgacgcgtttggataatgattatcaagaagaaagactctatcagaaggttcccggctccaccactaataatcgggtttatcattgggatagtttaaatgttagtgatcgccaggatgtttatgttgataaaaaggccattgcaacgttcaaagacgatgataatgcaaatgaatacgaccatgaggatttctatcgaatttcatttggcaggaatgctcatcaaaaatattgggcaagtgatgatgtgattgaaaatgaagccaatgaaggctatgacgactaattgaatcaaaggacttgcaatttatctggaatcattgtattatttggacaatcaaaaaaggaggtgatgctttttgactagtggaatatctcagaaggcatcagctgtggagaacgacttaaaatagttgatgtttaagagaaagaaccggcgaaattaaaaaatcgtcggtttttttgtgtctaaaattaaaaacgttctcagtcattcttttggcgtatatctatagacgcttttggataaaacttgtaatatggtaaagtctgcgacatctgtggatcaaaaaagaatgaaaaggaagtgaaaatacaatgaagcagttcaaattacaaagttttgttctggtattaattgcatttacgttgggattcagtgaattcttaattgtggggattttggatgatctttcagaacaatttaacgtatcggttgcaaccgttggttatctggttacgatttttgcaatggtttatgcggttagtaccccgtttatcacattgctaattggtaaatataacttattctggggtcttttagccttaatgggtatctttaccattggcaatatattgagttttgttgcgcaaaattttgtttttcttgtcatttcgcgaatcataacagcactcgtttctggtgtggcaatctcaatcgccttatcatttgttggctacattgccccgatggagaaaagaggctggttgctgtcatgggtattttccggcttcagtatcgcatcagtactgggcgtccccttgggaacttggatttcaacaaattttggctggcggatttcgtttttaacaattatcggcatttctgtgataacaatgggcttaatctttggttctttaccacgtgattttaaacagaagagaagcagtattggtggtcaacttgctttgctgaaagatcatcgaattcaaatcggcatgtttttgccgatgtttaatttagcagccatttatgtattttacacatacttacggccgattatcacaacgcagttgcatttttcgacaagcatgctgacgattcttttgtttgtctttgggattgcaaacattgtcggaaatcaggcgagtggcaaattgacggaaggccccggcctaagcgcaatgcccaaggtttatgtcgctcaatttattttaatggttgtcatgccgctttccttccattatagttggtttggtgcaattcttttgatgatgttgattgtcagtatgccacttttaaactctccaatccaaattcaatttttgcaggttgctgaaaaaaattatccgcaatcaattgttttagcttcttcactaaattcgattttttcaaactttggcattgcgctgggttcggcaacaggtggcataatggtcagtaactttggtatgagttcggttggcccgggtggtgcaggatatacgttggtcacgtttatacttgttgtatggcttaatcatctgaatcggaagtttgccccacaaagtttataaactgaaagtggggatgagtcatgaatggctttctcggagaattatttggaacctttgttttaattgtgttgggagcagggacaggtgctggtgtaaatttaaataaaacctacgggcatggatccaattggacattcatcagtttagcgtggggaatggctgttacaatgggagtctatgtggcagcatcgtttggctctttagggcatttgaatcccgcggtgacaattccgtatgcactttttggattgtttccttggaatcaggtgcttccttatttgttaggacagttttgcggtgcgttcctaggtgcagcagttatcattgtgatgtttgcgccacattttaaacaaaccaaatccaatcagggaaatactgttggtatctttgcgacaaggccggcaattaaagcgcctttggccaatttcatttctgaggtagttgcaacttttgtttttgtatttgcacttttaaatttaggaaatttttctcaaggattgaaaccgttggttgtcggactgctcattatggtcgtcggtatggggcttggcacaactactggattcgcattgaatccggctcgtgattgggggccgaggcttgcttatacgattatgccggtgccaaataaaggcagtgccgagtggggatattcttgggtgccgatgttcggtcctctagttggcgggatcattgcgacatttattcaaacgacccttcactgatgagtgtcaggttgacaagtatcgtgtgaataaatatactcagcaataacatattaaataaggcaaaggagttttcgatggatagaccacagcttaaacttgaaatgagacggatgttaaacagtcattttccgttttttatattattatttttacctgtattagtcattgaatttgggcttaattttacccaatatttaccatggagccatggcagttcctatttgaacatcggcaattattggaatgcacccagcatttatgattccagatttaattttgattatactgatccaaaagcaataactgcattcttgggcttgcttcttttactggcaattattagcagtttgctattaaccggtattcagtttgccagtatcgaccttattcgtaataaaacgacctttgatcaaccagtcaataagtcatttactattttcaataatggtgattattttattggtacgattatgattggacttataacgagtatcctaacctttctttggtcactgctgttgtttattcccggaattattaaagggtatgcttactcacaagcaatctttatttaccgggatgcacttgataagggtgaaaagattggctaccttgaggcaattacgaaaagccgggagttaatggacggcaataagatggatttctttgttctttacctgagcttccttggatggttcattctctcgaactttacattaaacattttggatttatgggtagttccttactataatttggcagttgctaatttttacgttaagattcacgatgatcaaagcgagccattacagaccattttggttgatcctgatcagccacatcattcggacgatgatcactcttcatccaatgatcagacataatcatgatcagaacctagaaaacggatgctttcctcaacaatggggggcgcatccgtttttgattgagtcatcattttagcattagtcgccaagtgcctgttttaaatcctcagctaagtcttccggattttcaaggccaacagataaacgtaacaattcatccgtaatgcccagcttaagtcgatcggctttggccatgtcccgatgtgtttgcagcgaaggaatcgtgagaagcgattcaacgccgcctaaactttcggcaaatgaaatgatatttaaccgtttgaacagtcgatcaacctggtcacggctttgaacgtaaaagctgatcatgccaccttgcccaggatagagtactttttcaacttgcggcaatttagccaaactggcagcaacataggttgcatttgacgtgtgtcgttgcattctaaccgaaagggttttaaggcttcgaagtagtagccaggaatcaaaaggatctaacgtgacgccggttgtattgaaattaaattccagtgtttcaccgatttcttctgattttgcgataacggctcctgccagcatgtcgttatgacctgaaaggtatttggtggcactatgaacgacaatatcggcgccttcacgaattggttgttggtaaatgggtgttaaaaaggtattatccacacagactagaatgtttgagttgctactatgagcgatatctgcaactttttgaatattaatgactttcatggtaggatttgacggtgtttcgatccaaacggcttttgtgtgaggcgtgattaggctagacagggtatcgtaacgcttgccatcccacttattgaatttaataccatagtgctcggtcagatagtcaaaatatcgaaatgagccaccgtataaatcatctgaggtgataatttcatctccggagttaaacagtgaaaagaccagctgaatggcagccatacccgaactcacagcgaaagcctttgcgccgtcttccagtttagccagggtttcctgcaatacttttctggtaggtgttgaaagacgggaatatgaatattgcttttccgggtcaaagttctcaacatcttccaagtcccggtgacgaaagttggatgataggtagatcggtgtcgaaatcgaatggaactggtcgtggttatctcggtttcctgcttgtgccaatagtgtgtcaatatcaaaatgtttattcttagtcatgtcaaagaatcctccaaaaaatagtttataaagcaaaaccgccactcggaaaatgaaaaatcattttcagggtgacggtttattcacgataccacctgattttaccaacatttcacaatgttggactcagtgagtgtttagtcgggcttactgcacaattattgttctcaacgaaactcacaccggtcagcaccggtgtgaggcaatgattaattaagccaaactatactcttgcaggtaacgtatgcaaacgatgtgtcagccaaaagaccgccacacaggctccgagctcatcttctttttagtcgtcgggtttctttacagctgccgaaactctcttaaccggctactaaacctactcttctcatcaaagctttaattcattaaaatcttctctattttaaactaaactggtgacagaatcaatgcaaaaaaatgggttgaaagattgtgaaagtgtttacattctcatatgaaaatgctattatgaaattggttcaaatcataaccatctaggaggaagtttttacaatgaaagaaaactttgatttcttaatgccgagtgtcaacttctttggtaaaggggttatcaagaaaattggcgatcgtgcaaaaatgttaaatatgaaaaagccattgattgtgactgacaagtttttgcggtcaatggacaatggaccggttgctcaaacattagcatcacttgaagcagttggcgttccttataccatctatgatggtgttgaacctaatccaaaaattcgaaatattcaagaagcaaagaaagtttatttagataatgattgtgacagcattatcactgttggtggcggttcttcacatgatgccggaaaagggaccggtattattttgacaaatggtgatgacatcaccaagcttgccggaatcgaaacgctgcaaaatccattgccaccattgatggctgttaatacaaccgccgggaccggttcagagctgacccgtcattgtgtgatcacaaatgaaaaaaccaaactgaaatttgttgttgtgtcatggcgaaatattccattggtatcatttaatgatccaatgttaatgttggatgttccggcatcactgacggctgcaacagggatggatacatttgttcaggcaattgaaccttatgtttcaaccaaccgaaatgaaattacggatggtcaatgcattcaagcaattaaattggttgaagaaagtcttcgtgaagctgttgccaatggtcacaacattgaagcccgcaccaaaatggttgaagctgaaatgttgggtggtatggcttttaacaatgctgatttgggatatgttcatgccatggcccatcaattgggtggtcaatatgatgcgccacacggtgtctgctgtgcaatgttacttccaattgttgaaaagtataatattgttgccgcaccggaaaggtttgcacaattagctaaaattatgggtgaaaatacggacggattatccacaagggatgctgccgacttatccatcaaagcaatgcgccaaatgtgtgatgatgtcaagattcctcgaagcattaaagcaatcggtgctaaaccggaagactttgaattgatggctgagaatgcgcttaaagacggtaacgccttttcaaatcctcgtaaaggaaccaaagaagaaattgttcaattattccaggaagcatatgatcaaaaataagttgtaaaaaaacttaagagaacttcaaaggcttttgcgtcataacgaccaacatgagtcatctgaatttaggggttgagacaaaagtagcttttgccttaatcctttttgtgtcaaaacgacaaccattacttggttgaaaagctccctgtgtgacttttttcctcgttaagggtttgactggaaaagaggttaaaagttcattgattcttcatactttctccgctttatttggttattattatggtaatgataagtgtaacgaaaaaatgacgagtgagtgaccaatcgacaagtcatagtctggaggttttattaatgaaacgacatattttaaccgacgtaggactgctgtttttgattccactggggattattggattttcattaagttcagataatcaaagtgagtcgaggcaggcagctcaagctcaaaataatactgtcaaaacaacgaccgatactgaatatggcagtggatccgtcttgagtgccaatcaaatacagtctcttgattttcggccatcacgagtataccgtgtgaggtatacaaaggtgaactttaaaacggttttagatgatgattaccgagaagaaaagctttatcgttatgtaccaggcgccaaaaagaataatcggacctataaatggagccggataaaagcgcgtattgggaaaaaggtctacgttgacatgaaagcaaaagcatattatcgtgacgatgatggtgaacgcgaatcagaggacttttatcgaatcagaacggccaaaagtgcttcatctcagaagtactgggttaatgaagatgccatagaggacgattaggagatccaagacgagtttaaaatgttgtttataaccagttttataattgaagtcaacatgagctgatgcttaatgggttggcttctttttctctaattttttttgaaaatatatgatacattataattagttctttcattgcacgaggaggtgttgctgttgaatattttggtgaccggcggggctggtttcatcgggtcaaacttcattcatctgcttttaggtcatcgtcaaagcgatcgtttaattaattttgacgctttaacttacgcgggtaatttagataatttagacgatattcccgaaggggcgacttatcggtttataaagggtgatattgctgataaagaggccgtcaaaaaagtggtgtccaattatcaaattaacgttattgtgaactttgcagcccagtcacatgttgaccggtcaattattgatgcaacaccatttgttcacaccaacattgagggtgtcaatacgctattggaagttgccagggagtaccacctcgataaatttgtgcaggtttcgactgatgaggtttatggcagcacaccttcccaagcgcgctttgacgagcagaccccccttaatccaagttcaccatatgcggcaactaaagcatctgccgatttattggcactttcctactttaagacatttggcacgccggtttgtataacccgatctgctaataattacggtcgatatcagtttcctgaaaaactggtccctttgatggtgactgctgctttgcgtggaaaaaagctaccaatatatggtaatggtcaaaataagcgggattggctgaatgtccaagataactgtcgggcaattgaaatggttatgagcaatggcaaacccggtcagatttataacatcgcagggcgtcaacataaaacaaacttacagattgttaaaataattgaaaaacaactggctgcgatccacccacaagtgacatttgtgaaagatcgacccgccaacgaccaactctacgcgattgatgattcgaagatcagacacgagttgggttggcggccggaatttagttttgagattggcatgggagatgtgatcgattggtatgtcattcatccggaatggtggcagccgttgctcaaaagggtacagaatagataaaacgaggtaattgatatgaaaattggatttattggaacaggtgttatgggaacggggatgattaataatcttctcaaggccaattttgaggtcaccgtttacaatcgaaccaaagcccatgcacaagaagtgctgaatcatggggcaagctggcagcaaacgcctgctgacgttgccaaggtcagtgatgttgtgattacgattgttggattccccaaggatgtcgaagaagtttattttggccataacggtatttttgagacagcaaagcctggcgaaacgttaatagatatgacaaccagctctccggttctggctaagaaaatttttagtgccggtcaggaccggcaaattgatgtgttggacgctccggtttcaggtggtgatgttggtgctagaaacggctcacttacaattatggttggcggtcagcaggctgtgtacgaacatgtactgccggttttcaatgcaatggggacatcagttacccgatttggtggcgccggtcaggggcaaaatgcaaaaatggctaatcaaattatgattgctggcacgatgacaggcctaacagaggcgctggtgtttgctaaagcagccggtttggatcaggcacaaatgatcaaaaccattcagggcggtggtgctggtaattggagtatggggacctatggcccgagaattttaaaggatgatttaaaaccgggtttttatgcaaagcattttttgaaagatttgcggattgcattggatgcagccgatgaaatgaagattcagctgccggccacgcaaaaggctaaagatctatatgaagcaatggttgatcagtttgatttaggtaatttaggtacccagggactcattaaaatttatgataagtaagcattgttttatttttaaagcgttctttaattaagtgcaattgagtaatggtttatgggttaaataaaaaaggcaggcctattttagacctgaacctatttgtaaagctatttatttttgcgctcacgtcgtttttgaatggcagaaacgacgttaatcacaacggaaattgttagaaaaatacttgcaagaatgatgagaccgatcttaacgttgtcttcaagatgacttgattggatataaaacgcaatagcaattgatagaatcaatgataaatcggctactattagttttggtgaaaatcccattttttccagtcctttcaatgtagatacgcaagcattataacaaattttgggcaggtgtttttattatattttgttaatcgatcatttgtatatgaaagatgtgatcggagatgcactgttaagtaattttgcttgttcaaatgatcaattatcatttatacttaataagtactttaagaaactgtgtcgtagcaaacggcggcacttatgtgtaacaattggtggttttaaccagttataacgacatagtgtgtgtcgaaagcttgttttcggtgcagatttaaaaaggtgaaaaaatgacaaaagagaattcaaatgaaccgcttatagacagtaacaaattaatctttgggattggtcaggttcaacaaatcaccggtgtttcgggtagacaattgaggtactgggaagaacagcattatatagcgccaatcgaacagcaaaaaggaacgcaacgccaatactcgtttcatacactttttttgatctttcatattcagcgctacttaactcaaggatttactttacaggcagcggttgaaaaggcaaaggaatttgaaaaacaaatgccggttttgcgtacttttataaaggctcaacttcagggagtcgatgtgtcgaatgaacgaagcgtcattgatttcgggtttaaaaacgatgagcgtaagcagcgcgtttatggcattgtcgaaggcgataaaacctactttaagatagaggatttaaaagagtcgaaatgaaatcgttatgatgagctttgagtcattgttagacgctcaaagttaaagatagaatccaggtaaaattgcgcttatacgcaacttcacctggattctttttgaatgatcatagtcgaccacatgattaataatcaaaaataggcacctaacctgctaatcagttgtattaatcgccctcattatcaaactttttgtataaaccgataattgttttatcatccaattcaatggggtttccatccaacgtcacactgtcgattttataataatcctctaaatcgggaacctccaagcgctgatttgccataaaatcagcggcagacttatagtcaatggtttcgtgagaggttccattttgataaacaattttgagcattgtatgtcactttctttccattaaagaatttcatttcaaaaccaccttaattttagaggttcaatttttgaaatacaactaacttgtcgtttggcttttattatcaaatggataaaatggagagtttaattttgcacaattaatttatgcttgatatgatacttataacaacaaaacaagttggcgtttattaacaggggaatatttaaatgggggatttaaatgtttaaaccaaatcattttttggcggttgtggggatcattttattaagtctggttggggttgcaacgtttgtacaaaaaccggtcttggctcagacggtgacttttacgcctgagatgcacgggacgaagaatttaacacatcaaggaacgattcactactacattcgtcctgatgcgggtaagtatcaaaaagagatcagaactgcggttgccaagtggaatcgagcattgggcaggcctattttacaaccgggtactgatatggggacatcccgtttggtttttacagcaaccaatcatttggataaaggatatgcggggatggccgagattaacagtggtgtcattgctttgaaccgttcgtggatgagtcggtacaatgacgaaaagaaacaggcagtggttatccatgagctcggtcatacatttgggacaagggatttatatgattactcgaatccatcgttaagagctgcatttaggaagcatacgattatgggtggcagctattcaacaagaattcagcaattcgacgttaaattagcaaaatggagtctggcaaatacgagaagtatgtcacaggctgaatttaacggatatcggtctaatcctgggctttactatcaacaaatgctccatggaaaactttgatcggattgaattgacaaggcttcgttcaacaattatgattaggttatcgtgtttgaagcgttgaggtaaatatagtatttaattgatcgagaagtcagaaacttggcgggtgatgggagctaagcggttaattaatgaaattacgtttgcggagctttctattcttatatagacgagtcatttcgttaccaatgaatgaagagactgcttttttaagtagtaacttgggtggtaacgcggaaaaattcgtccctggcaatttattgattgccggggattttttattttgggaggatatttggaatgaacattttagacgatttgaaatggcgcggtgcaatcaatcaggaaaccgatcatgatggattgtatgatttggttaataaaaaatctgttggcctttatgttggtattgatccaacgggagacagtatgcatatcggacatttaatcccgtttatgatcttgaaaaggttccaattagccggacatcatccggttattcttattggtggtggaaccgggtcaattggtgatccaagtggtaagaagtcagagcgggttcttcaaaccatggatcaggttcgtcataatcaggaagccctgacgcgccagatggaaaaattgtttggacaggatggttcttttgaaattgtgaataattacgattggctgtcgaaaatgtcgttacttgatttcttacgggattatgggaaactttttaacattaatacgatgattcgcaaggaaattattgcaagtcgtttggaagccggcatttcctttactgaatttacttatcaaattttgcagggagtcgatttcctacatttattccgttacaacgatgttcaggtacagttgggcggggccgatcaatggggcaatatcacgtctggaattgatttgatccataaggttgaagggtccgatgctcaggcttacgggatgacaattccgcttttgcttaaagccgatggcaccaagttcggtaaaagcgagggcggcaatgtttggcttgatccggaaaaaacaacgccttacgaattttaccaattctggcttaaccaggatgaccgcgatgtcgttaaatatctgaaatactttacttttctggacaagaccgaaattgatgacttggaaaagaaggttcaaacccatccggaaaaaagagaagcgcaaagaagacttgcacaagaagtgactaagtttgttcatggaccaaaggcggttgaatcagctgaacgaatttcgaaggcacttttttcaggtgaagtagctgatctgacgacgactgaaatcgaacagggatttaaaaatatgccgacggttaatgtgtcttcagaaccattgaatattgttcaatggcttgttgacgcaaccaaaattgaatcttctcgtcgccaagctcgtgaagatatcaataatggtgcgattcgaattaacggtgcaaagattcaagacactgattttgaaatcaatccatctgataaatttgatggtaagtttgttattgttagacggggaaagaaacgatatttcttagcccgcgtaaagtagagttgttccttaacggcaaagcgcttttgagcgtataccaattccatttgcattgtcgaatggaacagtcattttaagttggaaacagggaagtttaatccctgtttccaactttttttaatttgtttacaatttgtacttgaccagctttcgaaatcttggtaaactagttttcgttgcgttaaagcaatcgactttcaatgccaaattcaagttttgtttctttcaaaaaactgcttgcatttcaattgaaaatctgataatattaaatagttgtcaaaagcgatgaacaagcgctttgatagccaagtagacctttgaaaactgaacaaaattttcgacaaacaaattgtgtagggtgcttcgatttttgatcgaa

SEQ ID NO: 458 - DNA, 30885 bp, Unknown
  Metagenome-assembled genome
atcttcgtggtagttggttttgatgaacggacaggaaatgcccgttttttgttcaataataatatacaaaaaaatctgtcattaataatagattaaatctattaccaacaacagatattgtacagcccattttttgtagactaatcatagtcgttaaggagaaaattaatgttaaagggaacaattaaaagttataattcaaaaaatgcatttgggttcattaaacaagaagcaggagaggaccttttcttttttaagaatgcctttcctgaagatcagtatcaccgaattcaggaaaatgccaaggtgacctacgttgtcgttgagggacaaaaggggcctcaggctgccaaagcccagattgaagattaaataaccgattcgattgcattgatatcggtttgtttgtagaataaagatattgaaaaaggtgattttttggattttgaagaacgcgtaactagttccactgaaatttacaagggcgctatcattaatgtagagaaacaatctgtggagcttcccaatgggcaatcggcttttcgggaaattgttcatcattcgggtgctgtggcaattttagcgttaacacgagataataaaataatccttgagaaacaatggcgggcacctgcagaaacgacaaccattgaaattcccgctggcaaagtagatcaacgcgactctaattttcatcacgccgttattcgggaattaaatgaagagattcgctatgttccccagaaggtaagagctttatatgggttctatacttcagtgggtttttctgacgaatatatgcgtttatatttagccactgatttggaacctgtaaaaaatcaattgccaagagacaagggcgaatttttggaaatctttgagaaaacacttgatgaagccattcaaatgattgcgaatggtgaaattcgggatgccaaaacgattatggccatccagtattggcaattaatgcaaaagtaggtgactgatttttggcaagtgatgacgataaaacaacaaaatcgacgttaacgcgtgaacaatatcgaaaacttaaggggcaacaggaaaaagatttcgagcagcgtgataaacgccgtgttcaagttgaacgacaatatgcgcggcagcatcatcaggatctgccaaacgatgaagcgccaactacagatcaagcacctgattttaaaacatttcgatggagaaagaccaatcgacgattaaactggattatttcaattttagcagttctgattttgatcgtttacttggtgcttttctttgttaattaaggagaatctttcatggtttatggaattatttgtgcaatggacgaagaacttgctgtcttatctgaggcacttgaaaatgaggcaacaattgagtacgctcagatgaaattttatctcggtaaaattcataatcaagacgttgtattggtcaaatcgggaattggtaaagttcaagccggtattaccacgtcaacgttgattaacgagtttcacgttgacgctgtcattaattctggttccgctggtgggattggcacgggattatcgattggcgacattgtgatttcaacggaaactgcctatcatgacgttgacgtgaccacctctggttataaggttggtcaactgcctggctttcctgccagatttcccgcttcctcggagctgggtgataagattgatcgggctgctaaagatagcaacgtgatcgctcatcgtggcttgattgtttccggtgaccaattcattgcagattcgaaccgtattaaagcaatcaaaaaagattttccagatgcgctttgctcggaaatggaaggtgctgcagtggggcaggttgcctatcagaaccatgtgccttatgttgtgattagagcaatgtcggatgtcggtgatgagaatgctgaagtcagctttgaccagtttattattacggcgggtaaaaagtctggtcagatgttaattgatttgtttgaaaacgaatgatttaggaagtgaaaattcttgaaagaaatatatttagataatgcggcaacaacaagggtttccgatgaagtatacgccgaattgatggataaatataaaaatgtttatggcaatgcatcaactttgtatggcatagggcgccaggcgcgtgaggtaatggaaagttcacgtgaaacaattgctaaaagtatcaatgcaaaccccgatgatattatttttacaagtggtggttctgaaagcgacaataccgccgttatgcaaacggcaattgcccgtaaatccttgggaaatcatattattacaaccgctatcgaacacgaagcgattctaaaaccggcagcagctctcgaaaaaatgggctttcgaattacttatttaccagtagacgaatacggtaatatttcattggatgatttgaaagcggccttagatgacgaaacaattttagtttcaatcatgactggaaataacgaggttggttcaataatgccaattcatgaaattggtgaactcttgaaagatcatcaggcctggtttcataccgatgcagttcaggcatacggcttgctcgatattgatgttaaacgtgaccacattgatctgttatcaacttctgctcataagattaatgggccgaagatgattggcttcttgtacaagcgtaatgggattaactttccacctttaatcaagggtggtgatcaggaaaccaaacgtcgtgcagggactgagaatgtaccagcaattgctggatttgccaaggcggttgagacgattacccctgaagaaaaggctcatcggcaggaaaagtatttaaagttcaaaaaatatattgccgacaaactgaccgctaatggcattgattttgaagtcaatggccggattactgaagataacttgaatcacgttttcaacatttggattaaaggaatttcaacctatgttttacaaactaatcttgatttggcgggaattgccgtctccgggggatccgcttgcacagctgggagtattgaaccgtctcacgttttagttgcaatgtatggaaaagatagtccacgaatttctgaatcattgcgggttagttttggccggtataatacttatgaagatcttgataaacttgttgattcaatcactcaaattgtgactcgaattaaaagcaaagaggtgaagtcgtaatggcattttcaaaaattgctaaagtgaatggtgatccaactcaatatgaaattagtgaaaacattaaacgatatacattaaaagaccttgggtttgtcgaaaccaaagctggtaatttttcactagaacgatcattagatcccaattcgccgtataatgccggatataaatttaaaatgatggtctcaaaaaacatggacggctttagaatggctatcacaactggtaacgggttacagaaatacaatatttttaaaacacaagacactaaggaaagtgttgaacagtatcactttttaattgataatttgattagtcgtgaggttattaagcgcggatagctttgtgtgttctgctagctaaacttgaagatcttgcagtgactttttataacggcggtcgagacaaccacaattttgtcttggccgccgtttttgattgtgagatttttttgtcattcaatacatagagattgtcaatttttataaaaggttttctaaggattgagagattaaaagtggcttttctaagttatttacttattgacagccagggaaggctagtaacggtaatacagccgtttagggaatttaaagtttgggttgacaggcaattttaaaaggattaaattagatattgattaggaaataatgataaattattttgaatagtcattttaatgatttgggggagcgttcagatatactatgatcggtcatctctaattggaaaaacatacttagtctacaggtttatcattattatctaatattaatttaaggaggttatttgcgaatggcaaaacaagatgttaaggatcttgattggtccaatttaggatttacatatagagatttaccatatagttatgatgaagaatttaaggatggtaaatggcaaaatggtgggttaactactgattcgacgctaacattttctgaagcagctgaggatttacattatggtcaagaagtttttgaaggaatgaaggcttaccgaaccaaagatggtggtattaatttatttcgacctgaaatgaatgctgaaagaatggcaaactcagctaaacgattggtcatggaagaatatccaaaggacaaatttgttgaagcagttaaagccgttgttaaagcaaaccaagaatttgttcccccttatggaagtggtggttccttatatattcgaccattcatggttggcacgcaaccggttgttggtgtttcgccatcagatacatatcgttttcatatctatgccacaccagtaggcgcctacatcaaaggattgcatccaatgccatatacagttagtgagtatgatcgagctgcatatgccggaactggtcaggctaagactgccggtaactatgcaagtagtttattgccttctattcttgctaaaaaggcaggctttgctgattgtttatatttagacccacgtgaacacaagtatattgatgaatttggtggtgcaaacttctatggtgttactagagatggtcaatttgtgacgccgaaatccaactcaattttgccatcaattaccaaaaaatcaattttgcaaattgctaaagaccaaggattaaatccagaagaaaccgaaatcgatattaataagcttgataatttaacagaagctggtgccatgggaactgctgctgttatttcacctgttggttcgttgacctataaaggcgataaacatgtcttttacagtgaaacagaaccaggtcctgttactcagaaactttatgatacgttattcggaattcaagaaggcgatgttgaagataagtatggctgggttgaacctgttgatttgaattaaacagttaaaccagctttgagataattgcattattaaaaagttagctgagagagactggacaatcttcattttgtccagtctctcttagtgtttatacgattgttaccgagcaagaacgtgggacaaaaaacaacgtgaattgtcttttgtcccgttttggccacgattcgttaagaaagggaatcagagtaatcaaatgatatgtcaatcccttagataccttaacagctggctggcatgatcaggctgttgattggtagttagtgtttctgagacgctttgtgatagacattgacattctgccattaaaatattaaactattaaaaattggttagaccatttagtataattcgattcataatcgactttggaggaatttaatgatgacaaaagctaaaccggcaacagaaattgattggaataacttaggatttaactatatggatttaccttatcgatttattgctcattacgaaaatggtaaatggaataagggtgatttgactcaagacagcaccttacatattaacgaaggatcaactgcgttacattatggtcaggcggattttgaaggcttaaaagcgtaccgaactaaagatgatcacattcaattatttcggccagatatgaacgccaaacgaatgcataatagttgtgaacgattactaatgccagcatttcctgaggatcaatttatcaatgcagtaaaagaagttgtgaaagcaaatgctgactatgtaccgccttatgggactggcgggaccctttacttgcgaccattgatgattggtgttggtggtaacatcggcgtgcatccagcatctgaatatatctttacgatttttgcaatgccagttggtgcttactataagggtggtttaaagccaactaacttcacgacgtcatattatgatcgggctgcgcctcatggaactggccaaagtaaagttggtgggaattatggtggtagtttactgccaggggatgaagcccataaggctggtttttctgatgttatttatcttgatccggcgacccatacgaaaatcgaagaagccggctcggctaacttctttggaattacgaaagatgatacgtttgttactcccaaatcaccttcaattttgccaagtattacgaaattttcagcactttggattgctgagcatcgattgggattgaaagcagagcaaggtgacgttttcattaatgatctggaccggttcaaggaagctggcgcgatgggaacagctgccgtaatttcaccaattggcgggattgaatatcaagatcagttgcacgtcttttatagtgaaactgaggtcgcaccgttgacgcgtaaattgtatgacgagttaaccggtattcaatttggcgatgttgaagcacctgaaggctggatccagcgggttgagtaatcctaaaggagaagttgcatggtgaaacgagaaggacattcacatactgaattttgtccacatggtagtggtgacgatgttgaattgatgattcaaaaagcgattcgactaggctttgatacgtacagtattactgaacacgcgccattaccagctgggttttctgatgattatcgcggtaaaaaaaccgggttaaccgaagcagccatttcaatgagtgatcttgaaccttatttcaaaaaagctaatgaaatgaagaccaagtacgcggatcagattcaaattcaaattgggtttgaggtcgactatcttcctgaatttaccaactggacgaaggcttttttggatgaatatgggccgcggacaactgataatattttgtccgttcattttttaaagggtcgggatggccactattggtgtgtcgatgacacattagccgattttcagaccggcctacttagccaattccaagattctcagagtctctatcgtctttattttgaacaagttaaccggtcaattcgggatgatttgggcaaatttgcgccccaacgaattggtcatatgacgctgattaagaaatttcaagatcattttcggctagactccgccttttcacctgaaaacttaggaatagtgagtgacattttacttgccatcaagagtcagggaaggcagttggatttaaatgccgctggattgtataagaaggattgcaatgaacaatacccgagcctgcaaattattgaaatggccagggtgcttaaaattccgatgatttatggtagtgatgcccatagtgtggctgatattggccgtggttatcatgcattggctgatttcgtgactgattctttttgaaattactgttgacttctgagaattgcagtgtatgataataaattaaattaaagattactaataaaataaagttttgattagaaaaagtaactgaatttgaatgaaaagagaactctggtggtgagaatgagtgattcgattcggtgaacacacatctatgaactaattggttgaaccaagtaggccaattcgcatgtttagcgttatcagggttgccccaagtcttactgaagtgttttcagatgagtacttggtggcagcgtaaggctgtttatcgtgaggtagcagcaaattgaggtggtaccgcgatcaaaactcgtcctcgaagactgaatttcagttttcggggttttattttgctcaaaatttgtaaattgggaagtgacaatatgcagaataaaaatttacctaatggaacccgtgatgaatttggcccgcaagcccagattaaagaaacgattcaaaacaagttattgtcaggttttaaaaatcgtggatttcaaaaattaacaacgccggtcattgaatattcggatgtttttaagccactgaatcctgatgactatcgaccttaccaaatgttggatgagcagggagaaacgttggttcttcgaccggacctaacattacccgtggctcgggtaatgagcgccacaggtcttaatttaccggttaaatggtattacggtggggatgtttttcgtttgaagaagcgcttatcaggtagttataaccaactatcgcaagctggaattgaaattgtaggttacgagggggtgcgagctgaatgggaatgtttgtcggtggcattatccgaatgccaaagacttggtattcccaatgtgaccttgcagcttagtgaagcagggtttgtggatgcggttatcagtcaattggcgattccacagccaactagggagagcctgaaacaggctttatatgcaaaagatcttagcgactataatcgtctttgccaaccattagctgaaactgaatttagcgagtttttacgggaatggccatggttgtttggcagctttgaccaggttatggaagtggttaaaacgttaccggataatgaaagtttaaaacggatgattcatgatttaacgactactcaacaatttgttaacaaccaatttccggattatcgggtgacggttgacttaagcattccttcaccgcaagtttattacacaggaatggtctttcgcggtttcacggagcaatcagctgactatttgtttagtgggggccgttatgatgacttattaactaattttcagcaagtgaaggtaccggcagttggagtcgcatttgaaattgatgcattggtccagcgagtcccggttcccgaaagcggacctcagactttaatctattttgacgatgaacagtggccacaagcggagcagttactccataaacttgggaatgcaacgctatgcttaactcataattttgaagctgctaaacggttggcagctagtacgaacagtaagttgttggacttaacgaaaagaaggtaatcttatgaaaccaattaaaattgcgttgactaagggtcgaactgaacaacaggttataccgttgcttgaagccagtgggattgattgcagcggtcttcgaagtaaaggaaggcgtcttatttttgacgatgacccacgctacgagattattctggtaaagggtcctgatgtcttaacttatctgaacagcggttcggttcaaattgggatcgtcggtagtgatgtattggatgaacagggaaatcgtcagtatgcgatgttaaatctaagtgttggtaaatgccgctttgtcctcgcatcaactgaagactttgatccgcaacaacaacgccgaaagatcattgccactaaatatcccaatattaccaaacgatattttcaaagcattggtgaggacgtcgaaatcattaaaatcgaaggctctgtcgaattagcaccattaattgggttggctgatgcgattgtcgatattgtcgaaaccggtaatacgttgaaagaaaacaatttacacgtctatgcaaaattgcagccggtgaatacaaaattggttgttaatcggctggcacttaggcaatcacaagtcccgattaaatcgttaattaccagtttacagacggcggataggcaaattaaacaatttgaaatgaatggagagtggacgagatgagaacagcaacgattaatcgcaacaccagtgaaacaaaaattcaattaagtttaaatcttgatgacccttctaaaacgcaaattgacacgggaattggtttctttgatcacatgctggctgcttttgccaaacatggccgctttggtctaattgtgaaagctgatggtgatttagcggttgatccgcatcacacaaccgaagatgttggcattgccctggggctcgcattaaaacaagccttaggaaataaagccggtattgaacgatttggatcagccttgattccactcgatgaaacactaagccgagtagttattgatttatccggtcgcgcctatttggtttttaaagccgagttttctaatgatcaccttggcggctatgatacggaagtaacggaagatttttttcaggcgtttgcttttaacgctgatctgaatcttcatgcggaagttttatatgggcgcaatactcatcataaaattgaaacattatttaaagcgctgggtcgagcactccgagcggctgtgactattaatccggagattaaggggattccatcgaccaagggggttatctgatgattattgtgattgattatgacaccggtaatacacgaaacgtcaagaaagcgttggattttcttggtgtttcaaatcaactttcagcggatcctgccaagattctagcagcggatggattgattcttcccggcgtaggtgctttttcaaaagcgatggatgccttaatcagtcgcggcttggttccggtgatccagcaggccgctagacagggagtcccaattcttggcatttgtctgggcatgcagttgttatttgagcgaagttttgagtttggtcaaagacctggtctatcaattatgaatgggcaggtagttccaattcctgatcagttgggcgtcaaggtgccgcacatgggatgggatcaaaatcaagtgactcgccctgatcccatagccgatccttttgatcagcaatttacttattttgttcactcctactatgttgaaactggtccagaaaatattctggcaactgtcgattatggtgttcggcttcctagtgtcgtccgacgaaagaatgtgatcggaattcaattccatcccgaaaaaagtggtgacgttggtttggctgggttaacgaaatttaaggagttgattgatcatgcagattattcccgcaattgatttaaaagaacaacagagcgttcgactttatcagggtgattttaaccgaacaacaattattaatgcttcaccgctggcccaagcgcttgcaattgaaaaagctggattgaccaggcttcatttggttgatttggatggcgccaagtctgggcgaccgattaatcgagatgtgattgaacaaatttgccgtcaaacaaatttacaagtcgaggttggcggtggcattcgctctctctcacaaattaatgcatatttaacttcaggtgtgaatcgagtgattttgggatctgccgcgttaaataatcctcagctggttcaacaagctattcaccagtttggtgccgatcaaattgttgttggtattgatggcaaagatggcctagtggcagtttccggttggttagaacagagttccgtttcaatggctgaattaatggcatcaatggttgcatttggtgtcaagacatttattgtgaccgatatttcgcgtgatggtactttaaatgggccaaatattgatcttcttaaaggacttcaacaaaaatattctcaaagtacggtgattgcttcaggtggcattcgtagcataactgatttggattgcttagccagggcagacattaaagctgccattattggcaaggcaatggcaactggtgacctgccattggcgagattagcggaggtggctgaagatgttggctaaacgaattattccgtgtctggatgttgatcatggtcgcgtgaaaaaaggcgttaattttgttaatcttcaagatgttggtgatcctactgcaattgcgtcagcttatcaaaaacagggtgccgatgaaatagtttttttggatattactgcgactaatgaacatcgaaaagccattattgaaacgattgaaaaagtagctggccaagttttcatgccattaaccgttggtggtgggattcatacagtttcagatatgatggcattattgaaagccggcgcggataaaactgcggtaaattcagcagcggttgataacccgaatttgattacgaaaggcgctgaaaaatttggccgtcaatgtatcgtattggcgattgatgcaaaatttaacgccgatactaatcagtatgatgtttatgttaacggcggccgtaaaaagacgacattaaatgccattgagtgggccaagcagggcgttgattttggagcaggtgaattgctggtgaccagtatggatcgggacggaacgaaaagcgggtatgaccttaatctatatcaacagctgagtcgagccgtctcggttccaattattgcgtctggaggctgtggacaggttagcgatttcactaatttgttccagcaaacaactgttgatggtgccctggccgcctcagtttttcattttggcgagctcaaaatctcgacggttaaagaccaattgcgaaaagatggggtgattattcgatgaagccggattttgcaaaatatcccgatcgacttgtcccgacaattgtcgtggataatcgaacggatcaagtcctgatgatggcctatgttaatgaagaaagttttcagttaagcatgcaaaccaggcagacttggttttggtcccgaagccgtcatgagttgtggcataaaggtgaaacgagtggtaacacgcaagcaatcgtttcagttcaaatcgattgcgatgccgatacgctgttgatgaaagttattcccgctggccctgcctgtcatacaggtcatatgagctgtttttatcggaccttgtgattgttaaacaacagtgattaaatgactgcggcaatgattggcgagataacgttttcggtggcttcagtcagcgtaaagtaacctgattcgggctgaccaggaactgatcctgccaaaaaagaatttaggaggcataaatatgacagaggaaaaacaagacttggatgaattatatcaattaattatggatcgtaagcgcaatccaattaagggttcttatacggactatctgtttactaaaggattagataaaatattaaagaaggttggtgaggaatcaactgaagttgttgtggcggccaaaaatgaatcggacccggcatttattttagaggttgctgatctagcctatcacgtactggttttactagcagaacggggaatcactgttgatcagattaagaaagaattagctggtcgcgaaggcaaaatgagcaaaacaaaggaacgcgatgacattgaaagatggtaattgtcttaacaaatattgattaatcagttaactggaaggagcacgtgcggcatcaatgatcatcatttaattactatgttaaagaattgatttaaaccggtatccattcgatccgaagtgatgatagactagttaaataaaaagatattatttggaggcttacctatggtcaaagaaactgtcaaacacttaaatccttatgttcctgagccaacattatctgagcttaagaagcaacacgggcttgccaaattggttcgattatcggctaacgaaaacgcgtttggtacctcgcccgaagtaacagacgccttggataaatggcattttgccagtgctaatttgtatccggacagtaacgctgaacaacttcggtccaacattgccacccattttaacattagccctgatagtctcatttttggaaatgggttggatgagatcattgagttgttatgccgggtaattttggagcctggtgatgaagtgattgatccagctttgaccttttcagagtatcggttgcattcagaaattgagggtgcgacaattaaacctgcgccgcttgataaggccggcttcattagtttagcagctgttagccgtctggtaacggatcgaactaagatcatctggttgtgtaatcccaacaatccaaccggaacactgattgaacctgccgtgattgaaacctttttaaataatcttcctactgaaattacggtggttgttgatgaagcttatattgatttttctgaaaatggtcatgcctcagtgatggcattaacaaaacagtttaataatcttgttgttttacgaaccttttcaaaagcttacggtttagcaaatttcagagtgggttttgcagtttgttccgagccgttaatgggatacttacaggcggttcgcctaccgtataacttgagtacttttgccgaaattgccgcaacagctgctttccgagatcaaacatttgttgaacagactgtcgaaacggtaatcaatgaacggaaaaagtgggagcattttttgatggaaattgggttaccattttatgattcagcagctaatttcattttctttcaggtcaatcgtggcaatgcagatgatctttataacgagctcctacaaaatggctacttagttcgaaatggtttaaaaccgggatggttacgcgtcacaattgggaagccagcggataatttggcagttcaagccttaattgccggttggtgtcattctcttgattaggtagaatcagccccgcaacttagcatatttttagtggtaatcattatcagaatgagttagtataaagtttactggaaattacgaccttcaactcgtggattctccagaatctaattgaaatgatggtggttttatgcaagacaacagtcaaactcgagtcgttgttggaatgagtggtggtgtcgattcttcagtcgtcgcttatctgcttaaacaacaaggctatgatgtgattggcgttttcatgaagaattgggatgatactgatgaaaacggcgtatgtactgcgactgaagactataaagatgttgctaaagtcgctaataagatcggcatcccgtactattctgttaactttgagaaggaatactgggatcgcgtgttcacatatttcttggatgagtataaaaagggcagaacacccgatccagacgtaatttgtaataaggaaatcaagttcaaagcatttcttgactacgctttggaactaggtgctgattacatcgcaaccgggcactacgcgcagctgacacgtgatgaagatggtcataaccatctattgcgggctgttgatggcaataaagatcaaacttactttttgagtcagttatctgctgatcagttggatagagtaatgtttccaattggtaatctggttaagccggaggttcgccagattgctcggaaagcaggtttggcgactgctgacaaaaaggactcagttggcatttgttttatcggcgagaagaactttaaaaactttttaggccattatctccctgcaactccaggtaagatgatgactgtgaatggcgatgttaaaggacaacatgatggcttgatgtactacacaattggtcagcgccgaggccttggaattggtggcgatggcattgataatcaaccatggtttgtagttggcaaagatcttaagaagaatatcttatacgttggcaagggttatcataacccaatgctgtacgccgattatttagatgcttccgatattcattgggttaataatctggaccgcggtcaagacttccactgcacggctaagtttagatatcgtcaaaaggataccggtgtcaccgttcatattagtgatgatggcaagtctgtccgagtcgatttcgataatccggttcgggcaattacgccaggccaagcggttgttttttatgatggcgaggagtgtttgggatccgccatcattgatgctgcttacaagcaagccaaggagttacagtacgtataaatcagggcctttttgaaccgtactggaaatcgtttattagcggtatcactaaaagaaaaatctgcttaattaatttaaagtgattaatttaaaaattgaatattaagtcaaggggctggacaatggttagttgtctcggctcctttttgtatggggaaaattggcaatcgttagaaaatcacttttcatatagtagaaaatttgtggctggaaagtgtttaaattaaaagaaaacttcgtttaagtaagaatcatcagctgcaaatatccggcaatggaaataaagctgagataaagagtggtcgataatttgggaaagggttaattaaacttggcatcactttgaaaattttgaaattcgatcattttcctgtcataatatattaagtgaaaatagttttgggagggacagaattgaccaaattatactttatccgtcatggaaagaccgagtggaatcttgaaagccgttatcaaggcgctggcggtgattcaccgctactttcccaaagctatgacgagatgaatcaactagcccaacacatcaaaacggttaaattcagccatatttacgccagtccaattaaacgagctcgactaacggcagtgacgattgctcggcagcttaagagacgaccaccaatctctttactgtcccgcttggaagagttcaatcttggaaaaatggaagggatgaagtttgacgatgttaaacgactttatcccgaagaatttgataattttcgaaatcatccggatttgtatcaatcaaaagtgattggtggggaaagctattcggatgtgattaatcggatgacgccggctgttctttcgatcgttcagaataatccggatgataatgtgatggttgttagccatggcgccgctcttaatgctgagatgaaccatctgttgggaacgccattggcagatttacgtaaacgaggcgggttagccaataccagcacgacgattttggaaagcaccgatggcaaaatatttaaattgcttaagtggaatgatacaagctatttgaaccggaagttagacaaaactgatttagtttaggtgacgatcatgaaaaaaaataattcagataaaataaaaaagctacaagaaaaaaatcagcaaaatcaacgtgattatacaaagaagcgggagcaagaagagcagcaagctcatcaagtgattcatcagttgatccaaaaaattgatcgtcaaccgaataactttcataattattatgatttagcaacgtttttagtggaagctaaggattatcagcaagctgaagagttattaatgaaagccttgggaatttttgacaacgattctgatgatgtcaaggacactttaaaatttggcttaggcaacgtctattatgccgctgaagaatatgataaggcgattaaaacatttcaacagattaatgatgataagcttcaaagtgaggcttatattatgttggcccaaagttatatggctaagggtgataataagcgtgcgatggtatttgcactctctgctcagagtaccaaacatgatgacccgaccgttaatcaaatgattggtgataatttgttggcgcttggaaattttaaacaggctggtgagttttatgatattgtgttaaaccatgagcctaaagacggaaaagctaattttaatcgaggcttggtcgccatggttgacgatgagccatttgaacgctattttcagacagctaaagaaagcgacccggactattttcagaaagggcaacaaaaattgaaagatattgaaaaatttattcagttaaataaaaaagaaaaccaccactaacaagtttgatggtgggcaagatataattatctccaaaataggtaagaatggtgatcttaaagattatcatttgtgagttgccagaaaaagcaagggggatcgcgatggatcagtctatggaattgttggagtctgagcaaaatgaagctcaatatgttgatggtcgattaaaagcgatctttttttccagtcccgacagtttttataaagttattttagttgaaatttcaaaaacaaatattaattggccagaagaagaaattgtcgtcactggtaattttggtgatttgattgaagaaaacagttaccattttaccggcaaattaattaatcatcctcgttatggtaagcaatttcaagcaactaattacaccagcttaatcgcaacgactaaagatggggttgtaaagtatctttcgggagatcagtttccaggaattgggagaaaaactgcggaacgcattgtcgacgttttgggcgaagatgctttggacaagattagttccgatggtcgagttcttgatcgggttccgattagtaaaaaacagaaagatgcgattgttgataatcttcaggttgatgatagtctggaaaaagtaatcgttgggttaaacagctatggcttttccagtcagattgcttcagcaatttatcagcgataccatgaagatgccttaaaaattatttctgaaaatccttatcaattggttgaagatattgacgggatcagctttcgtaaagcagattcaattgcgctgagattaggtgttgttccagactctgatgagcgagttcgggctgccttgctgtatgccattgatgagttatgtatccaaaatggggatacgtatacaactactgagccattgattgccacagcgacaaccgttttggaagggaatgctgctccccgaatctccggggagaaacttgccggcggcttgattgaattggcaaaggaaaataaggtgattggtcagggtaatcgaatctatttggcacggttgtatgaagcagaagttcagattgccgaacatctaaatcggattattaagaatgctgatgacaattggctttcagatgataaaattgatcagcaaattcgacttgttgaaaagcaatttgatattatctatgatgattctcaagttgcggccattcagcaggcaattaaatctcaagtttttatcttaaccggtggcccgggaactgggaagacaacgattattaatggaatcgttaatagctttgccaggctccatgattattcacttgacgttaacgcctataaaagtaaacctttccccattgttttggctgcgcccacaggacgggctgctaaacatatgtcggagtcaactggattgccagccagtacgattcaccggctgttgggattgaacggtcatgaatcaaataacgcctcaccaactaaagatattgatggtaagttgttaattattgatgagatgtcgatggttgatacgtatctatttaaaacgcttgtcagggcaattcccaatcatatgcaaattgttctggtgggtgatcaagatcagttgccttcagtcgggcccggacaggtttttcatgatttgttgaagtctcaacaaattccggccatgcaattagacacaatttatcggcaagaaaaggggtccaccattatccagttagctcatgaaattcataatggtcgactcccggttgcgtttgccaagaaccaagcggatcgatcctttattccttgtagcgagtatcaagtaccatcggtgattgaacaagtcactcaacgggcccgtcaaaagggttttgatctgatggatgttcaagttctggcaccgatgtatcgggggaaagctggggtgaataacctcaacgatgtggttcaaaacgtttggcaggatcagccagctaaaaaatttgtaactatccgcgatcatatgtaccgaattggtgataaagttcttcaattggtgaataatcccgagcaaaatgtgtttaacggtgatattggtatcatcgttggaatggagactgttaaggggcaaaaaacaccgactaaaatcacaattgattttgatgaaactgaagtaacttatgaaaaaaacgaatggattcaattcactttggcctactgtacatcaatccataaggcccagggtagcgaattcaaaatggttatcctaccaattgtgcggcaatattcgcgaatgcttcaacgtaatttgttgtacacagcggtcactcgtgcaagtgacttcttaattatgctgggtgaacaggttgcctttgagcaatgtgtaaaaagtgtttctgttaaccgaaagacgagtttggttgaacgactgacagaaacaattagagttcaggcaagcccagatgttgctgatgataactcagctggaaccggcgaacagtcggtagatcacgaggtttcgaaggctaaagctgtgcccgataaagtttccgaaaagcaaccggattatttgaccgttgcggctattaattcggatttaattgatccaatgattggcatgggtgataccagccctaaagattttatgtaggtcaaccatttcctataaaatcacggtataattatggtaatatttagttaaacaaacaatccttggagggaatcatggccgaattaaaatcgcatcctaaacttaaacttttttcgcttaattcgaaccgttatttggcagaagcaattagtaaagcagtgggcgtaccgcttagcaaagcaactgtcgaaaaattcagtgacgatgaaattaaaattagtgttgatgaaagtattcgtggtgatgaagtctatattatccaatcgatttctgaaccagtgaattcgaatctaatggaattattaatcatggtcgatgctgttcgtcgggcaagtgccaagtcaattaatgttgttattccttattatgggtactccagagcagatcgtaaggcccgctcccgtgaaccaattactgcaaaattggttgcatcgttcttggagatggatggcgttgatcgagtggtaacccttgatttacatgctgaccaaattcaaggattcttcgatattccggttgatcacttgagagcgaatactttgctggctaattactttatcaagacgcatgatggagataatttggtggttgtttctccagatcataccggggtttcgcgggctcgaaagttcgctgaactactcgatgcaccgattgcaatcattgataatcgatcgcctgaagatgccactaccgtccctgaatcagttattggtaatgtgaaggggagacgggctattattgttgatgacatgatcgacactgcctttaagttgacgattgcggctgaaactttaaagaaggctggggcaaccgaggtatttgccattgcaactcacgcagtgttctccggagatgcgcaaaagcgactacaggattcggcaattaagaaagtgattgtcactgactcaatcagcatttcaaaagaggatcgatttgataagcttgaggtcgtatcagttggtgatttgttcggtcaagcaatcacgttgattcataatcagcaatcagtaggtaaattatttggtagataaaatttaacgtaaaggaatggtgatttaatttatgtataaggcaaatgacgatcggtatgaaaacgcagttgtaagaagagcgggaaattctggacttcaattacctgcattatcatttggcatgtggcacagttttggcgatgacgctaattacggtgacagtgagaaagtcattttgaaggcctttgatctcggactctttagctttgatttggcttacaattacggtcccggttcaggtgctgccgaaagaatgtttggtgaagtttatcgagcaaacttgaagccttatcgtaatgaattggtgatcaccactaaagcaggctataatctttggcctgggccatacggtaacttttcatcaaagaagacgttggttaatgctttggatggcagtttaaaacggatgggccttgactatgttgatatttattacagtcatcggtttgaccctaatacaagtcttgaagaaactgccaatgcgcttgatggcattgtccgatccggtaaagcattgtatattggaatttcaaattataatgcacaacaaaccaaagaaatttctaaatatttcaaagaactgcacaccccatttgttgtcaatcaggcatcttataacatgctcaatcgtggggttgaagacgatggattgatcaagacgctgcacgatgataataaagctctgattgcatatggaccactggctgaaggtttattaaccgataaataccttggtggtatgagtgaggatgttaaggttcattggagtaacgagtatgtcatcaagcatggtaaggacgaattggtaaagaaactaaatcagttgaatgatttagcaaagaatcgaaaccagacgttggcacaaatggcgcttgcatggttattacatgataagactgtcgccagtgttgtgaccggggcttcaaaagtggctcatctagaagataatttgggtgccttgaagaacatgacttttaccagtgatgaattaactgaaattgataaaattgtgaaaaaatagaattcttttagcgttaaccgactttaaccgtttggataacgctttcaaaaaaatggcattaaattggtttttaaccagtttagtgctttttctttggtataattagttggagtgaaactatgccttgaatggagaaaaacgatgacaaaaaaagtaacaattaccgatttagctaaacgagccaatgtttcggtaacaaccgtttcacaaattctgaacggcaaagatgaccgatttagtagcaaaaccgttaagaaagtgcgtcaactacagaaagaaatgggatatgcacctgattttaatgcccagagtttaattcgtcgaagcggtcgaacaattggtgtcttggttcccaacattaacaatccattctttagccgatttttacgcgggatcgaatcggaggccatggcacatgactatattccgcttatttttggctctaacaacaaccaaaagcttgagagccactatttatttgaatcaattagaagagccgcagacgggatgataattgcctctgcgatctctgatttgagttacatcgataatattctgacacaaaatggtattccgtatctattgattgatcaagctcctgttgtaaagggagataaggttgatgtaaataatcgtctgggtggcgcattattggcaaactatctgattaaaaaaggtcatcaacgagttgttgtggttgctgatgagaatccaaccttgaatatggaagagcggttaaatgggtttttggaaacttatcggaaagcaggcattccggttaatgatgatcaaattgttaaaacaacattgactaaggacggtggctatcaagcaaccaaccaagctttgctgcagaagccaactgcgatctttgccattaacgatgaaattgcaattggtttataccgtggtatccatgaagctggtcttacaattccggatgacatatcaattgttggttatgatgatattgatttggcggaatatattacgcctaagttaaccactgttcaccaaccggcatttgaaatggggacgaccgctgctcagttaattattaaacgaattgaaaatcaatccgagccaatccaaagggtctcattaccggtaaaattagttgaacgtcaaagtgttgaaagaaagatagattagataattttgaccggctatcttgtaaaaccctttcatttttgctaaactcttagtgaaaggttttaataaaggacacttagggatttcagaggagtttatcatgacaaataaagttgttgtacttggaagtttaaatgttgatacgaccttgcatattgcgcagatgcctaaaccaggtgaaaccattagcgctcaaagtaaaacgaactctgcaggtggtaagggtgccaatcaagcggtagctgcagcgcggtcaaatgctgtgacgagttttatcggtcaagttggcaatgatagtgctggtaagtttatggttaaggcgcttgaggacgacgggattaatactgatcatattaaagttgaccacgaaaacggaactggctcagccgttattttattggatgagcagggtcaaaatagtattatggtatatggcggtgccaatcaggccatgaaacctgacatggtggcagactgtgaggatttgattaagcatgcggatattttaatatcagaatttgaaacacctcaacaagtaacatacgaggcttttaaaatggccaaacattatggcgtgacaactattttaaatccggcaccggcatcaacaattattgatgggttgcttgaagtaactgatttaattgttcctaatgaaactgaaagtgcaacgctaacgggtatcgaagtaactgatacagcctcgatggataaaaatgctgataaatttactaaaatgggtatcaaaaatttaatcatcactgttggtgatcggggtgcttactaccatacaccaaatgacagtggttttgttccagcatttaaagttcatgccaaagatacaactgcagctggggatacatttattggtgcattgagttcacagcttaaaaaagatttgtcaaacattgaagaggcgcttgtatacgctcaaagagcatcatccattactgttcaacggttaggagcgcttccttctattccgacagctaaagaaattgctgatcaatccaaataatagttattgttatgattagttatttttgttaactttagttattttctagtaaagtgttgatttactaaattttatctggtagtatatccagtcgttagcaggaatgttcaactggttattaacatttctgcgtcagcgtgttatattctattaaatgatttttctattaacgttcaaaggagtttatagctatgagtaataagttagaaattcttagagaataccagcaggcatcctcaaagctagatcaattaaagtctcaggaagcacaaatcattcattccgacgaccctaaggaaaccaaggatacagtggttattaggccacaatttggtaacgagatgcatcatcttaatgaagaatgtatgcagcttaatatgatcttggaagcaatggatgcttctgaagattaatctacgcattagtttagaatcaaaaagttatctacttaagtaaagaaagagaggagctagacaaaagtaattttgtccagccccatttttgtaatcacgactattaccaagcaaaaacgtgagacaaaaggcaacttcctaccgtacaaccgaattatcccactaatccacccgggatattgggataatccaattgtactctggaagttaaccgccctttgtctcactctggctttgttattatcatgatagtggtgtgacgattatgtaatcgggaagatctgttgcataatttatcaattaacaagaatgcgtcaatccgacaaaaaagatatgttggattgacgcattcttgttttttaaaaataacttgaaagtagcgctgatgatactgctaccttgatctgattccgccccttcagagcttttagccattcgttggggaaggtcactggggcgtataaaagcgatgccagcatagaagtgattgagccaattgtatcggcatcattacctagattaactgctcacttaactgcaacaaaatattgctccgaattcattaaacaccaaaagacggcattcaaagtgtcaaccacgtatggtgaacttttaattttgttacttggttgtcgtaagaagctgggatcctctaattggtcaaaaaaggggatttcagcttcaaattcaggcttggtgcggtaatagtccaaagcttctttaacagcccttagcatggcgtatttgtttggattctgaatgacacgaatgatcacattcgttagaatcccggaagcaactagactacgtggatgtcgatgcgtggtagcagtgtattggtggattaaatcaactacttggtcattaaattgataacttcgataatcagttaggataaagaaagcgagcggcatcattcgcattagggcgccattaccattatccatttctgatttaccaccacacaggcttggtgacacacccgcgtcaaatcgttcaattgccatctgggttgttttcccgatatcaaaaggtttaccaaatggggtgtagtcaccaaaatgataccattgtgaatatctcgtcattaaatcatgtaagttaaatcccaaggttaagctaacaagagaagcaatcgataaagatgtatcatcagaccaagttccggctgggacgttaaaggtttgataaccaatcatggtattaattggattctccaataatttcgatcttttttcaaattgaaaagggacaccaagtgcatcacccaaagcaacagcagttagggattgaaatagtaggtagctcgtagaatacatgaaatttacctcgatttaatatctttaaagttggtggtaatttgaccaaaccatgctgctatttatttgatccagaaagggtatttggccgttccaaattcgagatcaaatgttttgtttcctaattcttcgccatcagtttgcccataacgcgaatcttctgttttcaagaatagctttttctcagtatagtgatggacaaagcgtaaatgcaaatgtctctttaaaaataacataactataaataaaatcaattggaaaatgttgggcttttcaaccacaatcaaatccaaagtatcatccaaaacagaggcatctggtgcaatcttgatgccaccgccaaaatatgggaggttcgtggtggttactaagtaagctttttggtatgtggtgggttgctgatcaggaacgcttaccgtgagtcggaaacctttaaaatgaattaatgtgttaaaaacggctgccatgtatgaaaatttgccaagagttgcgctgtccttaagcagtgaatggttggcatggtgaacaactgcggcatccaatccaataccaaaattgtttgtgaaatagccatctgtttgattatcgtgattgataaagcggccaattgtgataattgtcgctgaatgacagctgagaatttgagtgagtgcagattcccagtgcaaggggatttttaacgctcttgcaaaatcattacctgatccgacgggtaaaaaggcaattggaattttaggctgttgtggatgatccgcataataacgcatgcagccaaccattgtttcgtgaagggtcccatcgccaccagtggctacaattactgcattcgggtttgaaaccgcatttatcagatttaaagcccgtctggccaaagtaaccgcatgaccatcatgttcggtaattaatgtgcgataagcaatgtgttgtttatctagttcagtttcaatgtctggccatagtttttgaacgttatgggcacctgcttgtggatttacgataaaaaaatattccatttgaaaagaatctcccgtaaaagtgtctaaatctgacgttatttgaacggttctgatgtgaaacgtgtggtttgataaaatatgtaataaaagagcttgagtaccgaataatggaacatccgattctcaagcttttttggttggtaacaggaaagtagtcattttaaatggttacttctcattaccattcatgattagcattggtaaaatcattggatgacgttcagtcttggtgtacaagaactcttgtaaatcatcaataattgcgttgcgaatagaagattccgttgctttcttaccgtgcatcgcttttctgatcgtcttgaatactcgtcgtcggccttcatcaagtaactcgccagattcacgcatgtaaacaaaaccacgtgagaggatatcaggtcctgattgaatttcttgattatgcaaattgattgtggcaaccactaccacgataccttcctctgaaagtagttgtcggtcccgtaaaacaatgctacccacatcaccgatgccactaccatcaatataaacatcgccagctgtaaagtgaccagccattcgggcggtatctttggatagtgctaagacatcaccattttgcataataaaactgtggtccaatgggacaccacattgttcagcaagttccgtatggatctttaacattcgatactcaccgtgaatgggcataaaaaacttgggtttcatgagtcgtagcattaacttttgctcttcttgaccaccatggcccgaagtgtggatgttattaactcgaccatgaatgacatttgcgccagcttcttcaagtttgttgataacactgttaacactagttgtatttccgggaattggattacttgaaaagataactgtatctcccggttgaattgaaatctgacgatgcgtgccattagcgattctagaaagagccgccattggctcaccttgagatccggtacataggattaaagttttactggctggtagcgactggagttcatgagcatcgacgaaggcatcgtccgggatgtctagatagcccaactcacggccgttaacaattgctgcatccatactccgaccaaacacagcgatcttacgaccacgcgccaaggcattgtcacaagctgttttaattctcgaaatattagaagcgaaggttgcaaatatgatccgatcattgacattatcgaaaatatgagaaattgatttaccgacccatttttcggatttggtccagattggtttttcagcattggtgctatctgacattaagcagagaacaccttctgcacctaatcgcgccatttcctgaagatcaggcggctgattggtaactggtgtgaggtcaaacttataatcaccagtttcaacgataaccccaaccggtgtatgaactgcaacacctaaggtatcggggattgagtgggttgtcctaaaaaaggaaaccttggtttttcggaacttgatcacggttttatcactaataacatgaagctcaactgaattgagcagaccgtgttcttccaatttatttttaatgagtgccatcgctaatggtccagcataaattgggacatttaagactttcatcaaatatggcacaccaccaatatggtcctcgtgaccatgagtgatgaccaatgccttaattttgtccttattatcaactagatactgatagtctgggataacataatcaacgccgagcaagtcgtcttctgggaacttaatgccagcatcgattaaaattatttcatcttgaaactgaataccataggtatttttaccaatttcacctaaaccaccaacgccatagatagcagcctcgttatttttgacgtttaatttcttcatttattattgaactccgttaatttataatctggattttcttgttcatattccagatgttttccttgcaagggttcgatgaattcaatactgtaatcagtattatcatcaactaagccacgagcttcgacctctgtagcggcctcaaggtacagagattgggttgtttctcgacgtggattgcgcgtcttgtcgggttgatataaaaccttaaaaatcataaaaaaactcctttaaaaatatacttttttagaaacacgagggtttctttccggactagtggttgtgaaaacacaactaataacgatatcttaccataatataaaaaataagtatataaacttgatacgaaatacgaatccactctcatggtagaattaacttaacgaaaagaaatggagattgacttatggaattaatgattcaaattatcattggtttaattgctgcatttgccgtatacaatctaattcattatctatttgtgacccgcccaagcaggaaacgattattgttggcacaacgagtttcaaatgaggcagtggacgcatcgattaagcaactgattgacactaataaaattgcaacattgggtaatgatgatttaaagtctgagcttatagcggatgtctggggacggggcgttatggcttttgaataccacattccagttagcaaagtgcaaacttcaattcctaatttaaaacaactattgagtcagacgctggccgattatggcaatacacatcacatgcatgccagaatcaaggagaacgattcaccggtctttgttgtaaccgacatgtggcaactggatgatcgccttcattttgatgtggcatatttaattaatttaacgacgatcgagtatgttgatgacttaagcaggctgaagtaatgccactgactatcgatttggggacgagtatgtttttgggggggactcacagttattactgaacaaacaatgtaggataaaaaagtagttttcaaacaagagctgctttttgtcctacattttttgaatggttattataaatcatatagtgatgagagataatgattatctgttaactaactgagtaattaaagtaattaaagtttggattgtctcttgcgatagtcgagagccggttattttccggctttatatagttgctacccccaaaataagttgttggctcaatcgactctcccaagttaacagattcgaatcaaggcttttgactttttgcattattagcgtaactttcggcatacctgcgaatgttcagcatgacttaaatagtaaataaatatggttcattcagttatcgttgacataaaatttatcttaattagtttgcaatgtatttttgacagtttttcaaaacgagcatcaattgcgggaattaagtctgatttattgggcatcagttgttgagatgagcatagtggccattcggatttctgaaattgtccaaaccaatgaagttttatgattaaccagtttgatagtctacccaatcatcttaaacaggagaatcacaaataacgcaatttaaacaagaatatcgttacctattagataatccatttttaagtatttgatgattgtcgtaatatgtttaaatcttttagcgccagttatggacgtggggctgccgttcatgattattcaataggtgcacgctggtagccaaacgttgggaattccgaatggggatgctgattggtagttatttgtaacaaacagtaccagcaaaaaggacggggtttggcagcgttgccggctgcaaatatgaccttaattccattgagaattgttttatttacgataattttcaggcttttccaaatgaaatctgaatcaaacaggataaagcagctttgagtattattgaaaatggtagtgacgcattccgtttcaattgtgtggaaattaaattatttacttacaaaaagtgtgtaacggggtgttttttaaaactgcaaaactgattgggaaaactcaagtcggggttgcagacaaggatcactaattattagaataaaagcgaggagagctgacttccttctcgcttctacatacagtaatagtcgtgattacaaaaatggggctgagacaaaattggttgttcgtcaactgttgttggtgaattcaaatattaaagttctaatcatttcgtgattagggcttttttagtatgaatgcgcaaaacgtagagcacacgggttcggaaacgaaaaaaacca

SEQ ID NO: 459 - DNA, 42246 bp, Unknown
  Metagenome-assembled genome
ttgatttttcgacggactacaaacgtacctcatttagggacctgtgagtcattgtgaatgatgtggacgcgtcaattagtaattgtggctttagggaaaagctctgggattaggtgaacgtagccgcgtttagatcgacaagaaattggtttaagcgagctcgttctttggtgtgaggtactgcatgaagtagctctctgaggaacgccttacggcggcctacgagaattaacgactcgttattgatgatcgcaatcttgaaagataaaccgcatgcgcgatttttggtggaagacgtaaactcaactcaaaacgagattttcggtaagcgacaatacccgatatactgatcatttgcgctgcttgcggatatgctcgatttacggtacggggcagaaaccccgttttgtttagcaatcagtgtccgctgccatatgttatcatgaaagtcccatttttccccccccacacctactgattgccaacgttctggaaatttaggcgttaggcttacagcaatccgtattgcgaagtaatgattgaaccagcggtgtttacaaagaaaaaccgttgctttagtctaaccggagaattaataagtggaatctctgtgcgggataatatttaaataacggtcttatgaccgtctttacaagcaatcagcaaacccgcaatttgggacactgtgaaatctttttaagcaatttagcattgataaaaatgccggatgacgtgatatagccccggttgggttttagcatcagcctcgaagtgtgtggggggtcagttttaaaaccaactaaattaagataagcttgtcttgggacatcgtttttacttctttctatctgaattattggctaattcaatagtagggcgatgccctatttatatgcaaaaaaagattgataccttacggtatcaaccccaaaaattttagaccctaaaaatagacgccacacaaatctgcgtgagcgcctatttttacacatctgttctttcagatgattttcgcttattattcccggcagcctttttttcagcatccgtttgatcaggaatgataacggtaaaggtggttcccttgtgcggcttagaagccactgagatcttgccaccatgttgttgaacaagttggtggacaattgccaaccccaatccggattctccgtattttcgggctcttctggaggcatcagctttataatatcgttcaaaaatatttttttgttgttcctttgtcataccaattccagtatctttgatccgaataatcgtttcgttataaccgcgttcaccaattaaggtgattgtcccactgtctgtaaattgaatcgcattgtttgtgatattaaaaacaatttgaacaaaccgatcataatcagcgtatataggtaaatcgtccggagcttgaatctcaaaacgatcttttgattcggaagccttacttcctaattgttccacgatgctgctaagaaccttcgttgcattaaaatgtcttttttcaagtcgaatcgaattcgaacgaattttttcataatccaaattttcattaaccaatcgaataagccgctgagtttcattgctcattaaatcaatacttttcccccgctgttcctgaggaatgacatcatacttaattccctccaggatcccagagattgtcgttaacggcgttctcatttcatgagcagcatccgccagaaattcctggcgtcgttcttcctgccgctgaatttcttgattggccttttccaaagattccgtcatatggttaaaatccgtaatcaactcaccgatttcatcgtttccaccggatttgacccgaatatcataattaccattcgaaacctgggttgcagctgctcgaagcctactaattcgacgattcaagcgacttgcaataaagaaactgataatcatggaaataatcagagacacgcccagccccttcaaaaggtcccggttaattcggtcaacgtttgaattaacatccgaaacaaacacacctgcactcacgacagcaaccaatttcttattgtaataatatggttttaaaatctcgatcattgccggtctggttttaccattgcttaacttaaaatttcgattattgacttttctgacaatctggtcctttgttaaatgccgccaatcatttttagtaaccttgggtgataaaccattatttggataaataacctggtttttttgattgaataccgtaaaatgaacagattgattttccaaaagtgcctgcgccgtttttaaagtgctgagactgaaagttacttgttgactgctctttgtattaactgtcaatgactgctgaaccaaactatccgaatatttctccagacttcgccactcatcgttgtacacaaagcttttggacattcttccaaatgaaataccaagtaaaaggattgtcacggcaattaccagaaaaaaggccaataactgctgataaatcattttcatttctttttgtccacttcactatcgtcaaatttgtaaccaacaccccaaacggtttgaataacctgaggtccaacccgttcgattttctgacgtaattttttgatatgcgcatcgacggttcgctcatcgccataatactcatatccccaaaccagttccaataactgctcacgggagaatacctgacgcggtttctgagcaagtgcattcaataattcaaattcttttggcgttagttccggtattaattgaccatccaaatacgcttctcgagtattcgtattaagtttaaaatgctcagttgtaatttgatattcttttttctgtttctcttcagaatgctctggttcttcagcttgagcctctgtatgtgcccgacgctgtaaggctttaattcgggcaactagcgtgatgggtgaaaatggcttggtcacatagtcatccgcacccatctcaaagccaagcacctgatcactgtcagaatcacgagctgtcagcattatgattggaacggatttagatttagcacgaatttctttggcaacttccatgccgtccttttttggtaaattcaaatccaatgtgatcatgtcccaactttccggatcttcattgaacatgtcaacagcctcaataccatcatatgcaaaagaaacgtcccagccctctttttgaaagaacatcgacatcatctctgaaaccgatttgttatcttctatcattaacagtttcattgtctttcccccaactcctaatagctaatggcttctacatgaccttgaagccaatgcttttttaaatgattctccgagaccgattctaatcgcccagtccacggatcgttatagaaatatagtttcctgttaaaaccagtcagaacaattaagctggattttaaattattcagtccattgactcgcaatacaatcggtcgtcttctaagcaattgtttatctagttgcctcaaattgcccttatttaaatcccttatagagtgagtttccgaaataatcaaatcgcttaaaccgatcaaaccggtattcgttcgctgccatttttcaaccgcagcctttaaatcaggatatgaaatatcactcccggcatttcgaagcagcatcatcagtgctgcagattgattatcaatatctgcttgagtttcttgcttaatggcaggaacatccagtctacgaaaggtcttgcggatgtttcgtttaggcagccaccctgataggtcaccgtaagtaaagtgataccaaatttgtttattaaaaaaactaatttgatcaatcaaaaaatcctgggttttgatttcatctggaatcttaaccttactgctggtagtcgtaatttttggtccttcagtcgcaagataccagtgttctccagggattcttctaagtcgcacaaaaaaccgattggtcttttcattagcgatggtcgtcttctccattttttctcaccccatactatatctattttaccagaaaatggtcaacttgcttgaaaaggtccaagattgttatgataataaagtaacgtttctttttccacaaattaaaaaactaggatggttaaattcatgtataaaggaattgcatttttcgatctcgaccatacattattaaacgaacaaacaaaagttgatccagaagttgctgaagcaatgaaacaattgcgtcgcaacaatgttctaccagttatttccactggtagaaatatctttgaaatccctgaaatattagaaaaaacagaaattgatacagtcgtatccgcaaatggtgattatgttctttttgaaaacaaaccagtttatgaagcaattatcaagccggaaattgtaactaagtttatggattttgccaaatcaatgaacgaatcaacaaccgtgatgaataatttaggagccgcaatcaactttgtgacggacgacacaaaaaacaactaccaatctattaatactcgaattccacctttgggcgcagaagatttcgtcaagcaacacccaatttatatgatggttgtcaacaccgttggtcacgatcaaaaatatattgatacatttgatgatacactgactttctatcgaaatacaccgtttagtatggatgtcgtcgttaaaaacggttcaaaaaaacgcggcatccaggaacttatttcaaacgcaggattaaacggcattcccacttacggatttggtgacggtaataacgatgtgccaatgctccaatatgtcgatcatccggttgttatgggcaacggtttgccacatgttaaagaatatgcagagtttatcaccactaataatacagatcacggcattgtaaatggcctcaagcactatgatctaatctaattacttctaactaatttgaatgtatgatacaatactattgtatctatacggggtcgttaaggattcgacgggtataggtcgagcttggattgcgtttcgtgcggcgtcacgtaaaaacgcccagtttaaattataactgcaaaaaataataacaattcttacgctttagctgcctaataagcgcttaacgtagatcctcccaatctcgcccatgggttggatctgggtcttaaatttagtgggctcacgcagttggctcccacctgaagtcaactgaagagattaatcaggttagccatttatgggtgccttgatttgcggcgttttaaatggtgaattccaaatagtagatctatgaacgtagatatctaggtggcgatatgctcggacgcgggttcgactcccgccgactccattgatagggtttcatgaggggctgtcgagtgttaaaatactggtacaatgatattcttgactttctcgattgttatctaacgtcggtaaaaacaacttatgtggaaactaatacgtttccgtcaacgtcttaaaagagccaatactccagagtttctgggatattggttcttttgcttaaatgtactggagggacttacaatgaatgcaattatttttcacggatcggcacctcatgccacagcaaataaattttggtaccaaaatatctctaatagtttaatcaatcatggtatttcaagtattgtagttaacttaccccaacttgaccaagaacctttaactgacacgttggaaaagattaataaaatggatttagaatttaccaaagatacaattttaattggacattctgcaggaacaaatattatcttcgctttattagaacaacatttagaaacgcctgtaagagccgtttatttaatagcaggttatagtcagcctaacggcatgaaacacactaccctaaaagagtcttacgactggactaccgtcaaaaacaatgcaaaggaattcttcatactaaattcctttaacgatccttttaagtgcgatgaaaaacaaggtaaagttttatttgatcatttgggtgacacgctcattttacgtaacgacggtcattttatgcaaaaacaccaaccattgttgcttactttattgaatcaatattaatcaaaatgttacaagctgttgctcagaccaattctattgtttgagtaacaacttgtataaaacaacaaactaacttcaaaaaaatcaaagcatttcaacacatgaaccgaaacaccaacctacaaaattaacccgagtttcaattccttctttagtgaaactttcgttagtcgttgtagctacttacttctccttgatatcgatttttcgacggataggcacagccactttaccatcaaacgctgaattgagtaactaatcaagtcggaaacaattgcccttatttaaaaaaaatacaaagtccagcttcttttgacattaactcattgggattttaacagcattctggtatacttaaacaaatttatagaagatggtgatgtgtagtgccgagaaataactttgatactcaagaagcttttgctgaaaagaccgtggatatggtcctaaatcatttaaaagaaatacgacaaaaacgacccaatagtgattttatacttttagatgataagaattttatgattgatgatttaaatactgtcggttccttaatctctttaaatcttattaacaataagggaatgcgatgtgaacggttagtggccccggaagctttctcaattactatagaagaacttcgaaagcgataatggaacagaggcatattctgcctaacagcattagtaaactgctaagtgccaaagaagccctgtttaaataaagatagtaatgacaaaaacgcccacctgtcaaaaaggatgggcgttttggctttttaaactatttaaacttagtaaaaatgacaaatttcttattagccgtaatgtaacggtcatttaacaactggtatctcgtagtatatttgtacttaacgattttttttacttttaatatttgtccctttttaaaatgcctgatttctccggtgagtgcacgtttcctgtatgagtttattccatttgggttaataattttgatctttttatttgcgggcagagtcgcataataagcagggatgacatatttaacgctagaagtaatgtatccagaggttcctttaatataccgcttagcatacggactatattgttggacgcgataccttaatttgccagacttatcccgtttatatcctttaacaacaaactccggacgattaattcgtacggctcttttgtaatacttaatacgatttctcttggaaaaatcaccttttttataaagtccaatcgtatttactgcatatacagcttgaccttttgcgactacataatttggaatgtcagaatccgaaacttggactggacgtgttgtcggcactgttggggttgtcggggttgtcggcgctgttggtgtcgtcggcgctgttggggttgttggcgtcgttggcaccgttggcaccgttggcgtcgttggcaccgttggcaccgttggcaccgttggcgtcgtcggggttgtcggcactgttggtgtcgactcctttttatagtaataatttacaatgacattcttagcaccaattttccccaccttttcgccatcgaccgaaatgaatgtatatcccggtacatctacttgttcggttttataattatcaccaaaatagccggtaataattttagattctgcaattttgttatgactttcatcaaggtaattgacggttacaggcctacccaatacattaatcgttaattgaccattaaaatttatatccttatttggttgcttgttataggggcttggatcactcataatttttttccagtttacttccaattttgtatttggatcagcgttgtgccaaataatttcatttttaccttgatcatagctaccgttgttagtcgcggttatgccatcagtcagtgaaattctattcccttgatcatcaaaaatatacaacggattttttaaaacaatgtcgccattttcctccaattgtgcttctgcaaatgccgtattgttattaaatccccaaaacccattttggtaaagagaaagattagaatattgttgagaaaagccataccatggcgaaatatccgtaaaatgctgatgagtaaaccctaaataaacgacatgtaactttccaaggtcttctcgtgtactcaactgttgcttaatctgatttaacgtttgtgacaaatcattaaaaccattattatcatactgggtagtaagctgatggtaactgttacttaggtttgagtttaaataacttaaatccggaaaaagcacttttgtattcctaaacgttaagaacccgatactaaacataccgttgaagaattctaatccttgcaatgaagatactggattagtaatatcaatgtttatataacgattattctttgccacttctttagtaatatcctctaatgtggcatcttttggaagctgggatgttttctttagataggctaaaatatcctgttgtaagcccttatcaggcatccaagaatctaatgtttccctagattctactatttgtgaacttcttgtaccggtttctgggctcgtgctggctttagacccttgttgcaaaaaacttactcccaaagcaattgtcaatgccaataaactatattcgaattttttcatacatgtacccctcaagtatcaaaatcgataaacttttgctacctaatagttaccttgtttatagtattttaccatgttaactaatttcccactatcaacatgcctctctacttacaacacctataattcttagcgaatactataatttgcgaatacatgtacttattatgtggtagctaatcgataagggaaaatttacatcaaaaacttgtcatcccttcgacacattaatatgcagttccttaaaaacctctgatgttgattttgtaatcagatttgcattcaactcatcaaattgtttctgggcaagtacagcgttcgcttggttgctggcagttaaataggtttgcaaatccgctgtcttggcaattgcactggattgtttatcgctattctttaaatgacgcagaagttgtcgattaacctttctttgaatgggacgaatatagcggttagtaaaactatttggataaggctgtgccaaaactcccgttaatttgtatgtccaaaaagcggatttcgaatcatacctatcagttccaatttgataagtcaccggtgtgttattaatatccgtgtaaaacggaacataaacactagtgtctggagaagccattgccaaccattgaatacctgaaatggccttagcaacatgtggcctaatttgaagaatgtgtgattcatcattcattggcatgttaatcggtcgaaatttattaagccatcgaccttttgaatcatacttggtatttgtaaaatgactagccaaaacttgaccaactttttgaactgtaatttttttatcggatttcataaacatctgaaaacttctctgatctgggctctgctttttacttggtgttaaaattctttgaccgtcccaaattcgaggattattttcctgccgatcggctttgttgctggttccaaatgctttagcaaagttaacagtccctttactgtagccaagtaacttatgctttcgtacaaaagaaacgagatgcttggaagctaaatacttcttatggttttttaatctcaatcgtcctattctcaattgattgggaatgatcgcgtatctgttagcaggcagcctaaccgcagcccattgatgacccgctccgatttccatataccacacttcatttttatcagaaaaaataataccgtcggactctgcggcaccactctttctaataatgttccccattctgatcactccttgacgagcagaatgaatataaggtaataccacatcgagcatggcatcttcactgatccccctttttacgaatggatccgccttaatggccttcctatttgaatctgttgattcagtcgcgctcattgcaacgttactttcgttaatgccatcctctccgtattgaccatgtttttgtgtccagtccggagttgatgtgtatctttgatggattttaggaagccgaatggtaaattgatttcctttcgaaacgtaggttgtttgaccagtatccgtatgtgcatggacaataaaatgctttgcccaatttgttgagttatcttcatttctggcaataatcgttgaaccatctttagttgccttagagccgactatcacagttgtacaagctgatgcttttaaagctccagcaaaaaaagttaatgatgtcagtgctccaatgatgattttttcatataatttcatatattctcccaccttcaataaattattgtttgttttcccgttgtgaatcaatcatgaaatcaacgtctactaattgaaatatcgctattagattatctctaatcaattttattgagttgagggcacaagctcccatccctggagataagtaaacatccacttgaatgtgcatcccctttttaaaaataaatatttttttacagtttgacacgtgcttcgacacaatggcttctattgtgtgtttggtcggcccagccggcagttctgcgcccagtatctccttaaccgactgaatcataaaaccaattggctgcccaataaacattaggacaattatgatagtaatgaagaagtcaccggtatatagcaaaaatgataagggtgatccgcttggaataaacaccagcagcattgctacaaaagcaataccgatagacatcatgacatcgataaaactatttttagattcgacagtcagtatttcgcttgctcctttcatctttttgtttcccctgcggtacatcgttaacagccatgatcctaaaataaccatcacaattgcatatatcagaaccggaataacattaattttggttccctgcccgactgtaaaaaataaataagctttaacgctaacactccaagtcgtaaaccccatcaagaaaatgattaatatcgacttaaaaaacacataaaccggttctaagataaacagcccctttggaaactgtttcgtttttctctgacttattctggaaatagcggcggcaactatgccggaaatgacttcaattaatacaaacgaagcatctagaaataaggcttcaagatgggtaaaagcatacacaagcattccagcactccccattagaatgttaataatgacgccccgattgaggctttgttgttcaattctttttgcgttcattttctatccctcaccttattcaagaaattcaaatatcattatttatcaagataacttgcttttttgagaaacttagtcatacttagagcttaatagacggttgtctataaatgaatatgtgtatattatagatatttttcccttttatcaaagagcaattcattgaaaaatgtcttttaatggacaaaataataaaaattgaccaattggaggaaaatatggctgaagacagacgacagagaaaaaccaagaaaagtattcaagaagcactcattcagtttctacaaaaaaagcccctaaacaaaatttcggttgccgaaattgttcacgaggccgatatatccagaagtactttttatctccattacgatgatttgtatgatttatacgatcagttaaataatcattttttggacggcttatttgaaagctttgaaacctactacccaactacgcaaacagaaagctattttgagcttgctcagagactcattaattacattgacaaaaataaaactcttttttcgatttttattaaagaaaacaccgtttctgttgtaaacagattgtccaatatctttgtggacaaggtcatgcaattcgaaaaaattaataaagacgatttgcagggatattatgaaattgtttggtccgttcgtggcatgatgggaattgttatcgaatggacccaacatgacatgaaacctgataaagatgactttattgaaattgtaagatcaattttggataaattataaaaatatcatcgttattagttcgctttgggcgctaataacgcgtctcttctatataaatgagaccatccttcccccttgatattccagtacttttcatgctatacttcatgacggtgccaaaccacggtgagttcgtaacgatcggcgcatttgcgttcagaaggtcgaagcggctcgccatttttgtatccttatttatcaggataggatcgccacagcctgacggtcatattaaagactttgactgatatcacttttatattagtcgtcatctgtgcccaatgacctttaactcaagtgctatccggcacttttttaggctataagtgctaaactgatatcgttaataaactgacaaaaaggaagtgccgaaaatggatgaggtgttacttttagcaattattttggcagccgttgttttagccaatattttggcacgatactttacaaaaattccactgccattcttcttgattttcttaggtgttctgttggcaggattacctgtttataaaaattttcaccttgatccatccacctttgcgcttgcagtgattgcaccgatgctgtttaatgaggcgcaaaatagttcacggctttggatcggacgatctatcaccaatattttatcgttagcagttggcctggtgttggtcagcgtgctggttgttggtgccggactgcacatggtttataccgtgctacccattagtttggcgtttgcactgctcgctattgtcacgcctaccgatgcctcagcggttaattcgatttttgaatcaaatcccattgctgaagaacaagccggtattttacaacacgaatcactgtttaatgacgcggccggcattgtcgtttttgacatgtcactagctgcctttatctccggcactttttcaatggagttggcagtcggcatgttcttatgggaatttttaggtggcttattatttggaagtctaatcggtgtcttaatcgttagcgttcgtctattcttaattcgctacaacgatgatacaccgctcatcatggttctcatacaactattgacgccatttctggtttaccttttggccgaaaagctggcattgtcaggtatcctggccgttgtggctgccggactagcccagggttccgaacgtgaaaagctacgtttaacctcatcacgaatgcagttaattaccagtaatgtttgggaaatcatttccggcatgttatcaggaaccgtgtttgtcttattaggactctccttaccggaagtcattactgccatgcaacaatcccccaacccaaacttcggtgtgtataaattgattggcatcggggttctcctttatctggccaaaggtattatccgtctgttctggagtcgttatttaattaaaagacgtgttaaaacaagtcacgaatggcgggatagtctggtcatggcctttagtggcgcgaacggaaccattaccctttctttggctttctcgatgccagaagtcattcatggtcaaccgttcgaatttcgtggacccatgatctttttggcagctgttgttattttcatcagtttgattatgccaacgattttcgtcccgcttcttttaccgagtcaagataataatcagccaaggtatcgatgggtacggcgcatgcttcaagcggcaatttccgatttggttaaagaaaaagagcatcccgaagaagcccaaattgttatcgattctctgcaacaacaattggttttagacggcacaccaaatttaaagttacgtcgccgattgatgagtgaaagtcatcaggtagagttaagagctgttcaaaaattacatgacgacggcaaaatcaccgatgatgaattgttttattacgggaaattcttacaactaaataatttctctgccgatgaaaaaatttggaaaaatgtcctgttacgaattcgcttcagtttacacatcggaaccttatacaaggacatgaatcgcgcacaagatgcttttctaaccgctccagttattcttgaagaagtttactggcgggaacaatttaaaaaacacggtgaggatattttaccgattgaacaggttggctttgatgccgttatggcctttctaaaaaccaaagatgttgaaagcggtgttgaatcaaacatggttaaacgattctatcgaacacgccaccgtcgaattcatggaaaggacgttaatgctgacatcgtttatcagatgttcatgcgagcctttcatagcgagtacgaactaattcaagaagctttaagtaccggaaagatcaattcatcccttgccgaaaagcttcagcagcgaatctcaattgatgaaatgacttatcttcaaaatacagaaatattcagcaactaaaatgtatttaatattattaagcctgactaaatggcacgcattaaagtgtcattagtcaggctttctattaatggggtttgttattttaaaataccaaccagcaaaagcttaaattagaacgataacgctcccttcagatcccaaccttttaaaaacggaccatttcgcaataaatgttatactgaatgaaagcgacagattgaagggggagttttatgcaaaatcaaacaccgtcacgtatgcagcgaaaccaaacaacgcaacaaactaaaaaaacaaaacatacaaaattaattgttgtcgtaatcgtattactggtacttctgggaggctttctgtacattggtcatcaaattcatgaactatccgatgctcaacgacaaaccaatactattttagacaaaccaattaaaaatacagttgttaaaatcgtcaaaccaaaggttccggctgaaattcggccacaagttgttcaaatcattgaacaggaaccgctttatagactccaacaagccgcaaataatccagggacgtttcaggaaatcgccaacaaataccaagtaccggaaaaatacgtttatccagctaaacagtactggtttagtcagggaaatcagaccttacggaatgatatttaccatgctcagttacttcaattactatctgaactaaggcaattgaatgattcatcaaccaattcaacatctcaataattcgaaacagaagacctgtctgttatcaaatcgttttattcaaaaacttacttactacagagcgtgaaaaaacagtttatctttgtttgatgtgaggtatcccccccaaaagttaaagtaaaaactttagctctgggggtatacgccagtatcaatcaatgataagctgttttcgttttcgcaaatttaagcgccctcagtccagctgtcattatccatcgggatatatagccaaccgtaacgggacacttttatttgtaggtcccagaccatctcattgtcatatgttttaatacgggggtttctcgttgaataaacagcataaggatgtgaccgttcctttaatttataagtatttactaccagtttcgatttagccgccccaatcatatgaccatcacccaacaaaaataatctggtggccccgcttggcgttaataagcttattacactaagcatacttggcaaaataatccaaactgtcaatcggtgatgttggtctcctaagtgacaacctaaaagtactggaaaataccaagccgtaacgaccagaacacacggaaaaataagtgtcaataaattattggcagactggctaagggtcacattcccaagttccggatgaaatatatcgccgaaaaatgttactgatagtatgaccatcaaccctgtcagtataaaaagggattttttctttttaagaaacgctgccggtaatgcaataacaatcagaaaccattggaataataaaatccataaaataaggataacaccccaattatcgccatccgagctaatgtgaacctcgtttaacccaaccgctgctaaagcaaacatgatataccataaagcaataaatccgattcgtaatcctaataaaagccacctatgccacaaacgcaatgtaaagccccccctctccttttattatggcacactcagaactacaaaaaagcttccaaaaacgatttaaaaacaagttcaaaatcatttttggaagctttattaatttagttaatcaggtttatgaccgaacaccgtgtttctttaagaattcacttaatggaacaagcttgtcggcataataacgtttcttaaactcattaatcgtcttttcgtcaaacttatcaggatccaatgttagtttttcaaccggtattggacgctcattagtcatcttaacgtcaattaagaccggtttaccagctttggtcaactcaactgcttgatcaaacgccggcttcatttgttcaacttttgtcaccgtaataccggtcataccttgagcttcggctactttggcaaaatcggtttgcggcaaactaatgccaaaccattcatgattgtcatcttcctgttcatcttcaatgaaaccaagggcatcatttgagaagacaacgttgataaccggtaagtggtacgcaacctgagtacttaaatcctgcatcaccatggcagcagcaccatcaccagccaagttaaagacctgacggttcggataacttagtttagcagcaatggaaccgggtagacccacacccatcgttgcaaataaaccggaagtaatccatggttgtttaccgttaactttcaataaacgaaccgcattttgagtcacatcgccaacatcaattgagtaaattgcgttgtcttcagaaattcgattaatttccttaaaggccggttcaaatcttaactcaccgtccgttcgattcatcatgtcatcattgtactgatgccaattagcaacgttatccacgtttgcggcataccaatctgaaggcgcgctatccttacccaattcaataaatcgctgaagagacttcttagcatcggctaaaattgccacatcggtcttatgacgttttccgagtacttgcggattactatcaatttgaataaatttaacatccggtttaaacatttcttcggcaaatggataattggacccaacaaacagcatcaaatcagtttcttgcaaagcttcattagccggcttggaagcaacacgggcagctgatcctaacaatgcttcaaagtcataaggaataatttccttgccaagcgcggttgtaatgaccggcatttgaaacttcttagcaaattgcatcacttcatccgctgcaccaattgtcccttgtccaacgtaaattaaaggctttttggcttttgaaatcaattcaagcgcttgattgatttgatcatccgacccagccccaaggacaggttttgcaaagttctcagccgaactatagtagccatcggccggaatttctttatttgacaaatcgtttggaattgtcacaaatgcgggaccgtgttgtgcaaatgcccgtcgaatagcttcatcaagaatatgaggtaagctctcggcagtcatgaccgtacgggcatacacaccggcatctttgaaccaagggttttcatcaaactcttggaagaaatcttgattcattaatgcctgtggattttgaccaacaataaaaagcacaggaactttatctgccattgcatcataggcaccttgatacaaatgagttgcaccgggaccagccgatccaaacgcaacacctatgtgtccggttaactttgtatcggcaaccgcagccaaagcacctacttcttcgtgacgaacatgaatatacttaatacgatctttttcggcatccagtgcatacatcaaattattaacagttccacccggaataccataaatatgatcaacatgccaactctcaagcgttcgtaatgctgctatgcctgaattaattgtttctgccattattaagacctcctgtataaccatcaattttctattcattcttatgatagcggtgtcaaatttgaaaaacaattaaatgcacttattaatcgtaacccaaaaaatgaacctgatgatctttccaggttcattttaatctcgtattttattcttcaaatatctttccagctttagggcccggatcaagtgtccaaattttttcaatattaatcacaccggcaccttttggtactggaaactttccttcagcccatttttcggcttgttcataataaggaccgtctgtataaagttttgcagtcccgccaaaccgaaatccctttagcgctttagcattggcagtcgcaataataactttaccattgtcgttaatattggcttgtgtctgaccacccgtcatttcgttataaataaggtgttcgtcatccaacacacgcatggaaattttaggaccgacatccggattgccatctgcatcaactgtcgcaatataagataattcaccagcaattaaatctttcattgcctggtttaactttgccatcataacatcccctatttatttagtaaggtcattttagtgcttgttcaatcgacaagcaatcatttaaccttacacgacatattgatgccgaaattcagaaataaaccctttctccagacccaacccctcttttaaataattttcaaaatgaccatattgctgattgatcgtcacaaaaaaatgttgtaaataacgccgatcaactaccaatgcctgacttaatgccttttgctggccggttgttaatttatctgccaattgatggataatttgtttatttgctttcttacgtgattcgttggtttttaaataatcttcaaagatgtcgttatcactgacgccagccgtttttagaattaaagcggccgccacaccggttcgatctttaccggcaaagcaatgaaagaacgtcggctttgggtcgtctaccaatgcggtcataaattgatgataacccttttgagcagaaggactggtaaccagttgggcatacgttgctaacatcacttgactgatgtcgcccgcattattaatcatgccttcaatgctgacaccgcttttctttgcatcaaccaaaacatcgatcgcgtcataatcaactccaccccacacactatcgggatattgttttctctcggcttggcttcgaaaatcaactacccgggaaattgccagtttgtcttttaaatataaaatctgattctgatccaagtcggcaatctgaccaccccgatacaacaaaccatcttttattcggccatctgcagccggataaccaccaagtgttctgaaatttgttaattctactgccatttttttcacccattcattttaattatgaccacactctcatggtgccaatggtccaactctaccataactatcgtttaaaatgattaatcagtgtctacatctttaaattgataataatcggctccaaaatttgccataaattcatttaataatttgggattttgctccattacgaaagcatggccaccattattccaaaacttttcttttcgtccctttgtcagcggtcaatatttttccacaaagtccggtaatgttggatcggacagatggttattaacgtaccaactaataaagtccctcattcgctgtgtcgatttagtgaactcactgatttgatctgtctgttcctgcaatttttgcttcgcattgtcaatggctttttggcgttcttcggttttaataccatacctggaaatttcccaaagaagccacgtgaagcccttccaaaagtcgccctctggaatcaccacattcatcatcatcaacacatcataagatagtagatcaatcccaagaaatttttccttggacttaagatgatataaaaccggttcccaatgatcaaaaaaagtttgatcactatccgtgtgaaccttaccaactaagagttcatcttctaatctacgctggacttgagactgatctgttgagactgcctgaagcatttcttcgagttgcacggtaaactcgtgacgactgtccgtcaacgagctttcaggcctctttgaacgaaattctttgataatggcgttgaagttttcggtataaagagctgcttttacggcatctaccattgaataacgttgctttgacacagtatacaggaacaatgcatcatcaatgtcaacaaaccgttggttgacattctctaccaacggatccgatattggtgaccagtggacaatgtgtctacttgtgttattttgagaatccgtcagttcaatgtcgataacatcctgaactttttttaaatgttcaaaggcatcccggccaccaacaaaatagtggttggcctgaacgcttaattctcgattaaggaccaacacaaagccagtaagtaaggtcggattgtccaaatctttttcaagaattaaaaatgaaacatcttttgaatcaaaaaccaacttttcaccatttttaaatattaatgttaattgattgaccaatgctaaattgacacgactacccttgtgagcaaatttttcccaagcgtgtagtgccgtatcttttttgccctgcaatccaccacgttgtttacggaccagataatcacctgcagtcgtgcccgttattaagttattatctgcaagctccgcaataacgtccctatcagtttctctttttaccacaatcacatcaacccctacataccaaactcatttaatgatcattcccatattaccgatattttattaaataggcaactcgtttaaagaagcttttatataaaatagataactgccattttgttgctttttagatcaaaaataattattcaacttattttttgggtatccctaaatttaacttttgctaaacctcattttggtgtaaaataaactcaggagaaggtgagcatatgcaaaaccaatctgaccagaatctggatctttatagagaactggttaaagaaaaagaccttgtagaaaaacaaaataccgttaaggcatatggtttcttagcaatgctttatatgtatcttggtgaatagcagtctaaccgtcttctctgattatcctccttattattaatcgtattgtggttgtttattggcgttcacaactagaatacagttaataatcctgtttgttttcctttatttgcattaattccaaaggtcgtttcatctcttggacctttggatttttttgtgcacctgtcttttatatgacactgaaagtgatcaagcttttatcgaaaccagctgtaaaaaggttgtaaaataattgaccattcaactatttggcactaacctgtaggcgaagtggaaatttgagtatgatattaggaggtatttgagatatatggcaaattctacagatagtaaccaagctttaaaagaaagagaaaccgattattcctcaaaagactactttaatttaatgaccaagtattggagagctgccaattacatctctgttggtcaattgtacttaaaggacaatcctttattaaaacgcccactgacaaaagcggatgttaagtttcacccgattggccactggggtacaattgccggtcaaaactttatttacacacatttaaaccgtgttatcaagaagtacggtctggacatgttctatattgaagggtcaggtcacggcggccaggtcatggtctccaattcctatcttgatggcagttatacagatatttatccaaatattacccaagatgaaaagggattgcaacgtttgttcaaacgcttctcatttccaggtggtgttgcctctcacgcggacgctaagacgccaggctccattcatgaaggcggtgaattaggttattcactgtcacatggtgtcggtgccatttttgataatccaaatgtcattgctgccgttgaaattggtgatggtgaagctgaaaccggcccccttgcaacttcctggttctcaaatgtcttcattaacccggttaatgatggtgccgtcttacccattttaaacttaaatgggttcaagattgccaacccaactatcctctctcgtaaatcagatgaagaattaaccaagtactttgaaggtatgggctgggaaccgacttttgttgaaggtgacgatgccggcaagttaaatccggttatggctaaagccatggattcatctatcgaaaagatccatgctattcaaaatcaggctcgtgaaagttctgcagatgatgcaacgcgtcctgtatggccaatgatcattttacgtgcaccaaagggttggactggtcctaagatgtgggacggcaagccaattgagggctcattccgtgcccaccagattccaattcccgttgattcggaacatatggaacacgctgacgctttggtagaatggttaaagtcatataagcctgaagaactgttcgataaaaatggtgctttaaaaccggaaattaaggccacagttcccgttggtcattctcgaatggctgccaatccaattactaatggtggtaaggatcaaaaacagcttgacctgcccgactggcgtaattatgcattggacaattcaaagcgcggtgccggtgaagaacgtcaagacatggttgaattaggcaaattcttccgtgatgttatcaagaataaccctaagaactttcgtctgtttggtcctgatgaaactgcttcaaaccaattgcaggaagcctttgcggttaccaaccgtcaatggatggaaccaattcacaatccatatgatcagtggatgaaggcagacggccgtatcattgactctcaactttccgaacaccaagacgaaggctggttggaaggctacaccttaaccggtcgacacggtgtcttcacgagttacgaagctttcttaagagttgttgattcaatgttgacgcaatacttcaagtggattcgcgaagctaatgaacaaccttggcgtcaaaaatatccatcattgaacatcatttcgtcatcaacatcgttccagcaggatcataatggttattcgcaccaggatccgggtattttaactcatttagccgaaaagaagcctcgctatattcgtgaattcttgccggccgatgcaaattcactgcttgccgttatgcacaaagcattgaatatgaagcaaacattgaatgtgacaattgcttccaaacatccacgtccacaattttactcagtccaagaagctgaacaattagtagatcaagggttgaaagtcattgattgggcaagcaccaccaagcccggtgaagaaccagatattgtgatggctgctgcaggaaccgaaccaaaccttgaaagcttggctgcaattgacattttgcatcaacaattccctgatttgaagattcgctttattaatgttgttgacttgcttaagctgcattcaccgcaatttgacccacgtggtcttagcgatgaagaatttgacaattactttactaaagataagccgattgtctttgcattccatggctatgaagatttgatcgaaagcctattcttcaatcgtcataatcacaatttacacgttcatggttatcgtgaagatggtgatattaccaccccatttgatatgcgtgtattgaaccacttggatcgattccacttggctaaggaagttgcggaagatgtttacggtgataagtcttccgaattcacttcgcacatggatgacaaattacagcaacatcatgactacattcgtgaaaccggagctgatttacctgaaatcagaaattgggaatggaaatcacttaaataaaataaaaataggttaatcatacttgcctagaataaaatggccagctctcataaaacagcagctgactatttttgttggcactcacaacgctttagaatttgtaacggccctgggatatcactatcaaattttaaatttggcagaatgagaaaactgttataatagacttatcaaatacaggaatcacttggaggaaaatcatgaaagttattaatgttgaactcacggttaaaccgggtaagcaaacagaatacgaagcatttatcgataagctggttcaaggctcacgtgaagaggctggtaatatcagttataatcattttaaaaaagtcgggacagacaatgagtatgaaattattgaacattggaaggatgctgatgcagttgcctttcataacgacacttcccatttccaagcctttctttcaggcgttggtgcttatctaaccaaggatcccgtcatcattcgaatggattatcaggaaaaataatcaccgtaactaaaataagaagctgatccgggtgctattaaagcacttgagtcagcttctttgttaatgatcctgtttaattaatttttctcttcggatttaaaatacccattggatcaaataaatttttaatttgatgttgcagcacgtcaactgagtcacccaattcttcattagtccattgattctttgacatcccaactgcatgttcaccagaaatcgtgccacctaaagccagtgtttttctaaatagccgacgagtagcttcaatgactctttcaggtggggtgggttgatcattccatagcagacttggatgcaggttaccatcaccggcgtgtccggcagtataaatgtcgacatccaactcagtaccaacctgggcgatatatttaaccatttctgccagtttggataatggcaccgccatatcttccataatgtaatatttagcattggaaaagaccgccggcagcatatcctgacgcaacttgattaaggatttggccttttctggatcgtctgtaatttgaacattccaagcaccctgctcgtcaagaatcttcttggaagtttgcaattttagatcactggcactatcaatgctgaaaatcagtagtgacgatgtatcactttgtgaataactcgtgtgttcatattgatccaatgctttgacggttttaccatccaacgcctcaagcattgaaggatacaaaccggaatttctgattgctttaacgccttctgccaattttgccatatcgtcaaagaacgccattccggtaatggttttacctatcggaatcgggaataatttgacggttacttctgtaatgatacccaacgtcccttcggaaccaaccaataactgtgtcaaatcatatccatatgcctgcttgaatgtccgaccgccaagcttaatctcttggccattcgtcagcatcacttttagcccaaggaccgaatctttggttgcaccataccggacaccgcttagtccgccggcattggttgaaacattgcccccgatagcagacatcggtttagacgccggatcaggtgcataaaacatcccctgtttccgggctgccttatccaaatcctggttgatcactccaggttcaacgactgcaagcgagtcatctttatcaatttccttaatatgattcaacctggcaactgacaaaataatgccgccattaacaccatcggcaccaataacggtactggtatcagcggtctgtgggacaaccggcaaatgaaacttctgtgcggtcttcaaaacaccccggatatcatccttatctccaacggcgacataggccaaaatttgaccactgattgaactttcggcatttccgtttgctgtatgcttgactgccgtttcgtcatcaatatgaatttcagcgtgtggtgcctgttgcttcaaaaaatcgattatttgatcatgattgtaagctgtaaaaactgccatcaactagcactcccttattaaataaatttttatgaacatttgtaccaaaattaattgtcgtgggttaatgccatacatcaactttacgaacccatttttagttttaaagtgtcttgatcaattggtcaaatatttacacgtttaatttcaaaaccttctctattgcttatcaaataagcgttattcgtcactaactatttataagcacagatttcacaagctaatttctcacaacccaacatgtgaatttgctataatgaaagtagaagttatagaattaaaaagttataactatcataatctttaaggagttggtcaatatggcaattaaaacaactgtttcagaactagcaaagttaccagacatgaatgcaccggtgattacgctgaacttgaacctaaataaattggcttatgacgcaaacgaacaacttcgagttaagaatatcttgaaggaaattcaaaaggaaatcggtccaagcatcgattctttcgtcaatgaagtcaatgatctaattcgccaagaactgccttacgatggcatcacgatgatttccgaccgaagcggctcgaacgtctattatctcattcgaaccagtgtcgacgaggctgattatcacactgacaactccattgattttctactgctcttaagtgcttcgccaaacgctgattacacattacttgaattaaatcgtgataacagtaagttatatcaacttcaaaataaacgtgttagtccacttgctgttgaaaattatccacttaccgttcaagatgcgttgggaacagagcttcgtggcggcgaactgaactttagcggtcgtggcggtcaaactcaatatcatgggcataacgaaaccagtcaggaaaagcaaattgaccaggaaagatactatcacgttctggaagatttattgaaagatgacccatcattgagagaacacgactttattttgatgggattaccgcaaaatatcaatcttttcaagaagttgaacaaggcattaaagcttgccgatatctcaattgatcaatcggttcaaagcttagcaccagataaaattgccgaactggttaataagaagatcgaagattacaataatacccactctaatgaagcgatcacaaaagtcttcagagataaattatttacggatttaaatacgattcagaacatgctcaactcggaccaggttcgtcacttgttcgtggcttccagagatgaaattaacggtcatgatccagaatcatacgcaaaaattaacgtcatgattaaacaagctttggcacaagacgcaaatgtctctgttgtaaaggaacaacccgacatgcctcttgttagtgcagtgagccattaaaaatgccgacattaatcatcaaataggcaaactaaaaaaggtcgaaggctatcgtcttcggctttttttacatagaatttaaaaattattgatcaactgttgataacacatgtccgtttggcccaacaatatcgccattatgggattgcccatccaataaaatattagttaccagctgaccgccctcttcaacggttttcataaacggtccctgtcgatgaccattgatatcggttgacacaccaccggggaaaatgccaaaaattgatagtggcagtttctggttaataaaatcaaccgccagtgtttgaatcaaaccattcagtgcaatcttcgaaacacggtacgctgccggattataccaaagtgtggctgaaaacggaccggttagatttgcaattcgaccatgattatttttcaaaatcggcactaacttctgaatcacctgaagtgtgccaaataaattaacgtttagtgtctgctgataatcagcgaccgttgtttctagagcaggctttgccatatctcctgcaataccggcattgttaaccaataagttcaaatccggatgttgacgactaattttgcccgctgcttcagcaattgattgtgactcggttaagtctatttgaatcgtatccaattgaagggccgaaatgccggcttcaactaatttgttaactgcttgctgccctgattcaagccgacgggcaccgacaatcacaaaatacccatgctctgcaagctgttttgcaatttcaaatccaattccccgattagctccggttacaaacgccttatttaccataaagttacctccaatttaagataagcatttcgattaaaaaatcattgtaaccctgtcaataaaaaaagcaagtcagcaatccaaaatacctgtaattgtctaaaccttcattaatttgttttgaatttcatcggcaatttcctttaaccgttgcatgttttgaacctgcgaaattttatacccaacaaagtatggggatgttgcaaacctgggcacaattttacaataaaaccgttcattaattttataaaaaaacagattgtatgaggatagacggccacccatataatcatttaacaggtaatcgatcataacgtgagctgcatcggccaaagcatcaatattttcaacaccgttgattgcaatattgatctctacaaacccaatgatcggatgtgtcgaaagtgtgatctcccgttgtggctgatttgagacaaaaacaccagtgaaattttccacactgatattttgataaacgtcatagtcattcaaaccaacaatttgaaaatgtggatgtctcagactaccacccgataatggcccaaaatttttatacataatcacacttgtgtattgattggaatcaatcatcttttgccaacatttaaatgcaaattcaaatacttggcgattctgttcaatagaatagatagagggtccgccttcatgatcactggactcaatgacaaccgtttgaaatgtatcttccaaagttcgaaatttattaaccaaccaaatccggtcctgttcctgagctaaaatattagttaaatgggcaacatcacaaaatgggcagtagcccttcggatgacgaatattttccggcttgccttttgctgcattatagtcaaattttaacggttgattcactttatggcctaccttttcttaaataatcttttgtttattgtaattctgtctttagtattcgtccagcaatgcagtgcactgtcattaaaaaaccgacaaattgtgagaatagcatccatcagcgtagaatctgaatgatgagaaatgatgaacgcagggaatggtgacgattctttagttatgaatgaagtggatctacaagtaagttattaataaccaatttaatagagccaccccataaatggtttctcgggtgaattattcactccagcatgttatactttggtcgttgggtttgatataacccaactattggggataagatattagacgcgtccagactggcctttgtcaggatggacgtttttgcatcgatcagtatttcttaaagatccatttttttcacaatcagtgcaatggtttcctcccaacaataacactaacctttaagataataatcaaggtttgtgaataaaatggttgcactcgtttctcagatgcgttatatttttacttgtacttataaaaagtaagcaattaaagataacctttaggagtgacaatatcatggtaaaaatgaaagccggtcaagctttggccaaagtgttagtaagttggaacattgatcatatttatgggattaccgcagattcaattaataataccgtagacggcttatatcaagaacgtgaccacattaactatattcaggttcgccatgaggaagtcggttctctggctgcaacagctgacgcgaaattaaccgggaaagtgggaattagttttggatcagccggtcccggcgcgacacacttatttaatggcttgtacgatgcaaaaatggatcacgcaccggttgttgcgattatcggtcaatcggcaacaccgattatgaatacctatttcttccaggaaatggatcaggatccgatgttcgtagacctgactgattttcacaaacaagtgaccaaccccgaacagattccatacgttatggatgaggccattcgctatgcctatcagacaaaggggcctgccattgttattattccggataacctttcgggagaagaaattgattttgaaccgttcaaaacggccaaaacgcttacttccacaaccactaagataactgatcagagtgctgttgaggacgtctataatttgttaaaacaagcaaaacgccctgttctttgggccggtctgggtatgaaagatgcccgccaggaaatgattgatttttctgaaaaattcagcgtcccggttttgacaacggctcctgcaaccggcattatgccaaccgatcatccaaactatatgggggcccgcggccgacttggtacaaagccgggcttcgaagtcactcaggcagcagatttaattattctggcaggaaccaactatccatttagccgtttcttaccacagggtattaagtttgttcaaatcaataacaacgttgaagacttaggtaaacaacgtgacgttgacctggctgttctggcagatgccaagccattctttgcaaagctcaataccatgggcgaagcagttgccccaacaccatttctaaaagccgctcaaaaagataaacaaaattggaatgcttggctggataaggtcgcagatgatgacagtaacggcctttctccggaagcggttattcgggcgatcaaagaaaacagtgatgacgatgccgtctttggccttgatgttggtaataatctgatgtggtcaatccgccaattaccgtttaaccacgatcaaaaactaagcatgtccgcttggtttggcacaatgggatacgctcttccggcaggaatcgccggcaaacttagttatcccgatcgccaggttttcagtatcgcaggtgatggtggcttttccatgaccatgcaggatctattaactcaagttcagtacaacctacctattgttaatgttgttttggaaaacaaagcctttggttttattcaacatgaaaagattactgccaaccaggaaccctatgggattcactttatcggtgccgattgggccggttttgcggacagcatgggcgcaatcggtttgaaagtaaccgatcgacagtccttagcagaggctttcaaaaaggttcaagaacttcaggctgccggtaatacaaaaccaattttaattgatgccaaagttaaaaatcaggatccggttgataccagttttatgccaatcgacccagaaaaattcgacaaggcaacgattgatgcctacaacaagcagtcaaacctttttgaccaaccaccgttctcagaattactcaaaaatgaatcaaaataaagatcattagttaaataaaaaacgactgggtgcctattatggcacattccccagtcgtttttactcatttatgaacaattttaattagctgccatcgcctcattaggtttttcatcgccatctggttgaagcatttcggtcacctcttgtcgccgaccataaagataagtgactgaaaaactcacacaaaagctgatcacacaactgacaagaaatgatggaattgcagtcgtggcgatgctgataaagccaagaacgctgttagatcccagtgaaaccgctaagacgtgtgttaatccaagatagacagaggctacaccagaaccgatcattgatgcaacaaatggaaatttcaactttaagttaatcccgaacattgcaggctcggtaattcccaggagtgccgacatacttgcagaagatgccaatccccgttgcttcttatcctttgttaggaataaaactgcaagagcagaagcaccttgtgcaatatttgaaaccgatgcaatcgggaaaataaaactgccccccgtttgtttaacattggcaatcagctgtgtctcaatcgccgggaaactttgatgaagtcctgtgataacaagtggtgcgtagaataaaccaagtatcccggttccaacagcccctgatgtttggtaaagccaaagcaatccagatgttaaaccatcgctcacatcccgcataaccggtccaacaatgacaaaagtcaaaatgccggttaccaaaattgtgattaatggtgtaaacgtataatccaatgcttccggtagccgcttatgacactgtttttcaataacagataacaaccaggcaacagctaacatcggaataacagatccctgatagccggcttgggcaaccggcaagcccagaaaatgccagtaaggtagctgatggctggccagagctgtgctaacgttataaccattcactaaagctggagaaaccatcatcatgcccattgcgccgccaagatacgggtttccaccaaatcttttggttgctgaaaagccgatgagaacgggtaaaaacgcaaacggtgcgttggcaagaacgttaataaacgccgcaaacccttttaaatttggatacgcagtaataagcgaatcattcataaataaatgtggtgcagataaaacattgtgaagagccattagaagtcccgcagcaactattgccggaataatcggtacaaaaatatctgccaataaattaataaagtttaaaaaaccattttttgtcttttttaaaataactgattgcagcaaatcatatcctccttttatgataaaaaagtcacttcgacatagtttacagactttttaagaggatgcaagctttttccccaatcaaatttgctttaaaatcaaacgtaaccggtttcttccctactgtttcagtcacaatcaagcgacatattaattgcttttggtctgacatgcattacactatgaatagcaataattgattaataaaggagcgattttaatgaaagcatttggatacgaacaaaatggcggccctgaggtttttaaagaatatcaagtcccgattccggaaatttcgggaaatcaattgttaatcaagacacaggcttttaatttaaataattttgaacgggcgcaacgtgccggagagttcaaggcaactgatcaccgaatcatccccggcagagacgtagccggtattatcgatcaggtcggcagtgacgttagcgggttcaaaattggtgatagagttgtcgcccacggtcaccattcatatgctgaatatgcaattggcgaagatacaaacacggttaaattaccggacaatgtctcttttacccaagccgccggtattgtgacaccggggcttgctgcctataagggacttcatctttttgcagacgttaaaaaggggcagaccgttattgttaaaggtgcttcgggaggcgtcggctcaattgccgctcaagttgctctggaccttggtgcaaaagtgattggtgtcggcgccagtcgtaacgcagactatgtcaaatcacttggcgtttcgcaatacgttgcctatgatcaacaagatccagctgaagttttggctgatgctgccgatgttgtgcttgatgcggctttaaacggcaatggaaatgatagtgatgttcacattgttaaaaacggcggcatcattgccactgttggggatgctgaaccagctaccaataaagatgtctcttttaaacacatccatccgacccaagagatttctgacacgacggctttggctgcgctactgaaattaatgtctgaaaataagctgtcgattaaaatcggctatcaactgccatttacaattgatggtgtcattaagggacatcagatccttgaatctaaacacgatggcagagttgtcgtctcaaaagactgatttttattaaacgcatagcgacagaaatgttgttatagattaataccggatcatcgctggaatattaaagaggtcaagacgatttagtctgacctcttttttgttaggatgttcattatttggttaaagaacgcgctgcaagacgattactatcaaccatgaccattagcgacaaatctttttgttgtcacattgccaacctgatcaattgccttgactgtaaaggtatttctaccgggggttaaatcataggattggttaatctggtagtccggatacggatttaaaggctgattttgatcatgcctattaaaaccggcatctttttgttgggaaaagagattattaccgttaacgtcaagtttaacaccggaaacattatcattaaccgttcccgtaagccttatccgattgttttccacgttttcgctgacggccagactcggcttcactacatccaaataaatttccaaaataccgcgttgcttttgaaccttactttgcccgtttcttagtatcgttttggtatataaattgtagccaacgccacgttgctcggtcggattgaatgggactttgaacttaaatgtgccattctttgaaattcgaactctgttagccggatcggtttcgtctggcgttgccaggatcactaatcgttgcttgttaggagatgaaatctgtccgttaattgttaactgatgggtttgtaaatcataaatagttgcactgttagccgcatttaaaaatgtgctggcattatcatgcagctggaaaaatttaatccctttgcttggcgctctccgataggtgagttgtgacgtcttatggccatttggtattggtgatccaaaaatcgatttggtttttttctgtgcctgggcatttgaaatgagcttaggagtcgtctttttcagtttggctatgagtggcgctttgggtaattgggaaaccacaatcagtgttgagggcgattttaaataagcgccaaattttttctgtggaacttggctccatccctgtatcgtttcgtaaccggtttgactaaagtgacatgtaaaagcgacgacacccgttttaggattaaggcgtccctttacgactttgtttgtccctgtatccttggcataagcattcaatgccggcacaccctttggtactcttgcgtataaagtaaagaccttcttatttgaaatttccaaataactcgacgaggcgtttttaccggttccatacttaaaccatttaagttgtggagcccgatcaaatgacacattggcttttttttgtgactaaccccgaaagttttcgatgaacggccacttttgtactgttccccgcaatatccgtcaacgtcaaattagcctgatgcttcatgagcatctgttttacaattgatgttaaccgatcactaaactgaccggccaacgccgcttttttcgtcagtttaatgccgaattgatgaccatttgttgacagaatgccacgggaaataccggtaaagcctgcaccatgatcgttaaactgtcctgttaatcgacctgtttttcgattataggtcactgccgttgcctgaggagcccgcgtatccacttcaaccggataagaagccaattgttgctggtctgcgccatcgttatagttggtcgtaaccaattgataatgatagcggccattcggtaccacaatggatttcccggtcgactggtcaatataacggccattccactgcaatgcttttggattctgccgcatactgaacgacgtactgagatccaagttaccggaatcattggcaatcgatttgtctgtatcggtttcctgatcaataactcgaatgacattcccttgatcattgacaatctgtgccttcacattggcaaggctttgcttggcaaacacaaatggggtgacgctgtcttgatgatgatcgccatttggtgaaaatgccacccgagcaggatggatataactggccacttttcgccaatttgtcttattatcatgattgttaacataagcacttaaagatacccgatcactgattccaagaggtgtgttgttctcatccatcaaataaccgccatgaaaagcactattaggcataaatgcaggcgaatcaatcacctgttccttggtcgtatcaccatagtaagccaaatatggcattgacaacgactgcccgggttgatccgctttgaaatgcaggtacccttccaccacttgatttggcttaaccgttggtgaaatagacaaagataaagtgagggtttttctctgtcccggatcgatcacaatattggattgatcggaagttagcgatgcaccagtcaatgaaatatcgtgtacctgaccatcctttttttgatctcgaatctgtgtcatagggccaccgtcattgtcaacagcataattaatcggaacggagccgtgatttgacagctcaactttaaaagaatggctcccaccgatttggcctaacgaaaccgagccaataccggttgccggatcctgaaccgttgctttgagattggcagcagccgtcacattaatttgccccgcaccctgtcttctgggtgagacaatatttccgggataattaacatctttcattggtgttgcactgttcatcaacatattttttgtttgtgaaaccagctggctgccggataaatcaggctgggattgctttaatttttgaatgacaagcgctgctgcaccagatacaaacggtgttgccattgatgtcccttccagcatggcgtacgtgttattttgccaagtggaagtaatacccatgcccgggacagaaatatccggctttaatgtatagtcaggagttggcccccatgaagaaaaagatgccatttcattctgagaacccttcaatgaattttccgcggcaacggtcattgaattggcagaaactgccggatcagccaaagtgccactattggcttcttgataagccgtattgatcccgtttgtgtttgtcaacgggttacttgtaaaaatactggctgagttaccatagttgccacctgcaagtgaaacaaacacaccatgattaatggcatactgaaccgcggcctgctcctcatcggtaaacgactgattgggtaagctgatgcccagtgaaatactgatcacatttgcgccaagatctactgcatcgtgaatggcccgggcaacatcatttttgttttcgtcgtcaatcatgtcggacactctcaaatccaatagttgcgcttctggtgcaacgcccacgacatattcatgctgcttcttggtataacgcccgtttgcggcaataatgccggcaacgtgttgcccatgaaaccccgaaacatcatccggttcagttgcctgattactatttgatgcgtaattataggcaaacggaatctttgaattgacatatctcccatatcccttttgagcaatcatccgttgcgcatcggctttcgaaatcttggcagttccggggctcgtcaagcgaaaatctttatgaggttgaatcccggtatcgattacagcaacgaccattccctgacctcgatttcccgactgccaaagctttggcacattgcccttatcaattgcagcttgattctcgtttcgcccctttgcgtaaacaggcaagtcaatcgatacccgaccggccccaaccgggcttgaaaatccaattaaaagcccaagcgtcagcaatatgcctgcactaacaaacacaccaatgaacccttttttaatacataaacgcttcactaaatcattcaatggcaactcccccagtcagaataatggttctacaaattaagtatagttaaagaagtgccaacttgcatatgattagtttagttttcccaattcacggcgaacctccggggcctgttgtttactgctggtaaagataatgcgatcatttaattttaacgatgtgccgccggttggccgaatgaaccgcttatcacggtaaatctgggtgatcgtaatcttatcaatgaagggaatatttctcacttgaatatctgcatatcgggagttcctaagtgccacttcgtaaacactggcttcggtagacgtcattaatcgcatcgtcgaaggcgcttcaatcagtgaacggagcatactaatattaacatccggcgtattatagacctccactccaagactctccagctcactttgcttgtcgtttaaaatatttcgatcttcaaaacgaacgatcacccgtttaacgccatattttttagctgcccttgccaattcatagtttttcttagaattcaattgtcccataacaacaatatcggcatcaaaaaccccctgattgaccataaaacccgtctccatgttatccaataatttaattgagacttcactgttgaatgcccggtagttatgctgattattcgtatacatcgtcacatcataccagccctttgccaactgttgggcaaccgggaccgtcgttaaattggttccgataaaatggacagtggttttctttaaatcctctgtttccgcagaataacccttattaaacattaaaggtccaatcacgcaggttagaatggccgccaacagaaaagcaccggactgttggctgtttatttgatgcaggtgccgggcaacttgtagtacggcaagcactaccgtaattgttgtcgccgacattgcggtccccgcaactgcattactggtcttaaagcgcattttcagagcaaaatagaccaaggccttggatatgatataagcgccaaaaatagccggaatcatcaacaatgtttgcgaatgagagatcagttgtcgtaaatttaaattcaccccactcatcatgaagaaaatgggaataaagaaaccgtatccgatggaatctaatcgaactttggtttcttcatgcggttcgagcagcttaataacgatccctgccaagaaggcaccaagaatgccttcagcacccacagattccgcaacggtcaccaacgtaacaatcataaagaatgccaagcggacatctaattgagtggtggatttattgattttatcaaacaatttaaagaatggtttgaaacgcaaaaaaagtaaagccgcagcgaccaagatcaacaaaatcagccataatgactttgaattgggactgtacgccgaagcataaaatgtaagaccaaccatcggcacaacttcgcccaatgccgctatcagcaaaatggtttggccaaatggacggcttaataattccttttccttcaagcttgcaataacgatcccaagtgaaattgtcataaatagaatcgaagacaggaaaacatcttggaataaccccgacaatttcaaccccacacccattacaatcgacattgcaataatcgatagataacctaaaaatgcaatcgtcaatactgaatatttgggtgcctgctttttccctttttcttcaagaggagataaccgcgtagaccggcgtttaaaaagactaaaatcaatctccatcccactcaaaaacaaaagaacgataacaccaacattttgtaacaaatccagcgttgaatttatctgaatcaggtttaaaagcgacggaccaagaatgacccctacaataatttcaacaacagcagtcggcaaaaaagttattttaaaccttgccattgccaatggaatcagtaacgcagccagtaaaataataaccaaagacaattgattcaaactatcaactccttccaatgctacttgatctttatcagaaacgttaaaacagctaacactttaatggaaaccggttgaaatttcaatcataaaccgtcacttgaaatagatttcaactttgagaagcaacatttccaagttacatgaaagcgcttatagcttataataaagaaaaaacaattggaggctttcattattatggatccacgatggcatcaagcattatatagaacagaaggcattaattcagaaggtttggagggacacgcttatgtgcctgatggcttaaatgttaaaaccagcagtcctttaaataatcatcccggcacgaaccccgaacagttactgagtttatcgctaagtacctgcttagaagcgacccttgaagcaattgaacgggaaagacagttgcctcacatatccgaagtccgtgtccaggttgcctttatcggtgcccgtgcccactatgaatttttagtcaatgcccaaattaaagtggcaagtgtggactttgagacagctaaatcaatgacagcagaagccgaaaggcgctgttgtgtgtcacaattgttggcaggaagtaaaaactacaccgtagaaacggtcaaagaattcagccaatcaaaatgagtctagacccttaaattaaaaaagttttaattttaatcgggttattttttgatctggggtagtaactcagatcaatttgcggtaatatttatttaaattaaggaattaatcgaccgattttattcgtaaatattcgacttttattggtgtttatgtacaaagttgcttgattttaaattaatttttcaattatgtcattttactgtataatctcatttaatgacattaaaagaaaacaggaggcatttctttatggatagaaaaatcccaaacatcatgggtactcaacatccagataacgcaggagttccgtttttcaaaaatcatgataacccatttatctcagcttaccgagaaattgacgaagcttacgaaaacttctcaactctggatgctgatgaatatatgtgggactgggaaggcaaacatgccgatgcgtcggttattgaccgtttgtattccgaacattatgattactttaaaaagcaccaacttggtcgtgataagttcctaactttccgtttcccaaatatttgggaagaaaagggctacagtcttatgcaagccatgacgaccattctttcagcagaagattttgctaaagacctgggctttgatgaacgaccattattcgaagctattttgcctatgacacaatcagcagatcaactgattgaaatggaagataagttctccagccttgctcactacaagtcaaaggaattcaatactggtcatgaaaattcagacacgctgcaaatgattcccctgtttgaaggtttccaatcacaattagacgcgcccgaaatcttagagaagttcattgaaatgtacaaaaagcattttggccgcgatatcgaatacatgcgggtcttcttagccggttcagattctgctctttccaacggtttcctaaacagtattatcggaaataaattagctctgagtcatttagctaagtttgaagataaaagcggcatgccgatttatccaattgccgggatgggaagtaccgtcttccgtggtggtctatcaccacttatgttggaccgttaccttgaagaattccctggtttgaagacggccacaattcagtcagcattccgttacgattatccactagatgttgttgaaccagccatcatgaaattacgtgaaggtttacaacaaagtaagttccaaattattcccgaagacgatgaaaagacgcttttggaaatcgctgaaaaagccgccaaagaataccacgtcactttggatccgcttatcaatgatttgcagccggtcttcgatgcctttccaaagcgtcgtgatcgtcaccaacacgttggtatcatcggttattcacgtgacgttgatggttacaagatgccacgtgcaattacgtttacgggtgctttgtactcaattggggttcctcctgaatttatcggtgttggtcgagtccttaccaagctaagtgataaggaactaaccgtcttgagaaaatattaccataatattaaagctgattatgaacatgtctcccattacttcagtaaggaagctttaaccgaacttcaacgaaagaatcctgcttggaaggctgtcgatgacgatattgagggaattgaaaaacttttcgatattgttgcgggtccagaaaccgaagaggaagaaaaacatgcacaacttgcttccgatttggttaagatttccgacgatactactaagactgccctcattcaacgccaagcaacattgagaaaattcttgggttaaatcaaattcatctatcaagacatggatactatccctctagagagcaccagagaaaaacaaaaaattctcaggtgtgatctggagggatttttaatgcctaggaaaaggaaatatgatctggagacaatgttgtgggcaatagctgagattgaaaaagggcgggactatttatcagtttctcaagaacttgattatataaaggaacagttggtttttggcgaaagacttatttgcaggcggtgaagaagccttacggtccagtcataagacaaacatttactctgcagagtttaagattgaaagtcgttacgtatactttggaacatgatatcagtgtcagggcttgtgcctaaagtatggcataaagagctaccgaccttgtccgattgattttccagtataagggaaacaaaatcaaagcaacaggccagagaggtgccctaatgactggaaagaactcccaaaaagcaatgacctaagttcgagaaaaaaaattaacacgttgatggtattgaaacacaattacgactactagcgcagtccgtaaatttaaggcctcctacccaacaagtctatagttggctgaaaaaaaatatcgagagaatggccctgacggtctaaaagacaggacgaggacgcaaggttcctgaaaaagaataacagaagttcaacgttcaaaatcgaaaaataggctgcttaagcaaagcttgaagtgatgagattcgggaagctttggcaaaaaaagtacgagtcaaatcgaaaagaggatcgcacatagcaaagccagacca

SEQ ID NO: 460 - DNA, 135752 bp, Unknown
  Metagenome-assembled genome
ttcgttaagcgatcaccaaacatgatcgaagcatcagtaaagtgctcattaaggtcaaaagcagcccaccattttaacgaaatcgttaaaatggtgggctgttttgaagctatgaataattcgggttttaatgtagtttaataagaatctgatggccaggtaggcaacaacaaatgacacgatcatcccagttgccaaaacgatactctgagtgccgttaaacgttccaccatgatcaaagtacttataaactttcagaagggatgccccaaacattgttggaatcgcgaggaaaaaggaaaattcggtcgcaacatatctagaggttccgattaagattgcgcccaaaatggtggcaccggatcttgaggtaccgggaaccagcgataagagttgaaacatcccgatgataaaggccgtttgataaggcaggttatttaaatcggtgaaccgtggacgtcggttggcatttcgattttcaattacaataaacaagatcccgtaaatgagaagcatcgctgaaacaacttcccaattcattaaatgggcatccatccaatcattaaacagcaaaccgagaacaacggacggcaatacagccacaatcactttgaaccataggatccatgtcgcatgcttttcgaatggatccttctttggtgacaatgggttaagcttgtgaaaataaagaaccacaacagccatgatcgctcctaattgaatgaccacattgaacatatcggtaaactgagttgactcttgcatcttgataaattcattaaccaaaattaaatgcccggtcgaactgatcggtaaaaattcggtaatcccttcgacaattcccaggataacggctttaataatatctaacataaatccaaacctctcatcaataagatttaatagcaccctttaagaatgccataaaagtaaacgacaaggcgggaatttaccaataaattacagagtagaaaccaaacctttacattgtttcaacaatcccagcaattccaaatataagattattttttcaaacgacgataaatgttaagatgaagctgtaaatttaaaacaaaggggacttaacaattgaaaacaacattatttgtgaaaccaggaaaagtgactgttaaaaacgttgataaaccagtcattgaaaaacccgacgacgtcattcttcacgttgtccgcgcctgtgtttgcggctcggatctatggtcataccgtggcttggatgaaaaggccgccaattcagaaaacaatggccatgaagccattggtatcgttgaagaagtcggaaaagcgatcacaactgttagaccgggtgattttgtcatcgcaccgtttacccacggttgcggtcattgtgccgcttgtcgggccggttatgaaggcagttgccaaagccattctgataatttcagctctggttatcaagcagaatacgttcgctaccaacacgctgaatggtcactggtcaagattccgggaagtcccgttgattacagcgacggcatgctcaactcacttctatcattggccgatgttatggcaaccggctatcacgctgccagggttgccaacgtcaagccgggtgatacggttgcagttgtcggcgatggtgccgttggattgtgtggtgtgattgccgctcaattgcgtggtgccaaacgcattattgccatgagccgtcacgaagaccgccaaaaactcgctactgaatttggcgcaaccgacatcgtgccggaacgtggtgacgacgccgtcaaaaaagtgatggctctaacaaatggtgatggcgcagacgccgttctggaatgtgtcggaaccgaattatcgacagatacagcattgaagatcgctcgtccgggtgcaatcatcggtcgggttggtctccctcatacggctaaaacggacttggcagcaccgttctatcaaaacaccgcctttgctggtggccccgcatcagtcacaacctatgataaaagtgtcttactaaaagccgttttagatggcgacatccatccgggcaaagtctttacagaacgcttcggactggataaaatcgatgatgcctatcaggcaatggttaaacgtgaagcaattaagtcgttggtggttattgattaattagtcaatcaaatcagtgtcactttataaaagaacaagttgatttaacttttttaaatcagcctgttcttttattatctggataaatccgaaagccttcaccaccaccgtcacagtaactacaaataaaaacgtgcacgcccatgacaaaattggttgcgacttccacgtcacacgaattggttagccaaaacttgtcagttcattcaattcgtgatagattgttaagtgttcgaagtcgaacacttaacgcgaggaggtgagcttaatggctgctgatagacaactactcaaacaaattattattttaaatcggggtattcgccgaacagaacgacggatcattcgaaaacacgcccgtcaaaatggtctctcccccaatcagttactactgattgatacactggaagattttccgaataattcagtcatgggattggcggaaatcttggagcttaataaaagcaccatctccacacttgttagtcaattattagaacaacggctgatttcaaaacagctggatcctcaaaataaaagccggtttattctcaacgacacctctaagggcaaacacgtggctgccggtatttacgataactatttggacgaattgattcagactttccgtttggatcaactggatttagccgggattaaaaaggtattggaaaagatggaaagcaatcattaactcttattcatgaaggcaagtgtgtatatcaaatcaacaatagaaaagagagaccaatttgcagaaaagtaagaaccgttccctaacccaaattttaaccgtccttttgattatcttaatcggagccaacatgcgaactgcattaactgcagtgccaccgattttaactaatatctccagttcatttaatttgcctgactggtttttaggcagcttaacaactattccactattgtgcttcgctttgatttcaccctttgtcaatcgacttagccgcaagtttggcatgttaacaacaattattgccgccctaatcgggctattgattggctcattcattcgaatttattcattctccaccctactgattggaacgcttttaatcgggggatcgatcgctattctaaatgttttgtccccaacgatggtcgccgaattctatccacgaaaaataggtctcatgaccagtgcctacacactttccatgacgattttcagtgctttgtctgccggattaagtgcaccgatttcctcaaaaatcggttggcagccgatgcttcaatggctggtcattttccccattttaactttgttaatcgcgttcggatcacgcggccgcaagcatccgcagcagtcttcccgatcatcatttaatccgactgctcagcttaaaccggtttggcgccaacccttggcatggtaccttaccgtgtttatgggcttgcagtcattcttattctacacgattctgacttggctgccgtcaatctttatcgcccatggtatcaatcagaaccgcgcaagcctgctgctgggattactccagctggcatctttaccaacagcttacttcattccaaatttggctggtcggctaacaaaacaagcgccactggtttggacaattttcggattattcattctgggattaggtggtctcctattaaataccgcttcaatgaccattgccgtcatcatttgcattctattaggattcgcaaccagttctgctttcagtatgtcgatgattttattttcactcaaaactgcaaatccatacgaaacttcagctgtttcgggaatggctcaatccatcggctacctggccgcagcggttggcccactgctttccggactgatacacggtgccatcgccagctggtggcccgtcattgtgatgatgctgatcgttgtcgttattcaaacgagtttcggcctgctggttgatagtaaaccatcagtatttggcgaataatgatcttaaatttacaaaagcctctaaccacgtagtcgtatattgtgtggcttatgatttgtgatttgtgatttataatttatcatctaatactcttgcatcataatgcaaggcaaaccgtattcgtaatccagattttaacaccgctatcgaaaatgctggaggacaaaaatgctagaaatcacttattttattaaacaaaacgaaaaagatccccttttggatatattcaggagtttggtgacatctcaatccagaaacaatcacaaggccttttttaaagataaaacgcttaatattacccaaattcaaacggcagctgatatttccgcaatcaaaaacggtggcgtccaagctattttgaagaaaaatggcgtcaaatcactgccaattgtgacagtcaatcaaaagataagaaaaattggtcaactccttgaaattagtgaattagaagatttaatcgatgggttgtccattcaagttgacgaggaaaccagaaataagttgcacccataatcaagaacatgaatttaaactataagtcaattctaccaaatcatctaataattatcccaatcaaataaaagccttaactcacgtattaatgactgcgtgtgttaaggcttttattttgatgctgtttttttgtaatcaattttgaccttttgttcccaaataaaacctattttttaaccagcgtaactttgtgttggtcgtagcttaaatgccaattctttgccaatcctttaagctgaacgtgcttaaatttaccttgaatccttgctgccttaaagatgacctgtctatgtgctggccgttggcgtccatcaacaatcaatttcccattcaaatgagcgtttccactcacgttcagagattgaccggtgccggtctcaagtgtcccggaacttgactcctgatactggcccttaacttgaacctttttagtacttaattgaagcgtacccgctttgatgttcaaatttccagcacccaaagcatgttcgttttgagcaaccaccgtccctgcctcaatgactgtatcaccttgataagcattgtttcctaaaagtgtcagtgatccggttccctgtttggtcagaccacctctcccgccaatatcgcttttccaagtatcgttggcattaaaaccaccctgtttggcatccatattaaccgttgtattcgttaaaaagttgccaaacccgtttccagccgcaaacaggttcaatcttccccacccctcggtatcatcagtcattggataaccggatgaaataccggttgtatagagaacttctcgacgttgcaggtcagatagatatgggaatctggttttcagcagaacttccgcacccttgggaacgcgcatcggttgattggtgtcgccaaccggttcaaacccatagttcaatcgttccgtataggcctttaaatttttttgatagtcgccgtaggaatcctggctgttggcatcgtccgccgttaatttactttggatattactctttgcctgatcaattaagtctttattggccggatcatttaaaaccgaagcagtgacagccgttcccaaaatgcgaccgccgattaccgcaagtggcgaatgccgtccaaccaaaacccggtcgtaaccgatttccgacgagcgcgtaacaagctgttgaaatcgttgtggaaaaatatacgctaagcttaaaccagcttcaaagccttgggtggtgtgcccactcggaaaatcatagtcatcttgtggggcagccgcaaaaacatcggccaatacgcttgggaccttgacctgattactttgtcgatatggtcgaatatatttaaaatattgtttgggtgttcccgaagacgaaaagtttgatttagccgttaaatcaattaactttacaaccggacccaaatcagaatcctcgcttgcccaaggggttgtgttaccgtcatcgcccttgtcgctggcaggcaatggtgatgacggtaaccttgtgtaatttgtgtgggcgtcacttttttgaataaactcatccgcatatggtcccaatccactgatcacattatatggtgaatcacgccgatcggttaagtatgatcgcaaagcatcgtcagcggaaacattggccgtgatctgagcggtcttttcaacgttttcatcgagaatggtcggattcttcctggtcccgtcaccagaccaataattggaaaacgtattttgaaacacaccgattccgggattgatgttgggatccaaattagttttgacattatttttatataaatcgacatagtaaccatacgatgctgcctttggtgcaagctcttccgccaaattttgatcgctagtatcctgcgcatgcgtgacgacctgacttgttgtcaacgtcacgccagccaatgataggctcaataaccctttaaaaacccgatttgataaagatgttttgccccactgcataacccgttcctccactcgattatccttatttgacataacactttgccgatcatttcataccccaaaaatggtttaagcccgttatgccggtgctttaagcatactaaagcagcgtaaaaacaaaacgaattctttgtaaaatacccgtaaaaatgacaataagtctcacaaatttctttggataaaagtaactttagtatctgttcaaatatttagtgacaaatataagcagcagtctggtataaagtgacctcagcgtacagtgacgttaaaaaaataagaatcccgccaaccgttaagttgacgaggttcattaatttctatttataagcgtgaacatatttcgtattggcggtaatgtagccaccatttgttaaggtaaaaaagaattaactatcaaaatagcttccatgcctttaacaccaatcaagcattcagaggattttattagtcaacgttatattttcttatctactgtttgagagatgattaatcgtccaataatgcctgttctctttgagcaatcaatcctttaagttcatctaaatcatcttaggtagcaaagttgcggatgaatccttgcgcctgcgaacgtcgggaaatatactgtatttgttctttgtgggcttggtcccacttcttgttaacttgctgacgggctttggtataaggttgtttagccatgcttctcacatcctttaaattgtgttcccgataccaatatggtatgataattcgtgaaaaaatgagtaccagaatgccctccgatacccgcaatcgtgagtttggatacttgggaatgagactagccgattggttagtcttttttgatttcatggtaggctttggctaacaacaatacaccgtagcacaatccaatgaaatcaactactcacaggtccgtctcgacttctccaagtcttaccaattcggatacccgccacctccgttgagtttgaatggttgaaaagtgtggcatgtgtatcctgataactcacttggttaatcccgccggaagctatccattgcttttaaccatgttttgctttacacgcttataattacatggaaggaactgtatttatcttatgataccaacccttagcagttccgaggctcgttgtgtagtcccatactttataaggagcttgttcctgatacccacccttatcattggattgatcaaaaacgctaagaactagccggttggaaccacccaattttctacgattaatctgtacagtcgtaatatcatctgatgctttcgctccaaagaagtaccacccatgagatttactaatgacatatctttttgccggaatgtggcttactttccatttgtcgtctttatgaatcttattggcgaaataaaccgtatgtttagaaaaatgaattctttcatagagccatttcccgctatatgcattcgtatgaccataccaagtatgtgcccttaatgccttaggatttgtataataaacttttttagcttgaacttctgatggtttataagtgaacaaggccattccgcctacaaaacacgccattcctacaaataattctcgactaatcttcaatttaacactatcttctttccccataattgatcattcaatggttactataaactaatccacatatttcaaaactaattatacttcttctttaaagtgaattttcaattttttgaaacatcttaaaaacaatagatccccatgccacaacccggcatggggatccgttgtattgtctcaaatgtagcttgaggggggttaccgcatctgagttgagtacccaatttaattaaaaatcttagcaacgtaaaagtccctgaatgaccagcatttcagcttttcgcacttagctgccggattcaccagtccgcttttacagccaaatcatacatacaagtgtcattttaagcaagcgcttgagcttgaaatgtttgccctgtcaatcgatcaatatggcgacaaaagattccataggttccccttcaatcatggcctatctatcaaaatcccaatttacaaattcggttgatcctgtccctcaggtgccactgtccgccaatcatcccaagttgtctgcttataagccgcatcccaaaaataccattccaataaacagcttttaagaaaagtatccttggcttggttctgttcctgaggtgacgctgttttcgcctcttgatcgataatattgaagaagcgttcaataaagccgtccggtccaagaaagtcctggttggcaagtgtcaaaaaactgtgaaacggttcgtcattcacccgggcttgattctgcatatatttgcccaactcaatataaagccactcacccgccgcaaacgatggcaggatctgcagcacaccattggtagcaatggtaccgaccatgtgctgccgataaagttggttgatcggctgaatctttatctgcttaaggcttgcccaatcatgcgtcatgtcgttgggttcccgttttaaccaatcacgcaacatcgtcagctgcaaagacaatcgtttttgaaacagcaaagcttggtctgtagttgtactgttgttgattaacgcactaatgaccgctacctcattgtattcaaatgcgatgtcctgctcatcataataacgtaattgggctggcgttaatttcccggtaataatgccctgaacaaaaggatgcttctcgctggcaaccaaatatggtcgggcttctttgatcatttcttcagataatgacatactgattcctcctaaaattcctggtttggggaaccagtcgtgacaaaagaaaagcccacttgtcatttcaagcggactggtaatgctaattactcgatcttccttcgacagtactaactgcagcaggttccatgggtatttctcagccattaaaggcaccctagaccacgaatgatatttatttcgtttatttatagcagttaattggtgacaatcagatacacttattagcttctatgaaaatatgtcccagactttgaatgcacagatcgatacataaccaaatgatgaccccgacgccccagaactgttttttcatggaaacctttcttcgtatatggatgaaaggtttcatagccatcaatcacatacttacgattcccgagatacttccaccggggatttctgatattatgggcctgcatcccgctgctcgcccaatcaagcttgttcctggtcacggttattgcatccgatcccaatggtgccttatccttgtgtgtccaacttccacgtaatgctttaggtgtgcctcgatgccaactggccgcaatagtgctttgattaaagccagcaaaaacacccacaccagcaaaagttgccaacgttactgcaaaaaatgatcgtctaaatttcaattctgatacccccctaaacaataattatttgtttataatcgaattatacttcaataatccataaatggcgcatcaatttttgatttttacaatcttttacaattgggaggtgaatattgacagttttccagcaaaatcaggtttaaatttaccaacagttaaaaaatattttttctatcattgtcattgaatcatagtattcgccgtcaaaattcattaaagatgaatcaattgctacttaatccgccttatgctagaataatgaacaagttacatcatgtaaacttttaatgtaactgctgttcacaacatcatagactacaaggaggaattattatgtcaaaacatgtacagatagtttctaacaatggtcgagtatcaatgtccgcggaattacgcgagacagattttctccaagctggtgatcaggtgacttttcggaccgatgaacagggtcagattattatcgaaaagacacccgatgattaccaggaataaccatttcttgagtttttgatacagaattacattagatctttaattgggaggagctggaaatttcagcgcctctttttgaattccggtaaacttctcaaaataagaattgccaagtcaatcccatgccaacagccaactgtacgtgtatgctaagggtgaaataacaatcactattatcagaaagggatgacctaacatggctcatctatcaactgtaacggcactgattaccggtgctgccggtggtatgggtaaagcatttgtcgagaattttattcaaaatggcgctcgggttgtgtttacagatatcaacgaaaccaccggtaagacgatccaagcaaaattaggagatcatagtttgtttttaaaacacgacgtcacgtcagtcgcagattggcaacgggtgattgaaaccggtgaagccaatttcggaccgtttaacgttctcgtcaacaatgccggcatcgacatcatgaaacccattaccgatatgacgcctgaagattatgacaaagtcgtccatattaatcagtattccgtcttttacggtatgaaggccattgtcccttccatgaaacgtgcgggcaaaggatcgatcgtcaacatttcttcaattggtggtttgattgctatcctcaatacaattgcctacggtgccagtaaatttgccattcgtggtatgacaaaagatgccgctcttgatttggtagacgatcacatccgcgtgaattcagttcatcccggcatggttgaaacaccgattctaaaaaacattcctgctgaaaataaagcaaaaattgcgcagggcgtcccaatgaaacgactcgggaaaccggaagaaattgccaatgtggtgaacttcttggcttcggataaatcaagttttattaccggtcaggagattgtggctgacggtgggtatacgatggtgtgacattgtttaaattaaaccaaaaagttctcttaacaataaaattagcaaaaattaaaagcccatagcatcagtcgataaaaactgatcttatgggctttaattatagtaatcattgctgaaatactttgtcagcctaactttaaaaaagtttttaaattgtgctaaaaattacttatagatgtaaatatatcgggtgtttccagtaatataaccaccgacaattcgataacgtaaagctcctggcttacccatattgttcccatgtgaataatcaaagccgtaaactttaagacgcttgttcttcacaatatgaagatttttcttagtcaaatttgcattactataccgattaatcatacgcttagttttaaccaagcgaacctgtttatgtttccccatcttaacaagtttacgatttgcagtaatatatttcccgtttgtcaaaataaatctggtcgtcaaattatgctttacaatttgcttaacatgtagccttgatccttgacgaaaatgagccgatctacctgctaacttagcattgcgatatgctctcacaccccttggattgatgactgtaattattgattgctttttagcataataaactggacgaacatagttccaatttgcagtgatatatccctttttacctgctgtcttgcttaaatgattaacatctcgaacctcgtatcgtaatcgaccagtagtggaacgtgcatatccagtcacaacaaacatcggtcgataaattcttggcttcttcacatattttgctaaacgctctttagaattaaaatcagcattacgataaagataaatatttttcaatgcatatacagctgcattttctttagctgcatacttaggaatatccgaaacgtcaatactactcgaagatgctgagctggtagttaaacttgaggaaccgtttatactttcactagttcctggatatgcagacgaacttgaagcactgctggaaactgacgacgatgatgacgcgccaccactattttgatgatatttcaaatcaatttgtgtaatgactttgccatcggatcctagcgtcccaaatctaacggtcttgggattagaagtatctggtgaatatccattaattacttttacaggtatatctttttcagtattaaacgagccttggatagtttcgggatcagcaatcttttttccattttcatcaacgtagttaataacaacagataataaactatcctttcgataatataatttaacgttttgagtgacgtcggaaaacggtaattgagctacaccaccactaaatggtaacgtgtaataatcctctaaattctttgtaggaaacccttcaactttccataaatgatattcagataaagactgtttttggctttctgtcgcatctgaactaaccacatctgttaacttagaactgatttttgcattgtcattcaaggaaccacttgtctgatgggcgggaacaccaggaatctcaacaggctgatcattctcgttattttgatacaagtattgagcattgacaatcccataagcagcatactgaattttgtcaatattgattcggtactcagcttgtgcagcattcccagaaccagcaatcgcaaaattagttaaatccggccgatccgaaaatacctttgtcccctcatactgatgttgattagcatcctgaaaattataatgtagtgcgttatttttggcatcccaagtcaatttaaagggcattttttctacattaccgtcttttgtaagatcactataacccaacaaatgttctccttgactgtcaaaacgtgtcatccaatcaaggtcactaccgctaatatcaactccgtctccaatagtatagccaaccttatcataaaagcctggtatattctgagtatacgcaaagccaacgtttggcactgattgatctgacaataataattcaccaccattagctttatttgcataaaccttgttatggtaaaaatctaaggcaactccaaaggcatggggaattccagtcattcccaaccccatccctgaaacacccacaggagcagaatcggcgggtctaaaggcaaatgaaaagccatcaccatattggtaactattatcgccctcgtcagtaatgcctgtattttttaaagacgcttttcgtctgaaatcaggttttatacttatcgagccattaagtgaaaaatcatttttcatatcaattaagtttttattcaaatagactgagccggcaagagccggattatcagcaccatcattaataccgggtcgataatcaaatttaccatccgctgtcatatatctattattaagtggatacaacaaaattgcaccattttgtggatcataactagttcgacttgaacgttgaaaatacgtttcaaaattattcttatcaatagttattttattatttaaatcattcatctgtcccacagaatttgtattcatattagtttgactggtcaaatctgcagcaaatatacaccgagaatccattgaagaagcaaatataaaacttgacataaaaaagatgccatataaagtgatctttgaaaaatttagcaaataatgtttagataacattcccctcaacccttctgttctttgaatcctagatcgtaacctttcattaagtatatcattcagtaagttatatatgatattaaaagatgtcgaaaacaaaccaattgacattcataagtaaattcagcaaattaacggatcataccattaacaattatttttttgaaggatatatttgtcaatttgtttttaaaacgacgctaatttagcgcctcataatttcaaaagaaggtactttctcaaaaaggtaaaattcattatcatttaagtcagaggagatccaccttgtcaatagccatgcccgacagacctattgaaatgtgtgccaataatcactttcagtatgaccattaactcaaactaaaaatcatagcgatccttcagaaggctaaagtgaacccctaaggttggacactaaatccaatcttaggggttttactatgactaaatttaatttaaattttcgtataaaggtcgttactgaatatttatctggtaaaggttcaccatctttagccagaaagtatggcattagcacgcattcaatcattctggattgggttcaccggttggagcggcgaggtattgaaggtctgaaagatcggtcaatgtctcaagaatattctagtcagtttaaagtcgatgtattaaactggaagaaacaaaatcaagcttcgcttccagtgactgcattacactttgacctatcatcgccaagtactatttggcaatgggaaagacgattcaaggaatctggaattgcaggacttgagcgaaaacgagggaatcctaagcacatggccaaacataaacagaacaagccccaacccgcgaaaacacagaccccagccgcagagttgaaacagttgaaacaagagaatcaaatgttaaaaattgaaaatgaattcttaaaaaaactcgatgccttagcacggaagaagtcaaaacacacgaactcatcgaactagtagacgagttaaggcaggagtttcaagctcccatcaaactagttcttaaagcggttcatattcctcgcagcacgtactattacgctaaggaacatcgtagtcgcgatttagatgattcacaaatcattcaggccattgacgagattcgtcaacaagatccgaagtacacccgcaaatatggataccgacgaataactgatgttttacatgattacggctttaaaatcaatcacaagcgggtcttacgtatcatgcgggagcatgactggttatgtcgagcttttaatcgccagaagcgaaaatataattcttacaaaggaaccgttggggtgatcgcgcccaatcgacttaaacgacgcttcaaaacagatcgaccttaccagaagttggtcgccgatgttagtgaatttcgatacggaaacaagagtcaagacgagcgggtctatttagaaccaattttagatctcttcaacggagaagttttagctttcaatattagtgatcaccccaccgttgaattcgccgtaaagcctctgaaagaagccttaaatcagataccggtgttagattatcgcaccaccgttcatactgatcaaggatttcaataccagcatcgtcactggcaaaacgtgcttaaagaccatcgtgcatttcaaagtatgtctcgtaaagctacttgtctcgacaacgccgccatggaatcgttctttcacatcatgaaagtcgaagttatggatgagcagtttgagaccaaagcagcacttatcaaagctatgaccgaatggatagatttctacaatcaccgtcgtatcaaaacaaaactggacggcaagtccccggtaaaataccgggaacttaccgcccagaaagcagcttaataaagttgtccaagtttaagggttcacttcaggctatgatttttgataaaaggaactaaaccagtccaagttccttcattttattggtaatatccgcaattgccgcttcttcatcctcaccatcagcagaaatgacgatgtccgcattcttcccgattccaagagacatgacactcataatcgacttcaaattcactattttatcgtgatattgcaagttgatttttgattcataatcatctgcagttgagattaaatcgagtgcaggacgtgctgtaataccggtttcagaaacggtgtgaaaactttccttcagcaaatgaccatctcccgtgaatgagttacattttgataattaacgccaggtcggaatggctggcaaccatttttgatccttgattggttatacctttcattgtaatgtaaacgcattcatttttcaattgttctcgccatttaaactgtcattagcccttaagctgtcaccataaaacattgccatttaatttttagcaatcataaactttttgttcgccgtaacgtactgaccattattcaaaacgtatctggttgaatacttgtgcttaaccactttcttgactttgagtatggcaccttttttatagtgctttaccttctgtgttaacgccaattttttatacacattaacgccctttcgattgataatcgtcacttttttactttttggaaccgactgataataaacccgcacaacgtatttggcgctggccgtgatatagcccttggttcctttaacgtattttctggtatatggattatattgttgaacgcggtatcttaatttgcccgtattgtcacggagatatcccttgacgataaactgaggacggttaacccgtttggcttttgaataccacttgattcggttgtttttgttaaaaacggttttcttatataaaccaatcttcttagtcgcgtaaactgcctcacccttaacggctacctgtggcccatcacttggaacaggttttgaactgttatccccattggtatttgaatccacgtttggctgattgcctgagctattgttactgttgctgcctgagttatttgaattgtttccgctagtccccgaatcgttagttgaaccatcgtttgcgttattgttaccactactaccactacccgagccaccagttacagtcacagtgattgtttttgaaacattgtccgggagataagtgtaagtgattttatatttgcccggcacagccgtattcacagaacccgtaaccttaacatcggctgctgaggttaaatcaacctgtttgccgctatgatcaacaatttttccattatcggctgccttccacgtgctgcccgaattaatggttgaatcatgtgcatcaattacctggcgcaactcaacataaacggttccgtagccgtctttgccggaaacatcaaccggttttccggtattagggtcggtaataggtgagccgaccgacgtattgtagctgtaaaagtcatacatttttttagtaccggaattaacggctaccgaatagccttcgtcacggacggcatttttaatgcgatccaattgaacaaagtaaaggccacccgtgtatagcttggtatcccgagcactattaaaatcaacttcatttgatccactcgggaaattattaattcgcagttcgtttttagcggctggatcactcgcatcattcatctttggcataagccgttgaatattgtttggcaacatcaaatagcgatttttatccctgattgtcgcaatataccttccggtgctgctcaacgtgctgttaccattgctatcattaatggccttaccaaatctaaagtagctgtaaatcgatattccggaattatgcatcgtattgtctatattgaaagtatccccaactttgaccgccttgggatcgttaatctttaaaggaatctccaatttatattcctgacctgccggcaatttcccggtaatattaaaggaccttaattttgttggatcatcattttgatcatttacatacgaaaaccacctggttgtgaggccattctgtgtttcttcagaaaaaggtctggctgcaacaacctgcgagccgggatttatccacctgggtaaagaaacctgataactgctaatcgtgtagtccttatccgttgtatttttaattgtgacttcctgtgccagagacgttactttatccatatcaacaatggcatcgcttttctgggtagcaaaattcctaagtggatatggaccatactctccattaacaataagctgcgtattaaattcaattccgtcactaatcgctttttgttgcacactcttttcaccagtgtaggcatatatcgccgaagtgtcgtcagctgatgcatgccggcctgcggtaacaataaataacagaaaagcaaccgcaatcaatatcaatttaatcacaacatgccttttggttaaccccaccgtgttcattgatagcccctcctataattaataagaatcttatactaatctacactgtaagaataacaagattatatatattatcataggatgttgctctcttttttgaaaacgataacaatgccgttttaaaggcattctcagtgggttatagtaccggctaattaatgaaattggctctttgaaatcagcttaaaaattggctgctgtttcttctaaagtaatcaacccgttattcaaaagaatcattaattatcaaacactcacaactttttttgacagatgccggcttgatctttacgattgtggtaggatttaattcttagttaggaaatattatattgtttttccgaaaaatgcttggtttaacaatatatcactataaaggagccctgaaaatgttcattaaacgatacggcatgttaaccgtcgctgcactcacgcttggtattgcgattccggcaacagtcaatgctgccaacacaaatcatcacctcagcacacaacttctcaagaccggttcaaaacattcaaccaacaagaagagcaatactttgacagatcgtcaacgacaacacgtagccaaaattgtggctaaaaaaacacatcttaccaaagaaacagatggaacaatcgttgaaacctataaagatgccgatctttacggtgcaatcaaaaaagttaatcctaaagtttataagcaactgacaagctttgcagataacttatcttctacaaacacgtcaaccagaattgtttggcttgaaaagccgtccaatggcgatatcaacgtgttcccatcccaaaacagtgccatgctttatcggacgttgggatccggttatgacatgctcaaagccgaatacaatttggctggtgggacccataccgtcaatttacgcgctgcctacaaacacattcaaaaaattgtgacatccccaattgccgctacacctggaagcatgattacggttcgtaactggaaatcggttgagatagaagtcccaaataaaacactcaattaaagatcgacaaccatagtaatagtcaaccatccatttttgatcaagcaacaaaagcttgacataatgagctttcacccctaaacttcaatcaagcaaataaatcagcaatgaaaagatgagtagttttgacgctgtttcaagagaatcctcaactggtgaaagaggataacagcgctctacgaaaatggtcttcgagcggaatgttatcaagcagattgtgaaataacattggcaggtgcccattaccgcaccttagtgactaaatgatgtcactattaaagttatttagtgtgagctaaataaaaagtaaggtggtaccgcgaagaacaatcgtccttggaaattcgtttccagggactttttttattgtgaggaggattatcgatgacagcaaaaacacagctcaaatacccctatcactttgatatggtgggaagcttattaagaaccgatgctctaaaaaacgcccatgaacaatatgaccagcaactcattacagaagatgaactaaagcaggtgcagcacgctgaaaccaaaaaaattgttgataagcaggttgctttaggttttaaagatgtaacagatggtgagtttaaccgaaactggtggcatttggacttttggaaatcattaaccggcatcagtcaggaattcaaaacaaccgtttcatttaaaggtggtggtaacaaactccacagtgctcaattggaaggaaaagttgcttacaatcccgaccatcccttctttgaaacgtttcaatatctcaattcaattacgccggacggcatcatcgcaaagcaaacgataccgtcaccaactttattattcggtacaaattggcgagatttttacgatgactgggatgagtacctcaatgatctgtccgcagcttaccacgataccattctgcatttttatcaattaggagcccgctacgttcaacttgacgataccaactgggcctttctcatcagtcaattaaatgccactaaggatgacccgatcgagcatcaaaagtatgaacagcaagcggctgatgccgttaggctcattaatcatattcttaaaggcctaccggaagacctcaccatgacaacccatgtctgtcgaggaaacttccattctacctacgttttttcaggcggttacgatgtcgttgccgattaccttggaaaattaaattacgatggtttatttttagaatatgacagtggccgggcaggaaactttgatccacttggtcgaatttggaatggtgatcagaataagcgacttgttctcggcttggttacctccaaatcccctgaattggaaaacaaatcagaattgattaaccggattaatcaggcagctgaaaaggtaccacttgaaaacctggcactttcaacccaatgtggttttgcctcaagtacagttggtaacaaattgactcaagaacaacaatgggagaagctacggttggttcgggatacagctgaagatatttggaaagattagcccgttgtctagcatgtcatccttaaaacattccacaattacccaaaaagcaacatttacaaacgatttccttgtttgccagaagacctaatctcaatcattaaatttttaaaatcaaaaggactagccattacgttaaaacgcgtaacagttagtctttttagttagactttgttttcctatactaaaccaaagaattcaaaatgtgccactctaagactgatcaccatctgccgccctcatttttgcaggccgaataatccaaagcccaagtatcaaaagcagtgttgcgacacaataggcgaccgattgggcaaaaaacaaataatggtgtggctgacctgtagccgtcaagcttgtccgtccgacgaacaggctcaaactaccataaaaggtggacgtcgctaatgtcgttcccaaaaccatcccgaattctctagctaatgaattagaggcaccggccattcctcttaaatcagtgggaacgctactcataatcaacgtgttgcttggtgtattaaaagcctcggtcccaatggaaatcaggatagaaatgccaccgatcacccaagactcatattgaccgtgactaagtgccaagccaatttctgctaagattaacaaacaagtcagacccaatggcacattaacccaaaagattgcgtgccaagacagaagatttaaaaagaaccgcctatgcctaaattgacccgagcgcccgatgaactaacaatattttcaatttccggttggtttgaaaatttttatgtcattaataatcatattatcgcttaacataaatactctaaacgttatagtgataatgtagaaagcgtttactaataaagtcgagaaatgttataattaacagttatgttagtcattattaagaggtgaaccccatgggcgtaacaattaaagatattgccaaagaggcaaatgtatcaatcgcatccgtttctcgaatcctatccggaaaaagtgggttcaattcaaaaaaaaccataaaaaaagttaaagatatcgccaaaaaaatgggatacagaaaaaacacggcggccgttgaacttgtcactcaatccagcaaagtacttgcagtaatcgtttcggcaactaagacaaacttcgctaatcaaatcattaatggtattcatgaggaagcgtacaaacacggcttgaacgtcattatcatctatgctggggaaaacgatccccagcgacaattcgaagcagtaagaaccgtgattgaacgctctgtcagggggatcctgcttttagctttggatctgtccgatgagagttacaatcttttaaaagaggcgggaaccccttatatatttttatcaatttcgaataatcggggatttcctttcattgcctccgatgattatttaattggttatcaatccacaaagtatttaatcgataagggacatcaaaatattgccttaactggcttggaaacgacttcatacgtcggtaaaaaaagaattaaaggatatctggatgcccttaatgaggatggtataatccctaaaccggaatgggttattgacggatcttttacttacgaagacggtgtcaatactttgaaaagtctgggaaagtcctccgagatcaccggtatcgtggcatgcagtgattttgtcgggttaggtctcatcaatcaagcatccgcttggggcatcaaagtccctgatgagttgtccatcatctctgttgatggaacggaggtttgtgaattagtaaggcctaaccttacaagtgtgactcaatccttttatgaaatgggcacgttaggggttcgctatctgatagaatcaaatcaggatgaccattataaaaagtttactggattaaaaatcgaagaacgccaaagtacaaaacgaaacgggaaaatattaggataatcgtgataggttttgcaacaataaaaaggattaggcaaattttatttttgcctaatcctttttattatctctgatgatatttattttaatgagtgtaatctaaccgaattacgctttttcagcattctgacttggaaaacaaagataaaagccgaaagcgcaattaatatccaaaaaattgatgcaaaaggacttgcttgattatttaagtcattaagtttactcaatccacttaaagcaaccggtgtcacaaaggatccaatgtttgcaccgatcagtaatactgaattaccaagcgtttcagatccagcaggtgcaaccgttcctaataagttgaaggcgtatgatccaactagcggatatgaaagcccacaaacaattgcaccaagtccaactactagggagttgggcccaatgacaataataaatgcgcccaaggccataaagagaattccaatagtcagtgtaaactttttggcaatttgataaaccttaccaaacagaatgcccattaccatccctgccagtgtgttggctgaaataattaaactggcagtagtagccgatcccagcttatcgcttacaataatgttaggaatttgaacaataacggccgttgagcaaatgacaataaccatcatcaaaattgtcagagcaatcactttaaagttaactcgttgtctaacatttttactttcagttggtattggtggctccgggacatactttgaaaagaaagccataattgggaaggccaacagataaatcaaaaacgaagcgtgccaattaattaaaattaagaaaccaacaactaaatttaaaatcgaaactccaatttgttcagtagctgaacgaaatcccaacatttgtgatttgttatttccttggaaaaacaaatcgataacggtgatcgccagagagttaaacaacccaatcccaacaccaagcaataaccttgaaattaaaatagccacaaagttattactaaagaatggaaaaacacctgcgattccggtaatcaacaacccaatattaattgtttttttgataccgatctttcgcgaaattgtacctgacgctaataaaaatagcatcacggtaaattgttgaacggtcgcaattgtatcaagttgtgcaatagggattccggggaagcttcgcgccatactcggcaaggaagaagaaattgccgttcctgtcgttatcataaatgaaatagagagaatggcgaaagaaaaagtttttgaatttacatttggtactgacttactcaaataattacctccataataatgtttctctcttgacttattcaactaattttgttcattaaattcctatgaaagcctcatttcaaaaatgattaaaatgccttaatgtcggaatcatggctgatatctaacaatccacagcttctgatgcaaaccggtcatatccaagctgtccttgaaaataggcttggttgaacacgctttcatagagtcctataactaaaactcgctattatcaacgagttctatatcaacattcaattaaacgtattttaggttattagctttaagcaaatcttatttaaataaataaactttgctttcatatggtcttaaggttgttccctcatcatcgtcataattaccgatcaataattttgaggcatctttttgatcataatcacgcgtgattgtctggtctgtgaagttacttactaccaataatgtttgatctccgtaatgacgacgatatgcataaacttgatcatcctttggatcaagttcttcaaacgttcctcgtctgatgatttcattatcatgacgaagcttaattaatttttgatagtagtagaaaacagaatgatcatctttaagctcagcttcggcattgatttccttgtagttagtattcaatgcataccaaggtgtcactttagagaaacctgcgtttgcttccgagtcccattgcattggggttcgcgcgttatctcgagacatgttggccaagtacttcagcatagttggtccatcaacaatgtgcttttgatcaactaattcatgataagcgttcactgattccaaatcctcatactggttaagcttagtatgatgagcgtttgtcatgccgagttcttctccttcataaacataaggcgttccttgcatcatatgcaaagtagttcctaacattttggctgctcgaactcgatatttgggatcatcattactaaaacgagacacagctcgaggctggtcatgattattccaataaagactgttccagcctttaccatcaagtgctttttgccacttattcaaagcaacctttagctcgggaagcttaactggttcgtcgttccacttatcaagtcgaacatcagggttgggacttagtaggacatgttcgaattgaaagaccatgttaagttcgttactcttaagtccggtatatttaatagcatcttcaggtgttgaaccgggcatttcaccaactgtcataacatcatagtgtgaaagaacttcctcattcatctgctttaaaaattcgtttaatcgaggaccatcagcaacaaaagctagcgttgttccggcggttgcaactcctggaacatccggtaatccagcaggcttggaaattaaattaataacatccattctaaagccatcaacacctttatccagccagaagcgttcaatgtcaaagactgattgacgaacttcagggttttcccagttgagatcaggctgaccgggtgcaaacaagtgtagataatactgtccccgtgccggtacataagtccaagcagacccaccaaaagcggcccgccaattattgggttcgtgaccatcaaccggatcacgccaaatataataatcagcatattgattgtctttagaattcttgctttccttaaaccattcatgttgatctgacgtatggttaacaaccagatccattaacagtttcatacctttttcatgtgtttcagataataatttatcaaaatcggccattgtaccataatcaggattaatggctttgtaatccgcaatatcataaccattatctttattaggtgatttataaattgggtttagccaaataacgtcggcgccgagtttcttgatgtaatcaaggcgttctgcaattcccggtaaatctccgataccatcattgttgctatcttgaaaactcattggatatacttgatagacgactgaatctttgaaccactcttttgacatagaaaaaatcctttcggtataaaatttcttaattaagataacaaccatagattatcaccgataggaaacgtttgcaatgcctatttaaaaacaactcaaacgtttacgtaatttcttaaaaaaagacgctgaaaaccggttatttcagaattttgttaaataaatgtgcaaattctgaaaatatcgtatcagcattatcacccctgccgagaacataattcagcactacaattataaccattcatctattggattaacggtctatcatcattttatctaacatctgataggccaccgaaagagacatggtgtttttaacatgttgctcaataaaatcgtcaacataaggatagctgcttgatccaattagtctaactgcttcactcttatctatcctggttctcttgaacaaaaactgctgattatccactatccaaagccattgggctccttcctgatccgaaaaaggcatcccgatactaccggcattaatgatttgctgatggccgatcgtcaatttaaattgcaaatgggtatgaccacaaataataaacggtgagcgcacgcttcgaaacagcgttttaattgttgcaacattggaatgcggcgtaaaaaccgtcgtgttgtccttggcgactgcgtggcaaaagaaatcatcgccgactgtcacattaagcgataatcttttcaattctaaaatctgtcgttcacttaattgatctgcaacccatctaatttgatcctgagcatgttccgataaaaaaagccgcttgccattataggcatcaacaacatcttgatcgttattgcctgaaatacccatcgtattaaatttttttgatagctgatcgattagttgcaaagtctccaatggcattggcccactaacaatatcaccacctataacaatcaagtctggctgcagatgatctagttgctccgaaactgcttttaaagcaggataattaccatgaatatcatagagtgcggctattttcattacgtcattcaactcctgttagtatattcacgtctaaaactggctagcacattatataaataagccactggatagcttcatttataaaactgttgaatccttcgatcaatggttttgattatgaatccacttatcaactttacgattaataagttcctcgatttcttcatcggttgcgccgacttttgacagtaacgcaaatgtcactagtaatacatccactaattcttctttcacattgctttgatccagatgcttgtatttattacccgacgcaccttcactagacaaataagcctgtgatgcctcgccgacttcctcaattaacttcataaattgttgctccggctttttaggttccgactgcgttgctttttttattttatcgatcatattgtccattttttcagctcccaaaattattgtttgatatactgctattatcgattttatgacagctggcgtcaattctctctaaaaggatagaattacaatgacttacccataaattccaaataaagaacaaagccatcccggatactgagttatctcagacgcggcatggcttttaaactggttaattcagctgtgacttgttcgataaccaaccaattaggtttaaaatagacttgtcagaccagatcagcagtctattctaagatttaacgtttcatatttcaaattaagtaagatcaacaatcaggttatcttcgttgaattcacccactgatatttctctaataactttttttaattcggttttagacgcatagactttgctcatagccaatacgtcgttctttttattttttaacaggaattgatattgctcttcgttatttttaacgattaagaaaaaaatttccctcacctccacttttgggaaaaatgcaaaacagtaagattgctaaaagttacttcattatttaactctttttccatcctaaattcaactcaaaagacgggtggaaggagggcaagaactaatgtccacattgactgcatgatgataaggagctgttaactatggaaatcaatattttaaaccaacacactacagaaaaggagaaatgggccgacatccggcaacaaatcaccacctttaaatggggcggtgcccaactcaccgctaaaaaaatggcgggaacaatgggcatcaacgaacgggttattgtggcgattgaccataaaaaagtcgttggtattggttcacttgttcgtcaggatattgccgatctcccccaaaccccctttatcagtgcaatttacgtcgacccggattatagagagaaacacctcggcacacagatagtaaaggcagcgcaatcaaccgctaaacaactcggatttaaagacgtatacgttatttccggacttgataactattatgaaaaaatggggtttaattatcagggtgatgtcacagattttatgggacgaaaaatgaagctctatcataaaaatatttaaccagaattcaaaagcgaaacgcatgccgttcaatataacagcaataagtccgcatcatatttatttttataaattcgtttttgttaaattaatagaagtttcgaatataattaccgttaagcaaatcagttgtctgtacactgataaatgcttttttatctattttgaggatcaaatctttaaaaaacgaaatttcactcttctgaatgatggtgataaccatatccgtctcttgatttttataaatacctctgccgttaaacaccgttgcaccatgtgtgtactgacgcaagtgatttgccaacattgcagatttcttagtaaatataattaacatgacatcactttgctggatgtatattttatccatcatgtagcttgttacgaccatccccagcaaactataaatggctcctgaaataccgaagaaaatggccgttgcgcccaaaataaacccatttataataatgtttacaaaaccaatatttttacgaaatctttgttgaacaaaactcacaataacatcggttccacctgttgaaaaaccgttacgaaaacaaagaccaatcccaatgccaataataacgccgccaaccaacgtgttggtaatctgttcggaaattaacttctcttctggaataatctttaaaaaaacgacgttggaaataacagccactactgaaaatatagtataatcccagccaaaaataattagtgaaataatcaccatggggatattgagcaggacaaccagtccagcaatactaaaattgatttgatttaaggccaagagtccatgcagtaattgcgcaattcccggaataccaatcgagtaggaatgggcggaacttaaaaacaagttgatcccaatagctgaaaacaggccataaatgaccgccactattaatttacgaagccagttataacgatgcctgtagatagtaagagtttcattcttttccatagcaattccagctttatctgagagtcaattccgatagagaagtaggcgcatgggtcatcagtttatagccatctttagttattaataccgtatctgaatgacgatagccaccctgattcttaaagtaaatggctggttccactgaaacaaccatattttcctgcaaaaccatatcattcccaagagagagagttggccattcatgattattcaagccaattccatgacctggacgatgtaaaacactgtctaaaacaccctcttctgcaaaataagaatcgaccgttttttcaatgtcacttgccttttccccgggcttaagatgctttaaaaagagcttacgagcattcatcatttggttaaaatgtccgacctcttcttttgtcgggtcttcagtaaagaaagttcgttcacattcggcagcgtatccttgaataacaaacagtgcaatattaatgtttgggccggcaccaattttggcgttcatatccggaatgctatgcggcataaagctatattcggacggccagacggcgttgattgtcctgttttccagactgaaatgtttagtcatttcttcagccccaacttgcatggcaagtttataagtatcagaaactttagtgcccgtcttcgacatctccaaagtcttttgcacaacactgctgcagatatcagaaacatactgaagtttatctaactcatagtcacttttgatcatccgctggttttggaccaaaaacttagtttcccaattgataccttgagtaaaatgcgtcattaataattgaccgttggcttcaattccgacctttgataaaccaccaagataactcgtcaatacctcataccaattttgaccggacctggaagtgacatcaaaataatgatctaaatcatagtcaaagtatgggactgtaaaatgatcaacctctaatttcggcacaataaataagggcttcctatcaggataaaccacaaataagaaaggacgctgctccgatttataattaatgttcgtaaaataccaaatatcttcttgatcagtgataacataggcgtccaagtcattatcctgaagattgttttgtaaggtagtaattctgtgctttatttctgtttgtaaagaattcatcaatttaccctccattttctctagtaggcacatgtttaaaatacgtcgggtactctctctacattctatgtgtagatgccgatatactaattaattaccatgtgtgtattagacaatatagaagcataaaaaacatttgacaacatcacaaatcaatcatttggggcttatgccacacaatcgcttaatttggtaagaaagtaggtacattttatggaagagaaagtcgatcggcgcgttatacgaacaagaaaagcgattcaaaaatcatttgaagaacttgcaaccacccatgattatcacgatattacaattaaagaactagccgagaaagccaatattaatcggaaaacattttatttacactttgactcaatagaggacttggtaaattcttatgtaaatgaagtgacccaacggttagtcagcttatttaagcagcggtcctttaaagaaaactatgaacatcctggtcagaatttaaccgaacttatcagtttattgcaggaaagcaaagatttttggtcgcggttattattttctgacgaatatagtttctttaccagaaagatcgaacggatggtagccaaagaaatgacccagtcaattttggcatcattttcaattaaccgagatgacgccaaactttgcgctaattttttaattcaaaacacattgtcgacacttagattctttataaacgatcaacgtaatactgattatgatcagatccaaaataaaatcagtaggcttaacacctttggcatcagcacattcttgaataaattttcttccgggccacaaattgaaaacaggtgataacagctaaatcaaccttatagtatttttgtgctcatcatcgcgtcaactattcagttgagtatatcaacaataaatgaagcagataccctacctaatagagtacctgcttcatttttatattaaaacccatcaagattaattaatccaatgaacccattttattaaaataatgatatcaactctagagaacaacttgttttgccaacttttcaagaatagccgcaaacaccgacacaacatatggcacaagggctacaaccccgaacatcagaaccaatccgggtgcgtcttcactatcggcaacccgataaatgaatggcaggaaaagtgtgtaacagatccccatccccagaatcatttttttaattcgggcaatggcgttaatcgccgtaaccgagaaaacgttatgctgattaatcagatttagaatccggtaagcatttataccagcaacatagaagagaatcgctgaagtatatagactcgtcataaacaacaaacgttcaaaaccatattgtggataaatgacaccgagcttctttaaaagcgctgggaatgccaaaacacataggagcaaaactcccagtccaagaccaactaaaaccagttttaaaaaagaagttaaccatttcatcattcgattcctccttagctaaacccaagcgtagcaccacccgttcagctaagcaacaagtgtcgcctaaccaagtcaaaatttaagcaaaccacaaacttactcgatcttttcgtccgtaatcgcttcaatatagcctttggcaattttatcgagattatgcttgatctttttgaaatcgtgtttgttcgtgatgaagccggtctccaataaactatagtcgataccccggcggcgcaaaacattgcagtttcgcaaattggttcggtaactgtagccgtgataggcaggattaaggcccacatattttttaataacctgagcaagtcgtcgatcacgcttagttggtgtcggtcggtggataatcacatgtccaccatgggcgtatgcaccgctgcccgagtccaaatgaaacatgataaccgtggtctttttattgattttataagatcccttatggtagaccagcgtgtcacggacaatgtcgtgcttgggattgtaaaaggtgactttgctgtgcttaacctctttcgcatattttcgaagctcaggtaataattttgcccgcataaaatgcgcttcgtttgtcccgttgccgcgagcacccggatcaccggcaccatgccccattaccaacaaataatgatgcatgggtttggtcgacttaacagtctgtgtagttggcttttcagccgctgacacagataatttgtatgtaaatccaactactaataccgccagtaatgttaggcacacgaccagcacattttttgattttctcataattagccccctcagacttttacctttaccattccagtataccctagccactcacaagccattaatattttttgactcatatactttgagaacacgctattatattaaaccgtcccggttgtttttgagagagcaccaaatcaagcaaagtcattaagccttacaaatagtcgataagatagcgccgagagcccaaattcatttccacaaagaaaaagcgcctgagataaaatttctcagccacccttgtttattgcataattttgttcaatataatcagactttttaatgcttatttttattcaacgctatcttttcttaggtttcttattctttttaccctttttccgaggcttatctttccaatcctccattgaaaccacatttggcttaccttttttattatctggttggtcaagcatatcaaaaggattgtcgtctgatgaatcgtccagtaatttgaaaagcgtttcgcttggatcggttttgttttccttgacactcaatattagttgtttggtctcagaataattggtttcatcctgacccaaacgaatcatttccggtgttgcttcatcaatagctttctttaaagatttccccaccgttgcggtcatcaactgggtacctgcgataaaatcaataaacgcttttaggattggtccgaagctttgatagtcttttgaagcaagaaaagcatctttgacgatatatcctgttaaaacagcctttaatgctgatccggtccactcctcgaaaggcaactggcggtattcaccatataggtgtacagccaaactttgtattgtcagaataatattatcctcgtcatcttcgtccacttgaccgtccagcttattcagagcctttgaatcaataaatagttcagccgctttctccgcctgacgactaacttcattagccgtttctgatcggtactcatctaaatccgcgcgatcataatgatactcatcccgatcaatatcagccatatcatccattggagacaaataggataagtcctcgccaaagactccatcaatctgttcgccggtcaaattgatacttccgctgacagaaagccaagccaaaaagagatgtcccaatgtcaaagtatgatcaacaagatcgtcaaattcgggttctgcatccgttggtgctttatcaagcataccaatggctgcctgaatgtcgtcctcggtaatttgtggaattgattgcgcaccgttaaccaccattccggacataaatcctttaatgagggcgtacattgcctcaagttcttcatcactttgaaagctctgctcaccatcgttattttcatccacaaagttttgccaatagggtgttaagaaatcatccaaataggcatccatttccttttcgttcattgttttctctcctcgtactaatcatggttaggtatataattgctgtacttgcgcctatcgatatataagtgtgtttagtataccaaataataacagaacaaaagattaaatttaggattaatagtcacacaccctgttttgctattggttttgacttgaccatcctttacttttttctgcttagaagatacaactatcaatgcaaaggggaagatcactatggatcctattattaagagcagtgccaaattaagcaaaagaaaccagatcaccgttccaaaagttgttagggatgtcttgaatgttaaaccaacggaatatcttgattttgagatacgaagcagccatatcactgttaccaaacacaaggaatccgtttgggatcaaatcgaaaagaagaagaaagcctatcacattgatggtaaaatcggtaatcctgaaattgattggggcaaagatgctggcaatgagagtattggcgaatgagaatcatcctagaagatgctcactagccaatgatgaaatcaaatcatccctatagcatcccttatttttatcagtacaatattaaaaataggctcttatcaggtcaatacagacttgataagaacctatttgttttagcctaatttcagtacggctgataaccgtaactgattttagtaattacctgcaataattaactttttattggcagtaacatacttgccattgcttaattgataacgcgtggtcaaattatgtttaaccaacttcttaactgttaaacgaacacccttcttatagtgtttggctttaccagttaagttggctgacttgtaagcattaacgccctttttagcaatcacagtaatcttcttggactttggaacactagcataataaactggtacgacatatttccggctggcagtgatataacccttcttgccggcagtcttgcgtccatggttaacatcacgaaccttgtatctcaaagtgccattgctagtgcgtttatatccggtaacaacaaacatcggccggttaatccgcttttgtttaggataccaggcaatccgcttgctcttagtaaaactagtgctcctatacaaaccgatcttcttgatagcataaacagcttcgcccttaacagcaatgttaggacctaccgaagtagaaggcttggttgtcgtagttgtcgagccgtttgtgtttccggaattgttaccgttgttgctgttattgttattattatttgtgtttgacgtgtttgtaccgccattattcgatgtccctgttgttggtggcgttggatttccttttccaactgtaatcgtaatcgtctttttgacggttaaaccatcgtaaacctcataagtgtatgtgacatgatagacaccgtctttagtggtatcaactttattaccaggtgcggctgactcattgttgtttgagtcaactttcttaacaacgtaacttgctccatcagggttcttgtcaagctttgattgatctattccatagaaggtaacaccatcatatggtgcccatgcaccatctttggttactggaattgtcctatcggaagcatccaataattgttggacctgtagctcctgatccatcgggcattttaacatcggccaatggtgagctgtttgcaacggaataaacataatcttttgcttcttgatttgctttaaacccccatcgataatctacagagggaattaaaaacgaataaccattgttatgcaaatcatccgctaatgtgcccttcccagttgcagaaggaattgcatccaattgaacaacttgaagaccatctgtatagaaaacattgtccagacctgccttatcaacaaaggaattagtgttatcataaccgattgcattcaaagattttgttatttggggaaaatacttctgagcattatttgcaaaattaagtgtgctaggatgaccaggatctctattactacttgttccggctataaaatagccctcataacctggttgtcgataattcaactcaactggtgaagcaactcgagcccagttctgaatacttgtgtatacagcgctcgcattatatgaatagtcagcaaacgtgaacttcccgacattaccattagcatctgggataactttaagcggtacatcaatttgaatcgatcctccagctggtattacattaccagctttaatcgaaatcgcaaatatctgatcccaacccgaatcaggatgatccgtaccattccggccatcagcaaagtcataccaaatgcttgcattgtcaggattagaaaccggcttcgtatctccgtatacaatatgactattagcatcacccaaaaaattatgtgaaattggtaaatttaacatttcattatgaatcgttataggatcattttctgactgattagttagccgtaaatgcaggtataaatcctggtagttccccttttcgagcaaaaagttatgagtaactcctggctgagcagtaccataatttgatgattcagtttgaccactattattttttgcagtcatccaaatcttatgaatcagcccattagcggtacgtgagctattatcattcggatctaagtttgtcactgtcccattataaatggctgacgcgtcatccgcacctaccttatttggtagtgcattaactagcaatagtacactcaatactgccagtacaactgaaaagaacaatcttcgcatctttgttaaattcttcatgaatcttcatcccccctatattttgaaactggtacaaattcccgcataactaaaccctttaaatatgtacccgttttcacaatttaattgtaacataccgtgaacctaattcacaaacaacctagatagcatcaatggctaaaatattaaaacggtcttcttttaattatccttctttgatatttgagttgtttactcattatttggatgttaatcacgattgacgcgatactgacttgtaagactctgtagctcaaccctcaacacaacgggcataaagaacatattacccaaaatagacattccatatgagatatatcagtttgagtaatatgctttttatttattttataaattatcttgacatttaaaacgtacgttcgtatcatagagataagcaaacaaacattcgactggtgcttttacgattagtattttgatagttctagagtatttttgactctaacaatttacacattaaatatcagtttacgttcgcaccaaaataatcaaagccttgggggaagtgatgatgatgttcatagataaagaaccacacggtgtcttctttttaatcgataataagtcattttacgccagttgtgaggcggtccaacgtggcttcaacccgctcaaaataccattagtcgttcttagcgaacaagaaaatacgaacggcggccttatcctggcaacttctcctgaagcaaaacgattattccatcttaaagccaacgtttcccgtcaaagaaacttgcctcaagatcctcggctatgtgtggtgccaccacggatgaatctttatattaaacgtaatttacagatcaaccagatctttaccgaatttgcttccgaacaggacgtttggccttattcaattgacgaaagcattgttgatatgactcattcatggaaattatttggtaacactcctcgtgaggttgcccgcgtcattcaaaaaaccgttcgcaaaagattggggctctacaccactgtcgggattggcgataatccggtacaggccaaaattgccctagatgtttacgctaagcatacccctgaacttattggcgaaattcattacgaaaccgttccgaaaacaatttggccgattaataatctaaccgatgtttggggaattggcaatagaacagccaagcacctcaatcgactcggcattcacaacatgtatgaacttgcccacaaaaatccgtacctactaaaacaggaaatgggcctcatcggtgaacaactatttgcgacggcatggggcgttgatcgttccaaagtcagccataaaccggtaactaaatccgccagtttgggtaactcccaagtactcccccgtgactacctcggtcaacaggaaatcgaaacagtcattaaggaaatcggtgaacaggttgctgcacgtctgcgacaccatcacaaacttgcaagctgcctatcactcagcatcggcttctcatatgcggcaactgcagaagacggtcgtggcggctttcatcatgcattgagactgccaccatgcaataacaaccgtgaaatcgttaagcaattaatcttcatgtttcgccaagattggaacggtcaagcagtccgtaatattgctgtctacacgagtcgattaacccctgatacgcaccaacagttggatttgtttatgaatcccaaccgacaaataaagaatgaaaagctgggctatgtcattgatgaaatccatcaaaagtttggcttcaccaaattagtctacgccaccagcttaactacgggtggaacagcaattgaacgttcaaagctggttggcggacacaatggaggaaattcttatgaataatgatttggatattatctatagccgaatagaaaaattatttaaaagaatgagtcgtacccgctactggatactggttaacaacgatccatacgaccaaagttacaatttcttttttaacagtcaacgacagggggaacgtttgaaatcagtaccgctacataagctgattaactatgacctttcctatttggaacaagtgattaaagggctaaggagtaaaaccaacctgacaatcgagtttaccggttttgcaggtatgaagtggccttctacccaaaaagtcattcaatggaggcgtgagcaacttgaataatgatcattttgacatggacgttgttaacaatttttttgaacatgattaccatgatcgaggcatggtgaaatggcagggtttctatttatcagatcacactgcggcgttaaataaacaagaagccaaagatcaaaaagtttatcatcccaaatcccaacaatctctcgaaaccatcacaaccatcttggcagaagcttatcaacgacaccgtgcggttagccttcaactaaatgagttggacgcaaacggtaatcaactccccgatattcaaacgcatgtatacggctatcatagcgacaagattatcatcgatgatgaaaaggctgtttctattgatgacattcggcatgttgagcgtatatagacatacctacgttaaactcattatttaacttagctaccattttcaaaaagatgcagctaggacaataactctcttgtcctagctgcatctctttagataccatactttctcactttatcaggatataactgataaaattaaaaccaagtaactatttttgaatcacaaacttcttatttgccgtaatatattgaccattgctcaaaacataacgagttgaatacttgtacttaacaactttcttaacttttagcaaggaacctttcttatagtttcttaccttacttgtcaaagaagcctttttatatgatttaacaccgttgcgattaatgatcataatctttttactctttggaactgtttgataataggcaggcacaacatacttggtactgctcgtgatgtaacctttagttcctttaacatactttcgagtatatggattatattgttgaacacgatatctcaacttaccatttgtatctttttgataacccttaacaatgaattcagggcgattaactcgcttagcctttgaataccatttaattcgattgttccctttaaaatcagccttcttatacaagcctatctttttagttgcataaacggcctcgcccttcactgcaacgctagtcgatggttcagtggcagtacctggttgagtagttgccgaggaactgttttgactagaactgtttgccgtggtacttgacgatgagctacttgatgagctagttgttcccgttggtgtggttgacgtactagtaccgctgccaccagtggaagttgtcggtctagtaaatattccattaccgcttgtaatcaccttaattgtcgagctaaataagtccgctatatgtttattcccagcagctgtgaggacaacattgtatgactcacccgcaactggattagtaacaacatttccattactgtcttgcaattgaagatcatttgcaacgggcgtataagcagcgtgattattagcagcatcaccagtaaacgttaccttataatcactgggatccaaggtatctttactagtagatgagcctgataatctggcaatgactgtgtctgcagcaggtacagtataagtgaagtaagcatcattaagcgcggaatcaatcttaacgtcatttccagcctttgccttaatttgctgcattattttagccttaccggaatctgtcaaaacaactttgtacgtctgaccaggtgtcatcgagcttggagtattaccgctattatcttgaatgctcaaatcactatcagtcaaattacctactgtaaatccgttcttatcgttatcgccagttcgatacataacgtccacatagtacttggacggattgagataagaaccaatctcactaccctttaaaatatatgaattgggcgttagaaccgtgacgttaaccgttttagaaactttttgtacatcaccatttccatcagcgaatttggcatccggaactgtaaaagtaaccggataaacgcctgctttgctagtattaacttgactatgatcaatcttcaatccagccttttgagccgtgtccaagtctttgatcgttgaattgtttgtaatccattgtccgaacccttgactagcatcgaacttaccgttaacattcatttgccaatctctgacatccaacacttttcttaaggaaacgtagtcagcataattatcacctgtaagtggtagttcttttccttgatcatcaacaaacgacggaccattgctgccgccattgtcccaagtataagtataatgcgaatacattgtattctgttcttgtccaccattatttacatactccatagaccaaccgtattttgatacgacattaaagattggcaagttattaacgtaaaaagttcccgcgttaaatgatggaatcgcattttgattagtcctggcattttcaaatcctacaccaaatggatcaaaaattaccggattatctttagcagttgggagcaatgcttgaacatcatcaggtaacacctgatatttccagccgctaggatctcttgataataattgagttgccaaatatggtttattattcacagtatccttaacctctttagcaaaagacggattaagattggcctgtgtcaacgttccaccttcaaaactaaactgaatcattttaaaattactaaaactctcgcttgttggatcagataccgtcaaaggaatactgagcgaaatggtatctttatcagcaagtttattgccagtggtaccatcaggtgtggtgatctggattgcaaaaccaccattccaattttttgcctttaaattattccagtctgaatctgtgcttgcagaagtgtaacttacagcatcaccatttcccaaataaattcttataacctgaattttgctagttaagtccctcaatttagaaacaagcgcatctttgtcagtatcgctgatataaacacctttagttgacaaatcagttaatcgaatttcttggttaaccggctgtgctgaaccagaattattacttatatccaaatgagccaaaaattgtgtgttaccatcactcttccacttgtcataattaatcggaagtgtagtagtacctgcagaagttggatatccttcacctgttccctgcttgttaccagtcaatgtcatggctgctgttacaccatttggtttagctacaaattgacttccgccgttgtaaaatgaaccactataaccagcagcaagtgctgaaacacacataaagcttaagctaataacaaaagttactaatgttttagtaattaatgctacattgttttttcttagatgcattgtcataccccctagcttatttatcatgaccgtaacattagctctcattaaaataccgctcttaccctcttttcgagaaatgttaccaatcaataacaacttgcaataaccattttaacatttaatggtgtctaaaacatgccatatacgaaactaaacacattttgcttaaaaatctcaaaattgtagtttaatttattattaaaaatacgcagcataatttaaaatatgccgcgcactttctcaaaatatttcgataaaaattaccttcaaatcacaaacttcctgttaactgtgacacaataactatcaatcattagttatttcatagcaagctgtctaccaaattccctcaccgataaaaccgatccagcctaattgacggaatctttttagctcgcagataaaaccaagccccagagaaaagaatcagatccaatacaaggtttgaaacaataaatgtggcattcacagtagttgttgacaggacgcttccaacagcgacggaaccaacgaagtcccaaataccatggaagagaatcgacatcatcaatgatccgggcctgatataaagagcccccatgattaaagccagtgtgaatgactgaatcacttgaaacagtgtattaatggctggttgagaaaaggcattcgttgaatgatccaacccaaagatcaaactggtaatcagtaatggataccaaatttgacgtgctttggaagtctgcttgctaaacagtctcatcaaggttcccagaatcaagccgcggtaaaagaattcttcgaagatacccgcaccgagaccaacggtaatgcctaagggaacatccagatgtgtatttgtaacaatccgttgaacggcagcaacaatcacaatgtaaatgggtaccgccaatataagtattcttccccatgaaacggtcgggatcaaattgatcttcaccttaacaataaatatattgatcaaaacaaaaataacaaaagaaataatttcttgtgcggctattgctccggcttcagataaattaaacggatctaaaacgtagtgaggattgaagatgattaagtcttcaaccacaatcaggccgataatttcccaaatgtaacggctagtcgatttgttcattaagttcactctccctctcttgggctgcttttaacccaaaactattttgaaacctagagcgaagccagtcacgggaaacggtccctattatcatttaaaaacttgataacccaaatcagaagactcatcatttgaaaatcaaacgtatcatagcccaatcctatttgagcaaaaaaatatctttccaaattcaccattcataaacaccatggtaaatttaaaaagatattccatctgactaactcttatccttctaatcaactgctactaaagtgagcttacttcactctcttaatcatcataatcagcaagccgccaacaacacaaatagctgtttcaacaggaaacatcgctttataacccattgttgaaatcgcaacagctgcgatcatcggaccaaagacctgtcccaatgtgttggccatattgataattcccaaatctttcgctgcagaatttggattaggcagaacggcaacgtttaaggcctgatcgaccgcgttatacgcacccattccgattccggcaactaaagcatagacaaacatcgtccagggcttggcatcaaagaacgggaagaatgccccaacaccaagcaaaacggttgttagtgcaaccggcgcctttaatcgatgcattttatcagagattggaccggctaaagcggtaaacagaatgccggttaccatcaaaatcgatgacattgtcgcaatcgaagcagcggttgccgcctttcctaatttcatataatcggtaaaaatatatagctgataaccaacaatcacgtattgacctgtaaccatgagtagttttccagccagcgccaaataataatccctcgcgccctttgttggaaacatgaagttttgcttaatcgttgcagcatcaaactttactcttggttcatccaaattagaaggttctttggcaagaaaggctgaaagcaagccgccaatcaaggcaaatgctgcaagcacctggataccaacttcggttgtatcgataaattgtgatgcaatgatgcctgaaccatagtttccaaatgccatcccgataccataaaatgatgatatcgttccccgccatttaggagcaacccgatcggagatttgagcgatcatcggtgccacaacggcgtttagaacggcctgataaattccccaaacaatcagtaacattgtcacgctggttgccatcgataacgctaccaaacataaagcggatagaattgaattaattacaatccaaggtgttcgttttccatgtttggaccgcgtcacatccgataatgcacctgcaataatattggcaattgtcgcaacggtcatcgcaatcgctgaagcagcggctaccaacggaactttgtctgccggtgccagttgaccaattttagcaggcagtaaggttgccgaaaccccaacgtatgggcccagccaacatgcaggaccgattaataatgcaaatccgagtttaatcgggcgtttgggttgttgagaatctaacacgccaactgtcgaattttcttgtgccataatgttcattcctttcaaaatataaagctcatttaaagtcacatttttaaactttaacgctattcttccggcgtaatcttaaagtatttaaagtcggcatacgattgtcttctgtacgcatcccaagcaccgataccacccatcaaaccggtaaagccgcccgtttgttcatccgacataaacgagatatcaatcttggggccgagtttttgccaatcatcggttcctttgacccggtaatagaactgaacgtggtcgtaatcaatcttcgcttgcaattcagcatgatttgacggcaatgcgatccggtcaagaatgtattcatccttcttgcccttttcacctttcataattgccaaagcagtcccacctaaggtttctgaatgatagattcgggcgaatagccaattgctattgtcgtagtacagggtcaaaccggccgattgggaataatgaatcggatcgaaatccaatgccgttgacaccgttgatttaaaggaatcaatccgtgatgccagcagggacacttcaaactgactgaagaatgattgacgcccccgaattcttagccatcccggtcgtgcatcaaatgaacaccagtcctcggttcggggaccatatgggctcattaaatgatgatcaacttgaccggtaccaaagtctgcatcaactccggctgcttgaggggcatccgaaaccgtaacccctttcattccttcggtcgttggttgtgctaacgtgccaccggctttcattctcaaccagccgtcctttgtccaggcaactttctgaattgacgtttcccgtccaagcgtacaattggttgtgccgggcaatggtcgggcggatagatgaacgacgtaccattcatccgttgcggtgtgaacaagggatccgtgaccacatttttgcagcggtgctttaggattatataaatcaagccgaagtgaatcaggatcgccacgccggaaataacgatacggtgtcgaggtgataatcggattttgaggatctgattcatatggcccatcaattgtcttggagcgttgtacaacgacaccatgaccatacccggttccaccttcagccgtcatcagataataatagccgtcatgcttatagatatgaggggcttcaaggcatccccgatcagtaccaccgcgactaatccgctttgtcggtccaaccagcttttgttgttcgggatcgaattgttccaaaacaatggctcccgggtgctgatatccttttcgcgtatcccattccaaagtcacagcccagtgcttgccatcgtcatcatgaaataacgaacagtcaaagccgatcgagtttaagtagattggttttgaccatgggccggtaatagcatctgcataaacggcatagttatcttggtcaaacaggttaccgttcatgttgtgcatttgacacatcacaatccagtattttccggttctttgatcataggtcaggtcgggtgcccaaacaccagccggcgtatcggttcctgccagctttagaaaagccggatcattgaaaacgtatgattgaagttcccagtgggccaaatctttagagtgaaagatttgaacacccggataccaattaaacgttgatgttgccagataatagtcatcacccactcccaacacggccggatccggtgtaaaaccgggtaggattggattcttaattgttgcatagttgctcataatgggccttctttccagttattttgatagcgctatcatatataaaatttaagttattttagtctcccaaacaataagatccactggacgaaagccatttaaacgcatatgataatggcagtagtttacttgtaagcgctatctataagcgtttatccatttttattgtgtcattcttttacgtggtaaactttggtaaacaaaggagcatgattttatgacaacgatgcgtgatattgcaaaaatcgctcatgtttcacccggtgtcgtctcaagaattatcaatgaagatccgactttaagagtttcccgaaagactcgtgaaaacgtcaaatcagttatcgaagaaaccggttatatacttagaaagagctctcgaagcgagattgccatcttactggccttaagccaacaacgggttatccaggatccctatttttccgaactcctttcaggaatcctatcattttgcaaacaaaataatttaaaagtagtcaaaaccttatggctgccggataaaaacgacctgtatcacttggacagactggacggtgttctggtgatcgggccttttacaaccgccgcaattgtcagtatgaaaaaaatcgccaggtcatttgtgctggtagacgacaacacaactatttccggcgttaatcaggttaaaagtaattttgatgctattacgacaggtattttaaatgactttctagccgatcatcgacatcagatctcttttgtcggtggttcgattgagcggattaatcgctcggggaaaatatgggataatctaattgacctaaggctgtccacttattatgaatgggcaaaaaagcattcgatgattccggacattatcaatgtcggcctaacgattgctgacggtcaaaaggcagccgttcaacttctccaacggcgaaaagaatccggttatgcttttccaaacgccattattgcgctcaacgacttgattgccagggggctcgcagatacattttcagaatctaacatcaggattccagaagacgttggcatcgtcagttttgatgatctatcaattaccagaatcaggaaaccaaccatttcttcggtaaagattccaaccgatgaaattgcaaatgccgccgtacgattgttgcgcgatcaaattaaccattccctacttggtacaaatatcattactgtacctgggcagattatttatagagatagttttccaaaactggtgcctgaacaataggcatttatccacgataagatccgctgtctgtcttcaattatgaaacaacaaaaaaagagtcctccacttttgtgaagaactcttttcgcgtaatatctaaattattattttataaatgatcattcgagggacgatcatcagatacattgtaacagcctattaaagcaattgacaactattgtatcgccccactgggcagtgattaatcgtctaccgttggaatattatccaaaagtgtcttcatttcatccctcatttgatccttcatcgatgatgtgaagccttttttcttacgatacatactcttagccgaatcaaaggtttcctgccaagatttcagcagttctctctcatcaaccttttcctgtttttcttctaaaataaatttaatctgttcttttaaatacgccagtactgccagtttataaacgacaattttaccgtggaatgtcacacaataatcgttttcgtagacttcccaatataattgttgatcacgggctggaatattgacaaccgttagcttggggagaacctgattcatccctaacccagaccatcctaattggctcccgtaagcaacaacctgtcgtttaataaagtactgatcggttttggaaagccgagccctttttctcagtcgattcattcgttcctgattctcaacatctgttttaatatgctcaaaaagcgatggtaacatttcctggtgaagcccctcgagtaattgttgcttaaataacggatcgtgttgtgccatccgtgccactatactcacaaaggtaaagtgatctaccggcttatccgccgaatcaattgaattgcttaagcgggttgccgcgtctagaactgcttgtctgtcttgagtcatgtattattccccattaatttttattactttactattttgtctataattacatcataggaaacaatggctaatggttcaaccatttaaagggaaacgtattaattatgccatgaaactgtaatttagatgtcttttttgtaaaagtttgttaaagagattgattaacagatgccttttgaatccaacaaaaaacgctcccttttaaaggaacgcttctcgtttaaagattggctaactgatcgctttatccaaatcctgaataattgtttttttattagccatataaatatcccgttgcgaacgcgcaattcgcagtaataatttttgccgatcccggttcggtgtttgagccgccaactgacgcaactcgccgtcaataacgtgggcatccgtaattgtgccacacacatcttgaaccctcttggctttccgcaaaatccgaccttctttttcaggaatgaattccgaaaaataagttgccgaataccgtaatgtcttggcccttttacgaacatgatgaacatgaaggtaatcatggaaatcaagttgatggtactgcttcattaatttgtgatcccgacgtttgaattcctgagcaattgatttgtcccaatccgtctcatgtttgaaattcaacgtatccaactgcgcttttacctgcattaaataggtcgccaaaacttcctgtgttgtgtccgtcaaagtcgtttgcatttcttcgtttcgttgatgataaagcccttcaaaaagtccctgatagtccgtttcttcctccggatgagcatacgcaaacttcccaacttgaatcattaggacgtcaaggtctctcaacggcccaaagattttggcagattgactaagatccccattaagtgagtcataaacaacctgtggaatccgtcgcttcaaaaatttgatcagcccacgcaatgttcgaatcgaaacccgtaagtcatgagctcgctgcacatcataaggattattccggtaacgaagccattcaatttgaatggtcttatattgttgattcagaattgttttgattgatgtcatgattttggcctcccttgatgcaaagtcaagataaagaattaggtacataaacacctcagtttaaaatacaaaaaagcatttacttagcttcattgtaaaccgaaatgatgatttgtactcattcaagaatgtgctcttttatataagtcacttgatcgcagtcaagctcccacttttttcgctatcaatgtgtttttctagaacaataataaccacccaaaactaattgtaaacataaagataaagcatcgtttttgcagtctaaaacctcactgacaacgtcaatatctttttaaatattatccctaatccaactaattcttcagtgaatcgaaaacaaaccataatacccaaaacaaaaactactatcgcatgtgctataatatatctcatatgcgatagtagtttagtagagcggcaacgctcctacaggtctaaaagagaaccgaagaactggccaaagtttaacgacggttcttttttattgcccgtattaactctgtcaaagcacggattaaatccgcaactgactgattgtacttggcaattgccctgattaccgcagccccgccaaaaagcaaagccgcccaagacagcaaagactaatacctttctcagaatatgattgatacgttgcatacgcatctctcctttccttggaagaatattcccgcccaactactccacaataggttattttaccaccaataagttaaaataactagaaagttatttttcgattctatataggttaactactcaattgataccaccatgtcctattccgaaatagcgtattactcaatgccaaaatattaccgctaacgatctagaatttatccgtaattcaccactcccaaaactaactaaaagattccgctatatcattcacaaaaaaatgatatagcggaatcttttcttttttaaacaaatgtggaattcactacaactaccggatttagccgtgcccctgtttaatttagcaattattttcttcacatatttgcgactattcttttaagctctgcgtaaaatccctcgtatggtccaccaagaataaccgtgtcattttttataagatatgcaattcggtaagtctcttttttaggaacaccacttttggggtcatccgcaatgttaacgtaagtatttttgacaaaaagccactttaacttttatccttgagtctcttgagataccctttcaagtgattaccaggtattattttataaaccaatttccgtttcaaaggccgatctgctcatttctggctctttttcggtttgtgaaattaaataatccaaagctttcgaaaaatcttttttagattctttaaacttagtcactaattccttgccggtatatccctggttagttaaatcctctaaaatatcggtatcaaaatcccatacatgatcatcgtctttgacaaattcataaacaataccattgctggtcaaacgtgggcgaaccggaaccccttccccaatattaaacgacttaggaacagtgaggataatggaatttccctgctttctggtttttgtaatatccaaaataatcagtcccttcgtttatacttatacttactacaaatatagtttaccatctactattctaattataggtaatggcatgaattaaaggaacagtggttaatcaggatattggaagtattcgttgtaggagaaaatttttctgcaaggatacgcagtcgtgaccttttaacttaaattaacattgtttattcgcttatagtcattttcaatcataatcgatttacgtaaaatcgctctctgtactaacgatggtaatttcttagcaaccctctaatcaccaagactcgactcttttccttaactaactatgatgttttccaattgggaacctgtatagagtttaggacaatcttcgaaaaggtataaaattactccggcattgtatcagtgccatttttttgctgattaaatagtttgaagacacaccctagcatatgtgagctttattttggaaactgaaatcgtcacggttcttggaaacttctacatcctaactaaaagtattaatcgccctttggaacagttcgcttatcaacttatctgatgcatgaccaattacctcaaggcttctagcaatcgcattataggtcgataattaccaggtaacgatatcaccctcgataccacttggcagatcaataaacgggtaatacaaattcctattgtcatgtgtagttgatgtaaccaccattactattcctgttgcgcgattgtagcttgattttgataaacgatgaatggacagcgaatattgcccttcttggggtcatgacctccgaattcgtgaccagcgtgaggttcagcgtcaacaactacaatatctcctcgtcgggataattagttgtcatatttcactaccctttcttggctcttcaggtgaaagcgtgctgtcttcttcaagaaccaacaaatatttttgccaactttgacgtttacttgtgaaagaaagcccgtgaatctacataagtacaagcaatactaactgaatagattgacatctatggctaaagcctcacattgatttttgagtatttatcaatcaatttagagttattttaagtattaattactcaatgatgatataatttctttgaggtgataaacatggctgcttcagcaaaaaagaaaaaacgtattcaagtactaatcgatagtgacttatatgatgacgctaacgaagtgttatctgatattggcatatcgcaatccaccttgatcaatgtattgcttaagaaagttgtcgctgaaggaagggttccgtttgatctctcccaatccaaacgtgatcggctaagcttcgaactccacaaggccgttcaagattcagacattccgattatcaaggatcaaaaggaagtcgcacgttacctactggaaaacggagacgacagctacgatgaataaagatgatataggccttgctttcatcgaatttgatcatcattccggtgggaagaaaagaccagttcttatacttggtgagaccagtgactattacgatgcttttagcataacgagtcagtttcaaactaaatccgcacaaattcagacagtctattttaaaataaggcaatggcaactttctggattaaagaaaccttcatgggtcgatacaggacatcatctgcaaattaaaaaatctacaagaattcaagttatcggtcaacttcaaattgatgacatcgctagattaattttattcttaaacagcagaaataaacgatagattctgtcttatccaagtaaccgtttaaaaatcaattatgttaaacgacaaccagatgttaacttttggggataacgccattcaattgaccttatcctttttttgaaagaaggacccgttaaaatggcagcactaaaagcaacgaacattaatcaatggctggataaagcaaccaaacaagagttacgagaaattgttttaaagcaggcgcaaacagatgatgccctctattatgagcttcaaaacaggtttggtgacctttcggacaaagagaagttatcggaactcagagcttatattcgcaacatcattggcgacaataatgacagaggatttattgactatcatgattgcattgctgtttgtgatgttttggatgatattacccacaaagcggcaaaagtagcgccaactgaagacttaaattttgctattcaggaagtcttaatggtcattaggtcaaccatcggctttttggaacgggctgacgatagttccggttgtaccactgaaaccttggattttgcgtttgcgacattggagaaattatccaaaaccgctgccacagtattatctgatcagcagaaaacggcactgatcaaatcagccgtccaagttttcaaccttaaaatttttgacgactgggacaactttcgttatgccatttttgaaaagacgatgccattgatttccacgaattccctgaagctaatggaaagggccgccgccaaaataagtgataggtatgctcatgctgccccgaaagattccgatttctttgatgatgttgactttaccgataattataaaaattttcagttaaacgagatcaaggcctacaatgccaatttaaagagcatgggcctcatcagcattggagactttgcagctgcgaaaaaagtgatggctgaaaatatcaccttcaactcggttagaaaaacggcaatcgacttttatttatctcaaaaagatttcagaaccgcggaaaaactcgcggtcaatggtgcattatctaaaaataataaccttgatgaccaagcgacatggtttgattacctggaaaaaatttatctgcagacaaaggactatcacaaactggccggtgtctacaagtctcgtcttctccagcccacctggggctccttcaatcttgatgattacaagaagctaaagggtgtcattcaaatgcacggtgattggcaacaggcctatccagcattattaaccgaattttctcaaaaattgacaccgacagactacgccagcattttaagttttgaaaaggaaacaaccaagctcatggccattgttgaaaaagtgccgtctttggttgcggaacacgggagagtcttatttaaacagttccctgataaggtcacaacactatactacaaggcgttggtcaatcaagatatcggaaatacccgtaaacgctatcgagaactgggaagaaccattcggcattatgcggattatggcgataaggggatggctcgttattggtgtcaacaattgatcaagcaatatccgcgccgctcggcacttatagacgaaatgcagaaagcctatgagttaatcgattaagctgcttaaaattatgacagaattcatataaacaaacgtggctcaacgatatatgacgttcgaataagtagcagtaactggtttaatgattaatttttttgataactcaatcaaaaacagtataaaaacagccaagatataagaaagagactgatgaatgaataccacacataaagacatttttaagttgtgtccctttcaatcgttttgcatttttatatagttaaaaaagcatcattattaaaaattgatagaaatgatgattatcattctgtctaatttcgataacgatgcttttataaacgtttcataactttatttaaccgttatgacatactttggattagcggtcacataaccaccatcaattcgatatctcaataatccgtgcttggtcatctgatgctgacttgaatagtcaaaattgagaattctaaagatgtgtcccttagaaatccgcttcaaacgtttcgtcaaatcaacatttcgataagtactgatgacacgacgagtttttacgtatcttgcataatgctgtttccctatcatgaccagctttctattagctgtcacatacttaccgtttgttaatttgaaccgtgtcgtcaagttgtgggtaacaagaccgttaaccttgagaattgttccttggcgatataattgaccgcgttgagttaaatttttccgactataaacataaattccacgaggattaatgactgttacacgcgtcctcttttttgagtaataaaccggtcggacataagaccatcgtgcggtaatatacccccgcttattagcggtccggcttagatggttaacatctttaacctcgtacctcaattgaccattaccggaacgggcataaccggtcacaacgaacatcggtcgatagactcgtggctttttgatatagtaggctaatcgttctttcttaccaaagttggcatgtcgatatagataaatcggcttcagcgaatagacaaccgcattctttttggcagcatagtccggtaacactaccgggcttccctgactggatgaacctgcactaccggacgatgatgcgacaaccgatgaactgctgttggagccggagccaccggcagccgaactcgtacttgcctgactggatgaagaagttgacgatgatgagccaccgccacccggagttggccccgtagcagccttataaacataagtaatcgactgattttgatcactgtatgttgccggcactttttcgcctgtttttaatcctaccaaatcataagtttttccatccttgctaatggttgatgcgggaagaccgtcaggcaatgtaaatttgcttccggcatcaccactcttagtaactggatctttaataacgtgattattttgatcttcaaagttgattgtgacactaccttttttgacaactggtgtattgccgaatttataagtcaccgttgggacactatcagcctgataggttccggtttggctgcccgaaaccgtatacgaggtataaccgtatttagatttaagtgcggttatttcattctgaacattgctattggttgacaaattatatgagtcacccaacttgccggaaatggtttgttgcggtgccaattgctggttggtttttgcgtcaacgaattgagcattaacgtccccgacactatcatctaataagtaaggctgaataacgccgccatcataagcgaaatcaccaccaccgggaaaaatcggttgatcccaaatgaaagtcataaacccacctttttgacctgtactcgtggtccccgcaccacttgccaaatcagtccaggtaatgctgggcacagcagtcgttgccgtaccaccattagcagtacttttataggaacgataatactgtgtttgcgaactcgaagcgtaatacggtgtcaccggaatattttgaccatcgatattagtcacaaaacttgccatctgatacgacttaagattcgaattcaaaataatcgtcggcaatacatatgcttgatgattaacttccaacgaatcttgtaatgtatccttagatgacttaagtggtgaaatatccgtaatgttgttataagcaaaagagcttactgctcgtgttggatcggaatccaattttttaccggctaaagcactaatatcatgaaccgattccatatcgatgctaatgctgactaaactatctaaattctttaaggcactgatgtcatttaatttacccttttgaaagggattgacaccccactgaatggccgcacccatataaggtgaaatattaatttcctttaaattcttggcatattgtaggccatttaatgactgaatattcagcatgtcctcaaaaaatgccttgttattcagctgaacattgggatctccgctgtataatacggtaaattgatcactttccaacatctctttggtaatctggtcagcggatgaaatcaaactgccgttaaccatcacatcatcctgttgcaattgccataaaaccaactgttgcaagcttttatcaggcatccagtcatcaattgattcggtattggtcgccgccatgactttattcggtaaaaatacatcctggctaaatccaataccggcaccgattccgagtaaaaagacaacaaaaactaggatcaaaaagattgactgttttttaaaatagttagatttatgcacacttagcatatagctcccccctaaaaacaactaaacgtttctcaccaccaccttaacacagtataaataaaatattaaaatataatctatatggattaacgtatcggtaaataaaagttaacccgctatttatacagaacaatttccgtcttaattacaaggatcaataacgtccttgagcaatcaataatttgctgcctgagacaaagtgaccgttggaaagttcatagcgagtcgtcaaatgatagttgaccagctttttgactttcaactggcttcctttcttgtaatgattgattttaccggttaatttcgaagtcttataggcgttaacacctgtcctggcaatcacagtgatctccttggacttcggtaccgactggtagtaaaccggttgtacgtaactggctttagcagtaatgtaacccttcttgccatttgcagcacgtacttgatagcgcaaagcaccgttggaagaacgggcataaccggtcacaacaaatattggacggttgacccgagtttttttggcataagtaaccactttgttggccgccttgaagttggcacttttatataagctgaccttcttcaaagcatagactacggagccttttttagcagccgacttcggcacattaaccgacgttgatggtaccgttgtcgttgtactggacgaagaactagtggttgccgaacttgaacttgacgaggtcgtcgaagaacttgttacagacgatgagctggcagtcgaacttgaactagatgaaatcgagcttgagctggaagatgacgagccactaccatcaccgggtgtaaccgcaccgctgtcagctaatgtaaattgagcatagtcaatttcggcattgttatcacctttagtaatcttgaaagtattggtccccttatttagatgaaccgtgccatattgaatgacctttcgacttccgttaacatttggaaccgcattagtccaaccagtggtgggtgcaaaacttgcgtctttgagtgacttatcattcaacgtcaacttctctgttgccgttgtcgtattaccattggcatatccgatttcaagttgatagtcgccatcctgtagcgcatttacattcatggtaattgaactatcatctttatcgataccgcctacataataattaccggaagcataactgcctagcgctttcttagcaccaccggttaaagtaccgtcttcagcttcaaccctgataggatcgcttgcttgttgttgggtatattgaatatcatcttttgtaacggcagtatcggccggggtgacaattagttgatagccggaggatgctttcattcccttgacagaaaccgtggctgtcccatttttaacctgaacggtaccggtctcgattgtttttggtgtaacggcagtatcaacaccataccaaggagattcgttgacttgaactttagctccgttggcaaatttacttgcatccaaatggttcacagttatcgaattatcaccgttggcacccccaaagatgactgaagtttggctcttatcagcattagtgctagccaagcttgccaaactgccattttcggaagacgtgctggtagtatcaatgtttccggacatatcgccataccatttgtacagccaatagccaccatttggtttttgttgatcagttaataaattatccatacgaccataattaaaccaaaatgctaaatcagcactatcggtatatttatcgttttcaaaggattgaatataatgaaccatttgtcccggtacaccaagttcctgttcagcaccatactcattgatactaatcggaatcggttccgtactgccgggctttgtaatgccattcgcaagttcaaatttttccaaagcctgagcttgtccagggtaggcagacgcactccattgatgccaagaaatatagtcaggtagtgtgccgtcctttttggcatctaagaggaatgtctgcatccacttcatttgactcgcacctaacccgtccagactgggaccaacaattttggcacttggatcaagctgtttaaccagtttataagtttcgtcccaaagttgcatataggtaaccgacttataattaccggcgtccactgacttaccattgccataatcacccggactcttccaataaccatttggctcattccacaactcgtaagcataaatgtcgccactattctttttagcttcattgaccatttgggtgacgtgggatttccattgatccatactgtcaaagttatatgcaaacttgtcataatagtcaggaagtcgaaccataactttggtgccaaggctatgagctgccggttgaatgacgttaaactgtccggcggctttcggttcaccatttggaatctgttggccaaatggtggtgcctgagtgaatgtctttaattttaatggtgctaataagcttgtgtttggcgtatttgcatctgaaagtgcatataaaccacccgaagcaacatgtgaaaccgctctgactgttgaagtcgtatcaacactgatatcttcagcgtttgcccgaattcctccgaggccaactgttattaatcctgcggcagcggcagctgtgatccaagtgacaatatttttatgtgaaatcataactcaaccctctttatgtgttttttgatatcttaacggccttcaataatttttcttgagtttaacgaattaaaaagtattcgcttacattttttcataaaaaagaggaaccaggaacaaactacaagtattcctaaatcccccatattttatcaatttctaaaacttttttatttcaaagcttatttattcaaccaaaccctcatttggccgtcctgacggttagcccaggcatagtatggcaccatggtcaggtcaaccgtttccgtatccgccggtttagcttcggtatacagatcagcatcgtcggcattaagcttctcacgtttggcagccaccttgatgaccccaacgccgtccaataacttctcatcaaagtgatagtctgtctgggcatccggtgaaacctggtataaccaaagcggtgcttggttgtcggcttgttcagcggcgtaaaccaccggaccacgttgaacggcaaccttgccgaagtcatggctgacccggttgttggcccgcataatcttggtactcatgtccaacttgagatcaatggttaatgactggccgtcaacatcgagataaatgaaaccatccttaaccggtaaggtcttggcagcaccatccacgtttaattcgtaactggcagaccagctgggaatccgaatgccaaacttaaaggcggcctggttggaattttgaatctcgtagtggatatcaccgctccatgggaagtggttggtttgggaaacctggatgccgtcatcgaattcggcatcgttggcgatgaattgatgggacaaaatggtgtcacccttttcggtatagagatattcatcaaccgaagcaatcagacgcgccaggttggccgggcagcaggcgcaaccaaaccagtcagcccgatgcgtcaagacatgggacttgccggggttacccttgctggcagccggatcggcttccaacgggttaacgtagaagaagtgcttgccatccaatgacatcccacttaaagcgccgttgaagagttccttttccagcacatcggcgtactcgcccttggcatggatgttcaacatttgacgggcaaagaaggacatgccgactgaggcacaggtttcaccgtaatccgtatcgttgggtaaatcataatcatacgtgaaggcttcaccagtggtggtttggccaatgttaccggtgatgtacatctggcgcttaacaatatcgttccagaagcgatcacaggcagccagtaaatctttatcacctgtataacgagcaacgtaggccatgccggtgcaaaggtagaccacccgaaccgcgtgaccatgagggaccttttggtccttaatgggttctgcggccaagtaatattcacgggtaaagtcacgcatgccgggaattaaatcacggtcagtgctgtcgccatcggccttgatctgcttttcaaagaaggccggatcctgaccccgttgggtgaggaagtagtgggccaagtcaagatacttcttgtcctgggtgacttcatacaaccgtgacaaagccaattcaatttcgggatgaccatcatagccggggattttgccttcttcaaggccaaagtggttatcgatacagttggccatgcgtttagcaatgtccaaagctttttcattaccggtggcgttgtaataagccacaccggcttcaatgtaatgacccattgtatataattcatgcgactgttggagacgcttgaatttacgttccggggcatcaatttggaaataggttgacagatagccgtcatcatcttgagccttggcaatcaaatcaatcaggttgtcggtaatctgctttaaatccgggttgggatggtagccaaacgaataggcagcggcttccaaccacttgtagacatccgtgtcctggaatgggaagccatagtgatggccggtcatttcaccggcggcaatcttcaaattggcaacggcgtgactgttcttgtcctgaccgttgttttgtggatcttcggcaatcgaaatgtcggcttcgtcgttcataactttccattggtaaggtaagacttctttaacgacgagctcccgatagcgtttccaaaagtcggatgtcaccttgactttatttaacttcggcgtggtatagacttgcataaatggaccttcctctcgaaaatacagtgattagttagtaattagctgtttagataaatcgattaaataaactgattaaaggcatggtgattcaaccaactgcttagttggctgtggcagccttggcatcttgcgcatgacgttctgccaagtcggctttaacaactggttcatgattttcccacttacggtaaacaatcatcaaaatcaaactgatggcgtaaatgataaccggaacccaaacgaaggtaaagctgatacctgaaagacttgaagcagtttgggtcttaacagcagcgttaaagccaaagcctttcaacaacatggaagcgataaatgaaccgaagccggaacccatttggatacagaatgaagcaccaatggccgttaagaaaccgttggcacgaacgccggtcttccattcaccgaagtcaaccgtgtcaccaaccatggcaaagaacatggtgcaggcagaaccggaaccgatacatgcaatacaccagccgattaaagcggacgtggtgttggcaccggcaaaaccgatccaagcttgaccaaccatggtcaaagccagcatgaagacggtcgtgccccacttgtgcatgtacttaacaaaaaatggtaccgaagccataccgataacctggataatggtaaagccgttgaagaatgaaattaaaccggtgctccccatgttgtactggaagtagtaaggcatcgaagcgttacgaacgataaaggcggtccagtaagccaagttggcaacgacgatcagaacccaaggccagttacccttagtggctttcaaactttctttaatcgtaatcactttttcagattcgatattcttttcacgcatatcgaagaaggcaattaagagcaaaatcaaagcaacgattgagtaaataccaactgctaatgaccagccacgttgttggttaccattgcctaagagaccggcgaatggaatgatgaacgtaacggcgaagaagttaccaacgttcccaagaaccaaacgaactgagttggcttgcattcggccgtcggtacttgaagtcaagttaggcagaacggaggtaattggggttgacattgcggtataagacaagtcagccaggatatacattaccccggcgtaaatgatcttagccgtgccgctcaaagcgggggtagtgaacagtaaccaaacaaagacagcgaatggtaaggacatccagaggaaccatgggcgactcttaccatatttactatgggtgtggtcaaccaaaattcccatgaccggtgcgccaatcgcatcaaagatacgaccgatcaacagtaagacaccggctgttccaaccgtcaaaccaaagacgttggtgaagaagtaaagcatgtatgaactgataatacagtaaagcaagttaccagacatatccgtaaagccataggtaatttttctgtgccatggcaatgtgtcattggccaagagtgcctgcgcactggccgtatttgaatctacatgacttgcatttgaactcatgattctgacctccaattagttataaatacaaacgcttacaattgatgaaatattgcaaaatcataaaatggcttgttagtcgcccacgaaagttaattttcaatggctctcgcaagcagttagcatgtaaccgcttttacatttattatagtaaccgttttcaacaaaaaacataaggcctgaatttatataaaaagtgacactttccgactatttattaaagccggctagttcaatgtcccttatttaccaccttatatatcgtttattgaacctttggtgattgtttccgacattataaaagctaacgaaaattctataaatggtgatcatttccgactagcaaaaatcaccccctccaaataaaaggcctttgaattttaacttaataaaattcaaaggccttttgcatcatctcaaatgttattcggatggggttcgattttttatgtcaaaaataaaaaccatttgagcttaataccattaaattagtaacgtccttgggcaactaataatttgttacctgagataaagtgaccattggaaagttcatagcgggtggccaagtgatgcttaaccaacctcttgactttcaactgggttcccttcttgtaatgcttaaccttaccagttaatgtcgaatttttataggcgttaatacccttcttggcaatcacggtgattgtcttggacttcggtaccgactggtagtaaagcggttgtacataactggccttagcggtaatgtagcctttcttaccgtttgcagcacgtacttggtaacgcaaggcgccatttgttgaacgggcataaccggttacgacaaattttggtcgatttatgcgagtgcgttttgcataagtggcaagcttgttggcggctttaaagttagccgacttgtaaaggttaatcttcttaaccgcgtaaaccgttgagcctttcttggccgctgacttgggtacactcaccgaagttgatggtgctgttgtcgttgtacttgacgatgaactggtcgttgtacttgaactcgatgaagtggtcgttgatgaggatgaactggtaacagaacttgaactcgatgatactgaacttgagcttgaagatgatgaggatgaagaggaatcaccgctaccgccacctggggtaactgcaccactgtcggctaacgtaaattgggcataatcaatttcggcgttattatcacctttagcaattttgaaagcgttagtccctttatttagatggaccgtaccatattgaaggacctttcgagttccattaacgtttggaactgcattggtccaaccggtagtaggtgcaaagctggcgtcattaagcgatttatcattcaacgtcaacttctctgttgccgttgtcgtataaccatcggcatatccgatttcaagtttataatcgccggcttgtaatgcattcacagtcatactgattgaactatcggctttatcaatgccggctacataataattaccggaagcgtaacttccaagtgcctttctggcaccaccggctaaagtaccgtcttcagcttcaactctgattggatcggttgcctgttgggtggtgtattgtaatcccgttgtcgacgaaccgtctgcaggcgttacgatgacttgatacccatcggaagctttcatatccttaaccggaacttgaacagtaccgttattaacatcaaccgttcctgtcgcgattgtcttaggctcagaaacagctgtatcaacaccataccaaggagtttcattaatttgtaccttggctttttgaccaaatttagcttggctcaatccactgatattaaccgtgttatcgccacttgtcccgccaagaattacagaagtctggctcttatcagcagtggtacttgcaatacttgccaaatctccatttgtatcaatagtacttgtcttatccatctgaccactcatatcgccataccacttgtacagccaatagccaccgttaggtttctgttgatcggttaacaagttgtccattcgaccgtaattgtaccaaaacgccaaatcggcaccatcaacttgaggtacattttcaaaggcttgaatgtaatcaatcatcttaccgggtacggctgtttcttgaggttcactgtattcattgatcaaaatttttgtattctgatcaataccatatttggtttcaagtgcatgaagatcagcaacgttgcccttgaatccggcaggtgtccattccgaaccgccgccgagaagatgccaggaaataacgtctggaacagtctttgcttcagtaacgtgagcaaagtatttatccatccaacccttatcccaagcactggtacttggaccaacaatcactgcattcggatccagctttttcacttctttataagttgcatcccaaagcttaaagtaatcttcttgagtccgaccattaatcttttgataggtccagttgggctcgttccagagttcatacccataaatatcttgtttatatttttgggcctgggttaccatatcgtcgacttgcttaagccaatcgtccatcgtcgaaaagccatacggaaatgtcttgtaatgatccggaagacgaataatcaccttagccccaacctgttgagcagttgtcgcgaccttcagaaaatcaccacccggttcagttaacccgtttggcaattggcccggatcaggcggggcctgagtgaatgtccgcggtttaagcggtgaaatcagatcagcacctggtgtcgtttcattttgcagcgcataaagccctcctgaagcaacgtgttctgcattacttctgattgcagtcgttgtgtcaacgtttatgtcttccgcattggcagtattggattttaatccgaatgcgaatagtccggcaattgcagttgcggtcagcaaagccaaatttctatgtttacggtcaagcatgttaataccccttccctgcttatattccatttgaaaatgataatcagaccatggttgcgcttacattcgtttggtaaaaataagcgccggcaagtcattagtctacgtctcatcatgtcattttcgtggaataactcaaatagccttcaattgataattcatatagctaaaccatttcaatacaaagcataagtaaatgtatctacaaaacaactcgcgagtaattgcgtctccaaacgtttaatctatatttgtttggggattcatttacgctcttaatagtaagcggtttcaaataataaagaaacaccaatacccgcaaaatcagtgatggtttccgactaattaatttttacaaaaatgactgagtaatggcttacaggccatcaagtccaattgtgcgaacatttggtgatgatttccgatattttaaaaattgatcattacatgtccgaaaaacagttaacgctcctaacaacatgtccattaaccaaatttgaagataattttccaaaattggtttaatagaaatgttgttatagggtggacttagtataaaacttgagacaactttaggggaagtataaaattatccttgtattaagaaagattttgttgaattattggtgaaagaagttagttttgttacaaagagggagaatatgaataaaggacgagttgaagcattcacagacgcagtggtagcgattatactcacgattatggttcttgaatttaaaacaccggagaccgcccagtgggaagaaatcatcaagcaattgccctacttttttgcttatattgttagttttctatttgtcggtgtagcttggtacaatcatcactacatgtttacattagccatcagaatatccaaaaaagtgtattgggtgaataacctgtggctttttagcatgtctttattaccggttgcgaccggttgggtaggaaaatttccgcaatattccggtccggaatacctatatttatttgtctttattttttggagttcgtcatatctttggctttcaaattcgattaggaagacaccggagcatgttaacacgtcggttagtaaaaagattgaaagcatgtttccttttagattcctatcctcattctttttcccgttgtctattggcatcaccgtcattggcatttattttttgccagtacttggcattacaatcacttttgttgggctgatcatactaagcttcttgaccccttcggacagtgataaattgaccaaatagtttttaatagataagcctttaagacgtgcatagcaaaagttacgcgaatcaaatgaggttatgatttcacctgcttctaaagcaaagatcccatcagcttaattgttgatgggatctttgctttctatcatagcagcgcacgcctcagtgccaataccttcaaagtattgtcatttaccacgtttggcaacatcatcaccatgcgactaatcataaccgccacctcttagtggctaattgaacatcattccctttcaaccgatttaaaaaacatagtcttttcaagacaacgttttagtcacctctgccaaaaacgcttttgccgctccagacattgaaacgccatgaggccagactaaattggttttggcagtatttagaggcattaacgggacaaatttaagattcgttccctgtgtattaatgatgccatcgagacataacgcatagccaactccggcagcaactaataacgaggcattgtacagcaaattataagtagccacaatttgatactcaacctgactacttccaagccaatcctttaataagtcactgactcccttttgatgggagacaatcagtttagctcccttaaaatcactcggtgtaacctcactttttccagcaagcggtgcatcttgacgcattaacaatccccacctggcttctccgggcaaggtcataaagtggtaatgccgtttttcagtaggttccatgaccatgccaaagtcaaagagccccgtttttaatcgcttccaaacatcatcggcattggtactgaccaaattaactttaatgtggggatattgatcacccaatcgtttaatcgcttttgcaattgtcatcatcgtttgtgattcaccgctaccaatcgtaatactaccggtaatatcagttggttggcgaatattatcccgcgtcttgtccgccaaagaaataatttgtcgcgcctgttcggcaagatagtcaccactttccgtcagctcgattgaacgactgccacgtttaaacaaaacaacgcccagctcatcttccaattcttttagctgtcttgaaatggttggctgcgatacatgaagcaattgagctgcccgactaatattttgttcctgaacaactttaatgaagtagcgtaatacccttatttccatatagtcaccctccatatagttattagctatacaccttaattcactataagtattagacatcactattaataccttatattctaaaaactgtaaagcactaaaatttcattcaaggaggaattcgtcattatgagtgtaaaggataaagtggttattgtcacaggtgcatccagtgggattggcgctgcgactgtcgaattattggttcaacaaggtgcaaaagttgtctttggcgctcgtcgccaggacaaattagaacaggtggctcaaaatctacccgctgaccaaattgcctaccggactgtcgacgtttccaaacacgatgatgtggttgcgttagtcaatttggcaaaaagggaattcggtaagatcgacgccctttacaacaatgccggcattatgccaaccgcaaatttagctgaagatcacagaaatgaatggcagaatatgctgaatataaatgttatgggtgttctaaacggcatttcagcagttctaccaatcatgcacgaacaaggttacggccacattcttgcaacagactcggtcgctggtcacattgcttacgcggggtcggctgtttactgcggaaccaagtttgctgtaagagccattatggaaggcttacggcaggaagaattaaagaacaagattcggtcaacaattatctctccgggagctgtcaatactgaactttataagtctatcagtgatccaaaaagtgcaaaagatttagtcgctgcttggcaacaaacgcccgacagttccctcactccggaagacctcgctgaagctgtcgtctatgcgattggtacacctagtcgagtgtcagttagtgaaatcctgattcgccccactgaccaggaaatatagggaatgaccgatttgatagaaaaaagtaaaaagtcaattttgaaggcggcactatccggtaaacggttaaaatttgaagatcccgactttaaacagattgacaagattgtcgctgccaacactgaacgactccggaagttcaactatgaagcaacttctgaagaggcccggcgagagttattaacgcaaattactttacaaccgattaatcaagatacagttgtcagaccaccatttaatacggatttcggtcgccatatttttctcggtgccggggtttttgttaatagcgattgtgtctttgttgatcttgggggaatctatcttgatgatggcgctttgatcgggtcgaaagtaagtttgctgtctgtgaatcacgttaaggactcgaatcatcgccgtgatttgatccccaaagcagttcacattaagcgacatgcctgggttggcgcaggggcaattgtcttacccggcgtgacggttggcgaaaacgcgattgtcggtgcaggttcagtcgtcactaaagatgtcgccgcaaatacagttgtggtcggaaatcctgcaaagcctgttcaccgaatttctgatgaaacttaaatcggaagaacatcgattcttagtgcgtaaaccttgcaaattatttacgtgaacgcatgcatttgccatgtgtcgaagactaaatccgttaatataagataagcgtcatatgctcaacaaaaatcccaccaactatttaaattgatgggattttttagtctctattgataagcacgaacatattttgtattggcggtgatgtaaccaccggctactcgatgacgtaatgtcccatgctttgtaacatcattcttgtgagaataatcgtatccataaacctttaacgtgcgattcttggcaatcgaatgattcttcttagtcaaattaacgttactataacgattaatcgcctgtttagtcttaaccgattttacttgtttgtggcgacccatgttcaccaattttcgattagcagtaatgtaatcaccattggtcaagacatatcgagtcgtcaagttgtgtttaacgatccctttaacccttaagacagtcccttgacggtaattcttaactttgcccgtcaagttggctttgcgataggcattgacgcctcggggattgatcaccgtaatcgttgcatgcttggttgcgtagtaaacggggcggacataagcctgactggctgtaatgtaacctgcttgaccggctgtctttgatgaatgattgacatcccgaacccgatatcttaacgtcccgttttgactccgttcatagccggtgaccacaaacattggtcgggcaattcgtggctgtttcacataccaccctttgcgattagctttggtgaaatcaggactattgtataggccaatcttgttgatggcgtacacaacagcacctttttgagccgcattggccggtacattgttggcaggctcggtagtgttgttgctggagcttgacgagttacttggcgtcaccgttgaccctgagttattggttgtacccggatttggattagtcgttccagggtttactggcgtcgatgaattcaaacggtaagtgaaggtgatttgctgaccattgcttattaacgacacattatttgccgaagtcaacgtgtagccggaaatggtcggtgcagaaatcgaactaccggaagtgccgctaccagtgtagccccggccgaggtcacgtccctgactatcaatcgtccgaaccgtgtaagcatattgaaccggctgtggcttatcgactgcttgaacagtcacggtggcctgatgcgtttctccaccatacgttaccggtacctgatatgaaccgacctgatcccatttaactgccgattcgtcaatttttactttggccagatcaatgacattgcctttgagatctttatcaacgtaatcggcgatagttggttttgcgccgccaattttgtaggtgatgtctttaggtttgaaatccgccggcccattcacggtaacgttgataaccgcggtaccatcgacttcggattgattgtcataactgaatccagtcgcttggccgacatctaatgttagtccattaagcgctgtggcaacttcagccttataatcggtgtaatccttgcccaaatctttaaatgtaatagagccagtctgattataggcaattttctgaattgtttccgtagtgaccggttttgtggatgacttattggtattgaaatagttgacggtaacggtgcccatagcaggaacttggatgtaagcaacaactattgtgccaggcttcatcggtaacatcgtttttgaccgactagccttatatccaattacgcgtggtgtatcaacactttgtcccgacatcccaaccaccgaaataggctcgccaatataagcatttgtggcactatccctcggctgaatatagtaagtaccgacagccgcctgcacaacattactcggtagcccaacatccgtaatggcagtcattccaccaaatgttagtgttgccaatgcggtcatcaataatttggtagtgacacgcttcttggattgtgacctgttcgatcctctttgagccgttttttcatgtaataccttttttgtttccattcttaattcccccgataatcttgagtggcaacggttcttcgtcctttatcggggggacacaaaattagttatccccctgcatacaaatcatatcatcttgtcaaaaatcattgggatttaatgcttaatgcggtttgtcatttaatactttcttaatgataatcataagatcattaacgggaatttgggactggttgaaaaataggattatccactttttatcgacagtggaaaagcaaaaaaagacgccaaattggattacctaacttaatatcaggcagcccactggcgtattgtttacttcaattttaaatcaacctgtgatttgatcagtcacggacttcgaatcaatttactagccgcggtcaatcacctgaacatacttcgtattggcagtgatgtaaccaccggctacccggtaacgtaaagtaccatgcttagtcacgttgtttctgcgtgaataatcgtatccatatacttttaacgtgcgattcttggcaatcgactgattcttctttgttaaattaacgttactataacgattaatcgactgtttagtcttaatcgatttcacttgtttgtggcgacccatgttcaccaattttcgattggcagtaatgtaatcaccattggtcaagacatatcgagtcgtcaaattgtgtttaacaattcctttaacccgcaagacggttccctgacgataattcttaaccttgcccgtcaaattggctttgcgataggcattgacgcctcggggattgatcaccgtaatcgttgcatgcttgcttgcgtaataaaccggacgaacatatttctggctagcagtaatatatcccttctgaccatcagttttagacgtgtgattaacatctcgaacctgatatcttaaaacaccattggcagctcgcttatatccggtgaccacaaacattggtcgattaattcgtggcttcttagcataccaggaacggcgagtgcttttggtgaaatcagtcgtcttatagagcccaatttttttgattgagtagaccactgttcccttagcagccgcgtatcttggtaaatttgcattgtttgaagaattagacggagaaccagcgggcgtgtttgagcttgcatttgaaccaccgccagacgttgttgagggtactgagcttgaaccactcggtgtagttggtgttaccggcgttgacggtctgtttggcttggcaggatttgtagggttcgtcggatttgatggcgtttgaaccgttaacttaagctcttttgttgccgccccgttagtgtagtgaaccgtgtaagtccccgaattcttgtaaaggttatttaaatcattaaccggtttgccggaactatcagtggcgttaacggtgatgtctttaaagatcagcgtctgaccaccgacatcagtcgcattgtcaaaggcatcttccggttgccatgcctggttagttgtgatggttttagtagcgtacttcaagtttaaggtactgctatcagtcactttgatcgtcagcgaaccctttaacggatccttgccattctttggtttgtcagtcgcaatctctactgtgtattgcccgactttggcactgacatcgttaacagcaaccggtttaccagtcacatctttaatattgtattgataatttaacgagaggccgtcagaatcttttgcctcaatcttttctcgcaagtcggcatcagtaaaggttttgtttaaataaagatcaatatcggttgtctttaaactggtagtatcggcagtgatcgttaaattcaaagttccggtttggtctccgttcttataggtcaacggataagagcccgactttagggcagcaaccgtctcttgtgtcaccggtttgccgtcttggtcggttattgtaacactgctcttattactttcaccattcttggtggcggcagtaatggcacttgccggatcccaagattgaccttcgtataagtcttgagtcttattaaccttaagggtgtattgatctgcggcgggtttttgctcccagacgtagatttccgcttcggtaggtcgattggttaacaacccgtcatacactggtcctctagggctatcaacagtcccaccggcaacagcctgccaacctggaccgcttgcgtaacgtattggattgctgttagggatttttgaatttgacgaatgttcagttaacgccttataaccaaagctactatgaaaagttttgggtcctaacttcagaatccataacttttcatcactggcaaacatgaagtccgcacttttcactttggctgtatcaaaatttgatagatccaaactggttaaatcagcattattactaaacatacgatacatattttccactttagccgtatcaaattttgaaacatctatgctggtcaacttagaactatcaaaaggcatagaaaacatagactccatagttcgcacgttagccgtatcaaattttgaaacatctaagctggttagattaatatcaccactgaacatagagtccatgtttgtcacattagaagtattaaaatttgtgacatccaaatttgttaaaccggtattcaaacttagcatagactgcatattcgtcactttggccgtattaaaatttgaaacgtctaagctggttaaactagaattacctgaaagcatataactcatgtttgtcacattggccgtatcgaattttgagacgtctaagctggttaaactagaattaacaaaaaacatataactcatatttgtcacattggctgtattaaagtttgagacatccaggctagtcaatttagaatttgactgaaacatgctactcatgttcgtcaccttagaggtatcaaaatttgaaacatctaggctagttaacctagaatcttgagcaaacatgttactcatgtttgtcaccttagaggtatcaaaatttgaaacatctaggttggttaaactcctattctgagagaacataccatacatgttcgtcacctcagaggtatcaaaatttgaaagatctaagctagttaaactagaagcatcagaaaacattctattcatattcgtcaccttagaggtatcaaatttagataaatctaggctggttaatttagaattattaagaaacatttcagtcatgttcgtcactttagaggtatcaaaatttgaaacatctaggttagttaaaccaaaatcaccatcaaacatgcttttcatgttcgtcaccttagaggtatcaaatttagataaatctaggctagttaacccagagtcaccagcaaacatccaactcatactagtggccttagaagtatccagcttatccattccagcaattgattttaaattgctcataccccaaaaaagcgatgaagccgtatcgccttccaattttagtgtccccgttatccgtatatctgtaatcgtattatcagcccgccaaggataatcatgaacagtggatgatttaagagttccaccactcagcgttaatacaccattatcaatactatatgtgacatcttcaacctggccactggcagccgtcgctggttgagaagtaagcgcatttggacttgccatttgttgtacttgattttttgcgtttgtctgcacattaggcgtatcaaacgctgtctttccgacatctgttagattatcgatctgtgagttggtattagctacttgtgcaatcgggctatcggtgtcagcaagcacatcagttgaacacacgtagctaccggtgccaatcgttaaagcgcttacaaaaatgtacaagtagttttgattcttgttcattattaacccctccactatttgggcaaagaaatcagcaaatcgttcgagtccctcattattccaattaaatgttaacacggtcctcatattttgttgaaattataaaaccggttatctgaattcataaccttttcttaatctacttcgctttgcagtcaaaaatcactaattgcacgttggaaagggccccatcaaccgttaagttgatgagacctttatttagtccttattgataagcacgaacatattttgtattggcagtaatataccccccagctactcgatgacgtaatgtcccgtgctttgtaacatcattcttgtgagaataatcgtatccataaacttttaacgtgcgattcttggcaatcgaatgaattttcttggtgaagttaacgttgctgtaatggtggattgcccgtttagttttaactgacttcacttgcttgtgacggcccatgttcaccagcttccggttagcggtgatatagtcaccattggtcaagacatatcgagtcgtcaagttgtgtttaacgatccctttaacccttaagacagtcccttgacggtaattcttaaccttacccgtcaagctggctttgcgataggcattgacacctcggggattgatcaccgtaaccattgagtgcttagttgcgtaataaacgggacgagcaaaggtccgactagcggtaatgtaacctgtttgccccttggtttcggatttatgatttacgtcacgaacctgatatcttaatttaccgttggccgcacgtgcatatccggtgaccacaaacattggccgattgattcgtggctttttagcataccaggaacgacgattatttttagtaaagtcagtagtcttgtagaggccgaccttcttgattgagtatacgactgtgcctttagtggcagcataacccggtacgttggttgcactattgttagttgaagatgccgttgacgaattggtgcttgctttagaactgcttgaaccactcgatgcctgtgaagatattgttggggacgatggacctgtggttgttgatggtgtatttggtgtgcttgacgttgagttcttacgataaacgtactgaacaacaacagcattgtctccataagtgcctttagcatttgtcggtgtttttccatcccatgtgtacccactaattgccggacgtgaatcggcacctgtcacatcatattccctaccttgaaaaccagtaattacttttgcctcaactccaggaatcggctttccggtcgcagcgtcaatgtattccactgtgacggtttgcttggcgacaggctttgaatcctgttgccaaacgtaggtctccgtttcagcgggacgattggccaagtaaccatcgtaaacagttttaccttgtggattatcaactgtgccaccattatttgcatcaactgccagccaaccaggtccggtcgcataacgtaccgggctactattaggaatttttgaagctgacgaatgttccggcaactcacttccatccaagcccttattgagggttttattgcccaattttaaaatcgataacttatcattgtcataaaacatgcgagaaatatctgtcacgttggacgtatcgaaacttgataaatccaggctggttaaaacgtcatcccaggcaaacatattagccatagtggtcaccttagaagtatcgaaattcggtaacgccaagctggttaaaacttggctatgcgtaaacatcccatccatatcggtgactttggacgtatcaaaatttgctaagtttaaggtggttaatctattccgaccaaacatattagacatgttggttaccttagaggtattaaagtttgagacatctaaacttttcaacgccatattctgaaaaaacatataggacatatctgttactttagatgtatcaaaatttgagacattcaggtcggttaatgactcagtcgcacgaaacatccctgccatattgttgactttggatgtattaaactttgtgacatctatggtctgtaacttttgattatcattaaacatccatgacatattaattacgttggacgtatcaaaatttgagacatctaaattggctaaattaaagtcaccgttaaacatcgatgacatatcagtggctttagacgtatcaatgttatccattccggtaattgattccaaatttgtcatctcagaaagaaagcctacaggcgctgagtcttccaaaaatagcggtgctgttatctgcacctttgtgatgtctgtgttacccatccaaggataaacatgagccgaagtgagtgttccaccattaagtgttaatatgccattatcaatactatatttgacatcctcaatttgaccactgccagtctccgctgctacttgctgtgtctgctgaattggatttgcctgaacactaggcgtatcaagcgctactttcccgccacctgctaggttatcggtctgagagttggtattagctacttgtgtaatgggactatcggcgtcggcaagcacatcggttgcgtatagatagccactgatgccgattgttaaagcgcttacaaaagtgtacaagtagttttgcttcttgttcattattaacccctccactatttgggcaaagaaatcagtaaatcgttcgaggcactcattattccaattaaatgttaacacggtcctcatattttattgaaattataaaaccggttatctaaattcataaccttttcttaatctactccgttttgtattcaaacatcattgaataagacgtgtcccttattcactcaaccatatttttttggactctaaaaaacgtttcgtgcatatatcagcacaaaaagtccccgtgctttcacacagtgacgattaaaaacacaaaaaactcaccagtttcctggtgggctttcatatcccaaaaaagctttctacaatttaccgaaccacaaactaatttttaaacttatcgatcttgtcaccaaccgattttaacaagtttaacttcggtatttttgccccaactattatctttccaattattaaaggccaagtcttatgagtatgcttggcaatccaaggctgcataattgttcccacttttggctccgctactgtgactacaaaatgatgccattaattactttacagattattaactaaagtcttgaaatgccgacattaccaacatacttatattgagcataaccatgatacatactggaactgtcattaacgtaaattcattttttactcagaactttcaccttaaaccatgttttaccagaaccataggcaacatcgtctgaatgagccttaatgtcgtacagacggcccctatacttttgtactttgtatgtgggtacacgtaaagcccttgtccattagctcctgtccaagcattaatagaatcatttttaaatgtatacccgacctgtgccatatagtctttttgcgaattaagcgcttagttcttgtttctaacaacacccggtgtccctttatgccagcttgcggtactgcttgattgcgaattcgaactttcccccataccaataaagaataccgctgctaccccagcaacaaaaccttttgctttcatgaaagcatccctccaaattaatgtttgacaaaacttcggctttataatctccgtgcttcataggcaactaagccttcacattcttataataccaagttgcgtgcccatcaaaactcttagaagccagtttatgcgagtaatgatagaatttccacgtcactcttcctggacgtatacctatggctaccttcacaaacccatgtaaaatataagcatttctaactttcttatattttacattttgcattattaactgcggattaccttgtccttggtaaacaaccttattggaatagaactttaaagtttcaaactgtggataagctgactgctttctggcataattccctcttaatattcttggcgtccccctatgccacgttgcagcatttgattgttgaggattcgataataaaccgataccaataaaaggcacaactgctattccgacagcaaatttcttcatttccataagatcctccaaatttagtgcactctgctataccactggccggcattataactattaaatctaacattaatccttttgccacttcttcgtataatccatgtttcatggtccccatgtccgttgcctgtgtttgacttagcaaaaccgtttaatttatatgtataatgtccaacagctttatatcttacctgcgtcaaaaaactttgaggatcgccctgaaacatttccgaaatgtagttggcatgaatactcattacaccccaatgtgggtatgcatgttgatgcgttttacatttataatttccacatagtgatctcggtacacctttgcgccaacctgcggcgcttactgattgtgcatttgaaattaccccaataccaataaaacataacgctgctacacaatcagcaaacctttttaatttcataagtataccctccaaacaatttttgattactattttagtatactgcatggatccacaagcgaatgccattttttataaaatttttgttaatgccaacttcgatgaaagtttgactttattaattacttaaataatatacagacgctatacatctcccaataaaaaaagctaaaacattggtttgcaagtggcatataatggacataaataaaatttctggaggaaaacgtgaacactaaattgacattggcttcaattattaccgcaatggcatttataccactcttaaatagcaaaccggtacatgcaagttcatggggatcttggcacaatggtaacccatcatttttaaggaataaattttatcgaacgaggttagggccaaagtatgtgaagtatggtgataaatgggttaagaatggcaatgctcgacgatacgaaggcatacgtacttataaatcccatatgacttttctgggagcacaatattcttcatctttgcgaaactgccattatattcatgcaggaaagacttatataatcgaaggtgcatctgatcattctggtggtgactatacatacccgttaatcaaagtcgtgaaaattaacaagcatttaatctattcaaatacaggaagtgctactaaatcaggacgttattacatcactaccccattagataaaatgaaattaattaaataaacatgacacttaaaccttagcaaagcaaaataaccgagggcacagaactcaaacgttggtctgaaatctgtactctcggtttatttttaactttactatcattttatgtataattgctcacatatatcaaaatcgaccaatatcgctttatgaccatagtatttccctcgacgcatgacgtaattttcaccagctcgatgaccacttcttattggcaaaatggttacataatgcttccctcgatggacgcccaaatgtaatccgccaaaggttccaactgaagttttcacaaagcgtctatgaacgatcaacttttctttggtctccctataccagtgtccagtcaaagttctttcgccaatttcatgccatgtaccacgataggatgttggtatactttgataatagctctgtgcgtaagacgctgtcgtcttacagaaagaaaatcctagtaagaaaatcatcatcagcaaagatgattcaattattgtacttatatgtcccttcattaaagttgctcctcacatcttaaacccctagtaataatcttgcttcttaggtattaaaagcaagttaagccaacttatctataatagtttcccccaacccaatgattgccattgttcatatatgtccgtattttataacgattaatccaccttatccttagttgcattgctgtatttccaatatcgtttttagctttaatttgataagtatgattacctcgataccgatagtgaacattatgaacatacattggaccaacgtcttctgtaatacttccttgatgactttcaacactaatatcatgaatcttagtaccctttattttcagaatgtaatactcataggttttggtagctattttgtccctgtgagttctccaaacccccttcagtgcagcgggcgtgcccttatgccaacttgctgcctgactagaagtagttgtcgtacccataccaaatcccaatatcagtgaagctgttagaatcagtgcagatttattcatcattttccctcatttcatattgacttgttgacttaataccaaattggaacagtcttattaaaggaatggcgaattggcgttttaaaaagtcgataataaatactaccttctctgaattgtaatgatttatgccatcgccccttaatactaattggtgaatatttataaaaagcaattggccctgccatcttgtgtaccgggttaattgccacccaagtgccatgaacatagtttgagacttccactttaaaatgtgtataatcataatgattatcaaaatagtctttcgaatagaggaattgttcggttaatttaattttgaagtacttaccgtgtccttcataactataccaaacgcccctcatattggctggtacgacccgcgcttgtgcctgaactggatgattaaaattaattgaccacaagaggctcaaactggcacagccaagtaatacttgaattcctaactttttcattttgttatctcctactagatgttttagcaactacccaaatgccagctaaatagttaaatctgattcaagttgacgaggaacaattactgaccacttgatttttgtcatttgagcttgttggttccgcttcagtcaaatgaagacaacaagcccctgacagaagccagtttaacctaagactaatttgaccctttagtttcttataatcatcgccacgtcaactttaccagtacccatggcttgaagagtatttgacgcccaaacgttggataagctacaaaccaaactgaaaccaaaagagaaactattgtcgaagttaggctttcacagaatttgagacgttccccggttattgattattattttagtataccgtaaagattcacaaacgaatgccatttttataaaaattcgtgttaattccaacttcgatgaaagtttatttatctagaagtacgatgaaataggcgtgctgtcgagctcccaggataaggataggcatcgccatcaagataaacccacattttgtccttagctggccttttgatcgtaatttggtaaaccttttggtaactgtcaagaaaccttctcgcctttagaatataaacttgatgattaaatttgtgccatttaatatgagcgaatatgtcaggcataccgccaaaataattaaattcaattttatttgcaccaatttcggccttagaagtagttttcatatttcctttctgatgaattgttttagttctccaatgccctcttaaagcatatggcgtaccactatgccagccagcagcatgcgaaggaataactgtcatattgataccaattaggaatgtgacacaaataccgacaatccaatacatttgctttttaatcataaattagcctctccttaaaaaaactaatacatacgcgcattaatagtgtatgtttttgcaggcataaaatgcgtataaatcgccataggcccttgctccatggtggaaatcaaaacatgacgatacctgccggcaacttttaatttatatggaaaatatatgtaatctatatcaaagctgtagcccctaaaagttcttgcagaatgacctgggagtttcatttttctatagatagtacgaattcttgggcgaaatcctttatcattaatatcaaagcgaatccgatgctttgtaaaaagataatgattcattgaattataatcatagaaataccaattgcccctcattgctttaggcacagtcgaagttggcgccgctttcgtgttaaaagataatgtcataaataaaattgtggataaaaccactaataatcctttcttccaaactctcatttgaattacctcccgatatattatatattaatcatacacctattacttttacttgaatgataaaaatagatgaatatatgataatttagaagggataaaatgttttctgttaaaagaatagttggagtctttttagcaacattcttattttttgtaactttcactttcgtcacatatgccgcaccccagtctttgccaaagggtacatatgaaagtcgactcccaaagcaagcaaaaggaatctggatcgagaaattaaaagatggatccacttttgaatttaaagtatccaatccaaaatatgtttgggtaactactaaaaatggtgggccagctgccacaacggctctaacgattgtaaccaaacgaagaagggcctctaataatcgattcattttgtatagtccggccgcggacccaatcgatttaaaatggtttcatcaccatatttattattggggatatgggccaaatagatggataaagatgattcgatattccaaataaatattcaacaataattctaatagtccaaaggacctcactaatcgcaactttagtgaggttttacttttattcaaaaagtcctcataatctaactggtatatgcacagttatcttaaaccaattgtgaaaaatgccctgaatcattttagagaactatctaaatctgaaataattatttataaaacacacttgtaaatccaccctcaccataatacttcatagtgatcttctttgaattatttaagactgcctttgcatatccagccttattttctttgtttttagccttgagcatgtatgtgttttgattaatcaccttgtatttagtctttccaaaaataccgtcagtctcatttccccagtaccaacgtttattgaaaaatgatctggattttgtaaaagatccctcacttggtatattccaaagataaaagagtgtatgctccctgaccttggtcttccaaacgccacggattgaatccggcataccattatgccatgtggcagcgcttgcttgttgtgaactcaaaagtgtgccaaacccaacacaagataacagttccatcgtaataataaatttatctattttcatttaccgaacaatcccccttatattttaagagttttataattactcgcatctttcatactataccagccccacttagagctctattatttacctatgctcgctaccgtcactcgcttctgcattacgcaaatcaatatcattttgcaaagttaaaaagtaccgatcagataccccaaatactctgcctaatctaacggaggtatcgacggttatcttacatcgatcatgcaaaataccttgaatcctggatgttggaacttcaatatgcttcgcaagtgcataagccgaaaaattaaatggctccataaattcttctgctaagatttcactaatcttgggtgttggaatttcattcatcatagcttctcctatcacaaagtttaaggtattatgacaactcacaagcattaatgattaaaccagttcatctataataaccttccacgacccatttattaccgcttttccaatatgtttgcattgtatgcttgttaagccattttaaatttatctgtgttgatgcattccctaaagcattcttagccctaatccgatacacatggtttcccagatagcgataatgagtgttataaacattaattggaccagcgtcttcttgaatatgtccatgggtatttgcaaacatcgtgccatcaatcctagagccctttatttttagaatgtaatattcataagtgcctttgactatttttctattatgcgttcgccaagttccttttaacgcattaggcatccctttatgccaaacagaggcacttacctgcgaagaacttaaaaacatccctactcccaaagcagacattattgctacccctgtgacaaactctttcaatttcataagtataccctccaagtaattattaattaccatttcagtatacgctaacgtttcacgagtgaatgactttttttgtaaaagatatgttaattacgtaaaaagcagaatcaacagtgctctgattttatccatttccaaaacaaaacgaccccaccaaccattaagttgatgagatcccctagttattattcaattcatacagaaactctagtagttgccggtaatgattaatttcttattggctgtagcatagttgccgttactcaactgatagcgagtggtcaagttatgcttaaccaacttcttaaccgtcaaacgagtccccttcttgtaatgcttaactttaccagttaggctagctgacttataagtgttaataccttttttaacaatcactgtgatcttcttggacttcggaacactagcataataaaccggtacgacatatttacggttggcagtaatatacccagtcttgccgtcggttttacgatcgtggttaacatcacgaaccttgtatctcaaagtaccattactagtgcgtttgtaaccagtaacaacaaacattggacggttaatccgtttttgcttagggtaccaagcaattcgctgagattttttaaagttaacattcttatacaaaccaatcttcttggtagcgtaaaccgcttcacccttaacagcaatgttagggcctaccgaagtagacggtttaggcgctgtatttggcgtgtttggtgtagtttgtgaagagccatttgagcttgaagctgatgatgaagaagggcctgtacttgacgttacagtttgtgaattattattgcttggatttgctggcgttcccggtgtacttggcgtggcgtttttatgataaacatactgaacaacaatatccttatcgccataaataccttttgcattcgccggtgttttgccgtcccatgtgtacccactaatatctgggcgagaatcgacacctgtcacatcatatggttctcctggataatcgctacttactttagttttaactccagaaattgatttgccagtattagcatcaagatactctatcgtgacattttgcttagtaataggatttgactcctgttgccagacataagtctcaggtccgctatctgttccataaagcggatttttaataaaatcatcaaaggaaaagatgctgccctgtggattattaggtgtccctagagagggcattccatttgagtgaacggcctgccaaccagaaccatttgcataacggatcggtgtactgtctggaattggggtacctttttcgtggtatcttgcattttgcaactgcccaaataccaatggagtaacatttttacccaaagaaatacaccatagattattaggagctccagaaaaaaagtacctcgcatacttaacttccctagtatcccagttcgaaaaatctaattgtcttagttgtgggcaatttccaaacatctcagtcatttccgttaccttagcagtattccagtttgtaacatccaatttttcaactgttaaacagcctaaaaacatgtctgtcatgtcagtgacctgagccgtgttaaaacttgaaacatctaggtcccttaattttggacaccccataaacatccagctcatattcgttaccttggctgtattgaaccgtgaaacatctaattccgttagatatgcagaattgctaaacataccacttacgtcagtcacgttagccatatcaaactttgatacatcgatggtcttagcgtttccttctcgaaacatcatcgacatattagttacatcggtcgtattcaaattatccaacccctgaaagtcttgaatctcattatgagaaatagttccaaaaagcatagacatatttccctttaaaataaccttaccagctataatgacgtgttggcagccagaaacaaatatgtcattaaagggactaacatttcggtgaccctcagtttcgggcttcggaacagtgccgccgctaaaagttttaccgggctcaccaagcgttagtgtttttgagacactatcataattccatggacactcaccccaatacccttgctcaacattcgctgaattattgatctgtgcgttgttcttagctacttgtgcaatcgggttatcagcgtcagcaagcacattggttgaaccaaggtagctgccggcgccaataaatagagcgcttacaaaaatgtacaggtagttttgatgattcttattcattttagtcccctcactaattgggcaaagaaatcaacagtcgttcgagtcactcacttttccaattaaatgttaacacgatccttatattttgttgaaattattaaaccagctgtctaaattcataaccttttcttaaacagttaccttttcccgtaaaaaatcattggtcacataatcaaaaaatcccaccaacaatcaagttgatgagatcatttttaacttctatttatatgcacgaacatattttgtgttagcggtaatatagccaccagctactcgatgtagtcggtgtacttggggtagccggagtaattggagctaatggcagccgtttgtcaggacttcttttactgctgtaatacaaagatatttattaggattagtccttcaatcatttgctgcgatttttcagggaagcggtcagaaccagcttcgaccattatctcgtcattttctaaacgtaagccataccgttggatttgttgaacaagaatggttcttttcgttggggtgatagtttctgtatttaacgtccccccatcgtcggttaatcgaatctggttgtcgggtaaaggaacggcatagataatcaggtcgtccaaaccaagtcctaaaaatggcacttcaatgcgagtggcattttccaattatatctttaaaagaattgttatttattctaccaataactgccaaaaaattcctaatcgttgacaaaaatgaagtatacaatataatataagtttgaaaatgccaagttttgaaacatataaacgaccgaatggccatgatgaattcctggaatggatcaatatacttccaaataaggatagtgctaaattattgagtatcattgataagctccaatccaatggtatgttaattgctcagcggcttaagtgggtccataaactggactttaacctctatgaattacgtagtaaagttagttcgaacattcagtgagcactttattttcacattgaagatgagcgttatgtgatcacacatggttttacaaaaaagactcagaagactccccttaaggaaattaaccatgctaaaacattaagaagggaatggtttgaccatgaaaattagtcaattaattgctgaaaaacgtcgtgattctgaatttaatcaaatgtacgaagtagaagatgaaaaattgcaaacggcggtggcactatataaagcccgtgaaaacgctggattaacgcaagctgagcttgcagaacgagcccaaactactcaagctacaatcgctaaaattgaacgtggggacaatgtttcatttgaaaagctttcatcgattgcacatgctttaggtaagaagttggttgttagttttgattaaatatcggtaaatattacttcaataccgctacagctaaaagtgggcgtataggcgaaccgtttttttaattatccgggaagaagtttatttccggaacagatcgtactcagctattatgtaaatacttaaaaaatggttattggagtataggagctaatgatagtgaagctgcaattaaaagcttgcagttagctattcatcctaaatataatattgtatattgttataaatagggagataatgaaatggaaaagctatggatccttttaggcacaagcattgtcttaatatttggaattggatggcaacaaacaaccgtacaggcttcaacagtttggcacaatgaaacaccgaaagtacttcgtgggatttggcagaagacgattcctagtaaatacttaaaagataagcatgagaaaattgttcgtcatcaagcctatcggataaccaagaggtttgtgagttatgctgcaacaggtcttgatgactatggctataaagtttcacaaacagctaaagtcggaagcacttattatgttcgaagttatatgcaagatgggtctactaaatactataggactttcaagcttatacccatttcagtcaaaaaaatgtcagctcctgtgataatgggaagtggtcaaggtgtcttttataaggttcgtcataccaatgctggaatttgaaaaatctaaacccgttttgagagttttgagaatgaaagcgtaaaaatcacttgtcattgggttccattacttacactgaaacaaaacggtctcaccaattaagttggcgagaccgtttttactttctatttataaacacgaacgtattttgtattggcagtaatataaccaccggctactcgataacgtaaagtaccatgtttggtaacgttattcttctgagaataatcatatccgtaaacctttaatgttcgattcttggcgatcacctgattcttcttggtgaagttggcgttgctatatcgattcaatgtccgttttgttttaactgatttaacttgcttatgacgtcccatgttaaccaatttccggttagcagtaatatagtcgccattggttaaaacatatcgagtggtgagattatgcgacacaatccgtttaacatggagaacagttccctgtcgatagcttctggcttttttagtcaagttagccttgcgataggcattcacaccccgtggattaatcacggtaacggttgaatgcttagtggcatagtaaaccggacgaacatacttctgactagcagtaatgtaacccgtcttaccattcgtcttagacgtgtgattaacgtctcgaactcggtatctcaaagccccgttagcagcccgtttatagccggtaacaacaaacattggccgataaactcttggcttcttggtataccaggcacttcgattagtagctgagaacttggttgacttgtacaggctaatcttgttaatggaataaactacagtcccttttgcagctacataacttggcaaactggtattacttgaagaactggacgatgaagatgaagttggcgtacttgaactagtgctggaagttgaagatgatgatgaacttgagctactcgacgttgtcggggtacttggtgtagccggagttgatggcgtagatggtgcttggactgttagcttcaaatcttgctctgctgaaccattggcataatgaatggtataagttccagctttcgtattgagactgcttaggtctttcacaggtttatgtttactgtcagtagtgtcagtagccgtgaccttaatatccttaaaggccagattatcacccttagcatctgtcgcatttttaaaggcgtcttccggtttccaggcttgcccgacagtaatcgtatcggtagtgtactttaaattcaaggcacttctatccgtaaccttaattatcagtgtgccctttaaggcagctttaccatctttgggtttatcggttgtaatctcaactgtatactggcctttcttggaacttacttggtcaacaggtacagtcccactcgcgtctttaatactatactgatagtttagtggattcccgtcagaatcttttgaatcaatattgtcacgcaagtccgcatctttaaaggacttgtttagataaagttcaatattggttgtctttagactagcaaggtctgatttaatcgttaatgttagtgtgctggttttgtcaccattcttataagttaaatcataagtacccgggtttaacttagcaacggaatcttgagtgactgcatttccatcttttttgtctgtgatggtaacattactcttatcgtcagtaccattcttggttgctgaggtaatcgcactcgttggatcccatgtttgaccttgatataaatcttgacttttattagcgtcaagtgtgtattgatcgactggggttgtttcttgttgccaaacataagtttctgtttctgccggccgtttttcagcaaaagtagcataattactgtacaaagtcccttgaggatttgtgtccgttccacccttggattgatctacagctatccagccaggaccggttgcgtacttgacgggattagtacttggaattggttgattataaggttgtccaaattgatactcctgattttttaaaaagtcattagttacatttttcccaagtgttagactccatacatttttatccacaaataaaatattgcttttttctggttcaacattttttgtattgaaatttgctaaatttaatttctctaaatcggtacactgactcaccaaaaaatcaacatcagttacatttggggtgtcaaagcttgaaaggtcaagatttttcaagctcttatcaaattcaaacatgctgttcatagttgttacttgcttagtgtcaaaactagaaacgtttaaatttactaaattactgcaagcgtaaaacatagaatccattctttgaacatttgatgtaataaaattagataaatttagtgaagataagtcgttgcactcttcaaacatgtatttcatatcagtaacatgagaagtatcaaagctcgataaattaagattcgttaaagttcgacagttcgaaaacataagagacatatcattaactttttgagttttgaaattagacacatctagtgcttgtaagtctccgtcaccaccgaacatatatgacataatttttgtattttctgtatttaatctgtctaaatggtttattttacttatggaactcggagtttcccacttaggatcgtacaaactaaacaaaccggaagagtcttctggcaagttaacttttccaactatatcaattgacttgcaaagatccaacctgtcaaagggagttatgcctcgcgtgttagaacctgttgttgtttttgtgggatccccaatttgtaagacgcctgtagtaatattgagtttccatggacaatcaccccaaaagccactctcaacattttcatctgcgcttacttttggtgtcgtagtcgtctgataattatgttttacactcgcatttacattggttgaatttgtatatgtactaatactcaatgacaaaattaatgtcgcatacaaccaaaacctattttttcttaacatataatctctcccataatcccgattaatctaattttgctccttcttctatgttagcattcgaagtggaaaccaaccaaataaattatgaaaatatatgatgcgttaatcaattaagaatcaataaaagaactattttatccaagtacgtctgaagttttaaaggctacgaatataccagtaaagcatcttgaatatacctgaagaatttaagtgaaaatagtttgcaatccactatcaaacaagaacataaatttttgctacatctttttcctcaatccctttcaaaacaccgctcccgtgatataaaattaaccatagcagccacattccagaaaggactcaacaattccatgtcaaaagtaatcaccttttacagcgacaaacacaaagtcggaaaaacaacttctgttttcttcatcagctattgcttaaacaagatgggcaaaaaagtaaccgcaattgatcttgacaggcaagaagctttgacaaccgcattcaattctgtcgagaattatcaatcgaaaatcaaaaatatcacgccaatgaaaattgaagctgaggaaccattaatcaactttctaaagaatgacgataaatcagatgttgttctcattgatacaggcagcgacatgatcttaaataaggttgctcttgcaataagcgacgaagtcattattccaattcttgggtttgaaggactgcaaacggtatccccaaaaaacatttcttttactgcttccagaatcgccgaaagagtgacgcccaaagccttgatcagattcctgcctattgctgcaactgaatatctcccagaagagcagaaaaacatcaacacttatcaacaccatcacagagaaatcaatattaactgttacaaagaagccattccagacctttttaactttttggcagacaaacaatttgcatcagacgttttccatttagcaatgacatccgaattcggcatgaatcaattctatgaacgactaacaaacgagatattgcaagacagttagcgactttaaccgcgctttctctttccataaaaacgcctttccgaacaactaaatacattttttattaatagcgtgctttcacatcagtatgaaaggcgcttttttaaaagaattcatttgtgctttcactaaagtgcccttatccctaaaggaatcttttgcaatttccaaatcaggttgaccctcatgacaatttcgctcaataagcctaattcaaaaacgctcaataaaatcgagccacctatcttagaaactaaaaagcatccctatcaaaacagcttgaaaaatccttattccaagtcattctaatagaaatgcctttataaaccataaacacttcttctaatgccaatgaatcttatcactcaaagcccatcaactcttatccccaaagaaatttcataatcgtctcctgaacccgagtattcttggtctcaagattagcatgttttgccagttgtcccgaaaagccgcgaactttataactggccacttgctttttcaatattgatcccaatgatagagctgatggcacgctaatggtcccatctgaatcagatccatcattgacttgaccgaaaatattgaggattttagcctgccgagggaagcgatatcgatttcgcattaacacacgatattcaggatgcttaatcttgggctgaccattagcaagcaatcgattttgtccaggataatcgtcccacaatcgactcagcttgccactcaacggttgatcccatttgtgtcgattcagaataccgtcaaacggaccggctattaatgccagcttgttcagccgaggcaattgatttgagttaccatatttttcagcttgaaaggttaacgcataggcacccatggaatggccgatcgcattatattgagtcatgtgataatgtcgcttcaacagtatcaaaatcttgtgcagtgcggcggcttctttatattcaccaacgtaagcattgggaaatttaaccaggatttccggtgattttttgggatgggcaggtaaacgaccgtacatctggatttgacctgatggccctacatagacaaccagtcccttttgagcatacccttccctaatggcttttctagccaacggcatttgggaacgtaagccggctccccaaccatgcacaaacaaaaccggtgtggttgaatgattcacagccaacgttgttcgttgactcatccgttgtgaatggcttggcgaccgaaagagaataccggccactactaacacaactaccgcaccaatgatcatggttgtggtgattaaaattttatttcgctttgtcatcattcatccacctcaagcgctaagcttaccagtttagcttaattgattatagaaccattctagtagttatcatcactttaaggtgtttcaatgctcaaaataaaccaaacatttacaaatttaaggaaatcgaaactttactgttggctaacattaattgtaaccatcctttattaccctaaaagcctttaaataagccaagtttgtattttctttaacaattggaatcgaaaaagatactgtctcttctattgagtgctagaataaaaaccgaaagcgggttcataaaatattgcttccaattgccgcttctaatttgaaagaagggaatattatggaaaatagtaaaggagcaactaaccgctggctcattatcttcggcacaattttgattcaggtttctgccggatcattctacgcttggtcaatctttaacaatggttttatgatgaaatcaggtggtgttgttcaggtcgttaatggtgtaaagaagatcgtcgggggcctccctgcaggatctgtcagctttacctttacgcttggcatgctttgcttgtcattggcaacgttggctggaattccacttgctaagaagtatggcattaaagtggttagcctttgtgcatccgttatttatggcctatccattttaggtttaatgacgattggtaaaggctcgtcaatttggatgttatggctgtttggtggtgttttacttggtgcaatgaacggtgtgctttatttaacaacactcactaacgcaatcaagtggttcccagagaaaaagggattaatttcaggaatcagtgttgccagttatggtcttggctcatttatttttaaatatatcgacatggctattgctggtggtaatggtgcgattaccgccgacaacattggcagagttcttctttggtggggaattctggcattgattttggcagtcgttggatccttcttcttaaaggatgcaccggataatatggcgattccatcaaatgatgcgaataagcctgcggaagtcgataagacgaactttacaacgtctgaaatgttacacacatctcaagcctatatgatgttcttctgcctaacaaccgctgttatgtttatgggactcttgggtgccgctgttaccaacatggcagctgcttggacacaagctccgaatgaagttgccgtttggggtggtacaagtgccgctgcaacttttgtagcgattgtggcacttgctaataccattggtcgattcttcatgggctggttatccgatattaccggacgaaaaaccgtgttcttcatcacttatatcattcaattgctttcgctgattgctttgttgatgacgaaacccggctcaatgagcatggcgatgatgtacattgttgttatcgcaatggccttctgctttggtggtaacattactgtatttccaacttatgtctccgattactttggattaaaaaatacgtcacgcaattattcaatgatctaccaaggattcggaatcggtgccattatcattggcttcttaatggcttccggtaatccactggatccaaagaaagtcacgttatccaacggggctgttttaacccaaaactttactttaacctactgggtacttctggttatggttgttatttcattagcaatttttgcatttattaagaagccggttaaaaagtaagttgttgactaaaaatcaagcaagaaaaaagctggattttagacaacagtctatctaaaccacaaataataaaacgaggatgcagcaaatcaatgccgcgtccccgttttattttactattcacttaaaaacgactattcaagactttttagtatccgatcattggactttgaaggtaatgcacccgtttcataagtggcaatagtagtggggctccatcccaagagagtcgcaaaatcacgttgattaagaccatacttatgtcttaatgctttaattcgatccggactgataacatcatgcttgactctataggcatcaaaggcttcattgacagcttgatcatccaacttttcgtcaaaaacttgcttattggtttgactatcaaatcttgccgaagacctaatcgcaatcttctcaccacgaattgtatatacttcatcaatcagctttacatccattttctccacaataatcatcccctttaattagtcatcctattcctccagtcattactacacatataatattattgctacaaaattgtagcaacttttcagttctgccattgcttacttttagcaattacaggattcaatcctgacatacttcgaattaacggtaagtattcaaaatatgtgaacgattgctatccttaaaaaattcacaatatctggatacggctatcaataaattcagtcgttgaacaatttcaaaacgatgatttaacctcaaaattcgacactttaatatttttagccttagatttgccttactccaagtggcgacatatcataaatgtagggaataaatacgaggagaaatctatatgaacacaacttctataaaagcaaagttgacatcaaagaatcaggtcactattccaaaaacaattcgggaaattcttaatatcagctcacacgataccattgactttgaagtattaccaaataaagaagtacggattaaaaatgctaaacctactctctgggagactttgcatgaacaagaaaagatttatggcaatgtcagtactgatgagattgattggggaaaagacgttgaatcggaggattttgattaatgacaataaaacaaggagacattgtctatgttgacctggaaccctcaaaaggtaacaaaatgcgtaaaacacgcccttggctagtcgtgagtaacaacgattacaatagatacttcaatacaacgctcgttcttccgattagttcatcaagtaagtaattgcaacaggataaatatgtaaaatcaccgatctttgtttcttttaaggaacaagatgctcacgaaactattctattgcagcatgtcagagccgttgatttaaaaagacgtcaagacagtaaagtagtcggacatttatcacaagaaatgatgaatggtctttcggacactttaaagcagtttttctaataacttcaagaaatctttaatcaacatgaaaggtcacgcgttcacttgcaccaccatgacaatacctgccaatcgcttatcacagcgtattaattttttatgtgatcatcaatcaccaaccacttaaaaagatgtccgtaagttcatgacagccgaacttacggacacttttggggatcattgttacttatttcttctttttcttgttcttccgcttttttcgtttcttgtgccactcttctaccgacatcacgtcgcccttttcttcaacattttccaattcagcctgcatatagtctttggcctcgtcaatgggcatgtcttcggtaaccttcataagagacaaaatctttcttttttctggagaaaagttggcttcatttgtccctaagcgcgttaatgttggtgcaacatcatcaattgcacgcttcacggaatgaccgaccgtttccggaatgaaatcaaccgtcaccgcataatccataaacagcttcaaggtcggtccaaggtaatgaaactcatccggattgagtaacgcatccttcacaaaaaagccttttaaaatattttgtgttgcctcagccgaccatttagacggactaagtcggtactctccgtacatatgcgttgcaaaatcggcaatatccgataccgcattattttctatgtcaggggtaatcaatccataaatggttttcagcgcattcgttttaacaaatgcttcagccacatcaactgtcttggaacgaatctcgatagcttcatctttctgatacgttggtaaatcaggcttgtcgtaatgatacaattttcgattaatagcttcaatatcatcatccgttccggatactgaaggttcgtccaacgcctcgtcataagcatcatcaacttgatcatccgttaacttgagaatgccttctccaattaaccaccccagaaaaatccggctgactgccatatagtttgtccaaagatcttcgaacatctcatctttgggaagcgtttgctcgatcatcccgatggctaactgaatatccttagcgttgatttgtgataagggcttgattttagcatacatgaggacccttaaaaaggcttcgagatactcatgcatatcatttttaaagtcgtcctccatcgataccgttgtcatgaaatctccacccgaaagaaaatcatcccaataggttgccattagttgatcaacatatgcttcaacttgcttttttttcgccattttttctccttgtctactgccatcatcttgcatttaagtaacatattattataccaaatcaagaagattgatcgaacaccaatttgcaaaactaacgaacgttgcttacttgttatgtttctcaatgtgctgctccgtggcatgaacagcaaaaaaagccgtcctgccaaatgattccgttgcaggatgacttcgaattgttttctgcttatttgaccactacctgtaaagcggttctctcaggtagcaacctcatcagatctactcaacaatatgactggactgttgataaattggttccctgttcaaagctcttagaatagctgcttctatgcttaatggactattaatattactggtggcaaccaatttatcaaaatttttggcatttgtgatggctttattggctgtttcatggctgaccgagtgcagcatgacaatcacaatatcggcgtgtttgaccgcggttaataagtccgattcaataccctttccgcttgcttcaccatcaaagacgatcagttttccatgatgggctttaatgacgtcatctacttcagatctgtgagcagaatacccggccatgaggaccgtcttattttttaaatcaaagtccaacttcggctcaacaatccttggtgttttatcggattgatcaacgtaggcactgtgtggtttaggcgccgttttcaatggttcatccgtatcactgcttcgataaacccacgcaacccgcgcctctgccggaccccggtcccgataataggcaatatcgataatgtcaccatcttgtaccttgtttcggcttgaatccttataattcaaccgaatagtcacgggcgcgtcatcgtgtaataaaggtgtaccatcataggcctttttggcaaccagtcccaggttcggatcatcttcagcaatcaccgtttttcgaacaatggggtcctcaccggttgaggcctgacgtgccactaattcaatttccggttgataagaatgactatactttaatttgacgatatccccgtcttttaaatccgttttcctaatcacggtttcggagtaatgaataccattcacgactgccccgattaattttctgtcaaatcgataggttttatcgtcggctgccgtttcttccggtttatcaaccactttgtcaatagtatccttatcggttttctggttctcatctccagcaggctgttgctctttgtctgattgtggcttgttaattgcgtcgacaattttctgaacacttttttcactatcactatcgtctttattttcaactgaacttgctaaatgcgcgtatttacttatgatgccaattgcatccgttatgagcggcatattttctttatcggcgtattgcagtattttggcaacatcccgacaatagtccagataggttttagctgccattattttccctcttttcaatcaatatgtaccatttttattaattactggctataatacaatattttatctattatatcacgaaagagcaggcccgattaagccaccactgctttcgacttttgtctacaagcacaaaaataggcctcaggtttgctatgcgtttcaacctgagtgcctattgatcggaagggatattatgattaagggttaatgcccacttttgtttaaatctaatgttttatcgcctcaatttaacttattaaattgatctaactgtcgcaaacttgaatcggttttataatttaacttttgataaatttgccgtgcgatcaatttgatgtgtcgtgaaactttggaacttctaaaactgtcaataattggtactgaaacagtcgtgctacaaaaatctcatttttaataatcggatctgtgaatctgttatctatgcgtcaatttgatatcacatcaatttaacagcttatcggattcatcgatctactacaagcgacccctgtacaattatctattcgattactccactgagtattaatagtcgatctttaaatccatgtcgcatgattggatcattttatattcaaacacttaatcacctgaaattaattttgtcatcctcgcttgtaatcatcctaaccaatgttactgtttaaaactcatactcaccaagattaatcatccatcacttcaaattacaaacatttgaaaataaggttacttttccaacaaatacttgttggtggaagaacattcaaagtaggtttaaacccttgatgcttcgaacttctcttcccttccttgactatataataccacatccgtaagcgtttgcaagagttaaagctcacactttaaataagtgccttattccttgatataaccggttcttacacaccatcttcaatattaaaacacccctgaattcgatttacggtaccgaactcagaggtgtttatttgccctatcctcgtttactttaactattcactcaaaaatcactatctaataaccttaacaaatttcgaattagcggtaatccaaccaccggcaacccgataacgcaaagcaccatgtttagtgacgctgttcgcatatgaataatcccatcggtaaaccctcaagctttgacctttcttgagagacttctttcgattagtcaggttaacattgcgataaaggttgattgatcgcttaatcgttactttctttggaaaggccttttttgagacattgcccatcataaccagcttacggttaccggtaatataatgaccattcgtcaagatatatcgagtcgttaagttatggtgaacaaaccgcttaacgtgtagccgtgtcccttgcttaaagtttcggaccttcttagtcagagacgcttttcgataggcgttcacaccacggggattaattaccgtcagtgtttggtgcttggattgataataaaccggtcgcacataagtccatccagctgtgatgtaacctttcaaatgacgattcttggtcaagtggttaacatcccgtactcgatatcgaagctgaccgcttgctgatcgggcatagccggtgacgacaaacattggccggtaaacccgtggcttgctgacataccaagcccgccgattcttagctgaaaagttagtggtccgatataagccaatcttcttcagggcataaacggcttctccctttttagcgaccaaaccaggctgttcactcgtactactgcttgcagccgaagatgaggaagccgcactacttgaagaactcgccgaaccgcttggcgtaccaggtgtcgttggtgtacttggtgtaactggcgtacttggggtcgtcggtgtggttggcgtttctttattcttatattggtaaaccaccgagatgtccttgcctttttcaaagatcccggaagttgaaccaaccgttttaacaaacgtataccccttttgctttaaattatcttgggtcttggtcacatcactatttttactcaaatcataacgataaccactctgaccattgaagctaatatccggcgcaatggtttggccatcggtcgtttggaactttgccgttccgttaactttaacattagcctgcttgtcgtagtaaagtttgatgacattcttggtcagattccggtcaattgtaatggtttggtccttggaactgtcgggaacgtaaccggcaattggataatcagcagcatttgccgtcaatttgctacccaatttttggtctttaatcacttttggcgtcgcaattggttgatcggtcttcttatcatagaactggatcgtcgcattgacatatggctgcatggcgtgaaccgttgccgcagttgattcaagaagcgaattatctttatcgcttgttctgacaacaaacgtattgacggcttgagcatttttagctaacggactatttttatcaacgtttgggacaaccgatggataggtaatgttgattttatctttaagccccagctttgtaccagtatttgacttaattcgaatcatccgaaccttactaaagtcggttaccttgccagcactcacaaacttggctttataattatcaatcaacgttttacttggactgtcggtggaataggaagcggtatagccatccggtaccttgaccgctccggttaagtgcaacggaatattggattttcgagagacaccgtttaatttccaatcaccatcgtaaggcaaaacgtcaataatatccaaataatcatacgtccgctcaccgtcattatttaatgtgacttgatagcttaatggatcaccgatgtacgcatttgtaccggtatccgatacataagggggctgattgtctgccatgactttgttggtattgaccaactttcggttaggcaaataagtgaaattaccggcttgcgaaacaacgcctttaggattattggtgttttgatataggccatagctatccgcaacaccagccgcgttactaccgatcacaaaatcggtttgactgccggccttgccgttattattatccaggacaaggaacgcttcaactgaataagccccggacgtgagcgattcatcagccgttagtggaacttgataattaatactactcccatcactgttataatcaccgacattactgatatcaccgatgatggctgtcttacccgaacctgcataattgggctctaccgttaaattctttaaatgactaatatccgatgtgtcatccttatccaacgtcactccgtccggaacaaggtaaaccatcttggcattcttcggcgcaatgttcatcgtctcattggcttgaacgtaaaatgaaaagttagccaacagcggcttaccgcccaacatttgatcactattttgaccggttaggcttaagccagtataaccgtaaccgccaagctgaggaatattacgagttacagaaacatttccattgtctgttttaggattatcgctaccaaagtccggttcggttgtttttgaaaaattggatgatatattattttgatacgacgtatagggatcaccactggcaacaaaattatttaattcatcttttgtcagagcaccggtaatttgagcctggaaactatcagcttcatcggtatcaaaggttacaggtgatttaaatgaaattgtcagattcttataaacgccgcccttaagatccaaaggcttaccatattgaactgtacccaaatcaaccgattgacctttatcattcgttgctttgaccgtgttttgatttaattcggacttaatggccgaacttagatcatccgtgtcaacaaacgacaaacttttctcctgataaccaaaattaggtgtttcagtcacactgctaagttgagcagaattattcccggtgtttccagacgcatttttaccatctgaaaggttttgaaaattaacaggtgtcaaagttgtctgcaatggtgtagttccggcctgagaataatcaacactaggactatcgacatctccggtaaacgtcgcatcaattcgcgaataaacattaaagtcatacgtcggcacaggctgtggcccggacaacaatattgaaccgtctcgtgtatcaactaccccatttggtccactaagaactgttgtggacgtttctggtgtatcgacttgatacccctttggtacggttactgaaaaattcgaaaatgttgaatacttcgaaccggataaatttgtcgtgtcaatcgtcactttattggttaacgtattcttactcttatcatatgtccacccattaagatcgggaatgtcagcatcagatacacgaacatccttgggcagttggacagtaactgtataattaccgggttcggtacggtcatcataataaaatgaggggctgctcattgcaagttgataggtttccttcaacttaccatcactccaataagtatcacttaaagaagcagagccattagccgtaccgtttatactcggattatccgtcacagttgataccttaaagctttgattgctcaagattattttgccattctgatcaagaaaatcagctgggattgaatatgaccccttatttttaatttgtcccggaaccaagttcacaatcagtgaaatacctaaatgagaccctgccgggattgtgatgggatatacggtcaaaatatagttgtctttatcctcagtaatctccggatcttttctgaagtcaccacccgaaatctcactcttactgatttcctgaaaatactttttactaaagtaaattttagcagcaccattggcatagtccgctccagatccttgactatctatttgaagaattaagttgatgctgtcatcgggataaaatggtccactaccgcttccttgtggatcaaacattaagccacttccggttaaaacgggatcggacgatgttttctgctgagaagccgcattctgatcaggttgaatgctattttgtcccgatacttgaggctgctttgtaggagcattaggtgaaatcggtgttgtcggtttagacgccgtatcaatctgctgagtgattggaacggaagaaaaatctgataaactaactggactggctaaagctccgttgcccataaagaaaaacaataatccaagtgaaaataattcaactttgcgtaatactttgttaaaacaagaatacgccaattatactaccccctgttcagatacccgattaacaataaacaagataaaagacattgattctctagttaatcaataatcaaacttctttaaaattcatccccttcactatgtaaaagctttatctatcaaatataatttttagcactcgccctctatattaaagtatgttttgtccaacccctccactgactattataaaacaagaatggtagaacttatattctatttcaatatttttaatgttcgaacactacctatcatttattagtccttctgcataatttaattcaacaagatcatcagaccggcaatcttgaataaagaatattcaaaaagttatttactttttgaaagtgatctggcatattgaatctcatcgttatgaaagtagtgactttaatagtatttagttaatggagaaaataaaataaaatgaaattaatagcccaactgtcagccgcaggtagacgtgcacacaaaggtacgcttgatattgcaaagttaaagttaaaccaccttgatagtcgaagaaaagagtaccaaatcaactggcgagacgtttatatgattaccgagctggaaagcaagaaatacaagaccgccatttttcttaaaaccgaaaaaatcactggatatgaattgacaaccacaacattacttcaaaggctaacagccgaatacgctaccaacaatgactatacgagagaagaactggctcactttatcggcgtattggaatatatcccctgcccatttggcgaattaggattcattgcactcaaatcatccaataaatcaaaaaacgtcacttggatttcagccgaattgattgatcatacccagccggcggatcatggaaaggcaacgactgtcttcttcaagggctttgattcgcccgttatgattccaacaacaacatattttctggaccagcggctacaagccatcaaaaatattcaccgcttactttcaatcattagaaatgaacatgatgaccgttatcgacaaatcaagcaaggatttaagacttttgtgctttcgaacaagctgaaaaagtttgcaaataaaaaaggcgtcacaatcactcatgaagaaattgtggctgcctgtaaagaagaacttggattttattatgagccgtcgttagggtatcaaacgttacttgattttgagaatcaatttaattaaaaaccccaagtttaatcaatattcccttcaagaagtatcaaaatgaatttttgcgggggggtatgtacatagcgctataaatagtaggtggaattcaaattgaacaacggtattgttaacatttaaatcaatagaatcaccacaggtaaacgactataatactaagtactaaacaatagttaggaggaatttcaccaatgttaaagaaaatagcgttatcacttgcttttggaatcgtcctttttaccagcggtgcaattgcagtcaacgccagcaccgatttaggtaacaatgaaaacattcaatatgtcaaagttaaaaagccgacctttaccggtcaatacaccaaggttaatggtcagaaagggcaaagaattataacgcctaaaggaacaattttaaaaatcatggggataagcccagctacgaacagccggcgcagtcaagccgtcttttctctaggtcagatcagttatgtcaagcagcagcgaatttatcaaccaaagaatggggtttatattcgtaattacaatacaacatactttaaaccttattcgctcaagttacccattcgtggtcaattcctacagctcggaaaatatgctaatgatggctcggaacattacaagccaatctttgtcgtaacaatggacggctacctacagtattacagtcaatcacggcttaaacattatcagattcaaaataatatgagctatggcaagcaaggaagtggcggagcggcagttaatagtccattgttcaccatcaagccaactcaatcggtaaaaattaccaaatttctagttaaaggcaagtacgacacactttactatcgaacgccagtcagaggattagctgacaagaaagttactaagacttattaccggctaaagattaatcagctgggaacaattggtaagacctggcattctggcgaagacttcttctcggccagatggactaattataatgttggtggacaccacttcttttacctaggggatgttgagagcggtgactaataaaaaaactatcgtcaatttatcaagattggtaaacccattcgcaattgaatagtaagcactaatcaattgcacatattaaaatttgctttttttatttttatacccgcgaatctttgaatttaataaaaattggctgcatctagaatattattcaataaaaatgcataagatatatcacatttgcgatacatcaagcctttacttcaaaaaaaatattcaaaaaactatttactttctggcatttatctgatatattcttttcttattgaattttaatcaaagcaataagcacttactaatatggaggttcgaaatgaattttttaactaggcagtatttgacatcaactggaatgaaagcacaccatgcttctctaaatatcgcaaacttaaaaacaagccacattcaacaccatcaaaaaagtctttcaccctattggcctgatgtcctcatgctggttagcctagaaagctccaaattcaaaacagcaattatcactaaacgtgatggtattattctaacaaacagttctactaatagcttgattacaaatttagttgaacggcactcatatggaagtccttataccaaagaacatttcgcgaatttttccggtatttgcgagtacgtaccatacgcattcggtaatctttcactggcaccgttaaaagtgaccaatggtactcgtaatgcctcgtggattcaaacaggacttattgaataccacacctttgatcatcaccaatcaaatgacactattatcttttttaaagatgttaatcatccgattacggtcccctactcccatgacttcatctccagaagaatggaagatgtcgatagagtacatcaagttattgctgcaatgtatcagcaatttctgaatgtctattgtccaacctattctaattatgacgacaccgttagtcaggcaaacaagcgaattgtcttacccttcaaacaatttgtggccattcaggaatatcagaatatctgtaaaacaaccggcacaccggtaacggaaagcgacgagcgaaaatggtgtctggaacacattcattattatgataaatcaaaaaagaatttgaaattagaattcccgcttcgatatcacgttaatgcttattaaaaaaacgatctatcgaagtgttattctcagcctaataattgaggagacgcaacgattcactaggaattcttgcactttcaattaagcaaactcttgaaaccaaaatatgcaaaaaacaactatcagtttttttaatacaacttcatttaactaaacggaggacatcatgaagttaaaagcccaattatcagcaaccggtaaacgaatccatcaagacacactcgacatcacaaaattgagattaaatcatcttgatagtcgtcgaaaaaaatgccggattaattggcaggatgtttatatgataacggaattaaacaataagaactatcgaacggccattttcttcagaactgaaaaaataaccggttacgaattaacgaccaagacattgcttcaaaaattaaccgttgaatataccaccaataatgactatacccgagaagagttagcgcatttcatcggggagaaggaatacatcccctgtcctttcggtaaattagggtttattgctttaaaggcaactcacagatcaaagaacgtcacctggatttcggcagagcacattgatcatatccaaccaacccctaataatgacgcaacttgtgtgttctttaaaggcatcgactcatctgtcagaattccaacaaccagttattttctggagaaacgcctttgtacaatcaagaatattcattggctactcaatattctaagaaccgaaaacgatgaccgctaccgtcaaatcaagcagggattcaagaccttcgtttttataaaccgattgaaaaaagttgcggatcaattcgggatcatcattaccgaagaagaaaagattgcagcctgcaaacaagaacttggcttttactataagccctcgctgggatacgatactttgcttcaggtaagccgggaatttgacttggattaagattgataatcgcttcatcaaaatctaccattagccttacgattcattacaaaaaggttcttgatcgaacctgcttagcataaatcttaagcggtaccacgattgacgatttcaccccgctccccagccaactgcgaattggtgtcgctcgggatgccaagaatcaaggtggctgtatgatttttggtaaaggatttgggaactatgatcgggagatgcacttgacgctgtattgttcgtaagttgcaattatttttgtgtgccaagtgagcaaacaaaaattatgtatagtaaatattcaaacaaaattgtacactaaataaagtaataaaggggctaaatatcaacgccaactttgcaaacttaatgaaaagaggaatttaacgtgaatcaaaaacattttttaaaagcagtggtattaacaactctaggactaggattgatggtgggtataacatcccacctcaatcaacctgcggctcttgcgcaatctaaaaaagctaaagttgtttataacatgaaaaacccaacaattcgtttaaaagtatccaaaggttacatttggtcaaatcgatttttaacccaggctaagtatcatgccaaaaattataaaaacgaaatgttttactccagccgacatgccacaataaaaaagcccaatggtaaagaggcaaactattggctgatcagtaataagagcggcagtgtaaaaggatggatttgggacagaaatactaaaagattagattcctagttactaaagctataaatagcaccggttagaaaaactatgtttatgaaaacaaactgattaaaatgaatattccaactttgattttcccctcacaaggtttccggccttagtaaatgtctcaagaagctcttaaagtcgtaatatgaccatcaagctaattaagtttcttttcgtcacctttcgtacaacatttcggtgtcaccgcacaaactgcttctgcaaagtcatatgctaaggttacatctaacaaagccttaactgctgacgctactactcgtaacgttaacgttaatggttctaacgctctttataccaaagctggtactttaaagggtgctaagtgttgctactaaaaactcttaaatggtgtttaaagaagcaacaagtcagaagaactggcggcgtttaaccgtgttgctactacgtaaccgtgctatctcggttactacaaggtcgtatccattccgataagacttacgggctggatctatggtggtagagcacttctaacttttggctggcggtatcgcttcatcacacgacgtagtgctgctgttcatccagctcctggcttcatcagtcaaccttcactttgaagacctctggtcctagcacttagtcttactgcacctcgccttggtcacaataaaagtaggggccgtgctactgtttgatggcaaggtagttacctactactacaccatactctggcgctgtcattcactgttctgaacctgtacgacttctcgtgaaggcgaaacttggtatccaattctgctgccccgcttgtagttcagctcaacatcagtgctaattcatcgctgcttcgtcaagcacatcttcctctggacgctgccaatgccgacgggccctcaatgtgacggtaagtggatcaaggctttctgatcgcaagctgctcttcaagtgcaaaccctatcgctgacaatgctgttcgagtaaacttggttgactcaaacaataacgttgttaagtcattcgacttcactaagactggcgttaagaagggcgacacccttggtactcaaactaatggtgcttggactttagcaaatgccgatcaaaatgctcttcaaactcaaattaatactgctttgaacggtactagcttcaatttaacttcattaactagtgcacaacaaactgcattggcccaagctaagtttggcgattcaattaatttgacggttaacgcaaatgcaactattagccaaagccaagtcggtattaacttcgtaaatgttgataataaccaaccggttgggacaaccgttgttcgttcgaatgttaattatttgaaccaaagcgcttctaactttatcactagcaatttgctattaaatgcttctggtacttcaactattcttcctgatggctacacggatgttgtttcgaacaatggcttaacaaatagtcaagctgcaactaatgcatctgccgttgcaaacgcacaatatggcaagtcaattacttattatgttaaagcaaagcaatcagcatacaattactttggaaatgctactaattcattagccgatctcaagtatacaacgaatgctgatggtactggtttagagtcaattactaatggcggacaaactactgcatattcatttgctacgcagaaatcagatacagcaacaaataagaaagctgcattagcaactgataagaatactgcaggtggtattggtgatcatgtaactgcctcacaagttcaaaacgcattgaatgataatggattaagtacctattacttgattttgaaaccatcagatggtacgtatgtaactagtccttcggaattggctaacttgaagaataattcaggcgccggttcatatgttactattcaaaaattcgagttccaaccttcatggttaggatcaacccaattaactattcctgatgcaaatagtgctagtgctactaaatcaccagttccttacaagttaacaactatcaaagcatcattaggaacaaatgcatttaatggtcaaaatagctttactgttgataatgtttcaaaggcatttacagatcctggtatgtcacaaaactaatttgtcaccttggtaataatttagttgaattattgcaatgacttatagttataaaaagctcaactttagattaatttctgaagttgagctttttagattttaatacccgcgaataaaccacaagcttaccgtgtgaggggtgaaaaaagttttagcgtgaaaaactgcgttggaaaggagtgccttgtctatagataataatcgcttagcacacctaagataaaattgttagtaccaccacattatattccccccccaaaaaaatatcggtggaaaaatagttacggtgaattaaagcaagctattggcaggattttatgttgactgtgtgaattgaaagaggttgatagtagcgaggcacacgccatatcatattcatatgttagttagaattccgcccaaaatgtgtgtttcgagatttgtgagatatttaaaagaacgaagtgccggtattacgcacgaaggacatgccaatttgaaatataactatggtaattgaagcttctgagtaagcggatactgcattagcacggttggtttgaattaaatttacaaccagtcttttctatacaaaaaagaggctacctcaattgcatgtagtcccaatagctgttctacgatttagcattttattctactaattacttagtattgctttttgataacaaaacatttttccattttttccaaacttttggataactataatttttagaatccaagtatgaattctcacttgtcctttgtaggacagtatttttggttaaaagtgaaataatcgtttgagagtaaccatacaaatcaccaggttcaagtaagaatccgttaaccttatccttaatgatttctcctgggccaaagttcgtatcaaaagcaacaagtggcagcccatgagccaatgcttcagccatcgcaagtggaaaggcatcttgatgagcggcactggcaaatacttttgcggaatcataaacaggttgaatttctggcgtatatccagaaatagtaacgttattttgaaggttcaattgttgaataagatcttcaagcgatttaacaaattcttgatcaccgaagccacgaatatctaatgtagcatcgggcacttgtggtgtaaccaatgcgaatgctcgaatcagattatcaacacctttatctgcaccaagtcgccctacataaaggaccttattacctgggcgattagccataggtacttgcggttctttcaattgtttattactaaaggcaactccaggaattgaagtgatcttaatatttcgacccttgcctttttgacgcttcaatcggattcttaattgacgtgcttgagcatctgtcattgtgattaagccatccaatttatccaaatgtttgaagacttcctcatagcttggctcaagcggtgagttaatcaaatcttccggattagcagcatgaaggatcgggaagaagagatattttttggcttttgtcttcatattaaccagtggaatatccgcaacacccggtcgatcagcgatgaaggttgtttcatccttatcttgggtattgatttcatcaaggaagaaagtgaataattcttcctcagagttaaagtaatagtcattgcccttataattaatcaaatgaatgttgaaaatgactttacccttacgatcatcagtgacttcccagaatctttccaaagctctggtaccatctaaatgataaaggatttctgcatgtggagcaccgtcataatctagaaattgactggctgaatgaaaaccacgtgagtcccataattctcgattggcgatattgccaaattcatcataatgttctaccgaagaaatttcaccaactcggcttggtgtatggtgaatcgtttgggctaagcgaccaccttgataagcttttgaaacgtcactatcatatttcaactggtaactgatcgggatattaaggcctttggtactagtctgcttctccttaacatcagttgttccctggaaataatcatacatatttaagatatcatcctgctttaagccgaaattggcagcgttcagatattccatagtatcaaaatcacgggtcacaatttttgcatgaagccgttcatgtttaaacaatgctaatcgatgaaattccacatgttcgacacttgaattaaatgctttaatatactgatttaaaaagtaatacatggttacacctcaaaactttccggaatttgagcattcttctctgcatctttaagtaatggttgccacttttcccaaatggcatcggaagaataattccagctatctttataagcattttcactaaatgcttcaagtttctttggatctgaaagcagttcgataatccgatctgctaattgatcaacatttctgttttcaaccaaataaccatctttaccatcattaatcacatctcgaggcccgtatttaatgtctgtggcaacgattggcaagccgtgagcttgggcttccactaatgttagtggtaatccttctgcacgactaggcaaaattaagagttgggcttgattgtaaacagcactgatatcttttgtatagtcatggaaagtaatatcatcgtttaagttcagtctgtttacaaggtcggcaagtgttttatcgtaatcaccattactgtatccccagaaatcaagggtagcatccggtacggctttaagcactttaggccaagcttcgattagaacatcctgctgcttttcatcagaaaggcgggcaaccataatcacagacttgggcttacggtctgaccatttaacatgcggttggtctaagattttttgatcagtaacagcgcctggaatcatataaacattgggctttgttttaccaaaacgttcagtaaagtcttgatattgccaaggggttaaggtagcaataccattccaacgacgacgattctctaacatgtattcataattatagttgaagctagagtgcatgtggtcggtaccggaattaacgtgattattatgtagatacatcacggaatagataggcgtttccatcttttgaatggagtaatccaactcataggaacgatcacagatgattgtattagcttcacctgtcgagaggtttaattgatccagccaaaaagtggttaaatcttcaaaagtggcaaagtcgtaatcttgtcccttataattaatcacttcatgtaatgaagtctcagtggtaccgtcacggcgaggcattgtaaatctgcgaatggcaacttcgccatttggtttaaggatttgttctgaaaccaaagtggtatcataagcaaaaaattgttctaatgacgcaaaaccacgggaatcataacgaaccattcgaacgggtcgaccattaaaaccggagtattgaacccagtcaatctgcttgttttttacggtcttagtcccaacgatcataacaagctgatcaccgacaaaaacatcggtctttgtcttatccctttcaagttttagttttgcgcctttaggtaaggttagttctttgatagtcattttacggcgtttgaaattagttgttccttgaaagaagtcgaataagttaacgaattgatcttctggaataccggcatcatctatcacatcatgtagattaagtgaaagtgcgcgggtaatgattttggcaggaacatgtttttcattaaacaatttcaatcgtttaatttccgcatgttcgataccagactttttaaagctgatattgtcatcgtagaaaaagtacatgtgtatttacactccttgtagtgtcttctaatgattgagaaataacacaagataactatagtttatcatatcaaatagctgtaatgcgtggtgtttcagcaatattgaaagttgtaaaggaaaaataataaacatgaaattttttgcttaactatataaaaagggttcagacatattacgtctgaaccctttttaggttagtggaataattagactaacaaaattaatcgtttaattaaaattgagttgtccagttagtttgacccaaatcaccatgagtaggtgttgagttaacggctccactgtattgagctttttgaacagtgtaatgagcatagatagtatttgctgcatcctgtgtaccatcagcgttaatcttcaaagtgattgttgtatcacttgtgttagcaccgttattatggtttacagtagtgagagtagccttgaatccattttgagctgtgtcgatgttaccttggtttccggcaccaccaccattagcaaagtagaatgaatcgagattaccagcctttaaagcagccttgaaatcggcggctgataagcttccaccattagcaaccttagtctgtaattgagcagcaaaggcagcttttgcattagcatagaattgtgaattcaaaacaacgtgtgtagctggatcaccaacggcaccagtatgtccattagttccagcatagtttgccaatgtgtctgcttgtaacaagttgttgtcatcaccaaattgtaatttgtcaaagatttgaccgatttgagtgctggtcaatgttgcagctcgacttacaggaatgttaaatgactcaccatattttgcgatttgcaatgatttgtataatgctgaagttgctgttggaacgttaacggcgtaaccggctggtgcaacttgaacaaattgccatgcatttccatttgtcatatcaactgcttgaccattaacaacaccagttggtgcccaataagttgacttaactaatgctccagttgaagcatcaacatagttaagagttacagcacgtgttacatcaacgttagttgtagtagcattagcagtcaagttaacagaagcaccgaacttagcttgggctaaagcactaacttgagcaggtgttaatgtagtaatactgtagttagtaccagcaagtgctttgttgatttggtcttggatgttgctttgatcagtttgatcaagagtccaagtaccattgaattgtgatcctaaagtatcacccttcttaacaccgttcttggcataatcaaatgttttaacaacattatttgaggcatctactaagttaacacggattgcgttatcagcaattgggttagttggtgtagaagagctagcactagtacttgcagatcagaagccttgatccacttaccgtcaattgagcggcagcggattgagcagcagcggaagctgatctgaagaagcagctgatgagttagcacttgatgttgaagctgaactagcaggggcagcagaaacttggtaccaagtttgccttcacgagaagtcgttacggctttagtaacagtgaatgaagcgccagagtatggtgtagtagtagtaactaccttgccatcaacagtagcacggcctactttgtattgtgaccaagcaggtgcattgtagcaagctgctagtaccaggagtcttcaaagtgaaggttgctgatgaagcaggagctgaggaagcagcactagtagtttcgtatgaagcgataccgccagcaaagttagaagtgctcttaccaccatagatccagccacggtaagtcttatcgaatgatacgaccttgtatatacactgagccacggttagtagtagcaacacggtaaacgcgccagttctctgaccttgttgctgtctttaacaccatttaaagtgtttttagtagcaacaactttagcaccctttaaagtagccattaaagtaccagctttggtataaagagcgttagaaccattaacgttaacgttacgagtagtagcgtcagcagttaaggctttgttagatgtaaccttagcatatgactttgcagaagcagtttgtgcgttagcagaacctgcaacagcgacgaagcctaaagcagctaagcctacaaataatgatttcttcaagcttgatttcattatcttgtctcctccaatatataaattgatttgtagttcactaggtatatgtaaactgcaattatcattctaccccaaatcgatgaaatgaacaaccgcaatctcatatttttgctcctaatcaactttacgtacattattctaacgccttgtttaggggttcgcaacatttacgtccttaatttatatgattgttatatctgaaacactattgtaatgaaaagagggctaaacttatcagttcagccctcttctcttgatgctagtgtaatcagtaagaatatttcatttgatacattgtgcacaaataactagatttaattatttacgagtgtcgaataatggatcaatttcggtactcttgtattgagcggcgatcggtgtttggtatgggtttacaccatctttatcgaacataccaagtacagaaatggcctgcatcttcttttggacatcttcaccggctaaatttccgctggcatagctgattgtcatcgtttttgtcttgtcgtctgatgatttaaagattaattcaagtgttcgcatagagtgtttcctcctgagttttgataaaatttgttgttaaaatccggtatttccattaaaaaaagatttctgattatcctaaattatgcttttggcgcttcaacaggtgcttcttctttaacaggtgcatccacgctgacatgatcagtggtagcaaccgttgcgtccagcaagtctccctcagttaaagaatcaatgatgccgccgaattttgtgatcatttctgccgatacatccttcgcaacataactaaagttatgcttaacgccattcttatgatctttctcagtaaacgtgtaggtcgcagttgatttcatccaatctctttgcattatgtgtattctcctctgttttaattaactttgtaagctgttggccaacccttacatctattagtaacgaaatgagatggcaaaagtgtcccatgaaatttcaacttttttcaaattctttttttaaccttgtttataggcgattacctactttcctgataatgcttttacgccatctataaacggtttttctattaattcccaagtacagcgcaatttcagtcacgttcatccccaaataatacgcacatttcaaatatttcaattcgttcatcgtacataatcccgataatgtttcaattaatgcaacgccatccattttctcaacgctttgattagcatccgaaatttcggccagtggatcatcttcaccagttgtttcataaatatgtccatctgccacacgctgcttattcatataatcaatcatcgcccaatagacaccctgatagatatacgctaaaaacggatccggctttttctcagcatttatcccctgaatatacttattcacaaaagccagccgcccttcctggaccatgtcgtcatataacgggttgcctttcatcacatgtagcctcttcagcacaccgtaaataattagttcgtgatcaccgtctaatagaaagttaaatgcttcagttctgtctcgttgttcttgataattcatcttgaatctcctcaatcaatttgatttgatcacagggccctgatcacaagaaacaatgatagataatcctcaccaaaacagctataagggactttttataagcaagattcttggattatcaaggatttaaagcgatatagtaaaacggtttatgtatacttttttctgtttttcctgtttgcttttaaaatattggctagtgattatggattaaaacaaaactgtctgttatttacccgttttcagtcacttttcttgtcggttgattggcattttcaagcagaaattgataaaagctttctatattgtatggaatattttaattataaatgaaaaaggttttatataacacgattctctttttaagatatattcaatgaaaataatcattcttctagattctttcagttatcatttatataatcgacataacgatcttactgactgatacattttaaaaataaatgactttatagaaaggaacccgttttttatgaaaatggcaaccgaacaagaagcaattaacctactaaccgatttaaaaatcaactatcagcgagtggatcaccctgccatttggacaatggacgatccaaacgcgcctaaaggattaccggaagtcaaaaacctactgctgaagaaaaagaaaagcgatcaattctacctatacttgaccgataacacgaaagtcgactttaaatcattagccgatcaatttgggcttgcacacagccgactgacctttgccagcgaagatgaattggaaaacttactgggtgttgtttccggtatggtgacgccactagctctcatgcacgacaccaaacatgaggttcaagtgttactaaacagtcgtttgaaaaagctgcccttaatttctgctcatcccaataccaacacggcaacgatactgttaacgtggacggatttactgaaggtgctggatgaaatggaccatcacccgatcatggttgactagacgcaaaagccttggctctccggtaaagagatccaaggcttttatggttaatcagctgactccagttggttaatatttttcagttagccgtcattattttccaaatgacagttatgtatccgatccaacgcaatatcacattgtggatccgtaaaagacaagcacgagcataacaatatagaagataccgattaaaacgccccaaaaatagtattgacgatcctttgtgattacaatttttgaatcatttttcagaatcacaaatggactgccaagtagggacaatgaccaagtaatagtaagtaataaaggcgatgatgccggatagactatcagacaaataattgtgacagtcattaagccgatcataacaagatttatccatattaattgatctctgtgaaattgcccctttgtcaggaatcttgtagccagccatgccaataacgcgctaatgatgattaactcaatgaaatcactgaccatcatcagctccaacaatgaccttggctttggttcctgatccgttacattgggaaaaagtcgtaaccactcacgcgtgttaatatgaaacgccagcataccgccaataataaatgttgcccaatagcacaattgtactttccactgtttactcatagaaacgcctctaatcctttgtatacaagtcttattgtcatagaactcgcccccctaatctgcttttttgaataattcatatggtgccacatacctgcttctcgtaattaatcgtgcgattacttgagccaattcaggattctttttgtgcagccaatgcagaataatgatcaaaatactgctaaagaacattggcattgcatagtctgacggaatcccatcgaagaattctttgttttccatattttccgtcagatttgagaacagcgtctcacttaacgaaaattgaaaggcttctatgaattgacggctttctttctgttcagttagacctttaaaaagcatgaaattatcttgcactgctttagttaacgaaaaaaagaccggataagcattttcaaagtcgggagaaattgctgtggcattaatcgctgatttcaaatgatcatcctgtgctttttcaacgtgtgccaacaacctatcctgtaaatctttgaaaaacgccggcagatccgaatagtaaagatagaatgcggaacggctgacccctgccgttttgacaattgccgtaatggacacttgtactgttggcttttgatttagaagctttgaaagagcggcaaacattttaagctgtgcaggtgttcccgttaatttcacaatcaattcacctcttaactacacaattttagcttttttgtagataccaattcaactcaaaagtacttaaaataaacctatcaactgaaaagaggagattgcatatgatgaacaaaaaaattgatttgcacacccattatctgccaaagggttacgtagccgctttaaagacacacattgccggagatccggacggttggccaacccctgaatggcaagttggcacaaccctgaatttcatgaaacaaaacggcattaattactcggttttgtctctctcctcaccccatattaactttaacgataaggcagaaaccattcgtttagcagaagaaagcaataagctcggcaatgatctgaccttgaaatacccgaaacaactcggctatcttgctacattgccattcccttatgaaaccgaatccgtcaccgctgttaacaaagcattcgatcaataccacgcactcggagtaacggtcccaaccaatagtcggggaacttactttgggtcacccacactgaacaatgtttatcagactctagacgaccgacacgcaattgtcgccatgcaccctaacgagcccagtgccctaccgaagaatgtcgataccggtcttccaacgccactactgggattctttacagatacaaccatgaccgtcatgaatctattaaagtatcgtttttttgaccgttttccaaatattaaattaatcattccccacgccggtgctttcatggctattttaaccgatcgggttgctgaatacgttgagtcccaatacgataccgacatctacaaagtgatgaaacacgtttattttgacactgccggttccgtattaccgcgtcaactgccggctttgctgacgctggctgacgaagatcacgttctgtatggcagtgatattccttatacaccattagacaaatcagctaagttgcaacaaaaactatctaataccaatgctttgactgatctgcaaaaacagaaaattttccatgataatgcggcccagttgcttgaagttaaccgttaagcatcaatagtcttagcgttccgaattacaggctatctaccagtggtcgattatggtagataccggtagatactggtagatcagttattttcaatttaaaataggcaaggatgaaaagcccttcgatcaattcgaaatgggcttttttgctattttctcaaaatggctagggtctgtcttaaaacaagataatagtgtccgcctactggaataggcggacattaaaaaccgagcttcttccttttgcacgtgcaagactacgtgttactataatcatgtacctaaaggaggtacacatgaatggactctcgagaggtcattaagatgctaaaaaaggcgggttggaaacacgttcgaacccacgggaatcattttcaatttagaaatgatatgaaaccaggttctggcgttgtcacagttccgcatcccagaattcccaagggaactttaaacagcatcttaaaacaagcagggctcaaatgagccttgtttcgtgtatgttcacttaatggaggaatgacaatgaaatatatgtattatgccttatttacgtttaacaacgagggaaaggttgaagttacttttcctgatcatgggaatggggcagcaacctttggagataatgttcccgatgcgttatatatggcaaaagatgcgttagaaggatatttattaaccatggaagattatggggaggacatcccgcaagctaccaccgatccgcgtcagattaagcacgaccaaaaccaattggtcgtccccattgaggttaatacgaccatcgcccgcgaacgggaacaaaaccggaacgtaaaaaagacgcttgttattccgcaatatttgaatgatttaggtaacgaacaaaaaattaatttttccgctaccttaaccaacgctctcaaagaacaattaggcgttaaagacaattaaatagtagcaatcagattgccccgctaatgcaacttttccggttgctttggcgggactttttgcatgtctgatacaaaaaaacggccactcgtttccatatttatttgcaaatattgtctatgacttgaaggctgctattgcttaatgtaaaaaaaaaatgtattattattttaaagaaaattacatcctttatgtaattttctttaaccaggaggaggcatcccatgattaaattaatcggttttaagatatttggccactccctatttgaaaacaacactcatttcacacttcaaacaagtggccaaattactcaaaaaagtaagaatcgaatcattcaattcaataatgttctaacgctaaatcgcgtgattggcattgttggcattaacgcaactggaaaaagcactttaatggaaatctttgatggtctaaatcaactctatttattagataaatcagtcgaccagacgccattgaatgatcggctccgttcaaaagatgatcaaattacaatcaatgcttatctagccactgatactaatgatagttacgttgtcaagactacctttaaaaacgtacccattcccgatggtatcgatgatggcagtaataaagaatggattatatcagatgaaactgtttaccaccgcaaaagtaaatctgttactaaaaaggactttttcaaaattcccgaatcttcaaacgacaaaaatactttgacaaaagttattgatcgaaaagctttaagtcaggatcaaaaaaagttgttaagcaaaaaagattctgtttttcgagcagttggtgacttgggtcgtatttcaacagtttcatctactgtttccctgacgaatcgaaacaagatcatctcttttatggataatacgcctaaagaactgttggattacttggataattcaattgatgacttaatttacgaaaaggatgacgccggtaagacagtcggctacactctaaagtttaaaggttctgatgatatcatccacgcaaccagctttgatgaactgagtaactacctttcttccggaactatcaagggaattacactattccatgaatttttagttgcacttcggatgggttcaacgttaatggtggatgaaatcgaattgcatattaatcgtcaaattgtcaaagattttatcggtttctttgctaatccaaaaattaatattaataatgccacgctcgtctactcatctcattatattgagctaaccgatgatttaacacgtggcgacgaagaatacattctgactagaaaaggtcaaacaaaattaacccgattaaacgacgcacgcattcgaaccgaattaaagcacagcgaaatcttccaaaataatactttaagtggaactgcaccaaattatagcgcctatcttaagttaataagtgcggttaagaaccataaccacaaattcaactcattgaaaggcgctaccacaaaaaatacaggagtagccgttaaaaatgactgatttaaatggattaatggttgagggggccgctgaatcagcacttattaagattttgttagataatgatctgctaaagtttagcagtgacgatttgatatcaaactctagcggaaacttgtaccaggatttcttaggcgatagaaagtttgtcaacactttcctgtcccgtgatttcggtgatattccgattcacatgcatattgtctgcgacaatcccaatagagactcaaaaaaaattatgaaattaagtaatgcagtaacagacatcacctactacgttacccgagaagaaattgaatcaattcaacttcgagcagatcctaactggttgcctcgttttgaaaaatacaaaagaaaaaaaggcacagataaaaagcctagcaatttttttattcatgaattaaaaatttcaaagatcaaaaaatatgactatgtgtataaactctggaaagataaaccggaggcattggttgacgctttacagtccgtaaaaagggaaatgcagcacaaggatttgttaaaaagtaaaggaagcaactataagtatctagctgatttactaagagattagatagcagtgcatcatccaacatcattatctacagccagctggtctttttttgacaacagctatatgtataccaaaaataatcagttgcaaacagaaagtaacccatttcctccccaaaggagaaagtcacaggttctaactaaaacggttattcagaattggctcgggtaacttctgcagactgctgaccgcataacttaccatgatttacttgaactattgccccgttagttacttacaatcatcagaaaagagtcaattcagttatttaattggcattaaattgtttgcttgattttagacaatttaatgttttttagttttagtccattattattgctttcgtcaaaatcttgacaaccaaaaagcagatcagtaaggacttggtcgtccaagtgcaccactgatctgcttttttgtatttatcacgacagactatttaagtataattcagtcgctgctagcaactcctacttcactgttaagtaaagtttacgcattaacccagtcataccgctttagaaatttgtctgactttgtaccggttttggtcttctcttctttacgctggtcctttgccgcatgaagtttgaatttcgaatccaagttcaaaagaagaatgcttgataatcccatcaccttttcaattcttaaagcgatgacctcattaataaacctctttctctgaagaatctctgaaacatttttctgactaacaccgattctttctgctaaatctgtttgggtaatatgataatacatcattgtttctttaattaaatccgcagccgaactcgtatgatatttgagaattttattttcacgatgcagcattccaatcagctcctttggtgataatctgtaagtattaactgattccataacgtcattcaaagcctattataccgctttggtataataaatttagctatttatctttttattttttagctatttatctttttagctatttatctttttatcgtttctggctaaagcctgccattcatgactttcaattatcaaaatcacttctattcaatcatcaaaccagaaagaacacggtattgccaaaggagttgatcaacatgcaaaccattttaggaagcaatggccaaatcggtcaagaactggctaaagaattggcccaccactatacacaggatattcgactggtgagtcggcatccgcgaaaagtgaacagcaacgatcagctattaccggcagacctgctggattttaacgacaccaatcaagcaatagctggcagtgacattgtttattttacagtcggcctacctaatgattcagccatttgggaagcccaatttccaatcataaccgaaaacgtgttgaaagcctgcgaagccaatcacagcaagcttgtcttttttgataacacctatatgtatgccaaaaccaatcaaccccaaaccgaagaaagccccttccttccaacgggtagaaaatcagttgtcagagcgcaaatagccaatatggttctccaagaaatggcggctggcaaactaacagccgtgatttgtcgggcacctgaattttatggaccggccaaaaccaagagtattactaataacttaatttttaacaatattatagaagacaaacttgttaaaatcccggtcagcgatcagacgcttcgaaccctgatttggacaccggacgccagtcgcgccatggccttaattggaaacacagcggatgcctatgatcagacctggcatctgccaactgccgatagcctaacctatcacgacctgatcctgcttagtcaaagaataacaggaaagtcgatcaaagccattgtcatcaagccatgggtatttaaattggcgggcttcttcaatcagaatgcccgtgaacttcaggaactgttaccccgttatactgtcgataatatcttcctatcggacaagttcaaaagacggtttcccgactttcaagtcacctcaattcaagaaggcatcaaagaaattgtccaacaataaggtgtcgggtattaatccctattgatttcaaatctttaagtaaaaccaaataactactataagcacattaaacggcctattgtttttaggcgatttaatgcgctttatgcatggaattcgaccaattcttcatttgtatttcattagtatatacacagtcaatactaattatattagtaaaggctaatagatagcatttcttttaactaatatgttaaagtgaccctgtagaagaacagacggtcagcacttctaaaggggagaatgatcatggagacaactcatcgtccacacacaaacacattggtcagatggctgcttctcagtttgttagccattgctacaaccattaccgtatcattggggatctcaagcaaagcacacgcggcaccatatgatttaaacaacatgagatggggattattaccggcagggggacttgataagagtggatttccaatcttttctaattttgataccgctgccatcagttcaaccgactggtcaccggatcctgacggcgaccaaagcttcacatccaaagatgccacacttcagaaaccctacattgtcggaaccgacacaccaaagacggtgatcggtaattacgataaggatggcaatccaattggcggcgacaccaagcatcaatccgacgcaaagatcggtgacaccattcagcaacaggacggcagcacaatgacagtcaccggctttcgaatcggtgccaacgccacagaaatgggatcggtcacgggctatggtggctggtatgacaatttacgagccgaatccgaattctttgacttccaggttcaagaagtcgatcggaatggtcaagtcgttcccaacaacaagctcaccgtttttaaaaaaggcaattttcagtggtcgaccattctcggagtcgataaaatcaccgatcggaaaaacaaccttgtcaaggtcaccattacaccactcaattcatcactattcgccaaccctcagacactttatttttcactaacgggcattcaagcgccggtggttgaacctaaggcaaaggaatccaacatcggctacgcgctctacgataccggtggcaagattggcggttttacaagtaaagacgtggctacctcgacagaaaaaatgcccatcctacttgaaacgccaaacgacggcaacctctatttggaagatttaagcaatccgggtgcgacttggaaagccgacaatccaaaattaactttagtcaaagatcctaatccggatcaactcggctatcgggtttccggtttgaaatcacttgcgccgggaacgattgttaaatttacagatacgaaaatcgacggcacaaccgaagatgtgtatttcaagttcggcaacccaacaacccccggtggcggcacaaccagcggtaatactgccaacggtggcaattctaccggttcagcgacacctccggcaagcatcccgacaaccacaggtgactcatcagtcgttaatcaacagggaaccacaaccacagggacaagccaaggcagcacaccggccacttctacttccaatgcgccaattgccgtaccaaaagacgttgctgtaaagagccaagttgtttatggcttaaagaaactcgggttgtacaagaacccaaccttcacctcatcaaaaaggattgcttggtatccaaagcagaaacggattaaccgcccgatgtttgtggtcaccggctatgcccgttcagccaacggaaccttgagatacaaagttcgtgatgtaaatcatggcgccaagacggccggcaagatcggctatattaccacaaataaaaaatacgttgtgccagtctactacgcaagtctaccaaaaaataacaagatcaccgtcattgccaaaaaaggcgtcaatgcttacaaagccaaaagcctcaccggtaagctcaaacactacaagacgggcacccgcttaaccatcaagaaattggttaagcataacctgactacccgttaccagttgacgaacggatcgtttgtgacagccaataaaaaattgatcatcgcggggaactactgattgtttgactgacagtttcagcattaagggggattcatatcatgaaaaagaccagccatccacagtcgttgaaacgcccaagctggtttatcatcagtctacttttcgttatttcaacgatcacactatttatcggtcacccactcaactcaaaagccgcggcagccgagaccaatacgcatttggcagtcgcagcggatccggacaatttcagtatcgcctatggttcttatgattcaccaacagaattgccaaatgtcatcggtttgatcatcgatctcgataccgctacagagcagaacccaatcgagtttacgcctaccgatggtggtcaattctacatcgatgatatggttgacggaaatgccgtttggacagtcaacaacgacaaaatcaccatgacagacacatcgatcgcaaatccaaacattgatgggtatgtcgcttccggcttggacaaactggtttccggaactgtcctattatttaccgcgcgacacggtgacggcacaaccaatcatttctattttaagatcatcacaaacaataccacaccggcgatttctgaaaccaatgccggatatggcgtgtatgattccgctgatgttctaactgattttacaagcatgcagccgaatacttctgaaaatccgatcgcattcactgcatccaaaggcgttatcttttacgttgaggacataaatgacgacaaagcagtttggtcatcagataatgccaacttaacgttaacgaagaatactgatgggcttggttatcgagtaaccggcttagattctgtcgtctccggaaccgtggttaaatttaccgctcgccagagctatgactcaacaagcgactactacttcaagatcaccaattcaaatacaccggcagccgagaccaaccccagttatgcgttgtacgatgctaacggtaccattggccaattgaccggcatcaagcccaacaccgctcaaagtccggttgccctggcagtccctgatgacggtcggctttatctcgcagacccgaaaaacgcagccgcaacttggacaactgataatgacaagattaaagttgcaaaagatgccactcgagacggctatcaagtgacgggcttgaattcactgactcccggaaccgtggttaagtttaccgttcactatcccaatggtgcgacaggtgacttctatttcaaatttggaacagcctcgacaccgggtggcgggtcagccggtggcagtaataccacaaccaaaggaacaacgggctcaagtaagccaaacggtgtcatccctcccgccacaaccaccggtgcttcaaccagtaatcccggaacaggttcttcagccacaaccacttcaggtcaaaacaacggcacgacaccagctacaacgtcaaatgctcccgttcctacagttaagaacgttgcggcgaaaggcaccgtcatttatggattaaagaaggttggcttgtataagggtccgactttcaaggcatccagtcgactagcctggtatccaaaacaaaaacggatcaaccggccgatgtttgtcgttaccggttatgcccgttcagccaacggaaccttgagatacaaagttcgtgacgtcaaccacggtcgcaaaaccgctggtaaagtcggttatattaccgccaacaagaaatatgtcggttcggtctactacgcaaccgtaccaaagaacaagaagatcacagtgattgccaaaacagggattaacgcctacaaatcagctaccctcactggtaaagccaaacattacaagacaggcgtgcacctaaccgtcaaaaagttggttaagcataacctgactacccgttaccagttgagtaatgacctgtatgtcacggctaataagaaattggtcatcgtggggaataattaatttcttgattgatcgcttaaatatagtagaaataagtccaccaagtcgtccaaacgatgtcctgatgggcttttttgagtacaatatttcaaacgaatgctatagttaagacggtttattattaattcaccaagagtactgaagggggacatttttatgagaaaaattaatcatcgtttcaatcatttatcgaaatggttatttgccggtgcggtaaccattattgcattactgaccgtctttattggcgggccgtcaaatgcatcggcggcaccatttaatttgaataatttgcgttggggattattaccagcaggagatccgactactcctgacggaccagcaacatactcacttatgagaacacctgcactagatgcccgtgattggaatcccagtcctgattataatcccgggaatcttgaaaactttggaaccacagctggaaacatcgtttcacttcagaatccgtatgtcgttggaacaagcagtccaaaagttgttgcaatggataaagacaactataaccaatccgatgcacaagttggagatacgatcactcaatatgatagttccaaattcctggtcactggcgtttcactaggcgcgtattctgacatgatgtacgcagctgctgggccttcatatgatggttcccacacttcctaccgtccagaatgtgactacttcgatttcaaagttgaagaggttaacacaaatggtgatgttgtcccaaatagtggcttatatgttgttaattcccaaggctatcagtatccaaccattttaggattcgacaaaatggctaacaaaaacgacctcgctaaagtgaccattacgccattaaacaatgataagggcaagctcttcactggttcacaaacactttatttgtcattaacaggttcacgtcgctcaaatagtgatgacaattacggctatagtacttatcagtcttccggaactattgataacattaaaagtatgcttcctaacacagcccaaagcccaataaacactgatattccatctaacggtgaactttacctatctgatttgaatgatggagacctaacagaatggacaactgacaatccaaatctaaggtctgtccaagattcttcacaatatggttataagataaccggcttaaattcacttaaacccggaactgttgttaaattcaccggtacagatcctttaggcaatggtaaaaccaatgccttctacttcaaatttggaaccacgtcaacaccaggtactggtggaagttcttccggtagcacaacaacaccaaatacttccactgcaacgcctacaaccgacaactccgcaactaccagcagtctgtcctccagcacgccagccacatcatcctcaagtactacgaccacagtgccgagtacctcgccttcggaaagtggtaacgtcgaagttaagggtggcgtcatttacgctactaagaagatcgcgttatacaagagtgttaatttcacaaaagccaaccggatagtttggtacccaaagcaaaaacgaatcaatcggccaatgttcgtcgttaccggctacgcccgttcagctaatggcacattgaggtatcaagtacgagatgtcaaccatggtcacaaaactgccggcaagactggttatgttaccgccagcaggaaatatgtcatccctgtctactatgcaagtttaccgaaaagcaaaaaaatcacggtaatctctaaaaaaggtatctatgcctataaatcagtgaagcttaccggtaaaagcaagcattacaaaaaaggtattcgtctaaccgttaaaaagctggtcaagcacaatctgactacccgttatcaattaagtaacggttggtatgccacaactaataaaaaattggtaatcgggagcgattaatatcagaaccgatattccaattcagtcaagctacattttcaagataaaaactgctgtgaatcatttaataatagttaatgctatgatgaaaacggttaggaactgaaacttgaaagctaataatcacgccaaaggcgtgtggttattggcttttttggcaaaaaaataaacgcaagctctcctgcgttgtatactttagtcgaccaaaaccaaga

SEQ ID NO: 461 - DNA, 166675 bp, Unknown
  Metagenome-assembled genome
ttggttcatcatgttcacgtagtgaagatcactggtaaatcttaccgattacgtggcctcaagtaactgccgaaaacctacatttctttctgccgaaaacctacatttttaaactgcccttgacacatacaaacttttagacaaatttagattaattttggaatttggaaatagcttagcaaccagtcgagttaactttagcgctttattgctatttaggtcgttaaggtaggcttgttggctattaaagagaaccggcaacttaataatgctttttttgaaataaccgtaccaggcaatccctttaacttttttgttgtatgccgaatataacttgtaatacacttcgtttttacctttaacgggcttcacgaatgccttggaaaccaaccagacagtgttaggatagttttttaaattatgaattcgtttagtttgggtattattccaaatataagctttctggcttttagtacttgaataatacggaattggtcccgtaaatttggagccatcgaaagaatagttgcttggaatggtgttggcagatactgagccaacacttaatagtccgaggaaaatagcccccaacagtaacagaaacgacaaactcttttttagcatattaaatacctccactacatgcattataacaaaaatcctattaaactgatcttttaatcttcaagactggtttaataggatttttatgattgaacggtcaagaacctcagttatatggctcttctacccgaccaattttaatatgaataaccaaaacgtgacattttatttataggatggatcagctttaggattaatcaggatctgaggggctccttctttgcccacaacaacctcattaaccgcatttaaaaacaaaccgtgttcaaccacgccaaccgtgttaattaaggtatcggccagtttatcggggttgttaatttcatgcaggtggagatccaaaatgatgttatttgagtccgttttaaagaccttaccgtccttatcagtcctgacaaccggattgaatccggcatcggaaaactttttcaaaacatgatgactaccgaaaggttctacgtcaacagctagtggaaatgcgccgattcggtcaacaactttggatttgtctacgatccaaataagctttttagaattggcagccacaatcttttcccaaagcaggtttccaccaccgcctttaataccgttgaaatcactatcaacctggtcggcaccatcaatggttaaatcaattgcgtcaatcgaatccaaatcaacaatttttattcccagtgattcagcctgcttcgctgttgaaattgacgtggaaacgcccgtaaatttcaggcctttttcctgaacccgtcgtcccaactcatcgaccagcattgtaaccgttgagccacttccaagaccaacaatcataccgtctttaacataatctgcagctttaaccgccgcagctttttttaacttgttctgaagctctgaattgatcgtactcatgaatctcccatctccttaattgtaaagccaacctggcgttttctattcccaaactccatcaatgtcaaaacacctttatagcaaaacgatactgataatttttataaaagggcgaaaaaatttctacttagattgctaagcagaagttgacctcattttaactgattggtctcacaatacaagaaataaaatttgtccggttttacaagtctttttaaaaagctgttttcggatttttgtcttgccattttcagtacatatagcagatcaactttataccattgattttatcccaaatttagatggtaaaacaaaaacaccgctgttataagcgatgctttcattaaaccattcatttacagtctcaacctattttggatttgtggcagtcaatgatagattactccagaactcgttggttccttctgttgtgacactatatcccttaaccggtgtccaggataagttgaattcttctggtgcataagcagcttgatcattcatatactgttgccactttttaaactgctgagcccgatattttgcattccaggttttttttattcaaactattgagcaactgggtattcttcttagtcgcaaaatgtaccaaaaataaaaacatggaaacggtggtaccagtatcgttgcgcctcaatatgccgccgttgcagctgttataaatagtgcgcccaatcattcaaaaatgggattttgaaatccacaaatttatcaattgtccaaaaaaacaattcaccatttaccccactaaacagtacaattgacaattccaatctttactacaccggacagcctggtactgtttataatcaagcaaccggcttgggtacaactgattttccaaaactttttgccgtttatcaataaacaacttacattcaaatagttcatgtaaaagcgcttattcaattagtattcaaaaaatactgatattaaataagggctttcatgctatatggtcttctttttgatagcgtatcagaaagcaaaacgcttaatcacctttcattaaagaaggttcggtgttgagcatccatgggttattctgtctgatttataatcttctaaatcatcaagtcaatttattaaataaattggctacctctaatgaattattatcacttactatctccaggcactttttttaacaaagcgcttaatataagaacgataccaataatcaaaccacctaaatctagaaagaacccaaaactaacattaccttgtggtacaatcccttttacatccgtaatcacaaaaaacagtccaagccagaagtcaatcgttttataaaatttatgatttaaacgccatttatccataccttaaatacctccataatcagccagtctaagcatcacatacgaccaccatgaattttacgctcttccaaaagctatctaaatctttataccaatcccatttatttatagatatacagtagaaaaatgataattacttttaagaagtgattgtttttgaaaaaagtgctattcaaaaatcacttaaatttgtggaagattcacttccttcgtcaacgtattccaagatatcccctggctgacattttagtgctttacaaattttttccaacgtactaaaacgaatcgcctttgctttgccggtttttaaaatcgaaatattggttggcgtaatgccaaccattttggctaattcaccggtagaaatgtttctctgtgccatgacgacgtttagggtaattttaatcaagaattattcacatcctttgaattctttaaacggttaagtcactttcccttttcatttgttcggctaatttaaataaaatataaataacaccaatgataataagcgtaatcagatcgtccggtatattactccaagtcgcattaaaagcgccattatttacacgacccaaataacttgtagaaagttggtttgctccggcaaggaagggatcgcaagctaaagtgtaaatttgtgacacaataaagagtcgtactaacttaacattttcagccgtaaagtattttttctgtccaaggttactgatgatcttaattaatgctcttaattcatataaaatactgattgttgctagaatcacgccaatggacattaagatggcgtatatatattcaggaaactgattaatcaacgcctgactaatatgagaatgattagggaccaacaagaaatcatcactttttaaaatatcagaagccatattaccttgaaaagcttgaaagaagtaatagattggtgctaaaaagtaaaaaaggacaagaacaaatgtcagctgggcaaaaaagaaataacagttaatccacgacttaaaattttgggcatatgaagcatctcctttatgtattttgattataaatcatcgataaacgataattaatggttatttttcgaaaattgtttattgtttctcgttctttactaataaagtaaaaataaaaagcacatgttaacgcatggctttgtactaattattaatgatcaccaaacacagactcgtaaaaccaatcaataccatccccaaagcagtaatcacctttttgcctgaatgatccagcaatctttccataaaaatcttcccgatcactaaacaacattctaaattcttttcttcgagttaattcttttaaacatatacatcccaaatccaaagattacaccacctaaaatagccctccagtaaccatggaaagactgaaggccctgggtaaaactaatgccatcaaagaaccaatctaatcccctgttaacaaaccacatatatatacaaaaccaaattcctgctctagcagaacgccatctaatcccttttagaatctgagtataatttccagaggaaacctctttatcgtataagtgtagcctattcatagccgggaaaatatatcctataatgagcaacaatataaataaaatgttcacgaatataaaatcaactaaaacttctgattggcgagtcaccgtaaggaaagcaacaaccacattagacgtcaatatgtaaccaaacaaaatcagaaatgcattatttccaatcctattaatttgcttccgctgataatcatttagcggtgaatccataccgtagaaacgcctgataattttttgccataaactttctttttgcttcataattccgctccttgaaataattaatacttattctgtcatttattcagcgagtaaaggtttgccatctttatcaacaagtaccgtaactccgacaccgcctccgatccctcgttgagacacaattaaatattgaactttagttttatgatcaacgagtacgtcaacattttggctagtatcaattatttcatttatttttgtgtcaaacctatcagcatttacatctacttcttttttaaacattataattcctcattccttcacaaatctttaattgccatgcttatgttctccgccataaaacgaaatcagccatgactgtttagagaactacgtgcattactatccatcacacttttcgcagtgctaatctatttgtggcgttgataataaaaattaccaaatgatcgccaatatacgtattaaaacaacaataaaagcttgcctccttccacttgacgaattcagattacacagtaatcacaaacaatacaatggatcacgtgtctacaatacccagacacgcaatttgacattggtctcataattgttacataatgtaaaaagcctattatggaaggtgttccaatgagtatttcagaaaaaataaaacaatgtcgaaagcaaaaaaacttaacccaaaaagacctcgccgacgaacttcacctatccagaaagacaatttccggatgggaaaacggccgaggctatcccgatataaaaagcatcacccaattaagtgatatctttggaatatcagtagatgatcttttacgggatgataatctattggaacactatgctgatcaagacaaacgaagcttgctagcaaataaaatagctcaaattacatattatttaatcctggctctcacaattgtaagttatggtactatttttaatttatggtacatcaataacaccataattttgctgatcctagtagtactcatcagcattttgttctctaaatactctaattgggagtcttttaaaaaacataaaaagctactaaggtcggttctttctagcatattttttcttttcttaaataccattatcattccatcaaacataagtttctttaaattaatcaaagtaccggatcacgcggaaaagctaggaatcattactggcatgtttctcgtaaccattatactttcaatctgcctgacaataatcttgtttcttcatccccaaaacaagaaatgacaaaaacaagggcttcaaaaagtttaccgtactaactttttgaagcccttaatctagaaacactaattttatagtcttactggtaaactcgaaaaccaagaaccgcacacttttagtgtaattcttggtttttaagtttcagtgacctacttatttgtttatttgtttatttattaaccaccgtaaaccgctcattccgatgtgtaggattaacaatttcatcaacgatggcctttccaaccgttccggatgttacctcggacttacccgcatcatttcttaaaagatcattgtgtccaagctcataatcggcaaggcctcctggcacaaagtttgagcttggtgaaatagctacccaattaacatctttaacgttggacaaaaattcatattccttggactgtgcccgcggtgtcgcaataaactgctctttgttgggcagcccttcaagacgctcaatcaaccggtgaccactgccaatgtaaagactggctgcaccaagaataaagaatagccgcggcttatcctgccccttgacaagatctaccaaatgctccgctaattcaatgtgttgttgagccttgctgggatcatgaccaggtgaaaaggcatcaacaaccacatctaagtcagcgatatcaggcttttgaatatcaaatacatcaatgacactataagttgcttgatcgccaaacatgtctctggccttgctctcatttcgaacaaatgctttaacattcagcccctgcttaagtgcctcttttgtaattgcactgccggccataccggtggcgccaattacaccaatcgaaagtgccataaaaatccctccaatttatcagatcatgtcaaaattgaccagaagaataactttattaatcactactagtatctgatattcagataaccaggtcaattgattcgactagttgttatacatcaaaaaaagagaatcaagatagtctctatcccaattccccttaaaaattatttagttaacttcaatgccttgccggccacatcaatcgtaatcgggtctccctcaatcagtttaaattgagcacctttttgatcaacgttaacctcaatcaaacggccgcggaagacctgtctgaatgaataacgatgccacttcttaggtaaaaatggtgcatagtgcaactgaccgtcacgaacccgcatcccggcaaatccttgaacaacggcgatccaaccaccggtcatagccgttacgtgcaggccgtcatcggtatcgttgttataattgtccaaatccaatcgagccgtccgttcatataattcaacggctttatcttcataatgcaaatccgcagcaagtacggaatgaattgcggcagataagctggattcatgaacggttaatggttcatagaaatcatagttggcttttttctgctctggtgtgtaatcatcaataaagtcccaaattccctgaaggacatcaccttgcttgatatatggtgaacggaggatcttatcccatgaccagtgctggttgatcggcaattgatcggcaggaatagccgaaaccggttgaatatctttatcaagaaagccatcatgttgcacaaagatattcaattttttgtcataaggcagatacattctgtccacaatatcctgccagtgtttcttttcctcatcggtcaccgctaatttttcggcttgttccggcgaaaccttttttaagatttccaacgtatatttcagtgtccattgagccaaaatgttggtataccaattattatcaacgttattttcatactcatccggtccggtgacaccatgaatcatgtattgctgttttcgttggctgaagtgaacccgatcagcccagaatttagaaatttcggtcaataccttggatccctcattcaacacgtaagactcgtcaccggtataacgtgtgtaattgtaaatcgcaaaggcaatgtcgccatttcgatgaatttcttcaaaggtaatttcccactcattatgacattcaataccatcgaaggtcaccattgggaataaggcacctttaagtccctgttgtttggcattatggtaggcaccatccagttgtttatagcgatacatcaacagatttcgtgtcacttttggatccgtaatcccaaggtaaaccggaactgcaaaagcttccgtatcccaatatgtggcaccaccgtacttctcgccggtaaatccctttggtccgatatttaaacgggcatcttcaccataataggttgagaacagttcaaacatattaaaccggataccctgctgtgcggcagtatcaccgtcaatttcgatatcagatttattccaacgttcttcccaaattttggcatgggcatcaaataaatcttcatatgttttttcggcaacccgatcactcaattgatgcatggcagcaatcaggtcatcgtttgtttgatagtcccgtgaagtcgttacaataacgcgtttttccaacttggcactttggtccggtgccagttcacccgtaaattcgttaacaacttccttatcgttgggttgtgccacggaaaccgtctttaaatcggaaacatgacgcatttccattgcagatgtgaattgtggtgtcccaaacggatttggtgtggtttgtgcaatcacatttccggaatccggtttctgttcggtagaaaccacgttccagaatcgctcgtcatagtttgcgtcttcgttcttaacatcggcatcaatcgcagaatccaccgtaacagttgcttttgttgtgccaacattctttaacgtcagcctttgaacggataattcctgttgtgccacacttagaaaacgctcgaacgtaacggcaactttagcatcaccttttgtaactgtgaacgaacgtgtcagaatagaatgctgcatgtccagatctaatttaaaatcgctaaattggtcttttgccaaatcaattttgtcaccattgattttaacattcatcttaatgaaattaactgcgttgacaacttttccaaaatagtccggataaccgttcttccaccagccgacccgggttttgtcaggataccagacaccacccaagtacaagccggccaaactatcgccgctatagtcctcttcaaagaatccccgcatccccatataaccgtttccaagactggtcattgactcttgaaggcgtttattatcgggattaaactcattcgttacaatgtgccaaggttgaacgtcaaaaattctcttcatttgtatgaatcctttcttaattaagctttataagtttctttaattaaaccgactgataatgccccaattgccataactactccggcaaataagaacatgttttcctgtgcgtttccaagtaacgggaataatccaaagctggcaagtgaagcaacaatctgtggtaaacaaattgaaccgttaaacaagccaagataagtgcccatgtgttcaccggacaacgcgttggtaatcatagttaatggataagtgttcattgctgcccaagccattccaaccaagacaaacgaaacgattaatgcggattgcgaatggataaagaagacggacaagaaaccgacggcacccagaccaagactgagtgcataacccaatttatgatgattattgggtactttggccaaaacatatgaccaaacaacggcagcaattgactgaacggcagccagaacaccataccagttaccagcagcctgatagccggttgatgcagcgttggttgtgttccaaacgttgtgggcaatcgcaccggccgcgtaagtccataagtactggaaagcaacccagcagaagaattgaaccagtgtcacggtccaaaaaacctttggtgctttcttcaaaagtgcaaaccagttaccaccggttgtgttggcttcttcagaaataccatgatacttggcataggttttaggatcatactcgtgaaccttaaaaatcgttagtaaactcgtcaataacaggataaccgcaccaacatagaatgaaatgacaactgattgtggcacaacaccctttttagcggtattggcaataccgaatgcggtaaacaggaatgggaaaattgcggcgataaccgcaccaccatttgataagaagctttgaataccatatgcgtaactcttctgatcatcatttaccatatcacccaccatcatcttaaatggctgcatggcaatgtttgacgaaacatctaaaagagcaactgtaacggccccgaataataaggcagtaattgacgcatatccgaatccaaaactaccggaattagggagcagacacatcacaataatcgcgattaacgtgcctaaggccaaatatggcaagcgacgtccacccaatctcggtgcccaggttctgtctgaataatacccgataattggctgaacaattaacccggccagtggcggtaaaatgaaaaaccagccaagtttatttggatccgcaccaattgtttgaaaaattcggctcatttgagagctttgcagcgtaaaggccatctgaacgcccaagaaaccaaaattgatcatccaaatggtactggcaggaagtttgggtaacccagacttcttagttgcagcttctgcacttcgttcctccatgatttgttcctccaagtcttaatcttaaaaatcaataattgctttaacgatgatattatgacatcgttttcgacttaatgcaaccggttgcacacttatttttaatgataataacgttttcatgctgttattaagcgaatggtagcgattaataaagattgtgaaagattttttcataccgctttcaaaattcgagtgaatggcgaagtaaaaacactaaaataatcatatacggcgtgtattacccgcttagaaaaaaatttacaaaaaaagttttacccatttttttcacctatttttccagtttggtctagacccaaaaggttttaatgaaaataagtctcgatcaaattgagcctattttcatttacatcttaaaaaattgtgttatattgaatcatgattcacaagggaatcatttgaggattaaattaaaggtggtgacaattaatgttacttggaagtattgaagctggtggtactaaatttgtttgtgccgttggaaatgaagattaccgaattatcgacagtgtgcacatcaaaacaacaacaccagaggagaccttacaaaaaaccgtcgactactttaaacagtttaaagacttacaagcaatcgcagtttcatcgttcggccccattgaacttcgtaaaaattcaccaaagtatggttacattaccaacacacctaaaccgggatgggccaataccgattttgttggccggttaaaggaagatttcgatctcccgatttcctggacaactgatgttaacggttctgcatatggcgagtacgtcatggcaacactttttaacgaaaagattgagtcattggtttactttacgattggaactggtgttggtgccggtgaaattgttaacggccatttcattggtgacattggtcatcctgaagttggtcacgttcgcttgaaacgtcatccagacgacatggacttcaaggggatttgtccatatcacggggattgtctagaaggtttggtcagtgggccgactttcgaagcacggaccggtaaaaagggacaggatattccacttaccgatcacgtctgggacatcatggctttctacgttgctcaagctgctattcaagaaacactgttattccggccagctaaaattgtatttggtggcggtgttgtcagtgaacccttcctgaagaaagtccgggcacagttcaaagacctattgaatgactacgttgatgttggcgatttagacaaatatatcgtcatgccattggttaaaaacaacggttccgcaactgttggcgacttcgctttagcagttgaagaattgaacaaataatttttttactggaaaacacaaacgtttgtgttaacgctttatatttaaaggagattatatttcatgaaagcacttgtatttactgatgttaaaaaaatggaaatcgaagatattgataccccaaaggtaaaacctaacgaagttcgtatcaataccgcatacgcaggtatctgtggaaccgaccatgctttgtacaacggccttccaggatctgccgatgccgttcctccaattgttttcggtcacgaaaactcaggaattgtcgctgaagttggtgccgatgtcaccaatgttaaagttggcgaccgagtaactgttgaccctaacatttactgtggtcaatgcttctactgccataccgaccgtcccgaactctgtgagaacctatcagccgttggtgttacccgaaatggtggtttggagaagtcattcactgctccagcaactgttgtttacccaattcctgatgatgtttcgttaaaagctgccgctacggttgaaccaatttcatgtgccgttcatggtatcaaattacttcacctcacaccttatcaacgtgccttggttattggtgacggcttcatgggtcaattatttgctcaaattcttcaagcatatggtgttcaccaagttgaccttgccggaatcgttgacgaaaagttaaagcgtaacaaagaacaattcggtgttaagaacacttataacacaactcgtgatgccattcctgcaaactacgacgttgttattgaagccgttggtttaccacaaactcaggaacaagccgttgaagcaacccgtaaaggtgcccaagtattgatgttcggtgttggtaagcctgacgctcactttgaaatgaacacttacgaagtttaccaaaaacaattaactatccaaggatcattcatcaaccctaactcatttgaagactcaattgcgttacttcaaagcggtaagttggatgttgaatcattaatcaccgatgaattatctcttgaccaagtcgaaggcgttcttcaaggtaagactaaagttgcctcaaaagctgtcgttaaagtaggtgactagttacccatgcaaaacaacgaggaggctgagatgaacgattctcaagtattaaatggccgaacgatatcgatgaccacatcgattatttacttcgtcatttccttagtaattaactctgccggaaacgttctgacacttgttaccagcgcaaaaatccacccctcctatttaggatcggcctattggacagccgccgaagccaacttaagtgttgcctttgggtggaacctgttctgggcattcctgattttaggagttgtcattacaattctaaatgccattctggttggtcattggagctggcgacgggctcttggaaatttaatcttcatggttcccttctccgcattgattcaaatctttgaagatttctttattggtaaatactcattcttcaaagggcttccggacgctaattcaaccggaatgattatcttctacattctgcttaacttctttggcgttgcgctcatcggaacagcgatttcaatctatcaacgggtcaatttagtcttgcaccctgctgatgatttaatgcagattctacgtttcaaatattttaagggaaatgccaatgttgcaatgtgggcttcttatattccgcctacaattatggcaattatcgccttcatcattaccaaacaattcacaaactttggtatcggaaccatttttgcattcctattccagggtggtatcaccggaatcgcggatacaagagtctttccaagcttgaaacatcaggcactggatgtcggaaaatcagaagaataagtgaacgttgatttgaaaggaagcttatcatggctatcaaagatgatattacaggaattcaacacgttggaattccttcaaaagatttagataaaacaattgctttttatgaatcacttggtttcgaccaggccggtttgttccacaacggtgaaaatcgttgtgcgttcatgagatttggcaacctgaccatcgaaacatgggaaggcgatccggtggcaatgaaggccggcgctattaaccacatttcattgaatacgccggatgttgaaaaagcctttgccgatgccaaagcacaaggtttggacttggttgatcatgaaattcaatccattccttccttctgggaaaagggcattcgttatttcaatattcttggaccaaatcaagaaaccatcgaattttgtcaaattctgtaaataaaagaatattttgagcaataagcgtttaatttgatgataatattaagttaagcgcttatgttttcagaggaggaaattatagtggcacatatttcatttgacagttcaaaattatcaaaattcgtccatgacaacgagttgggcgaaatgcaggctatggtcaccgctgctgatgccgaggttcgtcaaggcaccggtgccggtagtgattttcgggattggttaaccctgcccaaagactatgacaaagccgaatttgcccgtatcaaacaggcagctaaaaagattcagggcgactccaaggttttagttgtcatcggaattggtggttcctatctgggagccaagatggccgttgattttctcaacgataccttcttcaactacctgcccgacgaccagcgtgaattccctcaggtcttctttgccggtaattcactcagcccatcgtacgtctatgacctgcttcatctcattggcgaccgggacttctccgttaacgttatttccaagtccggtaccaccacggaaccttccattgcctttcgaatcttcaaggataagctgattcaaaagtatggtgccgaaggggccaaggaacgaatttatgcgacaacggataaagctcatggcgctttgcgccaagaagccgatgccaacggttatgaaaccttcatcatccctgatggtgtcggtggccgttactccgtactaacaccggtcggcctcctgccaatcgccgtttccggtgccagcatcgatgacctgatgaagggcgccgctgacgctgccgacgcttataccgatccggatttgaccaaaaacgaagcctatcagtacgctgcctaccggaatattttataccgcaagggcttcacaaccgaattgctggaaaactatgaacccaacatgcagtacctggctgaatggtggaagcaattaatgggtgaatccgaaggtaaggatcaaaaagggatctacccttcatccgccaacttcacgactgatctgcattccttaggccaatacatccaggaaggtctgcgaaacttaatggagaccgttgttaaggttgatcatcccaaccacgatgaggatattcccaaggaagcggataacctggacggcttgaagtatttggaaggccgaaccatggactttgccaataccaaagcttttgaaggcgtggtcctggcccataccgacggtaacgttccgaatatgagtgttcacattccggaccaaaccccttacaccctgggatacttgatctacttcttcgaaattgccgtttcaatttccggctacttgaatggcatcaacccattcaatcaacccggcgttgaggcttacaagaccaacatgtttgctttgttgggcaagcccggttacgaaaaattaggtaaggaattaaatgatcgtctctaattaaacatgactaaaaatggtagttaagacaaacgtcccttttgtcttgactgccattttttgtactttatttttattggcgttccaagtaaaatcgaatccccctggtaatcaggaccctggataaaattcccagggcaattgcagccaacaggaacttcggcatcaataaactaacacctatgtaaacaatgctgatggcaaccatcactttaaccgagcgaaactcttctacatcgtgttcgattatcctttggccatcatgacgattctgctcaatgaccagatgaaaaagccataactgtgaaacattcacaataaacatcagaatggcaaaaccaattgcactttcactggagataaagctgctgctcagccaggttgtcgcaaatgggatcagacaaatcggacacaggtaatagatattggcaaccatgattttgaaagtcgttgtttttaacgttgtaaacaattcttgatgcagtacccaatactgggcaaccacaccgaaactaatcaggtaggataatagctgcatcatcagacgctgaatttcatagtcggaaatatttgccatgggcgctttaatatccagcaccataatggttaaaacaaccgcaaacaccccgtcagagattgcttccattctggatttggaatttctaaacatgtcgatcatcacctatccgattccagtcaattggctgtctgtgggtgccatccggattaatcagtaaggcccctaagttttccttttttaatccggacttaaattgcgtttctgctctaccaatctggtcaaaaatctttttttcctgtacttccacaaactgatcatcaaagaaaatccgactggcgattccggttgatttaataatcggagacggtccttcaatagcattgtaaacatcgagaagcgtcatccgattaatatcataggagagagaaaagccaccgccctttccagcctcagagctaatcagaccgcctaccaccatttggtgcaacaccttttttagatacgaatccgaaacacccaaccgattactgatgacaacacttcttaacggcatatgatccttgcttaacgctaacattaataaaatacagactgcctgctcaaaactactttttaatttcaaaatgactattgtcccttcctgacgatttactaactatagacattttctatctatagatgtatattatcgatgtatccacttaaaatcaagtttaaagaatcattcatcatactaagagaaggtgaacccgttgtttaaaattaaaagtcatattcacttatccgacgtcgggcaggacgccaaaatcagattgggtaatctagtcgataaatttcaaaatgccggctggatacattttcaagagcttcaaaaacgattacccagcatggatccccgcctactttactttgtcgtttcacaaaaagttgatatccatacagtcccctcgcttaacgaaccagttgtactccaatcattcatcacggatgcaaaccgatttaaaataacccgtttggttgaaatccgtgatgctgcaaagaaattgattgccagccaaattgaagatgcctttgttgttaataagctaaccgggaaaattgccagactgccggaaaactaccccattcacttaatggtagacgatctcaagaaactaacttttcaccgtgataagatcgatgtgccggcaggcggacaccaaaccgagtcaaacttccgggtgctgccacgagatgtcgataattatgggcatatgaataatgcccgatatttggatctcattgccgagcatcctgatcgcatcagggaagtctccatcaattatcttcatcaggcaaaattgggcatggagcttgagtaccttcgaacacaagtggaccagtccgtcttttataccgttcgtaatggcaaacagatcatgtccaaaattaaattagcccttaaataaccaaaaacacgctgtcggttgcctaaagcaatcacagcgtgtttctttgactaagtccgttgctttcttcttaatacaatacccagtaagataatcgcggtcaaaattagtcccagtgaaaaggcataggcataatgcatgccaaatacaaaccagtcgggatgcatatctggataagtggtcatccgttggccggctttcaagcttatgccatgataaagtaacgatgttgccagtgccagtcccattgacatgccaagatttcgacctaatgccgcaattgatccggcaatgccttgaaattccggtgccgcatttcccataatcatcggattattctgaaaagcaccatttgcacacccgaagagtgccagtccgaccaccaaccagaggattgaccattgtggcgtcactaaaataaagatgatctccggtacaatgaaaataaacaaggcaaaaaaggagactttttccgcaccaatatggtcggaaattgctccaccggttggcgcactgacaatgttaacaattggcacggtcattaaaatcaatcccgcaatgccggaggacagcaacaagcgatcctgcaaataaaacggcataataacgttattaaaataaccgcacatgtagaccaacatcgctgataaaataccaaaactaaaccccaggttatgaaaaatgctaagattaataagcggttctttctgatgccgttcaatcagaataaagattaccagaaaaatcactgttaaactcatcaggccgataatcttccagtgaccgaacccaatcatttgtccaagaaagatcatgacaaaaaagctgagaatcatgccggcatacgataagaatcccggcacatctatcttgggacgtccgtgaaccggctttgaccgtggaaagaaatgatgtcccaagaaaaacgcgataatgccaatcggaacgttgacaaaaaagatatagtgccaattggcaaaactaagaatcaaaccgccaacaccggggccggcaatattaccaacctgtacaaacgaactgttaacgcccagcgccagcccatgacggcttaaaggaaaaatatcggtaatgataccaaaattggtcgacatcgtcattgacgcaccaagtgcttgtaacgcccgtgatgcaagaatagttggcaggttaacgctcaatccacaggccagcgaccccaatacaaagataatcgttccgatttgaaaaatccgaattcgtcctacctggtctgataacttaccaaagaagatcagcaggacacatatcaataccaaataaaccgatacgatccactcagcttgattgttgggtacccgcaaatcccgagacatttttgggaccgcaatgttaacaatgctggcatcaatcgttgacataaaggacacaattgaggtcgacattaataaaacccattgattctgacgctgcacaaaatctcctccgatctgattcattcaataaatgataagagcggttgagacaacatcctctttgcccagcctctctttgtttaacgttgactagtatttaatttaaagacaggatcaacgaatccgcttagtcccccatttaccacgacgatgctttagatgctatgttccacgattgtgtgtttcacacgggcttcgatctgattttcaaatagcagttgaaccgcatcctgccccatttcttttggatgcaggtcaacggaatgaaagtgttgatccgtcaactcattgggtaacgagttattataaccgacaacctcaatttctttatccggatgaagcgttttaaatcgatggtagatcttcaaacccgtatagtcatcagtcgcaacaacgccgtccatttgcggattttccttaattaaccgatccaattgatgctcatcttcatcgggaaccgcaaaaataaccggtttgcgattggtttgcgacatttcgcgaagatacccttcccgtctatccaattcatagggccagccattgggtgattccgcaaagatcgggttggaaacatggtatcgttccattagaaaacgggtaccgtccgcaccggctttgacattattattgtcgacataaagccatttttgacctgccgcaggcttaccaattgtcacaaaggttaccggttgtttgcgtaacagttcaataaccggatcattgatatgtgaatagagtaggatgaaccgtttaatctgggctctggtgatcattgatttaacattttcaagaacctgttccgttgaatttccgatcgcaacagacaggacataatttttagatgtcagttcttcattgattccccgcagcaggccgacatagaaaatgttatcaaccacccgattattcaccggaaagacaacccccaccgcattggcttcctgatttgttaaatttctggcattatagtttggctgatagccaagttcctgtgccatttttttgacgcgttttcgagtatgaatactaattctttgattatcattaagtgcccgagagacggtggaaactgataatcccatcttcttggcaatatcacgaatggttgccataactatcttcctatctacattaatttgtatactatatttctaaattgcgaacgtgttaagatttcgtttcttttattaatattcgaacatacgactagattttgcaagtgttgtgtgataatttcatctatatgaggtgattacgaatatgaaaacaagcaaatcattagctgtgattctgataacaaccgcaggattaggacttgtcctggcaggttgcggcaaatcttccaacaaaggctcaaatccaacaagtaaaaccagcatgcaaaacccgactaaggataaaactgctaaggaagcattaacttccaacgataatctttggtatatgaacggctcaattaattataagagtaaaaccggtattgacgcttataaatttgataaggctcacaataccgttacaatttacagcgtcggtaagatgtacaaaacctatgacgatgctaaaaaagcaaatgacttggataaacaaggaacactgaaatattcctttaagaatgattccgcagaaaatccggttatttatatgaagggaaagctttcggatatcccaatggatcaaaccgtttctgttaagggaaaggtttccggaaagtatcacgcatctgatttgaaggtttccggttttaaagttgtccgcaatctggataacgatgacgctaaacaagtcttggtaacaccgggtcattaaacggcaccgtttatatttaataaaggaggttgggatagcattgtcccaatcttctttgcttttatccttagaaatcccctgcctaaaagctgttcttggtcaaaagccaaccaactgatggtttattcttaaaagctgttacaaaaaaggcactaccaacaagatatgacctcaattgtcaacgtcaatatccccaagtagtgacttctattttagtatcatgttctattcgaagctaggccaaagaatcccaagccggcagttcaaccggcgctgtctcaagtattgcttgttgtgcttttgttaagtacttcttgtggacaacaacttcatatacataatcattcatccagctatcggccattgtaaagtatcctttttcaccattcttatcgccccaggaattctcaaccttccatttagtcggttgatcctgttcatccaaatcaacgcccgtcagcgtcatcgcatgtgatacagctgcctggtgataagccattctcttggctttatccatttccaggttcacatcaaataattcggaataacggtataggtgactatccagataacccttcttacgatccatctgttccaaaacgtcgttgccgaaccaaacggcttcaccatcttttagttgggcaatggctgtttgctttaaaacggccattggcagattcaaaaattgaatctgcttgccacctgcgacattgtcctggcttggcagtgaatataatcgatcaaaatccttatccggcgaattggaaatgaccacgtaatcgtccagatcaaccccgaaatattgatcataaaattgttgtggcgttaatcccgaaattttatgataggctttgtcatcatccctataagaaaagttgaccgtggttggcggttcaccgaatgagtacgctgctattcgataaacttcgcttaacattttctgacgggcagcagcaacttcatcatcggatttaccggcattcaccaaatcgcgaagtaccattccgtcaatccgtaacttacgatccataacggcatcgaacgcaccggtattctcaacgttactggtttcgggataggcgcttaccggcacaaccccgtacttttgaaccaatgcagctgccatcgcccattgaccgccgtcttcaccgggcatccccaaataaaaggcaacttcgcggtcatttgtcggccgatcagcagtcgcaatcatccggctataataaatattggcccgttcgattttatcccaaaagaataagtacttttgagacaggttaaagtccttaattttgtactttttagcaaaaccgtgtctcagtgtattcactaatgaaaacaaccaacaacgtccgctctgcttttgattggtaaccgatccagtctgcaaatcaactgaaaataccggatccagccgtacttgggcatccggatcctgggcggcctgattaatgccgttttgtgtgatcacccgagagagtatgtcgcttttaggtgcctttacaaaatcttcatgcagctgggcaaagtctgctttccccagtgaatcgtcaatttcagccattaataaagcctcctgtaaaaaatttgaattgttaatattgtagtgcttttacgccaattcggcaattaagcacataaatggttatttaagacaccctatcgaaaaaatcggcaacctcttacggttaccgatttatgaaactcaactatgaattctctttcgtaaaaacggtgtaacagcgagggcgatgaccgcaccaaccaatccttgaatggtgttggtaaacattcctaagaagccagcagaaaaggtatataagatactgtcagcgaagaagtagccgatcaccataacgacggccgcaaccaaaacggcaatcacatcaacgaccttttttgtactgcggttcttaatccaaccggcaatcagtccttcaagaccgtgaacaataaatgaaaaaatagcataattactatatccggaaagaatatccaataaaaagccgctcaacgcgccaactgttccgcccactttagggcccaagagtaaggcgctgattaaaatcccgccatcacataaattaatgtttccgtgggttccgggaatcggaatcggcggaatccccatactgactgccagagtgactgcgacaaacatcgccgttaaaatgactgtcctaaactgcgttcgttgaccaacacttttattatccattattttgactcccttctaaaagataatctttggtgttctcctcggtaaaatcataccgggcacgttctccgccaatcaattttggccttgatgacaagcataccacattggctgctccgacttttctgtgagccatccgtaccgggatctgaacaaacttcacgtgcatgccgatttcggttccaccaatatcaatgccgccaaaagcagtaatgtgttctacttcaaccggatcggtcattcgttgataagcagctacttgtgtcccaccgcccgcgtgaatggccggcacaacggagacaacctccaagcgatgctgttcggccacgtcacgttcaactaataatgcccgattaatgtgttcacatccttggatggccatgtgaataccacggggtaaaaggaattcctccaatgtttccacgaccgctttgccaacatccaagcgtgaattggtgcctttccagtcaccgctgatttcactggtactgcagccgacaacaaaaataccatttttaggaaacgttactttgtcaaagtattcagttagtacgtcacttaaattatgtttgatcgttgtcaatgccatttttagagttcccctctcttctgccccaatgtgaacttggtcacatcattcaaagtctttgttaaatccagtccatatttgcgcctgtcgacattcagcttggctgtttgggccacggcttcatatgtgccaaagaccgaacgttggacagcactttcaaatccaacaccaaagttaaggtagccgctcaataaagcagagaatagatcaccagtcccgtaaaagtggcctgacacaaaaggtgagccattccatgccagcttaccattgtggctgaaacacgatcccatcccagcatccctgcgaataccggtcaccacaacccggataggatgaacaacggtctttttaaaaacagccaatgccgataaaatgtctcgatcactggaatccggtgttaaccgtgtcccggtcaaaagtcccagttccgtggcattaggcgtgatgacagtcgccgtttcgatcagtccccttatggcgtcaagataatgatcatcaaaaccgtcatacatcgttccccggtctccaaggacagggtcgatcacaacgtggttcattttcgatgtccgcaaaagggttgtcagtaaatcaaccgttgccgagctaccaacgtatcccaccagggcagccttcagattcaaatccgggattgtctgccagtgtttcaccgtttgctcaatccagtcatcggatttcgaaacaacgggtttgccaaagccttcagtctgagtggaaagcacctccgtgggaatcgctgctgtttgaattccaaatcctgaaagcactgagattgctgccgtcattgacatcctcccaaccgcagagaaatcttcagctactaaaatacttgattcagaaatcatcatcagcccccatttattatttctgacgcttattgtaccgcaaaaaacttagaaattaatatttcacacagaaaatgtcatattttctcacgaaaagtagattcattataccaagttttcggagaaagtgagagaattaattcatcatttaatttttaaggataaaaatatatcgtcaggggggcatttgtttcatgactttttcaacaaaaaacagtctgactactttattgcaaacatttattatgggctcgattgacgcgtacacatttcaaaactttgacgggtcgttcgtcagtgcccaaaccggaaatttggtggtgttcgcatacgaacttgcttcaaaaggttggcataccgcttatatccgagtaccagtgttaatcggctttttgctgggtgcctttatttcccaagcctgcaagcatttaaaattaagtacggatcgccgcttctcaatctttttattattaagtgttatctttttggggctgttttacggatcgatgttcacctcaatcaatgaattaaacatgctttttaccctgggattattttcggggtacgaactgactgtttttaataagatcggtggaaccagcgttaataatgcgattatgaccggcaacctaaaaaacttttcaaacaacgtttacgaagcactatttagccgtgatcatgcggcgttgattaaagcggggcaatttctaagcggtatctgtatgtttatattaggcattctattcagtacgtatgctttaaaagccaacggtacaaacgtattcctgtgtgctctggttattaatatcatattattaattatcgtcactattataaaagaaaagaagcctcaacaagattaggattcttttaggacaaacgtcattcctaccgataggcacatgccaaacgcctaaataaccgtatgttggatatattccatatctaaaaatctgaaaacgtggctgtgccttcttctgcatcaatcacagcctgggctcccaaaggcgttgtcatcatcggagttgtatgacaagaatcataatcataaatgataggaagccgctgattatttaatacttccagcaaaatatcaattggccgacgctgagtaccaagatcatcgaacaaagcatgttttccaagaataacgccacgaaccttatcaaaagcgccagcgtcgcgaatcatcgcaaagttcttttcaacagttgccgcatctttctcggcatcttcaataaataacaaatctccggaaaccaattttgggaaatacttcgacgctaaaatcccataaatagtgttcaaattaccacctatgagtcgaccggatagccgcgtctcgccaattgagcgccattgattgggatgttgctttttaggtcgttcaaaatcattccagttaattgcttcgtcgtcccaatacccgggtgctttaacggtcacagtctcccctggacgtgtccggattattttttcaaaatctgtccaagtctcatccacaaaaggcggccattcaccaaatgatgctaccaacgccggtccatacaacgtccgacaattgggagcctgcgttcgaaccgcaagcaacaatgcggttgcgtctgaatatccgacaaccgttttgggatgttcattaagatactcataatccagataaggcaaaacagcattggtgtttgttccgccaattgttgccatgataatgtctacctcatcattgtggatcaactgattgacctcaatcgcccgatcaaggatactgccggaacgataataatcccttttaccggataacgatccggctaccaaacgaatgcccttggtttttaaaaatgcctttgcccgctcaaagcgctttggtgatattgccgtaataggtgttgatgttgagcaaaatccaatagttatcataaaatcgcctctataatcaatatgtcagttgatttgattgtagcatttatttgggatcgcaaaaaaggccactcaaatcatctcttttcttcgagtaaatctcataatcatgcagcagtcttaattaaggcagtgaattcgtctctaataccctctagcatcccgaaaaatgatgttaattaacgaattaacgattggcatcatactgataagaactggtttccctcaaaatcaaagccgtcaaaatttagaaaggacatttatttatggacataacagcagctcaaaatacacctgaaggctattcaatagcccaatcaggcagctttcggtttaatacgacctgcaaggtgcgggaaaaacctttgatgagcgataccggactaacaagctacaacgatggtcaatccgtcacctattccggaaaggaaaaacgagacggccatttctggctgtcatttatgggaaaaggcggtgtaactttctttgtcccttacgccaacctatcaaccgggatttacttcggtaccgattccaacgctgttgatcccattaagatagaagacgatcagccaacgccaatgattggcgttgataccggcgttccaaagctcagtggtgttatccctgaatcaacacttgccgactatgactttccaatgtccggttgggtgacaatgtcggaggatggcgcccaagtccgcagtaaaccaacattctttgataatttaactgacgaacgttttcctaaagatcatactcacaaaatcagatatgttggaaagactgccggatccgatcgcatgtgggttaagcttggtcccagccgctacctcccaattggcaaattatcaactcttggtaatgtgatcaaaatgtccaagggcggccgctttgaaaaagcaggctatgtcactgaccaaaacagtgcccagccctgggaacaaatctggccatacactaaacccattggcggcaccaaaacggataaggaatggcacgttattggtgatgttggtagtccaaacactgcttcttgggaaaccgccaatcagccaataaaaaaagaaattccaagcacagaatttcaaccttcaagtaccgaattaaaggccttaaaaacctttaacaaacaggtcacgaggaatgctcctttcgatgctgtttatattgcgtatattgccgatacccatattgacagttatcaaacaccggcctctgccgaagtattgcacagcatgatgctcatgagtgactatgccaaaaagtatggcgttgacctcatgattcatggtggtgacttgaacgacggtgccaagccgcatgatctgagtaagatcgatatccaactaggggtagatgcaatgaagctgggtcaacgtccctacatcattttgcagggaaaccacgatgataattccggatatgttcgtgaccaggcaggttatcaacttgatcaattaatgacaaatgaggaagcatggcgcttaagagctggtgctctgaatcgaccggacaatggcaacaatgccgtttatggcacgtacaatataccaaacagtcaggtaaccatcattgttctagacggttttgatcagccggatattgaaacccggcgaaccacccttggtgatggaaacgtccattttgatagtttccgccacggttatagccgttacagcgatcaacaattaaattggttaaagaacgaggcactaccacatgtgccggagggtaataaagtcctttttctcaatcacattgcgttgggtggcattaagacctggcaaaatacctggtctaaagaaaatcaattgagtatcgatgaatacgctagaaatctattcgagaataacgttgtaaccaatcggcccggttttatagaaaatcaacaggttctaaaggatattattaactatcagaatgccactcataacgtcatcggttatatttccggtcatacccatcaagataatcaggcactttatcacggcatccaatttgtgacaaccacctgtgcgattgcggaccgtggtgacggttcagagaagaactttaatccacaaaattcggctcgaaacctgaccgatttaaccagcaatgcctggtcaatttttcgaattagcgctcattctggtgaagtggcccaatttagattcggatggaaaaatgatcggtacttcttgcccggttggcacttttaagggtcgccataaatgtaacagggtcaatcttcgcataaactcattttaaggtatataaagataaagatagcatccaaaaaataactaatgtttggatttcactatatgtaggggatattttaaaattcggatgtatcagctgtcttagcaactcaataaataataattatcaggagctgacgtatatatggtatggcaagtcgcacaactaacacaagaaaacgcattgatagtcgctaatgattggcattacgacggaaaatatgctttttatgacatgacagccgatccagaagattatcaggaaatcattagtccggtattaaggaaagaccattactatcaggtcttaaacgaaaataaaacacttgtgggtgtttttgcaattgaacctattgacactgaaaagggcacttatgaactgggattgggtttggcaccccgactgacaggacagggacttggccaaaacttcttagactttatccttgatgatattcaaaaaaacttttctgtcagtacgattatcttggatgttgctgaatttaacgtcagagcacagaaagtctaccaaaagcttggattcaaagcggtgcggcggcatagccaaaaaacgaattgttcgacttatccttttattgaaatgcgccgagatttcagaaattaaccatcattcatcattcaacctcaaaatctaactcactgcttacattaaagctgtaatgggcgcttatttagaaacgttgagcgagcataaatgaaacctattatgataaacaaatccagaaaatatattaagtatattaaatatattttcaattaaactatgtgaataagtcgcaaagccgccttgcgctataatagccgaaaactattatagcgcagggcggctttttagttatgatattaaaattaatcataacgtttaattttaatatcataactttgacttaaatcgaaatgataactgtcccaattaaattcgagtccttttttctgtcgccaaatacctaatgcctggtatagatattcaacggttacgccaaaatgatcagcggtttcatctgctgagaaccagtggttggcacagtaaattaagccatctaaagtgattaatttttggtgaccgcggtctcgcgcctttacttcttgttttttattaccaatatctttggtgtcaagaatgtcaccagcagttaataacgcatgctcaacttcttcataagccgtttgcagtaatgtctttggatccaaagtatcgctaagatagatatagttaccatcggttaatccctttaactggcagggtaaatgacaaatttcaaaatgcaattcaggatatttacgttctaaatcttccaaaacattcataacaaacaccccacaatctaatttccacgagcccttttaagattctcaatgaaattaatcacctgctgccgttccgaggcagacatttcatgatcgacgtgcgctgcgattgcttgaacattagcatttgcttgctcttgaggctcttcaatcagctcacttttactgacgttaaaatatttggttaattgctctaaacgttcgattcggggatagttcttagcattaatccagtcggaaaccgttgtatagctaattcccaagtcactgcttagctgacgtcgagtaatccctttttgactaattagatgttttagattttcggccaaaacagttcgattatctattttttttgccatcagacagcctccaaacgttcgttccttatgtgaaacagtttagcatagcgcttcttaaaaataaagtttaaacataaaaaataaaagaataagcgtaattttaattgcaataacgattaaatcgtcatataatcatcgctaaagaacacatgttcttagagcaacacttagttccgacatcttatgtaccgataagggcaatttttttacatttgtgtactgttaaacggtaattaaatcaaaaaatggtgtcacaaataccctaacaattcgattagtatgacagccaactcaatatgatataaataaaaattaggaagcgagatatgatgaaaaagatttcagctaaacagcaacgagcaattgacgcactaaaacatgattctgacaatcaattattgatccaaaaattacaatgggagtcaactaacaccgatcatggtgatcaaatcgagaataatcctcaattacgagacctaatatacacccatgaagtgattaaacattgcctggcgaatacctcagctcctaccagagccattattaccgacatgtatctccatcaatccgaccttaacactgaaggcattgctcaaaagctacatatgacgcgcagaaccctttataatcgtcgcaaaaaattcctcgatgaattgatcagattactgggttaatttctcaagaattgcacaaaaattgcacaaatctttctcaaagtctgcaatcactccaaaaaaatcagccgataatttagatcgtaaagttatgaagccagccaccaaacgaaaatccaatccttaacgtttgagatctggcaaataattttaacaattatcgaaagtgagtgattcaaatggcaacaaacgaagttgcagatatttcaagttatcaggacgattctgtcagtttcatgcagagtttagcccaatatgcaaaaagtgtcatcgttaaaattacggaaggctctgagaatggtgacgcctatgtcaatccgaaagccaaagctcaagtggcaaatggatttaaagtttttaaagccgtcggggcctatcactatttaaaggctaactcacaaaaatacggagcagccgatccggttaatgaagccaagtggtttattaaaaacctggaagccgttggtttgaataaaaagaccgtttgtgccgttgatgtcgaggacgcttctctaatggaaaatactacccaagatgtcaatacgtttctgcagtatatggatcaacagggctaccaaaatctagtggtttatggctcagccagttggtttaattccggacggattgaaaaagctaatctgtttaaaaatgcgcccatttgggtagcttcatatggctcaaatgaacccggtgtcgacaatgccagcgcttggcaatataccgataacggacatgggttacatgttgacttcagttacgatttcaaaggcattcttttgggcgatgccagcggtaatcaaggcactactaccggtggcggtagtacaacgccaaccacaccaacagatgcgttgcaccaacatgctcaacaagtttatacgtatttaaacaaaaaaggattatctgacgcggctatttgtggtattttagggaattttcagcatgaatcaaatattaacccgaaccaatggcaaattggtatgccccaaacctggtcaatgaattcatcaactggttatgggattgcccagtttacgccagccggtaaaattaaagtctatgccgataaagtcggcaaagcggttagtgatatcaatgttcagctggactatatctggaatcaggttaccgcaaccggcggtttctacggcggttcgaagtcctttaaacaatttgcccatgataccgatcccaaagtagccgctttagacttcctgcaaggctatgaaatgcattcagcttccactgatgcccttgctgatcgtcaaaagaacgctgaaacttggtgggctatttacaataaagggaatgccggaacgtatggtgatggtagttccaccggtggaaccaccacgtcaactccggatggctacacaattcaaagttcaggaacctttacctttaataccaactgtaaagttcgcaataaaccgctgatgagcgatccgggacttgcgacttataaggccggtcaagctgtcaattatgatcaaaaagagaaaaatgacaaccactattggttatcttatttaggcagtgccggtactcgtcattatgttccctatgccaacatctctaaaggcacctacttcggtaccgatacccatccgggtgacccagtgaaactgtaatcaagcaaattcgtcgccctccaaattgcacaaaaattgcacaaacgttgcacaaatcttgcacaaagtctgcaatcctgagcaaaataaatcggcataataaagacatggttagtcaaaggggcccttttaacagccaagtcagttagtcgattgatcgatgagtaatgccaaccaagccatgaaacaaattaacatcctgacatcgactagttgatgacaaacaatcaaaattcacaaaatttttcaaaattcgaaaggaagttttatttatggatacaacagcagcacaaaatacgccagatggctacacacttagcgaatctggtcaattccaatttaataccaattgtaaggttcgtagcacgccagacatgagtgctacaggtgaatcaaccgttaaagccggctcatatcttaactttgatggacgagaaaaaaacgggaatcatttctggttttactataccgatgcgactggggttacgcattatgttccctacgccaatattgatgatggtcaatattttggtagttttaccaatggcagttccgatgatccaattcaatcttcttcaacaggtggcaatagcggttcaggagatggcggttccgttacaggtactggtttaggaactcttaccggtcaggacggtgctaatgtcgctaaccaaaccccggatggaaccagtttggcaattgacggcagctttacgtttgacattccaatggctgcccataaagattcaaccgctgaaagcagtgtagttggtccgattgatgccggtacaactctaaactataacggcaaagtaaaggatgataattactactggttgcgttacgaagacgtgtcaacaggtaatacactatatgcgccttacgcatcgattgacccattccaatactatggcacggatagcaaccctggagatcccgtttatagtagcgtgcagaccggaaccggatctggctcaaccgatccatcacaatccacattggattttgtggctgatctgggcggtatttcaggcactaacgatagcaattcggcaactaatgatgctgcatttcagaaactatatgaactgacacagggggactctaatacccgaacggttaatattccagctggtgcctttatgattaatcggcccaacattggttctaatttagtgtttaatggtaacaacggaacgatttttctaggaacaacaagtaacaatgaagactcagatcatcatcaaggtgctgcctttatgtataaccaagtctccaacgttagctggtccaatgtatcctttagaggaattaactttacagatcctacaacaaataaagaaaatgtttaccgaattgttcacaatattttccgcagttctcaaattagttttaaccagtgtatatttgatcaaaacgaatccaatggtggacattcactcgatctaggcgggtcaaccaatatcagcgtaaataattcgaccttcattggagttggtgggaatgccagtgatttaagtggtagtgaattctataaagaggccattcaaaccgactatgcttatcagggtggagtcagtgcttatgattcaagtcaaaactatactttagaacccactcatgatgtgacaattgacagttgcaaattcttaccgctctatactgatagcagtgttagcaccctagctaagtatgccccacaaccagtcggaactcacgtcacccaagattattcagatgttattaacaacatcaaattaaccaattcgacgattattgatgtaaaaccggccaactatggcggttatggattctatgccccgattcattttccaaatagtcgtgatattacgattacgggtaatataattgaacgtcgtaaaaccaaagtttctccaaatgtctttatgttttattcctacaaagaaggttcacagccggtagctaataccaatttcaatgttaacagtaatcaaatctacaacatgaatccacaactagtccatgttgatgctagcgctgctgacaataaattggaaccgttgaagtatgccccggcttatgccttattcaccgttgcgggtgggcacactatggatgacatccattttgaaagtaactcgatttacacctatgcttcaatgcagacgcctaagaatcaagatgatcattcatttagtgaaaaacagaatgacattgatgatagtgataattaccgtgttaaaggcgtgggagcaaccacctatgatgataccggcacaactcgatacgtcaaaactgatgacggcggtagcggaaatgaagctgctcatacggcgactactcaaaacgtcatcgccgttttaccagatggtactcaaacaactttagggacggtcaatgtacaacaggacttaccatatagctattctttaagtagttacaactcatattcaccagcttttagtgatgttcctgttggccaaactactttagatggtaacgtttatgttccatatgtttaaacttaatagttagtataaaaacaggacgcaaaattgcatcctgttttttttacttttcaattactataacatctgaagcctctcgagtgtacgtatgggcctgcccaatgctaattccaaacccgacttttgggtaatctgggtgttctctttcgagtgttataattcccttctcaattggttctgcaaaggcattcacataactatttcctgtatccgacggattatacttaacattgccaaaccaactgctattgtatgtatcaacatcatcaccaaaatgaatagaattatcatcgcttaatccgaactgggccgctattgcagtactatttggatcggagatattcggatgagtttccgcataatgctgactataattaccataattcattaaattcgtgtcaagcgtatactttccagctaaatcctgcttaactttattgatgatttgtgtttccgcggtttgctgcggcattgctaaaaatgcttgaaactgttgtttaagtgtcgttttgtcagccgtcgttgagccattattggggcttccggtcgtactggtattacttgatgaaccggtattagctgaactatcgtttgaagaagaactacccgcgttaggcgtcgtgctagtccctgaattaactccggccgttaagtagcctcgccaaacaatgccactggcacgaccgttaccactggtcacgtagtaataaacggctcttttaccggtataactggaacgcattaacagacttttagaaacataccacgtggtattgggatagttctttaagtcatgtagctttcgcgtgtggctaacattataaacataagctgagcgctgggttgtcgcatgataaggtaaattagctcgattaatcgttttgaccgtgtaatagcgaactgacgcgtgcgttaatcctgaagaactgacactgatgacgcccactcctaaagccgttatcaaagtggtcagtaataagcttttctttttcagagatctcgcctccacaagtagtatagcaccaaaactaattagatttgcacacttttttctcaatcgttttccaattctttctcaaaagttgcacaaaatttgctcaaagtttgcaatcctgaacaaaataattcggcataataaagacatggttagtcaaaggggcccttttaacagccaagtaaattagtcgattgatcagtttaataaagccaaccattcaattggaatctttgtcaatctgatagcgactggtttacgaaagtaagcaaaaacttgaaaggaagttttatttatggatacaacagcagcacaaaacaccccagatggctactccatcaccgaatcagggagctttacgtttaacacaaattgtcgggtacgatcaacaccggaaatgagcgatactggtttagcaacttatgatgcggggcaatcagtcaattatacgggtaaggaaaagaacgatgatcatttctggctggtatacaccggctctaatggcacaacacattatgtgccttatgccaacatcattaaaggcacctattttggaacagattctaattccgatgatccgatccaagcctccactggtgacaccgggtctggttccggtgataccggctcaggtagcggctcaactactggtggttcaggtttaggaactcttaccggtcaggacggtgctaatgtcgctaaccaaaccccggatggaaccagtttggcaattgacggcagctttacgtttgacattccaatggctgcccataaagattcaaccgctgaaagcagtgtagttggtccgattgatgccggtacaactctaaactataacggcaaagtaaaggatgataattactactggttgcgttacgaagacgtgtcaacaggtaatacactatatgcgccttacgcatcgattgacccattccaatactatggcacggatagcaaccctggagatcccgtttatgcctctggcacaggtactggatctggttcaggaaccggaactggaggttcatcaaccggtagctcgcgaacacaaggtggtaccgacacgggtactccgacattaagtggccaaacacccgtatccagtttggaaggatacgaatttccttcaaacggaattgttcatatggacagcggtgcagccacgagaacggcacctgttttcgatgactctcatgaaactggaactactcataaggccggtgataatgttcactatgttgccaaaacaaatggtaatgatcggatgtgggtgaagtttaccgatggcaattacatgccaattggaaaattggataccttgtcaggtcatgataaatcctccggcacttttaatggcaccaaatttcacgaacaggttggctatgttcatgatcaaaattatgaacaaccctggcaagatatttggccatatattcagaacaccacaaatactgattgggatagtcttgaagactcaaacagtattgagactgaaacagttgacacaaacttcacaccttctagtgatgagcaaacccagctagaacagtttaacgagcaggtcaataacagcgctgaccaacatgatgacgatgtattaatcgcatatattactgatacccactatgatagctataaaaccccagcaaccgctcgggtgctacacagtatgatgctgatgagctggtatgccaagacttacggtgttgatctggttgttcacggtggtgatgtcaatgatggtgttaaaccaaaggatctcagtaaaattgatgttaaccgtgctgttgatgcaatcaaattgagccagcgcccgtatatcattctccaaggaaatcatgatgataattccggttatgcccgaaacattactcgtaacgacacaacccaagtactcggaaatgatgatgcttggaatattcgcggcagtcaatggttaaaccggccaactcaaaacagaaacaacgcggtttttggcacttatgatgttcccaacagtaatttgagtattgttgttttggacggctttgatcaaccagacgagctagaagacaatggtaaggttgacttttattcattccgtcatggctatactcattatgacgttgatcagcttaaatggttacccggggcattgaataatgttccagcaggcaataagatcttggtatttgatcatatttcattaaacggagtatccggctggaaacaagaagaaagatccccattcgaaaataactccataactaacccaaccggtgttaacgaaagtaatgagatttttagagatctaacaaattatcagagtaataatcgcaatattcttgggaccatcgtcggtcatacccatgaagatgatcaaacggttgctggtggtattcagtttattcgccaaacgtgtgcgctatccgaccgtggtgatggtcaaggtcaacgaacaattgacggccgagataacaacgcttggactattctacgcattagtccaagtgctggtactgttcatcaatatagatttggctggagtaacacgggtacctttttaaacaattggtcactgtgaacattttttctttctccaaaaataataatagttcgatgaaatttaaagatatgatcaaaacaagcggttgttagaattcgaggtgtggtattctaacacacaggtaaaagttttgagaaattgagaagtgccccataattgttagaaaaatcctaacaattatggggcacctttttatggtcaaatattctaatgaactaaatacacaaagctttcacacacaaaaaaacattttcagaactatttattttaccctaaacgggcttataggtacttggagttattttaggattggccggcaaaataaatacataataattaaccctagaaattttcccaccaccgggattatctgactctgcctcgctagccaccccgatgtgatagccctgatattgatccaaatttgaaaaatcaatttcgtttaacctattactaagttgactctttacagtatagatatctgggttttggacaaagccccaatcttgtagcaatccttgtgggctgccaccatataatttaactaatctcccagaaaataatggctgatcatcatgattatattgatcatttagccaaagactgtacgatgccaagtcgtccaatctttgatcctctattaacccaggagccaattgtaaaatctgcttattgaaggttgaagcttcttttgaattaaattgggtactatctgttgaataggtaggtgtagaggtactggccgatgcatcactgctcacattactcgaactagagctggaactcgtgtcagttgaactattgtttgaagaagaactgcccgtgttaggcattgtgctagtgcctgaattaactccggccgttaagtagcctcgccaaacaatgccactggcacgaccgttaccactggtcacataataataaacagcttttctaccggtataactggaacgcattaacaggcttttagaaacataccacgtggtattgggatagttctttaagttatgcaactttcgtgtgtggctaacattataaacataagctgagcgctgggttgtcacatgataaggtaagttatcccgattaatcgttttgaccgtgtaatagcgaacagacgcgtgcgttaatacggctgaaccgacactgataacaccgacccccaaagtcgttatcaaggtggttagtaataagctttttttcttcaatgatctcgcctccacagatagtatagcaccgaaaccaattggatttgcacactttttttctcaatcgtttcccaatgctttctcaaaagttgcacaaatcttgctcaaagtctgcatttttttcgataaatttcaatgataatgaaaccatggttagttaatccataactaattaatggtttttttattatgtactaaattttctcagccaaagttggataactaagccagtaattatgtttgactaactaatcaatcggaaacgcatttagccaaatagcgtcgtcaataaaggaggtgattattttggtaaaggaaatatccagtggttttaattgggctcaggcagctggcgtcctgtggttaattgcagccgtaattggcaccatttacaaacagttacacccgttaattaccactaaaatcaacagcgaaaagaacggtcaggttaaacaggcccttcaattagctgatcaattagccgcagtgatcgttcctgagatggccgtcatggctggtttaagcaaagccgaacgtaagaaagaagccatccgctttctttctgataaattgatggctaacggctttaaaatcagccaagaaacgctttcggccaccattgaaaaagcttatcaggaatacaagcatgtcacccaaggtgacaatcacttgcctacggctgatgcatcaaagtctgttaccccaaagcagtcggcgggaaccaacactccccaacagagtagtgcacatggcaaataactattttcaattttcattatgtcagttattcacgaagattccggctgttgtcaataattaaggaaaggaaatggccagaacaatgagtgaacgtggaactgaacaaattaacttcaccaagactttaattgacattaaaaccgatgtcgctcgcattagcaccaaacttgacgacctcaatgccatcagtaacaaagctgatcgggctttagaaaccgcgactgaaacacaacgcgaaattgatcaactaagtaaaattcaaaattggttgattgcgaccttggtaaccggaattggaacccccattctgattataattgtaaaagcttggttaacttagaaaccggtaaatgcgtttccgagaaagagggccctctttcttacataatcatgatctagtggtttttatgtctttattttcatagttgtcagatcttattaacagcactaattagtttaagcgcggatcatactaatatcagactggcatcaacttgccagcgttatttttggatttgccggtaaaatataaatataataatcaattttagtgattttactgctgtttgaactactcgatttggcttcgctagccacaccaatatgataacctttgtatttttctatgtccgaataatcaattgtgcttagcggatctgcaacttgctttttaaccaaactaacattaggagccgccaccgcattccaatcttcaagaaggccatatggatgccccccatatgtttgaacaatgtatttatcaagaagtgtctcctgatccccatagttatacttatttgacagttcaagatcttgagaagccacatcatccagcttctgatcctctaatagtccaggaaaaagctggataatttgcttattaaacgcggtcacatctttagtgttaaattgattgctattagttgaataggtggtcgttgaactaccagttaatcctgaattggttccactattgctattggttgacgaattattgtttcctgttgctcctgtatttgtaccgccattatcagctgaattgctatttgaagttgaatcaccagaattagtatccgaactggcccccggattcgttccagccgttaaatagcaccgccaaacaatcccattgactcgaccgttaccactggtcacataataataaacagcttttctaccggtataactggaacgcattaacaggcttttagaaacataccacgtggtattgggatagttcttcaagttatgcaactttcgtgtgtggctaacattataaacataagctgagcgctgggttgttgcatgataaggtaagttatcccgattaatcgttttgaccgtgtaatagcgaacagacgcgtgcgttaatacggctgaatcgacactgataacaccgactcccaaagtcgttatcaaggtggttagtaataagctttttttcttcaatgatctcacctccaaaattaatatagcacccaaaaaattggtacactttttatacaggatttttatttctcaacaatttcagcatcgccaacagaccgagtataagtatgaggttgagcaacgataattccaaaaccgattttcgtatagtcaggatgagcttttgcaagcccaataatgccatcttcaattgattttgcgaaagcattaacatagctattgcctgtgacagatgaatcatccttaacattgtcaaaccaactactgtcataatcatcaacgtcgtccccaatttggattaggttgtccaaattcagaccaaagcgtgctgctatcgcagtatcgttcgggtcagaaatatttgggttgttttcaccatagtgttgagtatagtcagcataattcatcaagttcgtatcaaaagtatactttccggctaaatcctgcttaactttattcatgatctgtgtttctgcagtttgctgcggcattgctaaaaatgcttgaaactgttgtttaagtgtcgttttgtcagccgttgttgagccactattggggcttccggtcgtactggcattacttgatgaaccagtatcagttgaactatcgtttgtggaagaactacccgcgttaggcgttgtgctagtgcctgaattaactccggccgttaagtaacctcgccaaacaatgccactggcgcgaccgttaccactggtcacgcaataataaacggctcttttaccggtatagctggaacgcattaacagactttttgaaacataccacgtggtattgggataattctttaagttatgtaactttcgtgtgtggctaacattataaacataagccgagcgctggattgtcgcatgataaggtaagttatctcgattaatcgttttgaccgtgtaatagcgaacagacgcgtgcgttaatacggctgaaccaacactgataacgccgacccccaaagtcgttatcaaggtggttagtaataagctttttttcttcaatgatctcgcctccacagatagtatagcaccgaaaccaaattagtctgacagcttttttactaaaaaaacaatgacaatttaactgcgggtaattcttgttagtcggaccaatgtccaaaaatctcagaactgtaataaatcgacggagattaaactccccgccgacttagtttgttaattaaataatggtattcattttcttcaatttagaaaccccttctgattatcgacatactagtaacctttgcctaataatcaattctcctcacacctttgggaagttccggacgattgatcactatgctaacaatttagtaagattgatcgaattgagcttcttttggcgcaaacagtaggcacaaatgagtaaaacaattaaaaatagaacaacattagtaatgatctcagcaagtgttaccgtagcagtttcattaatagaacctttagcaattcctatggagaaatcccaagtgccatggaataacattggtagaataattgtcccagaacgcaaataaagcacactcagtatcagtccgaaccatacggcaaacaacatctgtaaagctgtgtcaccaattggttggcgcaaaacattgacggagtggattaaaccaaacaggacgcttgaaataacaacagccaaccatacctgtcgttttttagtcatgtgcatgaatgcctttaaaaggattcctaaaattaatcctcgaaacaaaaattcttcaaatatcccagcacataaaccagctgagattgctaacatccagtacaagttcctgtcgatgacgatttccgaaactgctattgcaatcgccagatataacggccaacttaccactagtaattgaccccaagaaatagtcggcttaatcccaattttttgcttagtaaatcgtcggttaatgaaataaaaaatagcaaataaagggacatcttggacccaaatcattacggactgagaaattgtaaccgaccctttttacggtaaacaaaataacagctaaaaaagccattgcaataatcagcgttgcaaacaaaccggctacctgccaaatgtagcgagatgattcttccatttgattatcttctttctaaactggcttttatgggattattatagcctcacttttttctcggaggttgaatttgtattttgagcgaagtgaagaaattttgcgtcttgaattaagagattcagaatatatggtccaaccagcattgacatcactttcaacaaggcataccttgaatatatattaaggggacaatcattattgaaaggattaatttaatgaagttcaaaaaaattattttagtaatctgcttaagtaccgtcaccacgcttcttatttcaagttcagaaatctatgctgataaaaatccaatcaatactgtatacaaatcgttaacaaatgggaaactcatcaaaccggcacatctgagtcaaaatacaaccactagttttgacatcatcttaaaacctaaaattagtcccttaaaaacggccagtgaagttaatacacctggatctgccaatttcaaacagtttataacaccaggtacccttgccaaaacttatgggcaatcaacagccattattaacagatggacccgttttcttaaaaagaaacatcttaaggttactaattttaataacatcgttcttaacgtcaatggtaaggcaaagaatattgataacacatttaaagttgatattaacactgccaaataccaccatgatccgcttcaatttgggaaaagacgtcctagattcaacaaaacgcttcaaaattcagtatggtttttatctggacttaccgatcacaatcctaattacagactcccggcggatagtggctttgcaagctcaagttcgaattctcatcctggtttcactaaaagatttaccgaccgttataatgtcaccccactgtataggaaaggattaactggaagtgggcaaacaattggcattattgcattcgggaatcttcgtaaaaccaatgcttttcatttttggaggcatgaaaaggctagcactgatccagaacgcctatcaatcaaaagagtgactggcccacaaactcatccaaggcttgtatccaacgacgaacttgagacaaccatggataccgaatatgcaggctcagtagcacctaatgctaatattaaagtatatttagtatctgatgctcttccttcaattaccaatatgattaatgcctatttaacagcttttcatcaaaacacagcttcttcactttcaaatagctggggactaagttacggttctaattatgcacaattacttaaacaacaccttgtaagtcctcattttaaacaattgttagatttagtattatcccaaggtgcccttcagggaatatcgagttttaccgaagctggcgattatggtgctttaaacttagcctcaacaaaatcaagctaccgcaaacgaaccttgttggatataaataccagctcggcagatgtcctaagcgctaatccttggataacttccctcggtggcaccacgttaccgtttaagggagatgtgtacgcttctggtcaaaagcttggcagagtgaccgttaagaaagaacgaagttggggaaatgattatatctggccattactccaacaacattcttcttttctagcaaagaatccatatcagattgtcgaaagcattaatggtggaggcggtggctttgaccatgattacgctactccaagctaccaattaaacgttccaggcgttaatacttttaatgcacgaaactacctgtctaatttgggacagcaaatttataatcaaccgttactgagtggccataactatgggcgtaactatcctgatatgtccgcggatgcagatttgcagactggctattggatgtatcaacaggaaaaaggagaaagtccatggaatgctgttggcggcacaagcatcgtttcaccacaatacgctgccgttgccgcgctgattaatagtgcccctaatcacgcacgaatgggcttttggaacccacaaatctatcaacttgcacagtccagtaactcgccctttacaccgttgaatgcaacaactgataattcaaacttatactacactggtcaacctggaaagctttacaaccaagctagtggattagggacaaccaatttcgccaagttatttgcggaatataaataacatgaaaacgagtttatttgcttctgtggattagccactccgggaatttcaataatcaacttaacaaagaaaaacaaatcgacggggaataaattccctgccgattttgctttttaaccaattaaagacagccaaacacatttggtcatttaacgtttatttgaatcaggaacctgaataagattcagttaaattcgaacattccagtattaacgccaactctgagaaatgactttttagctttcaagctttctttttgcccttaacttaacggcaaagtccgcaatcttgatttgatctaatcgacttagatgaccaatttctttaaacttcaaaccggttttcggaaactgataaagattgcctaggtcaacccatgaaggtcggttcaatccagctgattgccaattcttagttggatagtattgttgcttaatgtaagctgatttattttgatacttgctcgttattttgaaagcctccactgtctgggacgctactttgcgaattaaaaccggtcttgatttaccgcctttggtttgtacgaagctaacatagagggtgattaagtcattagtcttcattgggatcgttgagccaatcagcaacttcttgcgcatttttaaacttagttaccggtgtcttctcggtagcttttaaaaagcgcaaattagcttttttggcttcgtttaacgctggtttaaacggtaaagcaccatcagccacaatctgcttataaaacatattaatagccgttgtctgattcagccccaactcgtttaaaactgcctcggtatcgtccgctaagtctttgtcaatttgaacctggacacgtttcttttccttcggtgccatgattgtctcgcctctctttcatttgctactcaaattatagtatataatgggtggtaaaacaattattaggcttcctccgcaatggcttgcagctaaagataaatggtgtcactaccgggattggcttattgatacgtactgaaaaaataacggctccaaaccttattttcatcaacaactgttcagttgaggcattactaccatttcaaaacgtaacactcacaattacaactggcaatatcgggattggcacaataccgtgaagctgactcaagtatctttattgaactgatgggcgccggtcaccacctatgaatcattgctcactatgctaacaatttagtgagatcaatcgaattaagcttttttgacacaaacagtaagcgcaaataaaggaaaaagccggactgattcccacccaacttgaacagttaggcgttaccagtttccggtttccatggcaatacaaacgctggaattacaatcaacacatctgtgtcttttacgaaatcactaatcttaatggcaagctgaccagccaagtgtctcaatttattggtcaggattcactgggagtacttgaaatctccttagcagaactgaacatcaataacgcatcgccgttggtttggaaaaaaagctaacgaaaaaaatcagggtgatttaatgtgtcaaagcaaactaaagatgaacaagcaggtactcccttaccttatttctaaaaccgcttccttcgaaaaatcaaataacccaacgcaaagaaaagagtcatataaaagagtgttccaatcagcaattgggcatttgccaaatggctagtcgcataataggtgatgtaattgtagtattctcgagttagattgatcatgttaagtggattccatttcaaaacagtggcaaatctacccgaattcaacaaacttccggtaacaaattgacccatgaacaccactaagaagctcacactaatcacgacggcattattattaattaaacatgacaacagaaaaaccaaactgacgattaacattgtcgttagtaaatcaatcgctgaagttttgagcatattttcccatagcggctgctgatatcgataacttgttgaccaagccacttgggcgttcatcggtgcatatcttaacccaactgtaaaaataattgccaagacatgcagaaagacattgtagccgaaaatcatcacatacttcgatagatagacgtcaattttgttggatgccttatacagtaaggtcaagattgtgttattttgaaattccattgaaaaggttgtcgcgccaataatcactaaaatgaacatgatccagtcaggggagttataacttgtcatggtcaacaatttcccctcgttgaaaccaatcgtgtatcctgacatgatcattaatgctagaaggattaacggcgatatccaagtaatttttttgtacattaacttatagaactcttgatatatgctaaaagccatcctaatatctccattcataagaaatcaaattctacggtgtttaaataaaacataacccaatgttgcgaaaacgagaccatagccaatagttcccacaataatctgccagccattcaattgagataggttagcatacgacctgttggctaattgttgggtcacaaagatcatattcagagggttccactttatgactgctagtaaggtggaatatgtcttcatcaaagctgtcgagatactcgcgcccagaaagccaagtgccaagccaatagcaatcactgctgcattaaccttgaccagcataataagcataaaagacagtgccacaataaagaatgaatagataattgttcccacgatgtgcaacattagactatccagtaaagattcatgcccgacataatcggccagccaccgatacttattacctaccaatataattttgagtataaatgtaaaaaggatcgcaatggctgcaagtaacacaccatataagaaaacgactagaaatttagctaaataaatttttaacttattagaatttttgtaaagcagcatgatgatggtgttgttattgtattccatggcaaagaaagctgatccaactgcaattaaaataattggaatccattggacggccccaaacccaaatgaaacagatacgaaaccaacatttgatgaaatgctactataagccatcaagattagcagagctaagataccgaataataaatttttctgatgattaaacttatagaactcctcggctaaactattcctcatgctgttgccttctttgtttttccaaaatgctaacaatgagttgctcaaagttcgcttcagccggtaatatttcctttaaatgaattttgttctgatacagaatgtcctgagctctaaagagatcctctttctttaccaagaaattatccgtgttgttagaaattgagatatgattcgattcaagtagttgcatcgccaatttgtctctttctgtgcttaatttgtatttttgccgactgatttgattaaatgtttcgatatctcgattgacaatcacgtggccatcgttaattaagacgactcttgtcatcactttctgcagttcgcttaaaatatgactggaaattaaaaatgcggttccttgtttagcatattgcttaatgatttttctaaccccaatcgttgcttcaacatcaagtccattcattggttcatcaagaatgattaacttgggatgatttaatagtgcaatggcgatacccaacttctgcttcatacctaaggagtagcctttagccttattgttaatatacgcatccatttgaagcatcgaaacgatattcgtcacatcctgcttatcgtaagaatacagctccaaattctgtgatcccgttaagaatggataaattgccgggtactcaattaacgccccaaccttggatagcgcattatgattattttcagtcaccaactcatcacttacagaaatcccgccggtaaatttagtcaaacctagaatcgtcttcatgattgtcgttttcccagcaccattcgggccaatcaacccgacgatagcaccagaattaacttgaaacgaaacgttcttaacaattcgctttctgccaataaaggtatttacatcagtaactttcaacattagatttccctcgattcaattgtgagtttccgcttcaaataactatgcttaaatgcgttacttttaaatttcgaacaaagtgtacacccactcgaaggtgattatgacaacgattaggactctttttaccgatgttagtgaatgtatcttgtaactttgatatcaagtcgttatgcttaagatataagcaagaaaatttcaagactttaattagagagaggtgcctggttctcatgaatagcaaactaatcgaaaacctgaagtttttcaggaaacaaaatcatcttaatcaaaaccagttagccataaaactaaatgtttccagaccaacaatttcaagttgggaaaccggcagaaccacgccagatattgataccttggttagaattgccagtttctatcaagttccagtcgatcaattgttattcactcgaagccattcaaagggaaatattaataaaagccaaaagcatattcttggtattttgcttatgatcttaataatcgaaagattcactgtggatgccccgcctgctgctcgaggttggattgacattcttgcgttaatacctgctttgctctatcttccattagcattagtaaaccgaaactggctgatttcaagaattagtctgcctatttacaccgctggtcttttcttatttggcgtgttggggattggcagtagcgtgattaacctattttcaatgggcccagggtttcaaacatcttgttttatttgtggcctgatcgcacttggttatctaggaaaaaataaacttacgtatcttttctggagaatcagggaaataaccgtttcttaagaagcctcttttataatctaaagtacaaacgaaaaccgctaacctcattgtctgagattagcggttttatcttatgcaagggaatgcgaatcttcaatttcctaaaaatcacttataagcctgcgccaatttatcaaaattagtaatccctaaaccggtcgcctgattatagactgtccctggctgaccgacatagtatagattagaattgctctgtgtactgttcagtggcgtgaatggcgaatcgggttgctgggccaactgatagatctgtggattccagaaacccattcgctttcgcccagcctgactgttaattagtgcaacagctgccgcgtactgtggtgaagcgatacttgttcccgcgccatcactccacggctttttgggatacttttttgttttctgatagatccaataccccgttactgcatccgagtcagccgaaacatccggatagtttctaccataacccgttccagttacggtttgcgaaccaaataccggttgtccaagagccgatattaagttacgggccataaatgtgttaactcctggaacattcatttgataagccggtgtatcatattgatgactaaagccaccggtactcccagccgtatattctaataagcttatcggcactctttggatgatgcttgggtgttgttgcaaaatcggccaaacataatcgcttccccacgcgcgttcatgcctgttaacaattgatccaagtttggttttgatacgaaacggcaaagtcgttccgccaactgacgtaataaacggattactgtcaaagaaatccgatgagcttaacgtacgatcaaacatcaattgcttgcccttgatcgatttgatcatgtaattataagcaccggcatcaccggaagccgtgaaattagaaactccttgaatggctccctgtgctaaaacaagcgttaatagctgtcgataagccggtgttagcagacgtcggtgtctcaaaatggcaattgtcccactatccatgagtccccaactattagttgtactgctgacaacattatcgttaaatgcttgttcataaacgtcaacgaaatttgttaaagtcggatacggattattaaccaaataaaccctgacgttcgattttggcgcaaccgaacccgcatactcagcatccattgtggtttcgtcagaacttcgaacgacatctttgggacgataaagaggtgatgccacctgcttaatcattaacctgccagaattggtatcgaccttttcgtgtttccaaaagtgaaaaacgtttgattttcgaaggccttcaaaagcaataatgccagtagtttgtcctttaccagtcatcccttttctataaagcggtgcaacatgataatgattggtaaaccgactggtaaatcccaattttgcctgaccgctctttcttcgggaagttctccgaaatggcagaaatgtattcgtattaatgtaaccgcgactgtgatctgttaagcccactaccgtccaaacggttttgctcaatttccccggaatcttaggtgctttggctccgaattgaagaggatttgaatggtaccttgccgtattcaaattagtacggaacaatttatcaattctaccgactttaccagatacttgaatgataagttggtttttcaaaggtcgcgcctttaaggaatgttgctttaacagcctctgccattgagaaatagttgtctcggaagccccaaatttcgagccgaactcaccaggcgttaaataatgtttgaagtcagcatttcccggtgtactgactgccaatgcagcgtttctaatattcttgaaactatcaggcttcaaaacaatatcaaaacatgtcgtttgtgtttttttcattggcgtcggcgaaacatttttcgccgtcgtcagcatcttatacatccccggcactgaagcttgcaaaagcggggatgttgccgcctgaacttgcatattcaatatacaacaactgccaacaactgatgtaactaatcctatccacccaaatactttcttcatacctacatcgcctcgatttaatgatacctaacaataaaaatttgaaaggcataattaaaggatactccaaaaattataacatgccccatcaaaaccaacttaaagttgctactccatcatttacaataagcatagtaaaaattgtcactagtataatcattttcccggtagtcgttatcataatatattttaacttggtatgacaaacaaacatcataacaacaaatagaagtggttcaattaacccttttaccctctaccttcaacatattctaaaatatctcccggttgacaattcaaggcactgcaaattttgtctaaggtttcaaatcgaattcctctagccttaccagtttttaaaattgaaagatttgcttgagtgatacccactttcatagctaattcctttgaagacatttctttttttacaagcattaaatctaaattgactttgatcaaagaattaacctccccctagataattcggtttgcatcatcctgaagctgaactccatgtttaaaaacaatataaatcacataaaatgcaaaccaagctatgatttcaatctgtaacccaccagcatcaggtaaagcactaaaaccataagggacaatatttcgaagtaacgctccaatcccatctaatagggcaatccatccaaaagaatacataatccatttgatattttttaaattactttcaataaaagttttattagttcgcaatttatttaacaatttagtaatgaaatagacaaaaatcgtctgaaatattaataaaaagtatagtaacaatgccgttactatcccccaaacggggtgacttgatccgccaatccccgtctgttgtgcaaaagaatttatcgattcaatattaaaaataatgccgataaatttataaacaaatataaagccaccacttaataatgtaattacatagatgcctaaaattaaaagactgaaataatacagtaggcttaaaggaagcttctcactctttttaatcatataatcaccctttcaaagtaattgtagattttcaaatattgtatgtcaatattttattattgtttgacaataaataatttaagtgaaacaataactgtggaagaagtgatagatatgaaaaacatattagttgtcaacaatctaacgaaaatattcggtaataatcgtggcctgaaaaatatttctttcgaaattcccaaaggaagcattgtcggtttaattggaccaaatggtgccggaaaatcaaccattatgaagtgcatcttaggaatctatccttattctcaaggtaatattttatttgagaacaaaaacattaaatcacaaaataatcattccataaataaaaaaattggatctcttattgaaagcccatctttatatccatttttaaccggtatgcaacattttaaactttattcagtcagtaaatcaggtgcacaaaatgtgattgcccttttaaaaatggaaaactatatcaatgaaaaagttacaaattattcatatggtatgaagcaaaaattcgggattgcattagctttagttaacaatccagacctaattatcctagatgaaccaatgaatggccttgatctagcttcaaccttagagatcagaaaaatcatccttacaaaatccgcggaaggaactactttcatagtttcaagccacatcttaagtgaattagaaaaagtcgttacacatattatcttgataaaccacggcagggtggttctccaagggccgtttcaaaaattgaaaaatattggaaaacagtactacgaattgagtactagtaacaatttaaaagcaaataagattttgttaaatcataattttttgtcgaacattgaagcttctggtattcaggtacagctttcatctaaaaacttaaatgaagcactggattttcttttaagaaataatgtaaaaataattgcaataaatcatcattcagttgacttagaaactgtcgctttgcactatattcaaaataaagagggcaatcaacatgcttagattactctatcaggaatcgtttaaactgtcgcatagaaaaggtgtattttatttcacattgcttttattagcgttcatgctactaaatgtagcatctacaaaggatagcagtaaccaaagatattttatcgcaatttcattcgatgctttccaatgggtcgatattgcattgattgtagtgggtgctaacatcgtctcctctgaattcgaatacggtacaatgaaacgtttagtagccgattataataataaattttttatttatatagccaaaatgttcactttactagagtatgatattattttgcatattttagcgtttactttgactcttattttaaaaacactattttttggtaatcacaactcacttaactctatttatttgaatcaccaatcattaataaataacatcgtaaccacaacaatgagtaactttttctctacgtttttaattattgtaattgtattcatgattgctagtatgagccggactagtgccctcgccgctactataggttttggatttattatgtttgggtcaggcctctctggcatcattattcaattatgtggaaagctatttccgtggattaaatggaatcctggaaatatgtttaatatcggcaatcaacctttacttcatagtgtcgaaaaaacttctttactcacaaacccacaattaataataggaaacttagtatatattgttttattcactataatcggctattgggcatttagtagaaagagaatctaattaggtattaggaaagctctggttcacatgtttgaaacttttaaggctaagtatgaatacccttagaacaatctttgtctgtatgaagaacaagttcaaactataaattctagccttttcatatcaaaaatttaacgatttagcaaattgctgaaataattaacgattcaatctttatatataaatctttatatataattaaagcaaaccttgtaatccttaaaagagctttacgtttttaaggcagatactaaccatttaaatgagttcgtcaatatctgccattcgcatccccctaattgacttttcccctcatatagtttattctaaattaaaatttgattagtctacgaattaaaaagacgaagagaagagtaaacgttcattgcatctaagagaatcccgccggtgagaagggatatgcaggccacgttgaagatgagctctgataagtcactgtgttgttcacgcaaggcagtcggtaggaaccgttaacttcccgggtatcaatcggtaccgttgaggcattatttgtaagaatagtgtaaataagggtggtaacgcgagcattcgccccttgtttgtcgaaatgacattcaggggcggatgcttttttcgtagacttaagtcaattcataatttttaggaggatttttaaaatgacagatacagcaaccaaaatcaaatttccatatcgctacgatgtagtaggaagcctacttagaacccaagctttaaaagatgctcatgagaaattcaagaaaggcgacatcaccgctgaccaattgcagcaggttcaacacgatgaaacccgaaagatcgtaaaaaaacaggtcgaattgggcttaaaagatgtaaccgatggtgagttcaaccgctcctggtggcatttagactttttatggggccttaccggtgttggtcattacgattatcatcaaagctacaagtttcatggtagtaaaacccgaaccgacaatgcagacttggtcggccgaattgcctacaacccggaccatcctttctttgacagcttcaaatttttaaagtcaatcaccccggatggcgtcacacccaaacaaaccattccatccccttccatgctctttcgggataatcgaagcgacaactggtcaaagttctacacatcatgggaagcatacttggacgatctcgctaccgcctaccaccaaaccattcagcacttttatgatctcggctgtcgttacatccaactggacgacacaacttgggcgttcttaattacaaaattaaacgaaaccgccgacgataaagatgaacaccagcgctacgttcaaatggcagaagacgccgttcaagtcattaatcagttactcaaaggacttccggacgatttaaccgtgacaacccatatttgccgtgggaatttcaagtcaacctacctcttttccggcagctacgacgatgttgcggattaccttggccaactcaattacgacggtctctttcttgagtacgataatcagcgttctggaagctttgcgccacttgatcgaatttggaacggcaacaagaacaagcgcattgtccttggcctgatcacctccaaatcacccgaattagaggatgaagatcaaattatcaatcggattaaggaagctgaggaaaaagtgccattggataatttggctctttcaacacaatgcggttttgcatcaaccgaagaaggcaacaaacttaccgaagatcagcagtgggacaaactgcgcttggttaagcgaattgccgaaaaggtttgggatgcataaactgtccaacgactattcattagtcaatgaataaacagggtgcctgcaaagtaaatcattagttactttgcaggcaccctgtttttgacttattcctgatttttcaatgattttagtgtcaccatgacgttaaaccagccagcaaacctataaaaatacattggtttccgggatttcgcgctccggctttattattgcaaagtttgtcacgatgttattggatattttcatgcagatcgttatttttttccttgccggaattttaacgggaatggccctagggcgaaacgtcggtaccagttgggcaaacctgttcggcacaactctactgaccgcgctgatcgtggctttcttcattggcgttgtattcagcatggccattgttattttgatgctgacaggatcactaatcggcagcgccgttttcatcattatttttccgctgcttgtttcaattatcagtatgatttctaaatgggattggttaaagtatgttgatttcttcggcgtttccgtcaaaatcagcttaaagcagctctcggttagtcagtttcaaccttacatctggtttagtgtcgccattttaattatctgttttggtttatcgttgatattaatcagaagaaaggaattatagagcagaaaacgcgcaccctcattataaaagaggtgtgcgtctttttattttacaaattggcaatatcgcccataacattcactaagaaatcatcgttatccttgtctcggtttcaactgaccagcattttataatttgatcatactcaggactccgatcaatttcaatcatattttaatatgcatctctgccttgcactttttctgtcaattcactacactaattcataattatattgattatttctcgaggtgaaactaatgctggcttggattacattaaaacactgcatcatacaggtaacaacactctagtgaccgaataaaaataaaaccagacaaccttctatatacccgggttgtcaactcactggagtgtttatctaatgaaaactaattatccaactaatatcaacacaggctatgcctatacatttttttcctttttcgggattaccggtttatgggttatctacctgcagatgcaagggttaagccttgtcgaaatcggcctgtgcgaaagtatttttcacgttgccagctttttgtttgaagtgccaaccggcgttttagccgatcgtttttcctataaatccgttttaatcggcggccggatcgcatcaatcctgtccgcagtcatcatgctgacaagtcatacatttctaatgtttgctttcagctttgtgttaagtgccttatcctataacctacagtccggcacaatcgatgccctgatgtacgattcacttattgatacaaggcaaacaaaggcctatcccaaaatcatcagtaccgtcaacgtgctgtatgaatttggcgacactgccggggttgtcatcgcaggttttttcgttcattggcactttgaattgacctatgttatctctatcctgatcggattcttcgcgctcatttcaatcttaatgatgaaagaacccaacgtcacaccatcaaaggtatcagcccaagtccccgaaaccattggatcgattctaagaacttcctatcgggttcttaaaaccaatcgcgtattgagaaacctgatgttttttcaggctgtttttgccggaatttgcacctcatactatttttattttcaatcgttgatggagaaagcccatttttcgggattgatgatctcacttttaatggtgacttcagcggctgtcaatattgtcggcatccactttacccctattatccaaaaacgttttccaaaagctgttttggtcaatagcctcagttggtgcctgattgcccttttactggtcagctggcttgattggattcctatgctaatgatgctttttctcgcctcacagctcctctcatcccttgtggagccgattttcagcagctactacaacgaaatgattgattcgaagcagcgggccactctcctgagtatcgcaagcgtgctgttctcctttgcgatgatcggcctatttccacttgtcggttggctgattgagcaccataatttctcatttgcatttggaacaatcggcggcattatactaatcctatatataacaacccgtattaaaagccgaaccgttttaaagtaaccttagtaccaaactaaccaatcaaaaatcctcttccgatccatggtattcaacccaaggtatcgaaagaggattttattgtaggtgtagctcattttaaccgtttcgtgcatgaatcaatgactgacgcaacaatgcatcattgtcagccgtcagattttcaattcattatttagcgtactttgcgtaagccttgttcaagttagcttgggcagccttgtatgccttaaggtatttagccttgttggcagcagtcttggctttcttgtagttggctttagctttggctactttagccttagcattctttacagcagttgggtgttgtaaagtagccagcttagcttgggcactcttgtagctggcaaaagccttcttgtaagctttaaggtatttagccttagtagctgacttcttagctttcttgtaagctgcttggtacttcttagcagttgctttagctttagcaaccttagccttagctgatttaacggctttagcatgctttgaaacagttggtgtcttagttgaagatgatgattcagttggtgtcaaagttgatgacaaagaaactgatgttgagctgcttgaaactgctgaaccactggttgcagttgtacctgaaccactggttgcggttgcagttacgttgtcagtgttgttggtatgtaagcttgctgaagctacactgccaacggaaaagagtgtgaccgctgctgttagatatagtaaagtttttttcatgtataataccctccgagttatgttttaccaatttagtcattatctatgaccgaaacaatagttgagcggttaaaatgttcaagccctacacccttagttacatataataatatgtatttaatcttttgttaagatctattatactatttttataaaaaactttttagaattgagtgatgattgtgttttcgaagatcaaaatttggctgtcaaataaatcctacctgatactttttctattaatcagtgtctggtttatgggatttgccagctatacgtccccgctgttttattttgactattcaccggataacaactgcttttttacggttggaaaggccttggtacatggtattctgccttataaggacgtttttgaacaaaagggcccctatgtttacttaatgcacggaatcgcctacttattgagcagccgttcattactcggcatgtttccgtttgaagttctcagtttatttctttcaatgtacatagtctacaagattgcgcgtatgtatacttttcaacttgcgtcctgtgcaattgcgattttaattccttttttccagttgtttcacccatactataactatggtgatacggttgaatcacttctatttccggcaatacttggactgatctataccctgctgaaaggcgaccgaaaccactttgtcatctcccgttggctttggagccttcagggatttttggtcgggctgacatttttcatgaaatacaccctgcttggcggctggatcatcttctacctggcaatgtttgcttattatcttaagcacaagtcatggaaagaagtctccaaaatgattcgttggagtttgctcggtttcttagtggcgattgtgccatggctgattttctttttggctacccattcattatccgcctttttccacgtttatttttatgagaatatgcatatctacatgttatccgacaactcggtcttcgctaaattcattgagtccttaacgatttacagtagttttcttcgtcaggatcccctgatttttgtgtgtggctttatcggatacatctatttgctattcagcaagtccgctttcaaaaccacctggggaaaaatgttattcgttatgatgatggtcgttaacgctgcttttatcgtctatggctaccatcctggccaggtttaccaatattatgaattggccttcttcccatacttggtcattccgagtgtttttgcgttcgtcaacgccattaaaaaattcgatgtgaaaattaacgaccaaaacgaatcaatcgtccttttaagttgcgcactgctaagctttttcttagttttaggggttaacgataatattttaagttccaaaatttttcccaataacggctccgtaacactcaatcaaaccaacaaaccacaacagcccgcacaagtcgaattcggcaacattatgcgtgcacagagtaacggtcgcccaaccatgctgaattacggatcaatcgatatgggcttctacacaacttccggagcattgccaagcacctactatttccaaaactataatatcgagcatgacaaggcaccccaaattttaaatggccagttggatgtcattaaaaagcataaggtccagtggattgtcttgaatacgccggcaggtattcaaatcaataaatggaatggctacaccggtgcacaaggtaaaattacaagtggcaacctaaatcccggcactaaaaagatatccaaaatacttttcaaacactacaggatcgttaccaatcacacacaaaattttgaaagtgccaatgtgacctactggttacttaaacgaaaagattaaccatttgaaaggaatgatagcttgaaaaacaacacgcaacaaacgaattcaacctcaaatctgttctctatcaaatcttttttcataaataattggctgattctcagttcttttatcctttttagcattttcaatgtcattatatttcttaggtatggatggctttttggtgctcaggatcttcaattccacttacaacgaattgaagagctctatcaaaatagtcaacatctcaatttctttccatcaattgcaaccttcacttttaatcaaaacggttcagccgtgatgagtatgtatcccaaattaccgctatacttatttgtggcctgccgactgattattcaacagccgatcattagttattatgtcggcattattttaatgacatttatcggcatggttgttgcctacttttgttacctctcagtcgaacggggaaagaaaatcggcgcatatatttttgcaattatctatatgatgtcagggctcatcgttaactataacttttatatgggcgatatcggaattagttttagcctcatttttctaccattagcatttactggactatttcactggataagtaccggtaaatataagatgttaacacttggcatttctttgatttgtttaagtcacgtattgaacgtcatttttgtcatcgttacaatgattatttttacccttattaatattcaaaagttatcaaaagcaaaaattgtcaatcttttaaaatcgatcggcattactatccttataacatccagtttctggttacctgctttaagttttggaacaagcacaaaaatggttaaaccttataatgcattgttgcaaggcattaacattcctgattacctgcttcgaagtttatctaacaatgtcacatatggcatcacattttttgctgtccttggacttgttttgggaagtatctattaccgtcgtctaccaacttatattcgtcaagccctttgggtcgcaattggctatttcctgatcagcagcaatttatttccttggaaaatatttcagcataccggcttccgactcattcaatttccttggcgcttgttaatatttacccaactatttctagtcttcatttttagctatttaatcagtaggttgttagaacaaagctcccataagcagattaatgggcttataactgccatgttaataatcgtcacagtcgcattatctttgaacacgcaacaacgacatttaaaatttgaattgggcgccccagaaattagtgcccctctggatgaaaactatggcataggctttaaaaatacagtagcttggtacaaaattaccaataaatatgaatatcatcatttaatggcttttaatagtacaggagattatttacctcaaaatgccttcactgtttttaaacaaattgccagtaaatcgcattttgcagcactacattctccagatggtttgcttcctacaacactcaaatccggagcggaccagtctaccatctcatttcagacaagccaaattacaaacaaaattgaactccctttcgtcatctacaaccaccattaccaaataaaattagacagcaaaaaaatcccgctcaacatcagtaagcatcaacttctgctgataaaaaacgttaaagccggaactcatactgttcatgttcaatacaagaataacgcaataaccattgccgttgctttaatgacagtggcaggactcattgctattatctatgttccaaaaaaacatcactcagtttagttgctatttttcccgcaatgcttttaactgatttaaaccagtaataattgattgcttggagaagttcccttcaactaattgatcatcactgtattcattcagctccgaataaaaccagataccaagcttcataaattgggcttcggtcatggcatattgtaaactcagtaatcgttttgccgcatcagcgtactgttttttatcaatcagctcctgcagctcattttgatagggcagtttctgttcctgtttttcggggaaaacaatttccgcttccgattggccgccctttccgtgtgacaaaatatatccaagcccttcagcgaatgcccgaatttgacgaagaataaaatcattttcatctcgcactttgatccctcatttcagcttaagtccttatatatagataatcttctcaatctcctacgaataattattcagcttcaactataaggataccatatataatgcacattaattgccttctacttctatctgaattatgataaagttagcgattgtgaattaggtaatttagcaactaatagagtggatgatgtgatgacttttaatcataatttttataaaacgtttccgttctggtgcggtctcgttattctaagtaatctcttattgatgagcgattgtccggtattcggtgcattttggtggtatcacgttatttgcacattgattggttttatcatgattttgtattcatttgttgcttccagttctgaatgacagttaagcttttctctttgatatagacattcaattgtatattattcatcgacgaataaagggatcgaatcaaaagtaccgactgatttgatccctttgatttcggccaattttctaatcttccattaagcttatcctttgaattagcaaagtagttcatttattcatggattatgttatataatgacggtgtttgctacatccaattcagaaaggattttgttgatgagaaaacgcatttttacggtcgtcggattggggctcttagccaccataaccggttttataacagaacagcctgttcaggctaaaagtcaaaacagctatcaagtcgttaaatcaaaggattactcccacgtttatagcgataaaaaacacgccgttcgcttaccattccatgccaaaacaactcatacggcctatatgtggaatgcccatcatacaaagaaactgcataaccttaaaaattaccaggcaacgacctggtttcttgctaaaagcgtggtattaaaacacggcaatcataaacgtgtttattatcaagtcaagaatactactcaatccatgagcggatatgtttggaagggctatttagccaaaggatacagtcccaagggttatcaaatcgtccaacaaaaatgggccaaccaatccggttcctattacccaagatattacggtcaggatgtcaaaatgtggaattataatcacagcaaggttcgggttcatttaaagaactttccgggaatgaattggtatcgaaccgaaacggttgtgatgcgccacggcaataagcgggctatctattattacctgagtggtaccctcagagggaacggtcgaacagtcggcgggtatgtttggcgcggttatttaaaacgcggtatcaatccaaaccacaccggtcaaaattacgttcccattgatgatttcttgggcgatacagactataaccagtacgttcaaactgctaaataccaaaaactggccaaacagattgcggctttatttccatacagcaaaatcgactatggcctgtcaagaatcgccgcttacaattacgatgctgccaatcaatccattatgagtgacgaagatgttaaaccgatcggaacgggtggttatagtaacattaaggcattcccggacattgaccgatacctgctaaaacactcgtcatggtcggatgctaaaaaactcaatgccgttaaaaccatgctcgacgaagctggttatgattcagataaacgagtctcaatggccggttatcaaatcggcattcaaatcattgataacatccccgacattttaggccaaatcgttgccagtgatggcaatggctatgccaacggatatgcgatcgtcatcggtcagcaggatccgaccggtaattcggaaaataacgacaaatcatttttctactacgattaagacccataaaacagctttcgacaatgcttaaaggcgttgtcggaagctgtttttgtatgataacatcattttaatcagctaatccacttagaaacacttggccaactgcttgaattaataatcactcttggcgtttgttttaagtcactgtgatcagtcacaataccattgtttaacgtcaaaatagcttttaaaccgggacggtcggcgagaaacttttgaatttgcggtgtcccactaccatatggatatgtgaagatcggcgattgataaccaactttttgtttgaggacagtttgactaacggcgtagtcccgcttaaatcgaacaaagttacttgggatattgaatacaggtgtgccatggtcaaccagataatgcattcgatttgtatgaacggcgaacgtcaccaattttccagcgcgtttcctcattcttaaaatggccggccaggttgccagcttggtaccagatttgtaccaaccggtatttcccgtaataatggaatccgtaaagggatagtggtgcttctgcaaaaccggaaacgcattgtcaatcatcgtacggtcaatatcatcaaacgttaaaacaacgtatttcccgtgaattggctgatgcgtatccattattttaattaattttggtaatgaaatgactttaatatggtttgcctgcagcgcattcatttggcgcttaaatgccggcagattaacgttaaaatcatggaactggctgttaggcgagacgttctcatcaaatttaaccatatcattattgtttaatacccggtggtagcaaaaaaccatcacaccgtttttaatgtgctgatcccgagcagaaatggcataactcggtcgatttcccaattcgtatttgatattgtgatgaacgctgatcgccaaggcaattaggaaaaggacaatcacgctgcttaaaataattttacgggttgttttattcacgatctttcgcctgccgtttcagttttctaattcgcagccatccaaaaataatcatcagactggcaatcactacaaccagcaacgcaaatatggcatatgaacgaaacgataaatttaaaaccagataatccgaaaccagcgcgtctgaatagacatttaaaagaaaacaaatattgatatacacaatatatccggtgcccatccaaaggccaattaaaataatggctcttcgaagcatcgttaacagcgatgacctttttcgaataatcagcttggaaggttgtcttttcttcatcatcaaagcccccgatccggactacgccagctgccaacatgcttggggtccaaaaagaacgacccgagtgccgtcaaacaactaattaaattaatgaaccagtagaaaacaacgtatagcggcaataacagcaaatcctgccaactgatgaaatccgatttttttgaatcagtgtatccaataataaattgcaccaaactgattaataataacagaaataaaataacaccatccataatcagatcaccggtaaacgcgaccatcatcaggtaaaagagtgttacaaaggcacagctgattgcccacaaatcgcttaaaatcatatccagcaatagccactgctcgcttaaacggccggtgaccagcatcccccgatttctaaacaacacttcaaagccaccgcgtgcccagcgccgtctctgatgaaccaaatctttaatatgttccggcaccaaaatccacgcaaccgactgtgggcaataaacgacctgccattgatggtggtatagacgccacgtcacgtcaatgtcttcggtaatcgcatcggtattccaccacccaacatcggctaacgcttcttttcgataggcaaccactactccggaaacagtggtgatatgcccggtcacgaacgcctgtccacgcttaataatatcaataacacccacgtattccaataattcgagccgacccaggatactggtccgatttctgacaatcggttttccaccaacggcaccgacacgtggattgttatagaattgtgccagcattggctccaatacatgacgatcaacatagcaatctgcatccaggcaaagcagaaatttaccatgtgcaatttgagcgccctgattaagtgcgtttgctttccctttatttggttgtacatcaacgattttaatcggaaactgctgtttgtatttttgaactaagcgacgcataaccgaaagcgttgcatcctgactgccgtcattgatcaaaatcaactcgatctttgaatacgtcatgtcagctaccgacaccacaacgttttccaacgtatcagcttcattatgagccggaatcaggacggaaactaaatcggcaggcttgccttcatgcagattaataagtggtacttgccggcgctgaattgaaaagaacaccgacccaatgatccaaaccattgatacgatgaccggatacaaaatcacaaatgaactaagcgtacgcatagtcttcccttcccctctaagcacgatatttccctcaaatatcgtttataatgactttcgtgtaagcaccagaaagttcttaatgaagcttttccctgcttgataaatttgctgatcagacacgtttccggctgaatcagcccagaaagaaacactgctgccaacaattcccttaagcgattttaagtgggtggcatcatcattgtgccacagtgttggtttccaatatcgcttcatgtcgctactcatgtacgaaacattgctctttgaaagattcttcttggaaatattaaaatataagtagtaatcattgtagttaaagactttaaagtgatgacgaatcaaattcggcatcgaggaccaggcttttcttctggcggcacccaattttccgtattgatcagcggtccaattccagtaagtgacttgaatatgatgattcaacgcagtcaaactgctgtttaggaaaccgtcattccaagcttccggaataaacccaagtttttgaatagttgcactggtcgcgtttaggtagttaatgtaagctgaattcttggttaatttatcagtaaattcatccccgcccaagtgaaaccgggcatctttttgtcccgcaaaatccgcggcaacttcagtatcgactttttcaacgaacttaatgctggctttacttaaatgtaattcgtcaccataactatcggaatgccaactcaatgctttaaccagctttgattgaccggctgcctttagtgtattcacaagaccggttacgtgagcaggtgtatcaatttccggaatcaatgtgacgttatattttttggcgttattaaccaaaaagtgaatttgctgccgactgtaaaacgcctgatgcgtttttttatttcgccaaataccgccttgttcaacagcccggtccctcgtctgaccgacaacctgattttcaatggcaaaatccttgtcatcactaagatgaagctgaataaattgaccgtggttcgtactaaccaacttgataaatttaactaacgtggccacccgataatgatgccgggatacatccagtgtgacaccattaaaccggccgtattggctttgagttgatttttgagtcgtttttgtcgttaaactacaccccattaacaaaataaccaacggcatcaataacaaccagcgtttatgcatatgatctcccccctaaaaacctttttaacgtatgtaataatcgacttttaaagtcaaatctatactagcaaagataactcaaaatggtattaacgtgacttgtgaatgatgaatcgttaactatctttaagaacttgatttaaaaccaccatttttcagccgtaatgatgaccacctctgccaaagaatcgcgttataatgaaatagcatttattttcagaaaaaagctattttgaaaacaaggaagtgatcctgtggcacttggtcaactgactaatcaaattgttctgatgtttgttttaatgcttgtcggcgttttgattaacaaactcgggtttatgcaggcccaaacatcaaatgatctgactaatattctgctttacatcgtttcgccctgtttaatcatcggggctttcgaacaacactattccgctagtcgcatgcagcagttaatgctggtttgtgttggcatttttattttctacataattgaaatttttatttcaaagattgcgtttggtaggaccagcaacatcaacttacgcagaatcacccaatatggcagtatttattccaatgcaggatttatgggtgtgccactaaccagtgctttatttgggaacaatggcgtcttttttgcggttgcttcactagccggttttaacatttttagttggacacacggtgtgtcgttattcaaaaccggtaagaaaacgaccgaccgttggcaaaattttcgggaaattattttgaatccaaatattgtcgctatttttgtcgggctactctttttcgtgacctcctttcaattacccggtccggcaaatgaagtagtcaaatacattagttccatcaacacaccattatcaatgatcgttatcggcaacagcttgggcaatattaaaatcaatcgtcaattagttgattggcacctatggctggcacttttctttagaaacgtcctgtttccaatgattgccattatggttctccaagtactaaccgtttccggcgttgctttatacacgaccgttctgatggccgcctgtcccgctgccggcctggtggttttattcaccctgcaggcgtacggagatacaagcccggcggttgcgctaatgagtttatcgacaattttaagtcttgtgacaattccgttggtattcgctttgatgaaaatatagtttttctttttcctgtcgtgacaaaacagatggcaaacaaaaaatggcaaccaatcaaggccgtcatttttgtttttatcagctattttattaatctgtttccactataacagtgactcgccacgattataattagcccgtctttcacttcccggcatcatattgccaccggttgcccaaacaatgtgtgtggcgttttcactgttaaacgccggaacattgttaatgacgggtgcgatcgccgtaaagccggccgccgctgaaggttccacggtgatttgctgtgaatccatcagctgggcgacgttgcggtaaatctcatcatcctgaaaggtcacactgccaaatagcagtgtccgcatcacctttccggctaatcgggatggtcgcccgactgccagaccgtctgctgccgtcaatccatccagaccgatgtcgtaaacggaaatttgattattcaacccggtcatcatccccaaagtcacggacggtacatgggttggctcacaaaagactgcatgaatatatggcccgataatggtttttaggccaaaagccacgccactggggcttccgccaacgcccgccggtaaataaaccagaaccgggtgtttacggtcaacgctgatatgctgcttctttagctggttttgcaaacgaacagccgcaaccgcatatcccaaaaataagtcagaagagccttcatcatccacaaaatggatattgggatccaggcttgcatcctttctggcttgtgggataacatgcgaaaaatcggtattgaattccttaacagtgacaccgttggctcgcaacttgtcctttttccattgacgcgcgtcgtgagacatgtaaacagtggttttaaatccaaacgttgctgcaacaatcccaacgcttagtgccaagttaccggttgacgccacaataacaccgtagttcgagaagattcttcgatatctgtcagttgctaaaacccggtaatcatccatataaaccaggtctgattgtgtcattgccacatgttccgcaaatttaagcacttcataaattccgccacgggatttaattgatcccgaaattggcagttgactgtctgcttttaaaaacaactttccggtcaaattttgataatacattttattccacgaatcctgcatctgatccagtttaattaatggtgattcaataataccgttcatacctgctgtttcaggaaacgctgtggccaagtacggcgcaaaacgttcccagcgagcgacggcatcaaatatatccgcttttgaaaagggtaattcggtttgctgaccgtaatccggattgcgccaaaatatcggttgttccgccatcagatcttttacttgcgggtactctgtaatcaacgacgtatcgtccatgcccatcagtcctctcagtttattttcaaggatagtataagacaaaacgttgatgttagattttgtgacgttaatcttttaaaaaggcttaatcatggtatcaacgtggtgtcagtcatcaaagagacgtttggcatgatgtgaatccctgttaaagcttcccgtccatataaagtatccgcataaaaagttgatcgagtagtcaatcccaagtaccatgatgactggattaaaattgattgtccatgcgtacgctctctcaaaagcatcatattcactaaagaagttgatcctgcttaatataagcatctactaaactagtagcaccctcttttttgaggaactcagaaggtgaaccggaaaattgaatttgacctgccttcagaaacaaaagatggtagtcatcattattaatattttgaaactgatgagaggtcataatcacttttttgccccgttgattaatcccttgaatcttctgcatgacctgctttgccgtttttggatcaagcccactttccggttcatcaaataaatataactctcggtcaagccgtgaaattgcatcaatcatgactaatcggcgctgacctccggaaagctcgccatacttaatatcggcaatcgtttttaactctgccggtaaatcagtatgtcgaaacttccccttaaagccactgacccccataaccatcttcattgtctgaaaaacagttgcttcgtaaataaacggcacactctgtggctgatatgcaatcctggcaaaattaggaaagccgtgaaaataagtcggttcccgtttattaacggtcgaaataaaatccaacagggtcgttttccccactccattcggccccaataagacattgactttgtcgtcaagaaaatcagcatttaatgactggaataatgatctgccactcgacagtccgtatgtaaaatcttttatttccatttttcctccggttaacgattcgttcttgatgccagactcattttagaaataatcacattgcctaaaatgatgtaggccaccccaacgatggttaataacaaaacgataaatacgacatgtggatgataaacaaaaagcgaataggtgttctgctgaaaatcaacagggttaatgatcgtcaccattgtgtttaatactggtgatttaaaataaaccgctcccaacgacaatgttgcaaaaatatatccggttagataaatcgttaatgtttttgattttatcggaagtaccaaaataatgcttgtaaagaaagaaataatcggaataagaacgaagttgagcagccaacaaacaccgatcaggctcaacaccctggttgatggtcgataaataataattgccaacagatcaaacagtgcaacttcaatttgcaaaataaccatttgtgggattaagttggcgtaataaatcaaccgtttatcaccggaaataaatgtatacatcttcaagaaattattctcccgcatctgaaacatcgtaattgtaatttgattaaggacacctactatcataatgtatgaccagaacccgaagagattattaaccatatcagtgtttgatgtggtacgccctgctgcaaagtcattccaggacatcaccagaaagtacgccgctggaaacatgagtgtgtacaagaagacaactttatcttctaatgccagtcgaagttcaaattcaataaggctaactaatttacgaaacacttgtaccacctcttaggttgcattttcttataatattaaaaggtagtgagaataattgcaaggtgacaattgtcataacttaagtgaatcaaacaaaataggaatggcttttcgtcattcccaatcaaattagtcttattttttagttgcttcaataacgtaacttgccatccaaggtccggtccaccaaccgttaaaacccgtattttcacttgaaacatcagaaaactcagaactttttttcaaaaaattgatatattgcgttttgtgatgacccgtatcgacaataatcaactttccacccggctttaaaacgcgatgtgcttcgcttaaagcttcaaaccgttttttattcggcttaatattatgaaaggcaaagctggaagtcactaaatcaaaacgatcatcctcaaaaggcagctttgccatatcagccgtaacaagttcagtgtggtcggcaactttggcaatttccaaatttcttttggtctcctctaacgaattatgagactgatcggcatttttccacaaatcaacacccactgcttttccaaatggtcccaagagcttcgaaagagcaatcaaaacagcaccgtgaccgcatcccagatccaaaaccgttgcgtcatccgaaatatcggttttggctaagatcttatcccaaataataaatttcccccgaaatgacgtatggaaaaaaatgaggcctccggcaatcaaaagcaacgcgtacagtaatacaaacccggcagccgcatattgatggaagaagacccaattaattaaaatgcccagaccaattactaaataagaaatgggaacgagcggcgcatccaatccgtaatgaacttttttcatcattatcctccaatatatagttggacttatattagcatataatcaatttattgcaaaaccggcaaccaggttaacaaactgtttgtaaacctagggcatcatcagttttcaaccgttccgtatcagctttagtcaataaatgatcaatagttgtaacagattcaggtaagaactgtgattaaatcaattttttaaacgtcattatccatctcgaatgccattacacgactcttaatgatttatcggcgcctcaccgtcattggaaaaccggttcgtgctcgattgtgaacctgtttgtgcacctgtttacaccgcgattgcagtcattaatccggttgggttgaatcggatgataccccaactaccttcaatcaggcgcatgatatgagtggtactgtttcagtgattcaacagaccgccagctgtttaatcatatgcctgataccaaagtcccattccatttcgcaactcttgggaaacgcctcccttcgtgaactactcggttatgaatgaccgagcttctgggaacacgaagtagtatttaggctgttacatcggtatgccgaaaacctaacttacagaactccgctcttttaccacggctagttcctagccaatagcttttagtccgcaattaaggatattaactgccgcattaatatctcggtcgtgatgcgtccagcatttagaacacgtccattcccgaatagctaagggcttggggccgtcatcctgaccgcacgctgaacagattcgggaagtattcctggcgcttaccactactaattgcttaccataccaggcacacttgtattcaagcatagtccggaattgagaccaactggcgttcgcaattgacttggcgaggtggtgattgcgcatcagattcttggttttcaaatcctcaatcacaatcacatcatagtttttaactaagtccgtcgtcagtttatgcaggtagtccttgcgctggttggcaattttagcttgataacgcgctttggtcattttagcccgttgccaattttgataatcgttgagtgccattttggataattgatggtggtgattccattggcgcatcgcgacagttgcccgctgcttgcgccgactaaacttcgattgccaacgcgtcgcttgcttttcgaaccacttagccttgaaagtcccgtacttaactccattggaagtaatcgctaaatcggcaacgcccatatccaagccaaccctctggttggttttcggcaagtcgtgaacttcggtttcgacctgtaaggaaaggtagtagcggcccgtggcatcatgactcaccgtgtaacgcttaattttgacgtcggttaattggttagtcttgctggtccgaatactcccgagtttaggcaatcttaaacgccgcttagcttccacaacgcagattgattgcccggtgtaggcttgcttagcgctatggcgggacttgaaccgcggatgaccaccccgatgttgaaacaagttcttaaacgcaagcgtgaggttatggttaaccacaaataagctggtagagtcactggctttgaggaaggggtactcttgcttaagccgtttaagcagataattcatatcgtattcgccaacaaactgacttttcgggttgttttcataacgtttattagccatcgctaacatttgattccaaacaaaccgctcgttgccaaatagttgccataattgatcgatttgtgcctggttagggtataaccgtagcttaaaccctttaaccactttggtcactgggatgcctcctctctttattgttctctctctggtgccaatgtttttaacatcaccactcgttgaccaccagcgacgatcctttggttgccaatcactagtcggtagctcctaaacactgacagaattcataccgtttaggcacgcttactagtagctggacctaatcagcttgaccaatcttcagatgaacaattccaaaaccgggttcatcggcgggtttcgtcaaccaggcgtttgaaaactttctcaacgggcttggttaaagtctagttccccatgtgtaatgataattcgcgttatgaaacgaagtttggtcatacgttaattgattcgtacttcttacaataaatattatagcatattaagagtgctactgtatacgtagattcataaaaacaaggaaatttattggcaggtaattatcgtttattagccgtaaaaacgggggcaattcatcacgtccttaaaagaacgtgttttctttccctatctcataaaaaaccaaagcacattttaattgttaataaatatgtaagcgattacaatatggctgtagagacagttagtcactagacacggaaaggacgtgttcggtatggcaagattcgataataaagttgccatcgtaacaggtggcgcatccggtatcggtttggaaaccgtcaaattattcttaaacgaaggtgccaaggtcgttattggtgacttttcagataagggcgacgacgttgttgccggcctaaatgcaggtggtaacgccttattcgttaaaaccaatgtgaccaacgaagacgacgttaagaacctaatcaataaaacagttgatgcattcggtcatttggatattatgtttgccaacgccggtattgcaaacgacgctaacattacagaattgccactggataaatggcaaaataccatcaacattaatttaaccggtgttttcctttcagataagtacgctttggaacaaatgctcaaacaaggaaccggtggcgccattgtcaatgcgggttctattcacagtctggttgggcttcctaacgtaacggcctatggcgcagctaagggtggcgttaagattctcactcaaacattggctgcaacctatgcaaagcagggtatccgggttaatgcaatcgcccctggatacattgacaccccgctgctgagcaaaatcaaccccggactaaaggaaaaattggcgcagcttcacccactcggacgtttaggaaaacctgaagaaattgccaaagctgtggcgttcctggcaagtgacgatgcatcgtttgtgatcggtgcaacgttggtagcggatggcggctatacgtcagtataggaactgagtttcataagaaacctatcacggcacaaacatttcaatcaggtaaatatgacgacagggaaagaccgagacacatattctatttgtgtctcggccttttactatatcaaaaacactcttccaccccaaaaggctcgacgtctctcaacgagcgtgataatgttatctataaccatttctatttaaggaagtgaaatcaaatcaaagcactttatttcgaccgtttcggcggtcccgaagtcttacagtacgggactttgccagacccgtctttatcagataacgatgtcttggttaaaatgtcctatataggccttaatttcgctgacatttatcgaagaaagggaacctatcatatcgaaaaaagagtctcatccccttacatcgatggctacgaaggactgggaatggtgattgcagttggtaaaaaggttacaaagcatcagcttggagaaaaggtctttttcgtagatgtaccgtttgcgaacgctgaattagtggcagttccggaagatcatgccattgaagtcccaagcgatctcgataataaagtaatcgcgtgtgcaggattgcagggactgaccgccgactttctggctcatgatttgggcaggaatcgaccgggacaaaacgtttttatccatggcattagtggtggagtcggccaaattttatcgcagatgctcacagcagatggtatcaacgtttatggtgtgacttcaactaaggcaaaacaaaaaatcgcacttaatcagggggccaaagccgtttttctcagaacggatccctggcttcagaattggctcgaaagattcgataccgtttatgatggcgttggcattactttggagcaaagtattgaattacttaaacatcgcggaaatttggttttctttggcatggcaggcggtaatcctccaagagtcgatttggtgacgttattatctcaatccaaaagcatcttaaccggcgatctgtgggattatctaaccgattattgggaaagaattgcacgcagtaaacgcctattcaactactttaccgatgaaaaaatcaaagtcagtgaacccacggttttccctttgaaagacggtattcttgcccacaagttactggaatcaggaaataatgttggaaaaattttgttaaaaccttaattaagcagcttggcattatcattaatgcaagccgttttttatttcaaatatattcttgacatgttttaaaagaactttattataataactatggtcaaatataatgaacaccgtcattataattgttaaaattttataacacttaaacgacttttgttcatctaggacatagctttttagcaattcatttgacaagcacacataaaccaactaccttgcaattagcagcaatcctgttaataactgcttatcatccatcattaaccacagaaggggtttaaaaattgagtcttgcaatcgacatttttatcacactctatgctctactcaccatggctgcagccattgcacatcttctcagtaaagacatctcgattaccctcattgttgggttatttctatccgctttcattactttgaccagtttgatgatttcttccaggttgctttcacttgataccctcttactcggattgcttggtatttcagtttttacactggcaaatggctaccatctttatggtcgaccacactggtcacatcatctgattcgattagtggtccacattgccatcttcgtcattgcactcatgacatggtagaaccaccagaaccaacctgattcaaagatccattgtcaagttgcgtggttcaaataatgagtgttatcctgttttatagtgacatatattctgatggggaactttaaatcatttgatgaaaggagcttcctcttgaagattcaatggcgctacggcttgattaacaatgcctatttgcttgtcactattgccaccgggtcacttatttatccattgtcagacaagggactttggtttcttctaaccattcttatcctatttatcatttcatggttaacctatagtttgatatttcagcggtcatatttaagacaacatcctgaagataaagcaagtcaccatcaattgagaggtcttggtatgatcatgaccgtcattgtcactctcttagcattactgttgatgttaacaaccaatgcgtcaacattaaccttctgctggatcattttcacattgccatttattagggattgcttatcggtcctaaaaacagattaacgtttagcatgtattttagaaagaagtcgacttatttttatgaagattgaatggcgttacagcctggttaacaacctgccgcttattgcattgtggcttacttttttggcatttaacggattaagtccccggggatgggatcgggtttcggttccgctcgttgttcttggtggattttggttggtttattacctgttatttgagcgatcatactttaaacggcatccggagcaacgaccgggaaaccacgttatttccgggcttggctggattatgacctttttaattgtcatgattgccgttatcgtattacttaagtttaacaattcaatgatcgcaagccctgccattttactgggtggctttgctttaatcagtctgatacgggattcgttatccgtcaaaaagctttcagttgaaaaataatatagcagctaaacactgcaaaatagcctatggtcgattcaagttgaccataggctattaatttaacggctatattctctgaaacaacggtaacttctccaaataaagaatgtcgtcacgtttggcggcgtccccttctgccaaaatagcacatttaaccaaaatggttgcgcctgcttttttaagaagcttctcagcagcttcaagcgagccgccggttgaaataacatcatcaactaacacaacccgtttgccacgaagataatcggcatcatgaccatccagtaccaggttctgctgacttgcagtcgtgattgaatcgacggaaacttcaagcggtgacgccatataagccttgacactttttcgtaacacgatgaacttggggtgatcactcacccggctcaactcctctgccaacggaattcccttgctctccagcgtaacgatacagtcaaacggttccgaaatcttgtctgccaatttagctgccgcataatgggccaactcggaatcccccaacaggacgaacgacgcaatcgcagtcgtttcattaattgggataatcggtaatgttcgttttagttttccaatagttaattcgtatgtttgttgcatcatttagacccccaagccaatcaacggcaaaacaaatttcaacacggcacctgtcatcaacccggcaaacgggtcaatgatcgctgtcacaaccaacgtcaacgctgctataacactatctgaaccctgcatggcagccgcagcattttcaggaaaaataacaaccgctcccaaaatcagcaggaaaccggcaattgatgccgccggcacatacttacctattttaggcagccaaccggcaaataaaataacggccatgattaacatcatcatcacacctgcgataacaggttcgggtgcgctggcagtcgcggaaataatcgtttcaaccggcgctccgcccagtaaactggttcccatatccgcaaatgcctgtgtaccggtcaacaaattcaagttaaccggatttggcttaatccccgtcatctgaccggtaattaggccatacgaaatattggcgccaacattcaaacaagccagactcaatgcccctcgaaccactcgagggttcaaaatcggttttaaaaaccggaatctgcgttcaacgacgtttgccggcaattctgcccgataatggataccgaaaacagccgctaaacttgacccaatcaccgaaagggcaattgtccagaccaaatctttagtgaacaaataagtcaaaatggcaatcgcaatggatgacaatccagcgacccgttcctttcgagccatattaacagcgatcttagccaacatgataccaacacctgccatcatcccagccataatactgctcccaagtacgtccacgatttttgttaaggtaccggttaccccaataaccgccataatcaatgatccgccaaagataatcgaggtacgttcacgggttgtctcacccaaatttcccgttaatgccaaagactccgcttgaaacgaaatgggtgcgaccgagccgaacgctccgttaactgctgaagcaaaaacaaacgaaaacgttgtgggaaaaaccgcaaatcccaaagtcatcgccataattccctgaggaatgccgtttagcaccacaccaattgcggcgagaaaatctgccagccaatgcatcgaattcatcctcctaaatgcgaataattattgtgtttgtttacatatagttcgtttatatctattataataacttatttcaaggctataatccaactatttttagtaaagcatgaacttttctcccgatatcctttttaaagttcggtcatttaaccatgtccacaaaaagatcccagtccatccccatatcccatgtagcacgatcatctgattagggttaccataagcatatattcaattagcaagcacattaccaaggaagggacgacttaaatgaaagaataccgaaacaaatacttcgacggcgaacggccgctctttgccgaacatgatgccaatattatcgggacaacgttcggtaaaggtgaatccccacttaaagaaagtcgcaatattaaccttaaagatgtcatttttaaatggaaatacccactctggtacacgagccacgccaaagtcgaccatactattttggaaaaaatcgctcatgccggtatctggtacacacacgatatcaaaatgaccaactgttcaattcaggcaaccaaaacttttcggcgcagcagtcacattaaattagtcgatgatcatttttcaaacgctgccgaaaccctttggaactgcgatcacattacgatcgaccacgttcaggccaatgggagttattttgggatgaacagcagtgatatctatattgatcacctcgatcttattggcaactactgttttgacggcgcaaaaaacgttgaagttcatcattctaccctggtttcaaaagacgcattttggaactgtgaaaacgtcacggtttatgattctgtcattaatggtgaatatttagggtggaacacgaagaatctgacactgatcaactgtacaatcgaaagtgatcagggcttgtgctacattgatcacttgaccatgcgcaactgtcgtttgatggaaaccgatctggccttcgagtattgttccaacatcgatgcagaaatcaactcaactatcgtgagtgttaaaaatccaatcagtggtaaaattcacgcacactcaattggagaaatcattatggatccaaccaaaatcgatccaagtaaaacaaccatcacaaccgacactaaaatcacaaaaaggaagtcagcataatgtatgattttaaatcaattatcccccgccgtaacaccgattcggtcaaatgggacgtcaaacccaacgaattgccgatgtgggtagccgacatggatttcaaggcagcgccggaaatcattgatgccatgcagaagaaggttgcttttggtatttttggttatgaagaaccccatgctgactatttcaatgccgttgccgactggtacgctaccgaacaccacgcccggcccaaaacggcgtggatgctattctgtacaggtgtcgtcccatctatttcatcaactgttcgccgtgtcagtaacgtcggtgataacgttgttgtccaagcaccggtttataatattttctacaattcaattattaataacggccgtcacattctatcaagcgacttgctttatgattccgccaaccaccaatacagcattaattggcaggatctggaagccaagttggctgaaccgttaagtaccatgatgattctatgtaatccccataatccggtcggcaaagtctggtcccgagatgaactgattaaaatcagcaggctttgtatgaaataccacgtcacgttattcagtgatgaaattcatggtgacttggtgtgcggcagccctgaatacacccctattttctctttgccggatgatttgattcagaataccattgtcagcgtttctccaagcaaaacgttcaacgtggccgcactgcacgcagctaccctcattgtccccaacgaaggactgcgaaacattgtcaatcgtggtatcaacaccgatgaacttggtgagcccaacttattggcaatccccggtaccattgccgcttatacaaagggacatcaatggttggccgaattgaaacagcagcttacccgaaatcgcgatatttttacaaattattgtgaacagttcataccgcagatcaaagtgattgcgtcgaatgcgacttatttggtttggatagactgtagtactattacccgagactcatcccaactggaagactttatccgtcaggacaccggtctctatatttctgccggctctgtgtatggcggcaacggcaatcaattcttaagagttaatattgcctgccccgaaacaacgcttcaggatggtttaaaacgtcttaaaaagggaattgaaacgtatatcaatcagaaataagtaaaatcactcataaccggaaggggctgagacaaaagtcattttgtccagtcctttttaatttcatcacgatgatgaccgagcaaaaatagctatgcaattttcccgtcattcttatccaatagcgcttatttttgccttgtttccttccgaaaaaatcggtaagatggatgttgcacggatttagttaaatcaatcattttgattgacacggtaaacaaaacaatccgttggctacaccagatatcgttgtggtcaacccattgaaaacacaatacttatggaaaatccattaaataacagatagttgttttaagacaacggagcgttaaatttttttcgatggccgtcagcccttgccagtacaaggctggcgcactcatctgctgaatttctccggacacaatatattgattatcctctctcgtcgagatactatatatagtgttaactcgaacgaaatacgagaatcaagagtacgggaggaatcgttatgcaagcaatgaaactttcatcagtttcactctctgatgaatttataaaccaaattaaaaacgaagtcacaccgcactggggcgaactaggctgggttacatacaaaagaacttatgctcgttggatcccagaaaagcagcggacagaaaattgggacgagacggttaaacgggtagttgaaggaaacatcaaccttgacccgcgtctccaccaaaacaatgttgatccacaagtgatcagcgaattaaccgatgaagccaagaagctttataaattgatttacggattggccgcaacaccttcgggccgtaatctttggatttcaggtacaccttatgaagcacgtaacggtgacgcattaaataactgttggttcattgctgtacggccacagccatacggtgacagccacatcgtgcccgaataccttaaaaaggatcaaccagctgtttcaatgccctactcattcatgtttgatcaattaatgaagggcggcggtgtcggtttttctgtcactaaagaaaatgtccacaagattccgctggttgacaacaaagtcaacctgactgttgttatcgataaagacagtgagtcatacgctgattcacttaagatgggagccgttgataaggacgactacttcaagaaccactcaatcacggatgccgcttattatcgtctacccgatacccgtgaaggttgggtattatcaaacgctcatctaatcgatttacactttaaatcaaccaatcccaagaaccaacaaaatctggtccttgatatgagtgatattcgaccaaagggcgctaagatcaaaggattcggcggtaccgcttcagggccaatgcctttgattgagatgctctttgatattaatggcgtcctcaataatcgtgcccgtcgtcacctttcatcagttgatatgaccgatattggtaatatgatcgggaaaacggttgttgccggaaacgttcgtcgttcggccgaattagcattaggctctgccgacgacgaagatttcattacaatgaaacaagataaagaaaaattgtatcatcaccgttgggcttccaacaacagtgttgctgttgattcccaattcagcaactacggtccgattgccgattctattcgtcacaatggcgagccgggaatcgttaacttggaactttccaagaattatggtcgtaaaattgacggcattcaaaaagatattgatccaaacgtcgaagggacgaacccttgtggtgagatttcactttcaaacggtgaaccctgcaacttgtttgaagtcttcccttacgttgccagccaacaaaattggaatcttggtgaagcctttactttaggtactcgtttctccaagcgggttactttcagtccatatgactgggaagtttctcgaaaggcgatcaacaagaatcgtcgaatcggtatctcaatgtccggtattcaagattggattctaagtgaattaggcaaccgggttgttacaggctaccaagatgccaaagatccggaaaccggtgaaaccatcaagaagccgatttatgatcaacgtgctatcgataaagtagacggtctgtataaggcagttgttaaagccgataaggattactccgatgaactcggctgcaacacgtcaattaagcatacaaccgttaaaccatccggtactgttgccaaattagcaggtgtttcagaaggaatgcatttccattatgccccatacttgattcaacgaattcgattccaggattcagatccgttattgccagccttaaaggcatgcggctaccacgtagaaaaggatatttactcaaagaatacaatggttgccgaattcccaattcgtgcggcgcatgctgacagtaagaaatttgcttcagcaggtaacgtttcaattgccgaacaatttgcaacccaagctttcttacaaacctattggtccgataatgcggttagctgtactgttaccttccagcccgaagaaggagatcagattgccccgctaatgcaccaatatcgtttcactaccaagtcaacatctcttttgccgtacgttggtaatgaatttaaacaagcgcccaaagaaccaatcgacaccaaaacctacgaaaagaaggttatgcagatccatggtgatgttcagcgtgtcttcaatcagttgaatgataaccacgatcaaaagggtgccgaaatcattggtcaaaccgactgcgaaggcggcgcttgcccaatcaagtaagctgttaaaatgatatcaagtcattcttcacccacgaaacaaacccgaattttaaatgatcaattctaaactgatcataaaaaaacggaaacccgcatcaaggtttccgtttttacatacccgtatcggttttactgaaagtttacaatgattaaccgttggtttcttgtcgaattatccaactcgcgttatcgtataagtattatttgtataaagccaggaggattattttgcacccatttaaaaaatcagaaaaagaacgtgaagactttttaagaaatatccgctttattgatcgccgtgattttcaacgatttgaaccggatccgaatgaagaaccgcttaaagaactggttcgaattaagcgggttcgccgagagtatcatcacgaaatcaggagggaaaaaggagaaatgcgcatccttcaccttaaactcttcttgctgggacatgaaggattcatcaagtttatccgccatctcattacagggaggagccttccctaaccttcctttgacaatttttaaaaaaggttcgccaattcatcgaatttcgcttattattaaattacttacttttcattaaaggagcatttctcaagatggttaaaatctacaccaaggttggtgaccatggtcaaaccaaacaagtaaccggaaaaatggtgcccaagtatgacttacaaattgaagccctgggcgcaatcgacgaactcgattcgtgggttggttatgttatttcaattctgtcaccaaaagcccaatccttagcaccaaagctcaaaacgattcagcgaaatctgtacgaactccaagctgatattaccgtcaaacgccatcataacatttcaacatcggataccaaacaacttgaaacggaaatcgacgacattatggcaaaacttcccattattaaagcctttatccttccaggtggcaatccttcgggggctgcattacagtatgcacgggctttggcacgaaaagcagaacgtttagtcgttgaattaaacgataagaagcagcctttaaacggcgacattttagaatatctaaatcgcctttctgactatctatttgcattagctcgttatgctaaccttctggaaggctatgacgaagagaaaagcaaactgtaacggggtgtgatacagtgccagttaaagatcataaacaatttaaaccacttagtcttgttgaccaggtttctcaacaaatccaagaagacattttaacccatcaattggccattggtgaccgtcttccaacggagcccaaattaatggcccgttttaacgttggtcgctcaaccgttcgtgaagcgatgaaagttttggttaatctcggcttaatcgaagtgaaacagggtaaggggacgaccattatcaacgataccctgcccgatcagacaatttcatcgacattgaaaaatgcgccggttattgaagcctacgaggcacgaaaagctttggaagtcggcatcgtcgacttagcatgccataatcgtaacgcaacggatctcaaagccatgaactactatttagagatccgttcagcagccgcaaagcttcattcactcgatgcgtaccgccatgctgatgagcaatttcatgaagctattactgaagctactcacaattccgtcatcacagatatctacactgatttttggaactcatttaaggatcgcttcggtgcaggcttcaccaaaacagaactttatcacgagcagtccattattcatcaaaacattttggaggctatcaaacagcaagatccccaccaagcagtttactggattgaaaaaaatattactttattggaacaaacggttaatgattgaccatttgtttttaaagtaaacatcagatgatacgatgtttaaagtgagaaaaaatttggaggtcatcaattgaatacgaaacggcaaggtatcaattttacattcgaggtcttcctgctggccgcaaacctgcgactggcaatcatcggaattccaccgatcgtcacaaaaattcaatcatattttcagctgacaactgctcagacaggtgtcctgacaactattccactactttgtttcggttttttatcagccacaaccgcaccgattattcgaaagctcggcacaaaacggacgattgaatatgcgttactcatgctggcaattgcaaatctgcttcgtacatatgtcaattggggcatgtttcttggaacaatctttgtcggtgccgggattactatgctaaatgtctcattaccggcattgattgttgaacgccatcctgagcaatcaactaaattaaacggtgtttataccgcatcgatcaatcttctttcagcaattgtaggtggcatcgctgtccctgttgccaacgccattggttggcaattcaccgttcagttattttctattcccgcactgattgcttttcttgggacacttatgttgccacatcaagcaacgagaccccggaaaagaactgccactgatcaccaggaagtaaccggaaaagcagctgcgacacctatttggaaacggggacatgtctggctattggcaatcttcatggggcttcaatccctcattttttacaccattgttgcctggttgccaagtgttctaacttcgcatggcttatcagccacaacggccggcctgttattttcaatcttccaaatcatcggtgcaccgttcgcttatcttgtcccacgggcaactaccaaggcatcaaacttaaaattgctgatggtttccttactgatcggctacttatccggtatcggtattctgattatgttcaacgccacttggctgctgatccttgcctgcattattgtcggcatcacaacagcatctattttcacgctctcactatcaatgattaccactatctctaccacaccacaggaagcaggttccgtcggcggcattgttcaatcgatcggctacctgattgccagtgttggtccaacgatgttcggtgtcattgaatcgacgcttggaaactggtcacaaacactcattattttaataaccatttctattattaatattttagttggctttgttctgattaaaattgttcaaaaaaatcattttgtttactagataagtttaaggaacgccattacgggtttctttttatgtttcatcgttatttagatattatctgttattttgaagtatgctaagaatagcctctaattttaaagaaggaatcaaaatgacagctaaaaataagtctcttaaaatatggtggatctttaccgcaatttccattttttcatttatgtccacactgaccagcagtgtcgtcaacatcgccatgccggtcatgagtcgtgcaatggatgtcacgaccacccagatcaactgggtagcttcaagctacttggttatgacctgcatgttgttactgccatttggaaagctcggcgacctatatggaaaagtatccgtttttaaaatcggcacagtcatttttacaattagctcacttctttgcggcataaactttggatttactttcttactgatctgtcgaggctttcaagccataggtgccagcatgacactaagtaataacgccggcattattacggaaatctttccaccgaaaaaacgcggtttggcacttggcagcttttcttcggttgttgctcttggaggggttgttgggccgggattgggcggtctcattttagcgcatttatcatggaactatattttttggattaatatccccttgggaattttggcaattattatcggtcaactgtttttgcccaaaacagctaatcgacagaaccagcaaattgattatctagggttggtttcatttggcattatgatgggcacactttttattggtttgttatgggggcaagaaatcggatttgccagtttaccgtttattttgctcatgattgtaaccatcattttattgaccgtcttcatctttacagaaaggcgctttaaaacaccggcagttaatcttgatttattcaaaaacgtcaatttctcattaaatttaattgcgacaattttggtttatgcgctaaactttgttgtcaatatcattgagcccctttatttacaggaaaatcgattaatttcaccggaagtaaccggcttaattatgatgagttttccaattattcaaatcattattgcacccttggcaggcaccctgtccgaccatatgggtgattggcaggtttacatcgccggcattatcatcctgatcatcgggcaggtcgggttggcaactgtttcccatgaaacatccatcagcactttatgtatctggttgggattcattggtttgggtaacggtattttccaagcacccaacaacgtcatggtcatggaagccgttcctaaaagccaactgggagtcaccagcggattattgggattatccaggaatatcggtatgacagtcggcactattttttcaagcgttttgctgtttgccggcattaatcacgcacttggctatacagttcataattatccaactcatgcgcccacagcttttatcacgggcatgcaactaacatttattgcaacagccatcgtcttcttcatttttttaatcggaaacgttaccgcaagaattgtgcacaaacaaagacccttcactgcttgaccttgtcactttaaggtagaataaattaacatacttttaataacgaggagtgattgacgtgtctaatattttattatcttcacgagcatttaaaacaaccgcaataacggatgcttttcacaatctattaattcattctgctaataacgccccttccattaccgttattgttaattctgtaaaggaagggaaaatgcaccctaagattattgagcttcaacaaagattaaaacaattgggattcaacgacgtcacattattggatgttcttcatgacgacctatccattttaaatcaaacttctttagttatcctgaatggtggttatcaattctacctgcttcattgtttgaaaaaatctggagccttcaatcttcttaaggaaagaatcaaagatggtatgccggtctacggtataagtgccggtgcgcttgtattgggaccggatatcaatatgtaccagtacctctatccagaagataattggtttgctgataccgacttatccgcaattggtgcgaccaaaattcgcatctatccgcactttgatcaacacatccaacttgatccgcagttagctactaagctccgtcattgggaaatagtcaaaaaccaaacaattactcgactaaccaatcaagaggccctgctaatcgaaaatgaccgggtgattaagctataaaaactctctaaatatccatattcagccactcaccggtttgctcaaatccgaatttttcgtacaccggccgaccaagtttcgaagtcccaagccataatttcgtgacacctttctttttggcctcattcactaattgatggagtaatcgtgtcgcaagtcctttaccgcgatagctgtccgccgtatacatattggtaatataccccttgacaccggattgattactataggttggcggaaactgctgaaagtagattgcggccgtcgcaataatttgctgcccatccagaatgagatattcaatcagggaaccctccgcaatcgttttcttaaaaaaggatgccagttgggaatcaatcgaaacatccggttcaattccttcatcaattaattgctgtttacgaatttggcttattattttaatatctgccaaagttgccttacgaatatccatcttggcacgctcctctcaactcgtcttatatgattattatagaataagttatccttatttgtgattatgccgacaagtttaatgtcaaactgtccgccgaaaataagaaataaccggcacaaaaaaacaactcaagattaaagcagcgggaatgatacaaccaattttcccgatctgctttattcttgagttattttcatttaaatcacttttggctaagtagaaatcaagttaccccagtcaaacaatatccctgttatttcttatagaaatagccaacgtccaaccttggtttaccatattccctgtcaatatgatatttatacaatgccgatttaccatgatgtttaaccggtttgaaataaagtgattctttagattccaagagtttcaaatcccaataaccatgcttgttcgcttgcttggagacagtaaataatgaatatttatttttggcggatttagctgtttttacatggaatgtcattggttttgacttccaatgaccgtcaactgtcgcaccttcctgcaatgtatatttggtcaacttatacataaccggtacatgctgatacttcccataccaagacccacgcagaacttgtggaattgggttaacctcggttgcagcctgagcatttcccgatgtgaggaccgtaacccccacaccaaacgttgcagccaccagcaaaacagattttgttaatgtcattcaattaaaccttctttcgcttgagctggtttcatggtaacgcaggattaagacaacaacaagaaaggattccttgacattggggttacataccggcaaaaagcgatcgtttccagttataagttttcgattaccaacaagccatttaaactatgtgacatttaacgacaaaaaagccgaggctcaaagcagcctcggctttctcgtatcgatgtgatggttcgagtcacattttgattttaattacttgtctccaaatgcctttgcagttctaatcatattggcaacaaagccatattcgttgtcataccatgtagcggtcttaacaacttggaactcaccattggttgtaacttcggtttgagttggatcataaacggccccgtgggtatcgccaatgatatcggatgacacaatttcatcttcattccagccgaatgccgggttatccttggtgtaaggcttaattgcttcattaacttggtcggcagtcacgtctttagttttcaaaacggaaaccaattcgcaaaccgaaccgtcaacaactgctacccgttgtgcgtgaccattcaaatgaccatcgagttctggaatgaccagcccaatcgctttagcagcaccagttgaatgaggaatagtatttgccgaagcggtacgatttggacgagctttctttcctttaggcccatcaagaatcatttgggaactggtgaaagcatggatagtcgtcattgtaccgacttcaataccaaattctttattcaggtaatatgccataggtgccagcgcatttgtcgtacatgaccctgcagaaacgatttgatcacttgcgtccaatgtgtcatcgttgacattataaacaattgttttaattggaccagctggtgcggaaatcaaaactttcttaacgccggcatccaagtgggcctgagatttttctttagaagtgtagaatccggtacattcaagaactaattcaacaccatcgtccttagcccaaggaatttgtgatgcatcacgttcagcatatacgtgaaattcatgaccgttgacaataatcgaatcatcggtcgaactaacgtcatatggtaaagtgccatgggttgagtcatatttgaacaaataggcaagcattgaaggtgtcgtcaaatcattgatggctgttacttcaatgtcaggatcgttaatctccaaaattcggcggagtgctaaacgaccaatgcgtccaaaaccattaatcccaattttaaccatatttttccctcctagaataactaaacaggcacaattaaaccgtgccccaacttttaacatttaaaagtatatgccggtttcagtttttatcaagcaattagactcttcatctaataacgccaaatatgccaatcaacttgtctaaactgtcgcaataaaaggtgatgcatgtccgttaaaaaatcggtctgaatataaaaacagagatgtcacaaaaacaaactgtgtcatctctgttttattgaatttaccgatcgttatttttgatcaagttcacgttgagctttttgtgctgcaacattaataatattccatggacgatcaaacccgggttggaagaagaaatctgcataagccagatcattaaccgtcaatttttgttggatagctaaggaaatgacattcatgtttgccgtaacatcagcttttgacatgatttgagcacctaaaacccgaccatcctttggatcaaacgttaatttgaactggacctttggattttgatctgccggcacaaatggtggtcgatacgtatcttcaacgtaaaccgattgcgtttcaactccgaatttgtctgcagtaccttctttaataccggttgaggcaaaatgataatcaaatacgcttaacgcagaagaacctgatactgccggtgtcggattctttgcgtcggtcaggtttttcactgcgtaacgtccctggcgacgaccatttgtggccaacgcaatttgagcgggcttatcagtcggtgcgaacttaatcttagttgcatcaccaaccgcaaagatatcgggttgacttgttcgttggtagtcgtctgttttgattgttccattactgttcaaatcaagtgtatcggcaagccacttggtatttggcttgacaccaacagcctcaacaaccaattcagcaggatattcggcctgatcagtgacaacctttgtcaccttgccatccttgcccacaatttctttaaccgtttcacccgtagcggcatgaataccatttgcctgcatttcatctgttaaaacactggtaaattctttatccaggtaaacacttaacaagcgtggcaaaatatcaacaaccgtaacattcttaccggctttggcaaagacttctgctgcttcaatgccaatgtagcccgaaccgatcacaacgacattcttaatagtcggttcaaccgttgctctctttagcttcattgcccagtcacgaccacgcatgtaatagacattttgtaaatcattaccgggaatcggtaatgcgaccggaaccgcaccaacacttagaattaacttatcatagctttcatcgcgttctgacccatcagccaaatttttaacatggacttcatgcttgtccggcgagattgacgcgatttcttgttgtacaaaaacatggacaccttgggcacgcatcccctcagcagtcgcataacgaacgttgttaacgtccttgacaacgccttcaaggtataattgcatcccacatgaaaggaaagaaacaaaatctcctttttcataccattgaatttctgcatccggatgagttgctaataactcgcgaactgcttcgtaaccaccgtgtgatgaaccaacaacaataactttcactataaatccctcctgttatttaactacctctacattgtaacaattctaaagtaaaaattcaacccaatttagaataattctaaacaagaagtgagaatagatcacttttacttaatagtaacaatctccaatttcaaagccaagttcaaacattgcaaattttgtcaatctcatcaatatgacaaaataaatcaaactgtaaactaattgtgtcttgtcttaataccaaaaatcaattatagtaacattaattaacgataagccatgtaaaatacaataacgcactcaaccattactggaggtggtatccatgttaaaacaactgatttcccgctttgttaattccctactgttatcagcagtttcgttgggaacggttctctttatcgttaaagggatcgtcgatctatcctataccgggacatatgcatgggcgcaatataccacttattttgtgaccgggatgattggtgtcagtatcatcatgttcgcatttgaaatgatcgaaattttggcttcaagaaaccgaagatgaccaacaacatccttctgggcatttaagcctcccaagtaacccttatctttcaccaaaaacatccgactgtctaaacgatcattgtgtccaagaatcatttaggcaaaccggatgttttttggcatctcacagtcagcaaacttgtcgcttctattgcgtcacggcaccctttgcaaattcttcgatttctgtcttctgatgaccgctaatattacccattttaggcataacgccatggagaaataggtgttcatcggaaaccgggatccgtttcttttttagtaccttggtcaattgcttctctattgtgaatacgcttccagaagtaccaaataaaaagacttccttaacagttgcaggatctaaatctgcggcataggccttcaaacgtttatcggcactcatattataaacaccgccaccaagaaatagacgatcaaccggctcgctaatcggtgaatcaattgattcggcctttacgtttaattgctcgcttaacaagttagctactttttcagtattccctgttcttgaataaaatcgaatggcatccatattctgacctccccaaattattttgcgttcggtaattacacctttaattatagttctgaatccgctttctttcaaagattagttcgccatcaacctaattggtcataaaaaaagactgaacaatacgatgtcgatcagcctcttgaatcagttaaaatcatgctttcagcgttactctttattaattgctaacttctgtttggtcttttctgacaattcatcatttatacggccacttttaaagcctcagtcaatactggttaatggtgccgccacaaatccaataattgaatacccagacggcatcgattggataatacagtagacaatcttagttaaagacacagtctccttttcttccagacaaacattgcttaatgcttcaaatttgtgacgtatttatacgactgctcgcctgcctgacggccaaagataaccgtttcggcaattgaattgccgccaattcggttattaccatgaagcccaccggcaacttctccaccggcaaatagtcctttaatcgggtgaccattgtcagtcaatacttgagctttccgattaatcttgacaccacccattgtgtaatgaacggctggtgcgatatgaatggcatagaacggggcttgtgaaatatcccgatccatccctgtcgaacggccaaattcagtatcgtttttatcagcaacgtaaccgttccagttggaaaccgtctttcccaaattggctgcatcaacattaatagtcttagctaattcatcgattgaatcaccgtgaacaaccaggccgatgtgatcataaaactcaatggctttaacatgggctcgaattccagtatccaaaatcagataggcactcttttcaggcaactgattaatggcgttcgtcacgttctttcgggtatccagttcgttaacaaatcgcttaccttcaccattcactagaatggcaccttcaccacgggttgcttcaccaattaaaaaggcatgatcggtatcctgctgaacggttggatgaacctggatttgatccatatccaccaaccccgcacccacactctgagccaatttaataccgtcgccggttgcccctggttggtttgtcgtgttgtaaccaaccagatccggtcgatatttttgaatgatatccttgctggcaccaaaaccacccgtggccaaaaccactgcatcggctttgatttgcttttgcgtgccatcacctaaagtgacgctgacggcgctaattgccttgtcggtttcttctaatttatcaacgtgaacgttattgaaaaccgggatttcttccttttcaataagtttaagcaattctgtaaccaggaaattgccaatcggtgccatactgccaggacggtgcgtccgcttaatcttcattccgccggtaatcgtcacgtcatccaaatgaataccgtgatctgccagccaatcaattgccaatgccccgtgagtggtgaagtattgcagcatttctttattgtttaattcaccgccgccacggtaagtatcttcataaaattcttcataactgtccacaatgtgatgcttgagttgaacgttggtttcagccgcattcatccctgaagaggcccggttggtattaccgccaaagttagccatcttttcaaagatcaccggattcaatcccagctcatgagcctgaagtgcagcggtcattccggttgagccggacccaatcacgactaaatcgtattggtcttttaattctttaatatcagttgattgaaagacatattttgccatcttgcgcttatttcctctctgttcattaggttgctatttttgaaaaatcccaacccaggatttcccaaatcgacgttttatacaccgggtgctaaacgctttgttacgcacgttcttaggactgctgcgctaaccataaacctgcatgtaagctaacggccatcaaattccaaaaacggggatttaatgcctgtcaactgacactccggcttgtcccgattagcttcgcgcactatcaatatttgtcatcttcaatgggtcaacccatttatcaaactgttccgccgttacctttcccgatttaatagcggcttcacgaagtgtcgtgccggctttatcagcggcctgggcaattttggcactatcgtgataaccaatatgtggcgacagtgctgtaacggtcattaatgactgatcaactaattcggtcattcgatcagcgttaacagtcaatccgtgaatcatcttgtctgcaaatccggtcattgtgccggctaataagtccgctgattccagaaaagcatcgatcaggaccggtttataaacgttcatttcaaaattaccttgtgaagcggccatatcaacaaccacgtcatttcccaccacccgaacagcagccatcgtaacggcttcggcctgagtcgggttaactttcccgggcataatggaggaccccggttcgtttgccggaatattcaactcatcatacccggcacgaggaccacttgccagaaaacggacgtcattcgcaattttcatcagatcagcagctaaggtcttcatggcaccatggacaacgtttaatcccgaatgagctgccaaaccgtcaaatttattggtatcagctgtgaatttaagcccgtaaactttactcattcgttcagcaatgtcatccgcaaaatgtggtgcagcatttaatccggttccaactgccgtaccacccattgctaattcaagcagtgtgccgtccaacccctttaaataggaaagatcatgttcaaccatgctgacccagccacttacttcttggccaaatgtcagtggcgttgcatcctgaagatgggttcgtccgattttaaccgttcgccaataggtttcctgcttaatctttaattcatcaattagatgttgggcagactcttccagtttctgaatggcttcactggccgtaatattcatggcagtcggaaaaatatcgtttgaactctgaccatggttcacatcatcattaggtaaaatatcaacgctgctgtcgatttgagcagccctatgtgcaacaacttcgttaacgttcatatttgtttgggttcctgatccggtttggtaaactttcagcgggaagtcttttcggaggtcttcatcggataacgacagtagtgaatcaattgctttaacgatcaagtcgcctttttcttgattcaatgcgccctcctcagcatttgattgtgcggcggctttcttgatttgcagcaaggctttaatgattggtaagggcataaactgaccggttggaaaattgtttcgactcctctcagtttgtggtccccataacgcacttgcaggaatttcaactgggcctatcgtatcttcttcaactcgtacatctttgtctgacatattggttacctccattatgaataatagttaaagtaaacagttaatattatacaatgcgtttaattgttacattaatcacaatataaataaaaatagtcgcattttttaaaatgcatttacagatcactacctgatcatcttactatccctcgtcagttatagtcaatctccgggtaggccattaataatattaatatgagcaaagccttaaaaatcaatcacctatgtcatattcaactacctgtttgagctacctttctagtggtaggaataaattaggctttcattctgattttcaaaggaatcgattgatgattgacctcttttcacaatgcaatcaatttcacgacacctttcatttcacaagcagttcctttattaatgagccaaaacatctatggtaataggatttatcctttaactttcggtgtttttatttaaaattcactaactaaaaaatgaaaagattaaattaaagcgtttacatttcacaatcatgcaactatactcgagtaagtgaagagcattttacaaaataattttaggaggcttaatttatggttgaaaagattagtggttctgatgctgtattaaaggtgctggaacaatggggcgttaaccacatctatggcctgccaggtggctcatttgactcgaccatgaatgcaattcataatcaaaaagataagattaactatgttcaagtacgtcacgaggaagcgggtgcgattgctgcatcggcaaccgcaaagttaaccggtaaggtcggtgtctgcttcggttcagccggccccggtgcggtccatttacttaatggcctatacgatgctaaaagtgatggcgttccggttgttgctttagttgctcaagtgcctaccagtaatatgaacatggacttcttccaagccatggatgaagaacctatctttgatgatgtagcggtctggaatcgaacggcaatgactgccgatgccttgccgcgaatgactgatgaagccatccgtcaagcgtatatgaagcacggtgttgctgtattaacgattccaaaagatcttggctgggctcaaattgataatacttacgaaccgaatttgaagtcacataccgcaccggcatatccggatccacgtcctgaagacgtttccgaagccgtcaagttaatcaaagatgccaaatcaccaatgatttacttcggtcttggtgccaaagacgccgctgatgaattaaaagccgtttccgaaaagtttaagatgccattagtctcatccgttttggctaagggcattattgatgacgattatccagcttatctgggatctaccggccgggttgcacctaagccgggggctgaaatcggatttagtaccgacctgattctttgggttggtaatgatgtgccattcagtgttttcctgttcaataaaaaagcaaaagtcattcaaattgatatcgaaagtgaaaagttgggtaaacgtcgtcacaacgatgtttccatgctgacagactccaagaaggccctgaaggctattttggatgccggtgaagaaagaaagccatccgcattctatcaagctgctttggccgataaaaccaactggctcgattggcaaaacagcttcaaagatgccaccgaaaagccggttcgtccggaaccaatatttgacgttattaataagactgctagtgacaaagccgtcttcgccgtggatgtcggaaacgtcaacattaactttgaacgtttaatttcaatgcatggcgatcaaaagtgggcaacttcaggtatttacgcaaccatgggctttgcactaccaacttcaattgctgccaagatggaatatccagaccgcgacgtttacagtctgagtggtgacggtggcttcgcaatgctgatggaagaggttatgactcaggttaaatatggcttacatgtcgttaacgttatcttcagtaatgaaacactcggctatattgaggctgaacaaacagatgatacccaccagccactttccggtgttgacctaccggataccaactgggcagaagttgctgaaggcatgggtgccgttagctataccgttcgaaccaaggatgatatgaagaaagcccttgaagatgccggtagcaccgacaaaccagttgtgatcgatgtcaagttgactcacgatatgccactcacaacccaacacatgttcattgaccctgcatggcaagatcaaaagaagattgatgcattcgtcaggaagtatcaagctcaagatttgaagccattcagctacttcttaaaggaagcgcaggaaggccaacttcaaactaactagacaaaattaaagatggttgctttcgaagtaaagataatcagttaacccgcttcgagttaactgattatgccgatattaatacaaaccaccatcgtttaatcataatcaaaaagttgggacaaaattcttgttttgtgcccagcttttgttttgctgaaagatgacctttgtgaactactcggttatgaatgaccgagcttctgggaacacgaagtagtatttaggctgttacatcggtatgccgaaaacccaacttacagaactccgctcttttaccatggctagttcctaaccaatggcttttagtccgcaattaaggatattaactgccgcattaatatctctgtcgtgatgagtccggcattcagaacacgtccattcccgaatatctaagggcttggggccgtcattctgaccgcatgctgaacagattcgggaagtgtttttggcgttcaccatcattaattgcttaccgtaccaggcacacttgtattccagcatggtccggaattgataccaactggcgttagcgatggacttggctaggtggtgattgcgcatcagattcttggttttcaaatcctcaatcacaatcacatcatagtttctaactaagtccgtcgtcagtttatgcaggtaatctttgcgctggttggcgatttttgcttgataacgcgctttaaccatccgcgcccgttgccaattttgataatcgttgagtgccattttggataatttatggtgatgattccattggcgcatcgcaacggtggcctgacgcttgcgccgactaaacttcgcttgccataaagtcgcttgtttctccagccaccgggcattgaaagtcccgtacttaaccccattggaagtaattgccaaatcggcgacacccatatccaagcccaccatttggtgagtcttcggcaagtcatgaacttcggtttcgacctgcagggaaagatagtagcgccccgtggcatcatgactaattgtgtaacgcttaattttggcgtcggttaattggttagtcttactggtccgaatactcccgagtttgggcaatcttaaacgccgcttagcttccacaacgcaagttgattgtccggtataggcttgcttagcactatggcgggacttaaaccgcggatgaccactccgatgttggaataaattcttaaaagcaagtgcgagattatggttaaccacaaataagctggtagaatcactggctttgaggaaggggtactcttgcttaaaccgtttaagcaggtaattcatatcgtattcgccaacaaactgacttttcgggttattttcataacgtttattagccatggctaacatttgattccaaacaaaccgatcgttgccaaacagttgccacaactgattgatttgggcttggttaggatataatcgtagcttaacccctttaaccactgtcgtcactgggatgctcctctcttgattgttctttctggtgctgaatatcaaaatacttagcgattgcccattcattgacagccctgatccttcggttgccaatcgcttgtcgacaactccggacactgatggcagtcatgccgtttaggcacgcttactagtagttggacctgaacatcttgagcaccttcagatgaacaattttaaagccgggttcatcaacggcttcgttaaccagacgtttgaaaattttctcaacgtgtttggttaaagcctgctacccatatgtgttatggtaattcgcgttatgaaacgcagttttgtcatacgttaattgattcgtactttttgcaataaatattatagcatattaagagtgctattgtatacgtagattcgtaaaaacaaggaaatttattggctggtaattatcgtttattagccgtaaaaacgggggcaattcatcacgtccttaaaagaacgtgttttctttccctatctcataaaatagattatggttgagcagtcatctttaataccttatgattagagttaagtgtttacattaatttattagatcaaattcggggagaaacccgctcatgcaagttatttatcttgattcacgtcaacaatcattcatcccgtcaaaaaagccgattgttctcgccctcggcttttttgacggcgtccacaagggacatcaatttgtgatccaaacagctggaaaaattgcgaatcagcgtggccttccgcttgccgtcatgacgtttaaccgccacgcatcacgaatttttcatcatgattcatcatcgacatttcgctatttgaccacactaaaacagaaagccgaactaatcgaaaaattgcacgctgatatcttatacgttgtcgattttaatcagcactttgccggcctctctccaaagacattcatcgaaaaatacgtcatcggactgaatgccaagattgtggtagccggtttcgattatactttcggacaaggtgggacaactaccattgattcaatggcagctatcagcaatcatcgtattcaaaccgtcacggttagagaactggatagccaacggttaaaaatcggttccagccggattagaaaattgattggtcagggtaggattaaagaagccaacaaattattaggacatccttacgaaacaaccggtaaactgatccatgctcaaattgacggcttatcaatcgtcaatccttcaagccgcctgcagcagcttccccaaaccggcagttatctctgtgatgtgaccgtttctaaagaaaaacaaaagataattgttcgggttcgccaacctaagaaagggcacgcaacggccgtcatttacatcaatcgaaaagcttttcacaatctgccacacattagttcactgccggtgtcaattaagtggttgagtgagtaaagccacttttaatgtagggggggtatcataaatgtcattaaccttagttcctttatcttataatgtcttacaagaaattgcacgacatgatacaccgatctaaaaaatcacactaagtcaaaaatagaactactcacatccgtaacagttacgtaggcatcacgatccaagattaatgcaggattgtgatacttttttatctgttggcagttagataaaatcactaatgtttttgtagttattccaagtcttgtttttaaacggatagctcagtaaccaatacatatctaactacagacaaaataaaattcctctcaaaacattatttgacaaatttatatttcttcttattcaataaactggatataaccaagtaaactcctgcgataaacagcaataaatcaataatccacaaaggatttaagatcgaaacatgaataaaaatgttcctgttcaaataggcaattataagcccaatccaaaaatgagcgtctttaaaaaaatatttattaaacattacaatccactcctcctattaaactaagttaaagggctttgttctccactcttgacatcaactactctgatttcgagaactaacaagcaactacagtatcttaccaactaactaaaatgcctagctgtaaatcaaagacattgatctgacagtactgtccgtgtatctaaacactaattagtttttgacattagtgacactaagtttccgtttttgcgaactcatccataagtaccaatcaccgcacaaacaaagaggccggggaaaagccctcggtctcttatcgtcttaaattttaattagtcatcctctgaaagcccatcaaaattaccatttactacttaacacattggattttcaatttttattaaactcgcttacggttaaaaaggataagcgagattgcaaggctgatcaacattaaaatcaccgtgatagccaaagccacgccatattcaccaaggctctgcttcccctgcagaaactgcatattttggttgattagtgaaaatggattaatctttttaaaacctgtaaaaacggtcgaaaacattcccagcgcataaaaaacgccattgattagtaaccctttcatgccattagccgaaacagtcgacccagtaacgacaactgtcattagcaacaatccaaatagccataaggcaaagactgccggaagtgaactactcggttatgaatgaccgagcttctgggaacacgaagtagtatttaggctgttacatcggtatgccgaagacctaacttacagaacttcgctcttttaccacggctagttcctaaccaatagcttttagtccgcaattaaggatattaactgccgcattaatatcgcggtcgtgatgagcccggcatttagaacacgtccattcccgaatagttaagggcttagcaccgtcattctgaccgcacgctgaacagattcgggaagtatttttggcgctcactaccactaattgcttaccgtaccaggcacacttatattccagcatggttcggaattgataccaactggcattagcaattgacttggctaggtggtgattgcgcatcagattcttggttttcaaatcctcaatcacaatcacatcatagtttctaactaagtccgtcgtcagtttatggagatagtccttgcgctggttggcgatttttgcttgataacgcgctttggttattttagcccgttgccaattttgataatcgttgagtgccattttggataatttatggtgatgattccattggcgcatcgcaacagtggcctgatgtttgcgccggctaaacttcgcttgccaacacttggcttgcttttccagccaccgggcattgaaagtcccgtacttaaccccgttggaggtaatcgctaaatcagcaacgcccatatccaagccaaccctctggttggttttcggcaaatcgtgaacttcggtttcgacctgtaaggaaaggtagtagcgtcccgtggcatcatgactaaccgtgtaccgcttaattttggcatcaactaattggttagtcttgttggttcgaatactcccaattttaggcaatcttaaacgccgcttagcctccacaacgcagattgatttcccggtgtaggcttgcttagcgctatggcgggacttgaaccgcggatgaccaccccgatgttgaaacaagttcttaaacgccagcgcgaggttatggttaaccacaaataagctggtggaatcactagcttttaagaatgggtactcttgcttaaaccgtttaagcagataattcatatcgtattcgccaacaaactgacttttcggattattttcataacgtttattagccatcgctaacatttgattccaaacaaaccgatcgttaccaaatagttgccataattgatcaatttgtgtttggttagggtataagcgcagtttaacccctttaaccactgtggtcactgggatgcctcctctctttattgttctttctctggtgccaatgcttttaacatcatcacgcggtaaccaccagtgacgatcctttggttgtcaattaaagtcggtaaccctggacactgacaaaataaccgaaaggcagtcatgccgtttaggcacgcttactaatagctggacctaatcatcttggccaatctttatatgaacaattccaaaaccgtgttcatcggcgggccttgtaaatcagagcatttgcaaattcctcaatgggacaagttaaagtctagttccccacgtgtaatgataattcgcgttatgaaacgaagttttgtcatacgttaattgattcgtactttttgcaataaatattatagcatgttaagagtactactgtatacgtagattcataaaaacaaggaaatttattggcaggtaattatcgtttattagccgtaaaaacgggggcaattcatcacgtccttaaaagaacgtgttttcttgccctatctcataaatgacggctaagatgatcattaaacggaccatctcataaaaaacgtttggacttcaacccactgatgatttgaattagttataaaactcacatataatccggtatcagattataaaaatcattaataactcggaaacgattataaccaaccgaattcaactacgattgaacatctcataacttgcctaaccaatcaaggcttgataatgaacaaacacttatcaataaacttcttaaactccagtcgtttatcaatttctaaaaaagaggccctatttgtggaaaaagttcccacacaacaatactccgttattcgtgacagtattaaatacggcagttacattttcttgttatttgcgaccggttggctattggtcattctgtacctgggaagtatccttctcttcttgcaatggcctttttatcgttcacattcggccttcagcatgcttttgacgttgaccacattacgaccatcgataatattacccgcaagctcattaatgatggcaaaaacacacatggtgtcggctttttcttctcccttgggcactctttggttgtcatgctcatgacactgattactattttctttgttcactggtccaaagaaagacttccccattttcaacacattggtaacctcgtcgggccgatcttttcaggtaccgtcttaattgttttaggattaatcaatttgctgatcccgatccagacgtgccatcaattcaaccagattcgtcagggacatacagatcagccagccgaccaaatgacacattggacacttggcatttttaacagagctctgcaattaatccagcacagttggcaaacattgattgttgggtttctctttgggttggggtttgacaccgctactcagatctcagtcttggcaacttccgctgtggccaccaataatggtgttccctggcttgcggtcatctcatttcccttattatttaccgcaggaatgtgtttgatggacaccagtgacggtctatttatgagtacagcttacagctggctgttctcttccccgtttcaaaaagtctactacaatatcgtcctaaccggtttatcggtcaccactgctttctttgttggaatcgttgaattcgttcaagttgcaggcagacagtttcacttacataatcaactcgttcaatggtgcaccagattgaactttcagcatttgggtattatattagtcatcctgttcatcatcacttggtcactggcattagttgtctggcgtcgacttaaccatcaaataaagtaaaggattgtgatctcatgtttatagtcacaatcccctttagtatgcgcttgcgatgatttattaaataatgaagaccaccaaactcatttaacagcgctcttcaagatggctacaatcttctcctgggcctcactaaagaccattccccgccgcagagccaatccgatcttaaacaccggctgcaacggatcatcaagccgcagtcgaacaacgtttggatccttaattttaatggcgttggttaaaaagccaatgccaattccctgagcaaccatattcacaatactctgggcagcgttggttcgaaaaatgactttcggccgtacatggttggtgtttgacagctggcgaaagacacggtcatgaacaaaactgtccttaaacaaaatgaaattttgatttttcaaatcagcaaagttcacgcgctgttgcttcgctaatcgactgttagtcgccaccaaaatcgaaaaaggttgttgatcaatctggtgaacgtcaatcatttgatcggtgagttgaccaatataacctaaaaatgatatatcaagcgtcccgtttttcaaatcattcagcgctgagatagacccttcttcaaccgtttgaatacttgttagatcttctggagacaagcgctgggcaatttttggaaaataatttgtttcaataattggcggcatccccacaaccaagcgtcttttttcactatttttgatttccgtttttgccagctgataatgatacaggatctcctgggcatgtcccaacagttgctcaccagtatgtgtcagcgcaatggtccgatgagggttaccccgcaccaataattggctgccaaattcatcctccaaccgtttaatcgctgctgaaaccgtcggctggctcacacggtactttttagccacgttcgaaaaacttttttcttcagatagtgaaacataatatgcagcctctctaatattcactatgtatcccccatttaaaagcagttttgtttgctactataaataatcataatcgaatccgctgtatttgactatagttaaaatcaaagcatacactgacggcaataatattaaaaaggaagtcagtgattaaatgtctactcaaactattttaagcgatccatttaaaaacaaaggaactgcttttacaaaggaagaacgtcaacaactcggactaacgggcatgctgccgccaaggattcaaacactggaccaacaggtagctcaagtttacgcgcaataccaagagaaatcatccagccttgaaaaacggatttttctaatgagcatctttaacgaaaatcgggttcttttctacaaagtattcagccaacacgtcgccgaattcatgccgattgtttacgatccaaccatcgccacaaccgttgaaaactacagtcacttgtttgttcaacctcaaaacgcggcttttctttccattgatgatccggatacaatcgaagaaagtcttaagaatgccgcggccggccgagatatccgccttctggtcgtgaccgatggtgaaggtatcctgggcattggcgactggggcacacaaggtgttgatattgccgttggtaaattaatggtttacacggcggccgccggaattgatccccggcaggtattaccggtcgtcctcgatgtcggcacgaataaccaacagcttctccatgacccaatgtatttgggcaatcaacatccccgcattcagggtgttaaatacgatgcctttgttaatagatttgttaaagccgtcgaaaataacttcccacacgtttaccttcatttcgaagattttggtcgcgacaatgcggctgacattttgaatcgttttaaagataataacttggttttcaacgatgatattcaaggaaccggtattattgtgttggccggaattctgggtgcgttgaatatttccaaacaaaaattaattgatcaacgatacttgtgctttggtgccggaacagccggtgccggtattacccaacgcatatttgaagaaatggttaacctcggattgagtccgcaagaagctcgtaagcacttctacatggttgacaaacaagggctcctattcgatgatacgcctgacctaacaccggagcagaaaccctttgcccgctcacgaagcgaattcaacaatgccgatgacttaaccgatctgcttagtaccgttaaagctgtccacccgacaatcatggttggcacatcaactcaagccggcgcgtttaccgaagacattgtaaaagaaatggcagctcataccgaacgaccgattatcttcccaatttcaaatccgactaaactaattgaagcccatgcggacgatttaatcaaatggaccgatgggaaggctttggttgccaccggaatcccctcaaagaacgttgactaccagggtgtttcatacgaaattggtcaagccaacaatgccttgatttatcccggacttggtttaggtgcgattgccagtactgccagcgtcctcaatgataagatgatttcggcagccgcccactcactcggaggtatcgttgacgtcaagaaacctggggctgccgtattaccaccggtctcaaaattatatgagttttcggaaacagtcgctgaagccgttgcgcaaagtgccgtcgatcaaaaattaaatcaacagcccattaagtcagttgtgaaagcaatcgaagccaccaaatgggaacctcagtattaatttaacagaataggaggaaactcccagcaatcgaacgaaactgctgggagttttttagcttttagttcaatgactattatacttttccaagtgaaaaagtctttcatcatctaatcgcgaatcgtcgtttttaaatgtgtaccccattttttcataaaattcaagcgcagttatagaagcaggcacttcaattcgttttgctcttttaaaaaagggatcattctctaaggtataaataagctttctgccaataccacgcccctgataatcaggtcgtataaaaatattaaataagctactttcatcttttttatcccaataaggtccaattgcaccatagccaataatttcatcacagtttttgtctataaaaacatagcagtgggcatattgagacaatttaataaaaaaataaggtgttcgctccttgatatctttttccaaatattctctagtgtattctttaatattagttgtcaacatcgtggttgtaaccaaatttgataccatttgtgcatcactttcgctaaataatcgactaatgatcataatacctcaccatcccttgggcatttacgcaacactttcagccggtagtttttgataggcctgatcagctttcaccaaataaataacgctggcaactaataaaggcgtaaagactgctaaaataatgccccagcttgcctgttgaatatcaaatttggtcgatgcacttgggaaccaatccaaaagaaaatgtattagcatcccccaaaacaatgtattcgtggtgaagcgaagagccgcaagaaatacaccgatcacaaaagcccaaaagacttgctggaaaacggcactagaattaccacccagcagattaacaaggtggaaagtgccaaacaatatcgatgaataaattgccgaacgggtcagcttataggaacgactattgtattgcgcatatgccagaaatccggaaagaaagaagccacgattaatagactcttcgaagatggccgcagatagggccactagtgtgttgacgagaagatgctttgcctgaaggaccataatgacatgctgtggaacgccgccaaacccaaagacgatccctaatgtgactaaagaaatgattccccaaataatcatgggctttgttaatgccagtcgatgcacgaaaactttcgttgacttaagtgcccaaagcataatcgcaaatgataataatgcatataccagatctgcaacagcctgctctaaaaacgtgccgttataaaataacattgacatcatgctaaaacctaaaaacaaaacaatcgctatcgttatctgtctaccccatgaccaccgattctctattatcactctgaccaacctcttccggtttaaactcgttcacattttattaaagttagtcacattatagctttacaaaagtgacttgactaggggagggccgacatttatggtgaaaatcccaatctaaaaatacctaattattgatatctttaaccattctttcaaatagatcttctatcttttctgaagatagtttcgtatcatcagaagttaaataatctttgcttatccaccattttctcaactgctgtattgcaaatggctgtatcttcaaacgattgaatttcaagctaagttcaaaaggaatatctacgtagtaaaccagggattttcttttagtttctttgcacagtcgtcttaacatcgaaccatatacatcttttcgcagaattccttccaaaatgacaattggataatgtctaaacccaaatttaaccagtgtttctattatgtcgactgcgggtgttcctttatgatcatctgcatgcaaaatactccgacgcaatacatcttgttggagcaataaacactgctcatagccaaaatatgattggagttcctttgctaatgttgttttccccgttcctgaatttccacgaattaggataaaaattggtttcaattaaaatcagctcccttatatatttttcgggccggcacatatacagtttgcacactagtaatctctttcttataagcatattcgactaattatacataaatgatctaatttataagcatcattatcactagaatgaatgcacagaactataataaagccgagatagactaatggttacaacttcacattattaggcagtgaccaccttggttttattcacaataatcttaattaactcattttcatagttattatttttaattggaggccttatttatgaaagcaccaatgtcgataagaatcttacttggcattcttttggtcagcgtagcagtggcgtttctcctaaaacttcatatcaccacagttgtcctgattattattacaggagttattgctttcggctacccaattatactcagcaagaatacccacaataatcaagataggaagtgattaacatggcgaaagttttactgcaaattaatcatttaaaaaccgttcttgattcttttacactaagggacatttcatttactgctactgcgggtgacattattggcattattggtgaaaacggatccggaaaaacatctcttcttaaatcgatcgttggcatttaccccctatcagacggaaacattcatttagacactgatcaaatcggatttgcatttgattctattccatttccacaaaaattaactatcaaggaactctcgaacgttttgaagaacttacttccaagttggcaatcaaaaacgtttgacgcttacgttgattcattcaacctgccacgcaatactccacttgaaaaattttcaaaggggatgaagatgcaattctctgtagctgtcacattatcccataaagcatcacttctactttttgacgaaatcacaagtggcttggatccaattgttcgaaacacagttctggaggccattaaaaactacgtcataaccaatcacgctgcggttattatgacaactcacaatctggatgatgtcatcaaaataggcactagatttattttactggataatggcaaaatcattttagaaagatccatcaactatgatgataatgccacttcactggaacaagacttcgtccaagctgttaaagactgggggaatcaaagatgaatggacttattctaaaagacgtttatagtcttgaaaaactttggttcaaaaaaagctatattttagcagcactgattcttttagtcggaagcacgatctggctaaaagaaagcggtagtattatctctgtcatatttttaagcatgctactcttaaatagcttacaaacactctttttagatgattctcattcaaattggctgttatttttgaaaacattgaatatcccattatctaaggtgatcctttctcgttacaccattgcattcatcatttctttaatagcaactattattacttttgccacagctcttatatcaagattattttctagcgtaatgacaatcactcaactctttgaatttagcttaatcgttttggtgatctcagtaatctacattttctttctaatcccatttatctacctatttaatcaaaatggattaataatcggctttctgacaatcattgctttaacttttggtatctttaaactcttttcaatagacgcactgacagtatcaattgtaaacacttctggctacattatttttttaatcgtacttggcgttataattttagatttttcagtttcatatgccatttcctttttaattatgaagaagaaatcatttaatggctaattactctaaaagaagtggttattatgattgataacaggtgtcaaaaattcattactatacattattttcctttaatcacactatctccgctcgtattattgctttaatttctgtattgaaatttgatcaagaaatgtcttagaaatactcagttgttctgctagctgtcgacctagtgttcatcccttttatgacggtgatagtaattgatgtattacaactgataattacgacatttttttaattattatgatcatgacaagtgtttgaagtagcttaatcattttaaactaagttcaaaaaatcataatagattatcaagtaatagctatattcccaatcaaaaacggtgtcgttgacaggttattgtccacgacaccgttttggtaaatccatttctaacctatttatattcttcaaacaatttttcaaaattaaccgtacctaatcccgaagcttgattatatacagtgccgggttgaccggtataatacatattattgttatcagttgtgctgtttaaaggattaaacggagaattctgtgtggttgctaattgatagatttgagcattcaagaagcccatacgcgtacttcgaccactgttcaaatcagcaattgctcctgccatttgtggcccaacaatactggtacctgctcccaagctccatgggctctgtcccttttccttttgatacacgatataaggcgtcaaagcatccgcattagcagagatatccggaaagtttcttccctgaccagtacccgaaataagcggggcattaaggatcggataattgtatttcgttaataactttcgagcattaaatgtatttacaccaggcactcccttttgatagcttggtgtcgcgtagatttccgaaaatccaccgccaccaccgaccgtgagcttaagtctgattataggatccttttttaataattcgggtttactttgtaaaacttttatgaagtttgaaccccatgcccgttcgttcttgttgctaatgtttccaatatttccaaactctgatttttttagcatggctcccttgtaaaaataaggcaacgttgttccaccacaacttgttaaccaaggattggttgtaataatatcattagaatgctggctatatcctaaaaatgcatgatttttcgtaattcgcttcacatagtaacttcctgcaccagtatcaccactgccaacaaatgtcgagattccttgaagatcaccttgagcaaacgttaaactcaaaatatctaagtattgtttaggaagcatcccttttttctgcattaaagcatttgttttattactttgaagtccccagcttgaagataacgagcttaccttattttcgtcgtaagccatattaaacaagtttactgtatttaaaaatgtaggcatttcactcttttgacgatacattcgaatatttgcctgtggtgcaaccgatcctgcatattcaacatccatggtagcctctccactatcatttgaaatcatctttggattaaagaaatttccttgaacattttttaccgtataacgagctggagaaatactggcatgttcatgcttccaaaaatgaaacacattgcttttatgaattccttcaaaagaaattatgccaacagcgttccctttaccgttaaaacccttttcaagcaatgaacttagatgataagttcttgtaaaacgagtcgtatatccacctacccgatgaactattggactgattttagctaattgaagatctgcattaggaataacattatctcgattatggtcggccatgcctccaaatgctaataaacttttagacaggtttttagggaattttggccccacttttccgaattgaaacgggttatggtgatacttggccgaattcaaatttgtcttaaaaagtttaccaattgaaccggcttttccggagacaaagataacccgtttgttcttcgatacgatagtttttaaaccatgctttttcaaaaaagatgtccagccagttatgactgaatttgattgcccaaatttattgccgatttcagttggcgtcagatagtgcttaaactgactattccccggagtattgacatcaagtgcttcttggaaatattgactttcgttcttaggctttaagaaaacatcaaaagtcgtttcttgatttggtttgatctttgacggtcgatataacttcgatttagtcaagatcgcattgacctgtgtattacttaacccttttgcctttgcagacacctggatattattcaaattaataccggttatcacagccgaaattgccagcatggataaccataaacccttcattctaatcatatcccattcccccgttctcctataattcgttttcagtatacatcaaatcaaataattgatatatacaggacgctcatcaaaatccaatttaattagagtggcttaatatatatctattaatcttttctaaaaaacaaataagatccatccaaatcaatctcttaaccccatttaccatgttacaactaacatcaataaaattattcgggggaaattttgatgagacattgcaaacttattttttggggcgtgggcatcgttgcatttatcggtattggattagtctttgcaaaggcaacttggagtccaaacgaggtaccaacttctgtcaccgaggttaaacagaccgtggcgccaaatcacatttaccaatcatatcgatttccatataaattaaccatttcgaccccaaaggccaaattatactctgcacctgccggaaccaagggagctcaatacttgggaacagctagtgacaaacatctccaaaatcatattaagggtagcgtaagagctgatttgaatcacaatcagcgtgccggttatatcaagttcaagcaaggtaaacacacctactggatcagcgcacagcaaactcaatttcgcgatttaaatgcactcaagggacataacaaaccaattgaaacagccattagcgccggtttaaaactcgtaggccattctaaatacgactacggtggcggacgaaatttaaccgatatccgtcaccatcgctttgactgctcatcctttgtcagatattgctacggcaaagccggtatcacgctcggaaatctggatagcgtgacaactttcacgcttgttacaatgggcaagcccgttagttttaatcacatgaaacgtggcgatttgttcttcttcacaaatgcaaaaggacaggtcaactcacacgttgccatttatttaggtgatcatttattcttgcatgaccatggccaatcagataccggtggggtcggcattacctcacttaatgcgcccagctggcgaaaggaaacaaacggaacggttagacgaattgttaattaactgttaacgtcgcaaacatcaagaatactaaaatgatttgtcctttcgaaaagtcattcaccaatttcgcatgactctctcaatcctttttgttttcattcatttcagtcttgaattaaactgagtgtaaacctgttggaggggaagtatcgatcaacatgagaaaagtattattagtaatggctggaatttttttacttatttttatcggtatcttcagttatgacattgttaatcataactcaatcctggttattggttacaatcggccacaaggcttacttggctggtcatttgttctaaccatcattttatttggctgttcttttatttttcgtcctacagataaaaaataggcataatgttaacttggcaactttaatttatggcaataagaaaatggctgcgatcaataatgatccagccatttttattgccgagcattaataagggggaagacaggcacagttttacctgtcagtaattatatacgtaagcctaacggttatgttttttaaattaatgatcttctttttattggtcaccccgctatccctttattaattaacatagccttatcatttaacttagttgcaatagtgcccttcatgaatcacaatgagcatcattaatcgttttattgacttctcataaattatcgaaagaggtgtcactatgaacaaatccttactggcattcaaattggaatgctcgctgattggtgtcattaccgttatcttttttattttgtcacccgcattgtcaataacatttggaaacctagtctttggcattttaacagctgttttggggcttttaattaccgccaaaacaatcatgaaaaggccttatttacaagttatcgacaatttggcaaaaatgctgttggtcctcacttttccagcaaccttactcaccagtatttgtttgtctttttcttcaataatgaccgcaaatacatatgtgaaatgggggatcctcgcggccatattggccatattcggggtattgatgctgccatttatcaaaattatcctaatgccacagtcacaaattggttggcaaatcgccagtagtattctattgatgaccgtttttttctcaacatccttaaatgcttttcaatatctaaagattccctttactctcaacttgggttcacccattatctggattctcattattggaaactttacgattgccatttatttaatgatttattggggctatcggctgccaaggctaaagatcaataccagtgtcaactactggtggcttctactggcggttgtaatattgcttttaaatatgggattatccgctggtagttggatgcgcctgctgacaaacttcgaccttaccttggctcagaactcattactaatcgttctttttaccattatttggacaggcttaaaagaagaatttatgtttcgttatttatttttgtggccgttagcatccataaaaagagtttccattgaatccagagttttctggtccagtctgatcagtgctctctttttcggactttgtcacgctcaaaatctaactgagcaaggcgttttacaaacttgcttacaaatatttgcggcatttggtattggtttcctgtttagtgttattgccctatacaccggcacaatatggatttcagtggttattcactgcatgattgacctaattggttttccaatcaataatggtggcgccttttcgggcaacacatcttggttcctggtcgaattcattctcctaaccagaatcattgaactgattgttgcgtttttgctcttgaatttacactttaagtgcaacactaattaaataaagaatggcccatggccaaatttctgtaaaatgatgtttgcgaaaacaatcatgaaaggaatttagccatggaccactacaagcatattacatagatgaacgggaaactatctttttaatgaggaatcatggaaactcacttcgtgagatgccagcatatcacgaaaatttactcaaccatttctcgagaatataagccgtaattctactggtaaatcctattcaccttcgaaggctcaggagaagtacaaacagcgcaaaggcaactgtggcagagtctctcttataatgagctcgggtgtttgaagggtggtgagagaacacttctgcgaagacctttggtctccggaggaaattcgaatcgcttggcagtcgaaaagtatccggtgcaatcagtacacagactatttaccgtgggatttcaatggcttatttgatatttgtttaaatctggcagctctagtgccttgcgccatctggcatcacggcaagtctcgccacaaaagcttatcaggaaaaacgaggcacgattccaatccccaacaagattcatgatcgtccgcagaagctgacaaccgtgtagaaattggtcactggaaggtgataccgtgttaggcaaaagcggaaaggcttgtgcgtacattggttgccgaaaatctcgttacctgctattgtaagcctaaagaacttcaaacagtcacggatactttgaggcgacttaatgaagctatggacgggtagatcgttaacgattaccccggataggggggtaaagagtttgccaaagttcaatgtttaactgataagtttggtacgcccttctactttcccgatcctcactctccttggcaacgaggaactaacgaaaatactaacggcttgcttcgcgaatatttgccaaaaggaactgaccttgatacaattacggaccgccggatacaagcatatgcagaacaaatgaataatcgtccccgtaaatgtctcggatggaaaacgccttatgaaatattctttaatgtggtgttgcacttaatttgacaattcaagcttattaaaaataaaaataatcaacgtgcttttagcgaaacgttcagtcgacttagacgcgacgagtctaaacttctaaaataaacactggaactgtcccctcacagttattggcaaaggattctcactctccctgaaactgcttatccccacgaatatctttaagaatcaatctcaaaaatcctatgacataaccaagcatcatcacgccgctaaccgcaatcacaagcgcaccactgagttgactctgaaacaagaacgtatagataagtgtgccaattggcatgattgccgttaccgacgtcatgagtgttgaattaacccttcccaaaagatgacttgggacggttgtttgcagtcgaatattagttgagacgttcatcacgccactcattgatccagccacaaacataatgacagccccggccagcgttagttgaaccggctgggtaacggttgccaagagaagccccaacaacgccatgcaagctcccataacgataatcggcggtacaatttttaatgaaaaatacacgttgttcggtatgatcgacatgatgatactcccgataaaaatgccggcggaaaacccggtttcaatatacccaatcggcatgtttccagcgtgaagctgggccgtaatcacaaacggaagaccgattgtaatcgctgtaaacaggaaattgacaacgatagcaactaaaataagatcgcgaatcaaaggccggtgccgaatatactgtaaccccgtcttaaaccccgacagttgggaagcaagcgtcttggaaatatttttaactgaactgacagcgtcactgtagtgaaactgcattgaaagcagtaacatcaaagccgcaaaggttgcgataatttcaacaacaataaaagtttcaaatccgatcagtgcatatacagccacaccaatcgccggtgacaaaaccgaagaaagtgctgaagccgcttgcgtcagggaacttaacagctgaatcttctgatcgttgacaagctcgtgaactgaagcagaataagcagtggtattaaaattagttgaaatggcgttaataacaacaaaaccagcaaccggaaccaatttataaatcccggtgaaaaggggatagatcaacgcaaaaataaccaagccaaccagtcgtgcaatcaaactgacaaccagaataattttatgatgatattgatcaacaatgtttccgacaggaatcaaaaagatcagcccgacaatcggaacaattgccgtttccagtccaaaacttaacggggaatgcgtatcatgcaataacattaatcccatggcaagtgaaaacatgccaccgctaagagaactaataaaattactggcgacatctttcataatttgatgatttgattgtcgattcgtgattggcgcgaattgagactttttttcaagtaagatgattgctttattttcaaccataaaggaagacctcaaatctattttcaacttggcaggggcaagcaataattaaatttattttatcgactaaattaatttaatagacaaataaaatatagccggttgaacaaattttgtcaagcgcttatcatagttatgaggtgaaagaaatggcgaaaaatgcagtttccaaattggcaaagctcatggcagacgaaaaagtcatcgcaatcttgaaagccaccaaaggcaaggaaggattaacgtcaaaggaaatctcacaaagggttaatattccgaccaatcagctctactacactgtcaaaaaaatgacggaccaagggctgttagaagtgacgcaaaagaagaatattaagaattttcaggaattctactactccagttatccaatgacgcaccatgatcccaaacttggtccggaagatcctgagttaaccaaaaaaggcgttaacatttccgctgaatgggttgaaaagcacagtcaggaagtcgctcagatgattctttttcaaacccaacagtttctgagcgccatgcagaccgacattaaaaactatgcccaaaatcctgatattgataacattcacgcaggttcagtccatagtacgtggaagttatcaccggaaaatgaaaagaagctttggcaaaagattattaaattgattaacgataccgaagaagagagcaagggacaagacacgcacgatgttcaccttttaatcgaaaaatgggttcaggaaccaagtgaggaatcacaaacagagcataaagaagaggacttgtaagcaaacaattgcttcaagtcccctttttaattggctctggctaaattaaaccattgttattccttcaattagacgtcccagattaattaaattcacatttagtgcgtgtttggcaatcggtgccaataacttgagcggcaatttggtttctgagtcgtcgataattaactcttcttgaatttgtaaatggttatcgctttccaataacgtgaatacaaggtcataattcaaacgcccctgtctactgtgatagatgattgttgactctgtcaactcaacggtaatcacttccacttggtttaaagccccttgggatcgggtaatggtaaaggaatctcgactttgatcaaccgcgttgatttccggcacccatttcaataattgagatggatttgtcagaacttgtcgtgccgctgccgcctttgcattaattgtcacgctgttggtaaataatttgtcattcatgatgaagcctcctcttatttaatggcttcactttaccaatcccgatcaataatcaaaaatcagtatactgatttttcagaaattttcatatggtttctcgtgaaacaattccgtaaagatcttggcacgctcctgtgcatcgtcatgtatatctaattgtgcttcaacttcagccgttcttgccaacaaataatacagattcgctaacatataatgtgaatcgtgaccggtagcgaagtcaatgcccctcaacacccagttggctgcgcactcgccagcgatagttgaaaatctgccgcaacatcctgaaggccttgctggaggtgccatttggaaaccccaagatagtaatagtatgcctgcgtctgcccatcggtttcaattgcatcaagaacggatggcttctgcaaaaagtcgaacaatttttgatactgatgttgattacataatcgatccaatttttgattgaagtcgcgtgtccgcccaatagcaaaattactggataagctaatatcgtccaaactgatcttcaatcgcctacagagtgcaattaataagttggcatttggtgtatattgccccttctcaatagccgaaagcatcgattgtgaacagattccttctgccaattgtttttgggtcatgtgctgtgcctgacgcgtttgctttaaaataccgccaagtttgattgtcattatgattccaccccccaagtgtggccgtcaacctatacaaacagaaaaatcgccgtatcccagacacaatgcagaattgtacttggccacaagtttcttgatcgatagaaaatccagccaaaaacaattcctaacggtagcacggttgcgacattggcaacccaccccatcaacgacaatccttcagcccaataaatcggaaaatgaattgcctgaaacaggagtgcctgaatcataatagctgtcagcatatcgtattttgtaagtaagaaattacagaaaaagccgcgaaaaaccagttcttcaattaaccccgctgccaacgtgacgctaagaaaattgccaccctctttggtaaaaggatgggttgtgatgtaaaagccatgatgtctgatccacattgacatgaataaatagccgataaaaataacaagtgccagccaaaactcaatcggaaaacgactgttataaagtttcttttttgatagccaaagctgattttgcgttctactaaaccaaaacagccccaatgaaatccaaatgacagctttaaccacaacattgatcaaatcattggccatccccgtcgtatattgggtttgaatgccctttaagtatccctgaacgaccagccaaatcaaccaaaaaataagatagtttccataaactgttttgagtgaccattgtttacgcatttaaattgcccccatactgatagtttaatttggcatatgatcatttccagtcaaatggtcgcggagatatctggtaatctccgctcttaaacgaccgtgttttttcggatcatattgatatcgcggtgctgaccagtgatcaggactgtataaccaaacgggcttgccaaggcgttcaggcggttcactgacatatctgggaaacacatgggcatgcaaaaattgatccgtatttcctaaaatatcataattaattcttaacgcgccggttgcttgaagaactgcatcacccaaaatgctcatatccttaagaaactcggtccgttccgacagtgataagtcgtttaatgacgcaacctcccgctttggtaataacacggcatatccgggcagaaattgggtatcgcccatcaccgcaaagccaccggaaagtcttgccattaccgtcggattagtaccattaatcgctgagtaaatgcgattttgctgccaagtctgcataccattcaccttcgatgtatttcttcctattatcccgcgtcatttttatttgtctagagcgtcaatagattcattacttctcataacgtggacttaaatattcctaatccaatacctttcactaattaatgtataagtatataaaacaatcaaaagacatttttcttttataaatattgatcatcaaccaagtgttgtagtgggcgtctcttaatctccgcaataacaccatttttggttaacagcttaatttcgcgttgcactttatttttatgatatatttttgaatcttctgcataaaggaccttaattaattctatatctttaatgcctgtttcaggattctcactaaacaatttagactgggcaagaatataaataatcgcacgttgaaccggatccttaaatgatgcttgaattttatgataggtttctccaagctgatccgataactgccttaaattaacaatcacatccatttgcccttcactgataatccccattattttttgaataaatattgtgacatccgctctgttttcccaattatctgcttgtttaaaagctttataataggcagactgatcagcgtaaatcgcacttgagacagacagccccgtatagtgatccagcttgctggccaagtacgatgacaaaagatacctacccgttctaccatttccatcattgaaaggatgactattttcaaacataaaatgtgtcacaaccgctttggttaaatcttgaatctcatgctgattcataaattgaatcaagggcatcagtttcgtttcaatttgctgctcattaaccggtggtgtatgaattttctgacttgaagtaccaatatgtacagattggttcctaaatactttaccatctggctgcttatcgtcaccgatttcgccacgtaataattcatcatagatcttgcgaaaatcccgaagttctttaatttgatatgtttttccggttaaagttgcatgatataaccttactgccgaagccaacctacgatctggctgatttttagatgacagttgcccaaccacagttccaatttcttctttagtagttttaacaccctcaattttattagtgtaataaatttcagaagtcaaaagtttcctagtataactcattttagccaccccgggcaacttctcagctatttcttcaattttccttgagtttctagtaattaggttaaccagcttattaatttcatttgtttgaacaaagaataatggataattgtcaatttgctcatatgcctttttatccaaaacaggatacatatccgttacaaccgttgaatacccgtttaatcgtcgctgatattcagcttccacttcagcatcgcgtttggaaggaccactaccattgtatttataaattgaaagtaattggtattccataatctttgccttctttcaataattaactgtttaaaaactattatacatcacatttaattaaaaacagcccattattaaaatacacaggcaatttttcatatgtaaattaataaatcgtaaaaaatcgatttatatatcagtaaataatgctttttatttatataacattcaaaaatctatttacctcttttaaaaggtactcattactccaaataataccaaaaagcagatctttttgcttcaaaaataaagtataaccatccttgctatttttgcagctttgttatactgtattagttgaatagtacagtagtataaaaagaaggggattattatgaagcatatcatcaataaagaatccgccggtttatcagcactattgttaaccctgataattgtgccatttctttcaggatgcagcggaagccaatccaagtctctaaacaaattaatgtccagcacaaaaaaagcccatcaatattcttttagaaaatatgactgggttaaagtttcaactgccaatggcaaagaagttgcccaaatcactaatcgcagggatgttatctatatttccaatattgttggcgatgctgccaatgttgatcaggtcggccttggtaaaaagtatcttaacaaagcccatctcaactatcgctacactttctaccaagcaaaacccaaagttgccattcatatgtccgtctattcggattccaagcacgcgcaggtgacgaacatccctgttattcgcgccgttcactataagttatcggaaaccaattatcaaaaattgaaccatccgtttcaatatttaaatgcggttcatgcaaattaatccgatttaagctttaagttattctgacagtatttcgaaaggtaactttcgtcacagatagttggctgctttcgtttgatgttgaacattagggaggcctttttatgagtgaaacgatactgaaggttcagaagttaaataagtcctttggatcaaaacaagttttacatgatatatctttaaatggtcaaaagggccatgttatcggtttggttggcgcaaacggtgccggaaaaacaactttgatgaaagccattttgggattgacttcagcgcagggaacgatctccattgacggtcagttaagctcgtttgaccaccatgagatcttgaaaagagtgggcgctttaattgaatatccaagcatttatccatttattagcggtagggatcatttgacattatttgctaagggacccgaccgaaaacaacacattcaaaagactattaaagagttgcacctaaccaagtatattgatcgacccgccaaaaaatattcattagggatgaaacaaaaattgggaattgccatggcgatggtcaatgaacccgagctggtcattctagatgagccgatgaatggattagatcctcaagcaaataaggaactgcgtcttttgattaaggccaaaagccaatcaggaacgactttcttaatttcaagccatattcttagtgaattacaaaaagtggcagatgaactattaatcctcgatcacggacgaatcattcaagaaacaacgatgaaagatttactggcagccagtgatcattacctgatattgtcaacaagcaatgatcctttagcccgaaaagtattaacacaagccggctatcacttagtcagcgattctgaattaaaaatccatgtggcggctaaagttaacctggagccaattcttaaagcccttgatcatcaaaaaataaccgttttggatattcaacatcaagatggcggcttggaagagtcggttttaaagttgttaaacgaagatcaacttgaaacggagggacaaaaatgaaaacactcctatggcaggagggatttaagttactgaggaagaagagtacttattgggtaactatcgtattagccggactggtttttggctctgccctcctgagcagaatgtatcccaagactttccccgcacagttatttttcacatccagctttggcgcaacgacgtgggttgtgtttgtaatgattgcggcttgtgcaacatcgctttcaatggagtttcagtatggcaccattaaagagctgatttatcaacaatattcccgtgggactattttgataagcaagtggttgatcatgcttgcctattcaatctatttgtatgccatgactggcgttgttgctttattgggaaaaattgtactcgtgaatgataaattctcgttgggcgataccggaacatacacttatcatctaacttttctagaacaatggctggccacaatcggcagcagtttcatcactttgtggtttatattaagtatcgtattcttgtttgcaacattattcagaacttcaacaacagccgttacagtgggcattgtcatgttcttcacgtttaacattatcagcacgctaatgttcaaattaattgataagtatcactggttcaaatggaatccgttcaatttcttgaattactcaaatcaaatcgtagatccgactcggcatacattaacgctcttgtctgataatcaattattctttggaagtctcgtttacacactcttctttctgtgtattgggttactgttcttccgaagacgaaatgtttaaaccatttaaaaatgatagtcaattctaagtcccggtaaaatgcaatttcagttacagtcatccctttaagactgcaattgagattgtattttttgtgctcaagcattgaataaattatagatagtgttgctatccaaaaaaggtcaaaaaaattggaacaaaattgcttttgccccaatccagataaatcttattttttaaaggataaacaccttaattattgatcaccaaacgacttagcggttctgatcatattggaaacaaaaccgtattcattgtcaaaccaagttgcggtcttaacaacctggaagtcgccatttgtagtaacttcagtttgcgtcggatcaaagacaccgccatgtgtatcaccaataatatcggatgaaacaatttcgtcttcattccaaccaaatgccgggttatctttggtatatggcttaatagcactgttaatcttgtcagctgtaacgcctttcgtctttaaaacagaaaccaattcgcatacggatccatccacaacggcaactcgttgcgcatgaccattcaagtgaccgtcaagttccggaataaccaagccgattgctttagcggcacctgttgaatgaggaattgtattcgctgaagcggtacggtttggacggaacttcttacccttaggcccgtcaagaatcatctgcgaactggtaaaggcatgaataaccgtcatcgtgccgacttcaatgccaaattccttgttcaacgtgtaagccattggtgccaacgcattggttgtgcaggaaccggcagagataatttggtcattcgcgttaagaatatcttgattaacaccataaacaaccgtcttcattggaccagctggtgctgaaatcaaaaccttcttaacaccggcatccaagtgagcttgtgatttctcttttgatgtatagaaaccggtacactcaagtaccaattgaacgccgtcattttttacccagggaatctttgaggcatcacgttctgcgtatacgttaaattcatgaccattaataatgattgaatgatcggttgaactaacatcatacggtgcggtgccgtgagttgagtcatatttaaacaaataggcaagcattgagggagtggttaaatcattaatcgctgtaacttcaatgttaggatctttaatttccataatacgacgaagtgctaaccggccaattcgaccaaaaccattaatcccaattttaatcaatgtaactgcctcctataataattagtaaatgaaatacataaatttttatattccgatttcacctctcagtgtattcggatttagacacttagcaataatttggtttggcaaatgatgccttgatctcaataaataatcaatagctgtattgagggcactttaagtgttaattctgatcttttttgtctattatggtacaaccataaacctactatctgatctacgctgtcacctactttaaagcttggtaatcatcatcaaagcttcttcaagcttctcatcatgttgcgtgccttcttcatctaagcaacggcgcaggttttcggcaacaaccagtcccataaccttatcaacactggaacgcactgccattaattgaggcatgatttcacggcaggatttatcatcgtccatcattttcaggattcctctgatttggccttctgcccgtttaagtcggttggcaatttttggatcacatgccatttctaatgtcctcctatgtgctggattcgttgcggataagccgcactgtatattagaaatgcgccatccaggtttttgaccttaaaaccatcgttttttaaaattcgttcggcaatataacttctttgcccacttcggcagctgacaataatttgacgatctttcggcaagtcatttaaatgatttctcaaatcatccaatggaatgtttactgcatttggtaaacgaccatcccgatccagttcttctggatttcgaacatcgaccaggtaagcaccggccttaaccgcatcatcaacctcgtcgaattgaatattctcggacagtccttctaccaaattctctgccgcatatccaatcatattaaccggatccttcgccgaaccgaatggtggtgcatagcttaattcaaattctggtaaatcaaaaacggtcattcgatgcttaatcgctaccgataagacatcaattcgcttgtcagcacttgctttaccaacggcttgagcaccataaagcctgccgcttttcgggtcaaacattaatttcagtgaaagtggtgtacctcccggataataagccgcgtgactttgaccggtgatatgaactgcctgataatgaacgccggcctgctttaactgttcggtattcagtccggttgcagctgcagcgatatcaaatgaacgaacaattgcagtcccaataccgccttggttacgccgattttcacccataatcacatcagccacttgtctgccctgcctgttagcgggtgacgccaatggaattgaggttagttcaccggttaattgctgtctgatgagaatcgcatccccaacagcgtatacatcatcagccgatgtttgataacaaccgtccacaagaatgccaccatgcttaccagttttaattcccgcctccgaaacgagctttgtatccggcttcacaccagcagccacaataataatgtcagcttgaagggttgaaccatcattcaactcaagccggtgatcggcaattttgctaaccttagtatttaatttcaacgccacaccgtgttcggttgtttcacgtgaaacgattgcggccatttcgttatccataaagggtaggatgtggtcgcctgcctcgactaatgtcgtctttaacccacgcttcgtcaggttttcaacagcttcaacgccaacggatcccgctccgataaccgctgccgttttaagtccctgacccaattcagccatgattttgtcaacatcaggaatactgcgcaaggtaaagacattgtccgcttcctttaatccaacaatgtcaggaacaatcgccttagaacccggagataaaatcagccgatcataatcaagcgtctcagactggccgtcatggacagcagttacctgatgacgccccgcattaattttaacaacttcggtatttggtcggacatcaatattgaaccgttccttcagatggtcaggcgattcgacaattaatgacgagcgttggctaatctctccagacatataatatggcaacgcacagttcgcaaaggaaacgtaaggtcctttatccaacacaataatttcagtatcttcagacaatcttctgagccgtgttgcggccgacataccacctgcaacaccaccaacaatcacaacgcgcatgctatttcctcctctgagtcaaaggtcctcgttttctaaaaccaactggtttatccctaacgcttaatcggtccattccaagcgttcatgccacctttaacattaatcacatcgtacccggctttacttaaaaatgtcgctgcccgtttgcttcgggcgcctgatcgacaaatcaggtaccacggttgtggcttggaaacttgagtcatcgtatttgccaaacctgctaatggtaaattaatcgctgaaagaatatgaccgacacgatattcaaaatcttcccgaacatcaataatggttggtcgattgatcagcttttcctttaattgatcggtcgtaattgacttgaatttagcaactaacaattaatcgtttcctcttataccccatggggtatttttctttatcataacgatttccgccaattaagtaaacaacaaaaaacgcaaaatataatacccatctgcaatcatgtctcgccatccaactgttttgtcagtacgataccgatatgatctcaatgaattttgtattttacgttaaatcaaatatttaactcatttgctcaattaatcaccacttccaatttggtgaccgtcttaatccaattcaagaatcgcgttaaacacttcttgaggtaactcaatatcacttctggcagcctggcgtttgttgacgttttgacgtcttagtaactgctgtttcttggaaatactacgtttatcgccattaaccgccgcattttttctcaaaggcggcacatcgatcctggcaatcgattttccctccacaaatgcttgtaccggcattggatataaccggcggggaaccgtgtacttcatcttcttcacgattccctgagcgatcttttcagcatcctgacgatgaacaatcacatccaaagcgtcaacaggcgcataattgatgtgaacctcaatttttacaacatctgccaactcataatccaaaaaactggtgtcaagcgttgcatagccatgagattcagacttcagctcattaaagaagtcgtaagcaatttcagaaatcggtaatttataaaccaattcaactagatcaccatgattgttcatatccagtaatgttcccaaatgattatccgctagcctcataacaggtcccaaagacgcactgggtgttgtcataacggctttaacaaaagattcctcaacataatcgattttagaaaagtccggaaacttcactggatttgtgacaattaaaggtgtttcaacgcgcttatccttgagatatacctgataagttgaattaggcgctgttgttaaaacggctacctggtattcatcattcaatctttcccggataatctgcagatgaagcatccctaaaaagccacaacgaaaaccgggaccaagtgcatcagaagtttcttcgacatagtgaaaagaagaatcgtttaatgccagcttttcaacagccgccttgagttctttataatgatcatcttttggataaaagcctgcaaataccatagacttggcgggttgatatcccggcaatgcctggtcagccggtcggttggattctgtcaacgtatcacccacccgaatcaactggggatcctttaatcctgtaaccacatagccaacgtctccagcggataattgcttggattgcttcatatccggggcaaaaacacccacttcatgacttgtaaaaccagtttgatcggccattagcttcaagtgctggccggcttttaattgaccatcataaagccgtacatacgccacaattcctttgaaagggtcataaagagaatcaaatacaagtgctttcaatggtttttccagttgtccggttggtgctgggatctcttggtaaattgcttccaaaacgccatgaacattttgaccggttttggccgaaatttccaagatctttgtataattgaatattggatccaattgacggatttgctgagccgttgtgttaacatctgctgtttcactatcaatcttattaatcaccggaataatcgttaatccattttgttttgccagtcgaaaattagcgacggtctgggcttgaacgccctgagttgcatctaccaacaaaatagccccgtcactggctgccaagctttttgaaacttcatacgaaaaatcgacgtgtcccggcgtatcaataaaattataatcatattcctcgccattatctgcacgataataatttcgaacggttcgtgatttaaccgtaataccatgtgcctgctcgacttccatgttgtcgagaagttgatccttactttcccgttcactaaccgttttggtttgttccataatccgatcagccaacgttgattttccgtgatcaatgtgggcaatgattgcaaaatttcgaatatgtgtctgtttcacaagaatacctccgtttacttaccggtttttgaagccagaaagccgtctaaataaaatttaaatgcttgaacggcatcagtttcgagattgacacgaaagtccttaaaattggatgtcaattttttgtgattgaattcatccaatcccatcatgttcatcaagccgctgataatcgcgctttggacaacaaaaagatgactcgcttcagaagcggaaatgagtgtgattcgttcagcaatcacctcaccaagccgttgactgatttcatacagcctcttacggccggcaagtgtttgctgaatattggcacggccctccagaaccggcgcccgaagtgcatttaaccgaaccaaaacagattgatcccgaattaaatacctggtttgtgcaatcataaactcacaaaacacttcattagaaagctcaggtggcagctgttgcaattttttgattaacttcttaaagtaattttgataaccattcaatagcaaaaacataaaaatattttccttagtttcaaaataattaaagagtgttcctttagagacaccggattgagtcgcaatttgggacatcgaaatgctgccaaacgactgcgttttaaaaagagccagtgctgtgtcagcaattctacccgctttttgcgtccgttgtttttctgttaaaatattcaacttaattctccaaccttcatttaaacaactcaaaattcaatattgaccaatagtcattttagacgtaaaacagttactttgcaactcataaatacttaattgccaattttactgcctcttattgcctaatataactaagtaatatgtagataaaaaatgatcggaataaacttagaatttactccgaccattttcttaatgatattatcaaatcaatcatctattttaatgaatcacctgccgaatcgacaattctctaatcatattctcaattcagcagataatcttgtaaaattaaacagcttttacgccattatttagaagtatgatgcttagcttctttgataatctttaacgctctcttgcgaatcttaatacttggactctttaaacgacgataggcacttgccaaatcttgtttttccatttaagtcacttctttcaagaaaacaattaccaactagccttatggacaccaggaatttggccgaggtgcgcatattttctaaaattcaaacgtgacatgtcaaacttacgcatatagccacggggacggccatcaatatggtcacgccgacgcattctaatcgggttcgaatcttttggcaacttggccaaagcctcgtaatcgcccttcgccttcagttcacgacgtaaatcagcgtatttagcaactaatttttgttgcttttcgtacttaacaatttttgatttttttgccataaaataatctcctttacttagtttctctaaaaatcgcgcgtcttcttaattttggtgaatactttttcaattccagtctatccggattattccgcacatttttgctggttaaataaatccgttcaccggtctcaacacattccaaaacaatattttttctcattattttcaactccactatttaattaacagtcacaattaacgtcacaatgatcaaattcttgaagatacattcccgcacgccgatacatcgtggttattcgcggattaatttcaatcccgattcgtcttaaaaccgtttcggcaagcggcgcaaatcgttgccggtatttatacacatagcacaagtcagcatctccgtgttgaacctgggggtcccagcataaaaacgttgggtaggatagttgattcatcatgctcatcaagcaccggcctattatctttattaataaacagtttctcggctaacgggctcaaaatattagcaaaaccagtcgcaaagatgggttgattctccgttttggtaatggaaccgtccttaaacaagatgacataatcatcgccatgatgatcatgcttaattgctaaaactgacttcccaacgttcaagtttatcaggtctgcgtgggccatataacgctcataggtgtaagtcgataaccgatggccggggtccgggtcattggagttaaacgcactctcagctgaaaataaatcattaacaatgttcttttcagccaaattgatggctaaatcaaacgccgactcgttcccaccaatgataacctgttcttccccagatttaaaatgattgtaatccttaacgtcaacatagtgaatgccataagcagaacccggaattttgggtacatagggataggcataatctccaatcgcgataaacacataatcagtaacgagtggcggctgcccaacaagctgtaatgcataccggtgatcgggcaatgttttaacctcttcaacttctgtatgaacccgaatcggtaagcttttattttgagccaccttttgaaggtaataagcatagtcgcgaccggaaagatgctcagttcccaatgtataggctggagatgtctctggtgtaaccgcatttaaatcaggaaacccgaaaccgttcgtagtaaacgaaggtgatataaaccgggtatggcgattccaccttcgaaaactgtccccaatctcgcccttctctaaaatgacgaaatcacgaaacccatatgatttgactgcagcaccgaaaccgattccggcggcacctcctccgattaccgtgattgaaacatgttgtgccataaaagaaatcgatcccttccaaaagtcgctggtttgacagcctgattaacggccaaaccgtctttggctaatcgaccaaattactatgtatcagttattcaggttgattaatcagcaaaagagtaaacgttagcgattgacatgcaaagcttaaatagtaactgttacgatttaatattatgacaactatttgaaaatttgtcaagaaaaaaagaagcctttttcagcctccttaacaaatcttcttcaaatagttaaaacttaccagttcgtcgtttcaacccagtttcttaataaataaacgttaactgcagattctagacctgccactaccaataatgccaatgaactaagatatatttgataataagaattatcgttcaccatgccatagaatatatcaccgattggattaacaatctttcccaagatgtacaaaatcgcagcaataacaaccacataaagaatgaatcgatacaaacgtgaacgactatcaggcagaaaagcggttaaggcacttgttgtcaaatgaatcaaactgatggaagcccatgcaaaaattgtagacacaatcatcagaattaccaggccaattaatgcaccgataatctcacttctactattcattgatcccggtgtaggagaggaatgttcaaatgcctgaccaagcgttgtcatcacttgttgaaagttcatcgccgctgcaatcatgctgaaaataatttgcgtaacgcccagataaatcatactgataaatgctgaaagtaggtttgcggaatataagccggtgtcactagttggcaccagacgatatgaatcgttaacgaagatccgctcgttatgtcgtgctatcagaatgaatgcaacaaagaagacaactaatgagtaagacatcgtgtatatcagtggatcagccgcactcaaatctccttgataaaccgcgtataagatagttagtaaaattgcaataatatcgagtaccagaagatggttgatcacttgtatctttcgtcgcgtaagcgcgtttgttaatgctccaaaactagtcatgtaattcagtcccttcataaactttttcgtagtattcttcgattccttcaccaaatttttcacggatttcttcagtactcttttgggcgaaaaccgttttgtctttaatgatgacaatttcatccagaacactggcaatttcagagacatagtgatcacttaccaggattgtcgcattgtcgggtttccagcgaataatactattaataatcttctttcgggacatactgtcaatcccaccgaagggctcatccagcaagtaaacttttgcccgtctggataatgcaagcccaataatcaacttctcacgcatgccttttgataattgtgataacttttggtcttcgttaatttgtagaaatccggccatttgattatacttatcttctgaaaagtcgggataaacatcctcataaaaacgaacgattcgctcgattttcatattttgattaaaaccggacaattgctcactaaaactaacgatcgcttttttagctgctatcttactttcatctacaacactaatctgcccctggtaccctttggcaactcctgcaattaaccgcataagcgtcgttttaccggcaccgttttcacctaacaggccaactatttttccagacgctatcgttaaattaacgttcgatagaatcggtttcatattttttcgatagttcaaatttttaatttcaattgaatttgtcatttttgatcacgctcctgtttatttatatattgactcacataatccaagatctcttgatcactcacatttaattttcgtaaactatcatacatttgtttaagttgttccataatcaatttacccttcaactcttttaccttattaatatcttcagtgacaaagttccctctcccacgttttgattcgatcattttttccgtaaccaactcgcttaaggcccgttggattgtgttaacgttaacggttaggtcaactgctaactgccgaactgcagggattttctcaccaggttcaagcttgccggtaataatttgcctgtaaatatattccttaatctggtaatagattggaatcttatcatcgaaattcattgtgccacctccctagtgttatattcatctattacactatagcatatttacactaaaagtctagcaaaatgtgttaactaattatttttgcgtctgttcttcaacagatagtaatcttgtgaagtcattatttcatcattcaaaaggcattttcattgattttcacaaggtttctgatatatttaaggtgatgatcgttggaaccgtttacagtgttataagggggatttatcatggctatcaaaaaagtgaccgttgcaggcagcggtgttttaggaagtcagattgcatttcaaagcgcttttaagggttttgatgtgaccgtttatgatattaatcaggaagccgttaataaggcaaaggatcggattaagaatttacgtcatgcttatcatcgtgatattgcagcaagtgatgaagaattcaacgccggtatcagtcggctaaaatatacggatgatttggcacaagccgtttcagatgctgatctggtcattgaagccgtcccggaacgtccggatatcaagcatgacttttacaaaaagatcagcacacttgccccggctaaaacgattttcgcaagtaattcatcaacactggtcccaagcatgtttgcagctgacacaggccggcctaagcaatttttaaatatgcacttttcaaatcaggtttggttaaacaatactgctgaaattatgggctctcccgaaactgatccggcaatctacaatgaaattgttcaatatgcaagagatatcggcatggtgccgattcaattgaagaaggaacaaccgggatacatcctgaattcattgttaattccatttcttgatgccgcagagaaactctggattaacggtgttgccgatccacatactatcgacagaacctggattgtcgcaacaggtgcaccattcggaccatttggaatcttagatgccgttgggatcagaaccgcttataacattacagcggccagcttacctgacaatccgggacttcagccaattcttgataagttaaaggaattattagatgaaggaaagcttggacaggagtccggtgaaggcttctataaatatccaaatcccgaatttaagcaaaaagactttttgaagggctaataaaactatttttaaaagatcagatttcaaaataatagttaacttaaactaaagggacacaaggcaaaaagattattttgtcttgtatcccgtttttttatgctttaagtttaaataatttcgtaaagaaccaaaagttaacggttcccactaatagaatcaggccaaaggcaatctgactgccgaccgcaacgttttgtgcatttgttaaatgaggaaccgtgattgaactcattaaaaccgccatcacagtcgtcccgattgatcctgcaacctgttggccggtgctgtaaaccgcattcgcgtcattcctcacatcagcactgagaatcttcagtccataggtcatactatttccaaatgccattgaacgtcccatcgcaaacaccaaatataataggataatagcgatgatcgttaaatgacgaccaaacacggtaaacccgagcgctgtaataaaaaacaacgcattacccagatataacggtaatttgccaccatagcgatccaacatccagccataaatcggctgtcccaatccatttaaaatacttccgggcaataacacaaggccaccgataaaggcgctggcaccgtcaacaacttgcacgtaattgggtaatagaaagttaataccgatatttgaagcttgaagcagaatgtatggcaggaaactgtaaataaaagatgggtgcttgaaaacagacaatttaaaaagggctttatgactgtatttggaacgccagccaaacaggccaaaagtgataatcgtcacagcaaagtaccatagacaattaatcaaaccatgaggatcgcccataatattaagtcccataattaaactggtaagcgccaccgatagtaacgcaaaccgcaaccaatcaaattcatatttgcgagttggtgaatactgtttgattttgaaaacacctaatataagtaaaagtgcggttatgggcaatgttatccaaaaaatcatccgccagctggcaaagtaggcaacggttccgccaaaagttggtcccaaagcaggtgcgattaagataatgaggtttgccatccccatatacgttccgaattttgttgcaggcacggtatccataataatattgaccatcagtgggccagtgaggccaacacagccggcctgaattaatcttcccagcagcaatacccagtagctggtcgcaatacctcctaaaatatccccggtcataaacaacaacgctgcgcaaacaaataattgtttattcgtgaaacgtcgttttaaaaatgcggatgccaacattaacaacgcaaccgtcaataaataaccagttgttacccactgaacggttgttaacgacacatgaaattgtttcattaacgttggaaaagtaacattcattgacgtttcagttaaaacacccataaatgtcattaaggaaataattgaaatgacgaagaatggatgttttttattttcatcttcaattgttgtttgcgtttctgccacagtttagaagcccccatatcagtaatttatcgttaagtgcgcatttaattatgataaacccatagaggggaaacaaacaaggataattttagtaaaaattggaattattttccggttactctattcacatgaacttgagaattacttctaaaaagcaattagcaccagggtgattccccccgcagtcattttttcactattcaaaaccactattaattgattttcttatcattaattaatagcccaaagcgagtatgttatacggacttgattactatatgtggctaattgaatccggaaaacgttcggccggcttttaattgcatagtgtagaaataatgacctttcaagcatcatgacagtttctcttgaaattcaagttaattagatatagggttttgtttaaatatctctttaagaagggggagtgattgaatgagcggtctaacatcgagtatcgctattttagttttattattattattctgtattgcctacatcgttaatcctataaaagccccttctaaccacattggataccgcacaaaattaagtcggtcatccaatggaaattggcaattatctcaaaaattgttttactgtttatcaatttcttgtcagtcgattttagtgatcgcaaatgctttcatagacatttctgtttcaactaacagtttcattctcttaggatacatgttcattattttcgtaatgattcaatcaattttatacaatcggtcaaaaacacggtaattcaaaagggtctgcattcactgcaaacccttttatcttattcactttagcattcaattagtaactgtcataaatgaatcattcgtaatatgtgtcaggcaactctatgcctggttccaatcaaactttagatcgggttggtcgctatgttggtttgatgattagtttctacttacactggaaaccgattccgaaattgtttctttgattgcatcccccaatcgcttaatgcctgtcttaatatgatcctcagacatatttgagtaattcaatctgaacgtaccaggggtaacagcatcgggatagaatggttccccgggaacaaacgccacattgtgcttgatacaggtgtcaaacaacgccttggtatcaacatcaccgggaacctcaacccaaatgaataaaccaccttcagggtgactataatgaacattcttagggaagaatgcttcaattgcattcatcataacccgttcacgttttcgataaacctgtttaattttgtcaatatgatcgtcaatatcatattccgacataaatttggctacgatatgttgtgttaaattatcagagtgaacgtctgcagattgcttcattaacgtaaacttcttagtaagagatttttcagcaacaatccagcccaatcttaacccgggtgccagaatcttggaaaaagtacttaagtaaatcacccgctcgtgatcatcataaaatttaatcggctcaatatcgtctccagcaaaacgaatcgctccatatggatcatcttccacaatcatgatgtcgtagttatcagcgatttcaatcattcgttcacgccgatctgcggacattgtgcgtccggtcggattttggaaatttggaattgtatagataaatttcgtattgggattttcagctactgccttctctaactgatcaatcttcatgccgttctcatccatatcaacaccaacaatatgagcaccataactacgaaaaacatccagtgcacataaataagtcggcttttcgacaattactgtatcaccgggatttacaaacatcttggcggtcaggtcgatggattgctgcgacccggttgaaatcataatgttatcaatcgttgttttaacgccttggtgatccattcgtttaacaatctgctcgcgtaactggggataaccgattgcagtgctgtactgtaaagcctgacgaccgctttcatcataaacttcatcagtaactttctttaattgtgccaccggaaataattccggggctggtagaccccctgcaaatgaaatcacgtccggactgccggcaaccttcaaaatatttccgactggatcctcatcactttctggtacacgatctgaaaattgatatgtcattgtcgaacaccttccctttgagtattattatccgcaacattttcctgtggtttgtggtactttctcatcatttcagccatatgaacttcatgaacaacaaattcatgcgttcgacaaatgtaatcatgttcccgaccgattttagcgatatagccattaatataatcgacttctgtgggacgaccttttgaaaaatcctgatacattgatgggtaatgatacttgtattcttgactgacggtaataactgaatcaacttgctgctgacgggttggaattaaataaattccggcacgctcacacgcatcatatgcttcatcaaataattgtcgtgccattgctcgaacaccctcatattcaataaattgccccatctgcatttcaaacatcgtacacagtgtgtttgtaacggcattgaaaacaactttagacatacacattcccatccaatcatccgcaaaaactggatttagcttggcttttttaaaatcatcagcaatcgcttttgtcttttcatcaggtttgtcatttgtatatctggccatatgcatcacttcagtaccttcaacgcccataaaatcaacattcgctggtccatccattcgagttgcaatcatcgccgtgccacaaatgatatggttctttggaaaaaactttgcgattttttcaaaatgtcccataccattcattgctgaaaaaacgtattgatcatcgtgaaaaattcctgctacattgtcgcgatccaattcttcagctaattgcatctgttttttaaaaataatccaaacatccggatgacctgaatactcttccgggtagaaaatattgatcggaataatacgacgattcttgtggtcacgagcaactgagacaccgccttgttcgcgaaccttctcaacattcggctcccaggtgtcgatgaagtcaacatcaacgccggcattcttttgtaacataacaccatacctatatcccattgctcctgcgcctataatgccgtacttcatattgaccactcctcgtattttattttttaaatacaactaaaaaacgtcctttggttatcaaaaccaaaggacgttaaattaacgcggtaccaccttaatttgagttgttctcacaaacaacttctcataacgtgcacgggaaatttatgattcaaaaatcataaattccactgacacgctgcacaataatgggtgctaccagttcacctcgaaaagtgacgttgtcaaattcagtctttcgaatcatagtcttaatgcactctcaccaaacggcactctcttagtaaggctgtgactttaaatccactgaatcaaatcaattagtcgtatttaaatgttgtatgaagtgtaagacatttattaaggcaatgtcaaccgccttttttagattttttgcttttttctcatcaaaatgccataataccaatgcttctacaaacaaaaaactttttacaaagctctgtgatcatttgctgaaattgcggtccgtacgttatagttagattgaaagaaggcagtggctatgaggttattaattggaattgggggacttatttcactactgctttgtatcggcgccatagtgcttcttttcttaggaaatgaagcactggccctaccgctcgtcattgtcggaacgattatcatgatacttagctggctattatccgatctcataagtcgaaaatcaaaaaagaaataaatcgggttggtcgctcaacgcattgaatggagatgtttaagtgcaaatcaggactgttcgaaaagaagactattcagctatttcggatcttattttaaccgcgttctcaaaatcatccaacggctatggcggtgaagcagagctggtagaaaagattcgattagatccaacttaccataaaacacttgaagtggtagccgatcaatcgggccaaattatcgggcacggcctactcagcgaggttcaagttaaaaacgcaaaccaatcgaaaaccggtttgtgcttggcaccgttagaagtctcgccatcttttcaaaagcaaggtattgggcaagccatactcgcagaattagagcaacgggctaaacgggccaagtacaactttatcagtattcttgggtggccggattactactcaaggtttggttataaaaaagccagcctatttaatattaaagcaccattccctgcaccggacgatgcatacatgataaaggcattggttcctaaaggacttgaaggcgttaccggtactgttaattatctatccgcattcaatatttagcaatattctgtcgaaacctatctttcctgtggtaccttgattttttctgttgactgataaaaccatcgtttttgaagtcattcggattatcctaaataagagaactaatataaccgggaaaggagaaaaacaatgaaaaagagattttttttaatattgataatgagtatctttgccattggaatagtgctaccttcaatgacatcaccggtagccgctcaaaataaaattgttcttaagtcaggttggaaggttatcaagggagctgcttatcctggggttccatatcatgccaaaacccccaagcaaagtgctattctttggacaacaccaacagtaagcaaacatacaaacctaaataagtacccttatgaaacttggaatgtggttggtgtttgggtacttcaaaagggggcaaagaagcgggtatattatcaagttgatggtgaacatgacactggctgggtatggcgtggttatttaactaaagggaagaacccaaatgctgcaaaagcgaatgataatcctaatcgattaccagaagatgactagctaataattgagaaccgcataaaaagaaacttaggcaatcctgaataggatcttgtccgagttcccttttagttaagagcattttaaatcgtatgtatcatctatcactcgggcaccccattatgaataaacaatttataattaccaaaaagcggaaaccgcattaaaggtttccgctttttactttttatcagcctaatcaacgctcactttaaatgttccgcaaaatcgcggacatttttttgtacaaaatcgacctgtgaaatatccagtcctgtatcggtataaatgttttggatcagcgcgtgacccaaaatcaaagtaatataatttgtggcagtaatctcaatattaaccaacccattaatttcccctgaatgcttcatttccgtcatccgggacactaagatttttttgagtttcatcggtaattggataatcatttcttttaacttgggaaactgaaacgaatcccgcataccaattagaaataacgctttatgagcttcaacaaaatgattatacaagtcggcaacccgcattaaatcagttacaatgtcgccactcggtataaaccctgcgttgactgtatcaatatcgctcatgtatttctgaaccaactctttaacaagctgttctttatccttgaagtggcgaaacaaggtactctcattgacgcctgcagcttgcgcgattttcttcgttgttgtttccgtataaccattttcttccagaagcttggaaaaagcattcaaaattttttcatctgtcgttattttttggaccatttatcagcaaccctacctttcagaatcgacttgttaagcccattatatccgattaacttagttgatgaaaatcaaggattggctgatgctttctaaaggtcacaataacgatatttactatcaagattccaagtgccaaaagaaccaattgtcccaaatacatgccggcctgactaccgccaaacataatattaaaatctgcttgaatactgtaaaacatcggtgaaatataatgagcacccttgaaaaacgaattgagtgttaccaaagggatcatccctgcacctgaaacaacctggatcattgttagaaaaatatttaacgcggtgccaatctgaccaagcagtaaaaccagaattaaattaaaattcaatgatccgaagatttctaatccgtgatttaaccataagtttgcgaactgcgaacctccaagccccataaacccggtgatgctccatgatgtgaacaatgaaccaataatagataataagattgctgctgtttccagaaacgcgaatgatttgaatcgaccaactatcggtacaaactttgcatatgtgccatagagaagaagagcaccaattaatgttccgaggtaaacggcaatatttgcaataaatggagccagtgcatgattcattcccgtcttaaccggatggacccgaacaagatttgttccaacggagtgatcaacatcttgatacgtatcggatacccggttgcgaatggctttggattgttgcttgacttgagcctcaagtttttgttttgcgttcaactcctgatgcttaagaagcgcctctagtcttggctgctgagcttctggagcttgggcaatctgttgttttttggcctgtaattgattttgaagttgagcctgttttgtttgaactgttttttccaagcccgtcattggctcttttaacaacatcgccttacctttttctataatcacttgttgattaacggtataaccaatcttttgagagactgtttttaatgcactcacctgtgaataaggggttgcttcatcgatatagaaattcaaattggttttagaattactactaatccttgatttaaagttccaaggaatctcaataatcattgccgtttttttattgtgtaactgctttttagcggttcttagactagaaactttcttgatatgcttaaacggcaaccctttttcaatttgatctgccaacgtccgagtattcttatttcggttaaccaccgttactgttagttcatcaacatgtttaggcattgcctgatatcccgtaaaatatatcgcaaaaatcaagcaaccatacaaaattgacacaatcgttgccaggatgacaccacgactcgttataaactttttaaaattcattttaaacacgcctacttcctttattcgatgccagaagtataacagtgtttttgaatgcatgcaagcacttgcatgcattcaacttaataaataagtgcctgggacataattccaaagaacattacttttaaaaaaactcccgtgaaatcagtttacaaaaatactgatttcacgggaatttcactttgaagtgggaacgttgtcgtattgatttttgactattgtcccagcctaactggatctaatcttagattgtttattaagacattaaaataggctttcagcaacctgctcaatatccgcaggcgttgtccgacaacagccacccacgatcttggcaccggcagccaaccatttaggcgttaattctgcaaaggtcgttgcattgggattaggtgtccaagttttcgttttaggatcataaatatcaccattgttaggataaacaatgataggcttgttcgtatttgaagcaatcgttttaatgctgtcctcaattaaattcatggacgtacaattcacaccaactgcactaatttgtggattatcttcaaagtaggataccgcttttgctaaagatgtaccatcacaaagatgctccggatccttaatactaaacgttagccatgcaaatcgatcagagaatttttctctcagcaaatcagctaatgcctttgtctcttcaaaatttggctgagtttcaaacgcaaagacatccacgcccgcctcatccattaaccgcattcttctttgatgaaacgtttgatatgcctcattagtcagttgataatgacccgtatactcactaccatccgccaagtaggcaccatatggaccaacacttccggcaaccagtggataaagggctcgtttggctcgttctgccgtgggtaacgttgcgtaaaaatcatccctggattccagtgccaaacggactgcttcggtgatcaacttttcactttgatcctcggtaaaaccaacttttttaaaagcttctacatttgcttggtaggtatcagtaattgtaatgtctgcacctgcttcaaaataacttgtatgaacagctttaacagcatccgggtcattaattagtgcagttgccgaccataaatcattacttgtatccacgccgtgcttttcaagttcggttgccattgcgccatcaagcaccagtgctcgtttgctatctaaattttctttaattaagtccgtcatgatttacctccgacatattttgggttgtaacttcttctaatttagtgcattcttttatgtattggattctaatcattttatctcaaaatgagaaaaaagcaattgtttggaggataacttttatgaaagaaaaaccgcatattgcacttgaacgcaaaatggaatcacggcatcttctaatgatttcactaggcggtgtcattggaaccggtcttttcctgagctctggatataccatccacgaagccggtccggtcggcacaattttggcctatggtattggcgcaattatcgtttatttagtcatgctttgtctgggggaactctccgttgcaatgccacaaaccggatcattccatgtttatgcagataaatttatcggcccggggaccgggttcactgttgccattctttattggctgacatggaccgttgcgttagggtcagaattcacggcagccggactaattatgcgcacctggtttccaaaatctcccacttggatctggagcctgctgtttatgatcgttattttcacttcaaatgcattgtctgtccggttttttgcggaaaccgaattttggttctcaagtattaaagtgattgcaattattctttttattattcttggtggtttggcaatttttggggttatcccgattaaaggctatactcatgccccgctgtttcataatttggttaaagacggcctttttccaaacggcttcaaaggcgtttttacaactatgttgacagttaactttgctttttcaggaactgaattgattggcgtaacagccggtgaaaccaagaatcccgaaaaaaatattccaaaagctatccatacaactctgttcagacttgtgatcttcttcatcggaagcatcaccgttatggcctcactaatcccatggcaaaaagccggcgttaatcaaagtccatttgttttggtattcaacagtattggtttaccctttgcgggcgatttaatgaatttcgttgtgctaactgccattttatccgctgccaactcaggactgtatgcttcaacgagaatgctctggtcgctggcccacgagggtatgataccattaaaatacgctaaaacgaattcccgcggtgtgccgatgatcgcacttgtccttagtatgctgggtggtgtgttggcacttgtctcaagcgtagttgccgcctcaaccgtttatctggtactggtttcgatttcaggattagcagtcgtgattgtttggatggccattgcctattcagaaattaattttagaaaagcatggcttaaagccggtcatactaaatctgaattaaagtttaaaacgccatggtatccgtttgttccttgggtcgcatttatcctaagttttttatcatgtatccttatcatttttgaccctactcaacgaccagcgttattctacatgataccatttttgattggctgttacctggtttactacgggaaaaccaaattcaaaaaatcaaaaagccggcgcaagttatagcttgcatccggttagtcgttcatgttatttagtgagtgtttcttcttgagaagcgctcactttttgattttccaaagattgttcggctaattgtactaggaagatgccgtaacgcacaagcacgaagatgaccatacaagtcgcgatggttatttccacatttgctatgataccgaccaggttacttaacccgttgacaagatgaaaggtatgatgccataaattaagtgctgttgcggaaatgacaagtgggaaggtaaaagcaccaaaacttggataaaatgataggcgaacgtacttaataatctttacgaatgtaccccaatacaatgtttgtgccagtaacaccatgattagtgaaaacagccaggacggtgctgggctcatatttaagtagcctgtcaaacaaagcgaagccggtgccgccataattgctagtaagggcaaggtagcttcaaacatgagctcgcggcgcaacagacggatacaaacaattggcaataaaatagcatacaatccaagcgatagccataaaatcggtgtgccgattgcaggaataaaattaggtgccgttaccggaatgacgccgataccaacaaaagtgacaaaccagcttggataaacattatccaagtggacggaaggttttagaaggtgactataaacaaaataccccattatcagaaattgcaggcaaactgcaaatacccaaataaccattggcatcatcggtaactgccatgattttagaaaagtgctcaaaatcatcaatgacattgtaaaggtcggtgcaaccgatgcgataaccggatcttgtaggtcggcaaaactgtgtttaaagtgaatcacgattttagcaataactaataaaatcaaccctaaaccaataatgccccatagattgccaatcagcgtcagcccaatggccttgaataaatttcctaaagacacaattcccaatattaagccacaaatcggtaatggtaattttttcaaaaataatctcattcattttccctccgttctttgatgggttttattatacgtgctatgttagaataaataaaattgataatatctatatttattatagacaaactttataggtggtgagttgatgtttaaattcttagaaacatttatgactgtttacaaaaccagaagtttttcactggcggctcagcaactttttatcacacaaccaaccgtttcaaatcaaattaagcaaattgaaatgcagttacatactaccctgttcgaacgtaaaagccgtcgtgagatcaccccaactcctgctgcagatctcctctatcaacagtcaggaaaaattttaaatgattggcaggcagttcatgatcaaatcggacatcttgaaaatgataacgtccgttatgttcattttggcatttcacaaactatttcacgaatcttgttttccaaaaccgctagtcgccttctaaccgattttcccgatgttaacttcgacatcaccgtttcaaattccgaaaatgtcttaaaccaggtagaaacttataaagttgatatcggcatcatcgaaaaaccattggtaaccgaaaccattagacgactatccattggtaaggatcaactagtgaaggctggtaaagataccggcacttggataacaagagaagccggctccggtattggttactacaccgaacaatactttcgtgaagctgacattcaacgccaaaaattaatacgggttaacaatagcggcttgattcgaagaatgatttcccaaggagttggccaagcactgctttcaagccaggatgtgccacagggaattcccatcgaaagcctagggaatcattttaaacgcgatttttatttattagtgaaggaggaaagggcaaaggatccctttatcaatcaatttttggaactaattaaatctgttttgccaactaacatttaaggcacaataaatcggagataaaagcaaatgaactttttgtctctggtttattgcgtaggtgtaattagtcaaacattagtcgttatttttcatgccgacacatactctggataacataacacaggcaatagaaaatgcgttgacaatcccagttaaatataacaatgatttaatacattaaaagcccgtcttcattaacgaaagacgggcctttaatggcaattcatttaaattcaacttattggcaattcagtatcaatcacctagattgccattctcaactttttttcattcaaactcacatttcgataaatcttttcaatggttttttcataatctttattggcaacgccaaacactaatttaatatcactgctttcttgaatcaccaaatgaattttaatttgactgttatccaaaatatccaaaatttttccggcaaccgctggtcgttttccaagttgatcggagaccactgcaactaacgaaatatccttttccaatttaacactgtccagatcggactcttcctcaagggcactaataatttcctgtaccttattagaaacggctgcccgcttcgcaataaagctgaatgaatcagttccagacggtaaatagtcaaaggaaacgtcaaatcgttgaataatagagaagactttcgacaaaatgtccagtcgcttactgagctggtacttattaatggaaataatcacataatcttttttaccggcaatacccgtaattaaatttgcggtattttcccgcgcctgatcaactaccagcgtaccgtcttcttcgggatgattagtgttcaaaatagcaatcggaatccgttttgccctcacaggctgaacagcttcttcctgaaaaacactaatgcccatgtaggaaagttcctgtaattcttcatatgttaattcattaatttttcgagactggtcaataatacgcggatctgccatctttatcccggaaacgtcagtccagttttcataaagatctgcatccaacaaattagctaaaatcgaaccggaaatatcagatccaccccgaggcatcaaatgggttctcccactttcatccacaccataaaaaccgggaaccacaattcgcgaactatctgcaacaattgattttaaaaggttcctggactccgaataatcaaattgatcgtcattaaaaatcatgaattgcttggcatccacaaaccggaaaccaagaaaatccgccattaactttgccgtcaagaactcaccgcgtgacaccaaataatcatgaccggcttgagcaatttgagacttgattaccctcagatcgtcttctattgccacattcaatcccagatcatcacgtattgaaacaaatcgttctgcaatatgattaaacaccggtagatagtcctgacctgcatcccgcaattgctcgattttaatcaagagatccgtcactttaaccggctcattctcacttctaccggcagcactgacaaccactgcctttctatccgcgttacccattacgatggcttttacttttttaaactgatccgagtcggcaaccgaactaccaccaaattttgctactttcattctgattcaccctctttgcttggcaaacttgccataaaggccgtttcgtctttttcaagtacttttctcatcaatcgatgcatctcaccgaccggaatctgttgaaccaaaagataatcgcctctggtacatggattaaacttggcaaataaatgtgcacaatcaatctctgaacgaacaatataattacttctggttaaatccgatcgatactttaatttgctcttgaattcacgttttaaatgttctttattttggaaaatgtccagaatatcttgaataactgcattagcagtagggagttgcccggctccttgccccataaactttaagttgccgatggtttcaccgtgcagcgaaatcaaattgtagttatcacaggtattggcttcaagcgtatcgccgtgatataaggtaggttcaaccacatagtcaaattcgttgccatgttgatgactttttcccattaatttaacggtgtagccctcttttgagaaatgagaaatgtcatcttccgtaatatttcgaatgccaaagattggcaattcggctgtcggtttcacaaagtaatcataagcaatatcacaactgatacataacttgttggcaacatccaacccgtcaatgtctgcgcttggatctgcttcggcgtaccctaaagcctgtgccttcaataagacatcgttgaaagtttcaccactgcgcttcatctggtcaagaatgaaattactggtaccattgaaaattccttgaattttgttaacatcatcgacccgtagtgcccgttccaacccttgaatccaaggaataccgccacccacactggattcaaaatagaatttaacgccgttttcgtcggcaatttttgtaaattcgtccatataacgggcaatcaccgctttgtttgcagtaataacgtgttttttatgtttaagcgcctcaagtatgtattggtgcgctggttcgataccgccaattacctcaacaaccacatctaaatctttatcatttaaaatttcatcgaagctgtcagtcatttccggtaaatcaggttttttattttttctaatcaaaatatgtttaacatggaggttttgggttagacggtttgccttctttataattttataaacgcctgttccgaccgttccaaaccctagtattgcaatattcacagctgtaacctcccgattctctcttttgttcattaataataaacacttgttttttaactgaaaacagattatcataatagtcacagaaatgcaaggagtaaaagtcgatgaataaaaattatacgagtaccagaaatgattcagtatccatatcagccaaagaagcaatcaaaaaaggattcgccgatgacaagggattattcgtttatccggatcttggtaatgatcaattggatttagaaaaaatccttaccttggattataagaatattgccaaaaccgtcctggccaaattgctaccggatttttccaaaggtgaaatcaacgacagtgttgataacgcgtatagttcaagctttgactctgacaaaatcaccccagtagcggccgttgataatttccacattttggaacttttccatggcccaaccagcgcatttaaagatgtcggccttcaactattgccccagctgatgaagcacgttttaaccgatgataataaggtcatgattctaactgcaactagtggcgataccggaaaagctgctttagagggattcaaggatcttaaaaacatgggaatcatcgtcttttatcccgatggcggcgtcagcaagatccaaaaactacaaatgattacaactggtggtaataatactaaagtggccgccatcaagggtaattttgatgatgctcaaacaaatgttaaattaattttcaatgataacacactaaaagaacaattaggaagcaccgttagtctttcaagtgccaattcaatcaacattggccggttgattcctcaggtcgtttattattttgattcttataagcagcttgtagaagatggcaccatcaaaccaggtgataaagtcaatttcactgttccaaccggcaactttggtgatgttttggcaggttactacgctaaactattaggattaccggtcaataaatttgttgtcgcatgtaacgaaaacaatgtcctggcaaccttcttcgaacatggtatttatgatcgaaatcgaccattcttccaaaccgttgcgccaagtatggacattcaaatttcaagtaactttgaacgattgctttattataagagcggcgaaaatagtcaatacgttaagcagctaatggacgatctcgaaaataatggtaagtatgaagtatcaaaggacgttctcaaagccattcaggaagatttctattgcggctacagcaccgataaagaaattgaggaatccattaaagatgtgtacgaaaaagacggctatttgatggatccgcacaccgccgccggttataaagtgatgcgtgactatcaaaaacttgacgatacaccaatgattttattaagtaccgcaagtccctataaatttgtaaatgccgtagcaacggccgttttacccgaagaagcaaactcggataacgttcttcaaacaatgaaagacctggccgcaaagaccaatgcgcctattcccgaaaatcttcaaaaggtttgggaccttccggttagacatgaaagtgttattcaaaaatcagatatggaaaaatacgtcaaagaacaggtggaggcagtattctatgataaagatcaaagttccagcaactagtgcaaatgtcggcgtcggattcgattgtatgggtttggcagtgtctttttactcaaccatcagctttgaagaaagctcggaaagattagagattgttggctgtccaaaagaattccaaactgaggataatttagtttacgaagccttcgttaagggctgcgattatctagacaagcctgttccaaacgttaaaatttcaattgacacagacgtccccgttgcccgtggtttgggcagttcttctgtttgtgttgtagccggactaaaagcagcaagtgcctggtttgataacgccatttcaactgatcagcttttagtacttgcaactgaaatggaaggtcaccccgacaacgtaacaccggcaatccttggtggactctgtgtttctttcctagacgagcaaaatcgaccagtcgttgtaaaatacgacgttaacgaaaagttaaacttcgtcgctttaattccaaattacgaagttagtactcataaagcacgcaaggttttaccaaagacaatgagttatgcggacgccattcatcaggtaagtcgatgtgccgttatgacaaaggcattggaattaggtgatgcccatttaattcatgaagcctgtgatgaccgtatgcatgaaccttaccgggcaaaattaattcctgattatgcgcaagcaaaggccatttccgagcaatcaaatggtactatgtatattagtggtagtggttctacaatgatggcgatcacacccaacgaaaaatcagcagatgatattttaaaaaatgccaaagccgcttttcccgactggaaaattcggaaaatggccgttgatctgactggtgtgcagagtgaggtaattgaacgtggaaaagtactacatcgttgatagttcgattttgcccgaatcttttgacaaggttattcaggcaagacaattgcttgaaagtggcaaggtcagacaagtcagcgaggccgtaaagatcgttggcattagccgtggtacgtattataaatataaagatttggtttttctgccggaagaaaatatgatcgatagaaaagcggtcatttctctcatgcttgaaaatcgtcgtggcatgctttcaaagattttacagactgtgtccgaatcaagtgccagcgtcctaacaattaaccaaaacatcccaattcataacattgccagtatcgtgatttcactggatctaagccatctaaccggtacggttgatgatctcctgaataatttgaaacaggtcagcggtgcaagcaatatccaattggtttcaatcgaataaacgtcattaagaaaacttgataacaataaaaaagcagcgatcaaatgattaaaatcaatgatcgctgcttttatgcgattaacccccactatttgatctttaagccggcgtcaacattattttgaataaaaagtatagtaaaacaagcacaataacaacccaaatgacctttcccaaaggattgttaggattaattgtaatcccaacacccattgactttggtacaaatagatccttagaatccccatggtaaaatgatttcactttgaagtagcttaggggcaccaatatcaatgctaataccatgattaaaatgccgatcatcttcgcctgctcggccgaatgtagattcgtaatcgtgattgatagaatgataatgagtgccagaatggccaaaagtgcgccatccagccaaggtttttttgatgatttgttggttttttgatccagattcctgtcttgcttcatcataaccatcgccttttcccaattgattttaaaagcggatatttttaaaaccaatcattatttgatcaaagactaaaactaatttaattatcaaaataagtatattccggacgttaaagaaataacagaaaatcaacttttcataggaacctttatttggataccgtattttatatgattaaaccgccctacataattaatatatgattagtaattcgatcacgaccccaccgatgatttttatgatgtatctgtgtagatagtcattgattagaccgttgatatatcaagcgtttaacaatataattatcaatcaacggaaacccgatttcatttcggtttgcgatgattattttaaaataatttgacaaatactaaattgcctgctatttttaatggtgttaatttcattagattttaatactgttatctaaacaagttgattcggaaagtagtttctaaacattgttcagagagttggcggctgatgggagccaatctttgtgagggaacgaaaatggccgatgattggttgatgtgatcttaatcgaaagcatcaaacgggctggtcttcgttattagacacaccatttcttacgagagatggttgatgagacttttttaggtaactgattaagtgaactcagaatggtatcgcgtttaagcgcttctgtatttttatgacaggagcgcttttttagtacctaaattttagaggagtgatttaaatgacaaaattagcaatcgtaacaggggcaggacaaggaatcggtgaaggtatcgccaatcgtttagcaaaagaaggttatgcaattgcggtggcagatattaaccaacgaaccgctaagaaagttgctaaacagttaaaggatgacggctacaaggcaaaggcttattacgtagatgttgctcatcgcagtgaggttttcgatttggtaaaaacagccgttgaggactttggtgatttagcggtctttgtaaacaacgccggcgttgcgtttattgattcttttgtagactcacaaccggccgatgtcgagcgtctattcgatgtcaacctaaaagggacctactggggaattcaagctgctgccaaacaattcattaaacagggcaagggtggtcgaatcgtcaacgctgcttcactcgccggcgtcgaagcttcggcgcttcaaagtgcctattcagcttccaagttcggaatccgtgggttaactcaagctgcttcaaaagaattagccaaatataagatcaccgtcaatgcttataatccaggcgttgttcggacaccgctacgggatggcattgacaaaagaactgctgaaatcaagaaaattccaattaaagaacagcaagcaaacgttttgaccgaaatctcgcttggaagagaagccacaccggaagacgttgcggacgttgtgtcatggtttgtatcgccacacgcaaaatatattaccggccaatctgttcaggtagacggcggcatgagatatcaatagtaaaaaaaacgattttaagggaagtgtaaacatggcagaatcgactcacccaattatcagtcttcaagacgtcagtgttacttttcaatcaaacgggaagccgctaaacgccgtggataaagttaatttacaaatccgtcggggagatatttacggaatcatcggttactcgggagcgggaaaaagtacgttggtccgaactattaatttattgcaaaaaccaactacaggaactgtaacagtgagtgatcaagatcttcaaaaattatctacgccaaaattaagaaacgccagaaaaaaatcggcatgatctttcagcattttaatcttttaaattcaagaacggttttaaacaatgttgaatacccactgctcagtcaagctattggtaagcctaaacgtcaagccaaagcaaagaagttacttgaactggttggtttacgggaatttgaaaactcatatcccgatcaactctccggtggccaaaaacagcgggtcgcaattgcgagggcgcttgccaacgatcccgatattttaattagtgatgaggcaaccagtgccctggatcccaaaacaaccaatgatattttgaagctattaaaacatttaaatgaaacactcggattaacgattgtcctgattactcatgaaatgcaagtgatcaaatctgtttgccggcacgtagcggttatggacgaaggcaaaattattgaaaggggagacgtagctgacgtcttttcaaatccgcaacaagcgctcacccaaaactttgtggattcctctgccaacgttaccgaagcactggaacaaatcaaagctgataagagtctacaaaacctttctaaaaatgaacgactgctattcttgaaattcaaaggccaggcaaccaagcaatcattgatttccgatctgaccgagctttatcatctcagtgcaaatattctatttggcaatattgaaagaattggtgctacatcaattggctacttaattattattctttccggtgagaccaaacagctcgcagatggtatcaatttactgaacaaaaacggtgtgcaggttcgcttaatcgcaactgggaagaaaggggagaaaaataatgctcaagcaaatatttcctaacgtgattaatatttggccgcaatttttacagtcaatttgggaaacaatctatatgacattttggtcttcccttattgcgggaataatcggtttagcaatcggcattgtactggttatcacccaaaagggcggcattgcagaagatccatatgtgtatagtctgactgataaaattgtcaattttttgcggtcaattccatttattattctactagctgtgatgtttccaatcactaacttcattgtccacaccaccgttggaacaaccgccgcattagaagctgtctaaaatctcttaagtaatagtgctaaaaacgctaaaacgaccatttgcagactggtggttaattgacgctcacaatttttccaaagtcgccgacaattctctagccaactaaaag

SEQ ID NO: 462 - DNA, 5645 bp, Unknown
  Metagenome-assembled genome
cgttcggaataggttatactagacaaaagatcagctcctaaaagatgggtttgtgataaacaccattttaaaggaagctgatcttttttgtccgaacagcgttcggattaattttacaatctaccaaaaggcgtcgatggattttatccatcaacaccaaatatcatagagccgttaaaacgttactgattcgtggtggtaccagtggcgtcggggtggctgccatgaggcttgccaaggcaatggtccgggaatcagggttgccggaataactcgagatcccgaaaaatttgctcgaatgaaagcagccggttatgatgatacccttttggaccatcagagacggcttcaaacagaaaaccattttgatgccattttggaattggtaggcccggatacattgatggattccttaacccatttgaacgttaacgggattacctgtttcaccggtgaattaagtggcatggacgatgcccgatggacagttgccgattttgatccgtttgggattcctgcaggggcttatttgacccacttcagctctgatacagcaaatgcatccgatctaaatgatctgattaagcttgtcgagacccaccatattgacattaaaccggcaaaaatatttgatttggttcataccagtgatgcgcaagcagctcttgatcaagcagatagttttggaaaagtggttgtggttaatagtgactactaatggttaagtcgattaaaaggagactggggcaaattgaattttgccccaacctcctcttttttatgataggcagctaattgtttgtctctttagtggccaaaaagtttaaaacgctttccgaatttaaatagccgatcacctgactgtcccttctaacagctaactgctgattttgagcaagcagctgataacagtcgcccagtgtccggtctccttcaacagaagtgaccggtaacttcttaaacggggtttttcttccatacccggccaagaccaaccggcgaatatagacgttttcgattttgtgggcttcgctgccgttgaacagtgttttaacatagtcgttgcttgggtgtcggacaaggttatccggtgtatccagttgaataatgtgcccgtctttgacgacgccgatttgctgtcccatttttaatgcctcgttcatatcatgggtaataaataaaatggtgttgttaaaatgtcggtggatggaaagcgtcaggtcctgcaactgctcgcgtgatacagggtcaagtgcactgaatggttcgtccatcaaaatcaggtcgggcttggtaccaaatgccctgatgatgccaacccgctgctgctcgccacccgataattcgttgggatattttgacagataaccgattggcaactttgcggcagccatcaattctttaatcgtttggtcgactgcagtctttgactggtgtttgatttcaggtagcagtgttaaattttgcttgattgtcatattaggaaaaagagaaatctgctggagaacgtagcccatgtttaatcgaatctttctcaaattctgatcgtttagcgttagtccgttgactaaaatgtgtccacttaccggtttaactaatccgctgatggttcgcagaatagttgtcttaccgccaccggattcgccaaccagcaccatgatttcgtgcggataaaccgataaggacaaatcatcaattgctttttgctgatcataaacgacagaaatatttgaaagttgaatgactggtgtattcggcatatgatcacttccttaatagatgatggcgttgtaaataatgccttgcaacctttgcggcactgacttttttgacgttgacgtcatagttcatctcccgcatctcttttgctgtaatttttccggccaactgctgaagttgcttcactacggccggatgctttttggcaaatgccttggtcatgagtggcgctccttgataggttggaaagagatgcttattatcccgcaacgaaaccaagtggtattgacgaatttgagaatcggttgaatagccgtcaattacctgaacctggccacggcgaatggcctgatagcgtaaatcgggatctaaatcagtattgttaaaggataggccatattttttgacgagtcccttatagccgtcatcacgattcatgaattccaaatcaaaaccgctgtgtaggcggatttgaagctttttgaggtcactgattgtgcgaagatgatggcgtttggcgaacttttgggtggtgacgactgtataggtattgttataatttaacggggaaccataagtcatattgtatttagccgcaagctcgtttttggccatgtgataaatttgcgttgcagatttgttttgaagctgtcgttcgctgttgggaatgatgtcttcaagaacggtaccggtaaactccggatagatgttgatttgattgctctttagagctgaaaataaaaagctggttttaccgaaattaggttttaagtcgacatcaattttcttgtcaccggcttcgatcaagtcccgatacatattaatcaaaatatccggctcggaacctaatttaccggcaatgacgattctttccggttgggtagtggccgtgtatacttttggtgcgataatgccaagcagcaaaagtaaaagggcggttcctccgacaatgaccatcgatttggcctttagacgaccgaatcgggtgatgagccaactaaaaacaacggcaagcagtgctgagccaattgcaccggtcagcgttaaagcagtgttactgcggtcgattcccagcagaataaaggttcccaaaccaccggcgccaatcagggctgccagagtagccgttccaataatcagaacggttgacgttttaataccggtcaaaatactgtccttggaaaggggcaattcgattcgaaaaagtcgttgccacttggttaagccgaaaacttcggccgcttcggttaagttgggatcaatcgttgtgagtgcagtatatgtattgctgtaaataggtaaaataccgtatataaccagtgcaataatggccggtttactgccaatgccgacaattggaatcaaaattcccaagatggccagagaaggaatggtttgcatgattgacgtaaaaccgagtgcaatatgagcgaatacccggtgattacgtgcataaaccgccagtggaatggcaatgacaatcgcaatgatcaatgagataagggtcagataaacgtgttccatgagtgcgttgataaacttggcgttggccgtaaaaaaatgaatgatggctgtgatcgacacggataggcacctccttgggtgtgaaaacaagttgactagaatttcattatacaactcgactgtgcatgatacgaatccgaagacaaaaatgattgggagaataccgacgatttaggccaagatgggctataattaaagtaaatcatgattttatatgaggagtgaagtactttgaaaacacattacgatgtcatcatctttggtgccggtcctgcagggactgcagctgcttatgggttagttgggtcaaaatctgttttagtcattgaaaatgatctttttggcgggacctgtcccaatcgtgggtgtgatcctaaaaaaatgctgtattcggctgttgaggcgaaggatagggttgcccgaatgcaggaaagcggactaaaagacgttcccacgattgattggaaacagttaatggcctttaaacggggatatacgtctcaaatcccaagtggtacaaaaaaaggattgtccggtgccggcatagatacgtatcatgggcaggctgcctttttggaccaacatcggattcagctgggtgaccagacgacggtgagtgcggatgaggtcattttggccactggtcgccggccacggttattggatattcccggtaaatcattcctaaaaaccagtgcagacttcctggatttggatgcactgccaaagcatatcacgtttgtcggtgccggcttagtatctatggagttggcaaatattgccaataaggctggtagtgatgttgatattattcatcataacgatcaaccattaaaggcatttccacaaccctttgtggcgcaactggttcaagacatgattgatgacggcatcacctttcacttcaatcagaatctgaaggctgtttctaaaaatgaaaccggttatacactgaccaccgatcttgaaacgttggcttctgattatgtagttgaagcggtaggccgatcggcgaatagtgatcaattacaattggagaattgcggggttaaaacgtcgagccgcggtgtgttagtggatgatcatttgcgaaccaacgtatcgacgatttatgccatcggggatgttattgacaaagccaagcccaaattgacatctgtcgcttcatttgaaggacgatacgttgctgagttgttaatgaaaaagacaacagcaccaattcagtatccggtcatcccacagattctttttgggacaacggaagttggtcaagtgggggttggttatcaggaagcattaagcaaacctgaaaaatatcatgtaagtgcctttgatttaacccattggtatacctataaccgcattaaagatgatgttgccaaggcaatggtgatccgggatgccaataccaaacaaattgtcggatttgacgttttgtcctcaattggtgagcacttgctaaacgctttcagctcggtgatgaacttaaagctgtcgaatgagcagattcaggacatgatttttgcctatccatctgtttcgagtgatttgcaatatttggtatagcatggctattttaaacttggaaagagtcaatttgaagattagtggagatcaggccgataaaagcctggtcttttttagttggaaataatgaatcaacttgtttgcgcaagcaagtaattaatgctaaaattttgtcagccataaatggagaaggtgattattgatgacagatatagaaattgatgggttgattgcaacaatcaacacggcttcacgtcagctgcaaacctatttggatgaacagttaaaaccgttgaagctgacatcgagtaactattattttattttaaaaattaaccaggcaccaactttaacacaggatcaattatttaaacgaatttacctgagtcaaagtaatgtcacgaggcgattggaacaattaatcagactgggatacgttcaaaagcaacggtcacagaccgatggccgctcttggtcaattagcctgacaagcactggaaaagcattggttcccaagttgaatgagcgtttagaatacgtcaacaatagaatctttagcggcattgatcgtgtgacgcaggatcgattaatggcagccttaatcaaggtcgaacaaaacttaatgcagtagcacggtgtttgaggatttaggaggtttttatgacaaattatgtcaagatttttgataaacccaatcatgatttgattattcctgagaagctgtcgggtctggtttatctcgccacacatcgtaatagcggtagacagtgtgccattccgggaaatcgtgcggtaattcacgccattgacaccctgtagtaagcgagtaaaggatggcattgaatacgtcataaagatcataacgacgcggtctt

SEQ ID NO: 463 - DNA, 107209 bp, Unknown
  Metagenome-assembled genome
tcgaaaattttattcagttttcaaaggtctacctgagttgttagcagcaatccctcgctgttgacaactatttaatattaccatgctgagaagtgattgtcaacaaaacttttgaattaactttttggttgaatccgtttggcttgttcactcactgaaacagcataaataaatataccgaataaatcgcgattcgtcaaggcttaaaacaaaaaaattagttgcagtcgaaaagtaggtttcgaagccttacttgtctaagcaaaaagtgcgaacaattcggctatcattcacaaatatcgttcgactataaagtggtataccctctttgattgtctttttcaagactaccgattcgtgtttgggctaccctgataaaaaaagagccaattacgatttttatcgcaatcgactcttaattatataaaatctaacactacccaaaacagacaaccatgaaaacaaagctggaggatctattcaaacaaccgaataacctttttctaaaaacacttctgctatttatgatacgacaacaaacgaaacactattttagctcgggtgcatcggtcttatacaggtccatcgtagacttgccattattctttgcctcaatactcgttgggtgctcctcttgggccttcttaaggttatccattcccttggtatattgatacgtaaagtcttttcgattaaccttctggaatcccttaggcgtgtaaaaacgtaacaaatcgccataaatgacacgatcagacaacgataattccgttgtgacatgattttggatactggcaatttgccttttctgagttgcgtttggcgtgatttctttacctgatctggttaaatagaccgtactgcccactttcgtatatttaggtgtaacaaagtcaccatctctaaaagccacgcgttgatcatgctgtttggacaaaaggtctgtcccgaactgaatggtattgttatctttaatacccagcaaatgcagcagagtcggtaaaacatcaatctctccgccgtacgtctgtcgaataccaccctttaatccggctgcatggatcataaatggtactttttgaaactgtgcaagatcataactgttaatactcttcttgtgcagtaactgagcaattgccggccggtgattattcgaaataccataatgatccccgtacagcacaatgacactatttttatataatccggtctttttaaggtagtttaaaaattcagcgaatgcctgatccaaataatgagcggtttgaacataaggatcaactgttttatccccggttttggtagcaggaaaatcagtattctgcttatccagcaggtatggataatgatttgtcaaagtaatgagtttggcataaaacggttggggcaactgctggatataatttgcagcgtccctaaagaagattttatctttcataccatagccgacattataggacggcttggtcttatagtattgtgaactaaagaagtattgatatccccaggacttgtaggtgctgtcccgattccaaaagctgggaacatcgccatgaaaagctgccgtcgtgtaaccgcgctgatctaaaatcgcgggggctgcctggaacgtattttgcccaccataggtgaccatagctgatccttggggaagtccgtaaagtgaattttcaagcatcatttcggcatccgacgttttcccttgggcaacctgatgataaaaattatcaaaactaagtgtgtgcctatttttgtagaaagcatttaaatgaggcgttacttctttaccatcaactttatagttaatcaaaaattgttgaaaactttctaaatgaatgatgaaaacatttttgcccttttcttttccaaagtattccggatttgcagccgcccgattattctttaagtatttaagaatcgagtccatatcacttgccttggcgtgtgatctagtagcagactccttatgtgtttgatacgcattaaatgctgcgtactcattcagtcccaaatatttcacaatataattattatcaaacgttcttgttaacaagccggaacgatcactattggctaaaccatactcgccagccatcagtacaagcgacaagccggagattaataaagcataccgctttttaaatggttttgcgtcaattctgataaccttaaataccagcaacagtatcaagattagtatgtctaaaaagacaaagaaatcggtaaaatgaatgatctccatcaaactttttcccagattattttgaacattcccgcttcctttaataatgcccattgacagaaaatcggaaaattcacggtaataaactatatttgcaaatatccaaatactttcaaaaaaatcgatcaacatcatcagccaatacgacaagcgcccgctgaaatacaacgcaatccctaaagttagaagtgccgccgggattggattaacaaccaagaggaactgctgcattccgccctttgcaccaagcgtaaatttagtttgataaattatatatgtttttacacaaaacaatatgactaccagaaagaagaaccccaatctggtattaaagaaatttaatatacgagatttctttgtagacatcattcttgttcctccaaaatttctcacaaatatttgaatagacggtatttaatcaacgtttctattgccctgccacacagagagaattgttaaaggccataacgactaagaagtttccacttcgccaaatagttaactaaaaccatttttactgaaagttcctataaaaagatatcataaattactcttttttacggaccactttgtgagaatcattaaccttatcaggtttgatcaataacgcaattgctccaacaaccattccgaaataataggtcaaaattcgccataggatcattgccagtactagtttactgttactactaatataactttgaaacagcgactcaaagctgaactccgcaccaccggatccgccaggaatcggaaataatgaaatgatcatcacgatcataatatgcaaactggttaccataaagacatttacattataatatcccagtgccaacataatgaaatatggaattagataataaaaagcgagctgcacgagcgtcagcaaaacaactttaatcataagtttcggctgacgtccaattcgaatactctcctcgtacagattatcaatcttttcatatagcgtgacacgcatactgtcatatttctcgtccttaacaaaccatttaaccggatgaaatagaatcctagtgacctttttcgtaaaggacggccaatacataatcattaacaaggcaacaatgacgaaaaagtgaatcagaaacccaaataggacaaacaacgatagatactgcatttttgttgcaacatagtgaaacccaatgagtagactaataaaaaaattgacaacgatcatggcctgatagaccacaaacttcatcaacaaaacggaacttgctcggccaccatcaatacccgtctgcagcataacaaccagctgaccgggctggccaccggatgaaaacggcgtaatcccattaaaaagttgttctaccaaaggaacacgcagtgcatctttaaacgtgaacgtcgagactcgatttgacacaagcactttcgttataaccgcttcaactaaaaggtatatacagatacaagcaaatgccacaatcagccataaggggtctaatgtgaaaaaatcatgaattaaaacactcagtttaacatccctcatagaataaccgataatcacgattcctatcagtaccatcagcataaaggtaaatttatttttccgtgacatacttaacctttccctgcttgttgattataaaagtcatgccaaatttgagccaaatgactttctgaataacgttcgctagcttcttttgctttctcggttaacttcattagttcatccggattttgaatcagtttaccaagttctgaattcatttcactcacatccccggcacccaaataataaccatcaataatcgacttatagaggtccaggtcccgaagcatcactggtgtttcggttgaaaaggcctcgagaaccgacattggaaacaattcattgtatgaaggtaaaataaaaagatcagccatattataatagtcaaccattttatgacggtcgataatccccggaaaagataaattgtttggtgggtccttcacaattttttcgagatcagcatagccttccgtcatttttccaaatgaaaaaccaccggtccaaataaattgaaccttaggattttctttagccagttggacaaagtctaaaacaccttttcgcgtttggatctggccacttcctaaaacagtgaaacgattctgatcatacccccgcttagcccgaaggtcacgtttggtttgcttgctggcagggtgaaattcctgccgattcacaaaattaggaatataggtgattttgttacccttgatgccatatttttccagtttaggaataaaggacggattaacaaccactatatgatccattcgtttataaaatgcaatcacataccgatagacaatccctttgattggccaaggaattttcaagctcccctcaagtgtttccggtaagaaatgaacgtatccaatttttcgtcctcgttttttgaaaaaagttgataaaaaaaaggtgggattaattgtatgatagtggctaatatccgattgggcataattattaatcttgatatcaaattcccttgggaaatgcttctccaacatattgattaactcggaataggcgctccccacaccttggcccttaacctttgttgctgttgagaacatattgatcttaagcatacaaactccttcaaaaacaattattcaatatttgtggcagtcggatccttttgtaactgttgttcaacagttacactatgataaaaatcaactacccgtttgccaaacgtctctgctgatatttctgttaacttttgatccagtatttttttagctttcgaattatctttatcaacgggatttgtaagataccttatgacaatttcggtaaactcgtcagatttcttaaacgtctgaccaagagactcattgcttaataaaccatctgtatagtcactggaagtcaccacaacgggaagtcctgctgccatcgcctcaatataagtcaagccttgagattctgaattagatgttgaaacgaaaacattagctgtccgataaaacgcgttaacatgatcattactgacttcacctgtaaaaatgacgtgttttgataaccctaactgtgtcacttgcttcatcaaatcttcttttgcaggaccatccccaacaatcattaagataacttttggaacctgctcgataattgatggtagcaaatcaacaatttcagaaatattcttctcataggccaatcgactaattgacagcataacaggtgtatcctttgaaatatgatatttctcgcgaatatccgtgtctattgacttggcatacatcccaacatcaatgcctgttggaataattctcatctgacatttcaccccatactcggtcaatttatcgagtactctatcggatggtgtaatcacacctgctagatgatagcaaaaagccaaagtaccttcctttacatgaacgggttttagtagtttaccatttgcaacatagtgcaaatagtcttcatacatcgtgtgataggtatgaacacaagggatattcaggtttttagccacaaatttgccaatcatgcccatcgaaaattccgtttgtgtatggacaatgtccaaattgagttccttggcaatttcatatgcctgaaataacccccttactgcaattcgtcgatcagtaaatgagataaaagggatgctggaaaagcgaaaaatatttcgctcgtatgtatccttatcaacatgagggtccgttgtcgtaaaaatatagacctggtttccctcccgctccaattcattctttaacgttttaattgaagttgcaacaccacttacttgaggaaaataagtatctgtaaaaataccaatattcatgaacagccccctcctttctacggaaaacatcaaaaagcgtatttctcaacgtaacatcatgactctttcgattcaaatgatgctgagacacttttacagttgttagaccaaaagctacgtggcttatagtctgacaatcattgtaattatatttgtttaacccattgaatgcaaaccaatgacatcaacaaaacaagctgctaaacggcaaccgatagccattagcagcttgtttttaagttatttataagtatctatgactttccaagcgcttgatgaacgtacttgagaacttgttgactagtgctggctaaactgactgttttgtttgccagtgtcaccatttccctggaatcaagctccttgatcaacgcacgagacttcaaaatcgaagttgcactcattgaaaattcattcaaccccattccaactaaaatcggaatagccttttgatcaccagccatctcaccacacatatacgcaggtgtcccgttatcatgacaagcatcaataactgacttgataagtctcaggactgatgggttgtacggctgatacaaataagaaattcgccgatttccccgatccgcagccataacgtattgaatgagatcgttagtacctatactcataaaatcaacaacattggcaaattgatcagccagcaatgccgctgccggtacctcgaccataatgccaactcggatatcaccaactgctacatcttgtgcaatcagtttggctcgttcgtcttcaaaaatccgctttgcgtgctcaaactccgtaatcgttgcaatcatcggaaacataatcgataaatttccgtaagctgaagcccgaattaacgctctaagttgcgtgcgaaaaatatcaggttgatccaagctcattcgaatagcccgataccccaagaacggatttgcctcgtgtggcgtatggagataaggcagttccttatctccaccgatatcagccgttctaaaaatgaccggttttcctgccattctctgaacaactgtcttataaatgtcaaattggttttgttctgatgggagttcgtcagaatccatgtataaaaattccgtccgaaaaaggccaattccttcagcaccattgtcaatggctgcctgtaaatcatccaaagtaccaatatttgcagcaataatcggatgcttgccatcagaagatgttgtggcaacatttctgaatgacgttaactgactattggcctgcctgtactttttaattttttccacgtactcatttttttcatcatttgatggcttaacaatcacattacctgttaagccatccacaatgacttgatcaccatctttaatatcagctaacgatccctgaaatccaacaactgctggaatttccatcgtcctggacataattgcagaatgcgatgttcgaccacccatatcagacacaattcctttaacgtagttgggaacgaattgtgctgtatcactaggtgtcaaatcatgagcaataatgatgactttgtgatcaattaaagccggatccgtcagcgggacaccgagaagatgactcaatacccgctttgtcacatcgttaatatctgtcgatctttgtttaatataatcgttatcggtcatcgaattaaagattttaacataactatctgaaacatctttcaacgcgtattctgcattgacatgctgtgtcttaatcatgctttcgattcgtttcaacaattctggatccgacaaaatggctatatgtgctttaaagacctcagcttcatgtctaccgaggtctttaaaagttctttgttggattgtacgaagctcctgtttagaaatctcaattgcttgatttaggcgatcaatttccgtatcaggattctttatcgtttttttgtcgaaactcagatcaggttcagtcaaccgaaatgcagatgcgatggcaattccgtcacttgcggcgatccccttaaactttgtcatgaacttagtcagtcaatccttctgttttcatcgtttcggtaatggcatcgagagcgtctttttcatcatcaccgtctgcagtaatggttactgaagcactttggccaacaccaagtgacatcacacccatgattgatttcaagtttactgatttttcttggtactcaagggtgatatctgagttaaacttacttgctgtttgaactaataaagttgctgggcgagcatgaatcccagtttctgcagtgatgttgtactgacgtttttccatttcaatcattctcctctggtcatattataagaaggtaagccaaattatttacagtataaatgagaaatcactcatcacctgtcttactttctaaaattattccttactcatctaagaatagcaatatataagcgaaaatacaagctttacattaaccgcttacagtatttcttaagaatttttctcctgctcatcacgttcgaaaacataggtgatgacaccaccttgatcagcagttccgataatccgctttcgtttgtcaaaattcatataagccgtttgaaatgtcatgaattcttcagggtgaacaatgatcttttcaatttcaccggtttcaagctgattcagtaatttctcatagtcggcatttcccgtatcatcggccaagcgcacatctcctttgcagcaaaattagttatgccatagctggtaaagcgataaattttcaagtaaagacacgattactttactcaattctaacataagtgttactttgatattgtaactcaaatcaagaatttctcaacgcgaatacagatcaaattcgtgactttattgaactaaaaacattagcgttttcacgcagatcatcttacttgaacaaacctttatccaagtgtatgctactttggaaatcaagactacttaaaaagaacgatttaaaaccacctagtaaccatatttggaagctaagtttaattacttgattccaattgagcttgttgtataattacagtcaaaggtcaaagttggtcagtactaaatcagtcttgattttgtccttttattttctatattaaaggaggaaagcaattaatgctatgtcaaaattgccataagaatccagcaaccattcacttatatacaaatgtgaatggtcaaaagcaaaccattaacctttgccaaaattgctatcaactcctctctaacaaacaacgtaacacaggaggtgctcaagatatggctcaagatccattcggttttggtggtttagatgatattttccgtgcaatgcaaggcggaaatatggatccaaaccagcaacaacaaattccaccaacccagccgcaaggaccgggaaatggccgtggtaacggaaaccgtcaaggcggcaacaccttacttggtcaatatggtattaacatgactcaaatggctaaggatggaaaaattgatcccgtcattggtcgtgataacgagattaatcgtgtcatcgaaattcttaatcgacggacaaaaaataatcctgtcctaattggtgaagcaggggttggtaaaacagccgttgttgaaggattagcccaagaaattgtttctggtaatgtcccttcgaaacttcaaaacaaacagattatcagacttgacgttgtatcacttgttcaaggaaccggtattcgtggtcagtttgaacaaagaatgcagcagttaatcaaagaagttcaagacaatccagacatcatcctgttcattgatgaaatccatgaaattgttggtgccggaaatgctgaaggcggcatggacgctggtaacgttcttaagcctgccttggctcgtggcgaatttcagttaatcggtgcaaccaccctcaaagaatatcgtgatatcgaaaaagattccgcacttgcacgtcgtcttcaacctgtcaccgttgatgaaccatccccagaagaatccgttaagatcttaaagggtattcaaaaacgttatgaagattatcaccacgtgaagtatacagatgatgctatcaaagcggctgttaaactttcagaccgttacattcaggatcgttttctgcctgacaaggcaattgaccttttggatgaagcaggttccagaaagaatttgacaatcaatgcggttgatccgcataccgttgaagaaaaaattcaaaacgccgaaaagcaaaaacaagctgctttgaagagtgaagattacgaaaaagctgcttattatcgtgatcaagtaagtaaacttgaaaagaatgccaaatccgacaacattgacagtgccgatacccctcaagtcactgctgaggatatggaaaaaattgttgaagaaaaaacagaaattccagtcggcgaacttcaagcaaaggaacagacccagcttaaaaacttaggtcctaacctcgaaaaaaatgttatcggccaaaacgaagctgtagaaaaagttgcgcgggcaattcgtcgtaatcgagttggttttaatggaacaggccgtccaatcggatcgtttcttttcattgggcctaccggtgttggtaagactgaattggcaaaacagcttgcctacgaactctttggttccaaggacgcaatgatcaggtttgatatgtctgagtatatggaaccacattcagtggctaaattaatcggttcacctcctggctacgttggttatgaagaagccggtcaattaactgaacaagtgcgtcgtcacccatacagtttgattctgttggatgaagttgaaaaggctcaccctgatgtgcttcatatgttcttacagattcttgatgacggtcgtttaaccgatagtcaaggacgaacagtttcctttaaggataccattatcattatgaccagtaacgccggtcaaggtgattccgaagccaatgttggttttggtgctgctgcaaccggaaagactcactcgattattgataaacttacaaattacttcaagccggaattgttaaaccgatttgatgatattgttgagtttaacccattaaccaaggagaatcttcaaaagattgttggtttgatgatcgacgaagtaaatggcatgcttgcacaacaaggattgtttatcaacgttactgacaaggcaaaagccaaattagttgatttgggttacaatcctgcaatgggtgctcgtccacttcgaagagttattcaggaacaaattgaagataaagttgccgacttctacttggatcatgaaggttctgctcgattaaccgcagatgttaatagtgatggcaacattacgattacgactgacagtagtcaaacaaatccttcagtaaaatctgacaagaaaaagtaatttaactcattaatagctcaagacagtcattgtcttgggctatttttttacatatcaccttccctacgatatccgaaaaaaacgtaaaaagtatatcaaacgacttaacttggcgcccgttatgatataattttctttagaacgttcgatgggggcaattttgatgacattttttagttggattaaaaagcaattacaaatgatcacaccgacgattcgctctgaccgaaggaaacggcgaagtcgtcatcctgattaccatcaaaagaaaaagcttactcctgaaaataactttgaatctgatcaaacagacactcaacaaaccaaccaatccaaaacaaacgacactttaaaaaatgaagatgactcactgaatacgtttcagaatacaacttcctttgaaatgcagtctcaagttattttcacttacttggatgaaaatgatcgtcaaatttcaagttcggatattatccgtggcattgtcggagaaaacatccaatttaaactgcctgacttttctgattactatttaacatcgatcgaaaactttacccataaattcgaaaaatcggatcaggaagtcactttgcgctttgctcttaagaatggcttaccgatcatgatctattgtttggatactgacactgggcaaatattaaaatccgttcaaatcatatctggaaaacttggtcaatcttacactgttaacgcacctaaaattaacggcttccgcgtcattagcagtactggtcctacttttggtcattttgatcatcaaacgcagggcgtgatatttgcctatcgtcgaacccattgggaaaccgttcaaccagtggaatattttgtcaaactcaaggatgcccatgatgtctacgacagtccccagggtcggtctttaaaaaccggtttaccggcaagaatcattattaaaatctttgcaagaattgatttatcggataaatcaagttggttaaacatcggtggctttgagtggataaaaaattcaaatcttgaaccaagcgatccaccaattcataatttaatcgacacgattactaaaacctcacgtaatcctgctagattggctggcacaatcgattacgttccgaataaggccattgccgtttttgacaaaccgtatggtaacaagataaatgctttgatacatggtagccgagtttcaatctcagcaactatcgtagatgatcagaacctgatttggtatgaattaaacggaaacggtgtggtccctaaaatgtacgtgattgttgatcgaagctaactttcagttagaaaacacaacgaaaaacaaccccgcaaagccaatttttcaattggttctgtggggttgtttactattccagattgctttgatggcaggctaaaggtttttatccatattaaatgtcaatttcgacaaattcaatcctttttcgaataatcgatgaatcatatcttccgtggcaattctcatcattttaactgcttgatgattttgttcagtcaaataatttgtcaactcattatctgataagccctttgcttcatcaattgttgcttgaacatgacgacgcaatttttccttaacatccgttaagaaatcaacatcatcttgaataaattcagaatagtgcgattcaactaataccgacaactttcgatacatccaataagcacttttgtcatcgcagcgaacaggtgtattttcatagctttcatcagtatcgtttgcatttccaaagaatggcacataaggtgaaaatgcaggtacgccaaaattcaaccacataattgcagcgcaatcatttgtgacatcatttcgaatctgcaaaacatgtgaattttgcgttcgattcattgagattggtcgaaagagcgttttcgtgccttcatttcctctgcttaatgggtcatattcagtttcgttataatgtgagcttaaaatatactcaacatcttccacactgatttttttattggttctacaaataaatggtaaatcagaagaagtcggttcctggtcgatctccgggtttagataccgttggccaaaccaaactcggggtgtattataatggcgatccttttcgttatcggtaccaaaaatacttctaaaatcaaacccactctgattggtattcaaatgatacttttccacgaatgcttgaatgccttcagaatacataaaattatcaggatcgtcaaaatcaacctgctgaatggctacttgattagctgcaatcgcataggcgtcatccggaatcctttgagcaacccagtgatgtcccgtgacaatttccatataccatacttcatctttatcactgaaaagaacaccgttaccttccggtgatccgtattttttaatcaaatcgcccaaatatcgtaccccatcgcgagcagaatcaatataaggcaacaccatggattgtaatgaatcctctgccagaccatcttcaactaacggatcaaaagccaaggcccgttcatttccgtaaacactttccgtggcactcattgcaacatttttttcgttaaagccactttcggcataaacgccttccttatcgacctcaacgtttggtgtaagtgaatatcggtagcccttttccggaagcggtgcggtaaaaccgttttgattggatttccacgtttcgtgtcgattggaaactgccggctcaacgtagaatcgttgtggtgtcaacggtagaaaagtatcgtcatttctggcaatcatcgttgatccatcaatggacgcttttttacctactaatacagttgtacaagctgacaaatgctttgaagccattaaaaaatctcttctttcaaaaattatagtttagccgttaacgtaacgtctgggtacttgtccttaaaccaacgcattgcaaaggtattttcaaacaagaacaatggttgtcctgtacgatctttcactaataaatttcgtgatgatgacattttttcatcaagttgatccggatcaatccatcgggcaatcttgtgacccattggttccatattaacgtctgaattgtactcgttcttcattctgaactgaaatacttcaaattgcaattgaccaactgctccaagaatataatcatttgtcgtataggatgtatacagctgaacggctccttcttgaaccaactgatcgatccccttgtgaaacgatttctgcttcatcacatttttcgcagaaacccgaacgaacaattcaggagtaaactgcggtaatttctcaaactcaaccggtgctttacctgtgtaaatcgtatcgccaatctgaaaattaccggtatcataaagaccgataatatctccggcaacagctgtattcacattttcacgggtattcgccataaattcggtcacattagataatcgaagtttcttttgagttcgatataaattaacatccatgcccttttcaaattcacctgagcaaattcgaacaaatgcaattcgatcacgatgattgggattcatatttgcttgaattttaaacacgaagcccgagaaccgatcggcatcaggttgaatcgtatcgccttcctgggttttatgtgcacttggcgccggcgcgtatttcaaataggcatcaaagaatgtcttaacaccaaaattcactaaagccgaaccaaagaaaacgggtgttaaatcaccggtggcaatcttatcttcatcaaatttattgccagccatatccaataaatcaatactatccttggtttcttgaaattggtcatcgtctgctaattcagcattattaatcggattattgttgtcatccaactgcaccatttggcttttttgagcatgcgtatataactcaacccgatgattgtaccggtcaaaaatgccttccaaggtttttcccattccaatcggccaattcattggatatgcctgaacaccaagcactgtttccaactcgtcaattaaatccattggatcgcggccgtcacgatccagcttgttcataaaggtaaaaattggaataccacgcattttacaaatttgaaataatttttttgtttgtggttcaatacccttggcagaatcaatcaccatcactgcagaatcaacagccattaacgttcggtaagtatcttccgaaaaatcggcatgccctggtgtatccaagatattgattcgcttaccaccataatcaaactgcatcacagaactcgtcacagagattccacgcttttgttcaatttccatccagtcagatttggcaaagtttccggtttttcgagcctttactgtcccggcttgtctgacaacaccaccaaaaagtaacaactgctcggtaatcgttgttttcccggcatccggatgtgaaatgatcgcgaatgtccgccgtgtgctgtcccttgtctgtaatttttgattgctcatattgacttcctttcaaacgtaaaataactcactaagtttaacatattcatacagcaaaaagccaccaatcgcacgattggcagcttaaccaacttaaactagacaccactttcgatctggtgcattacataattaacaaccttcagggaactcaacccatcattaattgcacagaatcggttataaaagttcataaactgctggttggcactcatatccggatgcccaagtgcatgatggatttctgccaataactcttgagaattatgggcaatcttacccggcaagtcccgttcataattcaagtaaaaacctcgaagttcttctttatataaatgataatcatatggatagaatagaattggtcgttttaaataagcataatcgaagaacacagatgaataatctgtaataagtaagtcagaagccaaataaagatcactgatattaggataatttgagaaatcatatacgaagtcggaatagtctgatatatcaagtgcatttgaaatgagataatgcatccttaaaatcaaaacagtgtcatcgccgaaagatttacgaaaatcatccaggctaaacggcagttcaaaggtgtactttcccttttccgcaaactggttatcacgataagttggtgcgtacatcacaactttcttatccaaaggaatgcccaatttattcttaatttcagttatttcatcaggcatcgtgttaatcaactcatcattacgtggatatccaacttttaaaatttggttattaaacccaaaagcagaacggaaaatttgggttgaataatcattgggagaaaccagtgcatcccatctattagcttcacgaacaaagtttttatggtacttggctgttgttgtccctggcattgaaacgttctcaatatccaagcccagttttttcaacggtgttccatgccatgtttgaatataagtgacatagctcggttttttaacccatgaaggaaaacgggcattgctaatccaaaattgtgatttttccaaaagccgaacccacttggacgttcgtctaataacgtaggcgatttggttctctttacaaaatgctttttgagaccgatcaattgaccaaatcatagtaataccgggataaagtgtttgaaacagacgataaatggcgtatgggctgtcgcttacctgtcgcccgccaaaactttcaaaaataatggtggtattttcataaggggagtgccctgccttaaataagaagcgcattcttgccagattcaacttatcctgaacgagccgacagacttccagcaaaccatgtgctttgccgccagcagctgcaactttttcaagcaatgaagccccttggaattctttaactaaaaggccattatcaaatcgcttttcaatcgtaatcacccgattaccgggtaaatctgcttcaactgattggccactcagtgatttggaaataatcaagcgttggttaatttcctgacctgcaagttcatatttaatggacaactcaccaactgagtccttaggtatatccgttaatggaatgccaaccttaaacatgcctgcaaacattgtttgggacacaggataatccaacttaccatcattgagtcgattttgtagaataattcgttgattcttaatcggtgtcccattaattttattatatccggtgatttccagatcagtgtccgttaagttaacagaattaatcatgaagtcctgatcggattgatgggttcgaatattaaataacgccattccctgagcgtcactgttaaattgataataactggttaattcaagttgatgacggtcacttaagtattcactttcaatctgaaccacgtttttaaaattagtcgcattatcaaccaaaaaaatttgccattcaaactcggtttgatccgccgcttcaaaatgaaagtcctgagcgtcaattttcactcgaataatgttatgatttaaaaccttcgtaattggtttcataacagaagcaagactatttttttcaacgaataacatataagcatgctcaagagaagtagcaacatctaacaattcaaattctagaacttgaagtccttttttttgatgaactcccgatagtatcgctcgcaattttgatttccccttaataattaaagatttgctttcctggtaagtacttggacgcgtcaataatgttattaatatctaaataaattctagcatcgtcaatgttcatatttaacaacacctgatggtagaacgcattaatatcatcatatcgatgatagtcactgtatgacgttgctttagtaacgatggattctcctttggcttcataatgtgtcagtggatcttccttcttgttactggaaatctccgataaactcgcaggaaccggaattaaagatgtctccgcaacaccgtaattgatcttttgagacatcacgtaattggtaaatctaaagaccaattctgatttcgtattcaacaagagactctcatcaacaaaatcatcattgcacttttcaataccataaagttgatcctgttgattgtaattattaatctgaatgattcggctgttcttatcaaaaagaattgtatgtaaccgaacctgattatccccaaaaagcgtttctgcaataatattaccggtatcatcaacatatcgcgtcacctttaaacgatttgtgtgtgactcatacgatgtgaactttgtcagatctatattaagataatcattatctttcagtaagattccagaatgatcagcataaacgtctcccaaggtaatgatccgaacagacggcaaatgttctctctcgttaattgtgttaaattcacgttttgcctgccaaacctcatcaaaattggtcattgcaaataaaatagcaacctcataatgatcattaatcaatgctaataactgttttaaaaatgttggtttcctaatgccctgaatgcttgtcaccaagaaaattgcccgtttcattactttcctcctaatagatcgcaactaatgcaactcataataaaagggggctggtgcaaaacaccttgttttgcgaacagcctctctttagtcgagtaaacctaagcctgccaatcctttgaatcggttaagccaagatcctctttaattttggttgttgaaataccctcagttctaggcaaataaacaacttcgcaataatctttcagaaagtcaaatttgcctttccaatcatcacccattacaaatacatcaatatctcgatcctgaacatcatgaattttttgatcccaattagtttcaggaatcacttcatcaacatatttaattgcttccaaaatgtattttcgatcttcataggacgtatatgcttttttgcctttttcggcattaaactcatcagaagacaagcacacggtcagatgatcaccaagagcttttgcacgctttaacaatctaacgtgacccttgtgtaataaatcaaacgtcccgtaagtaattacttttttcataaaatctcctactatctgttactagaaattaaaataaacacaacttaaatagtagcataaccagcttcaacgtcaatatcaattactgattattaaaaataattaaaattaatccagctgataaatgttatagagatgaacaacaattactttaacgatcgcgtaaagtggtacggctaaaatcatccccatcaaaccggcaatgtttccagcggccaacaggataataataatcgttaacgggtgaatttgaagtgacttgccaataacatttggataaaccaggttaccatcaatctgttgcacgataatcacaatcacaatgttataaaccatgcttaaccagccaccatgagaaaatgaaacgatcagggccggcgcgatcccaatgtatggaccaagataaggaataatattacagattccggcaatcacgccaagtaacagtgcataaggcaacccaataaccaaatatccaatggccgtaaacgttccgacaaatagacattcaatcatctgacctgaaatgtacttggagatggttcggttcatagcagaaagcagatccattgtttgttcacgatgcctttccggtaagaaagatttaatattaggagccaagcgatacccgtcttttaacatgtaaaaaagaacaaccggaacagttaccgcgataatgacagcatttgcagctgctgaaataacgccgccgataccactggttaatccattgaagaagctgtttgcataatcagtaatattggttgagaacttttgagtcagctgggtaaaatcaatctttttcaacagttgttgagaattcatttcctttagcgccttttcaagaaggttttgaccgtcattaatagcgccaggcacattattagccaaattcatcaactgatttaatactttaggaataaagaccgtggccagtaaaataataattcctaataacaataaaaaaacaagtgttactgcccaggttcgtgataccctcttcctacctatcggaattttagtcagtaggttaacaatcggattcaacatataatatagtattcctgccagtaaaaccggtataaaaatcgtggagaaaaaaatggcaatgggtgaaaacataaagctgatttgcgtacatccccagatgatcccgacgacaagtaaaatctccaaggaccaaaacatgaggggagaattttttaatctttcaaacaccgagagtatccccctatccaaatttagttggttacggcaattgtatcataatttttcaacgttaaaaaaatagctgtccggcaaatcgattatttaccaaacaactattattaaagtgactctcatttacgttggcgggataaggctaagtagcgctcataccagattgcaataaattcttttgagaacggacctttttcgttgttaatccaatcaacaataatccgaacgtttttcttcagaatatggtcaatttctggaccataatcccagcgtttgctgaaagccagatactcatcgacatccaagagctttcgcctgccatccggaaaaactttaacgtctaaatcgtaatcaatgtattttaaggcttctttgtctaaagcatacggggatgccaaattacaataatacgcaattccatcatccctaatcatcgcgacaacgttaaaccaataatgtttatgaaaataaaccaaagcgggttccctggttacccagtgacgaccatcgtcctcagtaaccaaagtatgattattacatccaataagtgaattttcgccgttctttaataccatcgtatctcgccaaacacgatgcaggctaccgtcatgtttgtagctttgaatcgcaatgaagtcaccctcctttggcaattgttgtccacgtggcattgtggtacccactttctgaataagctatcagttacgattgttaccaatccaatggtaattatatcagagtaggcgctattttccgaatgaatttaactttcagcaagatcttccaaaactgcctcaatatcatccattgaaaagcccttgcgaaataatgcctgctttgttttttgaagttgcttatatttttcaagcttggcatatttatgccagtatttttccgcaactccaccgatgatatcgctatcatgggaagccagcccggatgtatcaacctgctccataatatctggaataatgtcaaatccaaacccgcgtcgaaccagcgtttcttttattttattaatggccattttctccgactcattttgatgatggcggagttgattatcagcaactgtgacgccaatctctatcatctgatcctcaggaaagaaatccccaagagatgcatcaatcagggatttgggcaccttcttttcaaataatttctggcgaatccagtttggcccatttttcttttgacgaacaaccgtgcgtacataactatctgcatattttcgatcattgaccaactgttgatccttcaactgggaaataacctgctcgattgcgtcaggattatccgttatctcaagtagttttgacttgacttcatgctcagtccgtaaattatgagcaaggtaatttaaagcacgcgtgtgcagttttgaaatattatcagcattttttaaggtttcaatcagttgcttgtctaattccattcccttaaaaagccgatatttaataaaaacatcctcactgatcggaaaggcatattgaccgtcaacgtaaacattaaatcttcccttacgtttttgtgcttctattttagtaattgattgtgtcatggctttcaacccctttcttacatttaaacggccgaatcgaattcactttaacgactggatttgctatactgaaaccaaatcaaaatagaggaatgactaatatgataactgcccatgtagtttacgcaaccattaccggcaacaacgaagatattgcggatattgtaaccgaacatcttgaagatgccggcgttaaagtaaccgagaccgaaatttcacaaactgatccatccgtttttgaagatgttaatatttgtgttgtttgcccatatacatatgacgaaggtgctttgcctgaagaaggacttgacttctatgaggacctgagtgatgaaaagctgagtggcaaggtttttggtgttgccggttctggagacactttttacgaagaatactataacgtttccgttgataaatttgaagaagccttcaaaaaaaccggggccacaattggggctgatagtgtcaaaattaatttggaacctgatgaagacgatattaaaaaattggacgcttttactgagaaactaattgaaaaagctaaaagcttacaataaattatgataatggcattccagcaggagaagagaggttgagacaaaagtcattttgtccaacctcttttagtttaatcacgattattaacaagccaaaaatgttcaaatagaaaccttggtttgtgtgaattaattattttctctttcgcttcgtagcccttctcaagactgattcaatggcatcggtctgttcttggatttttcccattcgaagttcttggattgttgcattaatgacaccacccaacaacataatcaaacctgagaagtccaaccaaaacatcaatacgataaaagtgccgatggttttgtatgcatcaactcgatgagcgaaaaaagtgacataaattgaaaaggcttgtgctaataccatcaagcccagcgtagtaaacaatgccccaaaccaaacgtacctgaacttaactttagccgtgggcacaatgtaaaataacacgctcaatagcaaccacacaagaatcattgtcgaaggccatttaactgttgaaacaaaactaatgatcgattgtggaatatgaagaatgggcgacagccagctaaagacaaattggctgagcgcaaaagcaatcatgaccgcgaccacaactacaattaacaacagcatccacaaaaatgacaagattcgatttgaaatagccgtctgatcttccgcaacgccatatgccttattaatacttcgttgaaaagccgcaatggcgcgactggccgaccaaattgtcacaatcaatcctatggataattgactggtgccgccacttcttaaagttgaatcaataaccggttcaagcatgacataaatccgatccggaaagatcggcctgacatattccataatatctcctgtgtgaatatggaagaggttaagaatactaccaccaataaacaaaatcggaaaaatagacattagtgaataaaaggccaatacagctgcagaatcggaaacatctccctgcgaataatgactaaccaaggtttgaataaattgtttagttttcaaataaattgatttaatcattagccaacccacttacctaattattttgaaaatcgagccaaaatggcttttaaaattctattggaggctttaccatccccatacggattctttgcctccgccattttttgatattcaacctgatcgtctaacaactgcgtcatattttcttttacaacagcaggatctgtcccgaccaattttagtgtaccggcttcaattccttcaggcctttcggtggtatcccgcaataccaggacaggtttttccaacgatggtgcttcttcttgaacacccccggagtccgacataatgaaataactccgtgccgccatattatgaaagtccagtacatccaacggcgcaataagatgaacctgtggatttccgtcaaaaacgtcatgcgcaactttttgaaccgctgggctaaggtgaaccggataaaccacttcaacattggggtgtgtctttaaaacatctgaaattgccttaaacgttcgtcgcattggctctccctggttttcgcgtcggtgcatggtcagcaataccatctttgaatcactttttaattcatccaacacagaatgttgataatcggcagaaacggtttgttttaacgcatcaatagccgtattcccggttacaaaaatatttttttcgggatgattctctttaagaagattatccctgctcagctttgtcggcgcaaaatataagtctgccaaaacatcagttaattggcgattcatctcttctggataaggagatagcttattccaggtgcgaagtcccgcttcaacatggccaatctcaacctgatgataaaaggcactcacactggccgcaaacgttgttgtcgtatctccgtgaactaagatgatgtccggtaccactttctcaacgattggatccagcagcgtcaggacacgtgtcgtaatatcacttagtgtttgtccctgcttcataatatttaaatcgtaatctggcttaatatgaaaaacatcaagtacttgatccaacatttcccgatgttgcgcggttacaacagtaattggctgaaactgatccaaatggtgctgcatcattaaaataattggggccatcttaattgcttcaggacgcgtcccgaaaatagtcataacttttataggtttcaatttaaaattctcctttaacaagtgatttcattataacaaagatgttcaactctaaaaccaaattaaaaaagttttcaatgatctataactttcttccctgaattttctttccccgaagaggcttgtttcttgcatttaatcaaacattttaattatttattgccaaatttttaacatgtcgtgaacgtcacatttttttgatatggtataatttgatgatgtacataccataagacattttggagagtggataagccgatccatatcttcgggatgtcatggcagttgatttaaggttagattagttttttagctaattctgataatatggtcacgacttatcgtaaaagataacgaagaccagtcggtaaggtatcactattgtgtataataattggaggatttattttgaagacaatcagtctaattgttccttgttataatgaggaaccgactgttgagcttttctttaatacaacagaaaaagtatttaaacagttaaacgaaacacatgaggaccagtatcggccggattacttatttgtaaatgacggctctgcggataaaaccctggagattatgcgtcagctccacgaaaaacatccggataccgttcattatttgtcattttcccgaaatttcgggaaagaatcggcactggcagcgggattaagtaacgccaagggtgattatattgccgtaatggatgtcgatttgcaggatccccccgagctactccttcaaatggtcgatattttggaagacccaaaacaggattatgaagttgttggttgtgtccaaacatcgcgtaaacagaatccgattcggggttttctgtcagccagtttctataaaatcattaacaagatgtcacgagtccaattaaaacaaaacgtccgggattatcggttaatgacaagaaagtatgttgatgcgctcttggaacttccagaatacaatcgttttagtaaaggtatgttttcctgggttggctttaaaaccaaatacttaaaatatgaaggtgtcccccgggcagccggaacaagttcctggtcaatttttcaactcttcgagtactcattggaagcagttgttgatttttcagatgttccgttaaaaatggcaacacttgttggtgggctcatttgctttctatctatcattggattagtatttgttgttatccgagccctcttctttggtggttcggtcaatggctgggcatcgttggtatccatcatcctatttttaagtggtgttcagttattctgtttgggaattgttggaaaatatatagggaagatttatcttgaaacaaaacacagaccaaaatttatcattgcagaaagaaaataatcgtttaatgaaaaaaatagctgcagtttacgacaaatatcgtgaagtcatctcctaccttttttggggtgttgtcaccactgtcgtcaatcttggtgtctttgagggcttccatttactgacgaattggaattatatggttaacaacactattgcctggtttattagtgtgctagttgcgtacttatcgaaccgtgcatacgtttttcactcaaaaacaactggggcacgcgcttatcttggtgagatggcctcatttttcggtggccgactactcgtcctgattcttgaacaaggtatcctttttgttggtattaccctcatgagtggaaatcaattcattgttaaaatcatagacaacgttattgtggtcattatcaactatttctggtctaaatgggctgttttccgtgaccaaaagaaatgaattaactagccgtgataaagaggtaacctttatgagaaatccaaatcttaatcgtcaaacgttacgtaagcgaaaagccgaattttcaaaggggctttacacaacagccgatggtttcaaactattaggaatggctgttattttaatcgccatcttagttgcttgcgcaaattatttgatgtgatttaaataagtgtgattataaaaatctcgattcaatgaagttttattcattgaatcgagattttttaataccatcaattaggcgaagcagacgatattttcgtgcaattctgtttaagaagcgctaatataaaaacaattctatcattatatgacatagtgctgaggtgaaaatagctatgaacatcacttatttaaccgatttatttgatcaatacacacaaaagaaagggttactctaccagacttggtttatccacagtgaaaaccgtcttaaagcctttaatcaagttcgaaaaggcgtgaagcagatcataacagacattcgaaggcatcagttcccgcgagatttacatggttcatcattagaaaccgtgatgaatattattattgcgcaacaagaaattttcaagggtgcaaaacatgcctttatgtggaagcctaaactacgcattcctgatatttacgaaaatcgtcaaaatcaattggactttgccgaaatgttagaccaagtgataaacgctaaacaagaagtcaaaatgctgttagcagtgaataacttggcagagaaaaagattaagggtttgggccctgccgttgcaaacatcctctattttttggaaccaaccatcttctgtccctttaacaccagtattgtccgaggttataatgatcttacccattcaaaaatccggttgggaaaatggaatgattattttaaactaagagatggcataatcgaactaaatgaggctggtggcttattttcaaaagatcttggtgctgtttcagcttttctgtttgatattggtaaactaaactatattattccggaaacaagtgaagcgtacattcagataacagagagtcacactatgaaaaaactaaaaagtgccgaaaagacaacggaattaaagagtttgcactataaagttcaacttcttcttgccgacatcggaaatagcattggttatcagtcttggattgcttcgaatgatcacaatcgaacggtaaacggcaaacgtttgggagactattcgctgccatcactgcctaaaacaatgacacagctccctcccacccttcaagaaacggttaggctcatagacgttatctggttcactaaatcgggtgaacccattgcaacttttgaagttgaaaaatcaacctcaattatgtccggaatgaatagaatggatgatctgtatgaaattaacaaaggcgatatgatgctctatatcgtttctccagacaaacgcgagcaagaagtaaaagcgcaatttaatcgaccacattatatgcacaaccacaatttacacgatcatattcggtatatactttttgcagatctaataaaaagctatcaatctcttaagctttttggacatgattacgctattttgggaccgatatctcatttccctgatggcacgattgcggatcaacgttaataagaaaaaagccaaagcaacaaattcgctttggcttttttctattaatgattttactgacctcacccggactcgaaccgggatcaaccgcttaggaggcgggtgccctatccagttgtgctatgaggccaaaaacaatacatgtcaattttctcatttattaatcaacatgtaaagagaattatttagtagtccgcttatgccgcatcccttttcgattagtatgcttgttctttttgtgatgtggttttggcgccggatttgaaattaccggccgcttcttttgagacttctggttggcgaccttttctaatccttgagttggtccctcatcattcttatcatctttttccagatccgttaccgttcgttcaggtttggtgtctgaaagttggttcccactaaaataaacgtttgacaagtcaaattgatctcgaaccagttgctttaaatgacgcaggtcgtggtcatcgcccatgttaatcactaaaccgttttgatgcattcggcctgtccgcccaattcggtgagtatatgttctggcatcccgaggcaaatcaaaattaataacggctggcagtttaggaatatcaattccccgtgcagccacatccgtcgttaaaagaagtctcacttttccctttcggaaatctcttaatgcattttgacgactggtttgattctgctcgctggtcagcttagctgcttcccgaacatgacgatgaattaaaaacccggacactttctgaagcgtatttaactgatcaaaaaagaccagtgctttaaaatctttcatgtgtaaaaatcggagcaacatttgttccttcttcttatttgaaacttgaagaagaccatgcttcacaattccctgggtatcatcgatgtccgttacatcgaatatctgcatatcttgattgaaccaacgattaacgtgttttaaaatatcattttgagtagccgagaaaaatcccaactgtgtatcgtcaggtgcctgatcaactaactctcgaatcgaatccagtgtatcttcacttagcaaattatcggcttcatcaatcacaattgtctgaatatcgtccaatttcaacttaccaagctcaatcaggttcatcaaacgaccggttgtgccaacaatcacattggggtgttccttcaggcgctcgatctgccgtgaaatattagcgccaccaacagccccttgaactgtcaaaccggttaggctgccccattcaagcattgttttttgagtctgcatggctaattcggcagaaggttcaaccacgatcaacttagtgccatcgattgatttaattgattcaagtaatggcagcgtaaaagcaaccgttttaccggaaccggttggtgcaatgccaacaacgctttgaccatccttcagcggttgataaaccgccttttgaattgccgtccattgttgatatcccagtttctcagcatgcttttcaaattcactaatcaatctttttctccgttctattatttttcctcacccacaaaggaaatgtgtgcgtcctgacgtaggttaaacagaatcttattgacatagacacttaactgacgccaatatgcataatccttcatattttggtcattatttggttcattaatcactctggcaaaatcatttgcctccggaatcattggattagacccgtcgtaatctccaagtgtttggcgtttaccatccggatcaatataatcaacgtgttggatctccccggcatcatcaagttcaattaagtctttcaatccatatatctcggacgtcatatgggaattcgacattttcgagaaatttaaaataacggtatattcgggataactcaaaacagccgtcccctttccatcaacacccgtgcgaatcagttgtggataataggaaacctcttccggcataccaaacagggtcactgcatcataaacagtgtatacaccaaggtcttgcaaagcgccacccccaaattttggtgaaaaaacattcggaatttcaccagctaaaacatgatcataacgtgatgaatatttggagtacgtgaattcagcccctgaaacaacgttaagttcactcaacttcttttcaattgcatggaagttgggggtgtgaatatttcgagccgcctcaaaatacaagacttccgggtgcttatcaagcaaatgctgaatttctgccatttgcttttgattcataaacgccggtttttcaacaatgatatttttaccattttcaattgcctgttttgcctgttcaaaatgtaaactgtttggtgaagcaatgtataccgtatcaaagctgtcactggcaaaaaatgcatttaaatcatcaaatgtattttcagcaccatttttggtcgcaaattcggttgctgtctcaagatgtcgcgaataaacggttgtaaactcatattttcctgtaagcttgactgcctcaacaaattgttgggtaatccagttagtaccaataattcctaatttaatcatctagaaaaccgcctttcctagttaaattgtaacaatgttttaacgtgattaacatctaaaatatctactatcgtcttataataacgctataatgctatagtgtgttgtaagtattactgtaggggatgtttttattgcgtaaaagaagcattgctatttttttaatttcttttttcattggactttttcatgcacctaaacgtaaaaaacagattgatcacatagatccactgttttttgccggaacgtggttttttaaagattatcgggggcacaaccataaaattgaaattggtcccgatctcaaactgtcaatcgacggggaagatttgtcagccaaggtttcatctgtcaaaaaatatgaagtttcatatgtggaccgctatgggtacaccttggaaattcgggcaaatgaagcgcgtccaacaaaattttacgatgaatcggataacaacacatatgatttatatccaaacatggaaacgttatgaaagcagccaaggcaaaacagactttgtcatcagctgcttttattttgttaactctccagatacctggcccattgtcgtgcatcaccgttaaatacggacatcggtaaaaaaacaacctgtcgatctaatcgaaaatcctgcttctgagtcacttgaataaacgttgcatcaccgtttggcttaccaagctggccgtcagtcgtccaaaactgatgagcatttgttgcctcgattttcaaacgctgaataatctcctggctagttgaaataacgactggtcgttgataataatgtcgaatatcggacattaatgtccgaacattttcccgcgttgatttccaatgaaccgagccatcattatagcccccgtaatactgaatagaaatacaaatcggcaaactgcctgtattggtttttacctgacgcacaaagtttttaaattgggctttcggcgagctgctaaaactgaaataatggtaaacgccaactggtagttgcgacccctgacttctttgaaaattacttagaaagctgtcatcagtgtaggtcgctccctgtgttgcttttaaataaacaaacttaacaccgttgtttttcaaactttcaaagtcaatgtagccattatcctggttaatcgaaacgccccttattggatatctcttaagctcttgttttgcatgccaccgccaaacggaaaaagcagttattaataagacaatcaacaaaaaaacgccaaaaatcaccttacgggttctcacccgtcgccggtaagtttcagcataaattggttgaacatctcttcgtcgcataaatagtcatctcagttaatcgggattaaggtgtgtcgttttgaatcacacactttttaggactgctcctcaaaacaacaccactccatataagggattgattcgaaaaatccaaattcgggatttccccaatcaacgccttatactccgggtattacccgttttgaatcacacactttttaggactgctcctcaaaacaacaccactccatataagggattgattcgaaaaatccaaattcgggatttccccaatcaacgccttatactccgggtgttacccgttttgaatcacacacttttatcccctagtactttcaattatattttggacgctgcgaattgtgtcttcagtagcaggtcccattcgaaccgttgccatcataaataatgtatcaataatagttaattgggccaacagtgaatacatgccttcagaacgataattggattcatcgcttgacgaaataaatgtgatatcactgtgtcccactaaaggtgagtcctgatagctggtaattgcaatgacaggaacctttcggcgttttaacgtctcagcaatttttattgtctgtcggtttttacccgagtgtgaaacaacaattgcgcaatcgtcctctcccaattttacagcttgcatgagctgtacgtcaaagtcaggataataaaaacaatcaatcgacgtgcgtaaaaatttatgataaccgtccaaagcagctacagatgaaccgccgagaccaaagaagccgagtctgcggcagtgaatgatccgaagaactgaacgggcaaattcattctcgtcgatcccttcacgtgtatcctgaagcgctcgttgtgaactggtaaagatcttatcggcaatggttgaaagtgtatcatttgcatcaatatctttaaatattggtaaattctgtggtcttaattgtgtataagccaacgataatgtgaattcacggaagtttgaatagccaagtgttttcactaatctggaaacagaagccgttgacgtttccgttaccgctgccaaatcttctatattggcctccgatgcggcttggggattatcaatcacatattttgcaatttttttatttgttcgacttaaattatcgaaagactgcttcagcatttgaactggcgagctcatcttaatcacctttcatttcattaaaactagtaattattacgattcttattgcttgtaaatattttacaacaaaatagttgcattgtgaaattgtttttcatataatattgtagtcgcttacatttgataaaaagaaagatgcttatatttgatgcagcgcgataggcatggtaaatttagttcgaagcgataccggcactgtgctgtgatcaatatcttttttgaatatgaaaccagctattattattttagcgtgtattttcagattcgaaaaccggtatttgtaaatttaaaacatagaaaggaagttgtatcgatggcttacacattaggtgttgatattggaaccaccagtgtaaaaacagtactttatgatactaacggtaaagtacatggctattcaaacaatggctatccactttatcaggatacgcccgacatggcagaagaagatccagaagaaattttttcggccatgcaagacggtatcactgagcttattcgaaaagcaaatttaaagccaggtgaattgaaaggggttgcactttcgtgtgcaatgcacagtttaatcctcttggactcagactataaaccactcacacgtgctattacatggggcgacaatcgtgccgttaaatatgctgatgaactaaaggccagtccacagggaatggaaatctaccaacataccggcacacccattcacccaatgacacccttaactaaactgatttggttacggaatgatcatccggacctgtttaaaaaagcacgttggttcgttggcattaaggaatatattctctacagactctttggcacgttaaaagaggattattcaattgcaaacgcaaccggtatgttcaatatttacaatatggactgggataatcaggcacttaagttagcaggtgtaacgcgtaatcagttgcctgaattggtagatacaacatatcagttgaaaggcatgcatgatcagtatgcaaaagttttgggaattgatcccgatacaccgtttatcatcggtgcatcagacgggccattggcaaaccttggcgttaatgccattcagccgggtgtcgttgccgtaacaatcggaacctccggtgctgtcagagtggttacggacaaaccacatactgatccaaaggcacgggtattctgttattaccttgccaagaatatgtgggtcattggtggtcctgtcaataacggtggtgttgtattccgttgggttcgtgatcaattatgcgcacctgaaaaggttactgccgagcagatgcatattgatccatatgacttgttaactcaaattgctgctaagatccctgctggctcggatggactgcttttcttcccattccttggcggtgaacgtgccccaatctgggatgcaaacgcccgtggatctttctttggcttgaacagaacccataccagagcacatatgattcgtgccgtacttgagggaattgtctataatctatataccgttatgttggctcttgaggaagttgtcggccgtccaaccagtattcaggcaaacggtggttttgcacgttctgcactttggcgtcaaatgcttaccgatatttttgagcaagatgttgccatcccggaaagctttgaaagtaccgcacttggagcagcgactcttggcatgtacagcttgggattgattgacagtttgacagatgtctcaaactttgtcggaacaaccgtcgttcatcatccggatccaaagaatttcccggcttaccgtgaattaatcccaatttacattcgtttaagccgttctctcgaacccgaatataaaaatatcgccgactatcaacgacgtcatgaacatgaagatgatttctcggggaaataatatcagaatgaagtcacattgaaaattgaatacaaaagtcttacaagtttgaaaggagattgatgatatgcaattaattgcactattagccggtatcattattttactggttttaatcatcaaatttaaaattaataccttcgtttccttggtattaactgcagcaattaccgcgatattccttggaatgccgcttggtaaaattgccgactcaatcaccaatggtattggaagccaattaggtgaattgtcaatggtctttggctttggagccatgcttggtcgactggtttccgattccggtggtgcctacatgattgccagcaccttgatcaaacgcttcggtaaacaacgattgcaaattgccgttatgattgcatcgtttattctaggaattgcactgttcttcgaagtcggaatggtcttactggttcctatcgtctttgcaatcgccgttgaggccggtgttcctatcctttacttggggattccaatggcagccgctttgtcagttacccacggcttcctgccacctcacccggcaccagttgctatcgcccaagtattgggtgctaacgatggtcgtgttcttctattcggttttattattgctattattgccgcttatattgccggaccacttttctcaaaattggcacgcaaatttgcacccgatgcctttaacagaaagggaaatctttcatcaataggtgaagttaaggaattcagtccggaagaatcaccatcatttggcttatcagtattaaccgccctcttcccagttatcttgttggccattgccacaatttacaaaatgacggttaacggcggcgctgagccaaagaatccttcattgcttgattcgattatcgaatttattgggtcaccaagtattgcaatgctgatttcactattctttgcaatgtggacaatgggatgggctcgcaaacgaacaactgcccaaatcatggaatcacttgaaaacgccgttaaatccattgcaatgttgctattagttattggtggtggtggtgcttttaaacaagtcctgattgatggtggcgttggcaaagaagttgctaaaatcttccttggctcatctatttcaccattgattcttggttggttaatcgctgttgttcttcgaattgcacttgggtctgcaacggttgcatcattaactgctgccggaattgttgccccattaatggctcaatcaggtgttgatccagccttgatggtattggctatcggtgccggttcacttgccgcatctcatgttaacgatgccggtttctggatgttcagagaatatttcgatttgacaatcaagcaaaccttggagacatggaccgtgcttgaatcgattatttccgtggtcggtattgtccttgtcatgatcatgaatctatttttccattaattcacttgattaaatagtttgctattttaatatcgtttaaaaaagttcgatgcctcatttgaggtatcggactttttactttgaatccgtttaatccaagaacaatatcgtccaaaaataaatctgcattatactcgattaatttttggaatccgaatacgttggccaaccaaacaggccacaaccacttttaacgtatccccaggtataaataccagattggacagcaatgcacttattaacggcattccagagcctattgtcaaccaaagcgatccaataatatcaacgattaacactgcgccgatccaggcacccgccattttttcccacgattgtttcataaacttaaacgacatcgtgctccaaactaaagccggtgttaacagccaaccgaccagatatccccctgtcggccccacaaagaccgccgggcccgcctgaccaccacttagtacaggaaagccaatcagcgctaagaaaaggaataaggccactgaaacggtccctcgttttggccccaatacgatccccgcaatcataatgcctaagttttgaagcacaatcggcaccggaataaatcctaatggaattggcggaatcagccctaaaacaataataactgctgttactaacgcaatttgcgttatctctcgaatcttcatttgaatgcctcctcatcatcactcatcgaagtgatggttaatcatttctttgttttgcttaaccattttcgtacccaaacggctttagccatggtatggattctctggtaaaaaaacctttttgacctcaccactggaaatcgtgaccatttcgccatcttttttacgaataatcaacgcaccttcacgattaaacctcattgctgtaccagttactgtctgattacccatcacaatttcgaccgtctgaccaagcgtttcggaaagcgctgcatattccgataagaaactgcctgtacggtaggtctgatacatataaaagaaattatcgataatacctgcaacaattttgttgcgatcaacatcacttttctcaacaaccgaaccggctttatggataatttcatccggaaagccctgagaacttatattgaggccgattccgacaatcacattttcatgaatgccatcctccaagcttgagattgtttcggttaaaataccaccacactttttatggtgcgctaatatatcatttacccatttaactcgaaaatccacttggggaaagaactgctttagtgcccggacaacacaaactgccgttccagttgtaattaaaccagaatgaattgttcttcggctctgcagtggaaccaaaatactcatgtaaataccggttttactcggtgaataaaagtgacgtccaagtcgacctctaccatgagtctgtgtatccgttacaaaaacatgaggtctttcaacagtaacatgactactaaatgcttttgcgtaatcattggttgaggttattttcttgaaggcatgcacctcaacgggaaatgtagtcgtccgataatgatcaataacctgcgcatcaaaacatttagaatattgataacagtatcccaatcccttttttgttgtaatccggtgaccgcctcgttctaatttcaagatattattgtacacagccggccggctgatattcagccgttttgccaactcatttcctgaaatgtagcggccattggaggacaacagctcatataaaattttcgattgatgatctgccattattgattcccccactcattcgtcaaaaagccagcttatcttcacgttacctttatgataaaaaataatctggtcaagttacgatatgccataaactaagtgtttctccgaataggtcattcttatccggggtgcttgatccgatttttcacatcaagcacctgtcattaagttttactattcgaactgattattaatcatacaatattgtcgctaatcagatttaaattgaactcccattttataaattgtgcctgataatcgtacaaaaaatactgacacatcttacacatcatgggtaaaatcaaatttagatcaaatgcacacctttatctacatacacaacgtcaccagtcatcccagttgataagtcgctcatcaagaaagcagcaacatttccaatttcagaagttgtgacactcttttgatcaacagttcgggattctgattccttaagtaattcactatggtgtttaatgccggtaacagctaatgttttaacagcaccagccgaaatagcattcacgcgaacaccactttcacccaagtctgaagctaagtaccgaacgcttgactccaatgcagcttttgcaacgcccatcatattgtagttgggaattgcccgagtagaaccaaagtatgtcaatgttaagatgctgccgggattgtttaaaatcggttgtgcataacgactaaccgcaatcaatgagtaagcactgatgttttgagccagatcataaccatctctggtcgtattaaccaatcctgaagttaacgtttctttatcagcataagcaatggcatgaatgacgccatcaattttgccgtgcttctgaccgatcttttcaaaagtttgtttaatattgtcatcttcagaaacatcacattcgattaattcagcagtttccggaacaaatcgttgcaaacttttcttaattcgatcattttgatatgtcaaaataacattggcaccctgctcaagaattgcctgggtacatccccacgcaatacttcgtttatttgcgacccccatgatcacaattgtttttccttctaaaaagccactcatttattcggcctccaaattaattttctttaaaacttccgatatcgttcccgacgttgccgcaataattcatcagttggaagattcttcaattcattaaattgattgtaaaggaaatcgcgcaacggtttcaaatcatcacccggtcgatactcatgaataatttgatcaataataccactttccagtaaccgatccggtgttaatttaagttcttccgctgcttgagcaacctttgatgaatccttccacataatacttgcgtaaccctccggcgataatacggaataaatactgtcttcaaacataaagaccttgtctccacacgccagggcaattgcacccccactaccgccttcaccaacaatcatactaatataaggtaccttaagctgcatgccaacttgtagacactgggcaattgccgagccgacaccgtgatactcggcgtcaacatcgggccaggcaccgggtgtgttaaccaatgccagaatcggccggtgaaacttttcagcctgcttcatcaaacgcaatgcttttcggtatccttcaggttcgggacttccaaagtggcgtttaatattttcctcagtatccgatccttttcgaatccccacaactgttagtggttcatcatttaacagaccaacaccaccaatcacagcctgatcatcaccgtctgatcgatcaccatgcaactcaaaaaagtcactaatcaatccatggatcagttcatcagttgaaattttttgagtgttcctggcagcctgaacccgttcataagcagtttttttaaccatttgcatcctccttcttttgatgcaaggctaacaacttggttaacacttgcttcaaatcactacgaggtacaatggcatctataaatccgtgttggagaacggtctccgccttttgaaagtcttttggcggttgcttcataatcgtttgttcaattactcgacgcccagcaaaaccaactaaagcatgtgattcggccaaaataatatcaccttgcatcgcaaaacttgccgttactcccccagtggttggatcacaaagaacaacgatatataatagtcctgccttattgtgagcttcaaccgcctgggatacctttgccatctgcatcagggaatgaatcccctcctgcattcgagcaccgcctgatgccgtaaacatgacaaccggtaagttttcgtcagtcgctttttcaaacaatcgggtaatcttttcaccagtggcgcttcctaaactccccatcacaaaaaatggatccataatgccggctgcgacctgcattttatccaatgtcccaataccggtcagaacgctttctttgatcccggttaccttttttgctttggccacttttgccatatacttttcatccgtatactgcttgggaaccgttatatcggaatcaatttcattgaaagaatcgaatgtaattttagcacgtcttttagcagttatccgaaaaccgaagccacagttcgggcaggtacgttgcttccccgcccgcatcgaaaagaacgtagcatgacatactggacattccttcataatattgtcggggatgttgtccattcgcttttttaattcctcacggctgggcattttaaaccgactttgcaacatctaatcccctcctgttggcaagcacgtcattttcgataaagctggtcgaataagtgcctttcttaaaacgatccgttgaaatcaattcatacaaaaaagcctgatttgttgtcacacccgtaatttcgagttcacccagaacccgtcgcattttcgcaatgaccgcatcccgatcgtttaaatgaacaatcaatttagcgatcatcgaatcgtaaaacggcgaaataaagcttccgtttgtaacgccggagtcaattcgaacacccagggatccatcggggaaaaacaagtgattaatttttccgggctgtggtgcaaaattattttcaggatcttctgcatttaaacgacattcaagggcgtgccctttaacggcagcgtctgcctggctaaatgataatttttcaccacttgccacttcaagttggcctttaaccaattcgattccggtcacttcttcggtaatcgtatgctcaacttgaagtctggtattcatttccatgaaataaaaatggtgtgtttcgtccatcaaaaattcgtaagttccagtattggtgtaaccgagcttaagtgtggcatgagcaacaatctcaccaagctcttttcgttctgccggcgaaattaatacgcagggactctcttcaatgaccttttgatgatttcgctgcagtgaacagtcccgttcgggtaagtaaactacattgccaaaatcatccgcaatcacctgcatctcaacgtgcttagcgtttcgaatcaatttttccacatacatactgtcatcattaaaagatgcctttgcttctcgttgcgcctgttcaaaagcgtctcgaagctgatcaggccgatcaacttcccggattcctttaccgccgcccccagcagcagatttcagcaaaaccggaaagccgattttttcggcaatcttttcagcctgatcaatcgacgtcacgtcaccctcactaccgggaataacgggaacccccgccgatttcattgcttcacgggcgtttgccttatcacccattaaagaaatcaactgatgactcggcccaataaacttaatatggcaagattcacacaattcggcgaactcagcgttttcagacaaaaaaccatatccgggatgaatggcttcacacccggttaaagtagctgcgctgacaatctgagtcatatttaaataagaatcactgggctgcggtccgccaatacaaatggcttcgtcggctaaatggacaaatagactgtccttgtcggcacttgaataaactgcaacagcctcaatgtccatatcatgaagtgccctgattatttgtacagcaatttctccacgatttgccactaatacttttttaaacatatactcacctctcaatttgttccagttaaacatgcttgtctcttattccactgcaaatattaaatctgcctcacaaatgacctcgtcatcacgagtaattgtgccatgtccaagaccgatattggcacgtaacttcttcatttcaacattaaaaatcaatcggtctccagggcgaaaatcatcctgaaaaacagcatttttaataccaccaaagaaaacattttttccatgatattgctgtaatgtcaggatagctgctaccccggtttgcgccattgcctcaatcattattggccgtggaacggtcaattgatgagccccttgattggcaaaaaaccattcattgatcgaaattaatttgactgctgttgcgttcttacccgcttcaacgtccaaaaatcgatcaatcatttgaaagggatatctttgaggaataacatcattgacttctggtttcattcaaactaccccttcgttacttgaaaaatcggttgaccatattcaaccatgctgccatctttgaccaaaacatttgaaattgtgcccgaaacatcacttttaacttcattgatcattttcatggcctcaatgacgcaaacgacgtctccctttttgaccttatctccctgtttcttgaaagcgggcttatccggattaggtgcaaaataaatcacgccaaccaaaggtgccgtaatttcttcaacattgtccggcgaatcagcctcttccgattttaaatcgttggaagctgctgattggctctgcaaattttgtttatggtgtgtactatcacttccgacaagctcagttgcctgagagtcgtttatgacttgttcaccaccttcgcgtttactcaacgctagcttaaaatcatcctgtgttaactcgaaattttttaaagatgacttatcgaatttgtctaataatcgttcaatttctttctcatccataagttactcacatcccttgaatgcaataacggcattgtgtcctccaaagccgaacgagttactgattgcgtaattaacaggggcctttttattgctttcattaaccaaatcgacggtacattcctcatcctggttagcaacgccgacattaaccggcatctggttgtgacgaattgcaccgattgcagcaacggcttcgatagcccccgcagctcccaatgcatgtccggtcattccctttgtgctgcttaccttaacatggtcgttttttgcaaaaacttcattgattgccttggactctgcactatcgtttgcatgcgtactggttccatgggcattgatataatcaacttgggttgcatcaatgcctgcttcgtcaattgccatctgcattgcacgtttagcaccattaccatcaggatccggtgcagtcatgtgataggcatcgctggtagttccatacccgacaatctctgccaagatattagcaccacgatttttggcatgatcgtaactttccaaaattagcgtgccggccccttcacccatgacaaaaccatttctgtctttatcaaatggaatcgaagccttcattggatcttcagtctttgaaagcgccgtaattgcagcaaaacctgaaataccgatttcattgacagaggcttctgaaccaccagcgatcattgcctcggccttgccttctttaatatattcaaaggcatttccgatcgcattagtccctgttgaacaggcagtaacaatcgcttgacttgtattacgagcgttaaaggtaattgaaatgtcaccggcagccatattaacaattgaattaggcacaaaaagtggtgaaacccgtttgggccccttatcatgcatcttaatgacctgttgttcaatagttgttaagccaccgataccggatccgtaaataacacccagctcttccggcttaatgttatcttccgtaagaccagccatttccattgcttcatgagcactatataaggcgtagttcacaaagagatcgtttctcttagctgccttcttatcaagtcttttcaatggttcaaaatccttgacctccccggcaacagaaatgccggtcggttcggaatcaaatttagtaattttattaatgccgacttttgaatgaaacaaattctgaaggaaactttcaacatcgtttccaatgggcgtaacggctcccattccagtaataactactctgttcataaaattactccttcaatgcttaaattgtgagtccaccatcaaccgtgacaacttgaccggtgatgtattgattagcaatcaaaaatgcaactgtatcagcaatttccttagcttcaccaaatcgtttcaaaggaatttgatctgcaaattctttttgacgacgttcactcattttttctgtcatatctgttcgaatcatgcccggtgcaactgcattacatcgaatgttgcgaagtgcgccttctcgcgcagcggtttttgtcaaaccaaccaatcctgccttacttgccgaataattggcctgtccaaggttcccgtgcaaccctgagatacttgaaatattgacaatggcacctgtacgagccttttgcatgactttcatcgcaaatttggtcatgttaaatgccccaaccaaattcgtatcaatcactgctttaaaatcttcgagactaagacgactcaataatttatccttggttataccggcattattgaccaaaacgtcaagtcgaccatgcttctcagtaatggcctcaatcattgatttggcatctgcctcatttgaaacatcaccaatcagatgatcatattgaccgctttttccctcaagtgctgcctttgcatcgtctgacaggtcatgatgcgtattcaatacaacaaaaaaatcctcatccaacaatcgttttgcaattgccaatccgattcctttaccggcacctgttaccaatgcaacttgttttgcttcactcattatttcaccaacttcatgtttgatctgacatcattcaatgtttcgagactgtccacgtgatataccttcacatttgcaatcgttttagctgcaaacttcattagtgtgtcccctggaccaatttcaatcatggcctggctgtccattccatgaagaacctgcagacaatccacaaaatgagttggattaaccaactgatcaactagtgtttgttgcgttgatgccacttcaaacggttttttagtcgtgttgctgataaccgggaatttgaaatcatgaaaatgaatatctttaattcgggttgccagcaaatcactagcttcctgcataaatggtgtatgtgaggcaacgctcatttttaacggcacaactcgcttaatgccgtgttcatgcagataatccgttgcagcagccaatccgtctttagaaccaccaatcacaatttgtgatgtggtgttaaagtttgcgggatagatatcacctgcctgtgatcctactcgacaagcttccccaacaatatcaggatttgcttttaaaactgcagccattttaccaggatgatttttaccggcctgatccatataccgactacggtcacgaacaagcggcaatgcatcctcgaattgaatcccccgagccgcgattagggcactgtattctcccaaacttaaacctgcagctccaattggtgagccaatctcattttcaaggattcgatcaataccggtactcatcgcaacgatggccacttgcgtgttttgtggatcggacatgacagacggatcacttaagttgagccctaaaacatcggatgcctcatcaatcgtttgtcgataaatatcctcttgttgatataggtcttgtcccataccatcaaattgttttccttgtccgctaaataaataacctagtttcaaaatatcaacccactattcagctttttgcttaagtacgtaatttaccaaatcgtcaacagtttccatcccatcatctgtttcgatttcaatgtcatatgtgtcttcgattttgtcaacaacttcgaagatgtccaaactatctaaatcaaggtcatttttgaagttagtgttttccttgattttatcagcgtcaacatccaattggtctacgataatgtccttaacttggttgaatacttcttcttttgtcattttaaaattcctccgaatagttttaattttttattggttaaccgactgtttcaatttttgatcatatacatgacttaatactttaaaatcattgtgcccactgttaatccgccgccaaaacctgacagcaaaacgacatccccccttttaatggtgccgtcagtgaccagttggtccaataagattggctcactggccgccgcagtattcccatactcatcaatattgattggaaacttatccatagaaacacccaaggtttctgcaattttttcaacaatccggctattagcctgatgcaaaacaaaatgatcaatatcatcggttgtcagggatgcctcggacaacgcttggttaattgattcgggaacattgttaaccgcaaaacgataaacacgccgcccattcatttgaaagaatggggagaattcatcttttttcgtcataaatggcgttggtgcacccgttttgccagctgttaaataacgaccaagctttccaagcgtcttaaggttctctgaaataaatgcgccctctgatttaggcgtatttttaagtaaaacaccgcctgccccgtcgccaaacaaaacagctgttgaacgatcttgccaatcaattaatttgctaagcgtctcaccaccaattaagatggcgtttttaggtgtctcggctatcaaaagctgctttaccatgttcagtccgtatacgaatcccgaacaagccgcatcgatgtccatggcaacagcatgatcggcacccaggtttccttgaaccatcgcgctgacagatggcgttagataatccggtgacattgttgcaacaataatgagatcaatttcagatggcttcaaaccagtcttttcaagaagctgttttgcaaccgacgtacataacgaacttgttgtttcgtcaactgcaacgtggcgacgcctaatgccggttcgttgaacaatccagtcatcagaagtatccatcattgtagataattcatcattatccacaacccttgtcggaacctggcttgcagttgctaagattttgaaattttcaaatttcattttgctgaaacctcaccaataaagtcttcgacgttaattaacgcctgtttcatttttttaattgcaggaccatcaaaccccttcaaacattgttcgaccaattttcgatgaaatgcataatgtgcccgatacaacaatcgacccttactggttaacgctaaattaataattcgccgatcctgttgattcgtaattcgggtaatataacctttacgctcaagattgttcaaattggcagtcaaagtgcccttgctcaatctcaatatccgggcaacttcagaagttgttttacggtcatgcaatccaatcgtgtgaaccaaatgaagttcctttgcggtgatgtccttaaaacgactctttctaatttcgctctcttcaattcgcataatctgatcataaatgtccactagggcgtcactaataaagttgtaatccgctttaatttcatcactttctgtggaattcattggctaattctcctagtttctggtacaaattaaattttctttttgggatcaggaacaataaacgttaaagttgcggagcaggctactttttcgtcaaccttagcttcacacttaacttttcccatattatcacgttgtttttccatctcaacatgaagtttcaaaacatcaccgggacgtaccacttttctgaacttcgcattatcaatcgaaccaagataagctgtttttccttgatatttttcagtcttcaaaattaaaattgaagctgcctgggcaagtgattcaataatcaaaacgccgggcattacagggttaccagggaaatgtccttggaaaaactcttcgttaatggtgacattctttgtacaaacaattgattcgccggggtttaattcatccaccttatccataaataaaatggggtaacggttcggaattaaatccatgatttcagatgcatctagtacactcattggtttcttcctttcagttgttaaactggtggcgtaacttcctaaatagtttgagaatcaaactattagttataaaaaaatgtggacaattacgccacaggtatccgttttttaggacaaaacacactatatactaaaatagtttgagaatcaaactattttagtatatggcattatagataatgctattttacctaaacgaatcccgaaaataaaggaactgtgggaatgagaaataaaaaataaaaatttaatgagaaaaaatcatttatcaccaaaaaaagcttgagacattttatatgtgcctcaaacttgttataccaaatttaaaatttatctaccacgtgatcagcttttaaaatcacccattaatcttctacagaccaacccactgtttcataaatcaactttggttttttagctgttgctgaaatttcaatattatcataaagtattttcttaatgtcttcaacatctttacggttactatgaatcgttaagatcgactcaccttcggaaatcggatcaccaattttcttattgagatatataccgactgaataatcgagtttgtcattggctttctgacgtcctcctccaagcagcatgcttgcaacaccgatttcatctgcaaccatttttgaaatgattccggtcctttttgccggcagatcgatttgataggctgcttgtggcagaatatcagtcggctcatcaacaacttttgaatcgccgccctgatcccgaatcattctcttaaagcttttaaggccttgcccattatggataacagtttcagcaagtttttgaccttcatcgatcgttttagctttaccacccattacagccatataaccgccgataactgtgatcagtttttctaaatcagtcggtcctttccctttcaaaacatcaattgactcttgaatttcaagggcattgccaattgctcttccaagtggttgattcatatcagtaattagtgccatacactgcataccgactcccttaccgatactcaccagtgctttggcaagtactcttgagtcatccagtgtcttcataaatgcacccgctccggttttaacatcaataattaaagcgtcggttccggaagcaattttcttactcataattgaactcgcaattaaaggaatcgaatcgactgtatcagtgacatcccgtaatgcataaatctttttatcagcaggtgcaatgttaccggttgcgccaataattgcacacttatcccgcttgatttgctcaataaacttagcttccgacatctccacttgataaccgggtatagcttccaacttatccagcgtcccaccggtgtgaccaagtccccgcccggaaatcatcgggatgggaatgcccattgcagctaccacggcagctaatggaatactgactttatcaccaacaccaccggttgaatgcttatcaaccttaatgcccggaattgaactcagatcaagatgatcccctgaagtcatcattttcattgtcaatgttgcctgttcactgtccgtcatcccttgaaaatagattgccatcaaaagtgcgctaatttgataatcaggaatttctcctgacacaacgccatcaacaaaaaactgaatttcttgatccgataacacgttcccagaacgttttttatgaatgatatccaccatccgcataaataaatcccctttactattgtgaataatgtgtctacatgtctaacagcaattgtgccaatccttgatcaataatgacttgatttgcgtatccggccttcaataccgcatgtacacctgctgttttctgttttccagtagcaaccagaatagcgtattttttatttcttaactcgtcaagcttgatgccaattgtccgatcatcaatttgttgattaacgatttccccgtttcgatcaacaaaccgtgaaaacacatcccctatggcttcttgttgaagttgtttcttctcctcatcattaaaatatccaagttgaaaaatcaacgcatcggatctaactgtccccacagtaaacaacgcaatgtcggcgcttctacccagatcaaggatgcgcttgatgtagcgatcccgttcaaccattttctttgttatcttattatcaaaaatcactggtaatggtaaataatcaggagaggtatgatagacccttgctaattcattgacgctttcgtacgcccatgttttttcctctgaataactgacactgcccttcaattcaacaacccgaacatcagagaccgcttgttcttcaacctgctgggtaatcgcatggatcgttttgccccatcctaatccaataacatcaccatgcctaacgactttcgccaaaaaatcagcagcatatttcccaactcgctcttgtaaagaatgggaatgcccataattgtttgaaacaacataaatattaaccccgtatttttgtttgagttgtttctcaagtatcttggcatctactaagggattaacaatttgaatcttcacaagcccgttgtctttcgcatattgaagtaaacgcgaaattgttggtcttgaaattcccactgatttagaaatttcagtttgacttaaatcgtcttcataatacatttcggcaactttcaaactctgttttaatttttccaaatcatgaatttcagccatccgtctctcccgctgttaatctgtcgcaacgataaatccccgttagtcattaatatttctgtaggctgtttcaagtgataatttagccatttcatcaaatgacgtttcgcgttctttggctgacaacgcttcacccgttaagagatgatcactaaccgtcaaaatcgtcagtgctttaatatggtgtttagcagccagcaaatacagaccggccgtttccatttcagttgccaaaacaccataatcaattaatttttgtaaatctaattcatcattataaaaacgatctgcggcaaaaatattccccacttttgtattaatgcccatttcttgggcagtatggtaggcagaatccagtaacccaaagtcagcaatcggcgaataatacataccggctccaaaagtattggcaataatcgatgaatcggttgtacctgcttctcccaaaataacgtcacgaattttgacatccggactcattccaccacaactaccaactcgataaattgtcttaacaccgtattctttaatcagttcagttgtataaattgccagtgatgggatacccattccagatccttgaacggaaattttcttacccttgtaagtacccgtgtacccaagcatatttcgaacttgactatagcaaaccggattttccaaataggtttcggcaatgtactttgctcgaagagggtctccaggcatcaaaactgtcgatgcaatttcgccggctttcgcgccaatgtgtgtactcatttgatttcctccgtattcattaattcctttagaaaacttgtgccaaccgcatttcctgaaacattaaagttatctaaaacagtcgcaccaaaatctgcaaacgtttttcgaatgccaagactgccgtttgacttcatagaaggtgaataagcaagcagtggcacttgttcacgcgtatgatctgttcccttaaaacccgggtcatttccgtgatcggctgttaagatcaatagatcatcatctttaagattcttcaaaactgtcccaaggcgcttatcgaagtccattaatgcctgtccaaagccgattgggttgcggcgatgtccatacattgcatcgaaatctactaaattagtgaaacagaagcctgtaaaatcttcctgcatgactttatcaacgtgatccatcccatccatgttgctttcattatgaaagccaacgtcaatgccctgaccggaaaagatatcgttgatttttccaataccaatcgtatgaacctgtgcggattttaaataatccaagtcggtttgtccaattggcgctagtgtgaaatcatgacgatttgccgttcgggtaaaatgatctttgtccggaccaacatatggtcgtgcaatcacccggccaatcgtataagtcggcccgttaacaagtgatcgagcatactcacaaattttataaagttccttcaatggaataacatcctcatgtgcagcgatttgaagaacagaatcaccggaagtatacacaattagatctccggtttccatctgatgctcaccaagttctgcgataatcttggtaccggactcgggacgattgccgatgatctttctgtcagaaaaagtttcaatctttttaattaactcacttggaaaaccgtttggaaatgtatccaacggcttactaacaggaagtcccatcatttcccagtgtccatccatactatctttacctgcagatatttcctgcataacgccataataaccaattggcgtttcaaccttgggtacccctaaaatagcctttccccttagattagagagtcccattttttgcaagttgggaagtgccaatcgtccttcatatgcttcacccacatgtcccaatgtatctgaatcaacatcatcaaacttatttgcatcaggtgctgcacctgtaccaaccgaatccagcacaatcccgaaaattctcttgtattcttttgtatccataacttagcccctccccaaggattcagctttattctgacagaatcgcaattgttgcgctaacacctaagcgattcgcacccgcgttaatcattgccaacgcttcatctcgtgtgtgaattccgccagaggccttcacaccaagcttgctgccaaccgtttttctcatcaatgcaacgtcatcaatttgggccccggcagagctaaatccggttgatgttttaacaaaatctgcaccggcatccattgaagcatggcatcccattacaatttgtgtgtcatttaaataggaagtttccaaaatgacttttaaaagcttaccttttgcatgaacagcttcagcaactttcaaaatgtcagcggttacattttttcgatcaccatcaattaattgaccaatatttaggaccatgtcaatctcttccgctccttggtccattgctgtaacagcttcgaacacttttgtttctgtattagtggctcccaacggaaagccaactactgtgattggtttaacagaactgttttttaattgatcagctacaaacggaatccaatatgaattaatacaaacggatgccgtattgtacttaattgcttcttcacaagttttcttgatatcagcctccgtagcgttaggctttaagtttgtatggtccaaatatttagctaattttgaagttgttaatactgtatccatggtaatgtaacccctttcattgtttacaaaacaatcatacatgaggtatgaacaattgtaaagaactaatttgaaataaatttcacgttaagctttcaaatctcctttcttctgtcattttatcagccgagatagtcctgcctaaaagaatctccatattttgagttgagttaatcaccaatgatatggataaaatggttgcctggaaaaatcatcacctaaattgcattttaaggcgtatacaaaagtggtgttaagcaaaagactatccactacatttgccaatggcctttttcctcatttttcaatataaaaagcgacaaaggaattgaaggcaaatataaatttaccctcaatccctttgtcgctttttatcataatctgattaaaatctatcattcttaatgattaagctacacatcagcattaattattttaaatcagaaattgaattaacatttttcatataagttggaactgccaagccaactttagcgccgtgcagattttcacccaagtcatcaaaacgccctttaaaatcgttgtaataaagcccttgcgtatttggtaaccaagcactcacggtaccgtcagcagctttagttgcaatagatgtccacataggctgcaattccatcgcctgaatagtgaccttatagccaatagaacgcaatgcgttagcaacaacgttggtcgaagcaatttccgaatcccaagccacataggtcagctttaatttttgaccatgaacatgcttaattccctttgtccaggaattaacctgtgcttgattctgtttaatccaatcgccggcagcttttctcggactttcaccatgattaactcttagcatcactgatgacatttgttcaggtcgccagtgaaatcgatttagtaattcataagcttcaggtttatccttttttaagccttttcgaacaattgtgttgatatcctcggtttttccatatatattcttaggatccttcagaaacttaagtttatatttggtaaacatccaatgaggcgtccatcctgtaatcacgatcggctgcttatatcgaattgattttcctaacgtggacaacatagcagcagtcgagcttgtttgcaactgccaatttcccttatccagcccataagctttcattgccttttgagtagtggccatttcaccagccccggcctcaataccggtaatggtgtagttaatctgcttgccaacactttccttagggttatatttcgtcatctggctagagcagcctgaaaggagaatgatggaaaagaagaccgaaataaatattaataatttattggttattttcttcattattaactcctttctatgcttttggtgatttgctccgattgattgcttgtgtaattcgatctaaaataatggctaaaataacaattgccaagccggcggcaaaaccgctcccggcatcgtttcttccaaccgcaaagtaaactttgtttccaagccccattgccccgatcattgacgcaataacaaccatggaaagggaaagcatcatgctttggtttacacccgccatcaaggtggatttagccaatggtaattgaactttaatcaatttttgccaagaagtagaaccatatgagtctgcagcttcaattaaatcttcaggaacttgacgaattcccaagttggtcattcgaatggttggcggcattgcaaaaataactgaagcaatcacgccgggaaccatacctatcccaaagaatgcaactgccggaatcaaatacacaaaggctggcatcgtctgcataaaatcaagaatcggtttgacgataatttcaacaacctttgatttcgccatccagatgccgattggaacaccgataactaatgcaatcaagctggaagtcaatactaaggtcaatgtctgagtcatatcccgccagtaaccttggttccaaacatacagcaacccgataacttcaaaaccaattaatgtccagtgctttgtttttcggttaagccaataggtaccgccaacaacgagaacgataaatagccaaattggaatcaagtcaaagatccattggaatccattaataatgcccccaataaaattggtaataccattaaaaaatccggtaaagccttccaaccaattaacaaaatgattaatccagtctgaaactggtaattgaggaatattagtcatttacattcacctcatttccagaaatcgcacctaatactgcaccacgaataatgatgcccaacaaatgtctttgatcatcaacaactgcaaaaggaattgacgtttcagaaattttttccatgatagtcgtaatcggtgtatctggtgaagtcgtaggtacatcgcgttgaacaactgaatcaagctttgtaattttcttacgaattaattccatcacgtgacttgcgtcaacaattccaataaattgtcgtttattgttcatgacgtaaactgatgaaatttcattttcaagcattcgtcgcatcgcaattcttggaccgtctttatcaatattgacggtattaggtcgaatcataacgtttgaagctgttaacacttttgttcgatcaacatcttcaataaatcgttcgacataatcatctgcaggctgtgtcaaaatttcttcaggtgtcccgatttgaacaacctctccgtctttcataatcatgatgcgatcaccgattctcaatgcttcatttagatcatgagagataaacacaattgttttatgcaaattctcttgcaaatccagcaattcatcctgcatatcttttcggtttaaaggatctaatgcagaaaaggcctcgtccatcaacagaatttccgaattatttgccaaagctctggcaagcccaactcgctgctgcataccaccagaaagttgagtcggatattgatcatcgtatccgtgaagcccaaccaattccaaagcttcatgagcctttttatgacgggcatctttatcaacaccttgaatctccaagccgtatgccgtattttctatgattgtgcggtttggaaataacgcaaagttttgaaaaaccatactcattttttttcgccgaacgctaagtaattcttttttatccaatttggtcaaatcttgaccgtcaataaaaatcttaccaaaagttggctcaatcagtcgattaatcattcgaataatcgtagacttcccactaccagagagtcccatgataacaaatatttcaccatcatttacattgaaggatgcattattaacacccacagtggcgccaactgaatttagaatttcagccttagacttaccagccttcacaagttcctgtgctttctggattcgtctgccaaatattttagtcagattttgcactttaagtttttctgtcatgtgcttcctccttctgtcaaaattaaactataaaaaatgacactctactaagggtgtcatgtcttttcataaaagaataacgattactaccataacaaaaattcaactttcaatcaaacgtttgtcttaaaaccacagccaatatcaaaaaactaaataacgccagaatcacctttataatcgtattcacaccgatttcattctatttttgtcattttttgtcaaaatggtcatttgcattgataagccgcacattaagggctagataaccaaaaagtaataacttttttaatttaaaagggattactcgtgaattcgggcagtattttttattttggaaatggttgttattctttttgatggttttaaaaactcaaaaaaagcacaaacgagaagttctcatctgtacctttcaatgactaatagttaaaattctttaacgacttttttcaaaaaccgttactgattcaacatgaacggtttgaggaaattgatcaactggttggattggttgattaatttgatatccatgttcagcaaataacttagcatctcttgcaagcgttgccggattgcaagacacataaatcaaccgttgaggcgacatctcggcgacactttcaatcagtgattcatccaatcctttgcgaggcgggtcaacaacaataacatcaggtttaaggccggctttttgccatttacctaattgttcttcggccttagcaacaacaaacttgcaatttgatattttgttaatatgtgcattccgtttggcatcttcaatggcttccggcacaatttcaacaccgtaaacctttttaacaacttttgcgagcgataaagaaatggtcccaattccgcaataagcatcaatcacaatatcatctttattaagctgcgccttttgaattgctaatttataaagcttctctgtttggatagggttaacttgataaaatgagttgggggaaatttcaaaatccaatcccatcaactgatctgtaattgttcctttaccccaaagtaccttattctgattacccatgagagaatttgtgtttttagggttaatattctgcacaatacttttaacttcaggaagttgattaacagtttcggaaataatttctgcttcacttggcaacttcttactcttggtgatcaatacaatcatcatttcatgagaataatgacctcttctaaccataatgttccgaataactccacgatgagtttgctcatcatacggtgttatctgaaactttcttaagatgtcgcgcacaatgacaacggctttgtcaatttccggatcttgaatatagaaatcttcaatcggtactaaatcgtgggaatgcttgcgataaaagcctgtctgtaaacgtccatttaacatcctaacaggaatttgcgctttgtttcggtagtgataaggtttgtccattccaatggttggagatacttcaacgtcaagcttcattttgttaaaatcgttttgaatttgatgacgcttaaattctaattgtgccggataagccaaatgctgcaatggtgcaattcccgtttgggtataagcaccatcaattggtttaacccgatctttactttgctgattgatttttagtgcttttccaaaggcaaaatttttctttacttttgtcactaaaatcgttactaactcagtaggaagcgcatcctcgataaaaatcggaaaatcatcaatctttgcaacccctaatccctggtaagtcaaatccgttacttcaacatcatatttttgattcttttgtactggtacttgtattttcatttattcacctttattaacctataaataaaaattgcgagtcgagaattcgaatcgcaattttcttcaacaacctattaaactattctttatcgggcaacttgtcaacacctttgacgaagttcttttcaacctgtttcatttcatccgtttcttcagaataagcattatccggaatttcgtcaagatttgcaaaaaacgtgatgtgttgttttaaatcaacaaaagtcattggcgcatcgccaccatactcaccatcaagattgattaacattctatccccatttttggccggctttgcagtcacttttcttgtcttcttatagattattcgtgggtcatccacatgtcgaccaccatttaaaacttttgaggccaaatgtaaaatctcgactaaattactagtctttacgataatcaaagtaaactttccatcatctaaagatgcatccggtacaatctgttcaaaaccacctacagaatttgtcaaagccaggaaaaacattgacgcttttcctttaaattcaccttcatcgtatttaatgtccatatcaatcggcttaattcttggcaacagttctgcacctttcaccaaataagccaaatatccaaagaatgtcttcaaatcggaaggcacatcgtaagttaattcggttaaaagccctccggcggcaatattgataaaatagttttcacccgcacggccaatatccatatcgattgtttggtttttgtagataatctttgcagcatcaaccgggtcttcacgcggtatatgaagtgcacgagcatagtcgtttgttgttcctgcaggaataatagccatcctaggacgtttctttaatggggcaatgccattaacaacttcattaatggtaccgtctcctcccgcagcaacaacaagttcgaatccatcttgggctgcccgacgcgcttcattttttgctgaatctttctctggtgtggtcgcaaaagcactggtttcatatcctgcttgttcaaaaacattcaaaatatcaaccattttctgctttaaaatttccctgccggaagtaggattgtatatcactcttgcccgttttcgcataacaattctgaccttctacttattcatagaatcctttaatagtttattgacaacttgtgggttagctttcccatgggtttctttcataatttgaccaaccaagaatccaattgctcgatccttcccattatggaagtcctcaactgattgaggatttgcggcaacaatcttatcaacaattggttgaagttgtgatggatctgataactgaaccatgcccttttcttcaacaaactttttaggttcttcaccctttgtaatcgccttaaatacttttttagccatttttgaagaaattgtaccatcggtaattaatttgatcattgttgccaaatgttctggtgtaatatcagtattttgaagttcaacttgattatcgttgaggtattcattaacgcttccctgcaggtagttggcagctaatttagcatccgcacctgcactgatcattttatcaaagaaatctgacatttccttggtttgtgtgacaaccattgcatcgtagtcagtaataccaagttcatttacgtacctttgtcgacgctcagcaggcggctctggcaattcgtttgcaatctggtcaatccactcttgggaaattgttagcactggtaaatccggttcagggaagtaacgataatcatccgagccttccttaacacgcatcagttcagtttggccggttgtctcatcaaatcgacgagtttcctgttggattgtaccaccggacatcagaacccgttgctgacgttgttcttcatattcaagactctttcgaacataattaaaagagttgatgttcttcatttcaaccttagtaccatattctttttggccaaccggtcgaattgaaatgttggtatcaacccgcatggagccttcttccatcttgacatcggaaacacctgtaaactgcacaatttgtcgtaactgttccaaataagcatacgcctcatcaggtgaagcaatatccggctttgaaacaatttcaattagtggcgtcccctgacggtttaaatccacgaaagaatgctctgattcatgtgtattttttccagcatcctcttcaatatgcatttcagcaatgccgattttcttcttttgaccgtcaacttcaacttccacccaaccatcgtgtgcaattggtgtttcagattgagtaatttggtaagccttcggattatcaggataaaaataattttttcggtcaaaatgcggacgtcgctcaatttcggcatgtaaagccaagccggccataataccatcgtgaacgacacctttgttagtcgttggcaaaacacctgggtatccccagtcaataacgtttgtatttgcatttggcttatcaccaaattcaacgggggaaggactaaaaattttggagtttgttttaagctcgacgtggacttctagaccaattgttgtttcaaaattcattagttatttcctcccatctttggtgtttgctttgcgaaatcagtatctttttcaaaggcgctaccagcctgatatacagttaattcatcgtatggtcttccaatcaactgaacgcccactggtagtccctttgagaagccggcaggaatagacattcccggaagtcctgccaaattgacaggtaaggttaatacatcattcatgtacatggtcatcggatccgacacatcttcaccaattccgtatgccggcgtaggcgcagttggtgccaaaatcaaatcatagtctttaaagacatttgtgaagtcgttgatcatcaaagttctaacttgagcagcctttttgaaataagcatcataaaaaccagctgaaagtgagaacgttcccaacatgattcgacgcttaacttcgtcgccaaagccttctgacctcgacttaatatatagatcatccagattcttaacatctttagcacgacgcccatatcgaataccatcaaaacgttgcaaattagaggatgcttcagatgatgaaataatatagtaagcagctaccccatattttgtatgtggtaatgatacttcaccaacagttgcacctaattttttaaacgtttcagcagtatcattaacgacctttttaacatcatcgtctaagccttgtgacataaattctgaaggaattccaattcttaatcccttaacacctttgtttaaggtgcttgtaaagtcgggaacttctttagtagaagatgttaaatcatggtcatcatgacccgcaatggcatttaataatgtggcattatcggatacgtttcgagtaattggtccaatttggtctaaactagacccaaaagcaatcagcccccaacgtgatactcgaccatatgttggcttcatcccaacaacgccgttaaaagaagcaggttgtctaattgatccacctgtatccgatcccaaagccgcaataacctctccggcagcgacagcagccgcagaaccacctgatgagccaccaggaactttggttttatcccatggattatgtgtaatcttgaatgcggagttttcagtagaaccacccatggcaaactcatccatattcgttttgccgacggtgatagtcccaagatttttaattttttcagccgcagttgcatcgtaaatcggtgtgaaattctctaggatttttgaagctgctgttgttttcaatcctttggttacaatattatccttaacagccaccggcattcctgacaaaaggttatctgagtcaattcccttttcatcaagtttgtttgcctgctttaaggcgccttcttcatcaagcgttaggaaagcattaatgtcaccatcgaccatcttgatgttatccagagtttgttttgttaattcttcaacagaaatgtctttgtttaccaactgcttgtgaatgctggccaatgattggttaaagtaattcattattcgttcgacccactttcatcaataattgtaggaactctgatgtaaccatcttgagtatccggcgcattatcaagcagtgcttgacgctggttccaattgtcagcaacatcatcacgcatcacattaatttgatcggtgacactactcgtcggctcaacaccatcggtatcaaccttactcaaagtctcaaataaaccaataattttgtccaactgggtggtaaagtaaggaagctgatcatcgtcaatcttcaattttgccagttcggcaacgtgttttacctgatcttcggagatcttttcagtcattgaaatccttctctcttctgaaaatagtaaattttagcaacaacgttcattttaacatataaattaagctaatttcttgcaaaattagtaactattaaagatatgcgcagaaaacttcttctcgtttgtctttctgcttaagaaactttgaatcccttctgtagattgaacagtaatgtcgattggtgcattagccggaaggtacttttgggctgcactctgaatatactgtgtgaaactaatgatctcggtttgactatagaactgtgttgtaatatctatgttcatccctgtcaatgacccatccgtgtattgagcttgtgcagtcacaccgcttagatttgggaaaaacgtttgaacttgtgacttaaaattatcaaatgagtcctcatcattttgacttggaccctttttattggattgcaacgggaatacataattcttctgcttaacttttgtccatttgctaatcgtatttgccccactgttattagtagcatacgcaaagaagtttccccctacaaggctgtcatcagaagcctgtttatacagtgcgatcacaatggggatatttttcagtttcttattttggcgtaagcgttgcaacacctgtccggcaatctttttgccttctttattaacctgtgcgtttgaaatatgagtttcataagtgggtccatattgtgtctttttataataatcaaccgaattaattgccagaccaatggtcattccttgtaaactcaaagatttcccattctgtgtcatgaaatcctgttcatcaatttgtgacaaatatactggggttcttgtatttggattggttgacttggactgcttaggatttaaaccacttggattggatttggatttacgttccaaccaagcttcaacccgtttagtagaaagatattgtccttcttgaaaaatgtactttttggtagaaaattgtttctttgaaatattaagcagcccattttcaaagcctttaatattaaattgatttgattcctgttgaacacttacaccacgtgatttactggtctgatagcgaccattcttgataacaccttgataataacctgtgtttgtttgcccagtcagctgcgtctttgctttcgagcttccagaactattagtatcatttgataaattgtcaacgctcccgcaagccgacagcaggatcccagttagaataaccgaaattcccagaaatatttttttcaaaattgattcctccattgttacttttcatcagccattgcttcggcgaatctattttcatcccaaacctcgatacctaagtttcgagctttatcatatttactaccagggtcttctccgacaactacaatgtcggttttcttagaaacagacccgctcactttggcaccgtgattttccaaccatcgagtggcctcaggacgggtaatatgttgaagtttcccagtcaataccaaccgtttgccattaaaaacagaatccgattctttcaaatcttcatcggtagcccccaggtaatccatattcacaccaacctgctttagctgactaataagttcctttgattgcggcattgaaaaatacgtgacaacactatccgcaatgatcattcccattgtatcaatttcagcaatttcttgcgctgttgcatccataaccttatcaatatttttaaaacgttgtgcgattaatctggcagcttttgcaccgacatgacgtatcccaagtccaaacaataaacgttcacaggaattattacggctgttagcaatagctgttagtaaattgccggcagatttttcaccaaatttatccaaagtcatcaactgatcaaatgttaactcataaagtcctgcaacatctgttaacatgtgttttttaaacaattgtgcaataattttgggtcccaatccatcaatattcattgcatctcgtgaggcaaaatgtgttaatccttctttcaattgggccggacactgtggattaatacatcttaatgccacttcttcatccaaatgtactaattcggaatcacaagatggacatttagttgggatctcataaggttggctgtcaacttggcgcttgtctttaacatatgttgaaatttctggaataatatcaccggctttatgcagcttaactgtatcaccgattcgaatatctttttctcgtaaatagtctgggttatgaagtgatgcgcgactaacagttgtgccggcaagcgtcacttcatccataacagcagtgggtgtaacaacacccgttcgtcctactgtccactcaatatctcgcacgattgtttcagcttcctctggtggaaatttatatgcaattgcccatcttggcactttaacagttgcaccaagtgatcgctgaagtggtagtgaattaactttgattacaatcccgtcaattccatatgctaaagtatccctctgctttgtgtacctttcaacgtattgatcaatatcatccatattatgagcaacttgatagtcggcattaattgtgaagcccaacttctttaattcctccaacatgccactttgggtgtctgactccaagtcatcgtaattagcaacattatacataaaagtgctaagcttgcgatgtgctgttactcgtgaatccagttgacgtaaactgcctgctgcagcattccgaggattagcaaatggtgctaccccctctacttgccgttgttgattaagttcaacaaacgactctttaggcatataacattcgccgcgaacctcaatgttaattggtcggctaaggcgctgagggattgatttgattgtttttaaattacgggtaatatcttcaccaatttgcccgtttcctcgagtagctccctgaaccaatatgccgtcctcatatcttagtgaaattgccaatccatcgatttttaattcacaattatactcaaatggcacagattccgaatcagaaagtctgtcagcaaaagctttcaactcttcaatggaaaatacatcacccaaagacagcatcggaatctcatgcggtacttttgtaaacccgggaagcgtgtgatcaccaactttttgtgtcggagaatccggtgttactatttgaggaaaggtcgtttctagatcaacgagttgctgataagtttgatcatatacagaatcctcaacactaggcgaatcataagtgtagtattcatcagcccacttattcaatttttctcgcaattcttgtgcggcactttcagcctgttgttcagtcatatcttcaaaagccacaataacaccttctgctagttaatcattaattatcgtttacattatagctgttcattaattggtggcacttttttgacgacacgtcccggtgtgcctaccacaacagaattatccggaacattgtgtgtgacaacacttccagctccaataacgacattattaccaatcgatactcctggaaggattgcgacattaccgccaatccaaacatcattgccaatacgaaccgctttactaaattgttcaccatttcgtcgtcttggcccttcaagaggatgaccagtgacagatatcatgacattagggccacacataacgtgattaccaatcgtaacagaaatatcatcgacaattgttaaattaaaatttgcatagaaatcgtcgccaatagttgtgttacacccataagaagtataaagcggtccttcaataaacggacgttttccaacctgatgaaacaattgtttcatcagagactgtctagtcaattcgtcgtttggatcagtttgattaaatttgaaagccaagtgttttccaagttgtcgctgcttttcaagtttcttcgcataattaatatctatcggatcagtaaaaccactttcacgatagacttctccgctctccattttgctttttaaactcatagtcatccccaacctttattttatccttactcttgtttggtaattggtgcaaatgcggctaaaagacgtttaattcctttttgttcaaatgcaatatccaattccatatcctcaccggtcccggaaactttgacaactgttcctgtcccccaggctttatgcgacactttatctcctaccgaccatgaagacctgtcagctccagtccctttgggcttaattactttttgggctggttgatgataagttgttgcagttgcgcgtctagttcggcgatcaaacggtgtagataacggtttctcttgttgattaacgttctcgtactgaatcaattccggcttaatttcattaacaaaccgagattcaggattgttttgtcggcgtccatataacattcgtgaataagcatttgttaaatatagtttctcttttgcacgtgtaataccaacgtatgccaatcgtcgctcctcttgtaattcggattcatcctgggcagcacgtgaaagtgggaaaagtccttcttccattcccatgatgaagacaaccggaaattccagccctttagctgcatgcattgtcattaacgttacctcggaagtcttttcatctaagtcatcctgatctgaaaccaatgccaaatcacttaaaaagttaactaaattgtcttgaccaccttggtcaggattatcctgatcatatttttgagtaacggaaatgaattcttccaaattttccaagcgggtttgagcctgtaaagactttgaagattttaaagtacttaagtaaccactcttatcaagaatctcttctgttaattcagtgatagtcattgtatccaatttcttagcgacatcactgattatttgttcaaacattgaaatcgagtttttagcacgactggaaatttcatttgcaagatcaatattctttgaagcctcaagcagcgaccaaccatgatcgtttgcaaaagtccgcaacttttcaaggctcgtttcgccgatgcctcgcttaggttcattaatgactctttcaaaactcatcgaatcccttggatttcccagtaatgtcaaataagcaagtgcgtctcgaatttcttttcgatcataaaatttatggccaccgaccatagtatatggaatgttggcctttaaaagtgtttcttcgatcacacgtgattgcgcattggtccggtacagaatcgcaaagctcccgtaattacgcttaggcttacccatttcttcttgaatctttgccacaacataacgtgcttcatcattttctgtctggccccgataataagaaatcttttcgccttgctcattttctgtccacaagtttttatcagcccgattcaaattatgcgcaataacagcattcgctgcatccaaaaccgtcttggttgaccgatagttttgttcaagtaaagtaacatgggcatcagggtagtcttctttaaagtcgagaatattctgcatgtttgcaccacgccagccataaatactttgatccgcatcacccaccacacagatgtttttgcttttttttgctaacgtattgaccaatcggtactgagcttcattagtatcctgatattcgtcaacatgaatataatgaaatttatcctgatagtaagataaaacatcagggaattgatcaaataactcaattgttgtcatgattaaatcatcaaaatcaagtgattcattttgacgcaactcagcttgataacgtgcataaacatctgccacaatctgatcaaaatcgttatcggcctgggccttaaatgcctttggcgttaataaatcattttttgcatttgaaattgaagataatacggctcttgggtcaaactttttaggatcaatattcaattcacgcaaaacacgctttaccaacgttcgctgctcacttgtatccgcgatggtaaaggcacgattaaaccctaattgatcgatattacggcgtaaaatacgcacacacaacgcatggaaagttgatacccacacatcatcaccactttcatcaagcagcttagacacccgctcgcgcatttcacgagcagctttattagtaaaggtaattgcaagaatgttccacggcattacatgattgtgttcaattatgtaagcaattcgatgtgtcaatacccgcgtttttccgctacctgcaccagccataatcagcacaggtccttcagtgtgaataactgcatctttttgatctttatttagaccttttaataaactatcttctaccactaattattccatcctctcaaaagtatcgagttaattataccaaatatacgtttggctcgtcttgcccacaaacataaaaaaagccggaaaatccgacatttttaatttttctcatattttgatttaaaatcaatatcattccaaatactggttgcttcgactttcattagtgtgtccgaaattgacttcgttgggattaaaatatgtccaatagagtcattgggattatcagttttatttccataaaaggaaaaatgccaatttccttttattacccactgtgtctgcaccctttgatattctttttttctaatagcttgaaaaacggttggaatgccaacaattattttggttaacggtaatcctgcaattgcacgaatatgttgctcaaattcattcgtattagctgcaaaatcaaacaaaaaaccagcaggacttaaaattggtgcaacccgattgacgtaaatcgatccactttttgctaaaaagagtgatacttcaaaggtgccgacataatcaatatttttggcaatctcattggtaattcgattcatttctttttcgacactcggatcaagcttcacgggtgtaaaggctgtcataatttgttcaccattatatatgacctcaacaattgggaaaacgactgttgtaccatccatttgacgcgttacaatgattgaatagtctgtatcgtgctcaacaaatgattccataatataagtccctgaatcaagcaaaccagatgctgcaacaatatcggcttgatttttaattaccagttctttgtcccccagcaatcctctttgaatgggctttaaaattgccggataaccaattgaattaattgcttgataaatatcctcaagtgtcacaattgtcgcgtatggagccatattaatgttaagtgtctcaaaaaagctacgctcaattaatcgatcttgaataatatccaacaacgaatcactttgaggtactgaagtgaactgtgaaatataacggatcacttcggaattaattgacgggctgttatacacaacaacatcacagcgctctgcaaacatctttagcgtttgtttgtcatccatgggtccaatatatttataatcggctaaacggattgttttactattttcatttgaactatacatgccaacattaaaacccatttttttggcaaaataaagaagcgtcggactactaatactgtcacctagaattccaattgtctggttagggtacaagatgtttgcttcagccatgatttcactactttcatttctcgattacttagaatgagcaggaattactaattaccttactctagttaataaaacctaataacattaattcattgtactactttattgtctagtcaacaaaagtgactttaccatcgttcaaagaagcaatacgggcaagagactctaatcgaatgcctgccttctcgatcagtgtgtgacccttttgaaaactcttttcaattacgattccgattccagcaactgaaacatcggctaatttggcaatctccaataatccttgaacagcttgtccatttgccaaaaaatcatcaataattaaaattcggtcatcagaattcaagaagcgcttatcaacactaatatcgttgctaacttgctttgtatacgagtaaacactggccgtatataaattatcagtcaaagttaaagatttatgctttctggcaaaaatcagtggaacccctaaatgaatcgcagtagtcaatgcaggcgcgattccagaagattcaactgtaactaccttggtaaccttctcatccttaaacagtcttgcaaactcagctccaattttgtccattagctgagcatccacttgatgattcaagaaattatcaaccttcaatacatttccaggtaatacagtaccatcctctacaatccgcttctttaataaatccattatttgcattcctttctagtcgtcaaactgatacagtttataattctttattagtgagataagcttttcggtgtacgttgggtccgttgcataaccatctttttccaatccttgggccgcctgaacgtagttatttgccgaaacaacatcccgatattgatcaggattccatttggttccgtatgcaagtaattttgcatgttctgctaaggaatcattccaactgtcatatacctcaaatcgtgctttaacagtgacgtaccgcccatcaacatactcttgcgtatccaaataaactgattttgtattcgaactttgggccttcacgccaaacagattattgtacttgctggatagttgactagtcccccaattagattcaagaattgcctgagctaacgtcacgcttggaagaacattgtattgtccctgtagcagttgtgcctgtggtgcaagtttgttaataaatttacgatgctgtgccgctaactcacttctagcgttatcaacttgattagactcgggaacattggctgataataatcgaaagcccaaaataataaacaatccgaatccaatcaataccagcatcacaattaaatttgatgtttgttttcgacgtttccgtctactattatacttcgccaattcaacctcaaactttctaactattaaaattaattctaactatattcatcaataaagacaattactatttttaataaataaatagactattcattattattgacaaattcgacaatatcggttatgttatcatctgacacttaaaatctggagatggaaaccaatggctaaaaacaccgaagtatcagaagcgcaatcaaaattcaatgttggtgatgaggtttcgtttaagattgaaaaacaaacgttcaaaggctttattgataaaagctatacgaactcatttttaatcacatttgaatctgatgaccctgaaattattgacaagtatcacaagaaagttgtcattaacaaccgtcatttgaagttaattaaagctgcacctaagattaaagatcctgacagcgataaagaagataaagatgacaaacccgctaagaaataattcttttaaaaggtcacacaacgtattttttcgttgttggcctttttttcataccattatcaactagtccaagtgcccctttagaactttctgaagcggcaaggcgattaagggtgtcacaatgccactaaaaatagcttcaggaataccatttgttccaacaacaccaagtaaataaggcattaattctctgatatttatttgatatagttgtggtgcctttgctttataaaaaagataaattaatcctaatacaaaaattgtatttgttagggatccgagtatagcggctattgaaacgccgactgcttgtcttttgatccattttcttagtgcgtgatatgtgacacctgcgactactccaatcaggactcgcggtaacactgaaacaaatggattgacaaacacaatggtcgctaagggacttgttggccaaatatacgctcgaataaatgtaatcaacccccagacgcctccaataatagcgccatctctcgttcccatcaaaattgtagcaattgtgacagtcgcagaaataattgtaatgctcaatggaccaattggaatataaccaatcaaaggaatcgaggtttgcagaataataatagctatgaacattgccaacaaattaaatcttaacgtttttttcttctctgccattttctatctcctgtttagatggatatattataccagacaataacaccgtttcttggtattaaaaatgagcttatattttttttagaatatccctaaacatttccaagaccagttaaatgaatttttgaaatatcgtttctcaagcctcgaagtgatgatcaaaatacactcatttgatacctttgttcctgtcttaaatcttcaaaattaatactaacatatagtggatcaaattattgaagcattggcttgctacttagtttactttaacaggttaactcataaacactaataaattaaagctaaataaaaaagcaccttctctttgaaggtgtttttcataataaataaagtaaatattaacgctttgaaaattgtgaagctttacgtgcctttttaagacctggcttcttacgttctttcattcgagcgtcacgagtcaacaaacctgcacgctttaatggtccacggaagtctgggtcaactgacagcaatgcacgtgcaataccatgacgagttgcacctgcttgtcctgaaaagccaccaccattaacattaactaatgtatcgtagttaccaagtgtttcagtaacattaaacggttgtacaacaacctcacgtaaattagcaaatggaatgtaatcttcaattgctttatcattcataataattttaccagttccgggtactaaacgtacacgcgcaactgaatctttacgacggccagtgccgcgatattgtacttgagccaaagtgagttcctccttaaattaggttcttaatgtctaatgcttctggtttctgtgcttgatgatcatgttcaggacctgcatagacatgtaacttcaaaccgatcttatgacctaatgttccatgaggaagcattcctttaactgaagtttcaataagcttttctgggttcttttcacggaactcaccagctgtcttttgctttaaaccaccaatgaaacgagtatggtgataataaatcttgtttttgtccttacgacctgttaatcctaccttaccggcattgataacaatgacattatcaccagtatcaacgtttggggtgtaagtaggtttatttttaccttttaaaattgaagcgactactgatgagagacgtcctaacgatacgtctgttgcgtcaacaacgtaccatttacgttctacttcaccaggttttgccatatatgttgtgcgcactttatattcctccaagttctgtgtttgttcgacaccaaataagtttccggggctcatcgtggggcaaacaataccaactaacataatacaaataattctgcggaaagtcaattattttccagtaaaattgctaacgtttaggcaattttgttgggtgctcaggatcgtcgccctcatagaagacacgtttcaagtaaagaccggatgcaggcatcgttcttcgcgcctgatcacgatcctttacttcaaataatcttagaacatcactttctggacgcattcctgaaccgatttcagctacaactcctaccataattcgaaccatattgtacaaaaatccattcccataaaactccaaatgcacttcattttccgcctggtctaatttggcagatgccgaataaatcgttctaatattagaacgggccgtcgatccagaagcaacaaagcttgaaaagtcatgttctcccactaaatctgctaatgcatgattaactttctccatatcaattggaaatttccaatgtcctgtatagtttctcttaaatgggttttgaaattctccaagatacattctataaaaatattttttcccagaaacatcatagcgtgcatgaaagtcattactgactttttcaactttcgtaatttccatgtctaatggcagcatgctattcaacccgcgataaatagcttcagtcgataaatcaaacggaaaatcaaagtgagcaacttgtgcgactgcgtgaacacctgcatcggttctccccgaaccatatataataatcggtggctcaggcatttttgccatcacattgactttttgagttaagacgccttcaattgttcttctgttaggctgtctttcgaacccactaaaatttgtgccatcatacataaaagttattttgtaacgactcgtaattatgaccaactactttctaataaatataacaactgccccaatagctaaaaaaacgagccagctgatcgtatcttttacttgccaacgatactgccgatatttagtccgatgctcgctgtccgaaaatccgcgagcttccattgctgttgaaagattttcagcgtggttaatagcacctgtaaacagcggaaccagcaatggaacagcagccttaaccctatgttttagactacctgacccaaaatcaactcctcgcgcacgttgagcattcataatagtttccatttcgtccattagtgtaggaacaaatcgaagcgcaatggatagcatcagtgctaacgtatcaacaggaaatttcacttttttcaatggcttaagtatcgtctgaacaccatcagcaatagccagaggagtggtcgttagtgttaaaacagtcgatatcataataatcagtaaaaacctcataaaaatgaagccaccgtttatcaaactttcattagttacagagaatggaccaaaatgccaaagaactcgcccaccactactaaataaaatttgaagtaagacggtaaaaataattaaccatattaatggccgaattccctttagaaaatacataattgaaatacccgaaagtaaaatgacaataagaataagaatagataggattccataagaaataagattatttgcaaaaaaaataataataacaaagtaaaagcttaatagtagtttcgattgggggctcatctgatgaatccacgaatgaccgggaaggtatcgtccaaaaatgaaattactcatttggtatctcctttcccgacaagtctcgcaattctatctgcaagagcatctattgttaacggcaactgaccaatattaatccctgctttttttagctgttgtgcaaattccgcactgcttggcaaatctagttgcatatcataaacccactttggatcactaaaaacttgtgcaggtgacccaactttaacgattttacccttatccatcacaataacatttgtcgcataatcaattacatcgtccatctggtgagtaatgaggataattgtcatttgcttatttttattgagataccgagcaagatccatgatttcttgatgtcctcgcggatctaatcccgcagtaggctcgtccagtataagaatttcaggattcattgccagcaccccggcaattgcaacccgtctcatttgtccacccgacaaatcaaatggtgacttatccgccaatgctttatccaagcccactaaggccattgcactaaaagcagatttttttgcttcatcatcatttacaccatagttcttagggccaaacatgatatcttttaaaactgtttcttcaaataactgtttttccggaaattgaaaaaccattccgacgtgttttctaaacgccttgaggttcttgtttgttgtattgggatctatgactcttcctaagacctctaggtggccttcagttggctttaaaagagcattgatgtgttgaaccaaggttgactttccactccctgtatgaccgattatcgccgtaaaagaaccccttggaatctgaagtgtaacattatctattgcattttgagcaaaaggcgtatttgcctgataagtatgagttactttgttgagactaattgctgtatccatgcgattaactcctcatcattcatatatgacttttcatcactaacgccacgctcgctcaaagctgcaagcagtttagatgtataaggcgcatcaagcccaatttgtcttagcttgtccgaatgggaaaaaattccccgtggtgtattctcatcaataattttcccatgatttaaaataaccactctatctgcacctgcagcttcatcgatgtcatgagtaattgaaatgacagttaaatggttttcattcttaagtcgttgaaccaatgccaaaatttcttttcttccacgagggtctaacatactggtagcttcatctaaaatgataattttcggactaagggctataatccctgcgattgcaactctctgcttttgtccaccagataaattggcagggattcgttcacgaaaatcccacattcccacactctttaaactttcttcaacaatgtcatgcattttactacggtcaaccaactgattctccaagccaaaggcaacatcatcctctactgttgcgccaacaaattgatcttctggattttgaaaaacaattcctattttgcttcgaacgttatagatattttgatcgtttacttgtaatccatcaaccgtgatgtgtccctcatttaaaacaattagcccatcaattaatctggccagtgtacttttcccacttccgttttgaccaatgatagccagccactctccctcatgaacatctaaggataattgatcaaacagtaacggttggtctggataattataagaaatcttgtctacttgaattatatctttcatcaaattgacctcatattttttggcatcattttatgtacaaaaaaatcactaacaagtgattagtgcgtggaatttattccacattcaaactagactagagatttatcaatcccaccatcataacgttctataccaaaaacctgagtgattctcgtgaaaatgtgacaattatgcttagaaaaataaatgaaaatttagtctactaattctaatacgaccataggtgcaccgtctccacgacgtggcatagtcttaagaatccgtgtatacccaccattacgatctgaatacttagtagctaattctccaaatactttttgcaatgcagtagtgacagtaatgtcatcgccatcttccttaacatcagcaaccacattacgaacaaatgaagcagcttgacgacgagcgtgtaaatcaccgcgcttaccaagtgaaatcatcttgtcggcagtagaacgtacttctttggctctagcttcggtagtgataatttgaccatgaataatcaattcagtggttaaattacgaagcaatgagcgtcgatgttcactggaacgttgtaatttccgataactcatttccggttgtcctcctttataaaattaattaatcttctttacgaagtgaaaggcccaaagcagcaagcttttcttttacttcttcaagtgacttgcgtccaagattacgaaccttcatcatatcagcttctgtcttttcagtaagttcttgaacagtattaatgccagcacgtttcaaacaattataagaacgaacagataaatcaagttcttcaattgtcatttccagcattttttctttatgggtttcttctttctcaaccatgatttcggtattcttagcttcatcagttaggtctacaaacatttctaaatgttcagttaagatcttggctgccaaactaaccgcttcactaggtgtgatagaaccgttagtccaaatatccaaagttaatttatcaaaatcatcgcgttgaccaacccgcgtactttcaacctgatagttgacacgttcgattggggtatagatggagtcgacaggaagaacaccaattggcatctcagtagcacgtttcttattttcaacagcagaaacgtaacctcgacctctgttggctgttaaccgcatatggaaagtagcaccttcagcaacagtagcaatatgcagatcagggttgaggactgtcacatcactgtcgccttgaatgtcaccggcagtaacatcagcagggccaattacatcaatttccaagttctcttcttcgtcttctggtccatccaatttcaacgaaattttcttaacattcaggatgatctgggtaacatcttcaacaacgcctttaatcgttgagaattcatgaagaacatcatcaatttggatactggttacagcagcacccggcagtgatgacaacaatgtgcggcgaagtgaattgccgagagtagtcccgtaacctctttcgagtggttccacaacaacctcaccaaagttctttgtttcttcaattttatgaatgttaggtttttcaaattcaatcattcttatcattaacccctttcaaaacgcgtgagtccatgtgcaatatatcaatacgtataggcaaaataaacatcactatattgaatcaataaaaactaaactcgacgacgctttggaggacgagagccattgtgaggtacaggtgtaacatcacgaatagctgtaacttccaaacctgtagcttgaagtgcacgaattgcagcttcacggccagaacctggacccttaacagcaacttctacagacttcataccatgttccattgacgactttgcagcagcttcagcagccatttgagcggcaaatggtgttgatttacgacttccacgaaaacctaaagcacctgctgatgaccaggcaattgcattaccttgagtatcggtaatcataactaaggtattgttaaatgtcgaatgaatatgtgcaacacctgaagcaatattctttttagtccgacgtttacgacttgacttcttgtttaccataaaaacagatgacctcctttatctttattttcttctgcctactccagcagttgcctttcccttacgagtacgggcattattctttgtgttttgaccacgaacaggcaaaccacggcgatgacgcataccacgatatgagccaatttcttggagtcgcttaatattcatgctaacttcacgtcgtaagtcaccctcaattttaaggtcactaacaatcgcacgaattttatcctcttgatcgggagttaaatcgcggacacgaacatcttcagaaacacctgcttgtgcaagaatcttttctgaagtgcttgtaccaataccaaaaatataagttaatccgataacaattcgcttgtcacggggtaaatcgattccggcaatacgagccatttagtacacacctcctgttttaagttctactttccttggcgttgtttgtgcttagggtttgctgagcaaatcaccatcacacggccttttcttttgattactttacaatgttcacacattggttttactgatggtcttactttcatttttaaacctcctcaaaaaatgatgaagacaataactacttaaatcgataagtaattcttccctttgttaagtcatagggcgacatttcaacagtaaccttatctccaggaagaatccgaatataatgcattcggattttaccggaaacatgagctaaaatctcatgtccattttcaagttcaactcgaaacattgcgtttggcaatgtttcgacaacttttccttctacttcaataacattatccttagccactaattaacacctccaaaattaaattagattgaattaaaatataagcgagcttgacaaacctttgacagtttaacacatccattatatttcatcaatccaatagactcaacacctaatctatggagtgtttacagtgtactcaagattttatcaacatcctgccaaactttatcaatatcttgatcaccattaacattaaacagcaagtcccgatctttgtaataagaaatcagtggcgtattcattttaacattaactttcaagcgattcttaacagcctcgggtttatcatcatcccgttgatagaattcgtggtgaccgcaaatatcacaggttccattaactttaggcatatggtacaacttattataagtggcaccacagttcttacaaataaaacgtgcagttagtcgattagttaaaatttctggatcaacatcgatgttgataacagcagacaagggtttccccaactcgtctgccatatctgccaatgcatccgcctgttcttgagttcgaggatacccatctagtaaaaagcctggctgagtatcattatgagaaagtcgttctttaacaatcccattagtaacttcatcaggaactaaattacctttgtcagtaaacgacttagcctttaagcccagtggcgttccgtttgaaattgcttcgcgaaacatatccccagttgaaatatgtgggatctggtacttgtcaacaataaattgagcctgagtacccttaccagcaccaggcaatcccattaaaattaaatttaatgccatcaatttttcctccttgttcgatgtttaatcgtcttattcaccattagttggacgagaacctttaatgaaaccgacatactcacgtttcatcattaatccacgaatctgacgaatagtttcgattgcaacaccaacaacgattagaagacttgtaccacctagtccaatggattcatctaagttccaaatattttgagcaaccagtgggattaaagcaacgacacctaagaaaatagccccaactgtacttaatctcattagtaagtttgaaacgtaactttgtgtttcatgccctggccaaacgccaggaatataacttccttgcttttgcaagttctctgataacttttcagggttaacttgaacaaatgcatagaagaaagtaaacatgacaatcaaaattgtgtaaaaagcagctccggtggttgtctgcatgttaaacacgttgtttaacacttgataccacgttgttgtggaataattattcgtaaaagccattaaaatagtttgaggagtcgcaataaatgaactcgcaaagataactgggataacaccagcaacattaacctttaaaggcaaataactactgtccggtgaaccagcaactcttcgcgtgtattgaattggaatccgacgttcagcttgttgcacccaagtaacgaacgtaataatggcaagaacgataatcacaagtgcaatcgagaagagaattggttgccataaatcagaacccgttacgccaacaaagtattgttgccatagtgattgtaatccagtagggattcgagcaatgatacccgcaaagataatcattgaaattccattaccaattcctctttcagtgatcatgtcacccatccaagttgttaacattgtaccaccagtcaggataataccaatgacaatgaaggttttaacacttgggttggtaaccaaattcagactacttaattggttgaatccggctgtaattccgactgactggaagaaggcaaggacaactgttaaataacgagtatgttggttcaactttcgccggccaacttccccttgtttcccccactcaacatatttaggaacaatatccatctgaagcaattggataataatttgagcagtgatgtatggagatactcccatagcaaaaatcgaatagttagtaagaccaccaccactaaaggtattcaggatgctgaccaatcctgatgatgcaacggacgttaacgcctttgcatttacaccaggaacggttatgaatgatcccaaccggaagataatcaaaacaaacaatgtaaataaaatcttgtttcgaatttccttaaccttgaatgcaccagttagagtcgagagcattaaaccacctcgattttaccgccagcattttcaattacagattgtgcagtttttgaaaacttattagcctttacggttaatttcttagtaagtccaccgtctccaagaaccttaataccagatttagcgtttttaacaattccgcgatcctgaagtaactctggagttacttcagtgccttcgtcgaaaacatcaagttttgcaacgttaacaaccgcatattctttacggttaatattgttaaatccacgttttggagtacgacgatacaatggcatttggccaccctcaaagcctacacgtgtcttgccacgagccttttgacccttttgaccacggccggcagtctttccttttccagcagaacgaccacgacctttacgtgtacgtaatgaacgagaaccttctgcagctttcaattcattcaatttcatgaaattggcacctccttacgaattattagtctttaacttgttcaacttcaattaaatgagcgattttgaacagagctccgcgaattgattcgttgtccggtttaacaaccgtactattaatccgacccaagccgagtgccttcacaatttttcgttgatttgggaggcgatgagctacgctacgttttaaagtaatttttaattgagccaattaaaacaccctccttattcagctaaatgttgggttgatacaccacgtaaagctgaaatttcttcagcactcttcaatgcgaccaagccttcaaatgttgctcggataacgttgacaggagtatttgaacccaatcgcttacttgtaacatcgtcgataccggcaagttccatcacggaacgaacggcaccaccagctgctactccagaaccttcttcagcaggctttaacatgatacgcccgccaccgtaagttccaacaacttcatgaggaattgttgtaccaacaatcggaacctcaatcaaattcttacgagctgcttcaacagctttacgaattgcttcaggaacttcttgtgctttaccagttccaaagccaacatggccgtgtttgtctccaacaacgactaaagcagcaaaacgaagacgacgtccacctttaacaactttagtgatccggttgatagaaacgacattgtcttcaagctctaatttatcaggatcaataaacttcttcatgtgcggttattcctccttttattaaaattctaatccgttttcgcgagcagcatcagcaagagcttgaacacgaccgtggtataaatatccgccacgatcaaaaacaacttttttgatgttctttttgcttgcacgttcagctactaatttaccaacactagctgctttttcagttttgttaccatcactgattgcagaatcaagtgttgaggcactaacaagcgttacaccctctacgtcatcaataacttgagtatagatgtttttgttagaacgaaaaacgttcaagcgtgggcactcggcagtaccagaaattttattacggacacggttatgacgacgtttccgactcttattcttatctggtttagaaatcacaatagtcacctcaataattttttaagctggtattttacttaccagtcttaccttccttacggataatatgttcattttcgtaacgaatacctttacctttatatggttcaggtgaacgaacggcacgaacagatgcagcaaagtcaccaacatgttgtttgctgataccactaatatgaatagtcgtattgtcaggtacttcaacagttagatcttcaggaactgtcatgtcaacagggttagaataaccaacactaagtgtcaaagttttccccttgagtgcagcacgatacccaacaccaacaagtttcaaagttttcttgaaaccatcagtgacaccttcaaccatgttgttaaagtttgctcgcatagtaccatgcagagcacgaactttgttgttataatcaacaactggttcaaaattcacttcgttgtctttaacgttcattttaatttcggatacaaattcgcgggttaatgaaccctttgaacctttaacagttactttattaccatcagttgatacttcaacgcctttaggcaaaacaaccgttttataaccaattcgactcacggatcacacctccaattttttgaaatattaccaaacgtaagctaatacttcgccgccaattttttgggcgcgagcttgtttgtcggtaattacaccatttgatgtagaaataatagcaattccaagtccattaagaacctttggaacagcatcggccttaacgtaagaacgcaagcctggttttgaaattcgtttcaaaccagtaatgacacgttgcttatccttgccatacttcaggaacacacggatgacaccttgtttgtcatcttcaatgtattcaacatcacggacaaagccttcacgcttaagaatctcagcaatgtcacgtttgatttttgatgcaggaacttcaactgtttcatggtaaaccatgttagcattgcgaatgcgagttaaaaagtctgcaatgggatcagtcatagacatcagcgaacaacctccttcttaataatttttaccaactagctttcttcataccaggaatctgacccttgtgggcaagttcacggatgcaaagacggcacaagtggaatttcttgtaaactgaacgaggtcgtccacaacgctcacaacgtgtataattttgtgttgagaactttgcagggcgttcactttttacgattaatgattttttagccaatgtgaaacctcctcaattatctagcaaatggcataccgaattgagccaacaattcatgtgattcttcatcggtattagcagtagttacgattacaatatcaagacctctaacacggttgacattatcataatcaatttcagggaaaatcaattgttcacggacacctaaagtgtagttacctcgaccatcaaaggctctagaactaacaccatggaaatcacgaacacgtggtaatgaaacattaattaacttgtccaagaaatcatacattctatcgccacgaagagttaccttggcaccaattgacataccttcacgtagtctaaaaccggcaattgatttcttagctttagttactaaaggtttttgaccagaaatcaaggctaattccgaaactgcttcgtcaaggtttttagcgttagtaaccgcatcaccaacacccatgtttaaaacaattttatcgatttttggagcttgcataactgacttataactgaatttttccaccatgtgtggcacaatttcgctgtcaaattgttcatgtaaacgacttgtcatttaaaagttatcctcccttcctaatttgaattaatcaatcgctttttgcgatttctttgagtaacgaatcttcttgccatcttcaaccttaattccaacacgagttggctcgttggtagatggatcaataagcatgacatttgaaacgtggattggtgcttcagcatcaataattccaccatttggatttgttgatgaagccttggtatgtttctttactttgttcacaccttcaacaatcacacgatctttagaagcgatagtcttagtaactgtcccttcttttcctttgtccttaccactaataacacgaactttgtcaccagttttaatgaacatgttggcacctccttatatcctggttgttttaaagtacttctggggctaatgaaacaatcttcatgaagttgttatcacgtaattctcgagcaaccgggccaaagatacgagtgccttgaggactcttatcatcacgaactaaaactgctgcattctcgtcaaaacgaatataagaaccgtctgtacgacgagtaacagatttggtacgcacgataacagctttaacgacatcaccttttttgacaacgccacctggtgttgcttgtttgaccgtagcaacgatagtgtcaccaattccggcatatcttctagttgagccacccaaaaccttaatagttaacaattcccgtgcacctgagttgtctgcaacttttaatcgactttcttgttgaatcacaggtatatcctcccttcatcgtcaaataaaatacgataattatgataattaagtaagttaaataataaccgctttttcaacaatatcaatcagacggaaacgttttgtctttgatagtggacgtgtttccataatccgtacgatatcgccaacttttgcttcgttattttcatcctgagcagtgaatttctttgaataacgaacacgcttaccgtatgttgcgtgtttcttgtaagttgaaactaaaacagtaattgttttgttattcttgtcagaaacaacacgtccctgataaaccttacgctggttacgttcttcagccattaattatacctcccttatcgtgttttacttgtttaactcttgttgacgaagagcagtcttaatccgtgcaatgtttttacgaacttgctttaatcgcgcggtgttttccaattggccagtggctagttggaaacgaagattgaacaattcatctttataatctttttctttatcaatcatttgagcagtggttaattcattaatttctttagccttcatttgattcgccacctacttcctcacgttttacgatctttgtacgaacgggaagtttattagaggcaagacgcaatgcttcagtagccacttcttcagaaacgccaccaatttcaaacaaaatcttgccacgtttaactggtgatacccagcctgctggtgtacctttaccattacccattcgaactccgacacctttttcagtatatgatttgtgtgggaagattttaatccaaactcttccgccacgcttcatataacgagtcatcgctacacgacatgcttcgatttgacggtttgtgatccaatgtgaatcaagtgattgcaaaccgtaatcaccgaaggttacagttgtaccacccttggcactcccacgaagtttgccacgatgctcacgacggtgctttacacgcttaggtactaacatgcttatttgcctcctttgtcagcttcactgttctttggcttttcaggaagaatttcaccacgatagatccaagtctttacaccaattgaaccataagtggtgaaggcttcaacccatgagtagtcaatatcagctctcaaagtatgcaaaggaacagttccgtctgaatatgattcaactcgagccatatcagcaccgttcaatcgaccagcaacttgagttttaataccctttgcaccagcacgcattgtacgttgcatagcttgacgcattgcacgacggaaagccacacggccttctagttgacgagcaatgttttcgccaacaagttttgcatcaagatcaggcttcttaatttcaataatgttaatatgaacccgtttgcctgtaagattatttaattccttacgaaggctttcaacttcagatccacctttaccaataaccataccaggcttggcagtatgaatcgaaatattaacgcggtttgcggcacgttcaatttctacagttgaaacggatgcattagcaaggcgcttttcaatgtacttacgaatttgtaaatcttcacgtaaatatgcagcgtaatctttgccagcataccatttagcttcccagtcgcgaatgattccaactcgtaaaccgttaggatttattttattacccacgcgttatccctcctctttttccgacacaacaattgtgatgtgactagttcgtttgttaattggtgaagctgagcccttagctcttggacgaaaacgtttcaatgttgcgccttcgttaacgtaagcttcgctaacaactaaattctctgaatctaagtcaaaattattttctgcatttgcaacagcagatttaagcaccttagaaactaccggagaagcaccgcggggtgtgaaatccaggatggcggcagcttcggcaacactcttacctctgataagatcgattacaagacggaccttacgagcggcaatacgaacagttttggcagttgcttttgctgatgtaacttgttcagccatttgttatcctccttgtttaaacagtcttcttatcgtcagtaccatgaccatggaaagtacgagttggaacaaattccccgagcttgtggcctaccatatcttcttgaataaagactggtacgtgtttacgtccatcataaacagcaaaagtatatccaataaagcttgggaaaatagttgatcgtcgtgaccatgtcttaattacagacttcttttcttggtctttttgggcatcaacctttttaagtaaatattcatcggcaaatggtccctttttcaaactacgactcattttgaaacctcctcttcatatgcaaaaacaattgcatatgttttttacatcttcgatcctttacgacgacgaacaataaatttatttgaacgtgctttcttagaacgagtcttcttaccaactgtcttcttaccccatggtgataatggtgatgggagaccaactggtgctttaccttcaccaccaccatgagggtgatcgttagggttcattacagatccacgaacatgtggacgttgtcccttgtatcgagtacgaccggctttaccaacgttaaccaattcatgctcttcgtttccaacagcaccgattgtggcacggtttgttgccaaaatcattcgaacttcacctgatgacaaacgaactaatgcatatttaccatcacgtcctaataactgtgcagaagcgccggcagatcgtgccaactgaccacccttaccaggctttaattcgatgttatggatgattgaaccaaccggaatatttgcaagtggtaatgcgttaccaactttaatatcagcttcagtacctgattcaaccttgtccccaacttttaatccctttggagcaataatgtatgatttgataccatctacataaactaataaagcgatattagcagttcgatttggatcatattcgattgctttaacaattgctggaacattgtctttattacgtttgaaatcaataacacggtattggttcttgttaccaccgccacggtgacgaacagtcatatgaccgtagttattacgaccggcagttttgctctttggctcaagcaatgacttttcaggcttactcttggtaattgcactgtagtctaagctagtcatattacgtcgaccattgctggttggcttatatgtttttatagccacaacgtttacctcctatttattaagattattcttcgctaaataattgaatttcttttgaatcttgcgttaaggtaacgattgccttgcgacgcttctttgtgtatccggcataacgtccttgacgctttaattttccacgtacattcatgatgttaacacgtacaaccttaacatcgaagatatcttcgacagcctttttgacctgtgttttagtagctcgtaaatcaacatcgaaagtgtatgttttattatccatcttacttgttgactcttcagtaattactggacgtaaaatgacatcacgtgattccattatgcgagcacctcctctacttgagaaagagcagcctttgtaatgacaactttatcatgatccgctacatctaatgtattaattccatcagctgatacaacctttacattttcaaggttatgtgcagaaagtgatgctttctcgttaccatcttctaaaacgattaaagttttagttgaaacattcaatttttctagtaatgccgcgaattctttagtctttggtgtttcaaatactaatgaatctacaacaactaatttttcatctgcaactttttcagaaagaacagacttaagagctaagcgagatactttctttggcaaatgataagcataagaacggggtgttggtccaaaaacaattccaccgccacgccattgtggtgagcgaatagaaccttgacgagctctaccagtacccttttgacgccatggcttctttccgccaccgcgaactgcagaacgattcttaactgaatgagttccttgtcgtcttgaagcacgttgcataacaactgcatcaaaaacaacattattattaggctcaataccaaaaacgtcatcatttaatgaaacagtgccgttttggctgccatcttgtttatataatgctacgtcagtcatctatagttgcctcccttctatttgtttgcaccgcgaacagctgtgcgaatcgtaataaatgatttgtttgcacctggaacgttacccttaatcaagataacattgttatcattatcagtacttacaacttcaagattctgaattgtaacagttttgttacccatgcgccctggtagtttcatacctggaacaacacggttaatgattacaccaagtgaacctggacgacggtgataacgagaaccatgggtttctggtccacgtgattgaccatctttatgaatgtttccttggtatccatgaccttttgtagttccagtaacatcaacgatgtctcctggtttaaagatatctgctttaacttcttcagctaccttataatctcccagctcaacatctttgatttccttaatgaagcgcttaggagtagtatttgctttttttgcatgaccttgttctggcttgtttgtaagcacagcacgcttgtctgcatagcctaattgaacagcgtcgtaaccgtcattttcagcggtcttgatttgcataataacattaggtgtcacctcaacgactgttacaggtaccaactcgccgttttcagtgaagacttgcgtcattccaaccttttttcctaagattccttttctggtcatgagtacacctccaatattctgtatttaattaaagtttgatttcaatgtcaacaccactaggcaaatcgagtttcattaatgaatcgactgtctttggcgttgggtttaaaatatcgattaatcgtttatgggtcaaaatttcgaattgctcacgcgcatctttgaatttatgcggtgaagcaagcacagtataaatcgtgcgttcagttggcaatggaattggaccagaaatagtagccccagttctttgtgccgttgcaacaatcttgtctgcagattgatctaggatacgatgctcgtatgcctttaaacgaatacgaattttttgttttgccattgtattccctccttcgtctattttaaaaataagactaactccgtgaaaattaccgccaaacccatggcaaagcatccgggtgtgtcgcaacctttcacatcaaagctcacctatactgattttttggacacatttatccctaaaaacagtactcaactagtgtactaaaaaaaacgtctcaaaacaagtcctaaggacaagaaattaattttgtaatatttttgttacgaacaacttaattgtgactgaagttaaatgcttagtttacacacaagatttacattgtcatcaattattaaagcttaaacgccctctcacctccagtgtaatcgagtgttattcagtaaaatagaaaaaaaagagattggcaaaatgccaatctcctaagaaataaattaattatttattatcggcagtattgccgccattctttttgataatctcttcttgaatactctttggtacagcagaataatgatcgaatgtcatcgtaaaggtaccacggccttgagaagctgaacgaagtgttgtagcgtaaccaaacatttctgccaatggtacaaatgaatgaataacttcagcaccacttctgctttccatgccatcaacacgtcctcgacgagctgtaacttgtcccataatgtcacccatgtactcttcaggaacgttgatatcaaccttcatgattggttcaagaatgacaggagcagcagtcttggcagcatttctcaatgccaatgatgcggcaaccttaaatgcggcttcactagaatcgacttcatgataactaccatcatatagcttagctttcaaatcaactaatgggtatcctgcaagaacaccattagctaatgattctttcaagccttgttcaacagctggaatgaattcacgaggaacaacaccaccgacaatggcatcctcgaattcgaatcctttaccttcttcatttggtgtgaattcaatccaaacatcaccatattgtcctttaccaccagactgacggataaatttaccctgtgcagaggtttgtttagtaaaggcttcacggtaagaaacctgtggtgcaccaacggttgcatcaacgttaaattcacgtctcatacgatcaatgatgatatccaaatgtaactcacccataccagcaatcaaagtttcacctgtttcaggatttgtttcagccttgaaagtaggatcttcttctgaaagcttttgtaaagccacattcattttatcttgatcagcctttgttttaggctcaacagcaacttgaataactggatcagggaattccatagattcaagatgaagcggatgatcaacatcggttagagaatcaccagtagtcgtgttctttaacccaatggcagcagcaatatcgcctgagaacacttctgggatttcctgacggtgatttgaatgcatttgaagcaaacgaccaacacgttcacgtttgtctttagtggcatttaaaatataagagccagattcaagcgttcctgaatatactcgaatataagttaaacggccaacgaatggatcagtagcaaccttaaatgccaaagcggcaaagcttgcatcatcattcgcttttaactcaaccttatcgccggtatcaggatcggttgcattgtatggcttaacatcaagtggtgatggcaagtagtcaatggttgcatccattaacatttgaacacccttgttcttaaatgctgaaccagccaatacagggaagagttcaaggttcaatgttgctttacggattgcagccttaagctcgggaatagaaatctcttcgccttcaagatacttgtccataatgtcgtcatcaacatcagctacagtttcaactaattgttcacgacgctttttagcttcctctttatactcgtccggaacatcaacagtatcccattcagtccccaacttatcttcatcgtaaagatctgctttcatttcgataaggtcaataaccccttcgaattgatcttcggcaccaattggcatttgaatagcgagtggttttgcattcaagcgatcagcgatagattgtactgagaaatcaaagttggcaccgattttatccatcttgttaacaaaaacaatccgtggaacatcgtaatcagatgcttgacgccaaacagtttcagtttgaggctcaacaccggcttgagcatcaagaacagcgattgcaccatcaagaacacgcaaggaacgttcaacttcaacagtgaagtcaacgtgtcctggggtatcaataatgttgattcggtgatctttccactgagcagtagttgcagcagaagtaatggtaataccacgttcttgttcttgtggcatccagtccatttgtgaggcaccatcatgggtttcaccaatcttgtgaatcttaccggtataatacaagatacgttcagtagtcgttgtcttaccagcatcgatatgggccataattccgatattacgagttttttctagcggaaattctcgtttgttagccattgtgttactccttccaattcgcataaaaagtggccataagccactctttaattgaagcttaaaacaaatgttatattaccaacgataatgtgcaaaagcacggttggcttcagccattctgtgtgtatcttcacgctttttaacggctgcaccagtattgttagcagcatccataatttcacgtgcgagacgctcggtcattgtatgttcaccacgtaaacgtgcgtagttaaccaaccaacgcaagcccaacgttgttcgacgatcaggacgaacttcgattggaacttgatagtttgagccaccaacacggcgggctttaacttcaagaacaggcataacgttcttcattgcctcttcaaacacatcaactggttcgtttccagtctcttctttaataacatcaaatgcaccatataagatttctgatgcagttcctcgcttaccgtctaacattaaacggttaattaaacgagttaccaattttgagttgtacataggatcaggaagtacttcccgtttttggacatttccttttctaggcatttcgttatcctcctcatttttctaaaaacgaaaattaagattttatagttttaattattctttaggtttcttggtaccgtatttagaacgaccttgacgacgatcggtaacaccggctgtatcaagagcaccacgaataacgtgataacgaacaccaggcaaatccttaacacgaccaccacgaattaaaacaacactatgctcttgcaagttgtgaccaataccaggaatatatgcagtaacttcgattaagtttgataaacgaacacgggcatatttacgtaaagctgaattaggcttctttggtgtcatggtaccaacacgggttgcaacacctcgtttttgaggagcaggtacgacaacttgcttcttcttgtaactattgtacgcgtaatttaaagctggtgactttgattttgaacttctagaatgacgtcctttacggaccaattgattaattgtaggcatctaaaaggtctcctttcataatttgttctaagtccacacatccaggcggttcttttttatgtaaaaagaaatgtgttccgccaaacactttttgtcttaaacagtcagcatgtctgagatttcaggaatctgtcacaaaaagcaccttgtctaatttatcatgccttgcaatttgtgtcaatcattcaagataaaaatattattttttcgtatatattctttagaggtaaaaaactatgataatattttttcaatttttcttaggaacaagtttggcatcgtttatttatttagctgttactcgtcaacttcgatgtgaatcaattatatttccccgttcccactgtgataactgtaatcaagcacttgcaccttatgatttgatcccaatcattagttacatctgcttgatgggaaagtgtcgttattgtcaaaattcgattccattcttctctgtactttttgaattgttattaggatcctgcttagctgttacgccagttacgttcacaactattccttacattttgtcattattgacattagcttatcttagcctttttgactataaaagcaagcaaatgccaattcccggaattttaattttagcaggtatctgcttattaaattgccagcattctttttttcaagtagggattgcagccttattatacggactatgcttatggttaaattactatcaaacacttatcggcaatggcgacattgatattttattctgtttatggttatgtctttcaatcggtcatcttttatggattctgtgcatttcttgtattacagctttaatttacttaattattgcaccttggccaaaggataataagattccatttattccctttatcacatttggctatttcattacattgcattacgcgaatgcccttctgtctttaattacatctccctaaatataaggaaatgtgaaacccattaaacctatgtataaaaaaggtatcaccccatgacaggatgatacctttttaacttaccgaaacttatttagatgtttttgtcggattacttttcttagcatcttcagctttcattttttcttcaagctcactgatcgagtaaaccccatcagttgaagaaccgccaatttcttccggcttaattccacggtagtctggcataccagtaccggctggaatcaacttaccaataataacgttctctttcaaaccaactaatggatcgttcttaccacgaatagctgcatccgttagaacacgagttgtttcctggaatgaagcagctgacaagaaactgtttgtttcaagagcagccttagtaattccaaggagaacaggacgagcagtcgctggaataccgcctgaaataacagtacccgcattactacttccaaagtcgttaatatccattagagtacctggaagaacgtctgtatcacctggatccatgattcgaactttacgaagcatttgacgaatcataatctccacgtgcttatcagcaacttccacaccctgcatacggtaaactttttgtacttcatgcaagaggtagttttctgttgaaagaacatcccgaacctttaaaagttccttaggatcaacagaaccttcgttcaatgcagatccacggtggataaagtcaccttcagcaactctcatcctagctgtaattggaaccgtgtaagttctggtatcggcttcacctttaacagtaacttccttagttctttcagcaggattttcttcaatagattcaatcgtaccagtaacttcactaatctcagctttaccttttggattccgggcttcaaaaatttcttgaactcggggaagtccttgggtaatatcggcgttaccagcaacaccaccagtatggaagttccgcattgttaactgggtacctggttcaccaattgactgagcggcaacagtaccaacagcttcaccaacttcaacttcatcaccagtggccatgttacgaccatagcacttctcacaaacaccatgaacggtattacaagtaaatgcggaacggatcgtaatttctttaattcctaattgatcaatcttttgagcttgatcttcagtaatcattgtttcagctggaacaataacgtcaccggttttaggattcttaactgtctttaatgcataacgaccaacaattcgatcataaagtggttcgatcatttcgttaccttcagtaattgcactgatagttaggccacggtcagtcccacagtctttttcacgaacaataacatcttgggcaacatcaacaagtcgacgggttaaataacctgagttggcagtcttaagagcagtatcagtcatacctttacgagcaccatgggtagaaatgaacatttccaaaacggaaagtccctcacggaagtttgaggtaattggtaattccatgatttcaccgttaggagcggccatcaggccacgcattccggcaagctgggtaaagtttgaaatgttaccacgagcaccggaatcactcatcatataaatagggttttgaggatcctgagcttccatcaaacgtttttgaatgtcgtctttagcatcgttccaaatgccaattactcgttcataacgctcatggtcggtaattaaaccacgacggaattgcttagtaaccatctccacttttttatgagcttcatcgatgatttcttgcttatcaggaagttcggtaatatcagaaataccaactgtcaatcctgatttagttgattcatcataaccaaggtccttcatccgatccaagaagaaagatgtctcggttaccttataaattttatagacttgggcaataatatcactcaagaagccttttttaaatggtggaacaagttctgcgttttgaagatgttcatgaatgtcttcacccggttcaaggaagtacttatcatcaacaaatccattaatgtttgtgtctgtaggttcgttaatataagggaaatcctttggtagaattcgattaaaaataacttttccaacagatgtgacaaggatcttgcctaattgttctttggtgaatgacttttcaggatatgcagaagccttgatcccgattcgtgtatgccaatgaacaatcccatttcggaaagccaagccgacttcgtcaggtgaattaaaaatcattccttcgccttcacgaccctgctcttccatcgtcaaataatagtttccaataaccatatcctgtgatggcgttacaactggttttccatccttaggtgcaaggatatgaccagcagcaagcattaacagacgcgattcagcctgagcctcgtctgataaaggaacgtgaatagccatttggtcaccgtcaaaatcggcgttgtatgcttcacataccaatggatgaagtcgcattgacttaccactaaccaaaaccggctcgaaagcttgaattcccaaacggtgaagtgtaggggcacggttcaacagaaccggatgttccttaataacatcttcaagaacactgaaaacatcgtcgtcttgtcgttcgattttacgtttggcattcttaatgttggacgccaactttcgaccaaccaattctttcatgataaatggcttgaataattccatagccattggaactggaagacccatttggttcatttttaaacttggaccaacatcaataactgaacggccagaataatcaacacgtttgccaagtaagttttgacggaaacgaccttgcttacctttaagcatatgtgacaatgacttaagtggacggttaccaggaccggcaaccggacgaccacgacgaccattatcaatcaacgcatcaacagcttcttgaagcatccgcttttcattttgaacaatgatgccaggtgcattcaagtcaagcaatctctttaaacgattgttacgattaataacacgacgatataaatcattcaaatcggaagttgcaaatcggccaccttcaagttgaaccatcggtcgtaaatcaggtggaatgaccggaatagtatcaagtaccatccatgataacttattaccagattgaacaaatgcttccaaaatatccaaacggcgaacggctcgtgtccgcttttgaccggtagcattcttcaattcatcttttaattctgtaacttcctttgcaacatcaacatcatttaacaatgttttaattgcttcggcaccaatttgagcctcgaaccgaggaccgtattcagtcttcttatcgcggtactcacgttctgaaagtaattgtttcttctccaacggtgtgttgccggaatcggtaacaacgtatgaagcgaagtaaataatttcttccagcgcacggggactcatatcaagaacaaggcccatacgacttgggattcctttaaaataccaaatatgggtaaccggagctgccagttcgatgtgccccattcgctcacgacgaactttggaacgagtaacttcaacgccacatcgatcacaaacaattcccttatagcgaattcgtttgtacttaccgcaagcacattcccagtcttttgttggaccgaaaattcgttcatcgaacaaaccgtctttttccggttttaacgttcggtagttgatggtttcaggcttttttacttcaccatatgaccaactacgaattttatcgggagaggctagcccaatttgcatactttcgaatttattaacatcgaccactagtttgacctcccatgattagtcattgctattatttacattggttggtttggttgtctgatcagtaacttcctttttttcagaagcggattcagctttttgttgatcttttttatcggacatcttactcaaggcatcaacattgacaacatcatcgtcatcatcaaggtctcgaagttcaatttccttatggctactgtcaagaaccttcatatcaaggccaagtgattgtaattccttaacaagaactcggaatgactcaggaacacccggctttggaattggttcacctttgacaattgcttcataagttttaacacgaccaacaacatcatcagacttgtaagtcaaaatttcttgcaaggtatatgcggcaccataggcttcaagtgcccaaacttccatttcaccaaaacgctgaccaccaaattgtgctttaccaccaagtggttgttgcgttacaagtgagtaaggtccaattgaacgtgcatggatcttatcatcaaccatgtgggcaagcttcaggtagtgcatgacaccaaccgcaattggcttatcaaacggttcacctgtacggccatcataaagaatgtattttccatccttaggcataccggcttctttaacagcattccagatatctttatcagaagcaccatcaaaaacaggagttgcaacgtgaataccaagctttcgagccgccatgcccaaatgaagttccaaaacctgaccaatgttcatacgtgatggcacacccattggactcagcataatatcaactggggttccatctggtagaaatggcatatcttcttcagggataacaacagaaacggtacctttgttaccatgacggccggacatcttatcaccaacttgaattttacgtttttgggcaatatagacacgaaccattcgattgacacctggtgacaattcatccccgttttcacgagtaaagactttaacgtcttggataataccgccgccaccatgaggtactctcaatgaagtatcacgaacttcacgtgatttttcgccaaaaatggcatgaagcaagcgttcctcagcagatagctcggtaactcccttaggtgttactttaccaactaagatatcgccatcgtgaacttcggcaccgatacggatcgtaccaccctcatcgaggttcttcaaagcgtcttcaccaacattaggaatttcacgagtcatttcctcgggtcctaatttagtgtcacgggtttctgattcatactcttcaatatgaatagacgtatagacatcgtctttaaccaagcgttcactaatcgcgatggcatcttcaaagttatagccttgccaagtcataaaggcaacaattgggttttgaccaagtgctaattctccaccttccattgatggtccatcagctaatacctcatcagggtctacatggtcgccaactctgacaattggtcgttggttatagtttttaccgccatttgaacgacggaatttcattaatttatatttatcaagtgtgccgtcatcgcgacgaatacgaacttcacgcgcatcaacatactcaactgttccggcaaacttgcagataagtgcaacaccagagtcatgggcagccttatattcgataccagtaccaacaagtggtgcatgtggatcaactaaaggaacagcctgacgctgcatgttggcgcccatcaatgcacggttagaatcatcgttttccaagaaaggaatacatgcagttgcaacggcaacaacttgtttaggtgaaacgtccatgtaatcaactttgtcgatgctgatttcgatgttatttgacttatgacgagccataaccacattattgacaaatgatccgtcatcattcagtggtgagttggcctgtgcaataacaaagttatcctcttcgtcagccgtcaaataatcaattcgatcagtaactttatggcttgtccaatctacacgacgatatggtgtttcaataaagccatatttattaacccgggcataacttgataaactgttgatcaatccaatgttagggccttcaggtgtttcaatcggacacatacggccatagtgggtatagtgaacatctcgaacttcatatccggcacggtcccgagtcaagccaccaggtccaagggcagataaacgacgcttatgagttaactcaccaagcgggttagtttggtccatgaattgcgacaattgtgatgatccaaagaattctttgattgaagcaactactggacgaatattaatcaattgttgtggtgtcacagttgacgtatcctgaatcgacattctttcacgaacaacacgttccattcgtgacaagccaattcggaattggttttgcagcaactcaccaactgaacgaattcgtcgattacccaagtgatcaatatcatcaattgaaccaatgccttcttgaagattaaagaagtagttcatcgaagcgataatgtcggctggtgtaatgtgcttgaatgccagtggaatattgtcattgccaattaacggcacaaccttttcgggatcgtttgctgagtacaccttaatgatttgaactgtcattggttcagtcacaacagcttcgtcagaaggattaaaggtataggctttaaattctttttgatccaaatatggtgacaattttttcataacgtctttggtaacaacagtgtccttttggacaataacttcaccagtttccggatcagcaagtgtttcagccaatgtcaatcccaaaagacgattcttcaaactaagtttcttgttggttttataacgaccaacaggcgccatatcataacgctttggatcaaagaagcgtgctgtcagtaaacttcttgatgattcagcagttttaggctcacctggccgcaaacgttcgtaaatatctttcagcgactcttcaacacgtgaatcgtcagtatccttatgaacatctttttcaagcgttaattcaagactatcgttgtcccccaaaatgtcagtgatttcaccatcactaccaaatccgagagctcttatcaattcagtaagcggaatctttctagttcggtcaattcgaacatatgaaatgttctttgagtcagtttcaaattcaagccaggcacctctattagggataaccgtggttccatatgaaatacgaccatttttatcagtgtcttcatgataataaacaccgggtgaacgaaccaattgtgaaacaataactcgttcagcgccgttaatgataaaagtaccttgatcagtcattaatgggaaatcgccaaagaatacatcttgtgtcttgatttcatcagtctcgtgattggttaatttcaatgtgatatgaagcggtgctgaataatttgcttcatgttcacgtgcttcgtcaacagtgtactttggttctaatagctgataatccacaaactctaatgaaagctttccttgaaaatcatcgattggcataataccgtcgaaggtctcacgaaggccgtcttttaaaaaccagttgtaagaattagtctggatttcaataaggtttgggagatcaagcacttctttaatccgtgcgtaacttcgtcgggtacggtgttttccatatttaactaagtgtcctgccaagtttttcacctctccaaaaattccggaaccgaaatgttacattttgattacaattgccctttttagctgatttttggcaaaaaaaatccaaaaacaagctcgacttgcttttggttttttatgcaggccaatccggacaatagatcgcatcgaccatttcgattcacaacaaatacaattaagactataccaactaaattgataattgtcaaataaaagtctcgagaatcatatgctattttttattgttaactaacgcctgtcgatcgggctttttaacagaaattgtaatctgattgtttcgaccaccaacagtaaccgaatcacctggaacaatttctttcgacaataattttgcacttaaattatcttcaagctcagtttgaatagctcgacgaattggacgtgcaccatattgaggatcaaacccaacttttgaaataatcccaatcgccgttttggtaactttaatatcaattccttgatcatggattcgtttaataaccggtttagtcattaacttaacgatctggtcaagttctgccttggtcaatgagtggaagacaacaacttcatcaattcggttcaaaaactctggacggaatcgttgcttaagagcagcattaatcgtgtccttcattgcactgtaatcttccttggtatcttcttggccaaaaccaacagtcttcttatcgcgaagtgtcgtagcacccaagttggaagtcatgataataaccgtatttctaaaatcaatctttcgacccttggaatctgtcaaatagccatcatcaagcacttgcaaaagcaagttgaaaacatccggatgtgccttttcaacttcatcaaacagaacaactgaataaggtttttgtcgaactttttcagttaattgaccgccttcatcgtagccaacgtatcccggtgcagatccaatcaaacgactggttgagtacttttccatatactcactcatgtcaacccgaatcatatcgtcctcagagccaaagaccgcctcagcaaccgcctttgcaagctctgttttacctacacctgtaggccccaagaacataaatgaaccaattgggcgattaggatctttcagtccgcttcgtgctcgacgaattgaacgtgaaacggctgaaatagcttcttcttgaccaacaactcgttgatgaaggacagcttccaaattaactaaccgatctgcttcggttttactcaaacgagtaactggaatgccagtccattcggcaacaatttgagccacatcctgactggtttctttaaccggataatgagcctcggatgattcttccggctcctcatcttgcttagttagctcatcttgtaatttattagcctgttttcgaatcttcgaagctttctcgtagtcttgggcaacaagtgcctcattcagttgagcaaggagatctgaaagtttcttgtgatcgtcgacaacatctgaattctgcagatgatcaattcgtaccttggcagcagcttcatccattaaatcaatggctttgtctggaaggaagcgatcactgatataacgattggataggttaacagctgtttcaatagcatcgtcagtaatttcaacatgatgatgttgttcatatttaggacgcaggccctttaaaatctgaacggtctcatctgccgttggttcatcaaccgtaactttggcaaatcgacgttccaacgctgcatccgattcaatatatttttgatattcatcaagagtagtggcaccgattaattgaagctcgccacgtgctaacgctggtttcaaaatattggaagcgtcaatagcgccttctgcaccaccggcaccaatcaacgtatgcaattcatcaataaacagaatgatatttccgtcttgataaatctcctcgatgactttcttaagccgatcttcaaactcaccacgatatttggtcccggcaaccagtgagcccatgtcaagcatcattaaacgcttattaaccatgtccccaggtacgtcaccgtttacaattcgctctgcaagtccttctgcaattgcagttttaccaaccccaggctcaccaattagaaccggattatttttagttcgtcgcgcaaggatttgaacaacccgcttaacttccaaatcacggccaatggttgggtccaaacgattctcacgtgccatttcagttaaatcacgggctagtgaatcaatagttggtgttttactgtctttttgtttggatggacgggcgccccgttgctttgatgacatattagatgccattgagccgccactaatccccatctttcttaaagttactttacgaatttgtgataaatcaaggcctaagttaatcaaaattcttgaagaaagaatcgtttcatctgttaataatgaaagtaaaatgtgctctgttccaacttttggaacgccatttttcttcgcaaattctccggcttgtgccaatacttccttagccttaggagagtatggtaaataatcgttactgctaagatccttcagattaccatacccggcaaagcgttctacttcttctgtaatgtcttccgcagtcactgagaactgttgaagagccttatatgcgatcccattagtttcaatcagtagacctagtaacaggtgctcagtaccgatagcttggtgcttaaatttctttgcctgttcctgagcaatggttaaaacgttcttagcgcttggagtgaataaattattcatagataccctcgctttctatcgttcgtaacgcaaacgattcaatattgataccataatgtttgctctcatgatatcagttaaatcactattgttaaggtcaattgcatctttgtcaatcgccgctaaaataatgctcacttcacgacgactaattaagtcattattatataacgtttggacgatggtttcactatctcttttcgacaatttgttaccaattgcgtcaatcaacgagttcaacacgtcaatgtcatctaataaatgaaccttctctattctaatgtagccgccaccaccccttttactttcaacaatatacccattttgaattgtaaaacgcgtgttaataacataattaatttgcgacggaacaacgtcaaataatccagcaatttccgatcggcgaattttcacttgttcgttgtcggcaagtatttccttcaagtaacgttcaattaaatcagaaatgttttcgtcggccatgctctcacccaattctttgactaatattgactttaattatacgaagaaagtgagaaaatgcaaagaaaaggattcgacaccccttaattcatattattggccattaatcattgtgaaaaagaaacggctatcttttgtatcctacaacggcaagaatctcaattccaagtcttccagcatgcgtcaaaactcggaacacatttatataatattatagaagaaaaatcaatcataaagccctcaacggcaaaatatcaaaaaatagagggtctaaaatttttggggttgataccgtaaggtatcaatctttttttgcatataaatagggcatcgccctactattgaattagccaataattcagatagaaagaagtaaaaacgatgtcccaaga

SEQ ID NO: 464 - DNA, 7809 bp, Unknown
  Metagenome-assembled genome
cgttggtgcggggatggtctcgcgtggggaaatggccttgattatcgctcaaataggctaccaatccaaactaatcagtgatgattactattcggcaattatcactgccattatcctaacaacgttattagcaccattactactcaaacatgcggctcgtcatataaactactaaaacatcttagcggtatgacaccccttctctgtgaaaaataactactagatttcatcgagatattgcctagtttaattaagcactaaattatataatattggttataatggaggattagttatttgatacagcttgtaaaagaaaaatttgacgttactcgtttgcgatttgttttactcggcctgcttgtgggtttaatgagtggcaccgttgttagcttatttcgctattgtattgagatagggctgcactatagtcgattggtatatagatacttacgaatcgcgccatttgtttggtgggaatgggcattgttgattggcatcaaccttggtttagctttaattgtggctcgacttctcaagagagaaccttatatctctggttccggaattccgcaagttgaaggtcaattggctggcgaattggaaatgcactggtggtcaattctttggcgaaaatttatcggtggtattctggcattgggacctggattatttctcggacgagaaggaccgtcgattcaattaggtgcgtcagttggtcaaggtttcgctgctgggtttaagttatcaggaactgatcgccgactgctaattgcatcaggcgccgctgctggattagcagcggcgtttaatgctcccattgctggaactctatttgtcttagaagagatttaccataatttttcaccgctggtttggttaacagcattagccggagcaattggttcaaattttatctcgctgaatgttttcggacttgttcccgtgttacatttaaattattcacgtagtttaccagtatcaaattattggcacttaattttactcggcattgttttgggattgtttggttacttatatcaacgggtcttgttagttatgcctcggtggtatcatcaactgacacatttgccacgcccaatacaaggtatcgtaccatttctgctggtaatcttagttggttacttttcgccaaatttactcggtggtggtaatggattaattgttggatttggccagtatgttccacctttgtttgtactaattgcaatttttattatacgattcgtcttttcaatgatttcatatggttccggattacctggcggtatttttttgccgattctttctttaggtgctgtgattggtgcggtttatggcgtcttaatgaatcaattaggattattatcgcatgtctatatcatgaacctaatcattttttccatggccggttactttgctggaattggaaaagctcccttcacagctatcttgctggtaacagaaatggttggcaatttaacacatttaatgccattagcagtcatatcgttaactgcttaccttgttgttgatttattaggcggtgcaccaatctatgaagcattgcttaagcagatgacaatgcctaaaactgttcagcaacttcatcgacctgatcatttggaaataccggttttctttggcagtcccttaaacggcaaaatggtccgagacatgccatggcctaaagaagcactgctcattggaatccggcgtggtgaacaagaagtgattccacatggtgacaccttgattcatgaaggtgatacgttagtactgttaactgatacaacccaacgaacccgagttaaacaacggattgatgcattattagcaactttagaaaaaaacaccgagactaagttaataggcaaattggtctatcataataataaatattagattaagtgggtccgttgccagacataaacatattgggaaactatatacaaatacggcgaagtacgaaaaacgctgaaaaagaattagttgaacctatttttgaaaaatacaaagataaataataagctgaaaatgccttgctacccaatttttcatagtcatgctataatgaaaaagaaaaaggaagtcccacgtgaacaggacttcccgtgtagagccgttaaagacggtggcagatattaaaacaacactagttcgccccataaccggtcaaagttatgtggggcggctttttcatttgtggtgtttgtcgatatagctgagtagcgcgattaaaaacgtgccaaacagcaacatcaacgagagtgtctgaaagacgctcattgactgtgaagccttcctgaagattattccatgttcccatgagcctcacctcgcaagggaaaagacaatcattgccattaaagcttcttgcttaatctattatacagggaaatggggatagaatagtgtctatgcataatcagctttctttaatcttcgagccataaatagccaagctattaacgaaaacaacaggactataaataccgtgatgtaactcgtgtttccgtgataagttaaagattcgatccaaaaaaaattaagacaactaggatattcacgagaaaccttgtttccagatgaaaaaacatttgatggtaaatacagggaaacgataaattcaattaataattcgcactaagcttaaaggccactagggtatgctcttgtgaccttgcctatttgtatgaactaatgctgtttaaaaatgttcaatagaattgtctaaatgagatgatcattatccattggctttttaatgtaataacaactaaattgataacgaggcgcaatgtttttgtgttaaattaggcttattatgtaacaatacgggagttgatttacgtggaatctgaaaaacaagataaacaaaaaaacactataagtgaaaaagtaaagcaagctttgcttaacaatagtaatgccattagtaatcttgaaaacgactaagatctcccttaatagagcacacttctatgtaaaaaagcgaatttgagtcataaaaaactaatggaatcactgatttatggattcactctgctcatttgcggagttgtcggcaatctcatttttaattatttcgacttttatcatagcgatcgatgttgaccggataatcatcaaagagcagtcatcgaaaaatatgactcaactcaaatattgtatcttataacacatctcgttatgcactttgtattgcacccaaaaatcctattaaaccagtcttaaagattagtttaataggattttatgattgaacggtcaagaaccacagttatattgctcctctaaccgactaatttaatatgagtaatcaagacgtgacattttattgataagatggatgggctttagaattaatcataatttgaggtgccccctctttgcccacaacaacctcattaactgcatttaaaaacaagccatgttcaaccacaccaactgtgttaattaaggcgttagacagtttatctgggtcgttaattttatgcaaatgaagatccaaaatgatgttatttgagtccgttttaaagatcttgccgttcttatcagtcctaacaaccggattaaatccggcatcggaaaattttttcaaaacatgatgactgccaaaaggttctacatcaacagccagtggaaaggcaccgatccggtcaacaattttggattggtctacgatccaaataagctttttagaattggcagccacaatcttttcccaaaacaggtttccaccaccacctttaataccattaaagtcactgtcaacctggtcggcaccgtcaatggttaaatcaattgtgtcaatcgaatccaaatcagaaatttttattcccaatgattcagcctgcttcgctgttgaaattgacgtggaaacgcccgtaaagttcaggccgtcttcctgaacccgtcgtcccaactcatcgaccagcattgtaaccgttgaaccacttccaagcccaacaatcataccgtctttaacataatctgcagctttaaccgccgcagccttttttaacttgttctgaagctctgaattgatcgtactcatgaatctcccatctccttaattttaaagccaacttggcattcttctatttccaactccatcaatgtcaaaacatctttatatcgcttcatcaaacagctaacattaaagcaagtttattttctgtttacggacagattcaaccgatgaactgatgattttttatgaacaagcatgaaccaaactctgattggcaagatagtatcaatttcattctaatattgttgatttttatgtggcctaccgttctacctatacctaataggaatttatattattttgattgtctacatgatatacaaagtcctcaaagtcaaagatgccgatctatgataattaactctatctgcccctatactgaaatttagtaccaaaacttgacgtaggcgcaatcggtattatagcttacatttttgatcaagataatttttctgatattcatcaatctcccccccaaaaaaagattacataattttaaatccaatcaatcactagtttattacttcttaattttacagataccaagtataaaaaaaataaaaaacaatattaaaaaaataactggaattgtaactaatggggtcataaagtaattaacttgattagttattttagttccatcttgcaaaacatccgatgttgatagcatctcagaaaaaacattcataatttgtagtaaaaatattgttaatagggcaaagctaccaaacaaactagatagtttaaaaaaatccaattttatcacctacttatccctaacaacacgactcacaacaccatcgtacttatacgcaaaagccttaagatgtttcttttgtgttgatgatccgactatttttaggtattctattcgcgtaatcttatattttcgatacctcttacgatactgaactttttgtcgatattttccattaaaagaaaacggaacatttattgtaacggtatctgacctagttacattaaaccctaacaaagcagtcaacttccccttagacagtgaaacattccctgttaaagagtggccgttaaagcattaatattaaagctaacaataaaagtaacaacagtaacaagcattatgatcatctttttatacatacaagttccctcattcacaaaaaagttacattcattcaagatgtatctactttaacacttaaatgtaataactaaagagctaagaaactgtttgagatctgacttgaactttactatattttgacaaaaaaggaaattatgatgactaattatcccagcaatattacctggcaacaatttgttttagatatcctattagtgtggcacttgatttgacaattgaggaattactttttattttgatctttagatttaacgggcaaagtggcaattccaacgccgattgcaacagcaaaaacggtctgaattaaatcatggctttgattttcaaaaactgcataataaacagcaaataacccaatcgctagtaaataccgtaaaatatagatcaaggctcttttactcatcagaaactgcctcccataacaaacgatatctatttttatttaggttctctatctagattatgtgtgattttcacatttctgcttgtacctaggggttgcgacgctttttgcccatattttccccgtaaataaacgtcagttgctttcacatcaagcgtagatagatataaacggttgggttcatcttttttagttcggggattaaaaactggttgtttttgtatcagcaaatgagcagctgcgagttctctttttattttgacgactttctgattcttgcaattaagtaaatttcctaattcctgattcgaaaaaataaagtagatgtgcccttcctcatcaacccagtgattgcgtaaggcatactctaatcggtctttcagtaccatataggccaatttggctccactacttaaatatcgatattgttcgccgtacatcaatacttttggaaactgaaagaatgaggcttcgtaaacattgttaacctcgtaataattgaaattatcgaattctttcatcatataagccccgtttctatatccaactcatgttgattcaaaagatcgctgctaaaacacctaacttgctttgctaagattaaaaacttggggaaccctttgaattaacatgataccaattcaaaaggttctcgatacttggcatctattaatttatcaaagaccaccgcgattcttttttgctggcaatggtagtttgaacagaataacgattgaaattgcatacacaattagaattggaatcaataacatgccataagtgattgaccacgtcaaaactgtcattaataacgtcccaaccgtatttaataatactaacgtttttctagtgaggttaaatgaattccacattaaaaaccaccagtagactaatgagctgagcagtgcaaagccactccagtcagttaatgtcaatattcatttacctccttataaattaattgattttatagtatattaagatctgcaaaagttaacggtcatactctaaaggtggataaggagctagagtatctttaattccttgtcgatgatcataaatacttaaagaaacttttttatcttgccaagacatattataaatatattgataggtatgatgttggtggcgaattgaaacatcttcctcccattgtcccatattgacccaattaaaaactattttctgatttttaatgctatttgttggaatcttttgggcaaccatgtacgtttgaacggctccagtaaagtaaacacggtgttgccaataaatagtaaccaaactataaaagtaagtcctaccaataaagccattatgtagctatatctttttaacataactaattcatattctttccttactatactttaacatttgcataccgaaatatccgccttcccatagacagtaacacacttcctgtcaaaaaatagtttccattaccgatttaaaaaaggttattgttggattgtgattttattccgaattttcgccaaataatctaacagtccttttaacatctactcagctactaaaagggtaatgaagctatttacaataagccattatatttttgttactttttatgttctttgataaatcgataaattcgattatttaaggggtggttaacttttgtaaactgtactaaggcaaaagccaaagcaaaataaattatatttaaatagacgttatacaaataatacaaaagcatatacaaaataacaactgagattccaaaaccaattaatgaaattctcttttttatttttaatgctgtcaaatagttcacttcctagactatgtcttggtaatcgtcttcttcaagaatttaacaaattcaattgttttcaactaagttaatatcattactttcgaaaaatcaatcataaagcttattctgtatcttttcatgatcctcaattatttaacctatctttcctaattaagtgtcaacaccaattccgtaaactattcatcaaattcttataatgaaacgtgtaccagtatacttcaggtgttcgtatacataatagtgttgtttgatatagaatcgatagggtctaccctattgtattcggtcgaaagttggattattattagttacatataagtgatccggaggcgttctgaaaatgacaaaaattggttacgcacgtgttagtactcgtgagcaaaatctagcccggcaaattgaacaactacaagcagcgggagtgacaaaacttttccaagagaaacttt

SEQ ID NO: 465 - DNA, 8160 bp, Unknown
  Metagenome-assembled genome
cttctcaacggaagagattttattgattaaccaagccgcttataatatacatcgtacacctaagtgtacaaaatttatctcggtaaaatatgcgtaattggcctgcccatcaccctatgagcgggccttttgcgtatgttgatagcacaatgtttaactagagcctaccctaatgtaatcactgaaaacgactaatttcattagttacaattaagtgtttcggtgacgttcttagattacccgtaattgattcaccttaactaatcactgatacaacgtcatgactgcaatagtcgttaacagcttcttgaaaataattgactaatgaactgaaaatatacccctcaacattacttctcttacttctactagctgtcatgacaattctttgaagatcgactgccatatcttcataacgattgttgttctcaaaacttaaagcaagttggctgtttctaacgtttctagcctgtttcttaacgacatttttagctttgaacaccatgccacttaattgataaagttttttaggatcattaaaggataaggctttgagcatgttaactgttcgtttgctaaagcctgctttagtctctaatgaattacttaaagcatttatttcaagttcatttaattttttctgtttggctgcctgtttttctttttgagtgatagcgacaatttttttagaattagtctctggataggtatctcttgtatatattgtttgtttattatttgaattaaatgttctactagaattgggttttccaatttcaggacgttggatttcccgttttacgttgtcatgattggcttctggactggtttcattctcaaattttggtaagaatagtttagttgccccattgaattggtgtttcataactaaataacccttttttactaatcgtttaaaaacttctgtaatggtgctgacgttaacgcctaatttcattgctaactcatcacgggtgtaaataacataataatcattaaactttttactgaaaaaatctttatttttagtgctggcttgcatccgatcttctagcaatgaataaattagaatttcattgccaccctttaaatctgaatttaagttgctttcttttactttgaaaaattgcataattactatctccttggttttaggagtaaaaaaagagaataacaagttccgtttaacttgatatcctctttagtttgcaactatgtatcttgcatttaccaatcttatttcatataatgggaagtagggaattaattcctgcttctttcaaaatatgtttacaggattggcactaaaggctatcaagtggttatctcacttgttggctgattatagaagtttttggacggacttctataatcagtgccttttttcatactcatatttattgaattaattataactcattgtcaatgtttacacaaaaatatctaaattagagtggactgtaaataatttcattgttaattaaacgtggttctagtttgctaaaaaacatttgagataagatttttgaagctttttggtgcttttattggtctgtgaattttggcttatgttttgctttccattgtttgttagctcgtttattccaccaaatgccaaacaagttttgcatggtgccgtacaagtagttttcaacgttcttgatatgcttctcattacttctcagggcgttaaagtagcgcctcaaggctttagtcattaaaggcttcagctcctcatcatcaagtgggattatgacgccaatgtcctgatgatccttttcaactcgatatttagcattcaagataataccaataaaccggcgcatttgttgcggggtgcggcactagaaactaagtaattgtacggcttcgggttctaagaaaacaggtaacccactatcttcatcagttaagaaatcattagcatggttcaccaaatccttgttttgcttttctagttctgctggtgagaattgggctatggaaaagtctaacttttgagtatctatattgtatctagatttatctatatctttatgttctttatatagattgactaaagaatttttagttccgctgttatcaagggtttgacagtcggtgtttgttgaatttactggaactaaagaatttttagttccgctgttatcaacgttttttggaactaaagaatttttagttccgctgttatcaagggattcggagcttacttgtctataaacatcgttagcagttacttcaggctttagtaaatataaccggttaggttgattgatgccgattcttttttggtataataaatgagcagtttctaaatcttttttgattttgattatctttggttcactacaatttaagatttctttcagtgcctggttggtgtaaacaaaatacaaattatcctgttcatcaacccagtgatttctaactgaataattaaaacgatcttttaaaagggcaaaagctacttttgcatcgttacttaaccctttatagttatcatttgtaaatagaactttaggtagttggtaataggtttctgcataaacttcgctgactttatagaaattatcttggttcatataaatgaaagctcctctcgtaaccttggttagataaaaatggactaaatagcttttaccagctacttagtccactgttcttgtttttcattttacctttgcttgctcctaaggggctgtttgcggtataattaattcataaacaagattacaatgttcaatcaattttaacttggtggtgaaaattgattgaactaagtagctgttgggtagctactggttaatactatagggaatctcaattctaagtggattgagattttttgtttataaataaagcatagcattttgggcaaattaagtaaatgcttttattaaaaaatgataaatgataaattttttatctcttgtgatcaatcacaaaagatggtaaagttttattaaagaggcaggtgctattatgaatgggaaaacactattaaactttaattttaagggtggggttggtaagactactttaaccgtcatggaaacctatttattaggtcaagaaaataaaaaagtattactgatagattttgatccccagggaaatgcaactgaaattatgagggaaacttatcatattattttgaagccgaaattttcattatatgaaggtcttctcagaggcgatttatctaaatcaattgttgctgttacggatcaaattgatatgattcctacagattggaccttgtctttatggattggtattgtagaaaaggttagtcaaactgagcgtaacattttattatcaaaaatgctttcacagttaaagcaaaactatgattatatttttattgatgtaccgccaaccattaatgtctttaccaataacgcaattatggcttcagatttcatttcgattgtcttacaaacacaaaagcaggcctatacgagttctttaaaaactgcaacgcatttaggggagctgcgggagcaatatcatgggaacttccgattaatcggcgttatattgtacttaatgaagccacgggcaaaagtcgacactgaaattgcggcgcgggcaaaagatttttttggtgaaggagtctttttaaattcaatcagaacccaagaacgagttaaaactttcactaatgaaggtatacgtaataaagatcgttgggataaaagagccatcaaaatgtatcaaatggttcttaatgaacaattgtttagaattcaacaattagaagggtagtttatcatgacagaagattttttaaataaagttagtaaaaaagcatctgcacaacttggaaatcttaaaagtccataccaacttgaaacagaaaaaactaagacggttcagcttcgtatgagcacctataaagaagttaaacgcttggcttttgaaaatgatgaaaaaattgtcgatgtcttagaaaagctcattcattcagggctttctcaacgtaacccaaatttgaagtaaccaagatagaggcgatctgtgtgatttgtgattaaaaattaatttttaatcacaaatcacacagatcgcctctacaaccctatcccttttataatcaatagttagcctaagttatctcctgcagaacagttcggacatctaattgagaaatcttcagcttctgagaagagtaatcccaaattcgggacattacgtcattcggatgctggtctagttctcctagccctaaaatatggcctatttcatgctcagctaccaataatcgcatagttttattgtcgttaccagttttaattaaggttttgtcatacatataaatttttgaatggataagaacgctgccagagactgttaattgagtaactgcattcatataataggtatttccagccttgtctgtataccagtcaccataattagctgaactgataacaacatcaggggcatcggcaaccttgatgaatttaattttctgatgcaaagctttggtccaagccctaaaagcactttgataagcggttcggtctttagaaattgtctgattttcatattgataagtaatgactgttggattttgataagtaaacccttctttataatcagaattaactgctgcataactggtaatgggactaattagtattatcagtgtggttagtaaaatataaaaatatggtttcactttaacatttccccctttgtctaaatctaaaacctgatgattatgatataataaaataagctaataaaaccactataaatggttaatcgaagacattttcagtctgtcaatatcttccgatagaacattaatgttcttacttcaacaaattacaaaataacttattggttaacgaaactataactttaccagttcaagaatataataatggtggtgtgaagtcaatgtctcaacaaacggaaacaaacgaaaatttgattaatcactatcaggtttatcgtcaaggtaattttttaggcacagttactgcgtttccagattatgccaatcggagcttttatctggtttttaatgaagatgagcatttttttgaaattaaagatgaggatatttttattgatttccaggaagaaaaatattacattacaaatgttgaaagaattcattctagctatcatcttaaatttgaaacgaataatgaccataaccgctgccaaaagccacaaagttggatcaatactttggcaattaaaacattttcttttaaagacatagaaagtttactctcaatcgttcaattggaggatcgtgaacaattagtcagcttaattgcggtgctaaaaaggataactatcgaacacaaatctttaaaacagcatgatttatttcaatttaaggatttgctagataaatataatgtggtagaagccaagttagctgaatttttattaaatcacctagttaattaaataggagaaccgaattaatggatattaatcatttttggcggaataattggtggcttattttagccttaactattatcttaacaggaattgcttttttaacctattagtttatcgatgagtggtttttgatctgtgattgagatgaaaaattaatataagaatataatgtcaataatgattaaattaatagttatgaacgttagcgttgttattaatagttatattctttataaaaggagagtaaataaaaatgaaacctattcaatataaagacaaaacatttacctcttatcaacaagcagctgattttattggtattactaaaacagggtttgcaaaacgctatcgaaagtacgaagctggggaatatgaccttaatgaccttttttatgacggtaattatcatttaacacatctaatttattataaaaatcaaaaatttagtagtcatgcagaagcagctaaatttattggcattacttcagtgtcttttaataggcggtataaaaaatatctgagaagtgaaatatctttaaaaaatttatttaaaaaacctaagtacacaatttatcccatgcctgattggcacggaaaaatatttaacagcaagaaagaggctgctagttatgtaggaattagtcaaaatacttttacacaacgcttaaggcgttattataatggtgactatactttagatgatatttttgcttccgatccacttgaactacagaaaaagcattctaaaacaatggcaataacctataatgggcacacttttgaaactcaacgagaagcctgtcagtatctcggcatttctcaatcagccttttccgcaagatatcataaatatttatctggagaattgcccattgatgagctgtttcgccgtcagaaacactgagttcaattatagggggggatcatatatggaaccaattgtttataagggaaagcgatttataagttatcaacaagcagcaaattttcttggtatgactgcaacaggtttttctaaacgataccaaaaatatcagagtgggcagttctcgcttgcagaactttttaactccgttggaaaaaaaacacaattacagaaacataaaagtctcacctatcatggtgagacttttatcaattatcaggaagctgctaaaagcgcgggtgtttctcaaacaactttttatcggcggttaaaaaaatatcggactaatcaaatcaccttggatgaattattttcagcaaccaaataccggtcctatgaattacccccttatcatgaaaagatatttgcaaataaaacggaagcagcacaatatgtaggcattagtttaacccagttttctaaacgactaaaacagtattatgaaggagcatacaccattaatgatctatattcccgaaattcatctaatttgcgggctaaaagtttggggaccgtcaaattgcattatcagggaataacgtttaactcttacaaagctgcttatgattatattggtatttctagtacagcttttaaagggcggttgaagaaatatctggcgggggactttacgattgaacaactgtttcgatttccaaaacattcacagggatatatgattaaatatcaacgacacactttttactcttatcaagaggcggctgaattcatcggtatcagttataatgctttcaataaacggttaaaaaaatacaaaactggccaaataatgctggctgaattatttcaaccaaagcaatcgtgaagttgtgaaaaaaacagcaagtttgaagtgaacccttaaacttggacaactttattaagctgttttttgggcggtaagttcccggtattttaccggggacttgccgttcagttttgttttgatacgacggtgattgtagaaatctattcattcgtcatagctttgctaagtgatgctttggtctcaaactgctcatccataacttcgactttcatgatgtgaaagaacgattccatggcggcgttgtcgagacaagtagctttacgagacatactttgaaatgcacgatggtctttaagaggctgggacattagtccgttttgtagccttggtttcaaaaaatcaggtctcacatttcgtttatttagaaatgcgagacctgattttttgaattttttgtgtttctaaacccaatttgccccttattgagctaacttttttagattcccggccatcaaggcaatgccaatttcattagtagccgctgataatccccggaccgctaatcttcgaaaacccaaattagccttcaggttcccaaataccggctcatcttcaatcttacgcttagcgaagatggcgccgccttcgggacttgaaagctgttgacggatagtttccttttgttgttgccaattttcattaacactaatttggcgggggtgatccttgggggtccgcgaccaataatacttttcaggatccccatactcatctgcctgatacaccttgtaatgtcgagtatagccatatttatcagttctagtggttcgcttgagaaatgaaaaatggatctgatgatgatcagtataggaatcatcgccggtgttatagtgccaattttgaaatttttgtgtcaagggcagtttaaaaatgtaggttttcggcagaaagaaatgtaggttttcggcagttacttgaggccacgtaatcggtaagatttaccagtgatcttcactacgtgaacatgatgaaccaa

SEQ ID NO: 466 - DNA, 88082 bp, Unknown
  Metagenome-assembled genome
atcacgagaaaagtcggacgctctgttaggaataaattacctaggactcatacgatccgtaaaacgaggcacttatcgcgttccgtacacaatctaattataatattgatgtctagttatgcatttactcaaatctttccagtgaaagccagctcgatcaaattgattttggatagaaaaacatataaaatcgtatataagatcaaaatagaaggaacggagattatttgttgtccacaacaatcggccgttcattcttacggcatgcgtgccggaagctttttggttgagcttgcaattcggtaggcagtttgttcttaactgccaaaatagaaataaatgcaccgagagccaaaaggatataataattccccctaaaatttatacaataacgtttctttccaatttcccatataaattctctcctctcaaacatatgattctaagcttttccaagaaaaaaatatagttcattaaatgtaccctgttaattaccttgactgaaaaactaatatggatcagatgagctccatattttctgatgctaagaagactgtctaaattcttaagtaatagtgctaaaaacgcttaaaacgaccatttgcggaagagtggtggtattggacgctacaattttctcaaagcgccgtacatctcttctctatgcaactacaaggatcgttcgacatacccaacgtggggcattacttcgaatcgattgccaactcattgcgcttcgccaactgcaacggttggcggtttaaatactggctacagcgagctgaaagatgataaggcctgataaccaccatcaactaagcaattttgaccctgcgcgtaaatgcatggcatgtaagcgaatcattgcactagccccgtctcgatctagaggacgttcgctcgcgtacatgtgaatggccctgcggtaaagccattgaatcaacggccagatatgagcgcttaatccccagaattttccttaccgcgtccgtaaccttgtttttcagcaagtagcggtgtttttgacgctctgagcgtcaacgataataaggaaaagttaaagctggaacgtcggaagtccttggtaagtgtcgccgagctaatgaccaatttttttaaaacttgttccatacaaagaatcagcgtaggctcagctttagtttaccaaattttgtaatagttgtaaaactgaccgccattctgggaggaaatcaccgggactgacgccattggcaaccggttttcaagaaccatataggaaccgcacacagaagactcgtagaggtcatattttcgaggcttagttcgcttcgaaaattttctaaagctggtcgaattaattcaaattgttgccgagtaatattgctgggataatttttcatagcttaaactcgctttttacatagaagtatatcaaaaatcatagatcttggacagcttcttagtacctttggtggtaggtattttcccattttacgcccgtcaagttcaaaatgcgctcttggaaatcgatccccaggtcatcgaagctgctcgctcaatgggctccagtacaactgaaattatttttcgaatttacctgagagagggccttcctgatttgattcgtgcgtcgattgtgaccgttatcagtttaatcggattaaccacaatggccggtgcaatcggatcaggcggtcttggagatatagccatcagtattggttatgcccgttttgaaaatgatgtaaccgttgcggccatgttagttattttagtattagtgttcctggttcaaattatcggcgattggttcgctaaaaaaacagttcatttataaaaattaatagtataggagaaacacaatgaaaaaaggcaaaggaattatcattaccattattagtatcattgttattatcggtattatatttggtattcataccctaacaggtaactcgacaaaatcttcaaatacaacaattaccgttggctcgcaaggatcagattacgatatttggaatcacatcgccgcaagtaaacaggcaaaagaattaggactaaaaattaaaaccaaacaaattaccgatggcgttcagttaaacaacgcaaccgcgcagggaagcgtggacgtgaatgcctttcaatcctactcatatttggaagcatataataaagaacacaaaaacagtcaattagctgccctaggcaccacttacttggaaccactcggtatttattcagataaatataagcgcattagtaaaatccccaatggcgcaacagttgctattgctaacaaccccgcaaacacagccagaggactcctactgctgcaaagtgccggtttaattaaattgaagaaaaattttggtgcccttggcaatacaaacgacattgcgtcaaatccaaaacatctcaaatttaaagaaatcgatgatactaccggtccgcgtgtcctacatacggtcgacgttgtcctaatttcaaacaccgttgcacttgaaggtcacttaaacgtattaaaggattcaattttccacgaaaaaattgacatcagcacacgaagtaacatcaatgtgcttgcaactgctaaaaagaataaagacaacaagaactacaaaaaactggttaagctctatcatgaaccagctattcagaaatatatcaaagataaatatgatggcactaaagtggaggttcaaaaaccactgtcgtatctaaaatagtcgaacgcaaaaaccgcaacctggaaatcaatctcgattgcggtttttattttaaaaataattgcgaacgaagtcatagaatgccattaacggccaaattgccaccagtgtttcttttttcgcggtgcagcttgataactgctgccatcacttgaaagaacctgatctggacggtagctatcagaaacttttgttgcctgctgggtattttcggattgtttttggttgtcacttgattgattggttacgttttcttcgattgtcttggtttccgatgaattccccatcttattctgaagctgttttaacttattttgaacatcaagctgtaagcgttgtgattgatccaataattgatgcaattcgcgaatttgcttatccttttcctcaatctgtttacgttgatcttcaagcgtctcagctaacaacgccgtggtatctttactattcttagaatctgccgaagcagttgcgttactttcagccgagttttcagtactggattccgaattcttgaattgttctttcaagacatcgacaccctcatctttaatcaggattttatttccctgtttaatggtatatgtacttcgaaactcgtcatccatatgtttccggattgcggttttggaaactgccaactcatctgcgagttctttgatagtcaacgacataacatcgccccctactacttaattttttgaataaatatctttcaaagtgacacacatatcattatagtgatttaaccataattgagcaaataaaaatcgcaaacgcacttgatgagattataccaaattttattgtaaaattaaattcggattagagcaacaattgacaatctcatcatttttgaggtacactactcgcagcgtctgacgttatttaacactattttatgtgaaattgatataattctacataatatacttttaaaaaatatttcaaattattctttaatttagacacagaatttgttattcttagacaatcgaaattagtgttattcgccaggctagacatgcttagaaaatataggagtgagttcaatgagcaatgtttttgcaaagatgttccgtaaagaggatcccttggtataccaggataaggattctcatcttattcgaagtctgacaactaaagactttttagcactcggtgttggaacaattgtttctacatcaatctttactttacccggtgttgttgccgcacaacacgccggccccgccgttgcactatcgttcttatgtgccgcaattgttgcgggtatggtcgcgtttgcttacgctgaaatggctgctgccatgccatttgccgggtccgcctattcatggatcaacgtggtttttggtgaattttggggttggattgccggctgggcattactagccgaatacttcattgccgtcgcgtttgttgcttccgggctttctgcaaactttcaaggtttgatctcgccgctgggatttaaattacccgccacattatcgacagcctcgaccggttccaatggtggattgatggatttgtttgcgattatcgttattctattggttaccaccttgctctcacgaggtgcatcgcaaaccgcacgtgtcgaaaacacattggttgttttgaaagttattgctattctggtctttatttttgttggtgcaaccgcaattaaaaccaagaactatacaccatttattccgaaatatcatgtcaatgcagatggttctgcctttggtggttggcagggtatttatgccggcgtttcggaaatcttcctggcatatatcggatttgattcaattgctgccaactcggctgaagctaagaacccacagaaaacaatgccccgtggtattttaggctcactgttcattgccgtgttcctgttcgttgccgttgcattagtacttgtcggcatgttccgttactctgattacgcaaataatgcggaaccggttggctgggcactgcgtcaaagcggtcacgagattatcgcaactgttgttcaggccgttgctgttgtgggtatgttcactgccctgattggcatgatgcttgcaggttcacgacttctttattcatttggtcgtgatggcttgcttccaaaggccctcggtaagttaagcaataatttaccaaaccgtgctttaatcgttctgacaattattggaattgcattgggtgctttctttccatttactttcttagctcagttgatttcagccggaaccttaatcgcgttcatgttcgtatcaatcggaatctatgcacttcgtcctcgcgaaggaaaagacatcccggaaccaagttttaagatgccgctttatccggttctacctgcccttggatttttaggcgctttggccatcttttggggacttgacattcaggctaaaacctatgcactaggctggtttatcttcggaatgattatctactttggttatggtatgaaacattccactgcaactattgataaagaaaacgaagaagcaagaaaagattaaccttatttttaaacacagcatgcgttactacaggaaatcgctatcatttcctgtatacttaagatagacgtgattaaaaacattggcatctcgcaactttttgcacattgtgtttgaattgttcgcaatgccaatgttttttacatatatactaaggggacgtgattttcatgagtaatttagagaaagcatctcgcttgattgatgaagaaaacaattactatgcccgctctgcaagaattaattattataatttagtcattgaccatgctcacggtgcaacgcttgtagacgttgatggcaacaaatacatcgacctgctggccagtgcctctgcaattaatgttggccatacaaatgagcgagtggtcaaggccatcagtgaccaagcccaaaaactaattcattatacaccggcatattttcaccatgtaccgggaattgaattatcaaaaagattagccgaaattgcacctggaaattcacctaagatggttagtttcggtaactccggttcggatgccaatgatgccattatcaaattttcccgtgcttataccggacgacaatatatcgtttcctacatgggatcctatcatggatcaacctatggctcacaaactttgtcaggtaccagtttaaatatgacgcgaaagattggcccaatgcttcctggggttgtccatgttccgtacccagatctttatcgccgttataaaggtgagagcgaacacgacgttgctatgcgttactttgattctcttaaagcaccctttgaatcttttcttcctgcggatgaaactgcttgtgtattaattgaacccattcagggtgacggtggtattgtcaaggccccggaagaatacatgcaactggtttataaattctgccacgataatggcattttatttgctatcgatgaagtcaatcaagggcttggtcgaaccggtaaaatgtggggcattcaacaatataagaatattgaacctgatttaatgtctgttggaaaatcactggcttcaggaatgcctctcagtgccgttatcggcaagaaggacgtcatgcagagcttggatgctcctgcccatctatttaccacctctggtaatcccgtatgctctgcggcttctttagccaccttagacgtcattaaggatgatcacctggtcgaaaaatcagctaaggacggcgaatatgcaaaacaacgtttccttgacatgcaaaaacgccacccaatgattggtgacgttcgaatgtgggggcttaacggcggtattgaacttgtcaaagatcccgaaacaaaggaaccagacaatgacgcagccaccaaagtcatctactacgcttttgcccatggcgttgttattatcacgctggcaggcaatatcttgaggttccaaccacctttggtcattccccgtgcacaattggatcaggcgcttcaagtccttgacgatgcatttactgctgttgaaagcggaaatgtcacggttccaaaaaatacaggtaaaattggctggtaattaatggtcgtttaaatttaaaaacatgccttcaaatcaattgactgatttgaaagcatgttttttagtattttcatatagattaaactttaatttgattccttaatcccctaagtgtgacatataatcctatcgcacacaatacattaatgacaatatcaataattgcgatgatgagaaccggccaatggtttgcaaatgaaacaactaccatgccaatacttcccataatagtaccacccgcactataaagtgatgaagccgatccattatcgttttcttgttgttttaagataagataagtcgcaggtggtctactggccgagctggctaacgttgcaggaagttcagtaatcgcaaacagatatggattattcagaccaaatcccagaattaaaataccaccaataatcccaaggaaaaagcaggcatataaaataaccatccgatcaatgtactttgataaccgaatataaagtaaaggccctatcaacatcccaatcgcattgaaggcaaaaaaatagctaaatgcttggctgcttaagccaaagtgtacttgaaaaatataggatgaggatgaaataaaacttaacgaaataatcgaaacagctgagaagttaatcaacattgccgaaaaaggagggtttttcatcaaagcacccagtcgacccaaggaatgaagaacactgatactttcttttgacgtatcatgtgtttcttgaaaaataacggcgcctaaaaccactatcaatcctaataaggcttgggtaaagaaaattccccgccaagaaataaacgttaggagcagcgacccaagcacaggagccaatgccggagaaataaccaccatcgattgaacaattgccagcgttgtttcctgcttccgcccagtataaacatccttaataacggctgtggcaatggttgttgccacgccacctccaatagcctgaagaactcgaaataaaatgatttcaaacgctgaagttgcaactccgcacaaaataccagccagcatataaattgttaatccgataagcaaaatcgaccgccgaccatatcgatcacttagaggtccccaaattaaagttgcaacactatagaagacaaaaaatagaatcaaggttagattcattgtgatttctgaaacattaaaaaacgttgtcattgtcggtaatgctggtaaatataaatcggttgatagtggtacaaaagcacttaataaagccagaaaaataatgaagcccacattacccattcgtggttgaactttttcagaactcatttgaaacgccccctatgattggctttttgccattccatattaaaaactgtttcccccgttgcaccgtcaatttccgtagatgttttaatgaacccctgatggatataaaaatgaaaggcagctttattcttctcatagacagataaagataatttggatcgactcctttttgccgtgtctaataattgacggccaattccacgggacctaaatcgcttatcaacaaataacccagctatataagtcccggaaatacctaaaaagccggtaatcgtttgcccttgggttgcgataaacagctccgcttcacccagctgtttcttaaccgcaacatagtttgacagccaataatccttgttaatgaatgaatgtgcctccaaattggctgtcagccaaatctcagcaattttatccagttcttttccagtcattccggttcgatgaatcaccatgatttaatactcgcttccagttagtcattatcgtttattgtacaacggaacgaaaggattttggttcataaagcaatttatgaaaattattcaaaaataaaccatctttattcggatttcgtgtacaatatgactaaataggaactttttaattgaaaggatgactacttatgcctattcatcaaaactctgtatatttagcttccccgttcttcagcgacggtcaaaaagatcgtatcgcaacagtcgtttcattgctcaaacaaaactcaactattgattctgatcgcatttttatccctcaagatcaccaatttgagcaggaaccatttggaagttttaaatggcaggatgccgtttttgcttcagatatgcgtcaggttcgcaaagcagatgtcgtcgttgcaattcttgattaccaacttgaagaaggattgacggaaccggattccggtacgatatttgaaattggtgccgcttaccaggcaaatgtaccggtcatcatggttcaatttggcaataacggccaactgaatcttatgcttgctcgaagctataccgctttctttaatggcaaagatgatgttactgatatcaaaaattatgatttcaataacttggaaaccagatacacagacaaaaaggtattgtaatagaagtttatatcatatacaaagggatggtttgcgagtatggttcgcaaaccatccctttgtactaaatacctcttaagccaaaaagatccgaccagataactgagcaaactcagttatctaatcggatccggtttaagattatgtgtagtgtataaaacactgatgatacattatgctatatcaaaaaatgaaaatttaaattaaaatgattggtattttcaaattaattattatgaattgagctttctgaacttggaattggctctttagcaaacttggaaattgcccagctgccaagaagaccaataatcatgaacggcaagaaatcaagtccaacactatagagtggaattgtatttgaagcccatgaatcaatatttgcaaataatgacatctttgcgaatacgggtggcaaattatgaatcaaatcaagaatggccggaatcatcgtcaaagaaatggtgcttctataaattagctttcgccgaccaataagtggacgcataattcctaagataatcaaagcaatggccagtggatacaagaagcttaggattggtgaggaatatagaatgatttgatccaaaccaaagtttgcaattgagaaagaaacaattgtcgcaaaaatcaaaaacttatgataaccgattcttggaaaacgacggccccagtcttgcgaaagtgacgtaataagtccgattgacgttgttaggcaggccatcagtgttaaagcagccagaattgatgcaccagccatacccgtatagtgttgcataatcgttgtaaatgcagtacccccatcggcactcaacttagtgtatgacaaactcgaagcacccagtgcaatcaggaaaatatagattaaagcttcaaatcccattgttaaggcaccgattttagcaactgattttgaacgatcatgattattattttgaccaaataatttcagagcggtaacgatagtaactccgaagcctaacccagctaatgcatccatcgtattgtaaccttgtaagaacccattaattaatgatccggtaccttttccggctgttggaagaagattcatgctgcgcatatcgttgcccttcaaaaagaatgcaacaaagaacaaaaatgctaacaagagaaccaggataggatttaaaatcttaccaacatttctggtaattttattttgattataggcgagtgctaaggtagcaccaaagaataacagtgagaagatcagcaaactcatttgcgtccatgcttttgggataaacggctgaatccccattgaaaatgtaaccgtagcggtacgtggtgaggcaataagcaagcccagtgaagaatgggttaagatcaggaatgccaacgcaaaaatttttcctgcgggcaaggccaaatcgtacatgctattactctcagtcatgctgattgataaaatcgataataatggcaaacaaattgcggaaaccaaaaaaccaattgcggccggtaaccagtttgtaccagccatttgccctagatgaatcggaaaaatcaagtttccggcaccaaagaacataccaaacaataaagatgctgtaataatatattgcttacgcgttaaattaattcttttatccatattgcaattcctcctactaaaaaatgaaataatctaagtttaaaaataaattctgacaacaaaaacgtccttacctgttttttacaacagctaaggacgtttttcacgtgttaccacctttattcctagttatttcgcaataactagctcgaaaagtacggctcaagaaagaccggtccggcttaagcgatactccattgcggtaatgggcgcattcccagtaactactacaattgaaatcatagttacaacttgtagactactttcattttcaatctaattgccttatcgcaccatttcaaggctctcttcaaattatcatgaaaactactcttctacgcatcgttttttttaatatctggttgtcattgactaagattctattaacttaacataagaatgtcaagcctttttcttaaataatgtgaaagccccttattaaggatccccaaaatagcaagctaaacaactggtaaattaactttcttaggctgtggtaaatggtgaatcgcatgcttcaataaaaatggtgcaatcatcgtagataaaataataaccaagattaaatcagaataataggttgatgaaagcacaccggatgaaaaaccgatttgtgccgtaattaatcccatttcaccccggctaatcataccgctaccaatcatataactactgtgaatatcaaacccattcagcagggcaccaagcccacagccgaatagcttgctcagacatgcaaacacagtcagtacgccgacaaagcctattgaatgcccgatatgagcaaatgacatgtttaacccgatacaaacaaaaaacatgggtacaaacagtgcatatccaattggttccatgtgattttcaattaatcttcgataaggcgtatgcgcaacggcaattcccgcaaaaaaagctcctacagcgccgctaaggccaactaagtctgccaaccaggccattccaaggcaaataatcattgacgtgatggtgacacttgatgccattaataatctttcaccaatttgcattaaataaggcacgatccactttaccatcaaataggttataccaaagaaaccgatttgctcaacaaaaaccaagatcaggttatctgcggactgccccgttctaacgccatgcgttcccatgatactaatcataatcgacagtaaaataacaccaataatgtcatcagcaactgctgccccaagaatggttgccccttcttttgtgttcagtgaatgatagtctctcagaacctcaacggaaatcgataccgatgttgcgctgaaaaccacgccaataaaaattgcctccagtggttcaaaagaaaaggccaagctagccgctccaatcatcaccacgggaaaaataacgccaataatggcgacaatgactgcaggctgtaaatattttcgcaataatgccaagttactttcaagaccaccgataaacattagaataatgaccccaatccctgaaaatgtgtttaatagcaaatcaaggtgaatccaattcaaaattgcgggtccaacaacgacgccaactaatatctgaccaataacagatggcgtacccagtcgattggacaaatgtcctgccaaagttgtcagaattaaaagcaagcacaatgtcccgataaaagccatgtccacacgccccctttctcgcagaaggattcaagaaatatcatggcttaatgattatatgtacaataaatcccttgaaatcatctgatctcaaaggatttatttaaaagtcgttattatttaaccatttcaatagccagcatatcccgagaagcattgacaactcgttttttatgacattgtcaattgaactcaatataaactggataatttccaaagtcaaacaaaaccgaagaatcggaaactggtttgcaaactgtcataatacaattattgaacgacttttaccgctttatttgaataaacaacatgagcccctttgccaaattcgtgaagcgtaacatgatcaaattcaccaacacgtttattaaaggttaatacagtaccatgcgtattggatttcccatcgagaaccaattttccattcaaatgagccgtgccgtcaatatgtgccttatcaccagcgttcaattggagaacaccgttattaccttgcgtgtaattgccactaaccgtaacgttcttagaactcaatgtaacggtaccgccatcaagcttaacagcaccctttcctaaagcttgattattatcaacaactaaggaacctgctttaacagtggttccaccactgtaggaattatccccaagaactgtcaactttccggaaccttccttaattaatccacctttaccggaaatggcatttttccaggtatcattcgcattaaatccaccttttgaagcgtccagattaacagtggtattggttaaaaactcaccgaatccattagctgctttaaataaattcaaacggccccaaccttctggatcatcaagcattgggtaaccggaaggcaacccggttgtataaagaacttctcttctttgtgtatcggacaagtatgggaatctggttttcaaaagcacttcagcgcccttaggaacaaccatcggtttatttgtgctgctaatcggtttaaatccataagtaagtcgataagtgtaatctttaaggtttttctcgtagtttgcaaaagtatccttcacagttgaatcactggctttgctcaaatctttttgagcatcctgataagcttgatcaattaactgtttgtttgcagggtcatttaatgttgaagctgtcatggccgtgcctaaaattcgaccacccataacagcaaacggcgagtgtcgtccagcgagaacccggtcataaccgacttctgaggaacgggttatcaattgctggaatcgttgcgggaaaacatacgctaaactctccccagtctcaaaagcagctgttgtatgaccgctagggaaatcatagtcgttttgagctgctgaggccatcacatttgtcaaataagggttaaccttgacctggctgcttaaacggtatggacgaacatatttaatatatgctttaggtgttccggtgctggaccaatcggatgcctcattgagatcaactagcttcaccactgaccctagcttggaattttcatccgcccatttcatcgaactgtacggtgaatttgcaggcaatggagagcttggaacggaattaaagtcagtttgtgcatttgcgtccttaatgaatgcagttgcataaggcccgaatccactaattaaattatatcgaagatctcgccgatcggttaagtacgatcggtcaatttcggtctgcgtttcgtgatcggtaatttgaattgatttattcaaattttcctgcaatagaccagcattttttttggtgccattcggagaccagtaactcaaaaatgtattgttaaaaatagaaatcgctggattactatccggcgtagtatttgcttttacattttccttataatgatcaatgaaataaccgtagggtcccttcacaggagttaacgcttgtttaagcgactgggtttccgaacccttattacttgcagcgtgagtttctgattcaccacccataaacgcagctccgacgactgataaaacaaatgcacattttaaaacgttttttaacaatgacttcgatctgcttcccatcaacaaaaccctccaaacaataatataatgactaataaatgcttatcagaatcacaataatggtcaaaacaacaagtgagataatccagccaattttaggcgtttgtctcatttcgttaagtaccgtcgacatgattttcaccgtccctcaaaaatttcctgataatcattcacccttcatctataagggtaaaggtagtgtgtaaatcgtcagccaataatatgtaaaaaaagcgtaaaaaaaacaagaaaccaaatcggaaaccaacctgcgaactattcgcgaactggtttctgatttggtttccgatgttattgccaactatttctctggttgtctggcacccatcactccagaatacaacctccgaaccaattccggatttgcttttccgggattcaattcgacaattttaccgcttgcactatagacaatccattctgccaaatttacaatatgatctcctatccgttcaaggagacgaataaccataaaataacttgcacttgactgaactgtttcagtatcattatgaactgcctttgtaatttcatcccgaatcagtagatattgcttgtcaacatcgacatcttctttagacaagtttctagccgccagctcatcatttttcgaataagcatcaagcgccttttccaacatatcacgaacttgatctgtcatctgagcaatttctttttcgacacccggaattcgagcttgacctttcattctgattgtttcacgggcaatactaacggcatggtcccctacccgttccaaatccgaactggcttttaaaatactgatgataactcgaaaatctgtcgctaccggttgctgaagtgcaatcaacttcaaggcctgtttttcaagatccatttcttcgccattagtattgttatcagcatcgatcacttcttgagcaagttttttatcatgttcgataaatgcctgcgtggaattataaatctgctcactgatatttaaccccatttcaacaaatcgaccatgcaatttttttagttcgtcgccaaataatgctctcattctagcatcctcctatccaaactttccgttaagataatcactggtttcttctttttcaggattcataaataatttttcggttttatcatattcaactagattcccatttagcaaaaatgctgttcgatcggaaattcgcgatgcctgttgcatattatgcgtcacaataataacggtatatttgtcatgaatatttaacagcgtgtcttcgatttttgcactggaaattgggtccagagcactggttggttcatcaagtaggataacttcaggttgaactgccaaaacccgggcaacacaaatccgctgttgctgaccaccggaaaatgaaagtgcactatcatacagattatctttaacctcatcccaaatggctgcttgtttcaaactggtttctactcgctcatccaaaatactcttatcacgaatacctgccaaacgtaagccgtaagcaacattttcatagacgttgaacggaaacggattgggctgttgaaaaaccattccaacacgctttcttaattcaacaacgtcaacctttggtgcgtaaatatccttaccttccagctgaatcgacccattaatcgtcacgcctggaatcaggtcattcattcgattaaggcatcgtagataggttgatttcccacatcctgacgggccaatcagtgctgttatttcatgttctgcaaaatccaaattaataccatgaagcgcttcaaatgagccataatacaaatgaacgtcttcagaagtaatcatttgttttgtcgttgttttaattgttgtcttttccatatgaggacgctcctttttaaccaaaattccctgaaatataatcctcggttgcttttatctgtggatttgtaaaaattttctctgtcttatcatattcaagcacatgccccatatgaaagaatgctgtgtaatcagcgatccgggaagcctgctgcatgttgtgagtcacaatgataatggtgtaactcttacgcaactccttgagagtttcctcaatcttggcggttgaaatgggatcaagggcactagctggttcatccagtaacaaaatatctggcttcattgcaacacagcgagcaatgcagagtcgctgttgttgaccaccggatagtgccaaagcactcttgtcgaggtcatcttttacttcatcccaaagggcggctgatttcaaactattttcaactcgatatgctaattcttgtttatctttaatgccgtttctctttaaagcgaaggtgatattttcccgaattgattttgcaaatggattaggtcgctgaaataccatgctaatgtgtttacggacttcataaacgttaatcttcttactattaatatcagtatcccgataaatgattttacctttaacggtggcaatcgcatcattcatccgatttaagcatcgcagataagtcgatttgccggatccggaagctccaatcaaagctgtaatccgatatctgggaaattccagagttgcatcatgcatggcatggttgtcaccgtaaaacacttgcaagttttcagttgtcaacgccttttcggttggaatattaataatgtgtttttgatcaaatgaataagtttgcataatttcctcctacttggctgccgtcatctttttaaacatccagtttcccaagtatcgagcacctaaattaaatagtaaaatcacaacaatcaaaaccgctgaagcaccacttgaaatttgaagggcatctggtgtgacaccttcagtgttcactttccaaatatgcacggctaatgtttccgcaggacgcattggatttagaaaactggttggactaaacggattccagttcgagtagctgacaatcggtgcgctttgaccagcggtatagattaaggcggcagcttcaccaaatactcttccggcacttagaataatgccagtcagaattcccggaagcgcagccggaaaaacaatacctgtaatcgtcttccatcgtgataaaccaagtgacagcccagcctcacgttgcaaatccggtacgtcttccagagattcttcaatactccgcgttaacaacggcaaattaaagaaggttaaggcaattgccccagcaagaattgaaaaaccaacattaaatttaatgacaaatactaaataaccaaacaaaccaacaaccactgatggtaaagaacttagtacttcaattgcggtccgaattaaactggtaaaccagttatttggtgcatactcggaaagatagattcctgaaccgagtgcaattggaaatgaaatgattaatgttaagaccagcaagtataatgagttgaaaagttgatcacggataccaccgcccgctttaaatgattgggctgcagaagttaaaaaatgcatcgagacatgggggatacctgttaccaaaatatatcctagtaagaaaaccaagatgccaacgactgcagtaacgagtaggtagatgacgccggttgcaacattattcgcagcttttgagttcattttttcaagctacctcgctttccaatgaatcgaaccaatacattaaagaccaaagacataagcaacaggataagcgccaacgaccacaaggcattattaggtaatgtgcccattgtcgtattcccaatcccagtagtaagctgactggttagagttgatgatggggttaacagcccatgtggcatcagggttgcattcccaataaccatctgaacagccaacgcttcaccaaaagctcttgccatcccaaaaataatagccgtcaagattccaggcgctgctgctcgtaatacaactttataaattgtttgccatctggtagcaccaagtgcaagggaagcagatcgataatacattggaaccgaacgaatactatcaattgaaagcgatgtaatggttggtaataccatgacaaagaggacaatcgtaccagcaagaatcccgaatccggttccaccaaatgcgtgtcgaatcaaaggtacaatcactgataaaccaatgaatccataaacaacggatggaattccaaccaataattcaataaccggttgtaaaaacttggtgcctcttttgggcgaaatttcagtcataaacagggcaacaccaagtgcaaacggtgttgcaaccaatgccgcaagtaccgtgacgcagaaagacgttacgatcattggcaatgcgccgacttccggctgaccatgagagtcaagcatccccggattccagttagttccggacaagaatgcccagaaattaacatggttctccgtgaatgtcgccataccacgagtcgttataaagtataaaattgagagtactaagaatcccacaaacgcaatacagatatagctgattgttttaccgaagtaatcttgatgagtggctttagatggattacgcaattccttcttgatcccgtccattttaagcttatcctcggttccaggcttaatcccttccataaattgatacctcctaatttgaaaacagttctgtcataagtccctttaaagcggatagaggccagagacaacaacacaggtttgcctccagcctccacgtgatgaatcactatttaagttagcttattactataaaattaatttacttagttgttactgcgccgctggcattcttttgaactttcatgtcatgaatgctgatgtacccaagtttttgaaccagactatcttgaaccttacttgaattcatgtagtttaagaatttcttggttgcagcatttggttgacctttagtgtacatgtgctcgtatgaccaaatcttccacttgttattttcaacgttttgatcagttggcttaacgttgttaacagatggtgcttcaattttactattaacataagagaaagctaaataactaatcgtacccggtgtgcttgaaacaattttttgaaccgttccgttagaatcctgttcctgagtcttgatagctttagcaccttcaagaacggcgccttcaaatgttgctcgtgtaccacttccggaaacacggttcacaacgttgattttttcgttcttaccaccaacttggttccagttcttgtactttccagtgaagataccttttaattgggccattgtcaggtttttaacaccaacacctttattaacaactggagtcataccaacaaccgcaactttatgatcaactaacttattggccttaattcctgattgctgttctgcgaagatatccgagttaccaattgtaacggcaccttcttgaacttgactaagtccagtaccggaacccccaccttgaacagaaatgttaactttgctgttgtctttttgataatcacttgctgcctgttcaactaatggttgaagtgcagttgaaccaacggccgtaattttaacgtttgagctagaagatgatttctttgatgagcttgcgctgtttgaaccacatccggcaagtaaaacccccatggcagataaagcaacgattgctgaaaaaaaggatctttttttcatgatatgatttcctcctaatttgaaacccgtttttttggtactcatttaagtacagccttaatatatcaacgtcatgtaaatatcgagtttcgtttatgtaaaagtatcgtaaatgtctccgattttagtcaaaagtatggcataacttaagatgtaatcaatttaactaaaatggaggaagaacagatgccattggaaattctactaatcagccaagatttacagctagccaacaagctcgaaaaaatgttgaattcctttaatatcaaaatgcgggtatcttttgaaccactagaacatctcctacagcaaatttccggtgtcgtctgggatttaagtagcatttcacttccaaacaacgcctcagaaattcagattatgagaagccaagtggccggcccaattttacttttggataaaaccgacgaacctgttgaaacaatttgccgttactttttaagttatcatttagatgattacatccaaaaatcttctattaaagaagtagctgccagaattgttcaaaaattatgggtctatcaaaataaggatcgcttgcaaattaacaaacagggacaggccaacagtaatctaactgccggacacttaaaaatcgatttgaataaatttcaagttaacaacggtcataatcggctgagcctaagccccattgaatataaattgctattattctttatcagccactcaaatactgtacttagtcgtactcaaattgcttcagctgtttgggggaataccagtggtgcaaccttacgaattattgacacccacattagtaatttaagaaaaaagattgaaaaacaacctaaaaacccacagatgctaaaaacaatccggggatttggttatctctttaaagttgaaaataaaaccgctgacgcgagtcacgtaaaataataaatgagctgaaccaagtctaagacgttgctgtctcgaacttgattcagcttattttaattgatacttgcaatggagaaggacctaaagcttaatcattcttccgattataaaaacaatttcatttaatgaaacttggtccttaaaatagcagaaaacttaaggcgcagcaaaacattatcataccaacggcaagccaaaggaaccgatttgttttgatgtaaagactgaaaaacatcaagtaaccaaaaagccccaaaaaagcaatgttgataaacaattcgccataaaacaaactaagcaaacccgttatgattaaacaaatgccaacgttaacacccattgaagcaatcatccaatcacgaagattaagatctttattttttgatgaatttatgtagtcgtttaattttaatgatctctcctttgatgaacagcttattagtgacctatttttattaatgatataggtaataatagccagaacaatgaaaaagaaaaaatggcagctcaaaaaacgaaatcactttgaacaatcagaatacgtcggaaacacaataacgatcgcctcattttatgaaaaagatctctataatctatagtttgcaaattaaacgtccgtatttttagtgagctcagattatattaaaaatgtctatccatattagggaaaacgtcatgaaaatatataggattttaactagacataattacataaattatcgaattaataattgaatttattttaaatgcttttaaagttttcacatattcatactggtatgaaaaaagacatgaaatctttataggtaaagaatcagccattatattatttgtctaagactgcttaataaaattaaaaaataaacattttatgcttaatgtttcagaaaaatatatggtatttcctgtcgataagttgtaaaatgttcaataattgatcaaagttattttcaaaaattgaaaataactcaagagaggagattgattataatggacagtgtcaaaaatgatgtcacaacctatcctgcttacttagctggaaagtggcaaacaagtgaatcgcgagaaaccatcgcgattacctcgccttggcaacatgacgtgatcggcaaggttcaagccgttactcaatcagaagtcgaccaaagcattaaagcatcaaaaaaagcgcaacacgcttgggcatccctttccctcggtgatcgtggacaataccttaaccagtgggcaaatgagctcgaaaaagacaaggaagttattgccacttcagtgatgactgaagttggaaaaaactatgatgatgctgaaaaggaggtcactcggacaatcgatttgattcgttacactgtgcaggaagcgttgcacatgcacggagagagcgtgcgcggtgacggatttccgggtggatctaaagaaaaacttggaatcattgaacgggtaccgcttggcgttgttctcgcaatttcgccgtttaattatcctgtcaacctggcagcttctaaaatcgccccagcgttaatggcaggaaatggtgttatttttaaacctgcaacccagggatcaattagcggcattaaaatgattcaagcgttggatcggactggtctgccaactggattgctaagtttgattaccggtcatggttccgtaattggtgattatttaactgaacacccgggaattaatatgattagctttactggtagtacccagaccggaaaacatctttcacaaaaatccatcatgatcccactggtccttgaattaggcggtaaagatccggctatcgtatgtcatgatgctaaccttgatttaactgctaaaaatattgtcagtggtgccttttcatattctgggcagcgttgtaccgccgttaaacgtgtccttgtcgatgacagcattgccgatcaattggtcgcaaaattgaaaactgccgttgaaaagctttcagttggttcaccagttgatgataatgccattgtgccgttaatcgataacaaatccgctgattttgtccaaggtttaattgacgatgccctttccaagggtgcaacactcataaccggtaatcatcgcgataaaaatctattagcccccacattattggataacgtcacagaagatatggatgttgcatggattgaaccattcggaccggttttgccgattattcgagttcactccgttgcggaagcaattgaaattgcgaacaaatccaattttggattacaagcgagcgtcttcactcaagatatcgataaggcactcgaaattgccggtgccgtcgaggttggaactgttcaagtcaacggtcgtcccgaaagaggtcctgacaactttccatttctgggtgttaaagcttcaggtatgggtactcaaggtgttcacaacagtattttatcaatgtcccgtgaaaaattaactgtcatgaatttaaaataaagatttttaacaaaaggagccaaagcaaaaacgtattttgccttgactccttttcaagtcctaaataaataatccggtataagggacaacaatgctaatattattgttataacatttaccacttacctgccgagaacctttttagcgcttgcggtgaaaatagataaactggtatacaagaattgctagaacgattaacaaaaatattaacgatttgatgctaactgctctggttcctaataaaataaaggcacccgttattaatatcatctcaaacatttcgccacaaaatagtaatagtgtttttgtaaatggggcattcatacttattcgacctttccattacagattgacactcgcatcatttgtaagacatatgatatgaagatttacatagattgttttttaatgtaagcgtttcactataatgatattgtatcattcttttactaaataattaatggctttacgatcatttcgacaacaaatcacctttgattaaattaatcacgaaaaatagtcatttaatcactagccatgttttcatttttaagggtttgcttttacagctgatttgttttttttatctcatcaaaacacagttttacaaagtcactgccataagcttctttcaatcgatattgccaattttccggaacttctatttcggaaacgatcggctgtaaccattgatttgttggtaatagtttaagtaattggtgctttgtaaactgtgaaaataataagttttgaccgaaaagctgagctatctttcgctgaaattctggatgatccattctgatcaacaaatgatttgcattatttctatcacccagcattaacgttgctttcgggaaatctgacactaaatcaaaccgttgcaatttatgagcttgcgcaatatcaggtgtcattctaatataccaaatcaattgatgacgttctaattcgactaaaagctttagtgtactaagatcagtcccgctcatttgaaaaaaagatgctttcatttctgtgtgatttaaatgggtttgcaaaagatttttaagcagatcaaaatgatgtggatccccccacaatatttccaattgctgagcatgtttcaaccaaaccggatgtgttgcaattctaagcgttagccattgagggcctcgtttcgttgtttttctcaacagccaataggaacttgcagttgaacgcgcaaagtttcgtgctaataattttatgccaaccggcagcgaatcaatcactattttttcaagccgatttcgataatctggtgttgttgtaaatgaaaaatcaggaatagatggacgtagcttaaccataaccatccttctttcgttaactcgtcaagtatatttaagtaccattctaacatatcaacaacgcgaacaagtaacatcgatagatggacataaaaaagttgaggcaggtattctcttgtctcaactttcttcttataaatgtttcatgtgtaactattatgattgaagcgccttaatattcaagaaatcccgaattccttcagaaggaatcgacttgatagccggccctccaatttgatgtaagtatattaagttcaaatgaccagcgtgattctttttgtcatttttaatcttatcaaaaacagcatcagaatccaacaagggtgacgtaatcggtagtccaacagcttgcagccgatcaattagtttttggttcacgccggcttgggttaatcccttttcttcaaagattcgcgtaattgcaaccattccgatactgacggcctccccatgtcgaagatctccatcagctaatgcttcaattgcatgaccaatcgtatgaccaaagttaagaacttgtcttaaaccgccttctttttcatctcccatgacaacatctgccttgtattgaatggagagacggcttagttcttctgcattagcaaggatatcctccggtgaattaatatcttgcactaaatcccagagcttaccatcggtgagagccgctaccttgacaatttcaccataaccctcaaccaaatcacgccgatccaaagtatttaaagtctccggatcaatgataaccaaatcaggttggtaaaaggaaccaataatgttcttcgtcgtatccaaatcaaccgctgtcttgccgccaactgaactatcgacttgtgccaataaagaggttggtatttgaattaaactaatcccgcgcatgtaagttgcagcaagaaatcctgccaaatcgccggttacaccgccaccaagggcaataacaccatcatcacgagtaaagccatcagccgccatatctcgcgttaaatcagccaatacgccaagcgattttgatgcttcaccagctggaaattgataattatgaaccgtaaaaccaacactttccagtgcaccggcaactctttcctggtacaaaggggcaacattgctgtcactaaccagtgcaatttttcgttctgaccaaacacttgaaaccaattgacccgtgcagtttaagatgccggtctcaatttcaacattgtatgagtgatctggtaaattaacttcgataattttcataattcaacctcacttttttcttggacgggtgtcttgagagcatcacgaatggcgtaggctttttgggtcatttcaaggtattcacccggcttgagtgcttgagcaccatcagaaaaggcatgggccggatcatcatgaatttccactactaagccgctggcaccaactgcaacacctgcaagtgcttctgggataacaaattcggtatgtcccgcagcgtgacttgggtcaacaatgactgggtagtgagttaacttctgaagaaccggaacggcaccaacatctaatgtattacgagtgtatttattatcaaaagttcgaatcccccgttcggtaatgatgatgttatgattaccaccggctgcaatgtattcggctgcatttaagatatcatcaatggttgctgacatgccacgcttgagcataaccggaatattggtcttaccaactgccttaagcaacgagaagttttgcatgttccgagcaccgatttggaaaatatcagtgtattgcgcaatcatatcaacatgatcctgatccatgacttccgttaatacgtctaaatcataagcatccgcagctgcgcgtaagtatttcaatccatcttcgcccaatccctggaaagagtatggagaagttcgcggtttaaatgcgccaccacgcaggactgtcgcgccaccctcctttgcaacggcggccattttcatcacatgttcggcagattcaacagagcatgggcctgccatcattgtgaaatgatcgccgccaattttactatgcgcagtctcaacaatcgtatcttccggatgaaacaagcgactaccttgaactgcttttggtggattatcaataatttgttctgcagcggcgcgttcatctgaatttaattcatcttcggtgactccctccagtgccactcgattatgatgagtgaatgcatcatgagtaccaccgaatcgttgctgaagctcatcaataatatgttcctgtcctgctttaataataataatcatgttaacatcctcttttcatttttttcaaattatagaactgaaatatgcataaaataaaactcccgcagtgtccaaaacaccgcgggagttctttcgtgtattataagattcttctcgaatcggtcccgcagtattttgataatttactgtgtgaccggtttaatcatgctgaaaaactattggtcgcacaggattgctgacaagtgcccgcatcctgtacgatgtggacactacccgaaccaatagtaataaaatcgatttattttgcgatttattttctccatgattagaagctccttaaaaagttaaattttaattgttgctagcatataatttatttctttgcttgtcaacagaaaaaagtaaaattcgtaaattaccgctgattttgtctttgaatgttcacaaaaaataagctaaaaaacgagctaaataattgaaatgacttatgtatcagtattttcagtacataaataaccaattggattttaagaataaaataataagaaaaaatgatctttcgttttttatcctgttatatgatgtccagtcggattatttagcgaattgaagattctaagcctcttgacattttatgagaagtgccctattctattagcaataaaatattcgtcctaaataaaccattgatgtggagatcaagattgttgtgcacgtaaagagagtcatcgttgctgaaaatatggccgaacgcagacaattaaatggaccacagagggttctcctaaaagttcaacaagtatggagaaacgttcagacatacgtcagttgtcggaagtgtgttggcacttcgctaagtgtgatgagattattgattgtataaagatacagttgactcgtcgaatttaaggtggcaccgcggaaaatccgtccttacaagttaaagcttgtttggggcggattttttgtttttaaaatttattcaccaggaggaatcattcatgaaattcttatctaaacgatggcaactttcaaattttaattaattaaaaactaaaatttggaggctcatcataatgacaatcgaacaattaaagcaatatgcagatgcctatccggcaattcctattacacaacaatttcaggttgaatcctttgatccgatcgctatcacacaagcatttgacaatccaaaacatccctgctttttgttaacaggaaagccaaagaaaaccgaagatggttattcgtttattggctttaaccctgttgaatcattcacttaccgaaacggtatcctcacaaccacactgaatgacggttctgtttcacatgaaacaaccaagcttcaaccttttattgaaaacattttgcggacaaatcaaacaccgaaacttaaagatcttccaccttttttaggtggtttggctggctatttcagctatgattacgcaaaatatgcaaccactgccaaactgccagcagttgccgatccaatgaatcttaacgatgccgatttagtcttggttaatcgggttattgcttacaatcatgcaacaaaaaccgtaactttaagccaaattatcccttcaaaattgttaattaaaaaatacaatagcgtttgtctggaattagaagacttaaagcaacaaatattaactatcacaagtgagcaaccattgccatcgttttcaatgacacctttaaaacttcaattttcattacaggaattcaccgagaaggttgccgaaaccaaacaacatattgttgacggcgacatttttcaattaattttatctaatccgcaacacgccaaaatgaccggctcactattttcggtaaccccaactttatttaaagaaagtccatctccttatcaattttattttcgccatggtgatttcgaaacaattggtgcttcgccggaaaccttgatcaccaaacgtgaccgtacactttttacctacccgcttgcgggaacacgtcgacgtggcaaaaatcaacaggaagatgaccagtttgcctacgaattacaacacagccctaaggaattatccgagcataatatgctgattgatctgggaagaaacgatcttggaagtgtgagcgaatttggttccgttaaggtgaccgcttatcgacacttgctaaagtttgccaacgtcatgcatatgggatcagtcgtggaaagtacagctaaaaaagacgtttctgcgattgacattattaacgccgttttacctgccggaactttatccggtgctccaaaaatctcagcaatgcaaatcatcggaaacttggaaaatagaaagcggggcgtttatggcggatgtattggctacctgggtttcgatggtgatttggatctatgtatcggcattcgtttagcttaccggaaaaacgaccaactcgttgttcattccggagccgggattgttgcggacagtattgccaagtacgaatatcaggaatttaacaacaaagccagtgccgtcgtcaatgcattgaaggaaacggccgctaagggaggcgttgaacatgcactatctgattgataattatgatagctttacctataacctgtatcagttaattggtgaaatttctaaagatccaattaccgtgattaaaaatgatgccattaccgcagaacaattagcccttctcaatcctgaaagtatcattctttccccaggtccgggacgcccggaagatgctggaaagatgccagacatcctaaaaacgtttctcggaaaagtacccatcctgggtgtttgccttggacatcaggcaatcgctgaagcgtatggcgccaaaattattcatgcgccaaaattgatgcatggaaaaccttctgaagtaaccatcaccaaaaaaacggtgctttttaatcattgcccaaaaagatttgaagctgcacgttatcattcacttattatcgatccacaaacaatgccggatactttaacggtgactgccgaaaccgcggataaagaaattatggcagtagcagacgattctaaaaaagtttatggcgttcaatttcaccctgagtcaatcatgacagacccaaaggtgggtgcacagattatcaaaaacttcatagccgttgttagtgcacaaaaaaagatgacttctccagccatctgatctcttaatctagtttcaaattcgacttaaaaataaacccacagtttggacaacgatttaaaccgtagttaatcatcattggccggttgcaacgtggacaacgcccatgaatcggtttacggatcttgagaggatcggattgcttttcgggttgtttatcagccatgattgtcatacctccaaacgggaactctaattttgaactcgctctaaaaactgtgccggcattgcatcaaccaaccagatgccacttttcgtcgggtaaaataaaacattatttttagcagcgttctttgcagcaactcgaaacacaacgggacgtggatcacgacgccgaccaacttgaattgccatttgttgattggccgatagatgaacaaaatcacggtccattttctttaaaccttcagtttcaatcaatctggctgcagagtgagttgttccatgatataggtattcaggtggcattttcggcggcgttaatggcttaacagggatactatgtccatacaaagctcgaatagtattcccctctatagcgtagcgctgcttatcactttgctgaataattgccgtaatgattgattgactgataggcgttccataatgtttgttaaaatgccttattaaaacattcaagtttgtccggccatattggtcaagtttaatgtcaattttttccggatgatgacgcaaaataaacgacagccgcttacttagtcttgttaattggcgatccaatgaaccgcacccttctttcgttaaactgaacatttactcccagttaactaaatacacttatattataaagccgattctaaaaattgaacagctaatgaggaatggcttaaaggacatctttcatttacgtattaatgttaaaataagcgatcgagatatttactacctcaatcgctcattttacttctgatcgatctggataaatattcctgtggctacttattgactattaacgacaaaaaatgtcaattgtctagaatacaggctgaacaaaaaagataagaaaaacccgccatttctgccgggttacatcatttacaattggagggtatatatattgaggggtatgaagattgttgcacctacatcagaaacaaactatcaaaatcaatttgggttgttaaattgattatttatagaatactcatttcaccttaaacaaggcttaaaaatgattattttagaaatttattgaaataattaaagcttggacatcaattactatcaccattcccctttctaaatgacgacaaaaatagtaaagtcttattgtaaagataacctaataaggagtcagaattttgaaaaaaatatactttgttcgccacggccaaacacttttaaatcaatttcgccgaatgcagggttgggtagattcacctttaactgaaaagggagagaaacaggcagctgatgccggaaaaaagctgcagaatattaaatttgacctcgctgttagctcagatatgatgagggcaattcatacacttgatattgttttgaaaaataatcattattctgaaaatattcaccgtgagataaataaggatgttcgcgaaatttattttggttccttcgaagccatagacagtgtgacaacgtggaatatgattggcggaccacttggtcatttcaaacaggccgacttaataaaagagtacggcttactcaaagttcgagatttcatgcatgatgctgatccatttcattatgctgaaacctctgatcaattggaaacacgtatccgaaaagcagttgcaactatccagacgcaattgagtgatgatcaaactgccattgttgtttcacatggaacatatttaaggaatttggcaacccttttctctaaaaatcaggttgtccgagagcagcctaaaaacggtagcatcatgacgctggatgtcactaatgatcccaaggtgttgacttataaccagtagcagcaaatctctgtataagcataactttactcttgatcattaatcgaaaaacaaaaaccaaatgatccccctaaactggataaagccagttttagggggatcattttcccgtatcaaaaagattaataggccaatttgttaacgttattccgctttgtcttatcagttccccagaagaaggtctttgcaacaccggtaattttctttttaggaacaaatccccaataccggccatcgtttgagacactacgatgatcgcccagtacaaaatagtttccttttggaacttttacagaatttggatgttttgcccaactcttcgaaagtgtttgcaaatcccagttaccagttccggttgttcgttgataattgctgataaaactttgattaacctttttaccattaacgtataagttgccattgttactagaaactgtatcgccaggaagaccaataacacgcttaacataatctgtgtttggttttgatgcacttggatcctcaccatgtgcatcaaaaacaataacacttaaatgcttgattttggcatggcgccaaaccaataaacgttcattattaactaaatttggctccattgatgggccgtcgactcttgcaaccgtgacgacggttgccttaataacaagtgcaagtgcaagtccaattgcaatcggaataacaattcccagcaatccctttaaaaatttcatccttttactccttcatggacttttaacataaaagtcactgtgtttataaatccgttatttttaaatgaagccattaatggacacaatcgaattatattttagcatattttactatcaacacaacattttaagaacataattaacatatccataattagttgcgcttaacttgctaaaccgctatcattatttgagacagcatatgatttagaaatgggtgattaaatggcaacaactcccagtttaggtaaacgtatctggctggtatttattttgggcaccatcagtgcaactggtccactttccatcgatttatacttacccgcgttacccgaaatgacgcgcgatttacagacacatgcttctttaattcagctaagtttaagtgcgtgtcttttaggattagcaatcggccaactaatctcaggcccacttagcgataaatatggtcgaaaggggcctttgatagttggttttttaagctttggcatggtctcccttcttattgcaagtagtcattctgtctacttactgattggtttgcgatttatacagggattagcaggcgctagcggtcaagtgctatcacgagctattgcttcagatttgttttcaggaccactactgacaaaattttattcaatgctctctgctgttaatggtatatttccggttatttccccaattattggcgggtacattattaaatatgtcgagtggcagggtgttttcattttattagcgttaattggcttcattgtctcgatcgcgatctggatgggaatcaaagaaacgttgccttttgcctcaagaatttctggaagtccgattaactccatcattgaaatgtttagccttttaaagaatactaaatttgtaaaattagtcattgccagcggcttagtttatgggggacttttcagttatatttcagcctcctcatttgtctttcaaaactactttcacatgaatgtcgcaaactttggctttctctatgcaatgaatggtatcggtattgcaattggatcggcaattccgggcctattagcaactcgtgtttcggaatctcaacaaatccgtttcgttttaggatcaacatttatgacagctttggccttaatctcaagttggttcttacttaacaatctattaacggtcacaattttagttctgttaatggtctttcaatttggtatgttgtttacactgacaacatctgtcattatgaatctttcgcttaaaaacagtggcggtatttcggctttattaggcctctcccaaaatgcaattggtggtattatgtcaccaattgttggtgttatgggcagtcagacctacctaccaatggcaatttccatcgcgggttgtatcggattaagcctcattctatttttaaaaatcaattcctcaaatcaactcaaacaataaaagaaccggacaaatcacatgaaatgatttgtccggttctttttagttcttgattaatattccaaatgacataacgtcttaaatcagacactcttttttagcttggcaatttttccctgttgaatataaacacttagtattgcaatatcagctgggttaacaccactaattcgagatgcctgggcaattgtttccggatgaatcttttgaagcttctgacgtgcctctgtggcaataccatcaattgcttcataatcaatccgattaggaattttctttgcttccatacgtttcattttttcgacacttgactctgccttagcaatatagccagcatatttggtttgaatctcaacctgttcaataacgtgtcggtccaaatggtgttcaggatctgaaatgaactgtaacaatgtctgatagtcaacatatggccgtctaagaaagaccgaggcaattacgccatcctttaatggcttgtccccatgcgcttcaacgaacttattaacagcatctgatggcttgattcgaatactgtttaatcgatcaatttcagattcaatcgcccttttctttgaaagaaattgcgcatagcgctcatcagaaattaagccaatttcatgacccttttctgttaatcgcatatcagcattatctgttcgaagtaatagtcgatactcagcgcgacttgtcaagagacgatatggttctttagttcccttagtcaccaaatcatcgatcataacgccgatataagcttcgtttctttttaaaacaaatggtccttggccaagcgcacggcgcccagcattgatcccggcaataattccctgaccagcagcttcttcatagccggaggtcccatttgtctgaccagctgtaaataggttttttacaatcttcgtttccagtgttggcttcaactggtaaggagcaacaacatcatattcaatagcatatccgggacgcatcatttcagcattttctaatcccgaaatagtatgcagcatctgctgttgtacttcctcaggcattgacgtagacagtccatcgacataccattcttcagttttgcgaccttcaggttccaagaacaattggtgtctgctcttatcggcgaatcgaacaattttgtcctcgattgatgggcaataacgaggacccactccttcaatcacaccggtaaacatcggtgcacgatccaaattttcccgaatgattttatgagttgtttcgtttgtataagttaaccagcaagaaagctggtcttttacagccaaataatctttgtcagatgattcaaagctaaaatgatgcggcttctcatcccctggttgttcttcagttttagaataatcaattgttgtaccatcaacacgtggaggcgttccggttttaaatctttccaagtcaaaaccaagttcttcaagacttccagacaacttttctgctggttgagaattgttggggccggaagcatacattaactcaccaatgataattttaccgcgagcggccgttccggctgcaatcacaacggattttgcaaagtatttcgcaccggtattggttatgacacccttacaaacaccatcttcaacaatcaaagaatcaacaattgcttgtcgaagcgttaaattaggttcattttccattgtgtgcttcatttcagcatgataggcatgtttatcagcttgtgcccgcaatgcttgaacggcgggtcctttaccggtatttaacatcctcatctgtacataggtcttgtcaatgttacgtcccatttcaccgccaagcgcatctacttcacgcacaacggtcccttttgctggaccgccaaccgatgggttacatggcataaaagccaccatatccaaattaatggttaaaacaagtgtcttattacccattcgtgcagcagctaaagccgcctcacaaccagcatgtcctgcaccaacaacaatgacatcataatttttgccgcgatatttctgcttcacatcgctaactcgtaaacttttcaactgtattttcctccaaatgtttcacatgaaacagattattttcccaagcagaactgactgaacagttgatcaatcaattcatcttgataactatcgccggtaatttcaccaagaaaatcccaacaccttgtcatatcaatttgtaccaaatcaaccggcataccctcatcaagccccttaaggacatcttcgagtgcgcttttagcttgatttagtaatccaatatgccgtgcatttgtgacaacaacgtcattttgactacttgcaataccctcattaaagaacattgttgagattaattcctctaatccctttaaaccgtctgctttgatggcagatgttgaaataatattttgggctttagttaatcgctttatttcacttaaatttagtttgatgggtaaatcagttttattcaaaacaacgattcgttttttcttattagttgcttcaattaattgtcgatcttcttcggttaagggttcactcgcatttaaaaccagtaaaactaaatcagcactattaattgcttttctggagcgatcaacaccaattttttcaactttatcattggtatctctaatacccgccgtatcaataagctttaaaggaaccccagaaacatttgcatactcttccaagacatctctggtcgttccgggtacatctgtcacgattgctttatcttcatgcaataaatggttcaaaagactggatttgccgacgttaggacgtccaataatggatgtcgccaatccgtctcgaagaatcttaccttgcttggcagtctgtagtaattgtacgattcgtttatgaacatcagttgctttttcacgaagcagcttactggtcatcgtttcaacatcgtcatattccgggtagtcaatattaacctcaacttgagctaatacatccaaaatatctttccgaagatgtttaattagatgggacaaattaccatccaattgactaatagcggctttcatcgatcgatccgttttagcttcaatcaaatccataacggcttcagattgtgacaaatcaatccgtccatttaggaatgcacgttttgtaaattcgccgggttctgccattcgagcaccgttactcaaaaccaattgcaaaatccgattagttgcaacaatgccaccatggcaattgatttcaatgatatcttcttttgtgtaggtatggggagcccgcataatcgataacatgacttcatctacttcttgatttgtagaaggatcaacaatatgaccgtaattaattgtattactggctactttatcaaggttcttgcctcgataaacattttttgcgacatccaatgcttcttcaccactgattcgaacaattgaaattccgccctcaccaggcggtgtagaaatagccgcaatcgtgtcaaattctgttgttgttaaaaccatacttcagtttcctcccacataaaaatacaataacgtcacactattaaaccacaaaatacatttaaacgcacaaaaaaagtgcccactccatgcgtaaaaagcatggataaagcactttgactactttacctagttaagataagaatgattaccttcatcatattttaaagtacacgttttgtcaatggaaaattcgaaacggtttccaatttattttggagccacgacaatgacccgatgcggctctttgcccgtggagtaagtgataacgtggtcattatctgcaagtgcattatgaatctgtttgcgttcaaaagaaggcattggattgagataaacaggcttgccgtttgcgattgcattgcgtgcagtcttatcggccaattgaatcaatgcttcactcctccgatttcgatagtcagctgtgtccagttccacagtcacattatttgcgcctgatcgattaacaaaaatttgagccaggttttgaagcgcattaattgtccgaccatggcgaccaattaatcgactttcctgctccgtatcaatgtcaatgtagactgaatgcttattttttaaatcaagttttagggtaaacgaaaagcccatcgcttctaagacatcattaagatagtctgccagatcctgtgcgattttatctagatcaagatcatcctctgacctcgcttctttcacaatttctgatggattaacgattccctgattattagaagattctgtatgtggttgattatttaaagcggttttgatttgtgtttggtttgtgttttcttttcttaatagttcaatcttagcttgtttccgaccgatgccaaagaaaccattccttggttgttgaatcactttaacttcaacttggtccttattgagtgataattcagctaagccttgcttcactgcgtcttggatagttttgccagagtaaattgtcataataaactccctttaatggatttaactgatttataatagcataaatcattacattaataaatggtttagcaaaaaaaacgcaaactaaacgcaaaccttaattattttgtgatatttgcaatcaccatttaacattattttgataaagccgatataattaaccttggtggctctattattaatcgaatgagatcattaaccatctaaaatgatcgtcaggttctcgtttttaggaagtgagcatattggcaaatataaatcagtacgatgccggtcggaatattatcattgatcgccagcatcgcttaaataaattacaggaagcgcagaagattacatatgccaatctaagcgcctacgcggttattatgacagcggaactagttattggatactggaaccatattaccgttttgattgctgatgggttaaataacctgacaggcgtttgcggcgccgccattatcataacgggcttaaaaatttcaaggcggcctccagattccaatcatgtgatgggtcactggcaatacgagaatattgctgcctttttatcagcaactattatgtttgcaattagtattcagattcttgtggatggcgttttttccgttcgtagattttttcagggggttgccgttcagccaaatttctggtcgctgggcgtcagtttagtttctgcggccactatttctatacttgccaaatataacgctttgaagggaaaccagttaaataaccaggcccttattgcctctggacaagacctaaaaagtgatgcatggacaagcttcggtacttttttatcaatcggaggtgcttaccttggagctcagtggctggatggggttgcaactattatcgttggctttttaatacttcatgcgtctatcttgatttttcgaacaactattatgagactaacagagggttttagtcctaaagccattgataactattcaaaaaccattaacgaaatccccggagtattgggtgttcaaggaattgagcctcggtggcttggtgaccaaattgtcatgaaggtcggcgtttatttggctgatgatacccgcctaacaaaggcatattcaattggtgaaaaagtagaacacgcacttatgaaaaagtatgatattttggatgcagatgtaatggcctatccggtaagcctaaagaacgatcctaaccacgttgactagcaagaaacggtgttcaatcactatccttaggtgagtttttattaggtcgccatgttttaatcaattttctgtattattcagcatattcaacttgtaggttcccgttttttcgagaactaagtctgacaacttcttgttgtttattctagattaattgcgtatactaaatgcaagaataatctcagtacgaattattaatttatgttataaagtataattagcacatttgagagcccgctatgattcaacgggaagcaatggtcaatcatcacaggcttctggtctctggtgattttttctttacgtagtttatgcccgaataaaccgctagctggtcttacacaagaggaaaataacatttactaatttaagattttatcaacaattaataattcgactaaatcagggaggtctttaaatgtctagaaaaattggaattatcggaatgggtaatgttggtgccgcagcagctcattatatcgtatcaaccggcattgctgatgacttagtattaattgatttacgtgaggataaggtaaccgctgacgcgttggatttccgtgacgcattagttaatcttccttggcacattaacatcacaacgaatgattatgctgctttaaaggatgctgatgtgattatttcagctattggtaatatcaagttacaagacaacgctaatgatgaccgatttgctgaattaccatttacaagtcagcaagtaccattggttgctaaacaaattaaagactctggattcaacggtaaaattgttgtaatcaccaatcctgttgacgtcattacatccatctatcaagaagttaccggtttacccaaaaaacatgttattggaacaggaaccctcttagactcagctcgtatgagagcatctgttgccgacaaattaggaatcgattctcgttctgttattggctacaatttaggtgaacatggtaattcacagtttactgcctggtcaactgtccgtgtacttggtaaaccaattactgatatcgcaaaagaaaaaggattggacttggatgcgcttgaccaagaagcccgcactggtggatacacggtctttcatgccaaaaaatacacgaattacggtgtttcaacagctgctgttcgactagcttatacgattatgagtgatgctaggacagaactacctgtctcaaactacagggaagaatacggcacctatttatcctacccagctattgttggtcgtgacggcattttagagcaacttcaattgaatctaactgatgatgaactaaagaagctccaaacttctgccaattatattaaaacaaaatatgcagaaagtcgtcaaaagtagtcatcactataaaagttaacgcaaaacccccactttggaaaaatccaaggtgggggtttttataaactatttacgtttgcttcgtttagcctttttaattgctcgttgaactgcgcgtttgtgttcacgttcttctttttgcttttgctcgcgttcacgccgaattttccacggattttgaatcactaatgtttgaccaacttggaaagcattagtgattacccaataaagagataaagctgaaggtaaactgacagccataattaaaatgaagatcggcatcccaatagtcatcatagttgtcatagaatttgattcaggctgccccttcatcgccaaccaagacgaaatgaaagtaaataatgccgccaaaaccggtaaaacaaagattggatcaggatgacccagttgtaaccagaaaaatgtaccacttctcaaaatatcagttcgccaaattgcttgatacaaggcgaacaaaattggcatttgaacaatcattggcaagcatccggcaagtggattaatacctgcctccgcatacaacttcttttgttcagcctgtaacttttgcattgtttcagcatctcgtgaagaatacttcttttgcaatgccttaagttgtggttggacttcctgtgttttacgcatgctacgagtttgataaatcattaaaggcaagataacaattcgaacaagaattgtaaatatgataattcccattccatagttatcactgaaaaacttagataaccaaatgattgctcgagaaaagtttaaaacaacccagccatcccaaattccagtactgtgttcagtaattgggctattactacaagcagacaaaacaaccgttaaacttagtagtgataatagtaccgatattttctttattctttttttcaatgtttttccccaccatcatagttggaatcaagcagccttgccagcttaaaaacgtgaatcaagctggacttaacatctcgcatcgacatctgatcagtagatggacgtgctattacaatgaagtcgacatcttgacgtaaatcaggttttaactcaaaaattgcctgtctaattcgtcttttgacccaatttctatgtactgcattcccaatttttttcccaacagaaatcccgacgcgaaaatgtaattgatccggtttgtccaacgtatatacaacgaattgacgattagcaaccgagttatgagtttcaaacactttctgaaactcagcctctttttttacacgatacgattttcgcatgatccatctccacataattaaaaataatgaaaaagaccactgaatggtcagtggtctatgcagacaatacttttctacctttttgacgtcggcgtgctaacactttacgaccattgctggtactcattcgtttacggaagccatgaacgcgagcgcgatgacgcttctttggttgatatgttcttttcattagaaaccctccttttataattcaaagaaattagcgtttaagcatttaatatcggatgttcaaatgcatttccctaacatattaacatagtttgtctataaatgaaatacacttttttaatctcaaaaaaatttctaaaaaagaaaaatttgtttcatgcacaaaaactgtggataactcccctgtttaatatagtgaactttaacgaattccacaggcttgtccacagggtcacagcttgtttttaatcttatccacagcctgtggataagattagtcatcttttctaaaaaagctgataatagcggctttagttatccacatctgcctgttaattatctacccttttctttagtttttccacttatccacaggcacgttataccttctgtccacgtctgtgaaacaattatgcacaggctgcttttgcctgtggaaaacttttgtttggaatgctagaattaatttgcatttcttataacgactatttaattaggggggatttcaaagtgttaaataaagattcactgtggcaaaaattaagcacagaatttcgaaaaaataccactgatcttacatatgatacgtggattaaacctgtcacacccgttgattttgatggatcaactcttactttatcccttccttctgaattacaccgagattattggaaagaacaactggctcctaatttaattgaatatgcctttgtcattacaaagggaaatattgaaccaaaatttattctagactcggatatcaaaaaggaagcacaaaaaaaagaaccggccaaagccgactctacagctgacgatcaagatgaaactttttcatttagtaaagaaactcatctcaacccaaattatacatttgataactttattatcggtaaaggaaatcagatggcacacgcagctgcattaatcgtttctgaagaacctggaaaattatataatccacttttcttttacggcggcgttggacttggaaaaacccacttaatgcaagctatcggtaataaacgacttgaggaccatccagaaacaaacgtcaaatatgttacaagtgaagcattcaccaacgattttattaatgccattcaaaccaatagaacagaagagttcagacgtgaatatcggaacgttgatttattaatggttgatgatattcaattcttcgcccaaaaggaaggaacccaagaagaatttttccacacttttaatgatctatataataacgacaaacaaatcgttttaacatcagatcgggtaccacaagaaattcctaagcttcaggaacgtttggtatcacggtttgcatggggactacctgtagatattacgcccccagatttagaaacccggattgctattctaaaaagtaaggccaaacttgataacttaacaatcccaaacgaaacactatcatacattgctggccaaattaattccaatgtccgtgaactcgagggcgcgctttcaagagtacaagcttattcgaaactaaaaaatgaaccaatcactacggacttagtttacgaagcacttaaaggattaaagcttgcaaaagcaaataacgaattatcaattatggacattcaaaacaaagttgcaagttattttcatgtgactattagtgatttaaaaggaaaaaaacgaatgaaatccatcgttattccaagacaaatcgcaatgtatctttcacgagaaatgacaagcaattcccttcctaaaattggaaaagaatttggtggtaaagatcatacaaccgttattcatgcgtgtgacaaaattgcagaagtcatcaaaatcgatgctgacattcgtaaagaaatctcagatatcaaaaccgcactaagctaaatggtataatgggttgtggataattcttgaaaaagtcaataagttatccacaactttatccacaggatcatcctcaatagcatcagcagaattaatagttatccacaaatccacagggactactattactgcttttttgtttattgatttattaatttaattaatataactctccgggaggttaactatcagtatgaaatttacaattagcagaacagaatttacaaaggcattaaacacagtttccagagcaatctccacaaaaacaaccattccaattttaacgggtttaaaattacaagctacacaaacaggacttatcctgactggaagtgacgctgatatttctatcgaaacaaccattaaaacagacaatcctgataatttattagctattgaatcggaaggtgccattgtgttacctgcaagatttttcaccgatatcgttaaaaaacttcccgaagaaacactcacaatagaagtaggtgagaattttcagacaatgattacatcaggtccttcatcatttacgattaatggtcttgatgctaacaattatccacacctacctgaaatagaaacaacaaattcaatcccattagctggggacttgctaaaacaaatcataagccaaacagttattgctgtttcaaatcaagaaagccgtcccattctaactggtgttcactttatattatcggacaccaactttttagcagtcgctacagacagtcatcgattaagtcaacgtaaagttatcttggaaaccccaatcaacggttcgttcgattttgtcattcctggaaaaagtttggttgaattatctagaatgattgacgacaataaagaagacatcattttatctgttacagagaatcaggcattatttacaattggagatactttgttctactcccgtttgcttgagggtaactatcctgatacatcacgactaattccagattcacacgatacaaggatctctttcgatgcaccggagttactcgcttcaattgaacgtgcttcactgctatcacatgcttcccggaacaatgtagtcaagattacagttaaacctgaaacaaagacagttactatttatggtaattcgccagatgtcggtaatgttgaagaagatatggaaccaaggagtgtggaaggaaatgaactggaaatttctttcaatccggattatatgaaagatgcattacggtcgttcagtcaatcaacaattaatctagatttcacttcatcgttacgtccatttaccctaacaccaactgaagatagtgatagctttgtacaattaattacacctatccggacattttaatcatcaatatctaaaagttgttttatagtttttaatatagggactcaaaaagtttcagcataacccataaagggttaagctggaattttttttacttctaaaacaagttgaaacgtgcttaagaaatacattatcaactaataaattcaatctttatttaatgcttataatcactttatctcggtcaaaataaaaaaatacgtattttcaacatatttgctcatatgcgtgtttcttagaagtttttacgcttttttgacaaaagtgcctaaaaattaaagaacagctcagagtgcgtataaacagccgcagccgtatacttttacgtaaaaatggcgtataatatgtatgtgtaaaaggtgggtgaaattgtgaaaaaagaaattttcattgatagaccttatattactctgggccaattacttaaagaggaatcgattatcagtagtggtggtcaagccaagtggtatttaagagaacatactgtaaatatcaatgacgagcctgataatcgccgtggtcgcaagctatacgctggagataacgttgaggttccagatgttggcttattttttattcgctcaaagcaggattctgaatgaagttgaaagatatttcgctgcataattttcggaattatattgatcaaacactgcaattttcagacggaattaatgtatttcttggcgaaaatgcacaggggaaaacaaatttgcttgaggccatctacgttttagcacttacaaggagtcatagaacgtcaaatgagaaagaattaattaattggcaaagccaaactgctcaattaaaaggtacaattcagaaacaattaggaaaagttccaatagaactggatttaggaacaaagggcaaacgtgccaagattaatcacttagaacaagcaaaattatcaagttatgttggtcaattgaacgttattttgtttgctcccgaagatctttcaatagtaaagggtgcaccacaagtgcgacgtaagtttatggatatggaatttggccagatgagtaatcgttatctatacaattccacccagtataaaaaaattttaagacaacgaaatcgatatctacgggatcttcaacataaaattcagtcagatagggtatatttagatgttttgtcggatcaattatcagcatatggtgctgaaattatttatcagcggatacagctattaaaaaaacttgaaggatttgcaaaaaatgttcatacagagatctctcaaggaaaagaagcactgacgtttctttaccagactgccgtacctgacgaacaattaacatctattgaaaatatttatcaaaatctactaaaacaatttgcagatatcaaagaaaaggaaattcagcgcggtaccactctcttagggccacatcgagatgaccttaagtttgctatcaataaaaaagaagttcagtcctttggctcacaggggcaacagaggacaaccgcactttcagttaaacttgcagaaattgatcttatgaaagaacaaacaaatgaatatccaattttgctattggatgatgttttgtctgaattagacgattatcgacaaacacatttattaacagcaatccaagacaaggtacaaacatttttgacaacgacaagtttaagtggtgttcaacaggaacttcttagcaacccaaagatatttagaattgcaaacggcaaagtaaatttagaagaatcgtaaaggagacagaacatggctgatcaaaaagaaacaaaaaaagaacttgcaaatgaatatgatgccagtcaaattcaagttcttgaaggactggaagctgttcgtaagcgtccaggtatgtatattggaaccacatcttctcaaggccttcaccatcttgtttgggaaatcgtcgataacggaattgatgaggctctagctggatttgcgacaaagattactgtaacagttgaaaaagataatagtattaccgtgactgatgacggtcgtggaattcctgtggatatccaaaagaaaacaggtaaacctgctctggaaacggtgtatacgattttgcatgccggtgggaaattcggcggcggcgggtataaagtttcaggtggtctacacggtgttggtgcttccgttgttaatgccctttcagaagaattggacgttgctgttacacgaaatgggaaagtctattatatggacttttcacgtggacatgttaccactccaatgaaagtgatcgatcatgtgtcagatgatttacatggtactaaggttcactttttgccggatcctgatatttttagggaaacaacgacttttgatatcaaagtattaacagcccgtcttcgcgaactggcgtttttgaataaaggacttcggattattgtccgagacatgcggcctgaaaaaccaacagaacaagatttcctttatgagggaggtattcgacactatgtcgagtatcttgataaagataaagaaacattgcttaaagaaccaatttacgttgaaggcatggataacgggattaccgttgaagtggccattgattattctgaagattatcatagtacacttatgacctttacaaacaatatccatacttatgagggaggtactcatgaggaaggatttaagcgtgctttaacacgagttatcaatgattatgctcgtaaaaacaacttgcttaaagacaatgaagctaacctttctggggaagatgttcgtgaaggaacaactgccgttgtcagcattaagcatcctgatcctcaatttgaaggacaaactaaaactaagcttggaaattcagatgctaggactgttacagatcgaatctttagcgatcatttttcaaagttcttaatggaaaatccgaagttggcacgaaagattattgaccgtgggcttttagcttctaaagcgagatctgctgcaaagcgtgctcgtgaagtcactcgtcgtaaaagtggccttgaaattagtagtttgcccggtaagttagctgacaataccagtaaggatccgaaaatatccgagttgttcatcgtcgagggtgattctgccggcggttcagctaagcaggggcgtgcacgattaacgcaggcaattttaccaattcgagggaaaattttaaatgttgaaaaagcaagtatggatcgaattcttgctaacgaagaaatccgctccttgtttactgcaatgggaactggatttggtgacgattttgacttatcaaaaataaattatcataagttaattattatgaccgatgcggatgttgacggtgcgcatattcagacgttgttattaaccttgatctatcgttatatgagaccattaattgacgcagggtatgtatatgttgcgcagccgccattgtatcaggtgcgtcaaggaaaaatgcaacgttatattgattcagatgacgatctgaatcaattcttaggaaccctacagccatcacctaaaccagttattcagcgatataaaggattaggcgaaatggatgctgaacaactttgggatacgacaatgaatcccgaaaatcgtcaccttctaagagttgagtcttcggacgcagcagaggccaaccacgtattctcaatgttgatgggagataaggttgaaccacgacgcgagtttattgaagataatgcaacgtttgttgaaaatcttgatatttaattaatcatagaaatgtccgttcttaacgatgattgcgtgacatttactaagataatgtttcatgtggaacattactgctcttaattttgaatggaggtaaaaagtttggctaacgaaactaaccaaggtggggattttccggggagaatcacgaatgttgatttgtccaaaaagatgcgaacatcatttttggactatgcaatgagtgttattgttgcccgggcacttccggatgtccgtgatggattgaagcctgttcatcgaagaattctttacgatatgaatgaattaggcgttactcctgataagccatacaaaaaatcagccagaattgttggagatgttttgggtaagtatcatccccatggtgatacggctgtttatgaatcaatggtccgaatggcacaaacttttagttatcgatatatgttggttgatggtcatggaaacttcggttctgttgacggcgatggtgctgcagctatgcgttatactgaagcccggttaagtaaaatcgcaatggaaatgctacgcgacattaataaaaatacaatcgattttgttccaaattatgatggtaccgaaagagaaccaagtgttttaccatcacgttttccgaacctccttgtaaatggtgcctccggaattgcagtgggaatggcaacgaatattccgccacataatctttctgaagttatcagtgctattcatgtattaatggataatccggatgctacaacagcagatttaatggaagtgctgccaggacctgattttcctaccggcggagttgtcatgggtaagtctggtattcgaaaagcttatgaaactggccgaggttcaattattttacgtgcaaaggttgaaattgaaggtgaggcgagtggcaaacaacggattatcgctactgagttgccttatatggttaataaagccaaattaattgaacgaattgctgaattagcaagagataagcgaattgaaggtattacagatatcaatgatgaatctgaccgagaaggaatgcgggttgtgattgatgttcgaagggatgccagtgccgaagttattttaaataatttatataaattaacgttgatgcagacatcttttagttttaatatgcttgcaattgttaaagggacaccaagaatcctgagcctaaaagaaattcttcagtattatctggaacaccaagttgaggttattacaaggcgaacaaaatatgaattgcaaaaggcccaagcaagagctcatattctggaaggattacgaattgcccttgaccatattgatgaaatcatcaaaatcattcgaggatctcagactggtgaagttgctaaaaatcaattaattacgggttttggcttaagtgataagcaggcccaggctattttggatatgcgattggttcgtttgactggcttggaacgcgaaaaaattgataaagaatacaatcagttaatgaaagacatcgaagattttaaagcgattttatccagtcgtgatagagttaaccaaattatttatgaagaattgttagaaattcagaagaaattcggtgacgaacgtcgaaccgaactcttagtgggtgaagttcttagtcttgaagatgaagacttgatcgaggaagaagacgtcattgtttcgctcactcataacggatatatcaaacgattaccaacgacagagtttaaagctcaaaatcgcggtggtcgtggtgttcaaggaatgggtgttcatgatgatgattttgttgaacagttggtttcaacttcgacacatgacgtactgttgttctttaccgatgcaggtaaagtttaccgtatgaaagggtatgaaatccctgaatatggtcgttctgcaaaaggaatcccaattgttaatttattgaatattaattctggagaaaagatcgaagcggttattaatgtttctgatcgcaaaaatgatgtccaaaaagatcttctctttgtgacattgtatggaacagttaagcgtacgcctgtttctgattttgcaaatattagaagtaatggtttaattgctattcaccttaaagagggtgatcaattaattaatgctttgattattgatcaaaatcaaaacgtcattattggaacccatcttggatatgcaatgagctttaatgcatctgatgttcgctcaatgggtcgttcagctactggggttcggggtattcgcttgcgtgaaaatgattacgttgtcggtgccgatgttttgaatcctgacagtgaagtctttattatctctgaaaaagggtttggtaaacgaacgccagctgcagactatccgattaagggtcgtggcggaaagggtgtcaaaactgccaatatcacagaaaagaacggacctctttcaggattaacaactgttagtggcaacgaggatattatgttgatcactgataaaggggttatgattcgatttggaatagaagacgtttcacaaaccggtcgttctactttgggggttcatttaatcagaattgatgaagattcaaaagtatcaacgatggccaaggtggagaaacaagaagacgaagctagcagcgatgcttcgaagggcaaccttatgagtagcaatggtgatacatctgaagattcagattcaactaactaaattaatagaccgtttttaagaaagcaaagtaagtattgggataattccattatttactttgtttttttagataaaaatcattgacttactttttgtaagtgatattctgaaatcaataactttacgaaaaagcggaggattttaaaatggttgttgtaaatggatacaaacaaaatgaaaatgaaaagaaactgaatgttttgaatttagatcagttggaaaaacaggcaaaggaaataattccaaccggtggttttggttatatatccggtggctctgaagatgaatggacattacgagaaaatcgtcgtgcatttacacataagcaaattgtgccacgagcattgacaaatattgagaaaccggaactggaaacaaatgtatttggaattccactaaagacacctcttttcatggtaccggcagctgctcagggccttgcacatgcaaaaggagaagttgatactgctaaaggtgttgctgctgtgggtggactaatggcgcagagcacctactcttcaacctcaattgctgatactgccgcgagtggaaatggtgcgcctcagtttttccagctgtacatgagtaaggattgggattttaacgaggcgcttttggatgaggcgaaaagagcaggggttaaaggcattattttgacagtagatgcaactgtcgatgggtatcgagaagctgacattatcaataacttccaatttccaattcctatggctaatcttactaaatacagcgaaggtgatggtcaaggtaaaggcattgctgaaatttatgcttcagctgctcagaaaatcggtccggatgatgttgcacgaatcgcaaattatacggatttgcctgttattgttaagggaatcgagtctccagaggatgcactttatgcaattggtgcaggtgcatcaggcatttacgtttctaatcatggtggccgccaattaaatggtgggccggcatcgtttgatgtattggaagatgttgccaaagcagttaatgggaaagtacctgttatttttgattccggtgttcatcgcggatccgatgtttttaaggcacttgcttccggtgcagatttggttggaattgggagaccagttatctatggattagcacttggtggtgctcagggcgttcagtctgtatttgaacatttggatcatgagttagagattattatgcagttggcgggtaccaaaacgatttctgatgttaaaaatgctaaattgttaaatattcgatattaactcaacaaaatttttacgaattcaagttcacatctgacttgaattcatttttatttatttgaagaaacaaattcattattgccgtatataattaatgtatcgtaaatcaatttaggcatattgatcttttatcggaaacatgttactattcttatttgtgagtatctgagtaaaaacagaaactctccttgctctcgggaagggagccataagtccataaggaggtgcaatcatggaagaaaagaaatacgaaatcacttacatcatccgtcctgatatcgaagaagcagcaaagtcttcacttatcgaacgatttgacaaaatcgttactgacaatggtgctaagattcttgactcaaaagactggtcaaaacgccgtttcgcatacgaaatcggtggctacaatgaaggaacttatcatattatcacattaacaagtgataatgatactgccttgaatgaatttgaccgtttatcaaagattaatgacgatattttacgtcatatgatcgttgttcgcgatgactaataaatcattctaactatgagaggagcagattcagcatgcttaatcgtgcagttttaacgggacgcctaacccgtgatgttgatttacgatacacacagagcggaacggctgttggtactttctcgttagcagtagatcggcaattcactaaccaaaaaggtgaacgtgatgccgatttcattaactgtgtaatctggcgtaaatccgctgagaattttgccaactttgttcataaaggatctcttgttggaattgatggtcgtatccaaactcggaattacgaaaatcaacaaggacaacgggtctatgtgactgaagttgttgtagagaactttgctttgcttgaaccgcgttcagcacggaacaacaatgcaagtaatcagcaaaacggtaatgctcctcaacaaaataacggaaatagtaatccattcgataataataattcgaaccctaatagtagcagtaacaataatggtggcaataagagtaatcctaatgacccatttgctaactcaggggactcgattgatatttccgatgatgatttgccattctaaactagaaatggtgaagagactttcatgaggaggaactaacatggctcaacaaagacgtggcggccgtcgtcgccgtaaggtcgattttatcgctgctaatcacatcgaatacatcgactataaagatgttgatttgttgaagcgttttgtttcagaacgaggaaaaattcttcctcgtcgtgtaactggaactagcgctaagaatcaacgtaaacttacaattgctattaaacgagcacgaatcatgggcttaatgtccttcgttgctgaagactaatagtgttttattaggaggtctggataaaacttcggttttatttggacctctcttttatattcataaagaaataccatgcaaccattattgaagataaatgcgatagataattgcattttgaaattcttcagaaaaatttaatctttattttatggtaaaataaaaatattaagcatagtaattcaagaggataaaaaatgaaaaattggttttctcgtaatagtggtgaactaccaccatttgttcataatcgccgtttgcgacgaataatgttatttatcgcacttatcgtaatctatggtgtggttatctcatttttatataatatcgtggcttcagccattcttgttatcattagtattatgggactcatctatacaattgtgatgatgaatgagatgagcacggatacaaatagatacatttcggacttgtcctatcggattcatcgcggtgaacaggaaagtttgttggaaatgcctatcggtgtcatgattttaaatgaaaatggattggtagagtggacaaatccatattttactagatattttaataatgaaaatattcttggaaaacgaattgaagatgtagatcatgacctacaacagttaatgatgaagtatggagattctgatgaatttcatactgttacttggcgtgatcataagtttacaatgctgattcaaagtgagtatcattctatttatatgcttgatatcactcggtatgcaaatttggaggaacgatatgaagaagaacagatttcagttgggcaaatatttttagataattatgatgaaataacccagtcaatgactgatcaggaaatttctaatttgagtaattatgtgacaaacgaattagcaacctggtctaaaaaatacggtatgtatttgaaacaaattgatgatgatcactttttcttattggcatatgccaaatcgttgacccagattgaaaatgataaatttaatattttggatatcgttcgtgaaagtacatctaagcaaaatttcccattaacacttagtatcggaatctcgtatggagaagatgacttaaatagtttagctgatcaagcacaaagcaatttggacttggcacttggccgtggtggtgaccaagttgtcgtcaaatctttggatggtacggctagattttatggtggtaaaaccaacccaatggaaaaacggactcgtgtccgtgcacgaatgatttctcaagcgttaaatgaattgatgggggatgctgaccagatattcgttcaaggccatacacgtcccgatatggactctttaggtgcttgtatggggattcgccgaattgctcaaatgaataataaaaaatgctggattgttttggataaagaaaaagttcattctgatattcagcgacttcttgaggcagcaaaaaaatatccggaaatcagtgatgccatcatcacgccagctgaagcactttccaaggtgacagatagtagtcttttaattatggttgatcattccaaaccatcaattagtatttctccggatctgtatcagcgtatgacccagaaagtggttatcattgatcatcataggcggggagaagaattccctgaaaacccaatgctggtttacattgaaccttacgcttcttcaacttgtgaattgattaccgaaatgtttgaatatcaaccacacgaggaagaacccattaaccgtattgaagcaacggctatgttgactgggatctttattgatacgcaatcattctcaatgagaactggtaccagaacatttgacgctgctagttatcttcgttcagctggagctgactcagtggaaatgcagcaattaatgaaagaaaacattgataactatttgcaacgtaatcaccttatttcaatggttgaattcttccataaagatatggccatgattgtgggtgaagaagatcgggtttatgatccggtaacggctgctcaagcttgtgattcattgcttacgatgtcaggtgttgatgcatcatttattatcactaagcgttcagacgataaaattggtgtttcagctcggagtaccggctcaataaacgttcaaatcattatggaacgaatgggcggtggtggccatctttcaagtggagctacccagattgaagataaatcgattgcggaagtcaaacaattactgcttgaaacgatcgactatatcgatgataatgaatagagaaaccaaattttgaggatagtaggagtgatctgttgtgaaagttatttttctagaagacgtccgtggtaaaggtaaacgcggtgaagttaaagaagttccagacggctatgctcaaaactttctgattaaaaatggcaaagcaaaagcagcttcccgtcaggcaatgagtcagttgaagggtcagcaacgggctgaacaaaagcgtgaagaagaagagcttgaagaggctaaggccgttaaaacaaagttggaagatgacaagacagtcgttgaattaaaagccaagtcgggaaccgatggccgtttatttggttcaattccaagtaagcagattgcatcggctttggataaacagtatggcattaagctcgataaacgaaaaattgagttgggcgaaccaatcaaggttgccggatatactaatgtgccggtaaaattacattctgaagtaactgcacgaatcagagttcatgtatcagaaaaataattgataggtttgcaaaatgggctgggagcaaaacgattaacatcatttgtctccagtcccttttgtttggacagtatttaatttttatgttagaacaatatgattgatgtttttaaaactactagaaaacctgggtttaagattaaattggtgactattaatgaacaatgatttagtaaatcaggtgccacctcaaaatattgaagctgaaaaagcggtactgggatcaatctttctgagtaccgacgctttaatagatgcgatggaataccttgatccaaatgatttttacaagcattcccaccagattatctttcaggcaatggttaagctaaatgatgatgaccaagccgtagatggtattacggtgacggatacgcttaaagatcaaaacaatttagatgatgttggtggataccaatacattacagaactggcaaatgcagtgccaacagcggcaaacgtcacttattatgcaaagattgtcaaggacaaagccattttaagacgtttgattcagacggctacaaacattgtgacagatggttataataccgatgaagacgttacaactgttttggataacgctgaacgtgatattatgaatgtcgcggaggatcgtaatcagtccggttttaaagcgattaaagatgttttgaactcggcgtttaataagattgatgaattatcgcaggaaggtgaaaccgtaactgggctttctaccggatatcctgaacttgataaaattacgaccggactgcacaatgatgaattagtcattttagctgctcggccggccgttggtaaaacggcgtttgcattaaatgtggctcaaaatgtcggaaccaaaacagataaaactgttgctatttttagtttggaaatgagtgcggaatccttggtagaccggatgttatgttctgagggcagtattaatgcaaaccatttgagaacaggccaattaaccgaagatgaatggcaaaaccttgttgttgcaatggggagtttatcacgagccaatatttttatcgatgatactgcgggcattaaaatgtccgaaattcgtgctaagtgtcgtcggctggctaaagaaaatggtaacttaggacttattgtaattgattatcttcagttaattgaaggtggtcaacaagaaaacagacaacaagaagtttcatatatttctcggcaactaaaaaaattggctaaagaattacacgtgccggttatttctttatcacagctctctcgtggtgtcgagcagcgtcaggataagcgaccagtactatcggatattcgtgaatcgggttctatcgaacaagatgccgatattgttgcttttctttatcgtgatgattattatgagcgagatgatgatgacgatagtgattctcagggtgctgacgatgaaaatgatgttggtgaagttgaggtcattattgaaaaaaacagatcgggtccacggggaacggttaaactattatttgtgaaatcttataataagttttcttccatctcttatgcacaagatggcggatagttattttgtcgttgttagtcaaaaacaaagaaagaccggggcgagcgtcccagtctttctttatcatcagtataaaaaaataacaaccacggcattgaagcggcgtggttgttatttagtggtttatgtaatatagtgggcagtcaggggttcgaaccctggacccacggattaagagtccgttgctctaccaactgagctaactgcccatcactaaccgacttaaatataataacatggtgaaaaaacttttgcaatagcaattttaaaaatttacttacaaggcagtggtaatattgatttaaaggcagagtggtttggtcttttgaaccaatccggcccacttcatacactgtgttataatagcatcatgttggcgtgtgcaaattttgaaataataacaatattaaaatccatgttaggagaaattgttaatggctaaaaaaatattggtagtagacgacgaaaaaccgatcgtcgacatagagaagttcaatttaaccaaagaaggttatgaagtttttgtagcctatgatggtgaggaagctttaaaacaagtaaatgaagttgatccagatctcatcattctggatttaatgttaccgaagattgatggtctcgaggttgctcgagaagttcgtaaaacaaaagataccccaattattatggtaactgcaaaggattctgaactcgataaagttcttggacttgaattgggagccgatgattatgttaccaaaccgttctctaatcgtgaattagtagcgagagtaaaggctaatttacgtcgtcagggcacttcaagcggaaactcaagtgaaggcgacgaaaataaagatattaagattggcgatttagttattcatccagaggcatattcagtttctaaacgcggtgaaaatattgaattgacacatcgtgaatttgagcttttgcattatttagctcaacacatcggtcaggttatgacgcgggaacatcttttacaaactgtttggggttatgactattttggcgatgttcgaaccgttgatgtaacggtccgaagacttcgtgaaaaagttgaggatagtcctagtcacccaacttggttagtgacacgacgtggcgtagggtactaccttaggaatcctgaaagtgatcaacagtaagtttgagagaagataagaatgtaaggggtattaactggttgtgaataaccgaatcaaattttaccaatcaattaaatttaaaatagcgctggttttcgccctcgttttgttagtaactctggaaattgttggtgccgtatttgtgaggcaattggaacaccaaaacctctcaacctttaccaaccaggtgcagttacagtcttacgtgaagaactcattgatcactgaactttcccgttccaataagacgttggctaataggcggatcaaaacaattttaaatgattctgacagtagcaacgctgcacaaattcaggttattgataataaaggaaccattcgtggaaccaatcaagttaataatcaagcagtagttggtcaaaaaacgactgataacgatgttaagaatgcaatttataacagtcataaaattgaaaagaacacttatgattcatcgagtaatacgagatattacacgttgatctcacctttgataaaaagttcgggaaatagcagtacgcttgtgggtgtcgtttatactaaagccaatttggacacagtataccgaaacattaatagcatcactgtcatctacttgtttgcggcctcaattgcgatcatcttgggccttttaatttcaatcgtgatttctcgagcaattacgcgaccgattgaagaaatgaaaaagcaaacgattcgaattgcacgtggtgattattcaggtcaggttcatgtttacggaaatgatgaattgggccaacttgccagtgccgtcaataatttgtccgttagggttgaagaatcccatgaatcaacagaatccgagcgtcgccgtttggactctgttttggctaatatgacagatggcgttctggcaacggatcgtcggggtaacgtcattattattaatgaaacggctgctagtttccttgatcttgatgaaaatcaggcaatgggaaaatcaattttagatgttttggatattcgtaaagattatagtctgcgggatttgcttgaaaagccggatgaactgattcttgatttttcaagtgatgatcacagtctcattttgcatgcccatttttcattaattcaaagagaatcggggtttatcagtggattagtctgtgttctgcgggatattaccgaacaacagcgaattgaccaagaccggaaacaatttgtttccaatgtttctcatgagctgagaacgccgttaacaagtgttcgatcatacatcgaagcattgcacgatggtgcttggaaagatcctaagttggcacccaagtttctaaaagtcacccaggatgaaactgatcgaatgattcgaatgatcaatgatctattgacattatcacgaatggattcaggcactcaaaaaatggaagttgaacttgttaatattaacgagttgttcaattacgtattaaatcgattcgatatgattcttaaaaaagatgaacatcctgaaaaaatgtacaccattaagcgttattttaccaaaagagatctatgggtcgatctggatacggatagattcacgcaagttcttgataatctaatgaataatgcgattaaatattctccagatggcggtgtgattacctgtcggttgtatgagacacgtaataaggtcattttaagcgtcagtgatcaaggccttggaattccacgtaaagatattccacatatttttgatcgtttctacagggttgataaagctcgttctcgccaacaaggcggaagtggtcttggcttagcaatttctaaagaagttgttgaagcattgcatggtcaattatgggcggaaagtgtcgaaggaaagggatcgactttctatattgcgttgccatatgaaccgctagaagaggaggacttatgggatgaggtttagtaaatacttgataccaatcgcactaaccattgcggtgatcattagtctgacgctttcagttgtcatttggacaaaccctgccaattataaaaatcggcagaattcatcacaaaatacgcaaaatgaagaaattactaagccgaaacgttatgtttacgcaccaactcaggctatccatactgatagtaatggcaatcaaaccattttagttaatcgattggttaattcggtagctgaaattcaaaaaacgatgcatggctataaaaatgttcatttaaaaacactgagcattaaatctcaggataagtattttcagattgctaatcggcccaattcgattatgttaaattacgtaagtccggtttcgattagagttattagtgatgttacaaacaaatattttgaaaaattaccgaatcatcaagtttcacgaattgtcttgccgacaaataattcaacgaggatctatttgctgaatgataaaaattttgcggtttatcaaattaaagttaaaaaacatagtttgaaaaacttaaacaaggttttgaatatgaatattcggcgagtacctgcctctcttcaactatttaacggacagccaatgatttacgttaaaagtcaaattcagatgcaaccctacaagtacctaattgatcgtcagtctgaagattattatgtaagccgactattaaataatagagattcacaaagtaatgtcaccgttaaacgccggaaaaacctagtcacctatagtgatcagaatacgcttcaattggcatttaattcgcgaaccagaatgggaaccttttctgattttagaaataatagtgatcagcaaagtgtgacttcagtacttgatgattcatacgagcaattagtggatttgggattgccattggacagtgttcgatttttcaattatgatacaaattcgcgaaccgtttcgtatagaacctttgttgaaggatttcccatttatagagcaaatgggtttgggacaatttccactcagaccttgaatgccaacgctaaacggttgcagttttcactggataacccggaagtaccaattccaagtaaacaggggtatagcacattgccagcaactgagactgctattcggcgtttgattgcaaagggatatcatgcaaaagatattcgtgatttacgaattggctatggttggcaaaaagataaatcatcacaattgctgattaatttgataccggattggtacgttaattataaaggcacttggcgcagttattcatcgttgattaaccgatattgatagtgaaaggagggggagccgtttgaattttaggcgaatagagatcattttcctggtaacgtttattgcaattgatatttttttgtttggaatgtttgagcagaatatgaatatgcaaaccgaaaacgtgtctcagggtgattctgattcaaaaattatcaaagaaatgaaagatgaccagattaaagtgggtagcctttctaaaaagaaaaattttgcgtattacctttccggtacgcaaaacgataccttacgtaaccagatgggtcagctgttaaatcagactccccactatgttggctatgaactggatagtgaatttaaggatcctgttaaagttaataaggataatccacagcaatctattaataagttgttgatggacccaaccttcgttgcttttggcgatcaatatcaatatagtaaagacttatcgacaccgcgaagtatcgtctatattcaaaaggcaatgggtggtttaatgtattcgactgaagcgcaaatcaggtttacgctgaatggtcgttatcaaatcgtgagttacacacagtcttacttgcaggatattaaaagtttacgtgaaaaatcggagacaatttcggaaactcgtgctttaatatggttataccaatacaatgagattccaaataacacaaaggtagcctgggcaaaactaggttatactaaattgttatccattgacgatgatcgcgtttttattccgacttggattatcgcaatcaagccccaaaactcaccacaggttcagcttaaaaagattaatgcctttaccggtggtatcataaaagaaacgaatgaaaacttgaaaaacagtcaaagtatctctggagttaattaatgttggaaagaagaagcactatggaaaatgatgatatgcaaatcagtgtacttgccagtggaagcaccggcaacgttacatatgttgagactccgcagcataaaattcttttagatgcgggattgagtggtaaaaaaattgcaaacctgatgcgttcaattggacgtgacattaacgatgtcgatacactcttggtaactcatgaacactcggatcatcggcaaagtgtcggtgttttagcacgaaaatatgatttgaatgtgtatgctaatcaaggcacatgggatgctatgcgatcacgaataggcaaaattccagaagaagaaattaatatttttccaccagacacagttatggattttggtgatattgatattgagagtttttcagtgtcgcatgatgcagctgaaccacagttttatgtttttcatcatcgtaacaagtcatttgttgttttaaccgataccggatacgtttcagatcggatggagggggttatcaaagatgcagatggttatcttttggagtgtaatcacgacatcgagatgttagagaatggtgaatattcatggccgttaaaacagcggattttgggtgatcagggtcatctttcaaatgaagatggtgccaatacgatgctggatgtgattggtcatcgaacaaagaagatctttctgggacatcgaagtcagcataataatatgaaatcactttgtcatttaactgttgcgtcaattttggctgatcatgattatggtgtaggtaaagattttaaattgtatgatacggaaccggaaacggcatcttctttaatgattatttagatttcctttagaattttataactttgagaacacacttttttcaagaaaaaagtatatactttaaagaaaacgaagggggaacactcattggcacaaaaaaatggttttggaaaaattattgtaacagctgttatcgccggtgctcttggcggtggaataacttatggtggtatgtcatacttcaacaatagtgatagtggcactggcacatctttggtttcgaccaataaaaatggcaataccaagatcagtaatgtgaaggtgaacctcaatacacaagcagagaaagcttttaatgcaactaaaaacacggttgtttccgttattaatcttcaaagagaaagctcaagtgataatacgctggctggtattcttggtggccttgagggtggatcaggaagcagtggaagtagtaagaagagtggtgaacttgaggcttctagtgaaggctcaggtgtcatttacaaaaagagtggcaacacagcttacattgtgactaataaccacgttgtttccggtgcaaacgcattggagattattctgagtgatggttcaaaagcgtcagctaaagtggttggtaaggacgctgttactgatttagcagttattaagattacttcgaataaggtcaaggatgtcgctcaatttggagattctgataacattaaagttgctgaacctgttcttgcgattggctcaccacttggttctcaatatgcaacttctgttactcagggtattatttctgctaagaagcgtgaagtaccacaaacttcagaatctggtgctcaagttggcaatgcaacggttattcaaacggatgcggcaattaaccccggaaactcaggtggtcctttaattaattttgcgggtcaggttgttggtattaactctatgaaattagcacaggatcaacaaggaaccagcgtcgaaggaatgggatttgccattccaagtaatgaagttgttacaattattaatcaattaatcaagagcgggcaagttgttcgtccggctttgggaattggctacactgatctttccaatatttcagaagagcaacaacgctcagttctaaaattaccaaagagtgttacccaaggtgcggtagtcttgaaagtgaatagtggctctcctgctcaacgtgccggtattaagaagtatgatgttatcaccgaattggacggcactaagatcacacaacagagccaattacgtgatgtcttgtacaagcataagattggtgataaaatttctgttacgtattatcacaaaggaaataaggaaacaggatccattactttaagccaaaaggcaacgaataaagtgttaagtgaagcaagtaaataggaacaatctctagctagcaacaccgatagttaaagatgttatctattgtatgaaaagagcgagtaatcgtaaggttgctcgctcttttgttaaatactggttagaaggatacacagataaactgaacgatgacttaatgtaaattagtgggtttaatgggtttccgaacggtaagcggattaaataagaaaaataaggatagttaacggataaatacgaacttcatgaagattattttttaaaagattcagtactgataaaaacaaaccaattttgtacacatttctcctgtggataaacctgtggacaatccacaaggtgaattgaattcactggtatattaccgttaataagttatccccagattttaaaagttatccacactttctgtggataactttttttagaaataaattcttgtttgttcggtttccaaaatgctgatataatagggtttgcgaagtgaatttgcgaacgggtgttgtccacaattatgtggacaactaaaagggtacttgacatattttaaaaaaatgctgtggtagaagaaaccggtttaagttatcaacctgtggataactatgtggacaacttgtttataagcctctttttttacacaggctaaaaatggaattaggagaaaatgagattgaatattaaattagtcgttgtaggaaaattaaaggaaaaatattttaagcaagggattgctgaatatgcaaaacgtttatcccgtttttgtaagtttcaaattatagaagtttccgatgaaaaggcacctgagtcgttaagccaagccgaaatgaatgaagttatgaataaagaaggttcgcgaattctagataaaataaaagatcgtgagtacgtctatgcgcttgcgattttaggaaaagagcgatcttctgaacagtttgcaaaggaaattgctgatctgacgacctatggtcattccgatattacgtttgtgatcggaggctctttagggttatccaagcatgttttggatcgcgcaaacacgcaaatttcgtttggaaagtttacgttgcctcatcaattgatgagattggttttgactgaacaaatttatcgagcatttatgattaatgagggaagtccataccataaataagtgtaatcgaaaagaggctatagaatgcaaacggcaatcgatattttcaatgctatccaacgtgatccgcaaaataagatttatactgacaagggtgtgttgccgctttatcatattgagccaaacgccaagatccttattattagtcaggcaccaagtcggaaagcacaggaatcgatggtcttttggaatgatccaagcggcgatcggttacgcgactggatggggattgataaggatcggttttatcattcaggtaaaattgccgtgatgcctttggatttttactatccaggtaagggaatacatggtgatttgccacccagaaaagggtttgcggataaatggcatcaacccttattatcattgatgccaaacgtccagttaaaattgttaattggtcagtatgcgcaaaagtactatcttcaaaaaaatcgacaaaaaaatttaacagaaactgttcgctgttttgaagattatttaccggagtattttccattggtgcatccctcacctttaaactatgggtggatgaaacagcatccctggtttataaaagaagtcgtgccggaattgcaaattcgagttaagaaattgatgaattaatcgggtttattatagtgttaaacagggatgctacaatgtatagcctgattcttttgattattaaattgcgattacgctgtttagccggtttaacatgaacacttaataatcaacttgcttttcttcaccatttaagtaataattaagatgtcaaaatcgaatattgtctggggtgcctctttggctgagaaatacccattgaacctgatgcagttcgtactgtcggaggaagacaacaagcaattacctatctcgtgcacagttaactatgtaggtaaagactcctctctctgtaatttcagggaaaggagtttttttgttgtttcacagataattcccttttgaatactttagatgttgatcatcatatggaaaggaagaaatattgtgaaaaagaaatttcatttgcaggatgttattttgatcgcattaattgcgattgcgtttggtgctatttttgttggaacggactggatatataatgctttatatctggtaatcgggccctttgccaatgaagctttatttgggctttggatcatggctggaccgttgacgatgtatttagtacgggttcccggttccgcgattatcggtgaaaccttgggagctgcagctgaggttttatttggaggcacgtttggtgctgcagcgctaatttccgggattgttcaaggctttggcagtgagttgggctttacatttttacgctatcgcaattggggatgggcaagtcttctgacatcttccattacgacaaccgttgtggcttttggctacgagctgtttaggttaggctatgttaaatattcggttccgatgattattgcattatttactgttcgtttgatctctgatattgtttttggtgcggttttggtcaaaatgattttctcacttgttgagcgatcatcagtcctgcattttaacgtttcaaagtaaaagcttaataaagatgtctggggtgcttttatagctgagatgatacccattgaacctgatacagtttgaactgtcgaagggagactaagccggttattctgaataagaagccgtttgatcttttcttcgactgttttgaaggaaggatttttttatggaatattcgttagtcattacaaatggtcatattgtgacaccaactaaagttgtaaacgccgatttagcgatcaagggcggaaaaattgccgccatcggaagtggtttggccgatcaagcggataaagtaatcgatgccaatggccaaatcgtgttaccggggatgattgattcacacgttcacattaatgaacccggaagaagtgactgggagaactatcataccggttcacaagcattagcggccggtgggacgaccacaatgttggttatgcctttgaatgccttacctgctcggaccacaggggaagaatttaaacgacaaaaagaaattgccgagcataaatcctatgtcgattttggattatatggcggcctggttccgggaaatctgactgaaattcaaaaaatggcagacgaaggtgcaatgggttttaaagcatttatggcaacgaccggctcagatcttcccggggattttaaaaacgttgatgattatcagttactaaaagggatgcaggctattggtaaaacgggattgcctatcctggtacacgctgagaatgcagccattactgatggtttagctgctgagaagattgccgaggggaaaacagacattcaggactacgtcgattcaagaccaccatttgttgaagtcgaagcagttcgccgagccatttatcttgccaaacagactaatgttcatttgcactttgtccatttgtctacacctgaatccgttgatcaagtgacccaggctcgacagaatgggcagaatgtgacgtgtgaaacttgtccacattacctgatattggatcgtaatcaatttgaaaaaattggaccgttggctaaatgttcaccggcactgagagatcctgaaattgttaaaggactttggaagaaagtgtttgccggccaagttgatacaattggttccgatcattcgccggctccaatgtcgatgaaggaaagcccagagcataatatttttgatatttggggtggtgtgagtggctgccaaaataatgtcgatttgctttatgatgaagcagttaagaaacgggggttgcctgttacagatttcgtgaagctcacggctgaaacgccggcaacattatttggaattgtcaataagggaaagttacaggttggctatgatgctgatatcacgcttttagatcctaatcaaagctatgttttgaaaacaaaggatttgtattatgaaaacaaaattagtgcttataccggttttaaaattaacgatcgagtcacaacgaccattcttcggggccagattatttacactttgaaacaaggctttgtggggcaaccaaccggccggtttttaacaaaacagcgtgctggagttgagtcattatgaacacatcaaaggcgctttcaatttcacccgatttaaagcctcgaacccaagccgatagacatattggccaactttcgtatatggcaatgtggctgggagacgggtttaatattggtaacgtcactttaggttcatcgattgttgtagctggtgtcgcaacgatgaatctgctgcaaacgattcttgctgcgggaatggcgatcgcaattatcaccattatttttgtactgaacgatcattttgggtactataccggttcgccatatgtcatacagttacgaatgacatttggcattttaggatcaaaattagccagtttattaagagggattcccgcaattgtatggtatgggtttcagagttggaccggtgggttagcattaaatcaaatttttaaaattactagtggttatgataatcctgctacgttttttgtggcgttattagttgtgcagactttaatttccatacgagggtttaagtcaatcaaggttgttgcaacctggatctctttagtcatggctgttttattgatcggaatgctaatttatttagttactcagaggacagcagctttttccaatcggatgattaacgtcaaaggcacttggggcccaattttttggggattcgtagttgcatttttaggaaattatacggctgtgtttgagtctgcggctgactattcacgagaattacaagcgggtttgtcaaacaagcgtcgggcagcactttattttctgccaattttcattgcctatggcattacagttttaaccggagcattattggctgttgtaaccggtatttcaagcccggttcatgcaatggcgcatctatttaacaataatctggttaccgttgtggtgtctgcattcattgttttaggaacaattacgacaaatttggttgcaaatattattccgccgacttatgtattaaatgcatggtttaatttatcggagcgtaaatcgttaattattgtggcactattggccagtttaagctttccctggttactagttcaagatagttcttctacgggtttaacgctgtttattaaaacttattccgcttttttaggtccaatgacggcaattattttgaacgagtattatgtcaaacgacgtaaaagagttgatgtggctgatttatataataatcaaaaggtaaaggcctcaatccagcctattatcgcactgtttgttggagcagctctggcattgatgggagtgaatcttagttggccgattgggttcgtcacgtcatggctagtattatggttgttaggttatgataagcgacgaatacaggagtgaattttttaaaaggtttagggaaatagtttaaggcacctcccaaaggtaaagtctttttatctccggggagtgccttatttatgttcttaccattcttaatttggttaatttttaatgcccatatagacaagatctaaagacagtgttccattggatgcactgcctgataagttaaaccataatccgtatcgagttgtgtggttagcctttagaaagttttcgatctgggctgtaacagtatttcccaattcaccatttccagtgtcttcaagtaagatatcacctgtattaggatcaatcatttttgtgagatcagatacaggatattcaaaaatgcccactaaattagtcgggtccaaagtcatattttccgacatgatggcatctttgaatggtgtgtttaaattatttgtgtgtcgagtgccataatattgtgtcaatttcattaaatccggttgagccaggtaaccatcagcggaaagtttaccgtaaatataattccccaacattgaaaaatcgcgtgtattagccggatcagacaggttcaagccgtcagcatttgagtcttcatggtattgataagggccgccctttaagaaaccatgccaaacccaaccgctaaattgaccggttctgtctgtcacattgaaatatacggcttttttaccattgtgtgaaaggattgcaacccgctctaaagtccaggttgtcgtagaaaaattctctaaattatgtaattttattgtatgagaaagattccatatatagtgcgactcgttatttgcgttgtggtacggagccacccgacttgccgattgatttgagataacctgatagccagttgtttgggcgtttgcttttatcgttccaaacagaaaagcagaaaataaagatgttgttaccaaaataaccattttattcaatttactcaccctcttaaattgagtatagcacttatacaattaatgcggttagaggatttatggttgagtcgagtcctttcgatcatattaagaatcggttttagatgagtcttggtccagcgttttaaaattatgcttaagacccggccaaatatatttatctgcagtttgaatgattaagccgttaaaaagtattgaaaaaattgtgccaatattaactgcgtacaaattctttgtgacagcaaatgaaataatcattgcggcaataggcggcacaaagtcgagcaattgagctgcaaccgcacttttacgtaaataaaagaatctcaagatgttagtggtatcgtcatttggatgcataagaatgtttgcacgttgatacagtgaaatagctgtgcagaagaatacaattcccagacatgataaaacggcccgaatcacaattggcagagtcccgattccaagtgaattaagtaggttgacaaataggcttacaaaataactaaagaaacaaacataagcgatttcaccaataaatcgtggccaatcccagtatttaattagaatctggtttgtgactgtattaagaaatccaataatgaatagcaggactccgacatttacgttgaaccaatgactgtagttaactgcagaagcagtccagaccgcacttcccatgtttgctgaaatggttagtgcgtttccgaaggcgtttaatataagacctgatatgagaccaatccagcgttgtttgagtgaatttttgatagtaatgccccccttaacaccattagtgtatcatagtcatttatattgaatcatgaaaagaatgaaaataattgaaaatcagaattgtgctctttcatcatttttgatatactttctttaattaatatggcgatgacgttcgcctatactcgtttaataaaagagttgatgacgtctacctttatttggaaaggtaggcgttttttcgtcgagaggaggaaaggtcatgaaagtagattggtatagaatagggcaattttcttcggtttttattggtggcatgattggcggggttgccagatatgaggttggtaactggttaagcgcgaatacatttgcagggacaacttttgtgaatgttgtcgggtgtttctttttgacagtcaccatttatgggttggacttagtgattgatcttccagaatggataatcttgggatttggaacggggattataggagcgtttacgaccttttctacttttgcactgttgtttgctcaaaatattcagcaacagcctattgaaacattatggtttttagcgattaatttgattggtggttttatcacagccattcttggttatttgacagcacggctaatggatcgaggtaaaaagatatggtaattgtatgggtggcactgggtgctggaattggtgcaatagtacgatacttgattacaataattggtaaacactattggccaaaattacctcttgcgacattgatcattaatgtagtcggggccgtgattgccggcttcttgggtggtgttcaaatttcgggaaccggttcattattcttgttaacggggatttgtggtggtttcacaactttctcgacgtttacaaccgatacatttgttttattacgaaataggcgctggctgactgcgtgcgcgtattactttgggacgattggacttggctttttagccgtttacttgggattgtggttgggccagcttatggtctcttagggctttcacttaaagtgcgttaaaataaataagttacgtttgtaggtcatatatttgaaaggaacgattttaattacatctaaacaattagtgattttaaaaaatggcagcttgattatactgggcgcttttatatacgcaattgcaattaatgattttctgatcccgcatcaaattggtgagggcggtgtgacaggattaacgacgattggttactatgtattacatataccaccatttttgactaatttgtttttaaacggtttcctgcttgtaatcgggtttcgatttctggatcaaaaaacggtctggtattcactgtgggctgtattatggatttcaatctttttgaaattaccaagattattgcaatatcatacatcacaaacaattattccggcagtcgctggcggtgtcttaatgggggttgccatggggattatttttcgcggcgaaggcacaattgccggcagtactattttggcaaaaattatgaatcgttattttggtatgatgaccgggactgcaatgctactgtttgatttaattgtcgcaattccctccggcttcgttattggattacaaaatatgatcttaacggtcattgaactatatgtaagcgcagttgtcctaaataaccttctatcccgattcggggctaaaaaatcggtcacgattataacgaatcaaactgacagagtaacagctatcctgtcggaaaaactcaaacagggtattacccttgttgatgcaaagggatattatcatcaagaaaaacggccaatgatttatatcatttgtacaaaaccccaattagctgaaatcgtacctttgatctctgaaattgatccaaaagcttttgttgtagttgaggatgttcatagtgtgaacggcaaattattggataaaatcttgtagattgggcattataaatgtttcacgtgtaacatttaagctaatgacgataaaactaatgtagaccattgtaaaataaaacgcgtgataggaagtagttccatgacttcttaccacacgttttttattaatttttaaagcttgcttttgtttcccctaattttattgagctgtataaccgccatctacaacgaactcgcttccggttgaaaatgatgattcatcggatgctaaatagagtgccatattagtgatttcttccggttctcctaatctgccaaccggatgaagtgcttccagagaatgtctcatttctgggtacttatcaaccattggtgtgtgaacataacctgggtgaattgaattgatacgaatcttatagcctttttccgcacaatacaaagcggcagatttagtcagcatccgaacgccaccctttgcggcattataggcataaagatttggaatcccaattaaacctgcgattgaagaaatattgacgattgaaccaccattttttttcattgctggaattgcttgcttaacgccccacataacgccgtctaaatcgaccgataggattttatgccacatatccccgtctatttcttcggcattattaaattcaagaatccccgcattattcacaaggatgtcgactttaccaaaacgtttttcagcttccgcaaatacttttttccattcttcttcttttgaaacatcgtgacgaataaagatagcattatccccgagtttggaaatgttttctctccccgtttcttcatcaacgtcggttccaatcactctggcaccttcattaacaaatcgttgggcacaggataaaccgattccttttgcagctccagtaataatagcaactttgttgtccagacgacccataagtcatttcccctttcataagttcaaggtgaagaagcaattatctatactttaagtataacgctatgtgaaaaaaataacagcgtaaatcagttatttttgtttgcgcttacaagcactgaaaaacattgatttaattcgtgaatgaaaggtctttatttgatataatattagtagtgtttgttctgaaattcacaatcagtatggaggtaaatgatgactcaaaaactgactaaaattggtaaaactgatattttatctacgccgcttggattgggaactaatgccgtgggtggctacaacctttttccggatttaaaggatgaaaccgggttggaaattgtcagagcaggattggaaaacggtattacgttactggacacagcttatgtatatggattagggcattccgaagaattggttggacaggcgatgaaagattttgatcgtagtcatattattttggcaaccaagggtgcccatgatttttcgacaggtgaagaagtcattaagaatgatccgaagtttttgactgaacaggttgaagccagtcttaaacggttgaaaacggattatcttgatatttattatattcattttccggataagacaacacctaaagctgaagcagtgggtgcgcttcaaaggcttcgtgagcaagggaaaatcaaagcaatcgggttatcaaatttcagtttggatcaaattaaggaagctaatgcagatgggtacgttgatgttgttgaagatgaatttagtttactccatcaggataatactcaaacaatgatgccttatctaaaggcaaaccaaatcagctttgtgccatattttccacttgcatcgggactgctcaccggcaaatatgaccaagcagtttcgtttgcaggtgatgatattagaagccaaattgcagattttaagaaaccgcgttttgatgaggcgttaaaagcgattgatagaattcgaccagttgcacaagcatatgacgcaacggtcacacaaattgtgttggcatggtatatgcagaatccacttattagtgttgttattccgggagccaaacgccccacacaagttatcaacaatgcaaaggcaatggcgattgatcttacaaaagatgattatcaaaaaatcgatgatgctttttcttggttcaaagatgaagaaagcggtaaatccttggcagatcctgattaactgtttaataacctcttttgactgatccttcatgttacttgaaataacctggacaattaagttatgctgttggtaacttaagattagtcgagaggaagggttggacgaaatgaaaattggatttattggatcggggaatattggccgtaatcttgccaggttagccgttaaaaatggttatgatgttatcatgagcaattctcgggatccagagacacttaatgatttggtttcagagcttggtccccacgcaaaagctgcttgggcaaaagatgctgcagagcagggagaccttgttgtcgtcacaattccgttgaaaaattatcgtcaggtacccgttaggccactaaaaggcaaaacggttattgatacaatgaactattatccttctagagacgggcatatttcagagctcgatagtggcagtacaaccacaagtgaacttttacaggctcatttacccgaatcaaaagttgtcaaagcgtttaattcgatcattgccggtgaattgatttcaacgtcgttgtcggagagtaacccaaataggcgggcgttaccaattgctggcaatgattcaaaggcaaaagaaacggtagcatcattaatcaatcagtttggatttgatgtttacgatgccgggtcattgcacgaaggctttcgttttcaaaacgggacacctgcttatgttatcagggcaaataagaatcagctgatcgcagctttaaagaaagcttaaagacaactataaaacagttgaggtaaatataaaatttacttcaactgttttatagttgtctttttaaattttaataacgcatttttttatgctcgccatttccatgcacccacaacttcaacaattgcagttacaaccagcatagcaccaaagagttgtaagacaaacaggacggtaccaaatggatgaaataccagcacgcttcccagaacgattagcacaaggccatacatgataaatggtaatggggaaacattgacaaattcgcgatgcccgattgcgtcaataacttggataagcccaactaagatcaggacaattccaatgactaatggtaatgctgccaaaattggttttgcaaaaattaatatcagaattgccaaaataagctgaaagataccaacgggtaaactataatcgagttcgtctcctttatgacgttgaacaaaccatgaaatgagattaataataccaaataacgcaaaaaagcttgaaagaacagcaatgaaaacgttaatcgtcgcttccggttcaaataggaagaataagccaaaaataatataaacgatactctcaagccagatatatttacgaatttgactaataaattgatacatacgatcaccctcacaaaacagattagtagaatgataaacctatctttatcatacaaggagaaatgccaaagcaacagtatttgaacagatatttggcaaatacattaaaatagcgtgttttatgactaatgatgtatgttaagatgtcaaaaaaaggataataattaattttgaagggaaggtattccgatgcaatatccaaattttcatcttgcacgttttattgaccggcctaatagattcattgctcattgtcgactaattgagaccggtgaaattgtgacagtgcatgttaagaataccgggcggacaaccatcttacagccgaatgtgacaacatccttggttgaaagccataatcatgctcggaaaacaaagtatgatttagtggcagccaaaaagtatgaccgattttggatcaacatcgattcccaagcacctaataaaatagttaaagatggattggccaacaatgatattaaattacccggaattaatcagattacacaagttacgcccgaagtgccgtttttagattcaagattggacttttcaggaattggtgatcatcaaaaaaactttttcttagaggtgaaaggcgttacattggaaaacggtggtatagcagcgtttccagacgcacccacaactcggggactaaaacatgtgaaaactttgcaaaaagcgcttgacaaagggtacctttcctatctattatttattattcagatggagaaaataaaagctatgacaattgacatagatatttttgaacccctcgcgtttgagatttccaaggctcaaaaaagaggggttcatgttatagcctatgattgcaggataacgccggattcattgacgctgaaccaaccggttccatttgatttaaaccaaaaattcattagtgacggattgccatcgtcaatccaaaagagaacttgaaactataagaggtaataaattaatgctccaaacatcaaaacaagaaccaattgatagcccatttaatcgtacaaccactgctgaaagagttatgaagggcgttgatcttaagggaaaaaacgtgattgtaacgggtggctatagtggcatcggattaaaagtaacggaaatgctgacacaggcgggtgcacatgttatcgtaccggccagaactgtatcaaaagcattacctgtcgtagaacatctaaagaatgccgaactcggattattggatttaatggatcctgattcgattgatcgttttgccaagggttttttagcttctaatcgacagttggacttgttggttgaatgtgccggtatcatgtttccaccattaaagcgtgacagtcgtggaaatgaatcccagttttcaactaattttctgggacattttcaattaactgctaaactgtatccggctttaaagaaagccggtcattcgcgtgtcattttaatgtcgtcacgggcacagagttggaatggcgttgactttggggatccaaactttaatcggcgtaaatatgatccccgtacagcctatgcccaatcaaaggcggctgatgctctctttgccgtggaacttaataagcgcggtcaaaaaaatggcgtacatgcttttgcggttcacccaggactagtcccaggaactgaactcagtcgatatgttaatcacgagcctttgaaaagagcctcttcttttgcattgaatcaacttgaattaacacacattattaatgcaggacactccattaaagcacgttttcaccgccagtccgaatatgattatttcaaaacggttagtcagggcgccgcaagtacattatgggcagctaccagtgatcagttgactgagcggggcggcgtcttcatagaagattgcaatattagtcacgctgtttctgctgacagtcaatcaaaagtcggtgtccgaccatggtcgattgacaccgatgatgctgctaaactctggcatttgggtgagaaattaaccgaaacggtttttcccatttaaatctgttcatttgttataattagtaaacaaaatgttacaaacaaattcttatttaaacttgaaactttcagataaggtgctaacatgtaccgtaacaacgtgaaaatctatgaaaatgattaataaaacttgtttttggaaggaagcaaattataaatactatgttaaagaaaacattgatcttcggtcaccgtggctatccccacaaattcccggaaaattcattagccgggtttaaatatgcgattaaccatggaattgatgggttggaatttgatgtccatttaaccaaggacaacgttcctgtcattatgcacgatgaaaagattgaccggaccacaaactgtgccggtgaaattcgctcatatacattctctgaattacgtcagttccaacttagtgatggccaacgggttccaaccttaaaagagttgttggatcttgctgataagcaaccggttcatctcaacttggaatttaagaccaatgaaattcattatgaaaacattgaaaaaatcgtgttggatatggtgaaaaactatgatttggtatatccggttatttattcatcgtttaacttggattcacttaaaatcgcttataagattgatccaactcagcagtattgctttttgtcagaacatgacatcaagaatcctcgtgagctggtcactaaggaacacttggtgggtcttcatttaagccattatgtgccaatgaaaaatattaaagagcggatctggactgttgatgatccaaagattcaaaagcatttgttcgcgcaaaacgttgccgggatttttaccaacaactttgaagctgctgaaaaagtacaatcgggctcacttgcttaattgaataatgattttaaaaaagctaaggcaaattagatttttgctttagcttttttgtgtcatttgttttgctttacacactggattaggactgttcctcaaagcagcattctgcacgtaagggattccttccagaaatccaaacccgggatttccgaaaagaacgccttacgctccgaatgctaaccgctttgttgcacacactggattaggactgcttctcaaagcagcatcgctccgcataagggatcaaattgaaaaatccaagttcaggatttcccaatttgacgccttatgctccggatgctaaccactttgatccgcacacttgtatatttacatcacttttacactccttcaacacaggttttacattgaactgccacaatagctgtgtagtcaaaataactaagttgaggtgagcggatgtgtcaatttcgttaagaaatgttcgaaaggattatgatcaacaaaccaaggtgttggaaagtgtttcagctgaagtacagaccggcgagttcttcgtgatcgttggtccctccggctgtggtaaaagtacattgttacggatggttgccgggttaaccccaatcacggatggtgaggttcgaataaacaatcaagttgtcaatgaattaccaccgaaggctcgtaaattaacgatggtttttcaaaactacgcattatatccatttttgagtgtctgggacaatgttgcttttgggttaaaagcccgtaagcttagtcaatccgatattcggcatcgagtcgataatgccttaaaaatggttagtctatctgatcttagtaagcgtaagccacgtgaattatccggtgggcaacgacagcgtgttgccttggcccgtgcggttgccagtgatgcagatatttgtttaatggatgaaccattatcaaacttggacgcacaactaagaattaagatgcgtcaggaaatttacaatttacaacgcaaattaggtctcacattgatctatgttacccatgatcaagttgaagcaatgaccatggctgatcacattatggttttaaacgaccagcatgttcagcaaattggtacgccgtctgagatttatcaacatcccgccaatgaatttgtggcacaattttttggaacaccgcaaattaatattctgcccgcaaaacgttccactcaaaacaatcatattttgacctttgcgacaaataatatgcaagttgctttaaacgaagagatcccgattgacagtctgcggatcggtgttcgccctgatgaactaaccgttgcgcgagcagaatccgttgattcaaatgcagttgttaaaaatactgaatttttgggtaatgaaacaattatttacgcaactttaaatagtggggatgatgttcgggccgtcttgcccggacaggttagtttcagaggatatgaaccaattaaaattgggattgggtcgcatctcttattctttgataatgatgggaaacaaattgctttaacaaaggaggaagctgtccatgcttaaatcaccagcaacgcactcttccacagcgccagtcgctgcagatcatacaaagtcaaaagctgaaaaaagcgaagccggtttttggttaaatgcaaaagataaatactatgcttggatttttcttggtccgtcattattgattctgagtgttttcattttttatccaatgtttcggacactctacctaagtttatttttaacaaatacggtcggtaagccgacagtgtttgttggcttgtcaaattatatcaatctgcttacttcagctgactatctctccagtctaggagtaacgatggtttatgtattagcagtgacggctattaccattgtactgggattggttttagctaattacgccagtaaacaattggcaggaattggtatttttcgaacgttattctcggctacaatgggtgtctcggtatcggttgccgcaatcttttggttgtttattttcaatccttctactggattcctatcacttgtcagcacctggcttcatctaccacagattaattggttgacggatcctgtttgggccatgctggctgtgattattacgactgtttggatgaacctgggctttacctttttaattctactgggcgcgatgcagtcggttccgacaactttatatgaagcggccagcattgagggtgcgacacctcgctatcagctatttcacattacgattccaatgatttcaccaacgctattctttgtatcaattattactttaattgaagggtttaagagttttggattaattgacttgatgactaaaggtggtccaaccaacgctaccaacatgctggtttaccgaatttataaagatgccttttacagtggtaactatgcacaagcaagtgccgaatcactcatactaacggttatcattgcaattttcaccttgattcaatttaaagtattggaaaagcgggtgaactactaatggaaattgttgccaaacaaaaattgtcacacaaaattttaaattatgttttgctaattattttgaccgtggtcgtgttaggaccgttcttaatcgggctttggaccagtctgctgccgacgatggatattgcaaaagggaatttcctaagcctacacatttccctgacaaattacgttgacgcattcacacaaacaccgattttacaatatttgggaaatagtttatggatttcaattgtgacaaccattgcgcaattaattttttgctcaatgagtgcctatgcttttgtttttttgaaatttaaaggccgaaaagtattatttattctgtttttggcaaccatgatgctgccgtttgaagccgaaattattcccaactttatgaccattaaggcgatgggccttctaaatacgtattctgctatgatcgttcctttcctgacatcggcatttggcacgttcatgcttcgccaatcttttatgcagatgccagatgaattaaaggaagcggccgacattgaaggattgggacattttcaattctattggaaaattgtcatgccatataatcgaatcagtctcattaccttaggagcctatagtttcttgggagcctggaatcagtacctatggccaatgttaaccacattcagcaatgcctttcgaccggttcaaaatgggcttcggcagttgcaatcagaagaaacttttaatgattggggcatgattcaggcaacagctgcaatcgtcgtgattccaactttgattgtgttatttgttggtcaacactacttcaagtccggtatgaatgaaggtgctgttaaatgattaagaaactcgcagcctttttacgcgctcacattttaccggccattgcagttgtggtggttgtggttggtgcagttgtatttacatcggctcataaacaaacctcagccaaagccggaaggacccccgttgttttatggcacgaaatgggcgggcctgcagaggttgctttggatcaaatggtggataagtttaacaaatcgcaaagtaagtacgaagttattccgcagtatcagggtgcctatgatgaagcggttcaaaaaatcattcaaagtcatggctccagtgcatcacccgcgttgttccagtcctttgatatttcaaccgctcagatgatgcacagcaagtacacaacacctgtccagaaatttatcgatgaagataactatgatgttagtgatatttcaccggttgctcgttccttctattctaataaggggaaacaactggcaatgccgtttaatacatcacaaccggttctttattacaatgccagtttgctgaagaaatatcatattaccccacctgccaaatcaccaagttatagtgatgttactcgggtagctgaacagctatacaaacgatcacatcaccaggtaaagggaatgacaatggagatttatggctggttaatggaagaagcgttagccaatgctaaaacgtcattggttaatcacggggatggccatgtcggtaacccaactaaaattgatttaaataatccgacaactgttaaatatctaaaatggatccgaacgaatattaagtctggtgattttgtcaactatggttccggtgcaagtgccgagacaaatgagattgcggcatttttggccggtaaattgggtatctttgttcagtcatcagcctatattggtcaattaacaaccggtaacaaaaataagttgggtatttcatacttcccacatccaaatggtcaaaaagccaatggtgtgggaatcggaggagccgcattatggatttccaatgataaaccgacaaaagtccaaaagggcgcatttgaatttattaaatacgctgagaggccggatagccaggccaactggcaaaaagcgaccgggtatttggcgttgaacaatcaatctcagagtcagcctgctttgaagagtttatatgcgaaacagcctgaagccaaagtgcccggcgagcagttggccgctgccaagccaaatgatacaaactcgggaatcttaatggaggggatgcaacttactcgggaaatggaagaaacagcgatggagacggtttatgacggcggtagtattccaaaggctttatcaacagcgagtcaagggatgaatacaaacctgaagacaacaaatagagcaaacggggattataagtagtgtgcgaaccaaagcggtttacgttcggagtgtaagagagaaattgagtaaaggttgattaaaaaaggagtatcctcaaaatgacaaacgaaactttgatttttggacatcgtggttatccatataaatttccggaaaattcgttgagtggttttgaatatgcgatcgaacatggcgtagatggactggaatttgatgttcatttaacaaaagacaatgtgcctgttgtgatgcatgatgaaaaaattaatcgaacaactaacggtcgggggaaaatccgggaatatacctaccaggaattacaacagttccaattggaaaatggtgaagccattcctagtttgaaagacttgttgtcactggcaagacagaaaccggtttatttgaatctggaatttaaaaccaacaagattcattatccaaatattgaacaaattgttttggatatggtcggtaattatgacttggcccatccggtgatttattcctccttttctctacaaactttaaaggacgcttatcgaattgatcccaaccaacaatattgcctgctttccaaccatattctgagacatccaagggaactcatgattgatgctcacctatcaggcctgcatcttagtcactaccaaccactgagaaatatcaaagagcgaatttggacgattgacgatcctaaaaagcagcgtgcgcttttagcggaccacgttgctggaattattactgataattttgaaatggcccgggatgttaaatctagtgtgttggtttagaaattgataattaggtgttgagtttttgttaattttaaattccctgtcaaaaatctgatgtagaaaaactcattcttcttagtgtaggaggtctggacaaaagtaaaaacagtattataatattcttactccaaagcgaaaatccgataaaatcagcgttctctgtaaactgattttatcggactttttaaaataatgttttttcgacttatatttcagtctgttttgctatactgttgaatctgagccatcaaaagcatattctaaaacaaaagagcgcttttaattgtataaaattaataagtttgacaaaataaagggcttttataggagttcagaggatggaaagcaattttcatactacctacaaacggaactacaaaagcagttaaagaaacatgctaccatggaggacaaatcatttagcaaagctttagaagacctattgctagatcactacttaattgatcaggaaattaagcaagcgtacaatgaaggttatgataaacgtaatttgttgaagtgatagaaagcactgataacactggtgttttagtggttaaggagaatgaaaatgccaaacaaagaagagttgaaaacagttagaattgccagttctattcttaaggatatcaagatcattgcagtaaatgatcataaaacaattcaagaagtagttgaaaaagcattaaccagatatattaaagagaatggatattaaattcctaacaccatctttttttgaaatacgtaaaaaagtaaaaatcgattacggtagcttttactgctttctagagaacgtttgttgtctataactgaaacttgaaagtatgaagacagactgatcccttggtatcacagggcatattttaattaatttaaccatttagcttgctgttaacagcgaaactaaccgtttcggcaaaaatgtgaagaa

SEQ ID NO: 467 - DNA, 8402 bp, Unknown
  Metagenome-assembled genome
atagccttggctgtgcagcgtagcaattctgcctcgttcaaacgaagttaggtgctgacctttttttctgactgtggtattctgttcttgcatcaagacaataacctctttcattgtttgtgtaggaacatcaatgataacagagatttgtcttggtgttttttattttatcaattagctaaaagtatttggctaacttgattataaaacgcgcgggctaacttgattataaaacgcgcgagtttttttcacattctaaaagcagaagtttatgatcaaaaacagttcgataccttggcggaattaacccaagccgtagcgaactggattcaatattataatttcacgagaatcaaaacaaaactgggtggtaagagcccggttaaataccgtgttcttaccacccagaaagttgcttaaagtttcgtccaatatttggggttcacttcatcagtgcttttttgttggtggctactattcaattttaagtttacaaaccgtcaaggctgtggttcatacctacttatactagacaaataatcaatatccaaccactactaggtagcattgtgccaccgctgatagcgagcttaggtgaaaaaccgctaggttcaaatcgccatgtaccagactagagtccatatctacttaaccaattgtttccacaaaatcatttagtcagactttgaccaaaaccgtgacttaacttatacttcagttatgcgaaaaagagacgaaaaaaaatacacccaaatcattgatagtgtcaccgaattaattttggaagtcggactaagtggcgttaccatcgccaaaattgcgaccaaagctaacttatatccatcaactatttatatttatttcgccgataaagaagatctgctccggcaggtttttcggtatcaacgccacaatttacaacaatatttaggcgaaaagatcggcttagtgtcaacgccacagcaacaagtgcaaatctacatgcgtgcgctttaccaatttgcccaagatcaaccacgtcaactagccaccttgcagcaatttcttgattcaccattacttgatcagttggcgattccaccggtggaacaaaatctaatttttcccgaactacaggccgtgatcgaacaaggccaggcagctggtattttccgcccaataccagccacactagcaattttattgatcaatggcgatgtgttacaatacgcgcatgcggtgcgcaagcaactggttgatcccgtggttcagcccttggagcaactgctggaactgactgcagcttggttaaataaagctaaatagttagccggaaagctgcatcccttgcgttagcatggtacaattttaggtataccttatgcagtagcggtgagataagcgcaccagtaaaattttctgcgctatttttgttattttaacccgctatcagcacgaaaatggcttaagaaacgaccattaaaagtgaaatagaggagctttttcatgagtaaacaagataaaccaactagccgagttgcgcgccatgctgaaaagcgaacgcgtactcagcgcaacactacgaaaccaactaatgcgcagccacgtagttcaaaaccgatcagcaccgttaacacaccccaccaatcctttatcacgcgccaccgttggtctttgatcgcaatcgttgtactgatcgttgccttcggcgtttatgctgagttctctagtatcgccaatgataatcaaacagcacaaccgacaacaacggcagtatcttccagtgaatctagtagtacaactgccagctccagcaaagcaaaaagtagtaccgcgaaaaaaagtagtagcacaaccgatgaggccagcaccgctagcaatagtgaagcagacagtaattcgtctagcgacactgatagtagtgaatccagcagttcagcagcagccggtgatggacaaacattctcatcaactagtgaggccgttgcttggggtcgtgccaacgcttcttcctggatggctgaaggctacagcaactttaacgttattcctaatggcaatggcggttatacaattgaatacactaaataagtggttgaccgcttatttttttagataataaattgtacacaattataatttgtgttatgataaggctatcaaaataatcaatgaggtgaattagatgaacgtaacaatgcacggtgatcctttaacaactgttggtgaagcaccagaagtcggcgcacaattacctgattttaaattacacaataacgcgggccaaacgttgacgaccgctgattttaaaggtcagacgactttgatcagtgtgatccctaacattaataccagtgtctgcagtgtccaaaccaaacacttcaatgctgatgcggataaggttccaaatattcgcttcgtgactatttctacgaacacaaccgctgagcaagccgattggtgtgctgctgaaggcgtcactaaaatggaaatgctctcagatattgatgaagaatttggccgcgcaatgggcgtttttgttcccgaagcaggcatcaatacgcgttcaatcttcatcgttgatgctgacggtaagatccgctaccgtgaactgatccatgaacaaactaatgaacctgactacagtgctgcactcgatttcttagcaacattgtaagcaattaaaatgagacgataaccttaatcggctaccgtctcattttttaatacgtattttcagtgtaataaaccgtgtctaacccgaatgtgttatatagctgactatttttaccatcgaaagttgggttcagcgcgtttaagcgggtttcttcattgtcgatctgcttagctggcagttgtaattcgcgccgcaatgcattcgatgttttagtcaatgccgccgtcgttgcgatctgatatgaactaccgttgatccacgcatcgctaccttgtaattgtttggaagaaatattggtcgcgttttgccaatactttagcccaccggtcacaatatacttaaagggaacgtcggtacgcacattaggctccaaggctttcatcaacttttggtaacgcgacaagccattggtagagatcagtttcttcgtgacggcacggatcacagcttgttgccgcaattggcgaccataatcacctttggggtcatcgtaacgcatccgcgcgtaagtcagcgtctctttaccgtttaaatgatgggtgccctttttgatcgtaatattattgaaggtaaaggttagatcgctggtaacggtgacaccgccgaccgcattgaccattgtttccaggccgcccatattcatagttaaataataatcgatcggaatgccgaccagcttactgatcgacgccttagccattttcgaaccacctaaattataggcggcatttaatttctgcatattgcgcttgttgtcgccaaccatttcagccagtgtgtcccgcggaatactgtgcaaaatcgtcttgtgggtctgcggattaacggtcgccaccatcagcgtatcggaattacctttatcgatccgtccgtccgcgccagtatcaacacctaggatcagcaccgaaaacgggcggccttttttgatcgctgtggacggtgtttgcccattagtggcatacattttattaaaactagtctcggtcacatgatagatatggtaaacaaaaataccaccactaattaaaatgatcgccaccagcgctagaatggtccaacgcacccaatggcgcttcttccgtccacttcgttgcatgaaaataccgtctttctttcagaattactcattacagcctaccacaattcaaccgtcaaactcaaatcaaggtcggcggttacgaaaataacgacctaaaccaacgcttaacaacattaatccaccagccgccaccaaccaaaataaatcactattgcgcaacagccaataaccaccactgaccaaaacaacgatataaatgagcacactgcttaaacgcatttattcaccacttttatggttctgcaaataacccatttggtgtaattgttcccgaatggctttcattgattcagctgatgcccgttggtgtgcggcgtctggttgagccgttttaggtgccgccgttgctttaggtgccggcttggctgtcatggtcgctgccactggatgcagttgcgtcggtgtcaattgatccatcgttcgattaagcgcggcatcaacgaatacattgccggcattcgtcgcatgacctttcgtccaacgataatcgatctgtctaaactcacgtaaaagttgcgccaactgctgccatagttctttgttagccagtggttgcccgccgctacgttgccaaccacgccgctgccaaccggctaaccaatttttcgtgatcgcgttaagcacgtagcgcgaatccgcgatcaccaccactggtaaatcagttccccacgtagctttgattttccgcaacgcttcgactaatgcagtgatctccattttattgttagttgcgccaaattcaccggcagagtcgctgacttgttggccttggtattcgatcaggtaagcccaggcggccttgtcgccgcttttaacgtgaccaccttgaacattaccggtgttccgtgaaccgccgtctgtgtagacctgaagtacatttgctggcaacggtgtattggccgccgctgcggttggctttttttgtgctgctttagcggcagttgcgccaccctttagccaagcctgtgcggctgccttatcagtaaagcctttatagcgtgcgcccgggaagccttcaactaattgcttggcttctgcccacgtggtattaaaaacgccggtttgccgtcccttagcgatcgcgtaatattttttagttgccatggcatataaccctcctcgttaaggttgctgatcaatgtggatcagcgactgctttcgttcattcaccgcttaaatcgtatcatctaataaccaatcaacaatattaatgatcggaataccagccacttgtgtaaattcatagtagttttgcgtaattataattttacgatagttatctttaagcttcaataaattatcagtttcatgtgtattattgggtaaagcataggtcacctgaacatatatgtaaacggcggttataaaatgtaggaaaacggcggcgagacattgtcggttttcctacattttttgataccattaatcacatcttaatcggggaggttaatgatgtgagacacgatattagagaaggagtgaaacgttacgtggataatgatatcgaaccaaattatgccgctttaagccgacaatatgacgttgactaccgtactgttaagaaagcctatcaagaagttaaggacggtgacgctaagtcacagaaaccgaaaaagcaacgacccagcctacttgatccttatcgtggtgtgatcaaggccaaacttgaactgaactgttcggccatggccattttcaagttcattcagaagaaaggttttcagggtcaatatacgatcgttaaaacttactgtgcgacgatccgtaaggaacgtacacataaggagacaatccgagttgaacatactgctggtctttcagctcaagttgattggaaagaggagatgacgctttataacaaggaaaacaagccctatcattttaatatttttttatatgtcttgccttattcaaaattaaaatacttaactttgattttcgaacgcagccaagatactttgtttaattgccttgatgacgctttttggcacaccggcggcgtgccaactgagatctggttcgataacatgaaacaagtcgttgaccattcaaaatccaactttggtcacccagttttcaatgaacgttttcgccagtttagccaagatgccggctataagcccattgcttgtcgcgcctttaggccccaaaccaaaggttcagttgaagcattagcgcggacagttgagcgtttacgcccctacaattacgagttctgtgatggagttgagttgatcaacttggttgatgatctctgtgatgaacttaatcatgaaatctcgcaggcaaccaacgagatcccgcaagataaatggttggccgaagaaaaagagtacctacatcagctgccagatgacctgcttaagcccttcttcgaagaagacattacccgtgtcgtgtcgaaggaatcaatggttatcttccgcaaatgtaaatactccgtggatccacaatatatcggacggacagtcaatatcgaactatctgatgatgaacgtcacatccaaatttattataacggagaattgattcgcgcgcacgatattacgacccatcaatttaattataacgagaacgatcaagtcaatattctgagttctgatctgcttaaaggacgtagtgagacagatatcaaggcctacattgcggcgcatctgagcacctatgacgaggtgtgacatgcgacaaacaaccactaaatttcaagaactattaagtaatctcgatgctttagggctaagtaagatacatgcttatctgccggaatatattgatcaaatcaacggccaacaactgtcttttaccgatgccatgcttgagctgacgaatacagaattagcttggacacaaagccaacaagtcgagcgaatcatcaagcgagcccgctttcctcaggtgaaatccctgagcgccttcgattttaattttcaacccagtattaataaacaagcgatcttaggttttcaagacttagcctttctcgaataacacaagaatttaattttcattggtagtcctggtgtgggtaaaactcacctagccatcgggatcggtattgaagcttgtcatcaggggaaaagggctttgtttatcaactgtcacgaactattggcgcatttacgcgcagctgatgccaaagggacgctagatcgtaatattagtcgttacgctcgctatgacctattaatcattgacgagatcggttatttaccgattgatcatgatgaagccaatcttttatttcaattgatcaatgcgcgttatgagcaacattcaacgatcattacaagcaatagtgacctttcgaattgggttgaaacctttcaaaatccgaccgttactgccgctattttggatcgattagttcaccacgcccatgtgattaaaattaccggtaaatcttatcgaatcaagggagctgattgaccgccacaaacctacattttctaaccgccataaacctacatttttacgccgcccttgacacatataaaatggccgcgtttttacgcgcaataaaatcaatttcctgcgcacctaacttgccaacatcaattgtatagccccgtcgttgcagctcagtataaacgatattttctaattgattgctaaaattgcctgcacgccgatcagtggcaatgcgccgtaatccaggatcgatcatgaagtatttcccagcagtacgcaaatattgccgcccgcgtaaatcatattgtcgtgcccgatagaatagaaaagcatcagctagtagctcaaggtagcggctgatcgtatgtggactaatcgccagtccctccgcctttaacgtattagcaattttattaggttgcaccaattgacccgtgttatcggctaaaaagccaaccactgcctttaacgacccgatatcgcgaacgctaccgcgcagcgaaacatcatttaaaagaaccgtgtcataaattccctttaatatctggtccttaaccgcttcattggctaatgttactgctggaaagccaccaaattgcgcatattccttgaatgcgcgatcaaccgtccttgactctggatcgatattcttagcgacgagaaactcacgaaacgagaatggataaatgggaatttcaacataacgtccgcttaacaaggttgctaactcaccggataacattttagcattagagccagtgatcacaatatcgcaatcaaaacttacgcaaacgccattgatgactcgttgccaaccagtcacattttgtatttcatccaataaaatatattgccgttgatcatgctgcaaacgctgatcaagaatatgacgcaactgagcttcagtttggaccaattgcatctcataatcttcaaaattaatatagataatatttgcgtctgctattccatgggccaataaataatcacgataaagcattaacaaaacagatttaccagcccgacgaacaccggttataattttgactagatccatatcttttaaatcaattaaattcttaagatactttggtcgctgtatcattattgaggagagtataaaatagtttgtgtaaatgaataaaagtcctgttgaaaagggaatcccttccccgtatgattaaatcatccaaatcaaaccaaaacggagggattccccatggatcagtttaccaaaaa

SEQ ID NO: 468 - DNA, 3964 bp, Unknown
  Metagenome-assembled genome
ctaaataggctattaatggtgtatgcactcgaatccttctttctggattttcttgttgttcgcacaccaagaataccagaaaaagacgttcgggtgttttttaatattcggaaattaataacaaaaatgaggtacgtttgacagtaccgtttggtaaaaggaggatttgttatgtctgatcaagatgtcaaacaagcattttcacattatgccaagctgtcactcgtgaacaaaactcgctcaatctacactcaggaacaacatcaggttcctaaagtaccattaaacgaggaaacagtggagtacccgatcaatgaaggcccaccaactattaaattaataacagcggaacaagctattcaccttgaggaatacctcattaacgaacggttgatcattgcaatagccagattaaccgatgctcaaaagaaattactttattacaaatacgttgaacaactttcagataaggcaattggtcagattcttcatgtcagcagtcaagcgatttccaaacagcatcgcaaggtgttgagcaaaatcggctcaacattcttcgactagtttaaccataaaaattcggtctcccccaacacttctaagaattagacgacccaaatctaactctgggagagcgaattgcaatgaattataccgaaacgatttacgcagcccagcatggcgacccacttgctatggctcagctgataaaagaatttcagccattaattattagcatcacttgtcgggggcattcagtttttgatgaggatcgttatcagatattaactgaacaatttattcgaacaacctacaagtttaatttggaacgttatttgtagttagacgagaagcagattaatcttttttgattaatttgcttttttggtttcatttctcatcctttatttgtatgtatatagtgaacaggaaatattacctgtgagccctttgacaactgaatattgctaccctaactttcttactttacttgaactgttgatctgtggacgccatgatcagaactgcgagcgccacccacacttcaactacgatttttaactaacaatcgtacaaattaagtagataatgatacttccgcgaggctcccacgtaagcaggagaggtgcaattcctatgtccgttagtgacggaactgggtagcaaggtctgacagcaccattaaactgttgcactattttttgaaaggaagtgaaatcaacacccgacttttttaattctcccccattagtcattcatacctgattggagatgatacactatcgctacttcagaattcacgatcacaatcagtgatcaacaacaagataaactacgtgccgaaatctatcaaatgatcatgggtgaagtcaagcgagtaaggactgatgccgccattggtacccgctatcttaagaaaaaggatctttgtaattacttgcaaattgccaacaatactttagatagctggattgctcagggcctaccatcgatcacaattggtggttgcattcgctttgatcgctcatctgttgatgattggttaataactagagctgacgaaatgaagcatatgagttaaaataactttgaagccttacgttcgctctgaaaaatttcaattaatttttttggaggaatgtagttatgactattagtaaaacaaaatctggaagttatcttgtagaagtgcaatacccgaaaaagcttagaccatttttcgacaacaaacgccgctacaagagaacactgccaagtctcaagacagctaagattcaagaagctaatgtgttgatgcaaattgaacaggtacgaaaggatgatagcccgcgttcattggaaactaaaggagaaatgttatttagcgatttttaccacaacgtcttcatggatatttatgttaagggtgcgactggacggacacgcgttgtccctacaactgagacaatcgattatcaaaaatcaatttttagacttcatattctaccgatgtttggtaattactcattgaattatctgaacaatcataaggaaattgtcatcaatgaattgacgatgaaatctgccacttttagcaatattcgcaatatcaagagttacacacgccaagtgtttgatctcgccgaagcaatggattatatcgaatataatcgcgttggtaaggttctaaacatggttgcatctccttaccatgaccaattaaaaaagcagcgtcaagcgaaaggagaagcactcacggcgcaaaagttgctcgactggctcgaagcgctagaggaagactatcaagccggtaaaatcacgttgatgcagcatttactcttcttgctaactttacacgttggtgaccgtaagagtgaaacctatggcttacagtggcgtcatattgacttgaaaactaattccctgttcatcattcaaagtctttctaaatctaagaagctcaaagacactaagggccataagttcactcagctaactattccagaagaactagttagtgagattgcagaatggaaggcacagcaagccgaagagttagcgcaaattggaattgagcaaacacctgaccaatttgtattcacgtataccgattttcgtggtcacatgaatgtccccttacattccgactatttgaattatcgaatcaagtcgatccatcatcgtcatccagaattggctaaattacacccacacaagttgcgtcacacttttggtacacttgcccgtgaaggtggtgcttccctcgaagatatctccgaagcactcactcattccgacgtagcaacgacaaaaatttacgtcaatacgccggatgtcatttccactaaggtgcacgaaatgttcgtaaatcgattaaaaaaagaggttctatactttttcctgttgatagcttaacatggtaatctattagcaggattttttagtgcaaaataaaaaaggcccataagcctcgcacctaaaaaatccacccactacagcatcttttttaaaggacgtgaaaacttatggaccctgtagataataatataaaatttgcgctcagtattaaagacccaaatgtagttttttacaaatataactatcaagtgattaaagctaagcgcgcaaaagtatatatagccacggttaagttcgaccagaaacattgcgctaactgtggcttttgcgagctaagtcataatggacactacgtatcacgcgtgacctatctggcagcgaatgcgagtgaaccagtttatttagaactccataaagaacgcgtcatttgtcgtaattgtaaagcgtcgtttatggctacttctgatgtggtagacaagtactgttgtatctcccgagccacgcgtcagaaagtgtttatgagtctacaagacgaccgcactcaagctagcattgcgatcgatgccggcatatcagctagcactgtctgtcgttacttagacaactatgatgacttatttcgcagaaatcttaactatctaccggttcatctcgccatggatgaatttagaggaattggtggtcggctccatttcatctgtattaatggcgctggtgagcacgaaattcaacaaattctgccagaccgattcaagcaaagtattactgattattttaaacaatttccagcaagtgttcgagcacgtgtcaaaacagttaccgtagatctaaatagttactatcaagacattgccaaggcaatgtttccgcaggcaaaaattgtgatcgaccgctttcacatcgttgcaatgatgactcgagcttttaatcaaactcgggtgcaaaccatgaaaaagtacaataaaagatcctatgaatatcgcacgttaaagttcgcctggcggctttatttgaagtatgccggaaatctagatgaggaacatgtcttttatgaccgacacctgcgaaaacaactcacacaactagaacgtgtagaacaaggactgacaattaacgaagaacttaa

SEQ ID NO: 469 - DNA, 1412 bp, Unknown
  Metagenome-assembled genome
tgcgctatcacattatacaagaggtaccttagggctggtcaatctcttttgcagaacttggtcaatttcttcgcttaatggggtaaaattttatgccgaagggggtaaatgggaatgccgtcatcacgccacgactacgcagggtagagcgcgttgaaaaagcgctcagattatggcctatagcctagctggacgataagagacacgcaagtggctcgttcgaacagcgtagctatacggaataagctgctttttcgaccacgtttcggctagagtgataaattaggcgctcaggatttgcgcatcagcctactactccacaaaagtagttgattattagcaaaaaccgctaataatctttgatgttacgggcgttgaccattcttgtggcaaaattcgtgccgcaagaaacatggcagttgggtgataagagacacgtagtgactcgttcacacaacgtagctagtcgcagaaacctgcaccatttagcatgtttccaccacccttgagtaacgcgcaccaccctcattttcgccgccaagcgtacgccccaacgccaaattgcggaaatgccgcaccactaaattatctactactacacccaatccaccacagagaggagcattcccatgaaacaacttgatatggagttcaagaacgaaatcggcaaaacgaaacacatgcgcctgaactacgcttcccagaccttggacgaaaccacggtcaaaacagcgatgcaaaccatcgccgatttgaagatgtttgagttggaagctgttaatccgtacgcaacgccgatcaaggcgcagtacatcgaacggacagtaacaccaatttttggcggtgaacctgaagccgctgacgttaaggttactgagtaactgaagtttagcgttaagcgcaagttttagcacgcttgattttataaagaccgcccagcaagttgactgctgggcggttttttgaccagaataaataataagttaatctttagtgggctgatactttaactacttaattatcacacctaaaatccacgaaactcatgtaatttattcgataattcgtcattcttattgataaaattcattagataggatgttgtaatttcaaattgattttgcgtttgtttatctttagtatataggacttgttcatcatgatcattcgtaacttgatagctatgaacaattctatttctcatatcgactaaattgctaaaacaatctacaatatccttgcctgaatgttcaactatagtctccttaacagtattttttaaatatggtcccctgtcaataaaatagacaatttaaatagagacttttttgtcctatgccacgactaaattttgaatttgagtttgatactcatcttcaagttgctttggtgatttgaatccacagtgactg

SEQ ID NO: 470 - DNA, 16943 bp, Unknown
  Metagenome-assembled genome
ttggccggattaatactgtgcgcgtacagaactaaccaactagaccactcaatccttaagtcgatttctacagttgcatctacaccaccttctgaaccacggttttcatagaacttttgacgttaccatcggttttattttttagaaaatgctgcggaaacgtgctaaaaagacagattattccgtgtagctatgcgtcttttttaggcactctataaaaaaaagtccctgctgtctttcgacaacagggacgatttaccgtggtaccacccagcttcagaattatttctgcacttattgttagataatggttaaacccattggcaccacaaaataattcatgtcgttaccctgcttggcttgcaccgaccgccaattctctgttcactgaagtaatgcactacttttgtcattgtagcgacaaaatcgattattaaattattatgagaatagcatacagaatgaaaaccgtcaaatgttttttcaaaaaagcttaagtcaagcgcgcttaaaatcgcgcttagtccttatttagcttgcttatcgtcatactaatcgttttctttttatcggtgatgatcacaatcgttccctgaccaagaaaatcagtgtctccattataagctaatgtgacttcctcggcgacattcccattttcctgcatcactaaaatataaatattttcatcatcatgatcatcgctgaaggctattgccaagggtgacgaaacgattttcttttgattacgaaaatcacttagtgtctgccataataacttgatcactgcttctggtacgcgttcttttacttcgtctgcggtttgccgcttttttgttggttcaaacatgcctctacctcgttttatttagaattacttcttactctaccaaactttcaaactttcttaaactaaatcgtcgccaaaaagtgcacttaaggggtacaatagacttatagtaattgaatcgtacagaaagtggtggtgaccatgatgatccaagtaagtattctgatgatcctcttaatggctggtttgatcggtattaattcacggcagttacaggcagtaaaagtacgtgcccaacggccaatgagtcgtgcaatgttagcacgcgaatatgcagccggccgcctaacgaccgctgagtatcaacgggcactacgtcaatattgctaattcttttatcggggctgcagcaaaatctttgttgcggctccatttttttgcctaaacttgattcgcttaggtataatgtaagtaaatttatctttggaggctattttatgacacgtgtaacgatcctcggcagcattaatgtcgatacgattctacaaattccccgcttacccaaacctggcgaaacgctatccatgagcggtaagcaagttgctggtggtggcaaaggcgctaaccaggccattgctgcagcccgcgctgaagctgataccgcatttatcggtaaagttggtgacgatgctaacggtaaaatgatgcttaaagcattgcaacacgctaaaattgacaccacacagatcagcactagcaactatgccgacaccggcgaagccttcattctcctcgacgacaacggtcaaaatagcattctcgttgatggtggtaccaatcaagaaatcaaaattggtgatatcgaaactgcacacgaaaccatcgaaaacgccgattttctgatcacacaatttgaaaccccattgaccacaacgttagctgcctttcgctacgctaaatcagttggtgtgaccaccattttaaacccagcaccagctaaaactgatctcgaccctgaattactaaagttaactgatctgatcgttcctaatgaaactgaaagcgaaacattgacgggcatcaaagtgactgacgaagccagcatgaacgcagcggcgaccgcgttgatcaagcaaggcgtcaaggcagtgatcattaccgttggcgctaaagggacttactaccaaacaaaagccgatcatggcttcgttaaagcatttaaggttgatgctgtcgatacgaccgctgctggtgatactttcatcggtgccctcagttcacggctcaatagtgatttaagcaacctacctgctgccgttttgtttgccaacaaagcctcttcgctgaccgtccaaaaactaggcgctcagccatcgatcccccatttaagcgaaatcttggctgacggtgagatcaaaaaagcgtgattcacagcgaatcacgcttttttgctacgccagcgttcccaccaatcgcgcaacttgcctgggatcggctgaattttgccataaaaatgttcctcggtcaaacgattcagaaaagcactcaacagtaaaatctgcgcgataaagactagccagaacatcaaaacaataaatgttccgatcgcaccgtaactgctgactgagcgagcaaagtaacgcacatacagtgcgaaaaactgtgctagaatcagccaaccagcagccgttagtaatgtgcctggcaaaacgcaacgcaaatgtaaccgtgcattaggtaagaaatagaacagcaatagtaacaaggctagcagcatgagcccagtaaccggtaattttaattgggcaaagacctggacaatcacgtcagacaagcccaagcgcggcacaatgtagtccaaaatatcttgaccaaaaccgaaaaccaacactagtaaaatcatgaccagcacaaaaaataaagtgagtattaatgataataatcgtgccaacaatgcattttgtggtgttttaataccataagattggttaatgctgtcgcgtagactgacaatcccccgactagctgaccataatgtgatcaccgcccctaaagacaataaaccgccgctaccttcagtcagaaagcccttgatctgcgttgctaaggttcgatagattgaagcgggtacaagcgcttcaatgtaactcaaaacttcattaaccggaatatttagaaatggtagtaagttaccgagaaaaatgagcaacggaaaaatcgatagtaacgcataataagccactaccaccgagtttttgctaatattagcttcttggtaagcggtcaccagctgtgcggttttttgttgccagtaggttaaacgctgccgtaactttttcatcgccggtgaacctcactttctactttgtgctattgtgccaactgcgctacaaaagccgcaaaatctactgcaacttcggcttcatgctgctggtcaccacgcacgattcgtggtggaccaggttgcgcgtaagaaaaggctagatagcgctgctcactagcagcaaaaatcaataatgtttcggcttgctgttcagtaagaaaatcagcgcgggccgcttgattcaaataaactaagtccgcggccacattttcattgttccgcccggcaaaaaagtaaccaaatccctgcagcgcacctaactcacgtagcatttgttgataaccacgcggtaacggtagcggtaatgtagtagctagatccgccaattcagtagtggtcaaccggctattcggcaaggccgtcaacttttgtgcggcaatcaggcgtcgtagcgttgccaataaatccggatgatgcacgattggtactttttcaacatcaagcgccgtttcgagcgcgcttgatttaggctcatcgtcggataatagtgccaagttctgcgccagtgcactaactttttgcggttcctgcttaatcaaacgttgctgacgctcttgcgttgcccgttgtaagttcttcaacttattctttaactgcttttgccgctgtttagccataaacgacgacctcctcttcactatggtttaatcaagccttaaaatttcgcgcttttttgcttcaaattcctcgttggtcaataacccttttttacgcatttccagatattccatgatcagctgaccattggccacaaagtcatcctcgccccattcactatttttatcgatctgttgttcaaggatttgttttaattcaagtacaaatggtgcgtcagatgcgctaaaccaaaattcagcgatttgctcggctgactttttatctaattgataagtgacttgaaaatggccgtcatcatcttctgttggttgatgcatttccatcccgatcagcgcagtacggggaatcaagacggattcgacagtccgtttcaagccatgcttaaccgagtgcgctaccagcaaatcgtgatcatctagggtcaatttaactgcattgggttttttcactttaatttccattaggcaggctccctcatttagtccatcatattaatttaagtttaccttgctaatcgctgaagtacaacattcacacgtgataatttcaattacacatgatcaaataaaaaatcgccaccaataatggcagcgatcagaaaatttattgtacagaataattaggtgcttctttagtaatttgaacatcatgcggatgtgattcacgtaaaccggcaccagagatacgaacaaattgagcgtcgtcagctaaactttgtaaattagctgcgccaacatagcccatccctgaacgtaagccaccgaccatttgatacacgatgtcagctagcttacctttataagcgacacgcccttcaataccttcaggtaccaatttgttggcttcattaacgccactttggaagtaacgatcagatgaaccgtgcgtgctgtccattgcggccatactgcccatgccacgataagtcttgaaacgacgaccttgataaatttcgaattcacctggtgcttcgtcagtaccagctaacatcgaaccaagcataacggcattaccaccggcagccaaggctttaacgatatcaccagaatacttgatcccgccatcagcgataattgttttgccatattcacgagcgacgctggcagcatcatagatcgcggttaattgaggtacaccaacaccggcaacgattcgggtagtacaaattgaaccagggccgatgccgactttaacaacatcaacgccaacatcatacaaagcccgtgttgccgcagctgttgccacatttcccgcaatcaaagttgctttcgggaaacgtacccgaatttcgccgattttacggatcacgccggcagaatgaccatgggccgtatcaataatgatcgcatcagcaccgacttcaagtaaggcttcggcacgctcaaacgtatcactagtgacaccaactgctgcagcaaccaacaaacgaccttgatcgtccttagctgcattgggaaattcaactgctttttcgatatctttaatggtaactaggccgcttaaccgaccttcatcatcaaccaatggtaatttttcaattttatgttgttgtaaaatctgttctgccttatccaaaggtgtcccctcaggtgcagtaactaacggttccttggtcatcaccgtatcgatagcaaccgcatagtcactaacaaaacgaatgtcacggaaggtaatgatcccaacaagtttccggttagctaatgaatcaacgattggtacaccgctaatgtggtaacgtttcatcaaatcttcagcttcttggatcgaatgttcaggagttaaataaaacgggtcgacaataacgccactttcagaacgtttaactttgcgtacctcatcggcttgttgtttgatcgtcatgtttttgtggatcacgccaagaccgccttgacgcgccatcgcaatcgccatttctgattccgtgaccgtatccatactagcactcatgatcggtacgttcaggtgtaagttcttagcaagctgcacactgacatcaacatcgtgcggcaaaacgtgactctctgcaggaattaataatacatcatcaaacgtgtaaccttgtttcgcaaatttcgtgtcccaattagacatggcgattatccaccccttcggtagttgaattagatttttacaaaaattaagtctgacgccggcaaatagtgtcggtattttgatttaagtttaccgactaacttaccagagatatctaatagcgtcaaggctttttaatcgttttttcataaataaaaattcacaaaatagattttatgttcgtgttttacgtatggcatagtaaaagtagctataattgttcggataaaaaaacgtagccaccattgctggtagccacgttttgtgttaaaagacagtatttttgatattgaaatgacttttgagatagattcgtaatcctaacgctacaaccccgatcacaatataaaccggcgcaggtaaattagcattcaacggtccagggatcaacatcactaacgtgtaagttccggttagtacgatgaagaaaataaccccatagatcaacatccgccataatggaatccgtttcttacctctagcgctcatactcgtttgcatcatcatgatcccataaccagccacgatagctaaaataagttccgaaagaataccagcttggccagtttgtactttcgaattattcgcgaagaagaacatgatcccatacattaagttgaagaccatgaaaaccatcagtgaactatccagcatcaacaaccacttattttgtggtgcgttcggatctgcttttggtccagcaatgatattcgccacgtgctcagtcaccgtaccaaataactgccgtgcagtttgacccgttttttggccagctaacattttactaattgcttcatcgattgccgcttgttgtttgtcggcggtcaatttaggttcagccgccaaagctttcttcaaatggtataaataatcctgattctttttggttaattcttcaggcaaatcactggctggcttgcttttttggtgctgttgcacgccagcgttgcgcgcctgcttatcattgctcatattttcccctccaaattaaacgttgaatctaaattcaataatgtcgccgtcttgaacgacatattccttaccttctgaacgcaaacggccagcttccttgaccttttgcatgctaccatacttatctagatcagcgaaagaaacggtttcggcgcgaataaaaccacgttcaaaatcagaatggatgataccagcagcttgcggtgctttgataccacgacggaaggtccacgccttagtttctttgccaccagcagtgaagaaagtccctaagccaagtaaatgatacgaagcacgaatcaagcgattcagaccaggttcctcgaccccttcagcttcaagaaaatcagctttgtcagcatcatctaattcagcaatttcttcttcagtttccgcacagacagcaattgtttcggcgccttctttagcggcgtactcggtgatctgctgaacgtaagctgattcttccggtgctgccatatcgtcttcggcgatattagccacatacaaaattggcttggccgtcaacaagaacaaacctttaacgattggttgttcatcctcatcaaattcgattgaacgaactgaaccaccagcttctaaaacaggcttgattttttctaaaacagctaattcagccaaagcttctttattgcgtgacttagcatctcgttctaccttagccaaacgcttattgacactttccagatcagccaaccctaattctaagttgatggtttcaatgtcatcgagtggcgcaaccttgccggtaacatgagtgatattatcatcatcaaaagcccggacaacgtgaacgattgcatccacccggcgaatattttccaaaaacttattgcctaggccttcacccttgctagcccctttaacgattccggcgatatcagtaaattcaaatgttgtcggtacgatttttttagccggaataatttcatcgatccgcgctaaacgatcatcgggcacctcgaccattccgacattaggatcgatcgtggcgaaaggataattcgccatttccgcacccgccttagtaattgcattaaataatgttgatttgccgacattaggaagcccgacaatacctgctgttaaagccatcttaaactgtcacactcactttctaagagtgcaaaaaaaggcgcccagattatggagttctagcctagcaagacaataagcagcacaccgtgatgcatttggcttgcgtagctagatgcaataacctgccttttttgcacgtttccatcaaaatattaaaaccaacacacaaatcacggaacataacctaactaataaccaagcagcaactcgttcgacttgcgtagttatatgcccataatctgctttttcaaacacattttcctcaaaatattaaaaccacccgctactcgctatctgcggctttttccaaaacctttttcattttgcgggtaaaatcacgtcgcgacatcatcacgatatgttgacattgcgtgcactgaattttaatatccgcaccaacacgaatgatctgccagcgattggcaccacaagcatgcggctttttcatttccacgatatcatttaaatcaaacactgctgtcccccctctactctacaatagtgaataattttttgctgttacggctgatgattcctcaaaattgctgcgttgcctcaggattcagtcacgcccagtaaatctaaaatacggtttagatcttcagttgataaataattgatctcaattttgcctttatcaccatgggccgcaatattgaccttagtgccaaaatgctgttgcaattgtgtttcactagccttcaaataaggtgactttagcggcttaggtgctggctttgctggcttctcagcgtttaactgactaaccaatcgctccagctcgcgcaccgtcaatggttctttgatcgcgcgttgtgctactgccgccatcttacctttatcctttaaccctaacaaagtccgcgcctgacccattgatagcgcgtgagcttcaaccaacttcttaacttcagctggtaaggtcaataatcgcagataattggcgatgtacggccggcttttacccaaacgtgtcgcaacttgttcttgggtcaaatgcagcttcttcatcagcatatcataggccgctgcttcttccaatgggttcaagtcttcacgctgcagattttctagcaccgcgatctccatcattaacggttcatcaacctcacgcactaacgccgggatctcatttttaccagctaatttagaggcccgaaaacgccgttcaccagcaattaattcatagccattgatacttttacggacgatcactggttgaaaaacaccattctctttgatcgagtcggctagttcttggagcgctgttgtatcaaattggcgccgcggttgataaggattaggccgaatctcgcttagtgccaacgcggttacttgctcgctggcctgaggtgttgcgaaatcgtcaaagtcactaaagagggcatccattccacgacccaaacttttattttgcttactcatgggcagctaacacttcctttgccaataaatcgtagacttctgcgcctttagatcgtgcatcgtagtcgatcaccggtagaccatgactaggtgcttctgataaacgtacgttacgcggaatgattgtttgataaacttgttgcgggaaaaacttgcgcacttccgccacaacctcagccccaagattcgtccgcgcatcgtacatcgttaataatacgccttcgattcgtaagtcaggattgaaatgcttctggaccaatttgatcgtgtgtaataactgacttaacccttctagcgcgtaatactcgctttgcaccgggatcatgatactatcactggcggtaaaagcgttgatagtcaggttgcctaatgctggtggacaatcgatcaaaatataatcataatgctcacgcgcaggagctaagcttaatttcaatcgtgattctcgggccattaaattagtcaattcgatttccgcacccgctaattggatcgtcgctggtacaatatcaagattctgatgttgggtgtgctgaatcgcttgtagtaacggatattcatcgatcagaacattataaatatcatgttcgatctgacttttttcaacacccacgccactagtcgcgttaccctgggcatcagcatcaaccaataaaatacgtgcgcctagctcagctaagcatgcgcctaaattaatggcggtcgtcgttttgcctacaccgcccttttggttcgcgatggcaatcacttgtgccataaattcagttcctttcatactttaaagtttaatttttttcgatcaacggttccttattcggtacaccggcgcgccgaggataacttttcggcgtttgccacttcttatcgaccacgataatgtgccgcgaatcccctgtttccggtaattcgaaggcagcagtcgtatttagctgaccacctaatttactgatcgcgtattcagcttcatccagctcaccatcaggcaactggcccttcaacgccacaaactgaccaccttttttgactaacggcaagcatagttcacttaaaacattaagtcgtgccaccgctcgcgccgtaaccagatcatattgttcacggtgctcactgcgtttgctgccaaacgtctccgcccgatcatggtagaaagccacgttgtctaaatccaattccccagccaattgattgaggaagttgatccgcttattcaatgaatcaacgatggtcacttgcaattggggaaaggcgattttcagcggaattgatgggaaaccagcacccgcaccaatgtcgcatatagtcagcgcttctgtccgtaattctggtaaataaaaacttggcgtcaacgaatcatagaagtgtttcaaataaacttctggttccgcggtaatgttagtcaagttcatctgctgattaacagtgactaacacttcaaaatagcggtgaaattgcgccatttgctgactagataaatcgataccctgatcagctaaagtcgcctgaaaagtagtcggagtcatgactgccgcctctctatctaatttaaatttattttccaatctcgtgaaacatttctgtttcacgtacctactaactgtaccgaaaatcaggcttaaatgcaagccgtttctaggaattttctatagcgcgtgcgttgcctgcaacgtaaaattcgctggctctgcgctagcgttatctttcacgatttgaaaccctaaatgcgcgtaaaaatccaatgcagcatgattacttttcacacactttaaccgcaatggtttacgccgtccccgctgtaattgccgcaataacgcacgaccaatcccttggccttgtgcatctggcacaacaattaataaatgaacaaacgccgccggcacataaaaagcagcaaagctgcagagtctatcctcattttccgcaactaataattgctcccctttagtttctttttgaaaatcagctaactgcggtgatttgatccaagtaaaagtttgttgccgaacttgcagataaatttgagctaattgtggtagatcatttttggttgcacgccgtatcagcatattgagaccctcttttcttactaatttagcacaaaaaaagcctgcccgcaggcagactttataaacatctaattaaccaataccgaagaaagcatgcatgaacaatgctgcgcaggcagcaccaacaaatggtgcgatacctggtacgatgatcccgtactgccaatcgctattcgctttatttttaattggtaacaaagcatgagcgatccgtgggcccatatctcgcgctaagttcatcgcgaaaccagttgggccacctaagcccataccaattgcccaaactaacaagccaacaccaatcggcacaatgcctggtgttttaacttcagaaattgccaagattcccgaaataaagataaatgtatcaaagaattcgacaaagaagttacggggcaagttacgtactgctggtgctgttgagaacaagttacgaatcgtgatcggtgaaacttcctcttcagaagccttgaaatggtctgcgtacattacccagacgatcatcgcaccgataacaccaccgagtacttcggcaactgaatagggaataaatactgcccaactaaggttacccaagatacactgtgccaacaccatggctggattgatacaaacatcgccaaagatgaataaggcgatcgtgatcccaaaaccccaagttgtgatggcaaaaatatgaccagagccacgatacttagttccttttaaaacttcactacaatgcacgccaacaccaaagataatcataagtgcggtacccataaactccgctaataaatgatgaaccaaaatttttcctcctgaatttggcggctgtgaccggcatttagcttgcccagcaacgtcgtttttgatggcaaattcagacattttggcaacaaaaaagcagccgtgattgcgactgtccccttagcctgtcgatatgtataagtgctagaaaaatttatcaggctaaatatggtgctgtttaccgctttgcatgaaaaccatctgcataacaataccataatttaacgctagataatagctgattccgttttcattagcaaaataatttacagtacgtaaaaagagctcagcattctcatgccaagctctccttattgagcatcgttaatttaatcggttttacggccaggattcaataagttcattgggtcgagtaacgctttgatctgatgttgtagttgatcaacattttcacccaactcttcattgttccattgatttttcaataaacctaccgcgtgttcaccagaaattgtgccacctaagcgtaaagcttcacggaacattaattgtaatgcttgggtcactttctgcggtacttcagtctcttcttttggccaaattaaggttggatggacgttaccgtcaccagcatgcccagcagtataaatttcaacatccaagtcttgggcgatcttcgcaatgtaatccatcatgtcagccaatttagataacggcacggccatatcttccataacatgattgccgttagcaaataccgctggcaacatatcttgccgtaatttcaaaattgcagcctgttcatctggatcactggttacacttaaatgctgtgccgcaaactgagcgaggatctcctccacctttttaagggcttcttcaccaccgttgtctagccgcaagatcaatagcgcacccttaccttgagcatagtgtgttccttcataacgatcaagcgcttcaacggttgctccatccaatgcttcaagcattgctgggtaaacgccagaagcacgaatttcagtcactgcagcagctaaagttttcatatcatggaaaaaggccatccccgtaattggttgccctaatgggatcggcattaatttgacggtcacttcagtaatgatacccagtgtaccttcagaaccaacgaataactgggtcaggttataaccgaaagcttgctttaaagtccgatgacctaatgataattcgcggccgtcggctaaaacaactttgacccctaaaacattatcacgagttgcgccatatttgaccgtactcatcccaccagcattagttgatacattaccaccaattgcagatattggtttagaacctgggtctggtgcataaaacatcccgactttccgagctgcattatctagatcttggttgatcacacctggttgaacaaccgcaacttgatcagcacgactaacatcgaggattttattcatccgccgagttgataacatgagaccatgttcgatgccatcggaacctgctactgtactagttgctgctgcttgtggaatcaccggtaaatggaacttgcgtgctgtgcgcaaaacaccttggatgtcagctacatcagccacttctacgtaagccaatagcttaccagaaccagtccccattccgtatttgccggattggtgtttatccaattcattaggttcgaaaacaacctctgcatttggtgcttgggcgcgtaagtaatcgataatttctgtatcatcataagctgggaaaaaagccatttttaaaactccctttcgtatgttaataaaaaagtgaagtaattctattaatggtttgattataattcttacaaaaagtaagctcaagttttaagtcttgcgatcactataattcagaaatatttagagaataaaactgcccactacaccagctacgattcccataactaatacgccaccgccaataatagcaagatttttccaactgaaaactggttttaataaagttaaagaaacaacgctgaccgccggtaacgtgatcaacaacgctgctgccggacctgttgttaatcctagcgccatcaacgcttgaataatcggaatttccccagcagtcgggataacaaacaacgtacccaccacggcaaacagtaaaataaccatcaaaccgccatttaacccgttatgaattgccggaaataaaacgccttggaaagtgcctaaaatatagacgatcaccacatatgcaggaatactttcaacaattaaacgtaccaacgctttaagccaacgtacaagcaatatttcattggattcatcaatcggatcaaacattttattgttcggtacagttacatttttttgtgcgccgaatttagcaaccaaacttgcgattcctaaaaccgtgaccaaaccaaaaatgatccgaaaaattgtgaaattccaacctaagacaaagcccataaataccaaggtggctggattcagtaacggattggctaaaaagaaagcaacgacactattactggaagcctgggaacgtttcatgccaacagcaactggtgcactacaacaagtacacatcattgtgggtacacccatcaaagtcgccacaaacgaatctttaaattgactgccacctaaatagcgcttgatccaactggttggaatcagcacttgaactaacgagccaactaataaacctaaaataaccgccttccaaaccgaagtaaaataagcaactgtgaactgccaaccggcctgcaacgatggcccgctagccttagccccaatatcggcgataatagcagttccgatggagtgagttgcgctagcccctagcgctttttgccaatatggataccatttaacatagactaaaccaccaattaaaacgactaaaaataatagaataaacaaggcctgacgtagacttttatgattgctagacacattgtattcaacatttcgcatccggtgtcaccccaataatcaaatttaaagcgctttctttaaagatatcacacactcggtttttaaacataattttattttgttagtctattttttatttagttgccgtaaacttgaccgactatcaggtaacgctcatacttagattagacacgtataggggatgattttgatgaacacaaacacaaataacgcgattcatcgcggctggaataaacgtattgtcaccggcaaaacattagccgaatgtgacgaaaaattagtcaactacttaaatcaacaagattacggtactggcgaatttgttgtccttcatgaagacgatggtagcaacatcaacactggctataaattgcctgacggtgatgtttgctacatcagtttcatgatctactcaggacgtctataagccgcaaaagtctaggcagaattttctgtttagactttttttataggctgaaagaaactatcatctggtggtataatcaagctaatgttagtgcgaagaagggaacgattttcatgcaaccacaacgggtacttgatttggaaggcggaattaattttcgtgaacttggtggttatccgacaactgatgggcgcaaggtcaaatggcaaaaagttttgcgtgccggcggcttggatgaattgacaccgagtgatattgccgctttaggtaattacggcctgcgctatgatattgatctgcgctccgaacacgaaatggcttctttccccgaccgcttaccagctgccgctaaaatgattcctgcaccggtttatccatttagcgagcgtgactccttaagcgggctggatattcatttgcaaaacaaaaattgggccatgttctcacaaatctaccaacaaatgattgctgatccacatccacaacaggcatggcgagctatttttcaagcgatgctcaatgccaccggcgagcatgaaagcgtggtgttccattgcgctgccggcaaagatcgcactggtgttggcgctatgctagttttaagcgcgcttaaagtcgcgccagaaactatcaagcgcgattatttattaactaaccaaattttcggtgccggtaatcgtaagagtatcgaacaagttgttgcccaaaatgaacacgaagacttaactaatcgtatgaaccaaaccttatccgtcgaggatgccaattttgacgcagtttttgcgacaattgaagcatttggcggcattgatcgttatttaatcgatcaattaggctttacggccgcagatatcgcgactttacgcgcaaattatttagaatgaggtcaattatgtcaccgaaaatgcatcaactacaaaatcaacttatcgctgctgctcgcgagtcgccactcttgatttttgaagccactagtcgcaaggacggtactagttttcgcgagatctctaatcgccgccgctacaaaaatttgacaaataactatgattttaaaatactggctgatgaactccgcgtcactgaaacagtggttaactgggcgattgccgaagcgcgcttacatgatgagcccgaagatacgacaaacaaacaagcgtttaaagagacaactaataatgtgctacgcgaaaatggcgttgccgaaaataattaagttaaaaagactgaccagtaaaaattaactggtcccaaattgcaagaacaaattagccacacgataaatcctattaaatcagtattttcattaatattcatattttatggacttaacttaaccggcggaagcagcggagaaaagcgctttgggtgt

SEQ ID NO: 471 - DNA, 26889 bp, Unknown
  Metagenome-assembled genome
tattcgccacatgaacgaggcagtaatgaaaatcgcaaccgagtactacgccgcttcattcccaaaggtcaaccgattgatgagattaccgatgatgaattgattcaaattaactggtatttgaattgccgaccactcaaatgtttaaattggcgaacaccgattgagatctttttgcgtaatctgcgttactaaatttgttcaagttatttcttgcaatctgccataaataaaaaacaaccagctgcctggttgttttaattaaaaactatttagttgtgtcgagcgcgggtttactttttttcaaatgccgataactaaccacataacgaccgttgacttcttccatgatcttttgcgtgatcttgccgccgacttcgagtttgactagcgcgctgttaacgtatttcttggcgataacaccagtgcaatcgggaataccttgttctttggttacattgacctgatcaccagcggtaaagcgccgactttgctcattttctactggggcggtactattaggttgtgccactttaatccttctttcattattgacactgaaactgactagtttaattataacactttccgcagtctacttagtacagatgctgcttgacttcactaggaaatacgctatattcaaagtattgagagcgctttttaaattaaaatagactgaaaaaatttttcaacagattaaattaattagaaatgggatgagcggatgagaccttttacacaacaggttgttctattaactggggcatcatcgggcattggtgaagcgactgcgattcgtttgcggcagcgcggttttattgtttatgcggcggcgcggcgcgtggaacggatgcagcatttaactggtttaggcgtacatgtattgcctttggatgtgacggatgaagctgccttaaaaaatgtggtgcaacagatcatgacccgcgagcagcggttggatattttgatcaataatgctggttttggtgagtatggtgcggtggaagatgtgccaataaaagatggtcggcggcaatttgaagttaatgttttcggtgtgatgcgcttgattcaattggtgctgccaatcatgcggcgccagcattatggccgcatcattaatacgagctcaatcggtggtaaaatttatcagccgttgtcagcatggtatatgggtaccaagcacgcattagaaggaatgagcgattcgttgcgcatggaagttaagccattcggtattgatgtggtgttgatcgagccgggagctactaaaactgaatgggctggtattgctaaggctaaattgacgcagatctcgggccatggtgcttatacggcggcggttcgtgaaatggccgggcagctaagtttgtttgctaaaatgggctcagcgcccactgcgattgccgatttgatggagcgtgcggcgacagctaagcggccgcgcacacgctatgttggtggttttggcagccatgcgtcattgattgggcggcatttgttgtctgatcggcaattcgatgtggtcatggcggcaacgttaggtttaagttatcggctatatcgacattatcaaaagcaagggggacattaatttgaagcgatcaacgcgacgtttattaacaacaactctagttggtagcgccggtttcttactggggagctacttgacctttcagggttcaacgatgaattggcgtaaagatagccgcaaacaacgtgatcttaattttgacaacagtgatccctgggtattggaaaagcagtggtttcaagcacaaaaacgcgaaccgcggcaaataacgacagctgatgggctaactttgcgcgcaattttgattcgacagccgcaagccacgactaaggtcgctattttagcgcatggttatcatcattcctgggaacaaatggcgccatacgccaagttgttttatgattttggttacaatgtattggttccagatgcgcgtggccatggtgatagcgatgggcatacgatcggtttcggttggttagaccgcaaggattacgtccaatgggcgcaactgatgacgcaagaatttggtagtagcgcgactttggtactatttggtattagtatgggcgcggcaaccgtaatggcagctagtggtgaagcggccttaccaacaacagtcaaagcggtgatcgaagatagtggctttagctcagtggtcaaagaagtaagctatcgagcgcgctcgcggtataatattccgacgtatccatttattccgttgatggcgttatttgcgaagcagcaggcgggctattcctactatcaaggtgatattttgaagcaagtcctgcacagccagacaccaaccttgtttattcatggtggtcaggatgattacgtaccaccaaaggcttttcatgttctttacaacgcagctacaatgcgaaaaatggcgtactttgtaccgcaggccaatcatattgaagcttatatgtttaatcgggcgcgttacgaagccgtactacgggagttcttgagcaaattagacttactgtgatcttgtggttatcgcagatcgagcaagtgtactttgaaaaaataaatcaaattaagactatctttatagagatttgctataatgtataacgatcaaattatgtagacgtgatatttcaatagaacgaggtaacaatttgagtgttaaaaaattatggcgtggtgtactattgctgatacctttagctgcaatagtgatcgccagtcttttatttgttggttggcatacggtgccggcgcaaacatccgcaccagtggcattggaaaatggttgggataagctgactggacagcaaccggtggcttttcaattacaagttgctgcaaaagcgcaacggccagttttgcccactggctgtgaaatcaccgatgtcgcgatgttactggaatttcgtggtaagccgcaatcgttggctaaaattgctaacgagattccttatagtgatgatcctgaagctggtttttggggtaatccgtttaacgatactggttatacgatgtatccgcctgcatggcgtcactattttgaaaagcatctaggcagttttgctgatctttctaaacagccggtaagtacgttccggcaacagttagccaaaggtaagccgatcgttgtttgggtggaaatgcacggttttccggcgcatgccatcttgttgaccggctattcgacaagtacctttatttataatgatccttacactggtaaagctgaacgccgtattagtagtcaacatctatgggaactaatggcgtcgcaacattatcgagccatgacttattaaaattccgccaccagtagtggcggaattttttgttttggcaaagttaagcgcgttatcgagcgcgcttaactttgaatataatgcgatcctattgcgtcgctacaggtttgtcgctatactaaatgcaatcggaggtggtgtgcgtgacgcagaaaaatgaaattttagatacctgtttgatggcgggacggatcatgatcgaaagtggttcagaaatgtatcgggtcgaagatacaatgcagcggatcgcacacaatgctggcgctagtgccagcagtattttttcgacaccaaccggtttatttatggcgttaccagcgcaggatgcagttcagatccagccaatcactacccgaacgatcaatttggagaaggtggatcgcgttaacgcactatcgcggcaatttgctgagcataaagttaccttgcaccaattgcatcaacgcttggaaatgctggatcacgatgtgccgttttttccgttatggttacaaattattgcagctgctgtagtcagttgtaccttaatgattatttatggtggggtctgggcggattttattcctagcgccgtcgtcggtgccatcggttatgcggtgttttattttattcgcgaacgtttagctgtcagtttccttagtgaatttatggcggctttcacgatcggtttattatcatgggcgctggtgcattggcatttaggtcagagcttagatatgatcattattggcgcagtgatgccactagtaccaggggtggcgattactaatgcagtgcgcgatatgctagctggtcatttattatctgggctggcgcgggggatggaagctttatttagcgtgagtgcgatcggcatcggtattgcgttgattttccgtttcttttcttagcggctgaaaaatagtggaggtggcggcatgtggcaacaagtattgttacaagttggttttagttatttagcaacggtagcgtttggcatttgtaccaatgtgccccatcgtgcgctgaatgcgtgcggactcactggtgtcgccggttggctggtttattggggcttggtccaattaaaattgggccatatgctgcctaatttagttggcgcttttgtcatcgcgatggtcagtttattttttgcgcggcatgataaaattccggtgatcatttttaatattcctagcttagtgccgctggtgccggggggaattgcttatcgggcggtgcgcgcctttgttttaggtgactatacgcaaggtatcggctttatggtacaagtcatgatgattgctggtgcgatcgcggttggatttatgttggcgcaattagttagttcaccgggacaattggtgcgccgtcgtgattgagtgttgccattgccatcaaaattttacatgtttgtaatagtattttcgtgaaaatgatgatataacagtcctaagctaatttatattttaaaagtgtggcgcagatacgtagccactggataacagtctattggaggcagtaacaatgttttttaataaaccgatggattatttggtaactggcgtttacacgatggcgaatacgcgtaaaacagaacactgcattatgcataacgcgactaagcgcgaagcaaaacagcaaatgctggattacttgacgcataaattaagtcagaatgatggatcttatgcagatattgtatcgatcaacgtcactaagccgacaacggcaaaagctaaataatgttcattaagcgaagctaccaatatttggtggcctttttattttctgatcagcagtcggcgtactaaaacgcttgctattggtaaatcgaaccagctataatggagttggaacagattcctagcatgtttggcaatcgggataaggttgattgccgacaggttagttcagaaaagtgaggtataggtaaagatgagcgcaaaaaatacgcaggatccattagactttgaagtgcaaacaatggcatttcggcggctgttagtggccgtagatgaggatgattcgacctcgtcaattcgcgctttcaactatgcggtgacgttggccaaatcctaccatgtgccgttagcggtggtaacgattttagagacaagtgatttaaatatttatgattcactgtcacctgatgttttggcaaatcgacgcgaagaagtattggctaaggtcaatcgctacgcacagaaggctaaagatttcggtgtagttgaagtttcatctttgatcggcgagggtaaaccagggaaagtaatcgttaaccaagtcgttcctgaatggcggccggacctattgatcgtcggctcggaaactaaggaaaagggtcgcttatttattggttcgcaggccagctacatggcgcagaacgcaccttgctctgttatcgttgtgcgggctagtgaccagtatgaggcataaaaattaatggtgaggcgctggaccgcaatggtgcagcgtcttattttgtagggacgtgaaaaattggagtatccaaatagttatttagcacggtttgtggcgcggccgaatcgttttattgcgacttgccgattacatgatgaattgattcaagtccacgttaaaaatacaggtcgcaataaggaaatcttgcaaccggaagtaccggtagcgctggttaaaagtgataatccacagcgtaaaacgcagtatgatttagttgccgcaaaagtcggtccacgctggatcaatattgatagccaagcgccgaatcaagttgcatttgagagtattaaaactgggttgatcaagttaccaggaatcgctacccgtgatattttatcgttaaaacgcgaagtgacctttgaagatgcacgttttgatatctttggcagtaccgctaagcagccgttttttgtcgaattaaaaggcgtcacgttagctaatggtgcgctggccgcttttccggatgcgccgactagccgcgcgtctaagcatgttgcgaccttaattcgcgctcaagcagctgggtatcaagcttacttatgttttattatccaaatgagtgggatcagcaaggtgacgatttatcaacaacgtgatcctgcgctttacgccgctattttggctgcacaaaaagcgggtgtccacctgctagcctatggctgtgcagtgacacccgcaacgttaaacgcgacttatccagtaacgattgatctggcgcagccgtttaccgaggtaagttagctactaatgaatcgagattttgttgaatataggtcgctgaatggttaaatttttgttgttcttgctcagttaatgcgacatcaacgacccgtaaagtgccggtgcggccaatcagcgtgggctgaccgatgtatagttgatgttcggaattccagctagaaatcggtagcgtaacgtgcgcatcactaaagatggcttgcacaacagtgactgctgccgcggcaattccgtaactggtaaagcccttaccgctaatgatttgccatgcgcgtgtgcggatggctttttctaatgcggtaaaatcggtcttgcgttgtgctaagacttcggcgatcggccgtgttgcgactgtgatcgttgaccaagcggtaaattgtgattcgccatgttcgccaagattgtaaccctgtatgtcttgcagtgaaacatgtaactcattagctaaagcacgccgcatccgcatggtatcgagtaaggtgccagtgccgaaaacttgttgctgggggagtccagtcaatcgttgtaaataagtagtgacgacatcgcaaggattggtaatgtccagcaaaataccgttgaaaccactggccataatttttggcgccgtttcctcggcaatttgactagtgattctaagctcagcttgacgattatttttaccatcgctgaaaatcgaaatatcaccagctgctatgatcacaatatcggcatcacgtaattgccaataatcttgcgtgatgatgtgcgtatgtgtggctaaaccagcttgcgtatcctcaaggtctaacttttccgctaagacgactgcttcattttgatcgatcaggactaattcatctgcgattcccttagtcaccagtgtataggcaacggctgcgccaacgtgaccaagaccaatgattccaattttacgcacaaaaaaacctccaattcacaattaaacaatttagcaaacgtttacttatatttttagtatacgcgaaaacgcgagctaacgccttttttgtgaggaggttctaatctaagcctcattttgtgcagtatggagcaaaggccgactggcaaaatggatcacgatcaagttgatcagtaataaaatagcggtcatggcaaaaacaccgcgataatcaaactgaccggagatgacggcacctaacatcggaccgactacactaccaatagcctgaaacgactgattatagctaaaaatacggccaaaaacgctttggggtacatgctgggtcataattgtttggacagcaggtaacaaggcggcgtcagatacaccgactaagagacgcaagaagcccagctgccaaatattttggacgaagctcatcgggataaacaccaaggtggcaaataataaaccgacgagtaatactttttccgggccaacacgatcgcttaaagcacctagactaggggcactgatcaaggtgacaacgccaggtaaggcagcaatcacaccgctgaccatagcgataggaccgtgttggtgcagtaattcaccgacaaataaactaataattggcgtgaccgacatgttagcggcttgaatgatcaatgtcgtgatgaacatccctaagatcaattgcggatactgcaatttgtggaaaatttgcttggttggtagcagatccttagtggcaacgggagtaaattgctcatgaactaatactaaggtggcaatgaagacaattgccattagcgcaccagtgacaaaaaatgtgctgcgatagccgaacgtaccggcaatcacgccacctaataagggacctaacagtgtaccaaccacattaccagtggccagtgtgcccatggccttaccgctatgttcacgaggagcggcagccgcaacgatcgcgttggcattgttaatatatccggaaaaaccaccttgcagcgcccgtaaaataatcaagctagcaatactgttgactaagccacaagcggtgattgtaaacgtcatgcccaaagcagcgcgtaagcacataatcttgcgtccatgggcatcagccaagcggccccaaaatggtgaaacaattgctttgactaaaaaagtaatcgcaaaggccgaaccacttaacaaggttaactgtggtttggtgaaattacctaaagttttgataaatagcggcaaaaagggcatggtcatggaaaagcccatgcccgtcatgaaattacctgcccataaaacggcgaggttttgccgccaagtggtattttgggtcataaacccgcctactttcttaagtgaatttaaattaaaaaacagaaccgcaacgaatactgtcgccggtcctgttttagtctaaacatggttgaaaaaaccgattttccaacgcactctaactatgttgtaagacagccttagccggcgttgcttgctcacttttgaccgctttgttgcgccagtacgatgacagaacggaaccagaaatgttgtgccagatactaaaaatcgttgacgggatcgcagcagcgggatggaagtattgcatggccaacgttgcacctaaagccgagtcttgcatgccaacttcaaacgtgattgctttacgctgcggataattcaagcggatcagcttggaaaatagaaaaccgagaccataaccggatagattatgcagcattacaacggggatcactaaagctgtttggctagtaaacaaatgagcgtggttagcggcgaaaacagcgcagacgatcaaaagaatagctgtttgtgaaaccaacggtaatatgtgattaaccgccgcaatgcgatcgccgaagagggtatgtaccaagacgcctaagaagatgggtaacaggacaatgcggatcgcgcctaaaaacaatgatgccgccgggatcgtcacccactggccagcgtaaagcatcagtagggatggtagcatgatcggtgctagtaaagtggataacataccgatcgaaacatctaaggctacgtcaccgccagcaaggtaagccatgacgtttgatgacgttccgctaggacaagaaccaactaagatcacgcccactgctgttggaccagataagtgaaaaatcaggcagagtaagtaggcgatgccaggcatgatcacatagtgagccacggtgccagcgataactggccagggccgccgtaggatccgcgcgaaatctttacgtgatagggttagccccatgccgaacaaaacgacacctaaaagtaatgatgtgtgtggcgcaattgcggtccccacactaggaacgaagaaactaaacgcagcgacaacaacgacaagtagggtaaaccatttgctgacccaattgcccagtgattcaactttttgcatataaaaacctccaaattaaattattttttaatgaacaccgagggcgatacgggcatagcgactcattttgtcgatgccccaggcgggttcccaaacgagattgatgttaaccgcggtgacttctggtaaggcagttaaggcatcatcgatcatttgttctaacacatctgagatcggacagcccatggtggtcaaggtcatcgtgacggtgacgacactatcgaccatgctcaggccgtagatcaagcctaagttgaccacgtcgcaaccaagttcaggatcaataacagtgcttaacgcatccagcatccgatcttgcaattcggtggcgctttgtgttgcggtattttcggccataaactgatacctccttattacacagttaaagtcatttattagcacacttggctaatgagacccattgttgctatagaattggaacaaaaaacgccctgcgtagttggtgctaggcgtttttaaggatacaactaaactgattacggttgcctaatgcagtttaaacgtggtcgaaaaaactatcgctttttcaactcattcttgctcagttgcggggccaaataattcgtcggcacttttcatgatgccgccggtattagcggaagtgactaagtaggtataacgtgctaagtaaccttggcgtacttttggttggaacggctttaaatgcttgcgccgttccgcaaattcggcgtcagagactttaacgttcaatgtccgattgatcatgtcgatagtgatttcatcaccatctttgatcaatgcgatcggaccgccagcggcagcttctggtgaaatgtgaccgacagcgatcccgtgagtggcaccggaaaagcgcccatcagtgatcaaaccaacatcacggcctaagccacgtccaactaagtccgaagttggattcaacatttctggcataccggggccgcctttgggaccttcataacggataacgaccacatcgccttttttgacagtgccatcatcgatcccggcgacagcatcatcatgggagtcgaagcagacggctttaccagtgaagacgcggatatcaggatcgacaccgccaactttaaggacggaaccatcaggggcgatattaccgtaaagaacggataagccgccttcactagaatatggattatctaacggccgaatgacctcgtgatttaaacttttagcacccgcaacgttttcacgtaacgttttgccggtgatcgttggtcgatcgggatgaatgatgccacctttttcgatcagttcattaatgatggctggcataccgccagcctcgtggacatcctgcattgtccacgaagaggatggcgcaattttagctaagaatggggttttcgcagcaattgcgttgatatcacgttcactgtaatcaacgccggcttcgtgagcgatggctaatgcgtgtaatacggtattagttgaacctcccatcgccatgtcaagtgcgatacaatcatcaaaagcttctttagtcaaaagatcacgtggccggatattatttttgaccacggtcatcaattgtttggcagctttgcgaactaaatcacggcgttcttcagaaactgctagggcagtaccgttgtatggtaaggctaagccagtcatttccatcaaacagttcattgagttggcggtgaacatgccggcacaggaaccgcagctgggacaagcattttgttctaattgaaggaaatcttccttggtcattttgccagacttgaaggcgccgactgcctcaaacatgttggatagcgtcacggctttaccattaggatctaagccggctttcatcgggccaccggaaacaaacacagaaggcacgttggtccgcgccgctgccatcatcaacgccgatcgtattaaattcaaatggaatcccgccggcttcgcggatcgcttcctttgcgatatcggcaagttcacgtaaatgaacgtggccagggacaatttcaatataggaattacagatggcgataaacggttttttcatatcatcggtgtttttgactttgccagtggcatataacaaactacgtcccggtgctcgatcatcgccgaccttaatttcgtcactgcgcttctgcatatctttaccagagatcgaaaaatttaaggtgtcactcatgtgatcagctcctttttaattttaaaatgtgaatttgatgagtaaaagttgtaatagtacgaatattaacaccgatttttttaatcgtcaaccaagaaaaataataatttttttacgaaacactgttgacatagtatctgtagccgtgtaaaatgagcctcaatcgaaataaaatttaattattatctaatctaaaagcttcgacgaggaagagtagtcgattgcagtacctgaacagagagccttgtgagctgagagaggcagtactgttattgatgaaagtaacctttgagctatctgctgaacaaagtaggcgggattgggagtgcccattatcgcaccaacgcatcaactctagaagggatgagctagctcgtttctacgtttgtgatctatctaaaggctccaagcagacgtagcattctgatttctagaagtttgtgcgcggcagaggcatttgcggtgacgtagatgtaaattaaaggtggtaacgcgcgataagcgtccttagtgatctaatctcatagatcactttgggcgctttttttgtggagtgcgacaaaaggcgctcagcttctggagtataacctagcttagtgataagagacacgcagtggctcgttcgctaagcgtagttatacggaagaagttgccttttgaagcacgttctccctttagattagattgttctttgacaactatatcttgaaggcagtatctgaatttgcgctaaagctactcgcggcatgaagtgtgatgtgagtcatttgtccgtaacatagaagaaaataaattaaccgtaactatcaatagaaaaggggaattccattatggaaacaacttatgaaatgatcgtctgcgctaactgtaatcacaccgtccccagcggtaacttctgtacttgctgcggacagcatctctttgaagaacaagggcataacgtgtttagcaccagcttctgcgtcaattgcggtgcacaaacgcctaacgccaaatattgcagcgtttgtggatttgaaaaagattttgatcgttatttctaaaaaagtgttgacaatgaactaagatcacgtgtattatgagcaacatagaaatcgagttacatttaaattaataatgtgttgacgagcaaaagtatttttcatggcttgggtaagcgaaccgcgtttggtgagaggcggtaccaactatgatcaagaaaatcggctctgagcaatgaatcgaaatttttagtagaattcactggctgccaccattatctggctagcgtatcggcaatttttgcccgcacgtgaagaggtagttgcagtaatgtcgctacaaataaaggtggtaccacgttaatataacgtccttcaagataagtaattttatctcgaaggacgtttttttataccctaaaccgctagctaaaaacagtttcaaaaaaatttcaaaaagcagttgacattattaataaaaagagtaaagtaacttacataaaatctaattgtattttaatcaaaacggaggtgagcagatgcaagcaccagaagaacagcccatgccagtacgtaatggcgctgaattattgcttgatacattaactgcacaaaatgtcgaaatgattttcggctatccgggtggcgcagtcctcccattgtacgatgccgtttatcggcaaaagttccgtcatattcttgtccggcatgagcaggctgctgctcacgctgccgaaggttatgctaaagcaaccggcaaacctggtgtcgtttttgttactagcggtccaggtgcaaccaatgcgatcaccggaattgcggatgcgatgatggattcaatacctttggttgtttttaccggccaagtcggtactcaagccattggcagtgatgcattccaagaagcggatattctcagtatgacggcttcgatcaccaaaaataattatcaggtccacgatgtgcgtgatttaccgcgaattattaatgaagcgttctacgttgcttcaactggtcgcaaaggaccagtgctgatcgatctacctaagaatatcgccaatcaaacgacgaacgcaccgtttccagagcaagttaatttaccgcaatatcaaccagcaccaaccgttgataagcaccgggtcgcacagctaatgcaggctttaagccaggcgcacaaaccagtattattagtcggcaacggcgttcacgccgccgcagcgcaaacggaagtgcaacgtttcgcgcagcgttaccaagtgccagtcgtggctacactgcttggacttggagttatgccaaccaacgatccaatgttcttgggtatgggcggtatgcacggtacttatgcagctaatatggcactttccgagtgtgacctgctgatcaatgtcggctcgcggtttgatgatcgtttagccacggcgccacagagatttgcaccacacgcaacgatcgcgcatatcgatattgatgctgcagaaatggataaagtgatcgccaccacttaccaactagtgggcgatgccaaagctgttttgaagttgatgctgcgtagttcagcaacacgaccagaagtcagtgcttggcaccaacagttgcaggaatggcagagccaacatccaatgcattatcaaaagagtgctaccgagatcaagccacaacaagttgttgagttagtgggagagctaactcatggcgatgcgtatgtggttaccgatgtcggccagcaccaaatgtgggcagcacagtattatccgtttaaacatcagcaccaattgatcaccagcggcggcctaggcacgatgggctttggcttacctgcagcgatcggcgccaaactagctgcgccggataaaccagtggtgttatttatcggtgatggcggtatccaaatgactagtgaagagctagaagttatcgcaacttatgacttggatatcaaaattgtactattaaataaccacactttaggtatggtccgacagtggcaggatctattctatgatcagcggcgttcacaaacgatgtttgaacatcagcctaacttcatgaagttggctgaagcgtatggtttggcagcacatcatctcactgatccacaaacagtggcggccgatttggccaaagcatttgcagcaccacatgccgcactgatcgaagttgcgattccagctttggaacccgtaatgccgatgatcgcgccaggcagcgctaataatgaaatgatggagagtgattagatgcgacgggtacttacttgtcttttgagtaataatccgggagtgctgaatcgctttactgggacgctgactcggcgtcaagtcaatattgacagtatttcaattagtccagttggcgataaaagtgcttcgcgggtgactgcagtcatctatttagatgatacggcggcggctaagcaattagttgcccagttaaataagcagatcgatgtgttggagatccacgatattacggaacaaccacacatcgagcgcgagttggcgttgatccgcgtcaacgccgcaacgaacaaacgggcggagttgttcgcgatggtccaaccatttcgtgccgatgtcgtcgacgtcgcactagattcactaatgatccaaatcaccggatcgcgcgagaaagtcaacgcactgctccgcgtagtccagccgtacggcgttacccaagtcgtacgcaccggggttgcaggctttaccagagcagaaggatagagtgtgacgggaagcgttcaggttttgagcattagcctagtttcgagataagcagcacgaagtgatgcgttctcgaaacgtcgctaagcggaaaaactgcttcccggaacacgtttccgctatcaaaagtgagtgaaccgttcaataatcacgttcaatcccacacactatctcaaaaaagtctgattaatgtaggtcacaattttcaattcttcctattatataggaagaaaaaagaaagtttgcgataaatttggttacagaaaacagtgtggttactgttttcaattcgaaaaatggagggttttatatgtcagtagaaatgttatacgagaaggatgtcaccactaattatttggaaggtcaaacgatcgctgttattggttacggtgctcaaggccatgcgcaagcaaataacttccgcgattccggtttccacgttatcgtcggtgttcgtccaggtaagtcatttgataaagctaaaaaagatggttttgaagtctattcagtagcagaagcggctgaaaaaggtgacgttgttcaagtacttacgccagacgaagtcatgtcggatgtttacaaaaacgaaattgctgaccatctgaaaccaggcaacactcttggcttctcccatggcttcaacgtttactataaagaaatcgttcctccagaattcgttgatgtaacaatgatggcacctaaaggtccaggtaacttatgccgtcgtacttataaagaaggttttggtgttcctgcactttacggcgctgaacaagattatactggccatgccgaagatacttcaaaagaattagctaaagctaacggtgctgctcgtgccggattattgaagacaaccttcaaagaagaaactgatgaagacttgtttggtgaacaaaacgtcttgatgggcggggttactgccttgatcgaaactggttttgaagttttgactgaagccggctactcaccacaattggcttactttgaagttgaacatgaaatgaaattgatctgtgatttgatctacgaaggcggcttcaacaagatgtacgctgactgctcaaatacttcagaatacggctcatacgttgtcggtcctaaggttatcggtcctgaatctaaacaagcaatgaaagacgctttgactaacatccaaaacggtaaatttgctaaagactttatggctgactaccgtgctgggttcccagaactttatcgtttacgcgaacgttcagctaactcacaattatcacaagttggtgctgaattacgtgcccatatgccatttgtcaatgatgctgacaaatacagtgactgatcagtaatatcgattcaacatttaagcaatactcatagcctaaaatgtgtttggaaattaatgccacgttttagccccaaaagtagctttccagacgccttaaacaagatcaccggaaaatgagtcgagggtaacttggtccctgactctttttctttacatatcgccggtagctaacggcgaaatatatttacacacataattgagacgatactcttaaaaaattgaagggatgtgactagatggtcgtcatgcaacaatccgcattacttactaaaaccgacgtcgacaaagcttatgaggtgttgcggccgattattcgccacacgccgctacaatacgatgtttatttatcacaaaaatatcactgtcaagtttacttaaaacgggaagatttgcagagtgtccgctcgtttaaaattcgcggcgcttactatgcaatcgccgatacaccggccgaacaacgccaacgtggcgtggtctgtgctagtgccggtaaccatgcccaaggcgtggcgtggacctgtcatcaaatgcaagtaccagcaacaatttttatgccggtgacgacacccaagcaaaaggtcagtcaagtcagcttttttggcggcgatgatgtgacgatcaaattagttggtgacacttttgatgcggccgcagcggctgcggaagctttttgcaaagaaaatgagcaaacgtttattgccccatttaatgataaacggacgatggctggtcaagggacgttggcggtagaaacgctggctgacgcggctaaagctggaatcaacgttgactatatgtttgcggcaattggtggtggtggcctaatcagtggtgtggccgcttacgttaaaggcaccaaccccgcaactaaagttgttggtgtcgagccagctggtgcggcctcaatgaaagcagctttggcaactggtgggccgatcgcgttgagcgaaatggataaatttgtcgatggcgcggcggtgaaaaaagttggcgcgctaacttacgccaatgtgaaagaatacgttgatgacgtgatcgccgtaccagaaggccaagtatgtagcgctattttagacttgtacagcaaggaagccatcgtcgcggaaccagccggcgctttaagtgtagcggctttagcggcacaacaagagcaaattgctggtaaaacagtcgtctgcgtcgtcagtggtggtaataacgacattaatcggatgcaagaaatcgaagagcgttcattgatttttgaagggtaccaacactacttcatcgtcaattttccgcaacggcctggcgctttacgcgaagtggtcaatgaaattcttagccccgacgatgatatcacgaaatttgagtacactaaaaaagttaatcgcggtgaaggaccagttttgattggcgtacgtttaggagatcgggctacattaccaggtttactggaacgcttgtcacagtttgatccacggtacattaatttaaaggacaatcagatgctgtacacgatgatggtttaaggcagcgtgtattaaaaaacgctcagattacgtttccgccagaaaatgacgtttatgtttgtgtagcagctggaggtgtggtatgacaaaaattttagattttcaaaatgtaaccttggagcgtggcgagcggacaattttaaaaaatatcaattggacaacccacgccaaggaaaattgggcgattcttggcttaaatggtgccggtaagaccacgttactcaaaatgatccacggtgatctatggccaacaactggtcgtttagaagtacttggcggtgtttttggtcatacctcgatccctgagttacaacgaaaaattggttggatcagcacggccttacaggatgcgctgcatgtcggcgatcgggtagaaaaaattgtcttatcgggtaaatttgccagtatcggtgtttacgaaaaatatacgcaagcggatgttgaacgagccgagcagattctacgacaaatgggtggcgctgagctgattggcaaacgatatcaggtgctatcgcaaggtgagcggcagacggtgttgattgcacgggcattaatggcgcgaccgcaactattgatccttgatgaaccatgtaatgggttagatctttttgctcgtgagcggttattacagcgcgtggctaagctagctgaagcaccggatagcccggcgttgttgtttgtttcacactacaccgaagagctattaccttgttttcaaaatgtgatgttattgcgcgatggacaagtaattcgccaaggcaagcggactgacttattgactgaagctgttttgtccgatttttatccggcgccgatccagacggcagccttaagtgaacaacgattggcggtttacccacgttgacgaaaaaacgcgcaacccgtttacggtgcgcgttttacttatttgctggcaatgtattcgatctcgatcagtgcaccggcaggtaatttagcaacttcaaccgttgaacgtgcaggtaaagtagcggcatccgtgaaagcggcggcgtacaagtcgttgacttgggcaaaagtggtgacatcatcaaggaagatcgttgttttaacaatgtcggcaaaagtcatgtcagcagcagctaaaacttggccgatattcgccaaaacttgtttggtttgggcttcaatatccgtgccaactaatttaccattggtaggatcaataccaacttggccggaaccatatagtgtgctgtcaacgaggacagcttgtgaataaggtcctaatgctgccggtgccttggttgttgcaattacttttttcataaaaacttcacctcaataagaaattagccggtagtgtaaatcgaactaacaaagccgatctgcgcactcgctacttttatcatacgtgagattaagcttaaagtaaatgtaattatgatacttaaattaccgactttaattatgaatttcagaaacaaggttgacaaagtgacggtaggttactacacttaatattaaaattaaataataaaaataatcgttttgtaattttaagggggaaacatcatgtcagttaaagcaagtgaagttgattttgataatttagggttcgattatatggacctgccattccgtttccgcgcgtattatcgtgacggccagtggcaagaagcaggtttaactgatgaccccaacatccatatcagtgaaggttcaacgattctccattatggtcaaggttcgtttgaaggcttaaaagcttaccggactaaagacggtagcatcaatttattccgacctgacgaaaacgccaaacggatggctaaatcctgtgaacgtctgctgatgccgactttcccagaagataaatttgttgacgcggttaagcaagtcgttaaagcgaataaagatttcgtacctgcttacggtaacggcgggactttatatttgcggccttacatggttggtgttggtggtaacattggtgttcatcccgctaaagaatatattttctcgatcttcgccatgccagttggtaactacttcaagggtggcttaacaccaacagcatttatcacttccgaatatgatcgtgccgcgcacaaagggactggtgctaacaaagtcggcggtaactatgcagctagcttgttccccggccaatatgcgcatgaaaatggctatagtgactgtatctaccttgatccagtttctcatcgtaaagttgaagaagtcggttctgctaacttcttcggcattactaaagacaacgtgttcgtgacaccgaaatcaccatcgatcttgccatcgatcactaaattctccttattatatttagctaaggaacgtttaggcttaggtactgaacaaggcgacgtttacgttgatcaatttgatcgttttaaggaagctggtgcctgcgggaccgctgccgttatttcaccaattggcagtgtgactcatgaaggtaacaaacatgtcttctactctgaaactgaggttggtcctgtaactaaagaattatatgatacattgactgggatccaatttggcgacgttgaagcaccagaaggctggattcaaaaagtcgatgttgactaatatgaagtcgaaaaaagaacacagcatattgtgttcttttttgttattcagctaaatgctgctgcaatccagcaataatcaaatccaagcccttttcaaactgttgtttagcggacaattggttgcgcattttaattgaggctttcatgtgttctaaatgatgactttgcgcttgtgcatgaatttttttgacgtgttcggccaaacctggatcttgttgagttgtgatctgctggcggaagcgattttcaatcgataagtcgatcattaagccggttagtaagaaatcaatcgaagtgacggcgatgttggcggtttgctcattgatgccagcggtggtgatgattccgatcgtgtggtcgatcaagtgtagtcgtactagtgcagacggtatcgtttcaaccattagaacggctgccaatgggtaacgttcataaacgtcaaagatgttactgaataattgtttgagctgcacagtccattctagctgcgtatcgggaagctcaacgtgttcgatcaccgcttcagccatagcctgtaaaatatcttgtttgtttttaaaatgccagtaaagcgttgaaacatcaacgtgtagatcggcagccactttgcgcagcgaaaagtcggtgaaggaatgtgcattacccaaagtcttcaaggcttgtgcaatgatctgctcccgatcaattttacgatttgccattgatttcaagcctccatttttatttaaatagcttctcaaattttaaaaaataatattgttttatccattaacttttgatacaattaaaaccgttttgtttttcaaagcgatttttttattttggtatccaacagtgttggagcactaatttattataaccgaaattatgacaaattgtacatggggggatacttatatgatgatcaaggcaattggcaagtacaaagcgctggtcattgcagcattgttgaccatgcttttgcaagtcggtgcggcattatggcagccaagttatatgaaacgcatattaagtgtaatggccgatacgacgctgacaacagcgggtaaggtcgataagatcagtaattacgggatcgcattgatcgtgatcgctgtgatcggcttagttggctcgattttaaatacgatcactgcggctaagttggcgcaagttgtgtcagccgatttgcgggaaatgacttttcgtaagatccaaacattcgcgtacgcggatattgagaaattcaattcagctaatttagttgtgcgcatgaccaacgatatcaaccagatccaaacgttgatgatgattattttccaagtattgattcgcgtaccgctattattcattggtgcatttattctatcgatcattaccttaccacaactgtggtggatcattattgtgatggtcgttctgatcgtggtcgtcactgggctgtcgatgcgctcaatgggtccacattttggggcttttcagaagttgatggatcggatcaacgcgatcgctcgtgataatttgcgtggtgctcgagtggtgaaatccttcgtccaagaaaagaatcaggctaaaaaattcgataaagaatctgatgatctactgggacataatttggcagttggctatacgttctcgacgatgattccggcgtttacgattatttcgcaattagcaatttttgctgcaattatgttggtatcaacttttatcactaaatcgccatcggttgctcaggatcaattaggcggtattatgtcatttattcagtacatgatgcaaattatgttcgccattattatgggtgggatgatgtcgatgtttgcttctcggggctttgtttcaatgggccggatccgcgaagttttggatgcggaaacgtcgatgcactttgcaacaactaccgatgaggagcttgacggtactgttgagtttgaccaagtgacctttgcttatcctaacgatgaaaaaccaacgctgaaggatatcagttttaaaatcgaaccaggccagatggttggtattgtcggcgcaactggggccggcaaatcaaccttagcccaattgattccccgcttgttcgatccgactgaaggcacggtcaaagtcggcggtaaggatattcgtcaagtatcgcagggaacattgaaaaagacgatctcgatcgtcttgcaaaaagcgatcctcttttccgggacgatcgctggtaatttgaagcagggaaagcaggatgcggatgcgactgatatggatcgtgccgctaagatcgcccaagcagcggaatttattgatcgcttaccggagcagtataacgctgaggttgaagaacgggggaataacttctctggcggtcaaaagcagcgcttatcgatcacccgcggcatcattaaacagccgaaggttttgatcttagatgattcgacgtccgcgttagatgcgcgttcagaaaaattagttcaggacgcctttaaccgcgaacttagtggtaccacgacgatcattattgcgcaaaagatctcatcggtggttcacgcggataaaattttggtgctggacgaaggtcgtttagtagctgtcggtaaccataaagaactagtagcaaactcggaagtttaccggcaaatctacgcgacccagaaggcaaaggaggactagaaatatgaatgatacaatgcgagcaataaaattcttttacctctatcttaaaaaatataagctacaattcttgatcattgcggtatttattgttgtggcaacttatctccaagttgcagcaccagttgtgatgggcgatgcgatcactcatttaacgacttatgtgaccgacttcttcacccaccagcatgcggatgatgcaatcaaagcggtgaagaaaattgccgctggcgctagtcagtcgcaagaggcgttacgcaatattgctgcgcaaatgagtcaagcaacggggcataatattgattggacaacgttgactaatagcaatgtgccgcaacaagttttatcgtcattaccgaagggcactacgatcgatagtttgcaaaaattagccgatatgccgactaactggaagcaactcaccgatgctaacgtgcctgcaagtattttatcgtcattgccaaaagggacgacgattcatagcttgcaccaagtggctttgtcggcgccagctagtaaagctgatttctttgcaacaatgtggaagttattggccttttatgtcatgaccggcgtggcccagttgatctatacgctgctgtttgcgcgaatcgtggctcactcgactaaccggatgcgtaaaggcttgttcggtaaactagaacgaatgacgatcgcttattttgatcgccacgaagacggcgatatcttagctcgttttacttccgatcttgataatattcaaaatactttgaaccaagcggcggttaacgtgacaaccaacattgcgctctttgttggggtattgatcatgatcttccgccaaaacgtcagcatggcttgggtcacagtttcaaccacgccggtggcagtattgtgtgccattatcatcattatccaagctaagcgtaatactgatcgccaacaagcggagatcggggtgttgaatgcctacatggatgaaaaaatctctggtcaaaaggcgatcatcgttgaaggccagcaacaagacgccatcgatggttttgttgaacgcaatgccaaagtgcagaaatctgtttttggcgcccaagtttggtcaggaatgatcttaccattgatgaatgggttctccttgttgaccaccgcgttagtcattttcttgggtactaagatcgcgttgaatgataaatcacttggtgccgctgcagcactaggtttagtcgtcacttttattcagtacgcacaacaatattacaatccaatcatgcagatctcgtcgtcatttggtcagttacagttggccgtaactggtgcgacgcgcttgaacgtcatgttcgatgaaccagatgaagtgcggccggaaaacggtaaacagtttgatcgcatggacgaaggcattcaaatcgaacacgttgattttggctatttaccagagacgcctattttgaaagacgtgaatatcaacgtgaataaaggccaaatggtcgctttggtggggccaactggttcggggaaaacgacggttatgaacttgatgaatcgtttttatgacgttgatcgtggtgtgatcaagtatgatggcaccgatattcgtgattttgatctggatagtttacgcgccaatgtagggatcgtgctccaggagtcagtgctgtttgccggcacgatcgccgataatatccgctttggtaagccagacgccacgatggatgaagtgatcaccgtagctaaaaccactcatattcatgaattcatcgatagtctaccggataaatacgaaacgcaagtggatgacaccaattcagttttctcagttggtcaaaagcaacaaatttcgattgcgcggacgatcttgactaatccgaagattttgatcttggatgaagcaacatctaacgttgatacggttacagaacaacagatccagtgggctatggaagcagccattgccggccggacgtcgtttgtgatcgcccatcgtttgaagactattttgaacgccgacaagatcgtcgtgcttaaggatggtcaagtcatcgaagaaggcacacatcatgagttagttgaacaagacggtttctacgccgaactttaccacaaccagtttgtgtttgaatagaaaataaaatacgcagcgagcgtgtacgtgccaattttggtggcgttgcgctcgctgcgtttttgtttagatagaagtgtaagagcgaaacaatgactgcttcagtgactggcgcggtataatgaaggcagttgaattaagggaggtgcagtggatgaagttaagtcgcttacaagcttttagcgacggggttttcgcaattttgatcacgatcttagttttagattttaaggtgcccaattatcaaacggggcatttactgacggcggtgctacagcaatggccagtgctagcggcttatattttgtcatttatgtatatcgggatcttatggctatttcatcacgacctattcagtgttttcgcgcagatcgaccgtaacgtgaatttgctgaatttattgatgctgtttgccattacgttgatcaattatccgacggcactgttatcgcatacgttgatgcaacatgaacgcgctgatctacaggttgcatttgttagttacgctgctatcgcgctatttatttcgttgacgtttttgctactatatagttatttatcgcagcatccggaattaaaatctaagcgcgttagtcctgaattatttgcgacgatcagttatgatccgttacgcagtatggtcatttactttttgtcgatcgtagccacattcttttcagttgagttaggtgccttattgctagtcggtgggattatttttcacttttatgcgtatttgcatttaagtcgccgaattattatttaaatatttttgaacaaaataggcaaaaatgctaagatgaagctgtacaaatgaaacgttttcaaattcagtctgacccttgtttttatcgcggctattatttgccacagtaaaggctgggggacaaattatctctattgtggaggtaacgtctaaagttccatgaaacccaagttcaaaaccggatgttcaaggggggatgacgattaatatatggaatcaccgttcacggatgaatcgaacttaattcaggtgttgcttctcactggat

SEQ ID NO: 472 - DNA, 1637 bp, Unknown
  Metagenome-assembled genome
cataattataaacattcctttcgcgtaccgctcaaggcacaaaacgcaatgaaaaagcgtttgcctgcagcggtatttctttgtatatttaacttgtgatcgtaccttgtacactacaaatcacgtggagattagtagcactgacgttagcgttagtgctgaataattatatgtgtaggttgtcctttcaagcacaaataagtgtgactttgagcacgcaaacttatctttgtttaaactactcgtttaatgctggacaactagtccctactttgtgggatcacaatcttgagggaggtacaagacaatgctaaaaattgtctatcagaactgttgtggcttagatgttcacaaaacttttgtggttgcttgtttggccatcactgatggccacggtattaccacctacaagcgtcaccgcttctcgaccttcactaacggcctgcggtcgttagctgattggttagagctatactcatgttttgatctctgtatggaatccaccggtaaatactggatccccgtacacaatattttagaaaaacgtgatattcggatcactttggcccaccccaagtatgtcaaagcgattcgcggtaagaagaccgataagaaagatgcccaatggatcgcagatttatttaaacacgatctcgttgctggtagctttatgccaccggcagatattcgccaattacgtgatctgctacgttatcggtttaaactgactaattttacttcaagtgaaaagaatcggtttcaaaattcattaacggtctctaacattcaattagctagtgtggtttccgacactttcggaaaaagtgcgtccaaaattattgagcgcatcctagaaaatccgttagaacctgatgtggatttgccaagtttgattcacggtagcctgaagaaaaaattaccagaattagaattagcgattgatggcgtcattactcctgaacaagcagagaaaatgaagcttatcaagcaacactatgaacagctggttgccaataaacaagcattagaaacaatcatcctagaattggctaaaccttatgccaaagaaattgaattgatccaaagcacaccgggctttggtagttctatgatgtcatccattagtgtcatctcagaaattggtgttgatatgactaagttctattcagctaaacatctttgttcttgggccggcttaacgccaactaataacgaaagtgcgggtaaaaagcactcggttcgtatctcacgtgctggctgctatctcaagccattactcgttcaaatagccaatgcagttgttcggagtctgaaacaccccgaaattcgcaatcgctatttagcgctcaagaaacggcgcggccataaacgggcaataatcgccattgcccggcaattattaaccgcaatttatcacatgttgagtgaacatgtggtctatacgccgccggtgattaaagaacaaaaccaaccaacacgcgcaatgaccgttgaagccgcaatccaatttgcgaaacagcacggctttagggtaactgcttgagggaggtcaaattctgaggtttacccacctttatttaagttggccttttttcaattaattaggttgactgctaatatctgtttttttcaaactt

SEQ ID NO: 473 - DNA, 46858 bp, Unknown
  Metagenome-assembled genome
tcaaatgataaaatagtggtgcccataaaggtccttctttctagtggaatgttgtggtgacaccattaaagacctttatgggtttttctgtccactaatatgttcaacttaaattttacaatctaccatatttaagttaaaccgttttcttttacccataaaacaatttttcgttgctcacttaatagacttttctagaactcagtgcgttttcaaaactcgctatggtataatattgttttataaaggtaagcataattttggataacggtccaaaattagcatcaattgacgtgattcatttggcttactcaattaaattagtaaaggaggtcgcgatgatgactgatgatcaacaggcaattacagcagatatggtgttgcaagatgatgcagataagattgaagaattagtcaataaacaacgcgtttcactttgtttaagccaatgtcctgcttttgaagaagtggtcgatacacaagtctttggttattctaaagaagtcatgttagctgttcggttaaatttgattcctgaggaacagggtcataacttggtacgcgacttagaacagcggctaaacgccatctacgcggatagttttgataaacaaaaacagaaatagaaggaggctgttcctccattgcaacagaaaatagttagttggctgcggcgtaacttacaataccgtgattacctacctaatctagattggtttattttagttccgtacttacttctttctggaattggaatcgtcatggtttttagctctagttccgattacgtgatcatgcgcaatgtcagtccggtcagttatttgatgaagcaggcattcttcgttattttagggttgttcattgtagctgctttttacattattaaattggatgttcttaaaagtatgcaaaagatcttgatttgcattgttgttttgatcattgcgttgctctatttgttgtttgccgggcattcggttaatggggcctccgcgtggatcaatgttggtttcttcaacattcaaccagtagaatttgccaaatttattctaatttggtacttagcttattttttcagtcatcgtgagcatgagatcgcccaagctgatctaaagaatctcgggcagaatttagttagaccaggaattatcgttggtttgatcatgtttttagcgattctacaaccggatattgggggaacatcgattctagcggcaattacgttagtactagtttttaccagtggggcacgttttctctatggtttcagttttagtgcaatcgggtttgctttagttggcgccggcttcatgtatttacaaaagttaccgatccatgctagcagtggttaccagtatcggcgtttgatggcgtttgtccacccatttgctttggctggtacagatggtaagcagttggttaattcgtattatgcgatcaataatggtggctggtttggtgttggtttaggtaatagtatccaaaaacgcggttacctgccagaaccctacaccgactttattatgtcgatcactgcggaagaattaggtttggtcgctgttattattattttagcgttggtctatttcttagctgcacggatcattttggttggtatacgtgcgcgtgattcctttagtgccttattttgcattggaattggggcgatgatcatggtccaaacaacgttcaatattggtggtatttcaggtgttttaccaattacgggggttacatttccctttgtgagttacgggggctcatcaatgctggtcttagtgatgtcgatcggtgttgcgttaaatgttagtgcaactgagaaaggtattcagaaacggcgtaaacaaaaaatgaacaaaggttaattgataatgaaagggtgatagttagtatgaaaaaagtactgatcgcgaaccggggagagattgcggtacgtatcattcgtgcatgtgaggaacttggcttagaaactgtaggtatttatgctaaagaggatgaatattcattacatcgtttcaaggccgatgaagcttatttagttggtgctggcaaacagccaattgcggcttatctggatattgaagatattattcggattgctaaaatgagcggcgccgatgccattcatcctggttacggttttttgtctgaaaacgcccaattagcacggcgttgtcaagaagaaggtattacttttgttggaccaactgctgaattgctagagatgtttggtgataaagtcgcagctaagcatgcagcgcatgaagctaacgtgcaagccatcccaggtaaagatgagccggttactgatctagccgagatcgaagagtttgcggcgacctatggttatccgatcatgatcaaagcagcaatgggcggcggcggccgtggtatgcggatcgtacatagtgctgcggaattagctgatagttacgctcgcgctaaaagtgaagcactacaatcatttggtagcgatgagatttacgttgaacgctttattaagtcagctaaacatattgaagtacagatcctagctgatcaacacgggaatgtgctacatttatttgaacgcgattgttcagttcaacggcggaaccaaaaggtgattgaagttgctccttgtgtcatgttgactgacgaacaacgtgaacgggttaccagtgctgcagtccgttttatggaacatgttcactatcaaaatgcggcaacggttgagttcttatttgaaccggccaaggatcaattctattttattgaagttaatccgcgagttcaggttgagcatacgatcaccgaaatgatcactggtgttgatattgtacaaacacaattaaaaattgcccaaggccaagatctatttaccgatattggtctgccacaccaagcagatttacgctttcatggtgcggcgatccaatgccgggtcacaactgaagacccattgaataacttcatgccggatactggcacgattgaaacttatcaatcaccagctggaaatggggtccgtttagatgggggtaacgcctatgctggggcggtgatcacaccatattttgactctttgttggttaaggtttgtacccatgcgcttaattttgaacaggcaactcagaaaatgttgcgggtattgcgtgaatttacgattcgtggcatcaagactaacattgcctttatggaaaaagtcattcagcatccagaatttatttccggtgaagctgaaacaacgtttattgataatacgcctgctttatttgcgattccacgttcgatcgataatagtacgcaaaaaatgcagtatatcggtgatattacggttaacggttatggcgatcttgatcggcatgagaaaaagtattatcctgaaggtcaatttaaagctgactttaagccatttcctaagggacttgtcactgcaaaaacaattttagatgcacagggcgctgatgccgtaaatgattggttaaaacaacaaaataagttgttattgactgatacgactttccgtgacgctcatcaaagtttgtttgcaacaaggatgcggacacacgatatgctaggaatcgctgatggcatgcaaaaggcgctacctaatttattctcttatgagatgtggggcggtgcaacttttgatgtggcgtatcgtttcttagttgaggatccatgggaacgattgaagcaattgcggaaaaagatgccgcataccctgttccaaatgttattccgtggtagtaatgcagtgggctataaaaattatcccgataatgtgttggctgaatttattaaacaagcagctactgatgggatcgatgttttccgcatctttgatagtttgaattgggtaccacaattggagaagagtatccaagctgttcgcgatgctggtaaaatcgccgaagcggctatttgttacactggtgatattttggatccaactaagcataaatatgatttgaagtattatcaggatctggctaaagaattagcggcttccggggcgcatattattggcatcaaggatatggccggtttacttaagcccgaagctgcctatgaactagtttcaacattaaaagaaaccgttgatctgccaattcatttgcatacccatgatacaccgggtaatggtgttagcacgtaccaacgtgcggcagcggccggtgtcgatatcgttgatgtggcgcaaagtgcgttgtcaggtacaacgagtcagccaagtatggaaagcctgtattatgcgttaactgacaatccacggcaacctgatttagatattcacgctgctgagcagttgaatcgttattttgaaggtatccggccattctacggtgactttgctaatggcttgaatgctcccgtaacggaaaactataccgcacaaatgccaggtggtcagtattccaacttacggcagcaagctagtgcggttggcttaggtgattgttgggaagacgttaagcgcatgtatgccaccgtcaaccaaatgtttggtgatatcgtgaaggttacaccatcgtcgaaagttgttggtgatatggcgttgttcatggttcaacataaattaactgaggatgacgtttacgctaaaggtgatacgatcgattttcctgattctgtagttagattcttcatgggtgatctaggtcagccagttggtgggttcccagaaaaattgcaaaagattattctaaaagggaaaacaccattgacagtacgacctggtagcttagctaaacctgttgactttgcgacagttaaggctgaattagctgagaagattcaggacgaaccaactaaagaagaagtacttagttatttgatgtaccctgatgttttcctagactatcatcaacgaaaagaaatttatggagacgtttcaacattggacacaccaacattcttccaaggcatgcggatcggtgagaagattgaaattcatgtccgtccgggtaagacctggatcttaacgttaaatgaaattggtgaacctgatattgaaggtaatcggactttgtatttcactgttaatggccaacgtagtgaagttgtgatcaatgataagagtgctaaacaatcagtgacggtttcacaaaaagctgaaccaactaatcgtgaacaaattggggcgacaatgacgggcactgtccttagcgttttggtgacaacggatcaattagttcaaaagggtgaaccgttgttagttacggaagcgatgaagatggagacaacgattcaagcaccatttacaggccgaatcaatcatttatatgttcaagaaggcgatcgtgttgattccaatgagctattgttggagatcaagccggaaaaaacaaatagtaaagcttaggcagatgatttgatgattatcactgagaactcggttgctttgttggagcaagttgatcagttggtggccactttagcggctagcccactttttcaaacttatcagcaagctaaaaaagcgctggcggctgacacagtagcacaacagaaaatcgcggcgttacaaaccgtaaatgaggcgtttgcggctatcaaggattatggtcagtatgcacctgattatcaaactaagcggcgtgaattacgccacttaaagcgcgaagttactttatggccaaccgttgcagcgtttaaacgggcagaaatggatctgcagaccgcacttgatgagattggcatccggttggctgattcgatttcaccagatatcaaagtggcaactggtaatccgttttatgtaacgagtcatacgaaaaaacattgtcgttagtaattaaatttcaactagatatttttgtttggttggcgcaactaggaaggagtgtgagtagatggcatttaccatgacacctagacaagggttagttgtttgggtctatagcttaaagcaactacggcaactacgccgttacggtacgatctattacacgtcctgccggcttaagtacgtttatttgtacgtggatcaagcgatgattccaacagttagtgaacaagttaaaaaattacattttgttcgccgtgtcgaagtctctcatcgtccagaattggatatgaattttggcgagcgggtcggccagttagataaatcagagccagcagatgttcgtgaatcagcagggcctaaaattttattaacaagtaaagaaatattgaagaaggattcataacgtatgcgaattatatctggagagtttggtggtcgtcgtttaaaagccgttcccggccaagcaacacggccaacaactgataaagtcaaagaagcaatttttaatatgatcggaccttattttagtggtggtcgtggtcttgatttatttgctggtagcggtggtttgggcattgaagcgatctcgcggggccttgattcaatggttctagttgatcgccaatatgcggccattaaagtgatcaaagataatgtggcaacaaccaaggccgcagatcgttttcaagtgatcaaagccaatgctgatcgtgcgattcaacaatttgcggctgctggggaaaagtttgatctagttttactagatccgccttatcgtgcccaacaaattgcggcggaattaacaacttttgcggcacagaagttgttagctccaggcgcaacgatcgtttgtgaaaccagtagtgaaactgttttgccggaagctcttgctggttttacgcatttacgccggcaaacttatggtacgacagcaatcacgatttatcagtatggaggaatcgatattgacagctagaattgcagtttttcctggcagttttgatccatttaccaacggccatttagagaccgttcagcgagcgagtcatttgtttgatgaagttattattgcggtaatgaccaatacctcaaagcaaccgctgtttcaaccggctgaaaagctcgcgttgatcacggccgcaactaagtctttgaccaatgtacgtgcagttgagcaaagtaacgaattgaccgttgattttgctcgtagtcaaggtgctaagtttattttgcgcgggattcgtaacgtaaaagacttcgagtacgaacgtgatattgctgcaatgaatcaagtacaagcaccagagatcgaaaccattattttattggcaccaaagcgttatgcttttctttcttcaagtttgatcaaagaagtggccaaatttggtggcgatatctcaactttagtaccggctaatgtcatgcaagctctaaagcaaaagtttagtcagaaagagggctaagcatgaagcaacacaagcgcaaaataacgattttagttatcgtgctgctattattgattgggttcttcttacctttacctttttatttggagacaccggggactgcggaatctttaaataagtttgtcacagttgatggcaaacgtgatcgccggaaagggcattatatgctgacgacggttgctttgcagcaagcacggccactgacttatttatggagcaaaacgcagccctttgcggaaacagttagtaaagaatcgttgatgggtggtgctagcaatcgaacgtatgaacagatgcaaacttattacatgcagtcatcgatcaacgatgcgatcacagttgcttaccggcgagctggtgaagcttatcataaaaaatatcgtggaatctatgtgatgtcacttttagctggttcaaagtttaaagggcatttagcgattggggataccgtcacgaaaatcgatggtcatgcctttaaaagtgcgcaacaattcatcaactacgttaaacgacaacgtgtcggtcaaaaagtgacggtgacgtatacccataagcagcaggttaaaacaacggcacaagctttagtcaaactgccaggaactaaacgacctggtttaggaatcactttagttgatcattcacaggtcaagaccgatattccggtaaaagttaatgtaggtgagattggcgggccttctgctggaacgatgtttacgctggaaatttatgaccaattaactggtggtaagttacggcgtggacggaagattgctggaaccggaacgatggacgcaaaaggcaatgttggtgctatcggtggcatcgataaaaaagttgttgctgctagtcgtgccggagcaactattttcttcgctccagatgacccagtcactaaagctgataaaaaggctgaccctaattataaaaataattatgcggttgcaaaggctgcggccaaacggatccacagcaaaatcaaagttgtaccgatcaaaacctttagtgatgtcgtcaattatttgaaaaaataatgaattaatgaagccgttcagaaaatgaacggctttttttgcgtagattaaatatagtggctgattaaaataaactggaggtgaaatgatgttagcggcttgggaatggctgaaacattattggcagtttgtgatcattggtttattgacagttagtgtggggcttgttttatttttgttattgcgtacaccagcaccaacacaaaaaagtgacgatgtttttactagtagtcattcagcggtactagcaactgcttcaacagcgagcacaacggcaccaaccactacacagactggctttgttgacgttaagggagcagtcaagaaaccgggaatttatcaagttaatgataatacacgtttgtttgatgtggtgcgcttggctggagggttagccgccgatgccgatcaacagcaaattaatttagcccagcaactcaacgatcaacaggttgtctttattcctaagattggtgaggaggtgccgccacaatatgctgcaccagtgtcaacaccagctacaagtgaagcaccaacgactgctacagcaacaactagcacgagtaccggcgggacacaagttaatttaaacactgctactgcagaagaattgcaacagctaactggcattggtcaaaagaaagcagaactcatcatccaatttcgaactgagcagggcggctttaagcagcctgaagatctaaaaaaggtttccggcatcggtgataagacctttgaaagcctgaaagatagcgttacggtctaaccgcatctttggtatactggaaacaaacaaaaataaccacaagcgtggagtagagccatgtttttgatgagcgaggttgcggccatcaaaatggacatcgtccgtaacatcaagaatttttggtacaaaaattaaccacaattgtggagtagaatgaggttttagtaatatggatagtgtacaaactaaacggatgccgtgggatcagtattttatgacacaggcaatattgtcgtcactacggagtacttgtccgcgagctacggtaggcgcagccatcgtacgtgatcgtcgtgtgattgccagtggatataatgggtcagtttctggtgacgatcattgtattgatgttggttgctatattgtggatgggcattgcctgcggaccattcatgctgagatgaatgctattttacagtgtgccaaatttggtgcggcgacagagggtgcggaaatttatgttactcattttccgtgtcttcaatgcactaaaatgttgattcaggccggaatcaaaactattaattatttaaaagattaccatgatgatgagtatgctcaagcgctgattaaaaaatccggtgttgaattaaaccaaatcaaactggatgctgcttattttgaccaatttgaccttaatcaattatttggccagcgttaatttaattaattgcgcaataactggatctttttagccggtttagcgacaacactttcttttgcagttttaagtgtccaatggtgggcgtggttatttgttttgcttattttcgtacggttgctttttacccagcaacttaggttaactgttttgacaattattttagccacgatgtttggtttttattatcggtactatgagcaattacaaccaccattacctcatgggcataccctgctagttgagccggatgattgtactgtagccggtgatcaactacgttttactgcccgggttgttggtacgcgacagttggttcaagcctattattatttaccagatcagtccgcacaacatttttggcagcaacaacaacacgcagttaaactgacggttactggtgattatcagcgattacagccggcaaccaatgtagctgagtttgattatgcgtcttatttaaaacaacaaaagcgaattttctatagtttaacaattgacgaagttaaaaccgtccaacgttgttcaccgacttttttaacgcgactgcacgagtggcgccaacggctgatcatacgatcgcgtgggttacctcagcagttaggccaatactatcgaagcttgattttaggctatcaagatgccgcatttaagtcaacgggagcgttatttaaacaattaggcttgatccacttatttagtttatcgggactgcatgtttattattttgccaatttatttcaaatgggcttattgcgtctgcgttggacgcgagaacgcgttgagatctgtttgttagtcttattaccgttatatgcgttatttgctggggcaacaactagtttattgcgtgcggcgttgttatgttggttgcacgtctttaatcgtcattttcatattcaagttgcaccgttagactgttttgctgcagttgttttaattaatttagtttatcggccatacttattttttagtttaggtgggcaattatcttatttactttcgtttgcactattatttttacagggagcaaatgaatggcaacgggcgttaaagcttaatttattaagcttacccttgctgttgtatcatgtttacgagtggcattggttaacgatcctgttaaatttattgatcatgcccatattttcttacgccattttaccgttaacattattaggcggtttgacctataatttcattcctatagttggacggctgattgatcgttgttttgttgggttacaactttttcttagttggtttgctcgacctggattgatgttgacgtatggacagttaccagcaatcctagctagcagttgcattttactgttattttatgcttggtgttccccacataaaaggcgttattatggggtgttagcgaccctttatctggctggcttttgctggctgcattttcctcttcagggtcgcgttgttttctttgatatcggccaaggtgatagtattttgattgaaacaccatttcatcatgaagtgactttgatcgatactggtggaaagctgcattttggtcagaaagcttggcagaaaaaagacagtcgtacacgtgcagaacaagtcattattccttacctgaaaagtcgcggaatccggcggatagatcacgtttttttgagccatcaagataccgatcatatcggtgatttacctgctttactaaagcaattacagattggattggtttattttccggcgggaatggaatataatcaacatttccagcaaaaaatttggccttatcgttatcaaactaagtggcagccattattacgtgataatcagattgcaataaaggattttcattgtcaggtgttggcaccacgtcagccagggagtgggactaatgaggattcgctagttctacgcttgagtttgaatcataaaacgtggttatttactggagatctaccaactagtggtgaagatgctttagttaaagataccgtattaaaagctgattatttaaaagcaggtcaccatggtagccggacttcttctggcgcagcttttttagcagccgtacaaccccaaaaggtcattatttcggctggtcgccataatcgttatggtcacccgcatactgaaactttggcgcgttttaaagctgctaatattgcctataaaaatacggctgatgtcgggatgattatctggtcgtttgatgataaatggtggactttcttacataattagaaagccgaatgccgttaaatatgttcgtacgaataaataattttggtagccgatcagctaccgttaattttgaagtagaaagcggggctgagtttagctatggatgtacccacattgctcaagaatttaaagcaacaaaaattacaatcgatctatttagttaagggaactgaaagctatctgatcgatcaagttaaagatcaatttcaggcactgctaacccctgatgaagccacaatgaattttggtaactatgatttggcaacaacgccattggccactgcattagacgatgcaatgtcggcgccgttctttggtgatcgtcggttagtcttcatgcaaaaccccatttttttgaccgcggaaagtaaacaagccaaaatcgtccatgacgtggatagttttttgacttatttaaatgatcccccacaaacgactattctagttatttttgcgccctatgataaattagacgagcgtaaaaaggtgactaagacgttgaaaaagcacgcgactttagtggatgtgcagccactgtcagaacaacaagcacggcaatacgtgaatgattacttaaccgcccagcaattaacaatcgaaccagaggcattacagttattgatcgcgcgtactgaggctaatctttcattgatgatggccgaattaactaaactgactttatacgcgatgcaggatcagcgaatcacgacagcagcagttgaacagttagtgacacaaaatttagaacaaaatgtttttacgttggtagatgcggtgatggcacgtgatgttgcacggggattaacactatatcaccagttagttttacaaaaagaggaaccgctgaaattaaatgcgattttagttggacaatttcggttattgttacaggtgaagattttacaacgtggtggctatagtcagggtgagttagctaaggtgttgcgtgtacatccttatcggatcaaattggcgatcaatcaagctaaaaagtttccacagattgcattgcggcaagcttatttaggcttggttgatttagaatacaaattaaaaactagtcagcaggcaccagaactgctatttcaattgtttattttgaagttcagtcaggatgttgcttaaaaaaggtaaataaaaaagccaacgcaaatgcgtcagcttttttattttaattatttagccaataatttagttaaacgtgatttgtcacggccagctttattagcatggatcaaacctttagaagcagccatgtcgattgaacgaactgcatcgcggtacaaagcttcagtgttttcggcaccagcagcttgggcagcttcaaattgtttgatggttgtacgcatcgcactaatttgtgaagtgttttgtgcgttcgctttttcatttgtgcgaacacgtttgattgctgatttaatgttaggcattgatgtcacctccgtggtagcaaattacattaattgcattttttcaacgttgctaattatacagaagactgagaaaatttgcaatacaaagttgtaaagtaaaatagcttgactaacttttgtaggtttaatcagggttactttaattttttactaaaaagtagaatcaattttggtgctaatttggcttgcaatttaaattagtttctagtaaagtagacaacgtgcttagcacgaacccagcacttggtttaacgaatcaccaacgttttactcagttatgggcattttatatatagtgaaaggtgtggaaaaacatggcaatttcccaagaacgtaaaaacgaaatcatcaccaaatttgctcgtcatgaaggcgacacaggttcgacagaagtacaaatcgctgttttaactgaagaaatcaacacattgaacgaacatatccgggttcataagaaggattatcattcttaccgtggtttgatgaaaaaaatcggtcatcgtcgtaacttgttagcttacttgcgtaagtctgacatccaacgttaccgtgacttgatccaaagcttaggcttacgtcgttaagcttttatagaaagatgcagcaggggttataccttgctgcatcttttttatttgttgcaaaaacaatcctgcaagtggtggggataatgtcgtgaccgtttttttgtggtatcatagaataaaattattcttaaagactagaacgatttaataagcattggttacagttagttttctaaaatttttgatgaaaactaatgattcggggaggattttatggattcgttaaaagatgtttcattgatcacagcaatggttaccccatttgatgacacgggtgctgtgagttttgatcgattagctgttttgatcgaacatttattaaatacagggacacaagcgattttagttggtggcacaacgggcgaaggaccaactttatcgatcacagaaaaattggctttattcaaggaaactgttcgtttagttgctggacgcgtgccgatcattgcaaatacggggagcaataatacggcggctacaattgagtttacgcagcaaaccgcagcaatcgctggtatcgacgcagcactgattgtcgttccttactataataagcctaaccaagctggtttattggcgcattttcaggcagtgagtgagcagggcggcttaccgatcttgatttataacattccgtcgcgtaccggggttgcaatgtcggttgccacggcgctacagctttctttattacctaatgtgatcggaatcaaagattgtacggggatcactaatttagccgcgctggttgaaggtacacaggatcatgacttttatgtctatactggtgaagatgaatatgcttttgccgctaagacactaggtgcacagggcgtgatctcagttagcagtcatctctttggtgcagaactaagccagatgtttgcggatcttgctgacaacaaaatcggtgcagcggcagcgattatgcggcagctaatccctaaggggcagcagttatttgcgcaaccttcgccaggtccagtcaaaattgcgttggcccacgctggtatccctgtcggcggtgttcgtttaccgttaatgttaccaaacaaagtcgaacaagaacgcttattaaatattttagatctttaagaaaacgaggtgaagtaattgagtagtcatgtaaaaatcatgcctttaggcggcgtgcgtgaaaatggtaaaaatatgtacgttgtcgaagtcgatgatgaaatttatatcttggattgcggcttgatgtacccggaaaatgaattactggggatcgatgtcgttattcctgatttctcttacttagaagagaatattgatcgagttgtgggaatcttcttgacccacggccatgcggatgcaattggtgccttaccatatttcatcaagcagcattcagtacctgtttttggttctgaactaacgattgctttggctaaattaaacgttaaggccgacaagcaaactagaaactttaaagattttcatgtgatcgataaagataccaaaattgattttgaacgggcaacggtgtcgttcttcaagacgacacattctattcctgattctttgggaattgtgatcgaaaccaatgccggcagcgtagtttataccggtgatttcaaatttgatcagtcagctactccagaatatcaaagtgactttgcgcgcttagcagaaatcgggcagggcaacgtccttgcactattaagtgattctgctaacgccgaatccccttacgaaatggctagcgaacgcgatattgccgctaatattctggatactttccagtaccataatggacggatcattgcggcggcagtggcttccaatattgcacgtattcagcaagtgattaatgctgctgccaagtcagggcgcaaagttgttttaactgggcgtgatctagaaaagattgtgcggacggcaatgcgcttgaaacggctcaatttgccaagtcctgatattttggtaccaactaaggatctgcataagttggcaccagaaaagacagttattctagaaactggcaaaatgggtgaaccaatcaaagcgttgcaacgaatggcaacaaatcgtcaccgtttgattcgtatcaaggaaggcgatcttgtctttattacgacaacgccatcacacgcaatggaaaccacagtggctaagactaaagatatgatctatcgtgctggcggcgaagttaagtcgatcagtgacgagatccatgtttccggtcacggtaataaaaataaccttcaattgatgattaatttgatcaagccaacttatttggtgccagttcaaggagaatatcggttattagctgctcatgctagtattgcacatgagacagggattccgtttgaaaatattttcatcaccagtaaaggcgacgtccttgattatcaaaaagggcagatgcatttagctaatcaagtcgacgttggtaatacgatgatcgatggtattggtgtcggtgatattggtaatattgtgttgcgtgatcgtaaagtattatcagaagatggtatttttgttgcggtgatcacgatcaaccggaagaaacggaccatcgtgtcccatccgaaaatcacgacccgcggttttgtttatattaaaactagccgtgatctcattcatgaaagtgctaatctagtgaccaaaacggttcaagataatttagataataaagaatttgattggggccatttgaaacaagatatccgtgaagcacttagtggctatttatttgaacaaaccaaacgacggccagtgattttaccagtgatcatggaagtcaatcagaatcggcgccatgccgctaatacgacaacaactaaagcataaacttatgggacaagggatggtgaatcagccacctttgtcccatcttgtttagcgccatgtttcttgcgaccaaactgtgccgcaaaattagaatcggcgttcacttttggcctattatgcaactatgtatgaagcagcaaggaggtttattgatgggtgaaccaatcccgtttccgcaaaattttcaacgttttgttcagctaggccgtgaagctagtcagaagcaacagtggactgaagcgatcgattatttacaagcagcttacgaattgaagcaaacttttgccgttaatgtgttattggttacggcgttattagcggatgaacaatatcagcaagcagcaacgttagcacaggagcaagcgtccgcgtatttagattcacaagatgctggtcgtttatatttgaccgcgttgtgcaagacacatgattttattggaatccgtaaactttgtcatctgcaacccggcaagcaggcgccaactttttgggcacaacagctaacattggtggaacaggctgaaaaactgtatcggcaacaagcaacgcaacagatcaaagaactacaaaaggcgttatatcaattaagtgctgtaccgatttacgaacagttgaatttagcaaagcgcgcgcagcaattaccgcagactgaatttgtgcttgctagtcggcggttattaaccgatttatatgtgcatccattactgcgggctaattttttagatgagttacggcagttaggtatcaatactgcagttgagtatttatggttggatgaaacaattaaaacggtggtgccggcagaattgaaggcaattacagaagtcgacagcattcaagctttacaaaagcagttgtttacgcagttagcagctgatccagttttgacgcaaaccattagtggcgaattagctttacatgcagcttatctttatccttgtgctgatcaggtgatcacacaaccaaaagtttgggcagccgtttatctaactacttatgcgggtaaaaaaaataatttagcggcttttgcgactgctgaaattaccgcagttcaggactggcaacggcgatttaatcgattaactcagcgtttaagcgagtaaaattcgcaggtttatgaaaaaatgctgaaaaatatgaaattattaggcaaaggtatttacaaagttggtagaagcctatataatatctaaatggattcttccttgtgcgaaggcaagctagacttggcttttaacagtggaagttgtataataaatagtaaaggattatcggcattaacatttttgatggcgaactattcttgcgaaaatacaggaggtttcattaatggcaaaagaacattatgaaagaacaaaaccccatgttaatatcggtactatcggccatattgatcacgggaaaactactacaacggcagcaatttcaaagattttagctgacaaaggcttatctaagatgactgacttcgctgcaattgattcagctccagaagaacgtgaacgtggtattacgatcaatactgcccacgttgaatacgaaactgaaaagcgccattatgctcatatcgatgctccaggacatgctgattacatcaaaaacatgatcactggtgccgctcaaatggacggtgcaattttagttgttgccgcaactgatggcccaatgccacaaactcgcgaacatatcttgttagctcgccaggttggtgttgaatacatcgttgtattcttgaacaagactgacttagttgacgatcctgaattgatcgacttagttgaaatggaaacacgtgaattattatcagaatacgattatcctggtgatgatattccatttatccgcggttctgctttgaaggctcttgaaggcgacaaagaagaagaagctcatatcatggaattaatggatgctgtcgatgaatatatcccaactccagaacgtaacaacgacttaccattcttgatgcctgttgaagatgtatttacgatcactggtcgtggtactgttgcttcaggtcgtatcgatcgtggtatggttaagatcggtgacgaagttgaaattcttggtttacatccagaagctgttaaatcaactgttactggtttggaaatgttccgtaagactttggactttggtgaagccggcgataacgttggtgtcttacttcgtggtatcaaccgcgaccaagttgaacgtggtcaagttttggctaagccaggttcgatcaaagttcatgacaagtttaaaggtcaagtttatatcttgagcaaggacgaaggtggccgtcatacaccattcttctccaactatcgtcctcagttctacttccatacaactgacgttactggtgttatccaattaccagaaaacgttgaaatggttatgccaggcgataacgttgaattctcagttgatttgatcgaaccagttgcgatcgaaaaaggtactaagtttacggttcgtgaaggcggccgtactgtcggtgccggtgtcgtaaccgaaatcgacgaataagcttagcttatgtttaactcggagcttgtctccgagttttttttattatcaataagctaatacaagtcagttaaatcaggcaattaaacttaaaagcgtaattagcgcggttttttagtgagaatgatttacaagaccgttaaactacgttagaataacaaagtatgcaatttattaattatgaaaaattatgattccggagggaaagtaatggcagcaaaatgggaaaaaaaaggcgccactgatggtgaattaacctttgaaattgaacaatctaaaattaaagaaggtttagatcaagcatttgcccgcgttaaaaagaatcttaacgtaccaggcttccgtaaaggtaaagtctcacgacaagtatttaactcaatgtacggggaagctgcattgtacgaagatgcattaaacattcttcttccagatgcttatcaaaaagccattgaagaaacaaaaatcgaaccagttgatcaaccacatattgacgttgacagcatggaaaaagatcaaccttgggtgatcgttgctaaagtaacggttaaaccagaagtgacacttggcgaatacaaaggtatgaaagtacctgaacaagatcgtacagtcactgacgaagacgttgatgctgatatcgaaagcaaacgccagcaacaagctgaattagtgcttaaagaagacggtgcagctgaatctggcgatacagttgttatcgattataaaggtactgttgacggtgaagcctttgaaggcggcacagctgataactactcacttgttttaggctctaactcattcatccctggctttgaagatcaattgattggtcataaagctgatgaagatgttgacgttaaggttactttcccagaagactatcaagctaaagatctagctggtaaagatgcagtctttgcaactaagatccatgaagttaagtcgaaggaattacctgaacttgatgatgaattcgctaaagacgttgacgaaaacgttgatacattagctgaattaaaagataaggttcgtaaagacttgcaacaaagcaaggatgatgcggcaacagaagctatccaagacgctgcgatccaagctgcagttgaaaatgcgactgttcaagacatcccacaagccatgatcgatgaagaagttcaacgtcaaatggaccaatacttaggcaacatgcaacgccaaggtatcgatcctaagatgtactatcaattgactggaacatctgaagacgatttacgtaagcaatttgctggcgatgctgaaactcgtgttaaaacgaacttagtattagaagcagttgttgcagctgaagatatcaaaccttctgctgatgaaatcgaaaaagaagttaaagatttagctgacgaatacggtatggaaattaaagccgttcgtaatgctttaactgatgatatgttgagtcatgatatcgccgttaagaaagcaattgaaatcattgctgatgctgcagttgaatcagctgacgttaagccagctaaagaagaagctgctgatgctgacgacgctaaataattagatttactttaaaattgcggtgtaagagtcatatacttttagagctagcgaactgacacacgctgatcagtgtatgtcattgctacctgaaaggctgacccttgcgccgcttttttgtctagtaaactgaggctgttcatatttgtcagtgaggttctagaatcagtttgctttaccttcgagtgtggatatgctaaagttttcactgttcaaagaaattggcatatccgttggcaagtgattgtttttacggtaagattgaactaagaaattaataggggttgatatatgtgttcgacaatacggaaacggatggccctgtcaactgctcattttgcgggaagtcacaagatcaagtgaagaagattgtcgctggaccgggtgtctacatctgtaatgaatgcattgacttatgcaaagagatcatcgatgaagaattccaagatgaagcatacaatgatctacttgaagtaccgaaaccagttgaaattttaaatattttaaaccagtacgtcattgggcaggatgaagctaaacgtgctttgtcagttgctgtttataaccattacaagcgggttaaccaaatggaagttcaaagtgataatgatactgaattacaaaagagtaacatttctttgatcggaccaactggttcaggtaaaaccttcttggctcaaacattggcgcgtatcttaaacgttccatttgcaattgctgatgcaactactttaactgaagccggctacgttggtgaagacgttgaaaatattctcttgaagctattacaaaacgcggattatgatgtagaaaaagcccaaaaagggattatctacattgatgaaatcgataaaatcgctaagaagagcgaaaatgtttcaatcacgcgtgatgtttctggcgaaggggtccaacaagcgttattgaagatcttggaaggcacgattgctaacgttccgccgcagggtggtcgtaagcatccacaacaagagtttattcagatcgatacaacgaatattctcttcatcgttggtggggcttttgatgggatcgaaaacattgttaaggaacggttaggtgacaaagttatcggctttagtggtcacgatgccaaaggcgttgatgaatcaaagagcttgatgcaacaagttatccccgaagacttaatgaaatttggcttgattcctgagtttatcggccggattccgatcatggcagcattagagaaattgaccgaggatgatttggtgcggatcttaactgaaccaaagaatgctttagtcaagcagtatacgaagctgttaggtctagatgacgtcaagcttgaatttgagccaggtgctcttcacgcaatcgcacatgaggcgattgaacggaatactggtgcccgtggcttacgttcgatcattgaagaagtcatgatggacattatgtttgatctaccaagtcgtgacgacgttgctaaggcaatcattaccgaagatactgtcgacggtactggtaagcctaagctggtcttagcggacgatcaaaaagcatcttaaactgatctaaaaaagaaacgattcacttgttgaatcgtttctttttttgcaggtaggtatgctaaaatagtaagcagtgattcagaactatagttgtggaggaaaaataaatgcagattcaggatgtggaattggtgatcagcgccgtagcaccaatgcagtatcccaccgacggtttaccagaaatcgcactgacgggccgctccaacgttggtaaatcatcaatgatcaataagttgatccaacgtaaaaaaatggcacggacgtcaagtacccctggtaaaacacaaactttaaacttttataagctgaatgatgctttttattttgtggatgtccctggttatggttatgccaaggtttcaaaaaaagaccgcgaaagctttagccagatgatcgaaacttacttgcaggagcgcgataatttgcgtggtgtgatttcgttgatcgatgtgcgtcatgaaccgactaaggatgatctggcgatgtacaagtacctacagttcttcggtgtaccagtgttggtcgtggcaactaaaggcgataaagtaccgcgtggtaaatggaatcagcgggaaagtaagcttaagaaggcactcgaactcaatcaaactgatgacttagttgtgttctccagtacgactgggatcggtggcaaccaaatctggcagtgggtcgaggaacacttggcagattaaattatttttagaaagtaggggcgcgtgtggaatttaatgattatcaaaaattagctaatcggactttattaggtaatgagcaggttttaactaattgtgcgctaggcttagctagtgaaagtggcgaggtcattgatttgatcaaaaaatacacgtttaacggggaagacttgaaacgtgatgaattagtcaaggaaatgggtgacgtgctctggtacttgtctcaagtggctgagtgggccaatattccgtttgaagaggtcgcacaacaaaatattacgaccttaaatacgcgttacggtaaacagatcgatgcacagaagcaataaaaaatggagttgtgacataagtaatttatgtccaactccttttttgtactttcgaacaatatagctaaaacgtgtgatataaggcaactttttccgcttgccatgtttcaacttggcggtcttcgccttgctatgtttcctgcggtatgatttttgccacaggaatagtcaacgtccgaagcatcaaagctatttgtgctttttgcaaatagctcaaccttattagcggagtagttgaatggtcaacgtccggaacatttaagattttcggtacgagaatcaaccactacagtgacgtagtagctacgatcgtcaaataatccactacgtaaattattcgccgctctaggctaatgctcaaaagctgggcgccttatgtcacactcgtatttttttgacttatttttcgatccagccgccatcaatcggaacgacactaccatgaatgtagtcagcaacagggctagctaggaacaagcttaaagcggcaacttcttcgggttgcgcccatcgttgggctggtgttgcggccgccacttggcgtgccattttggcatcattatggaagtcggctgcgttcattggtgtatcgatcgcaccaggggcgatacaattagcacggatgcccttggcggcataatcataatcgatttgtttggtcagaccaatcacaccatgtttagccgttgtgtaagccacgccgccaccgccagcgactaagccagcgatcgaagccatattgatgatcacaccatgtttttgggccaacatttgcggtaataacgcttgagcaaacaaaaattgactggtgagattagtagctaaaatgttttgccaactagctaatgtggtcgctaatagtggggcgtaggcgtccaaaacgccagcagtattcagcagcaagtcgatatgatctaattgttccagcgcatgactaacactggcttggatcgctgcggcatcgcgaacatctacctgctcaaaaaagaattgctgcgggtattgttgcgtcagttgttcaatcgaagcattgctttggcgatcaataccgaagacaaggacaccttgagctaaaaaagccgttgcttgggcatgaccgataccagaagccacaccggtgatcaaagcgtgctggtgagctaattcgggataggttgccattattcgaccacttgccagtcggtggcgagtaggtcgcagctagtgggttggaacattgacaagctaggtacttcgtcggttttgatcaaaaagtaaggattgatcgcttcaccatggtaagttgcatcgttaactagaaagatgtactgttcgctaccttcccagccactacgaatgactttttttccagctgctaataagggtaaaacttcattaaaagacatattaaattcctcctattttacaattaagattattagcgaattacgctaacttgtaaacgtgacccggtaattaggcggttaggtcgatccgcttagctaaaatataaaataaaattgcgccgatgattaacgaaatcaattcaccgaaagcgacgctaaagtaagttggccaaaaaggggctttgctgacgaggtgtaactctaaggcgacgctccacatcgcgatggtacaaataattgtactagtggttaatttagccgcgacactttttaagcgccgactaagatagtagctaacggtcgtcatgaccagtgtgcctaaagtcccaaagatgatgtcaatgattcctaagggtgaaaataaattgacgatcgcgcagccaatagtcaacgcccagatatagcgtttgttaaaaatagctaaatgattcagcatttccgaaaaacgtagctgagtcgcgccaaagctccatggtgccaccaacatggtgatcgcaatataaagcgcggcgatcacgccaatcttagtcagtgaactggttttgatcctagttttttccattataaatagcctcctagtttttttcggtgggatggtcacgaaccaccactgacaaattgtcagacttgcagcattaagtataacaaactcagccgctatggggaaattttgccagaaaaaaactcaagtcagcgctgacttgagttgagttggttttatttttttgatgcgtcttttttagtgactttagcttctttaggtttttttgcgactggtttttcaacaggcttttttggatccaaggcgaatttatcgaataattcgtttagcgtgttgtcttgtttcatggtaagtcccattgccatcatcctttctttacttggtacctattttagcagaaaagtggcaactttgctcagataagtgttagcctttttccagcttaagcaaaacctaaagttattgcgcttttgtttaagtttaggcgttaattatttatttgagcaggttatttttttagcttatagtaagcgctttttgtatattggtagcaatggctgcatatttgtttaacttaaccggttaataatgaatttagcttactaataggtttttgtacgcgacttttagtttgatcgagtgctttttaattgaatagtcgattaattttatgcataaatgtaattatttatcgaaaatacttgcataaaaaatcattagcaggtataatcgacctattgaatatcaagtgtgagttttttagcggtcagtatgttggggtaccgcgaaaaatttcgcaaaaatgtagattagataggtaggcaagcacatgaagaaaataatgagctggttaatgttagtcgtcacagttagtgtggcgttgctcggcggatttgcacaaccgtcacatgccgcaacggcgacgacggatgattcgttggcacgggttaaggaaaaagggacgttggtcatggggacaagccctgactatccaccgtatgaattcttagtcaatcgtggcggtaaagatcgtgttgtcgggatggacgtggatatcgctaagaaaatcgccaaagatttaggcgttaaattagtgatcaaacaaatggattttgattccttattggtcgctttggaaaccaataaggtcgatatggttatttccgggatgtcaccaacgccggcacggcaaaagagtgttgatttttccaaggtctactataaaggtggccaatcgatcatcattaataaggcggataaagggttatacaagaataaagattctttccgcaacaaagccgttggcgcacagactgggagtatccagtataatttaggtaagaaacaaatcaaaggttcgacggtcaaaggcttggctaagatcagcgatttaattttggcgttgaagagtcataaagtcgaaggtgtgatcatggaagaaccatcggctcaagcttatgtggataatgatcccgatttagcaatgatcgatggtaaattcagtcttggtagcggtgaaaataacacggcgattggctttaagaaggggtcaacttcattagtcaatgccgtcaataagtcggttgacgagatcaatcaaaagaacttaacgaagacttatttgaagcatgcgggaacgtttatgaagaccaacacgaagaacactagcatgtggcattacgcaggttacttcgtaaaaggggtagagtatactttactgatcaccgttgtcagtgtcttctttggtattttacttgggattctcttcgctttgatgcggttgagcaagatgaagttgatccatggtttaggggttgcctacatcgaattcgttcggggcacaccgttgatgattcaagtgatgttcgtttacttcggtattggcttgcttatcaatattccggcgttgatcgctggtatcattgccgtttctttgaactctgctgcctacgttgcggaaattattcgtggcgggatcaattcagtggctaagggtcaaaccgaggcggcacggagcttaggtttgagccggcaacaaactttccaaagcgtcgttttcccacaagctttgaagaacatttggccagcattgggtaatgaatttgtttccttgattaaggaaagttcgattgtgtcgatcattggggtcaccgatttgatctatcaattaaaagctgtgcagacagcgacttataaaggggttatcccgatcgtagttgcgatgatcatctatttcgttctaacctttagtttgtcgaaagtattgaaccactatgagaggaagatgaagcacgatgcctgaagaaatgattgcgattgaaaatatcaataaaaaatttggcgacaccgaagttttaaaagatttaaacggtaaggttgaaaaaggccaagtgatctgtgtcatcggcccatctggtggcggtaaaagtacgttcttacgctgcttgaacatgttggagcagccaactagtggtaaaattttgttcgaaaattctgatttaacttcattaaatgaaggccagatcaaccaattacgggagaaaatggggatggtgttccagagcttcaatctattctccaatatgactgtcttggaaaatgtaaagttggccccagttaaagttaaaaaaatggctgacgctgacgcccagaaattagcgattaagctgttggatcaagtcggtttggctgataaagcggacaattatccggctagtttatccggtggacaacagcagcgggtggcgattgcccgtgcgttggcaatgaacccagatgtgatgttgtttgacgaaccaacctctgcgcttgatccggaaatggtcggcgaagtgttgaaagttatgcaagatttagctaaccaaggtatgaccatggtcgtggtcactcatgaaatgggcttcgctaaaaacgtcgccgatgaagtgtggttcatggatggcggtgtctttgctgaaaaaggaacgccagaacaaatttttgaacacccacaaaatgaacggacccaagatttcttagcaaaaattctcgaagcataataacaaaagctggctgcggccagctttttgcgttgtcttaaactagacgcttgcttttccggctggacgcgttaaaatataacagcgaacatgtgtacgttgattaatttttgcttatttaagaaaggttgtttggtgtggcaacagaacatatagaacacaaactagctctactgccgccgctgccgggctgttatctgatgaaaaatcgcgacggcaagattatttatgtcggtaaggctaaaaatttaaaaaaccgggtccgttcttactttaagagcagccatgaaggcaaaacggcgcggttagtctctgagattcgtgattttgaaacgattattacttcaaccgataaagaagcttttttgttggaaatcacgctgattcaaaagcaccagccacattttaatatcaagttaaaaaagggcaccggctacccatatattaagatcactaacgaacgtgatccccgtatgctgatcacgggtgacgttaaaaaagacggcggctactattttggcccgtaccccaacgtttatgctgctgaggagacactacattttttacaaaaagtatacccgctacggcgttgtaatgggcggcagaaacggccttgcttgtattatcatatgggccaatgtttaggtgcgtgcttccgcgaggtgcccaaaagtgagtatgacgcgcagatccgtaagatcaagcgctttttaaatgggcgagtgagtgatgttaagcgggagttacgggaaaaaatgcaggctgccgccgctgatctacattttgaacgtgccgccgaattacgcgaccaattacgctatattgaggccaccgttgaaaaacaaaagatcatctctaatgaccatacaccacgggatatttttggctattacatggataaaggctggttgtcggtgcagatcttctttatccgccaagcccggctgatcaagcgggaaaagcggctatttccgtgtgttaatacgccagaagaagagttggaaagttttattctccaattctataagcgcaaaaacaacgtgttgccgcgggagatcctagtccccaaaggcgtcaaccaaaaagtgttagccgatattttacaagtgccgatccgcacgccgcaacgtggtgaaaaacgggcgttgatgctgatggcgaataaaaatagccgtttggttttagaagaaaaattccggttaatggaattggataattcgcatacggtgggcgcggtgcaggaattagttgatgctttgcagatcacatccgcccaccgaatcgaagcgtttgatcattccaatattcaaggaacggatcccgtttcggcgatggtttgctatattgatggggagcccgccaaaaatgaatatcggaaatataaaattaaagccggcgatggcgctaatgaagcggctaacacccaagaagtcattcgccgccgttatattcggttgttgaaggaagaacagccgctacctgatttgattttaatggatggtggcgagattcaggtgcacgcggctaaggaagttttggaagacgaattaggactaaacattcccgttgccgggatggtcaagaacaatcatcataagaccgctgacttaatgtatggcccagattataaaaagctcgatcttgatccgaaaagtgaaggcttctatttactgcaacgcatccaagatgaagttcatcgctttgcaattaccttccaccgccagttacggggcaagcattctttgagttcacagcttgatcaaattcccggcgttggtccaaaaacacgaacaaaattactacgtcattttggttcattaaagaaattgaagaatgcaactatccctgaattgcgtgaaatcggtgtttccaaaacggttgcgcaaacgattaaattgtcattaaaatagagaatgaattaggtccaatcacacttgtggttgggccttttgttattttagcggtctttaatgataaggcgtattttatcacgatcgtagattaaaactatacgttaaacgcgaacgattataataaaaaaattgaaaatatacgtttatggtattgacgaatgattatggatgcttgtatacttagtgtacgatttgtaaagggtgatgtattcaccttaattatggaattgtgaaatagggaggtcatttttgtgaagcaagttgcgatcgtgatgggttcagtttcagattggccgacaatgcaggcgtccgccactattttaactgaattgcagattccgtttagtaagcacgtgatttcggcacatcgtatgccggcacagctgcaagacttcggtcagcaggcggtgacccagggcatcgatgtgattatcgctggtgctggtggtgccgcgcatttaccggggatgttggcggcgaataccgtgcggccggttatcggtgttccgattgaaagtcatgcgctgcacgggctggattctttgttgtcaatcgtacaaatgcctgccggtgtgccggtggcaacgatggcgatcggcgtggctggcgctaaaaatgcggcgttgcaagcggctagtatgctggcgttgcaagatgatcagttgcaacagcggctactagattaccgagcggcgcagacccaaaaggcgattgaaagtgaggcgcaacttgattaagcaattattaccaccggccacgatcggtattgtcggtggcggtcagttagggcagatgatgacgttagccgccaagagcatgggttacaaagtcggcgtgctcgatccaacgccggattgtcctgcggctcaggtggctgattttcaaatcaccgccgactatcgtgatcaaccagccatgctggcgttagctaaacgggctgatgtgttaacttatgaatttgaaaatgttgatctagctagtttaaaggccgctaaacaatatgctgaattgccacaggggacgcatttgttggcaatcacccgcaatcgactgacggagaaaaactttcttaaatcgctgggggtgccggtgactgagtttgcggcggtgacgacaccagctgaattaaaggcagcttgtcaaaccgtgggcgtgcccagtattttgaaaactgctactggtggttacgacggtcatgggcagcatgacgtgaatacgctggccgatttggcgactgatttattgccgggtgattgtattctagaacggcgccaagcatttaccaaagaattagccattatggtcacccgtgatcgtgatcagcaagtgcggacatttccagtggtcgaaaatagccatcggcagcatattcttcatgaaacgatcgctccagcgccggtttcagcggcaattaaggctgaagtcgttgcgatcgccactaaaattgcccaagggttggaattgtacggcgtcttaggcatcgaatttttcttattgccgaatggtcgtttgttggttaatgaattggcgccacgaccgcataattctggccattttagcattgaggcttgtaatttatcacaatttgccgcccatattcgtagtatttgcggactgccgatccccgcgatcacccaacagcgaccagcagtgatggtcaacttactcggtcaacagttacagtcagcgcggcaacgctggttacaacggccgcagtggtatctccatgactatggtaaagcagaaagccgttaccaacgtaaaatgggccacatcactattttgactgatgatccagcggcgacacaggctcagttagaacaagaaaatatttgggaggatcaataatgcgcaaacttaaagaattgaaaaccggcaaggccaaacggctgtataccaccgatgacccgaacgttttgtgggtagaatacttagatcaagccactgcacttaatggcaaacgcaaggaacaaattgctgctaaaggtgcgctgaacaaccagatcgactgtttaatttttgattacttaatggccaatcagattccgactgattttattcgccaagtttcggcgacggaacaattgatccatcccgttaaaatgatccccttggaagtcgttgtgcgcaatctggcttctggtagcttccaacgcaagtttgccactgactatttacagccgctaactaagccgctgattgagttcttttacaaatcggacccgctggacgaccccttcatgaatgatgcgcaggccgaaattttaggtattgcgaccgctgatgaattagctgcgatcaaacaattagctttgcggatcaatcagttattgcaggtgcggtttgcgcaagctgagttgaccttagttgattttaagatcgaagttggctatttagagggtcaattggtgttggcagatgaaatttcaccggattcgtgtcggctagtcgatgcgacaacgcaagcctcgttggataaggacgttttccgcaagcatacgggtgatttgaccacggtttatcaagaagtgttgacgcgcttagaaaattcggaggtggctcatgtatcgcgctaaagtttatgtgacctataaagattcgatcctcgatccccaggccgaagcagttaaaaccgctttgcaccaattggatttttctgaattgcaacaactgacttgtggtaaatattttgaattagttttagctacatcgaaagaaaaagcagcggccgcggtggaacagatgtgtcaaaagttactagctaatgtgaatatggaaagctatcgttacgaattggaggcttgctaaaaatgaagtttgccgtggttcaatttccgggctcaaattgtgatcaagatttagtggccgctttacgtgatgtttttcagcaacaggccgttttagtcgattatcgaaccgctgatctaactgattatgcggcggttttgttaccgggtggtttttcgtatggcgactatctgcgtggtggggcgatcgcccgttttgctccgatcatgactgcagtgcgtgactttgccgctgcgggcgggctagtgatcggcatctgcaatggcttccagatcttgaccgaagctggcttattgccaggcgttttgcagcaaaatcaaagcgccaattttatctgtcaaccagcggctttgaccgttgtcaataaccaaaccagcttcaccaacgcttaccagccgcaacagtcgatcactttaccgatcgctcacggtgaaggtaattactactgtgatgcggcaacgttggcggcgctcaaagcgcaccagcaaattgtgtttacttatcaggacaatcctaatggcagtgtcgctgatatcgccggtatcaccaatcgagccggcaatgttttgggcatgatgccccatcccgaacgggcggtggaagcacttttaggtagcgaagacggccgcggtgtttttcaaagtatattacaaatattaacggaaaaggtggtgccagcatgatcgagcaaacagcgacagcaattgaagctagcgggttatacgaacaatggggcttgaccagcgctgaatatcaacggatccaagaattgctcggccgtttgcctaatttcactgaaactggcttgtttgcggcaatgtggagtgaacattgtgcctataaaaattctaaaccgttactgaaacaatttccgactagtgggcaacggattttgcagggccccggtgaaggtgctggcatcatcgatattggtgacggtcaggcagtggtttttaaagctgaaagtcataaccaccccacggcagttgaaccttatcagggggcagcgactggtgttggcggtattatccgcgatattttttcaatgggcgcacagccgatcgcgctgatggacagtctgcgttttggcggattaactgatgcgcatacccgctttttactacaggaaaccgtcgcgggtattggcggttacggtaattgtatcggtattccgacggttggcggtgagttggcgtttgatgatgcttatgcggccaatccagttatgaacgcaatgtgtgttgggttgttggacaccacgatgcagcaaaaaggtcaagccgccggcgccggtaacttgatttattacgttggcgctaaaactggccgcgacggcattcaaggggcaatttttgcttcggcggaatttaatgatgcggttgaagctgatcgttccgcggttcaagttggcgatccctttatggaaaagcgattaatggacgcttgtttggaattgatccgcgaacacccggaagcagtcgttggcattcaagatatgggcgctgctggcttggtctcatcttcagccgaaatgggtgccaaagcggactacggcatgactttgaatttagatgcggtgccgcagcgggaaacgggtatgattccttatgaattaatgttgtcggaatcgcaagagcggatgttgctctgtgttgctaaagatcaaggggcggtggtcgaagaagtgtttgcccgctatgaactggatgcggtacagatcggtgaagtgacggcagctaaacaatatcagttgtatgctcatggtgaaaaagtggctgacgtaccgatcaaagcgttagtcgatgaggcgccagtttatcagcggccgcaacgaatccctgcacggttattgacggctgacccacaacagtatcagccccagttcaccagcgcaacagccgttttgacaaagctgttgcaacaaccaacgctggcttccaagcaagccatttatcgcagttacgatactcaagttaaaaccaatactgtcgtggcaccaggctcggatgccgccgtacttagaattcgcggtgggcgtaaagctttggcaatgactactgacggtaacgggcgctacttgtatttaaatccagagatcggcggccaaattgcggtttgcgaggcggcacgcaatattgtggccagtggcggcgttccgctgggtatcaccgactgtcttaatttcggtagtcccgaagaaccagaaagtttttatgaactggcacaagccactaaagggatgagcgcggcctgtaaagctttagcaacgccggtgatctctggtaacgtgtcgttgtataacgaatctaacggcacggcgatctacccaacgccgatggtcggcatggttggtttgatcacagaccttgctttgatcacgacccaagatttcaagcaagcgggggacgtgattttcttagtcggccaaactcatgctgattttaatggcagtgaattacaaaaaatgttgactgggaatattaatggtgcgctatttgattttgacttagcaacggaaatcgcccatcaacaattggttcagcaagcgattcgggcgggtctcgttagtagtgcgcatgatctagcggaaggtggcttagcggtcggtttagcggaatgctgctttggtcagcaattaggcgccagcattgacgtagcgatgcccgccagctggttatttgccgaaacgcagtcacgctttatcatcaccgtgcccgcagcgcaagcagcagctttcagtcaaatggccggcgaacaggcacaacagattggcacggtcacagcagcgactgacctagttatcaaaacaaatacagaaaccttgacattggatatcgtcaccagcaaacagcagtgggaaggagcattagcatggtaagcgaggtcaaaagtctcaatgaagaatgcggtgtatttggtatttggggcgatgcgcaagcggccgagctcacttattttggcttacatgcgttgcaacatcgcggtcaagaaggcgccggcatcgtcgccaatgagcagggacatttaagcggtgagaaaggtttaggtttgttgatggaagtttttgaccatccggataaattagcccatttaactggtaacgcggctatcggccatgtccgttacgccacggcgggcagtgccgggatcgaaaatatccagccactattatttaattttaaccagcaacaagtggccttggcgcacaatggcaatttgactaacgcggtcagtttgcgggcgacgttagaggcagccggcgccattttccacgctaactccgataccgaagtgttgatgcatttgatccagcggcaaaccgccgcgacgtttgaacagcgcttaaaagccagcctgcgccaaatcaaaggtggctttgcgtacttagtcctgaccaacgatgccttgtacgccgcactagatcccaatggctttcgaccgttagcgctgggccagctagcgactggagcttatgtggtggcgagcgaaacttgtgctttagatacggtcaatgcgcgcttcatccgcgacgtgcaaccaggtgaattgatcaaaatcgacgatcacggttaccacgttaattcctataccaccgacacacagctagccgtttgttcgatggaattcatctattttgcccggcccgattcaacgatttatggtgtcaacgtgcatcaagcgcgcgaacgtatgggccagcttttggccaaagaacagccagtggatgccgatatcgttgtcggggtgccaaattcgtcgctgtcggcggccaatggttatgcggcggccagcggtattccatacgaaatgggtttgatcaaaaatcagtacagccaacgcaccttcattcagccgacccagcggttacgtgagcaaggagtgcgaatgaagttatcagcggtggcggcagtggtcaaaggtaaaaaagtcgctttggtcgatgattcgctagtgcgggggacgactagtaattatattgtgcgccttttaaaagaagcgggcgccaccgcggttcatttgctgattgcctcgccacctttgcgctacccgtgcttttacggcatcgacattgaaaatacccgtgagttgttggcggctaatctgaccttaccgcaaatgcaggcgcagattggtgctgattcactacattttctcagcgtagccggcttgatcgcggcgatcaatttaaaaagcagcacgccgtattctggtttatgtgtggcttactttaatggtgactatccgaccccgctgtacgattacgctgcaacttttgaattgccgcaagtgacggcttgaagtttggcggcgaaattaaacagtaagtgtatcgctaaacgaaggatactactgagctaaattagttgtaagagccagccaaataattttcaaatacagcttaggaggaaaccaaatgaatgcttacgagaaggcgggcgttaacattgctgctggagaagcggtggtcactaatttacagcaacagatcaaaaaactaaattcagcaaatgtgttaggggggttaggcgcgtttggtggcctgtatcaattgccaccgcggcagcagccggttttagttgcggggacggatggtgtcggcaccaaattgttgttggcgatccaaagtgggcggcggacaacggtgggccaagatctagtggcgatgtgtgtcaacgatgtcgttgcacaaggggcacaacccttatttttcctggattatttagcggtggcgcaaacccaaccgcaggaagtggctgagctgatgcaagggatcgtggctggctgtcaacaaagcgggatgaccttgttaggcggcgaaactgcggaaatgccagatatgtacactgcgggtcattatgatctagcgggttttgccgttggtatcgctgaaaaagcagcattgctgacgccggagcaggtgcaggccggcgatgttttacttgggttacctgccagtggcttacatagtaacggcttttcgttggtgcgccaattgttgttcaaaacacacgattatcgttttactgatacccctgctgaattagggggagccaacttgctggataccttgttgacgccgacacagatctatgtcgacgcgttgctgccattgcttaagcaacagttgatcgctggtgcggcgcatattactggcggtggcttgctggaaaatgtaccgcggatgttgccagctggattaacggctcaagtcaacttaggtagttggccgcgccagccgatttttgattggttgtgtgcattaggtcagttgcagcaaaatgaggcgttcacgacttttaacatgggtctgggcatggttttagcgatccatccaactgatctagctgccgtgcaacaaattctgaccgctcagcagcaagctttttatcaaattggtacggtgcacgcgggcgcaactggtgtggtattagtggaggccgacgcatgaaaaagttagcgatcttcgcttccggcaatggtagtaactttgaagcgttggtaaccggcattcagcagcaaaaattagcagcacaagtggtgttactagtgtgtgatcagccgactgcgccggttattcaacgggcgcaacggttaaagattcccgtttggaccgcggaatttaagcaatttgcggataaagcagcttttgaaacgacgatcttggctcaattacgccaacatgaggtggaattgattttgctggctggttatatgcggatcattggtcccaccttgttgcaggcttatccgcagcggatcatcaatattcatccggctttgttgcccaagtttcctggccgtcatgggatcgaagatgcgtttgccgctggcgtgactgaaactggcgtgaccattcattacgttgatgctggcgttgacagcgggccaatcattcagcaggctgtagtcccagttaaaccgcaggacacgctggccagcttaagccgccgcgttcatcaaacggagcatcggctttatttgcaaagtctagtaaaaatattagaagagaaataaatgatagaataaggggcgcatcattaatgaaaacagctttacttagtgtatcggataaaacaggattggttgaattcgcgcagggattagtcgcacaaggttaccggatcctttcgactggcggcacccaaaaagtattggcagcggctaatattgccgttacccccgttgaagacgttacccattttcccgaaatgcttgacggtcgggtaaaaacgctccacccagcgatccatgcagcattattagctaaacgcgatgatcctgaacatatggcaacgttggcgcagcaaaaaattacgccgatcgatctggtgtgtgttaatttgtatcccttcaagcaaactatcatgcagccggcggtcacggaagcggcggcgatcgaacagatcgatattggtgggcccagcatgttacgctccgcggcaaaaaactttgccgcagtgttgccgctcgttgatccagccgattaccagccagtattgacggcattggctgctggtgaagttgatcaggcattccggcggcaattggcgactaaagtattccagcacactgccagttatgatgcgttgatcgccgattatttgaacacggaagaatttccggcaacgttaccgctagcttacgagaagaaacaagcgttgcgttatggtgaaaattcacatcaaaaagccgctttttatcagacggcgcttccggaaccttattcgatcgcgcaggcacaacaattacatggtaaagagctttcctacaataacatcaaagattgtgacgcggcactgcggatcagccgtgagttcagccaaccagctgtcgtcgcagtcaaacacatgaatccttgtggtgtcggcttagctgctgatattgaaaccgcttgggaccgcgcgtttgctgctgattcaacttcgatttttggtggtatcatcgtgttgaatcgggaagttgatgtggccaccgccgagaaaatgcatcagctgttcttagagatcatcattgcgcctagctttacccctgatgcgtttgctgttttggcgcaaaagaaaaatctacgtttattgaccttagatatcagcgcacctgaacaaactgaactcgaaagtgtctcggtactgggcggtttgttgcgccaagaggccgatcaagtccacgaaacggcggctgattttgaagtggtgactaagaaacagcccacagcggcccaattaaaagcgttagaatttggccagatcattgccaaacacgttaaaagtaatgccatcgtggttgccaccgcggaacaaacgctgggtatcggtgcgggacaaatgaatcgcgttggctcagtagagatcgccattcaagcagctaaagataaaccaggttatgccgatgctattttagcctctgacgcctttttcccaatggacgattcagtcgcgtatgctgcggcgcacggcattactgcgatcgtgcagcctggtggcagtatcaaagataaagactcgatcgctaaggccgatgaattaggcgtggcgatggtcttcagtggtcggcggcatttccggcattaagctgggcgttttttcagacacactctaaggagggcgattatggctaaagttttagttatcggtagtggcggccgcgagcacgctttgtgccggcaatttttgttgagcccgcaggtgacgcaagtttactgtgcccctggtaacgcgggcatggtggccgatggcattcaattagtagcgaccactgcttttgcggcgctcgcagattttgtccagcaacagcagatcgacttgacctttgtcggcccggagatgccgttgcaacaggggatcgtcgactattttcaagcgcgccacttacttatttttggcccaacccaagcagcagccgaattggaaagctcgaaaagtttcgccaaagcattgctgcaagaacaagggatcgccaccgctgcttatcaagaatttactgattacgcagcggcttggacttatttgcagcagcaggcattgccccaagtgatcaaggccaacggtttagccgccggcaaaggggtcaccatcgttaaaagcttggcgcaagggcaaacggtgttgcaggatttattgcagcaacaccaatttaaaaccactagcgtgatcattgaggaatttctagtgggtgaagaattttcttgcatggcgtttgtcgccggtgatcagatcgttccgctgccgctggcacaggatcacaaggccattggcgcaggcgatactggcgcgaatactggtggcatgggcgcttatagtccgttgccgcaaatgccggctgacttagcccaacaggcgtttgaccaagtcttgcggccaacggtcaccgggatgcaacaacggcaacgcgcctttaatggcatcttgtacgctggtttgatcttgaccaccagtggcattaaagtgatcgagttcaacatgcgctttggcgatccggaaacgcaggtcgtcctgccgcagctgaccagcgatttttatcagttattgcaggatatgttggccggtaaaaaagttcagccgacttggcaatcaacgcggcttaacttaggtgtggtggtggcggcagctggctaccccggcgcttatcaacaaggattgccgttgcctgacttaacgcacttgccagccgatttaacggtttattatgccggcgtggcggtcaaagaggagcacttagtcagcgctggtggccgtgtattcctagttgcaacgcaggcagctgatgtccgtaccgcgcaacaaaaaatttacgccgcccttgatcagttaccgctggcggactttaattaccgcctcgatatcggttggcatgccttgggctaaaaaagcgttagtcattcatttcacgaatgactaacgctttttagtagcctaatttgagatcgacttgattgacgcttaacttgccggtctggcaaaaggactgtaaatttggataaaaaatagcaaataaggcgtcctcaacatgatcgacggtgccggtggtatgtggcgtcataagcaagtttggtgcttgccacagcggtgaatcagctggcaacggttcttgctcaaagacatctaacgcggccccagccaattgaccgttttttagagcagcgatcaaggcagtggtatcgactgatgggccacggccgacattaatgaagatcggcggttgcggttggtgagcgaaaaagtcagcggcaaagaaatgctgagtggcgttagtcagtggcaatgcattcacgatgaaatcagctaccggtggctggaccttgctagtggctaaggcgatagtttcggtgaactctggcgctgggtgaccgctgtgattgacgccgatcgtttgcaaaccaatttgtcgcaatagttgactgacggcttggccgacatggccggtgccatagatcagcactcgcttgttaacaacggaatacaggacacgccgctgaatacgtccttgccagaaattttgcggatcgcggttttgcgggtgggtgatataacgggcaaagtccaaaatgtaaccaagtactgattgcgcgatcgcatcgccgtgaataccaccagcatgggcgactaacaccttttgttggtccaaagcggctagcggtaaataatcgattcctgctgaggaggtttgaataaatttaactcgattggggccggccaaaattttagcggcgagtgggctccaagccatgatcacatcgatggttggcgccagcttaggctgaaaatcattttggcgaatgacgtggacgtcgggtaagctttctaattgactgatctgggctgtagagaagtgagtggcagtaagaatgttcattggttaaccgtccttattaataagtttaactgtattttaagtgggttagcttaaaagcaacttaaggtcacaaaaaagagcgtgccggcaaagcggtacgctctttttcagatcatattagttttcttcttttaatgctgggcgccagatgccaaggatcacaccggcaacgacagcaccgatcacgacggctaagaggtagaagatccagttagttgccagtggggttacccataacccaccatggggtgccgggacgctgacgtgccataattgggtcaagccgccgcctaatgccgcaccgatcacactagaaacgatcacgtgcaaggggtcagaagcggcaaacggaatcgcgccttcggtaatgaaggagataccgagcacgtagttggaaatacccgctttgcgttcgtcagccgtgaatttgtttttccagaaagtcgttgcaatggcagttgccaaaggtgggaccatcccgccgaccatgacggcggccattaatttaccgtcaccagttgcggtgtaaacgccgatggcaaaggtgtaagcggctttgttaaagggaccacccatatcaatcgacatcatcccgccgaggactgtgccgagtataatcgcgttaccagtacccatactcttcaagaacgtggtcaaagcatggttgatcacggcaaaaattggatcgacgatgaagtacattaggaagccgacgatcagtaagccaaggatcgggtagaagatcattggtttcaaaccgtccagtgacttcggtaagttacggaataaatgcttcagtaagacgatcacataaccggcaataaaacctgcagctaagccaccaaggaagccagccacactggttgttttaacgatacttgcagcggctgtgttggccatgaaaccaccgacaaagccgggcatcaaggcaggtcgatcaccaatggaaacggcgatgtaggccgccaagactgggatcaagaaactgaaggcccagttaccaataccgtttaagaagataaaggtcgttgaatgcgcacccacggtttgttcaaccatgaaggaaatcgccattaaaatcccgccaccaacgacgaatggtaacatattagaaataccgttcatcaagttagcgtagattttactccaagcggatttgctttcaccatcgtcttcgctagcagcgccatcagcaccagtagcgtggaaaattgagcctttttcagctaaagtctcgttgatcaattcttcgggctttttgataccgtcaataacagggcggttcaataaatgcttaccatcgaagcgatccatttcaactttcttatcagccgtgatgataacaccgaccgcgcggttgatatcatcagcggtcaagcgatgtttcacgccttcggaaccatttgtttccactttgatgtcaacgttcattgcttcagcttgctttttcaaagcggcctcggccatgtacgtgtgggcaatcccagttggacaagcggatacggccacgataaagggacgttcgctgttgtcattggtcgttggggcagccacggtttgtgctttagctgcttcagcggcttcgtcagcagcgtcttttgcttccttagctgcctgggcgtcagcgaataattgctgtacgtcatcgggtgtctgggcttttttcaaagcggcgactaaatcagggttgatcaataaactggagagggcggccaaggcctgcaaatgggtattattggcgccttcaggagcagcgatcatgaagaataaatgtaccggttggccgtctaaagcatcgaagtcaacgccggcatcacttttagcaaacaggaccgtggcgcgggtaacggctttatttttggcgtggggcattgcaatgccatcgccgatccccgtcgttgattcggcctcgcgcttgatgatgtcttttttatacaattcttcgtcgttgatgatgcctttgacgtagtattggtggactaactcatcgatggcagcagccttagtggtcgctttgaggtccatgatcatgacgtctttgagtagtaggtcacgaatatccatgaatgttacactcctttaaaattaatttaattgtggtaagtatcgatgtgaatactttggcgaacttcggcaattttagcttggttagccaagtcttcggaaaaggcggtggcactgccgcaagctaagccagtttcaaaactctgcagtgggtcgtgggtttgactaaaggtaccgacaaagccggcgatcattgagtcaccagcaccaactgagttgatcacggttccttttggtgcagtcgatttgtaaacttggtcaggggtgatcaagaaggcaccgtcgccggccatggaaactaaaacgtgcttggcaccaaggtcgagcaatttacggccgtatttcacgatatccgcgtcgccagtcaattcaacgttgaataaagcggctagttcgtggtgatttggtttgatcactaatggttgggcgcttaaggtatccaaaagcgcttggccagtggtgtcgatcacaaaatcagcaccgtgggctttgatcaacggaatcaagtcacgatagaaactttctggtagggttggtggtaagctgccggacatgacgacgatatcgccggcttgcagttgatcaaatttggctttgaaagcagccagtgccgttgcactaattgctgggccttgaccgttgatctcagtttcttcgccagccttgaccttaacgttgatccgggtgtcggcgtcgatcttagtaaagtcggcggtcatttgttcagcggctaattgttgttgaataaagttgccggtaaagccaccgagaaagccccaagcggcgtttttgactgctagttggttcaagatccgggatacgttgatccctttaccaccaggtagtttggtatcataactcattcgattgactgcgcccaaagttagctggggcagttgtacgatatagtcaattgaaggattgactgttaccgtatagatcatttgatcgcctccaaaatgtctgtatgttgctgatattggtcaagttcacgttgacttaagtggtcggtgacgatggtggctttcgctaggtcaccaaacttagtaaaggaaacttggccgaatttagtatgatcggctaggacgatcgtcatttctgcctgagcgatcgctgctcgtttgatcgcggcttcgtctgggtcgggggtggtgtaaccgtaatgtaggtgcaccccattagttccgagaaagactttgttaaagcgatactgttgcaaagctgcaatgctgtcggcgccaatgatcgctttggttacattttttaagcgaccacctaataggaaacaacggatgtcatagtcggccaaaagtgacgcatgattaacgccgttggtgaccacagtcagattagctgtggcctttaaataaggaatcatggctaaggtcgtggtgccagcgtctaagaaaaccacgtcttgcggagtcaaacatgaaaccgccaatttggcgacggcttctttttcgctgacactctggttcgatttttcgctgaccgctaattcggtttgcagcgcggccacgtgtttagcgccgccgtgcacccggactaacaagccggcttcttccattaattgtaaatcacggcggatggttgattcggatgcctgcgttgcactgatcaagtcatgtaatttaataatgtcatgttgctttaattgattaagaataatttgatgtcgttcttctgtaagcacttacgtcacctccgcaaaaactaatttaccaccaaaaccattcaaaatcaatagaaaacttttaaattcgttcaaaaacattaatcgccggatttacaatgtaagtgcaacaccgaaacaactagaccaaaaaggccatgaagccttaaacttataagcgacgaaaccaataagttaggacggacttcatgacccaatttaaagataccatca

SEQ ID NO: 474 - DNA, 2093 bp, Unknown
  Metagenome-assembled genome
tcaaacacccaaagcgcttttctccgctgcttccgccggttaagttaagtccataaaatatgaatattaatgaaaatattgatttaataggatttatcgtgtggctaatttgttcttgcaatttgggaaataattgttttctgaaaaggcaaaaaccacgcaaccaaacttattggttgcgcggttcttatatccccaattttctgcccgactaccttaaccagctaatcgtccaattccaatggtcggttcgcttgtttattggcgccaaccattgggaaaactttgtgcggattcaaaatatggtttggatcaaaggcatccttgaccagttgcaaaatgcgcactttatccttgccgtagtatgcttcaaaataaggctcgcgggcgaagccgatgccgtgttcgccggacatttcgccgcctaacgctttggcagttgaataaagttggcgaatgatccgatcgactttacgggtgaattcttcatcagaataattatccttacgcatataaatatgcaaattaccatcacccgcgtgaccaaagttcggcatgctgactttttctgccgcctgtagttcagcgactttgtctaacaccttaggaatctggctgatcggcacaacgatatcaacctcatcgatcgccgtcgtggtttgttggatcgccgttaacaattgattacgggtttcccaaacggcgacccggtgagcatcgtcacccatcagaactggcgccaacgccccattatcgcgggcaatctgcattgctcgatccaaatcacgttgaaccacagtgccatcatgcccgtcaaaagtgatcaacaaataaccgccgccagtgtgatccataaatggttggtgcgcatagctttcccaatattccaccgtttcacgactgaaaaattccaatccagttggtactaagccagcccgcaaaatcttcggtaccacgctgatcgcctttttaacgtcaacaaatggtactaacacgtctaaattaaccgttgaccgcggaatcaaacgtaaaatcaactcggtgatcaccgccaaagtcccttcactaccgataatgacgtcctttaaatcataaccagagctgtttttaaccgttttgctgccaaaatgttggattgtgccatcggccatcaccgcagtaatgccgcgaatatgttcacgggtcgtcccgtatttaactgcgcgcatcccgccggcgttagtgctggcattcccaccgatcgtggcccatttcatcgccggtgctggaatataagtaaacggcttgtcttccaagaattcgttgatgtcccgaatacggaaaccattttgcaccgtcaatgttaggtcatccggatcataatccaacacttgattcattttgatcatatcgatatcgataccgtgttcgatcggcacgttcgcacccatcaagcccgttgcgttcccccggacagtgactgggatcagccggtcattagcgtaacgcaagatcgccgccacttcttcattggtcttcggctgtaccgccacgtctggtaggctacgcacttgcttgaattgatcgtgatcataatggaccgtcgccggataaatcacccgttcggcagttacgatatcagtcaaggctttaacatcagtttcagttacacgtgaataagtcatcattatcactctttctaaaatataaacgaacggatcagcgtccggcatagctaagaaatttatgccgttagtttacattagcttacaaaatatcagtttagttgtaatcgcttacaatgattactatataaaatattttatattttgtccactcattattatctaaaaataagtgtatttgttatataaaataaattaattaaacgtgtggtgctagtttgtaacatttaaaaatttaacaaaaaaggtccaacccagttagactcataagtgacaaaacttaaaaggagtaataactgtgttgaaccacctcaagtttaagcaaaatcgtcacgaattacaagttagtttccattacttttaccagttatgttcattgctttatcagcgttattgtccgcgtagcgtcattgagcggcgcaacgttga

SEQ ID NO: 475 - DNA, 4358 bp, Unknown
  Metagenome-assembled genome
tagaaaagtcccgcaaaaagcacataattaattgcgcatcaacaccgaaactcttggcatcctgagttgcccgataaaatccattaataaccgtttcaaagctgatcccacgactggtatgcgcctgggggtcaaaaaataattcaacgtgacgaacatgattatcttttgcttttaataggtaggcataggccaaatcataaaaatcctgttcagtttgtaacacagccaatgctggataataaactgccaagaatgaagccaaatcatcaaactgataacttttcttgacttcctcaattgtattctgaccaatattaatatgattttttttggccagctttaatttaagatctggttccaaagttccttcaagatgaatatgtagttcggcctttggtaattgttgaagaaattctcgggttacatctgtcaaagtgatcttcctcctaaaatacgaacattatcttttatttttattatattgttagaataacacgtaatttcaacctcgtaaatagttattccattaaatatatcattttatttattaacgattaagcgttgcttttgttaattatctatgccataattctagttaaacacgaactttatattaggatggtggattaaagtatgaaaactgctacaaaggaacgtcacggatggttagatcgacgattccatttaagtgagctaaataccaatgcccgaaccgaaacagtggctggaacaaccacctttgtttcaatggcttatattttgtttgttaatccaagtatcttaggggccgctggaatggataaaggcgctgtttttacggctaccgcattatccgctattatcgggtgcctattaatggcctttttagccaactaccccattgcaattgcaccggggcttggagataatgccttctttacatactcggttgtattaggaatgggcatctcttggcaaacggcaatggcaggaattgtgattgcatcagttatttttaccattatttcaatttttaaaatccgagagattgttattgatgccattcctaatgatctaaagctcgcaatggcagcgggaattggcatttttattgcctttgtcggcctacaggaaagcggcttaatcgttggtagtaaatcatcactggtccaaatcggttcactgactgtgccgacgacttggctaagtatctttggcctctttgtcatcgcaattctaatgactaaaaaaattcccggttcaatctttattgggatgatcgcaacgacgctgttaggcctatttacaggtctcattcatttaccaacccatttaatttcgtcagtgccaagtcttggtccaacctttgctgtcggcattacccatttacctcagcttaattcaccaaagctatgggctgttattttaatcttcttattggtggccttctttgacacggccggtacgttaattggcctggcccaacaagctggtttcattaagaataacaagatgccccgaatcggccgggcactgatggctgactccttttccatgctcgcaggttcagtcatggggaccaccccaactgccgcctacgttgaatcttcagccggaattgcccttggcggccggactggattgaccgccttggtcactgccggcttcttcacacttagcttattcttctcaccactattaacagtggtcacctcgcaggtaactgccccagcattaattattgtcggcgtgttaatggcccaatcgttaaaacaggttgactggggccactttgaaattgccctacctgtctttttgacagttgtcgggatgccactcacctacaatatttcatacgggattgcatttggctttctcatctatccgatcacaatgatcgctgctggccgacgcaaggaagtcaacccgatcatgatcgcgctgttctttgtatttgtgctgttgctgtatgttttaaacattctgtaaaagtaatggaggaaaaattttgctatctacaaacgaattaggtaactatattcaagctggtgcagcagagattcctgctgacaccgtcatcgaacacggcaccttagtcaatgttatgacaggtgaatattatccaaccaatgtcgcaatctatcagggacgaattgttgcagtcgaccaagatatcacggactacattggtccgaacaccaaacacattgatgcaactaatcagtatttggttcccggcttaattgatggtcacattcacgttgaatgctcaaaaatgagtatgactagtttttctcaagcagttcttccccatggaacgaccagtatcatctccggtcttgatgaatatatttcatcaattggtttagacggcctggaagaaatctttgcagaaatcaatcagctgccattaaaagtattttggggtaccccatacaaaaccccttatacatttcctaaatcaaccattgcttatgacattgactcggacgatcaagccagactcttacaacaggaaaattgttttggggtctgggaaactgttcgtgaagccgttcagactcgtgatgaggatactttaaaaacgctcacattagctcagaaatatcatcaaccgatttttggttgttccccaatggcccgtggcaaagcacttaatcagttcttaatgagcggcgttcgattggatcatgaaagctatagccacgaagaattcgtcgaaaaggctcgtaaagggttgcatgtcatcatccgtgaatcaaccgttacaaagtttttgaaagaaaacattcgggcaattacggaagttgccccaggaattgcccgaaataccagtttctgcacagatgatgtcaacgcaaccgatattttggatcatggtcacgttgatcatatggttcgcttggcaatcaatgctggtatcgcacccatgacagcaattcaaatggcaactattaatagcgccgaagcctatcgaattgatgatcacgttgggatgattgcaccaggaaaagatgctgatattttattagttgaccagccaggcacttttaatattcagtcagttatcagtaaagggcagcttgttgcccaagataatcaaatggtggttaatttagccgctccaaaacgtagttctaaactacagggccgactaaaacatcagaggttacaaccacaagattttgactaccatgttgatttaaaaaatgggcaagccaatgttgaaacaattaaaagtgtcggcccatttgttcgaaaacgacgggacgttatcctagatgttaaggatggcattgtgcaacccgatcccaacaaagatgttgccctcgtatccgtgattgaacgctacggcaaaaatggtaatcaatcattaggatttgtctcgggatggtccctcaaacaaggggctgtcgcaacatcagcttctccggatgacaataacctggttgttttgggcactaatactaatgatatggcgatcgcagccaatcagctaatcgaacatggtggtggtcagattgttgttgtcgatggtaaagtcattgatcttcttgaattaccaattggcggaattgcaactgaccttgtacctgataaattagcacaaagagaacgtgacctgaaacaagcaacttatgaactcggcagtaaattacctgatcctttattctatctgtcatttttgccaatcactgcaatcccggatttagcaatcaccgatatgggaaacgttgattgtattaagttggaattatttgatccaattctaaaattaagtgaagccggccaaactgtttaggtgcactccttcgtttatcccaagatctctatcaaaataatcaaccatcaaaaaggatcccgtgaaaccagtatttgtagataatgaataacctacaaatactggtttcacgggatccttttttaatcaggcttatcagacttcaatttagattatgaccatatcgcttttttaaaggctatcaaattaaagattagaacggtcttccttttaagtaaattccaagaactaaccgctattccaacaccatttattttgatactgccacataccactttttcaactgatcaacagttaatttaggaatcaggttcgtaactaattgaaccgtcttctcaaaatccggataggcacacagcgcataattggtatgctcataacgaaccgggatcccaatgcaaaatggccgccccatttcaatgccaaattggtaacttcatcttcatactggattgaagtcaatatttgagacagattttaagagacattcagaaccgcgtttaccttccacagctcaaataaatcattaatcgcgattaataacttatttgaaccctggaaagcattaaatcag

SEQ ID NO: 476 - DNA, 16863 bp, Unknown
  Metagenome-assembled genome
ccatcattgatgaactcttcgatcaatttatccgaacactgcccaataatctggcccaattattgggcaatggcgtgtaataactgaattaactaatttttagtcttcaaactcaggactagcaggagtttgaagttatttgggtactttcaacctttagatgataatgtacagatcagttggacgcccaaaataggtatgcagcgacatactttcttgacactcccaaaaagtatgtttaccatataagagacaatttgtagattttcaaagaaggtgatgagcaaatggtactattaaaaatgtcgcatctgaataagatttatggcggcactaaggcagttgacgactttaacttagaaattgaaaagggcgagtttatttgttttatcggaacatccggttcaggcaaaacaacaactatgcgtatgatcaatcggatgcttcatcaaacctcaggaacgattgaaatcaatggtgaagatatttctaaaatggatccagtaaaattacggcgtaaaatcggttatgtgattcaaaatattggcctgatgccacatatgacgattcgcgataacattacgttggtacctagattgcttaaatggtctgaagaaaagcgtaatgaaaaggccaaggaaatgatcaaattagtcgaattaccagaggactatttagatcgttatccagctgaattatctggtggtcaacagcagcgaatcggtgttgttcgggcgttagcagcggatcaggatattattttaatggatgaaccttttggtgcgctggatccgattacccgtgaatcattacaggatctagttaaagatttacaggagcgcttaggcaaaacgtttatttttgtgacccatgatatggacgaagcgctgactttggcgacacgaatcgtgatcatgtctcatggtaaacaggtgcaagtggatacgccggataatattttgcggcacccggcaaatgaattcgttgaaagcttgattggccaagaacgactgattcaagctcgaccaagtattacaaccgttggccaagtagctactaaggccgtttctgcgcgtgaatcacagaccttaaaggaagcgctaggcgaaatgcataccaagcgtgttgatactttgttggtaactgatgatgctggcgttttacgcggctttgtgggtattgggcagatcaaccagttttacgggactggtaaaaaaatcggcgatattatggataaaaatattttctacgttaaggaagattcagttattcgtgatacggttgagcggatcttgaagcgcggttttaaaaacgtgccagtgatcgatcatgatcatcatttggttggcatcgtgactcgggcgacgctggtagatatggtttatgatgccctttggggtgaatcagacaaaccagaaaagtcggatgataccgaggtaggtgatcaagcgtgatcgcattcttccaagaatttggtggccagttgctttttaaaacttggcagcacatttatatctcagcgattgctctctttttaggcgtaatcgtggcgattccattaggtgtactcttaacccggtataaaaaaattgctggcttcacgattggcttagccagcgtgctccaaacggtgccggcaatggcactattagcgatgatgatcccgttattcgggatcggtgcgttgccagcaatcgtagcgttgttcatttactcactattgccgattttgcgtaatacttatttaggcatggaaaacgttgatccaactttacgtgatgcggctaaagggatggggatgagtaacctacagtcgattttacaagtcgaattaagaatggccgcgccagtgatcatggccggtgtgcgtttgtcagcaacttatgtgattgcttggacagcgttggcctcatatattggtgccggcggtttaggggactttatctttaatggtttgaatctgtatcgtcctgatttaattttgggtggttcgattcctgttattattttagcgttgatcgttgacttcttgcttggtcggctggaattgttactcacgccacgaacgaaacaggagggaaaataatgcgtaaatctaaattttttaaattgacgctactctttctgtcattggtcacggtgctatctggttgtggctttcctggtttaagcagtagcagcgatgatacggttaaaatagcggcgcaaaatacgactgaacaacagatcatggcggcaatgttgcagcagataatcgaacactattctaatttgaatactacggtgatcagtaatctaggttcagggacggtcagctttcaggcccaaaaacgtggtgacgctgatctgaccgcgattcgttataatgggactgattttcaaacgatattgaataaatctggtgaaactgaccctgaaaaagtcgatcagatagttcgtaaagcgttcaaggataaataccacatgacttattttccaagctatggttttgctgacacttatcaatttatggtgacgcagaaatatgctaaggcgcacaatttgaatacagtcagtgatttgaaaaaaattgctcctagtatgcgggtagggatcgatcaaagctggatgaaccgtcaaggcgacggctatgctgacttccagaaacgctatggctttagctttggtcgtgtatatccaatgcaaattggtttggtctacaacgccttggctagtggtaaaatggacactgtattaggttattcaactgatggtcggatcggtagttataatttgaaattgttaaaagataatttgaattattttccaccatacaatgccagtgtagttgtgaatgattcagcacttaaacggcacccacaattgaaatcaattttgcatcggttagacggtaaaatttcgttgaaaaccatgcagagtttgaattataaggttgataataacttgcaggagccatcagtagtcgctaaacaatttttgcaacagcaccattattttgaagggagtgacgattgatgcaaagcatgaatattgtagaacaacttttctattatttcgcccacaacggcatgtacgtgctggaacagtttgatcgtcatttcttgatctcaatttatggtgtcttgttagcggcaattgtcggtattcccattggtatttttattgctcgctaccgaaaactgagtaactgggtgatcggcattgctaacgtgatccaaacgattccttccttggcgatgttgtcgatcattatgctgggcttaggcttaggtgtaaataccgttattgtgacggtattcttctatgccttgttgccgatcattaaaaatacctacaccggcatggtcaatgttaaccgggatgtattagatgctggtaaagggatgggcatgactcgttttcaagtgttgcgtatgatcgagttacccctgtcactatcggtgatcatggctggtttacgtaatgcgttagtgcttgcaattgggatcactgccattggttcatttgttggttccggcggtttaggtgatattattatccgtgggactaacgcgactaatggtggtgcaattattttagcgggggctttaccaactgctttaatggcgatcattgctgatctagtgcttggattctttgaaaaacgctttgatcccagcacgcgaaaaactgatcaaggctaagcgagtgtaatcgcttgcaaatatagttataacctgctatatttaaattaaggaagacgaggagactaattagggatgacgagtcagtcattaccgtagagacgccagcgtgagaattgcgtagaaaaacaatcagcgctgtgctaagttagtcaagtaaataggataacgaatcgtatcgtgctacgtgaaaggtagtgtaacggcgctgatcgcgggatcaggttatcacgaaagctatagtgatcgtgtcggatcactgaaaattggtctcggaagttgtcttccgctagtatcgatccgcaggctgcatcaaggcctgcggttttttgttgctatttttttgtagcacaatagagatagttgaatttattaattaaccttaattgtggaatggaagtatcgaggatgcataagaacgatcaaactgagtggacgggtaatggggcgcatgaatattcggcttattttggaacagtgacccatgatgatcatattttattcgaattattgacggttggcgtgtttcaggttggcttgagttggcaagctgcggcaagtaaattaccgatttatcggcgtgattttgggggcatggtgatcaatgcagttgctggatttagtgaagcggatattgagcgaatcgcggctgactcagatatgatccgcaatccgcgcaaaattaaggcaaccattactaatgctcgggcaattattggggttcagcgcgagtttggtagttttgctaattatttgtggcaatttgtcgataacgtgcccctactgatcacttatgttgatcgtgatgaagtggataatcatttgccgctagcaagtaaggtggcgcaagatatgaaaaaacgcggtttcaaatttgtagggccggtggtaacccatatgtttatgaaagcagccggaattattcaggatgagattttggatcgttaagtcataacaattttttaagcgactggcaatgtttgccagccgcttttttagttacttcaaatgttataaaatctattatatgctaactggtgcaactgattaatagcttaaaaattaaaaatagatttgattataaatataattttaattataatctaatttatagtaattggtttagtcatttgaggaggctttgttgtttgttaccttatgatttaattccagctagtgatcaagcattgaatgtgacttttgctaataaaattgatccgcagatcaacttaatcattagtcggctggcaaccaaattgaaagaatgtccagaagttacggctttattaccggcctttcggacattgactattttttaccaacccttagtaaccagcctagaccagcttaaaactttagttacaaggactattgataacttagatttaaaacaagtgggacagacacaaataattcatattcccgtttgttatacgccggaacttggtcccgacttgcaacgagtcgctgaacatgcgcatttaagtgttgccgatttgattcagcgtcatacgcaacctaattatccaatttatatgttaggttttctacctggatttgcgtatttaggcggtctagatccacatttagcgatgccacgtttggcgacgccccgcacaagaattgcggctggttcagttggtatcgctggtcagcagacaggaatgtatccagttgtttctccaggtggctggcagctgattgggcgtacaccaatcaagttatttgatccacaacgtgagcagccgctattttatcaagcaggggactatatccattttgataaaattgatcgggctagctttgatcagattgctgcggcaccagatgactatcgaattcagatcacgcaaggataggtgagtaagtaatgtcaataacagttctggatggtggattgttcacgacggttcaagatgctggacgcaccagtcaacaagcgagtggttttggtgtctcaggtgtaatggatccatggatgtttcgtttagccaatttactggtgaataattcggcagatgctgctgttttagaaataaccagtgtgggaccaacgctgcaatttaatcaagattgtattgttgctttgactggtgctactggtatagcgacgttagatggtcagccatttccgttctatcaagcacgtttgattttatctggccaacaactggccatcaagcagttaataaatggtacacgcagttatttagcagtcgttggtggttttcaagtacctatggtgatgggtagcagggcgacgagtacgcgttatcgattcagcggttttcatggtcgtgccttacaaacgggggatgttttaccagtggtgagccatgcggcttatgtgcctaattatggtagtcgccacttaccaagcacgacttattcacaaacgcaggtttcaattcgcgtgactcccggaccacagtttgaccaatttgatcagcagacgcagcgtgtttttgcaaaaatgacatttaccatcagcgatgcagctgatcgaatgggctatcgcttgtccggtgcacctttaaaagtggcacagactggtaatttattgtcggaaggcactttttttggtggtattcaggtaccgcaagatggcgcgccgattattttgctggcggatcgacaaacaactggtggttatccagtgattgcagtaattgctagcgttgatctaccgctgattgcacaagccagaccagggatgaccgttaactttaagctgatttcaattactgcggcccaacaactgcttaaagcgcaacaagagaaattggctgatttagaacgacaagttcagcagctaagcgagcgagatttaagcccacgcttagctgctacacgaattgcacgtttatttaaataatgattgcgacaagatagaagtttagagaggaatgatcgtattggatttggcagagatcaaggctttaatggatcacatggcagccagcaatttaactgattttgtttatcaagatggacaaacaactttgaaattagctaaaaagtctaatttgcctgcagcaacttcatcagttgatgtgcgaccagtagcagcgacaacgcaaagcaaaaaagtactgaaagctcccttagttggggttttctatacttcagcagcgccagatgagcccccatttgtaaaagtaggtgatgtagttaccgtcgggcaaacggttggtgttattgaagcgatgaaaatgatgcatgaagtgaaggcggaacaagcaggcaaggtcacgcaagtattgattggtaatgaacaacgagtgggctttgacgatcctttgtttgaattagattagttgggagcgtgagactgtgaaaaaagtattgattgctaatcgcggtgagattgcagtccgtattattcgtgcttgtcgtgaacttaatattgctactgtggcgatttattcaacagctgataagaaagcgctacacgtgcagctagctgatgaggcgatttgtgttggcccagctgacccacaaaaaagttatttgaacatcgacaatattgttgctgcggcgacaacgatggcggctgatgcagttcatcccggatatggttttttatcggaaaatgctgaatttgctcagcgttgcgagggacagggattagtttttattggtccctcggccaaagtaattgcgcaaatgggtgataaggcagcggcacgtgagctaatgcaagctgctggtgttccagttattcctggtggtcggcaaggatttaccaatcaaaaagtcggtgccaaggtggctgctgatattggttatccagttatgttaaaagctgcagctggcggcggtggtaagggaatgcgtgttgtcatggcggcaaagcaatttggtcatgagtttcagttggcacaaagcgaagcagaaaaatcttttgccaatggtgaaatgtatcttgaaaagtttattgcacacccccgacatattgaagtgcagatcatgggtgatacttatggcaacgtactgacattaggtgaacgtgactgttctctacaacagaatcatcaaaaaatggttgaagaggcacctagtgatgtgctggatgccgcgacacgcaaacagatgttagcaacttcggtcactgcagcaaaagcgattcattacgttggtgctggaacaattgaatttctgtacgctggtcccggtcagttttattttatggagatgaatacacgggttcaagttgagcatccgatcactgaactgatcaccaaagaagatattgttgcctggcaattaaagattgcgtcggatcaagcattaccaactgttacgccagcaatcaatggtcatgcagtagaatgtcgtgttaatgcacaaactcctggtgtgatcactgggttgcatttgcctggtggtaatggtgtgcgagtcgatactgcattatatcagggttatgctgtgccaccagattacgacgcgatgatcgccaagataattgtgtatgctgccgatcggacaactgccatcgctaaaatgcgcgcagcaatcgacgaaacggtgatcagcggaatccagaccaatttagactttttaactgagttattagctgcgccagattatttggccgataacgttaatattacttttattgatgattttgtagcggcgcactagatcgggacttgatttacgatactgatcaagaagttagcgtttttgacttttaggtggatcattattgaaatagccggctttcattaggtgtatttggttaataatgacattaatcgtttagtagaaagaagcgtaaaatagtgaaaattgatttaaattgtgatcttggcgaaagttttggtcgttatactttaggcttagatgcagaagttttaccgtacgttacctcggccaatattgcttgtggttttcatgctggtgatccaacggttatggcagcaacggtcgcattggccgaaaaaaatcaggtggcgcttggcgcccatcctggcttgccggatctggttggttttggccggcgcaagatgcagatcacaccggcgcaagcacaagctgatgttcaatatcaagtaggtgctttagcggcttttagcaaaaatggtaaattacatcatgttaaaccacatggtgcactatataatatggcagcacaagattatgaactcgcgcggggcatttgtttagggattaaggccgtcgatccaaccttgattttggtcggtttggcgaatagccaattgatcaaggcagcgcaagacattgagctaccttgcgcgcaggaagtatttgctgatcgcaattatttagcggatggtagtctggttccacgctcacaacccaacgcactgataacggatgaacaaactgcggtcgatcgtacggtcaaaatgattcaaacacaaagtgtaacggcgattgatggtcagcaagtggcgttgaagccggatacggtttgtgtacacggtgatggtgccaaagcagttgcgtttgtgcagaaaattcatgcggctttattggcagctgacattgaagtgactgcgctataagtagatgcatagatgagtggggagcgaattgaatgaaagaaaaacaaaagcaacaatcgcctttaagtgtcgccatgggggcggcctttatgatggctatggctgcagttggtccgggttttttgacgcaaacggctacctttactggtaagatgggggctaattttggtttcgccatcttgatctgtattgtagttgatgtgatcgtgcagttaaatatttggcggattattattgtttccggtaagcgagcgcaagtgttggcgaatgaagttttccctggtttaggttacttgctgactgtattgatcgtcatcggtggttttttctttaatattggcaacgttggtggcgccggtctaggcttgaatgtactttttggtatttcaccagaaaatggggcgttgattgcagccgcagtcgcaatcattattttcttagtcaaggatgcaatgcgtgttgttgatcgctcggtccaatttttagcgattatcaaggttgctattttgatttatattcttgcggtaacgactgtgccctatcaagcggcggtgacccatgcatttatgccgactcatattaacttttattctattgtaaccatcgttggtggaacggtaggtggctatatttctttctcaggtggtcatcgcttgcttgaaggtggcgtgcagggacaggataagatcaaatatgtaaatgaaggtgccttgacaggaattggtgtggcttcagtgattcgaatcatgctttttctcgctggtttagcggttgttttagaggggcacacccttgatccagctaatcctgcggcttcaatcttcaaagatgcggcgggacaatttggttataaattttttgggttattactattggctgcaggaatgacgtcgaccttaggctccaccttcacctcgatttcatttttggactatacggttaatcaaggtgcggaaaataaatatttacgtttccgttcatggttgatcgtggcctttattatttgttcaaccgcaattttttattttatcggtaatccggctagagtgttggtttttgttggtgcattgaatggtctgattttaccgatcgcactagctattttattggtcgctgcaactagaaagaaaatcatcggtgattatcatcatccgcggtggctattatatactggctggctagtggttctatttatggcctatgcaggggtacggacgcttttgacattacaattatagtttgaatagtgcaagcaacgtttatcgctgcttgtttttttgtttgtaaataggtcagccttgcaacggagattcatgaatgataaatgtgaatttaattagacttaaaaatagttaaaataaattaaacgccttaatataggcgatcttattagatgatttgtgaatattatgagaaattgcgttgactatataccgaaattatgttaatttattaaaaacaaattagaattttaatttatgcataataggagatggagatatgatgaaaggtaagaaattttttgccatgctgggcgccgtcgcggcaactggcttattattagccgggtgtagtggcagcggaagtgctgcaggcggcggcaaccaacaatcagggaacacgatcaaaattggtggtaactttgaactttctggtaacgctgctgcatatggtcaagcgatgcaacgggggactcgcttggctataaagcagatcaacaaagatggcggcgttaaagtcggcaacaagaagatgaaactggagttagttggaaaggacaacaagagtgacaactcacaagttgcttccgtcgcttctaacttaacgacacaaagtaaagttgtcgcaaccgttggcccgatcacttctggcgccgatttagctgccttaccaaaccaaactaaagccaaggtgccgttcattacgcctggtgggacgcaagatagtttgacggtgcaaaagaatggtaaagttcaaccatatatcttccgttcttgcttcgaagatagttatcaaggtaaagctttagctaagtatgtttacaacaatatgaagttgaagaaagtcgccattttagccgataaatcaactgattatggtcaaggtttaactaaagctttcaagaacgaatttaaaggtcaagttgtcgaaactcaatattaccaagctggcgacaaagatttccaagctttgttaactaagctaaagtctaaaaacttcgacgctatcttcgttcctggttattactccgaagctggtttgatcgtaaaacaagcacggcaaatggggatcacagcaccaatcttaggggctgatggtttcgctgatccgaagttagttaagatcgccggcaagaagaacgccagcaacatttactacacgacccatttcgatgctaaggctaacgacaatgctaaggccaaggcttacatggcgctttacaagaagacttacaatgaacaagcgggtacatttgatgctttggcatatgatgccacttacatgatcaagcaagcgatcgaagatcaaaagtcggctgattccacgaagatcgccactggtttagctaacttgaaggacttcaagggtgttactggtacgatcaccatggataagaaacataacccacaaaaacaagttatcatttccaaggttgataacggtgaagaagttagtgccactgccgttaaatagccacttactataatttatgttttgaacttcatttagcatcatcaacagtttaatcgtagtgctatggatcgctgaaatctaatgctgaaaggcatggttttcggcgtttcttagcttaaaggatatttagtaattagattactagtaaattcatttttagctcataattatatgagcggcaattattcggcagagttgtgatctggtaggtttttgatggatgtagtagttactgactatgttcttggaactgattgctgaaacgtgttctgtaaggcaactttttccgcttagctacgccagccaaacgcatcacttacgtgctgcttattgtctggctaggctaatgctcaaaagctgggcgccttacagaacactctgccatattttaaggagggacttgcctgtgcatacagtcttacaacaactggtgaacggtttatcattgggtagtatctacgcgttattagcgttaggctacaccatggtttacgggatcatcaagttgatcaacttcgctcacggcgatatttatatgttaggcgcgttctggggctattatgtgatcaatcaatggcattttagtttctggcctgcgttgttgtcagccatggtgttctgcgctttagctggcgtgatcattgaatatttagcctatcgtccgttacgtaattcaccgcggatcgccgcgttgatcaccgccatcggtgtgtcgttcttgttggaaaatgggatgtcctacttatttagttccaatgtccgtaattttccccaagcgatgcacgttaaaagttataactttttcggcgccaaggtttctaatattcagattctgatcttagtcgtttccatcgtgttaatgattctattacaattgatcattcgccggacaaaaatgggtaaagcaatgcgtgccgtcagtgttgatccagacgcggcccaattgatcggtatcaacattgatcggacgatctcatttacctttgccttaggctccgcgttagctggtgctgctggggtcatgatcggcttgtattacaactcgatcgatccgttgatggggatgacaccaggtatcaaagccttcgtggccgccgttttaggtgggatcggcttgattcctggggccgcgctaggtggcttcgtcatcggtattttggaaacagcaacgcaagcgttaggtttctctgcctttaaggatgccgttgtgtacgttgttttgatcattatcttattggttcggccagcaggaatcctgggcaagaacattaaagagaaagtgtaggtggctgcgatgaaaaagaatttaaaatacaacgccatctggctagccatttcggttctgggctacgtcttgatctatgctttggaaatggtcggcgtgatcgatcaattcggtgagacaacgttagttttgatcggcatcaacattattttagcgactagcttgaatttagtgattggtttttctggtcagttttcgttaggccacgccggctttatggccttaggtgcgtacagctcggcgctggtcacttcggcgattccgaatgttggtggcctactattaggtttactcgttgggatcattgtttccggcttagttgcgctggttgtcgggattcccaccttgcgtttgaacggtgactatttagccatcgcgacgatgggagttgccgagatcatccgcatcattttaaacaacttgaaaattaccaacggcccggctggtttgtacaacattccgatgttagccaactggggcacggtctatgttttagtcgtgatcaccacattgatcatcgttaactttgtccatagtcgtaatggccgggcggtgatgtcagtgcgtgaagacgagattgccgctgaatcgatcggtatcaacacgactaaatacaagatcatcgccttcgttttaggggcggccatcgccagtatcggtggggccttgcacgccaactatattcagaccattaatccatccgacttcgggatcatggaatcgatcaacattttgatcatcgtcgttcttggtgggatcggtagtattaccgggacctttgtggccgcctttgttttagggttactggacatggtattgcaaaactttgggaccttgcggatggtcttgtattcattagccttgatcctgatcatggtattcaaaccatctggcttattaggcacttgggaattttccgttcgccgtttatttacgcataaaaaagcgaaaggggatgcctagtcatgccattattggatgttaaagatctaaccaaaaactttggtggcttgaccgccgtttctaacgtgaccatgcatttggacaataacgaactagtggccttgatcggaccaaatggcgccggtaaaacgactttgtttaacttattgactggcgtgatcgtgccttccgaaggcacggtcagcctacaaaccgatgctggtttacaagtgttaaataagcagaaaccctataaaatcgcggcagccggtatggcgcgaacctttcagaatatccgcttgttcaaggatctaacggttgaagaaaatgttttgatcgccatgaccgacaagaacaaggaaggctttctggaaagtattttccgtttgcctagcttctataaaaaagaagccgcgttacacgagcaagtcgtcgaactgttaagcatttttaaaatggaaaatcagttggacacgttggcacgtaacttaccttacggggcgcaacggcggttggaaattgtccgcgcattggcgacaaagccgaagattttatttttggacgagccggcagcggggatgaatccagaagaaaccgccgacctgactcgcttgatccaacaaattcagtctgaattccacattaccgttttgttgatcgagcacgatatgtcgttggtcatgaatttggccgaacgcatctatgtattggaatacggcaagctgatcgctgaaggcacgccgcaagagattcaaagcaatcagcgcgttatcaacgcttatttaggaggtggcgactaatggcattactaaaagtaacggatctttcggttaattatggcgtgatccaagccattaaaaaggtcaactttgaagtcaacgctggtgagatcgtcaccttgatcggcgcgaatggggccggcaaaacgacaatattaaagacaatttctggcttattgcggccttctggtggtacgatcacttatgaaggccaagaaattcaaaaatataaatcgcaaaaaatcgtcgctgctggtatttcacaagttccagaaggccgccatatttttccaggattgacggtggtggaaaacctgcagatgggtgcctttttacgtaaagatcgtgacggagtcaaaagtgatttcgatatggtcttcgatcgttttcccgttttaaaagagcggcgcaatcaggatgcggccacgttatccggtggtgaacaacaaatgttggccatggggcgggcgttgatgtccaagccaaaattaattttgttggacgagccgtcaatgggcttggcacctatttttatcaatgaaatttttgatattattcaggcaattcaaaaacaaggtaccaccgttttactgatcgaacaaaacgcggccaaggctttatcgattgctgaccgtggctacgtgctacaaactggtaacgtgctgttaagtggcactggtcaagaattgttggctaatgatgaagtgcagaaagcttatttagggggttagggagtatgagcgtagcagattttatgacgaaaaagttgatcacagtgcggccaaaaacgcggatcaacgacgcagtcgatctcatgaaaaatcacgatattcaccgcttgccggtattagacaacggtcagttagtcggtttggtcacggaaggcatcattcaagctgctttaccatctaaggcgaccagcttatcagtttacgaagtgaattatttattgaataaaaccaccgtggccgatgtgatggaaaaagacgtccgcacgatcccggcggatgcagtgttggaagatgcgatctaccaaatgcgtcactacaagatcggtgtgttaccagtcgttgataacgggcaattagtcggtattatcaccaacaacgatatttttgatgccttcttaaatattgccggctatgatcaaggtggcaccaccgttacgatcaaagttacgcaaaacgtggctggctttctggctaaagtcagtgacgccttggccgagcataactacaatattttaacgttgatggtgactgatcgggcggatatccgtttgatcgagttacacgtggataccactgatgcaactggggtcaaagccgccttaactggggctggatttgaactgatctaagttttaacactaattcaaccatacattagtctgaatttaagcaattctgccttgattatctggggtggagttgctttttgcattgtcaggtatctttttagtgaaaagcataaatattgcagtatactgcaatatttattaataagtgctatgaaatatagtataatgcaaaggtgtggaggtgctcaataagggagtgtcaagaagtttgtgtaaatgaaaatcccttctcctggcaaaataatgtattaatcgaaaagtgattctaacgtgtctttgacttgaccaaatccgcgatggctacgattgaagtacttttcgttatagcttatgacttgaactccaatgaaattgtctaaagatttttcgtttggaaattgttcctttggtttggtcttgcgtttgattcttttgttcagtgattctaagatattggttgaataaattgttggtcgaatgggtaacgtcaaaagttctatgaaaaccgtggttcagaaggtggtgtagatgcaactgtagaaatcgacttaaggattgagtggtctagttggttagttctgtacgcgcacagtattaatccggccaa

SEQ ID NO: 477 - DNA, 8137 bp, Unknown
  Metagenome-assembled genome
aacgaatctgtaaccgcagataataatttattaatgttagcgtaagtgaggtaggattgatggatgtttacaaaacgagtcctaactttatgtggggcgtagcaactgctgctaatcaagtagaaggcgcatggaacgaggacggtaaaggcatgtctattgcagattgcctgcgttaccggccgcaaattgatagtagtgactatcaagcggtgaaccaaatggatagtgctgaaattgaaaacgccttaaatgatgaatcgactaaaggttgggcaaaacggcatggtgtggatttttatcatcgttatcgagaagatattaaacagttggcagagacaggaatcaatacctatcgattctcgataagttgggcccgtatttttccaaatggtgacgataagtgtcctaatcaagcggggttagacttctacctgtcactagttaaagaattggcaaagtaccaaattacaccagtggtgacgctatcccactacgaaatgccgttaaacttagtgctaaattatgatgcttggtatgatcgacgagtggcagacttttttgggcgttatgcgcgaaccgtcattgattatttacatgattatgtcaagtactggattccgattaatgaaattgacagtattattaggcacccattctcatcagctggattagtcgcagatcgttttgctagtcatgattttaaaacggttatttatcaagcaatgcatcatcagtttgtggcagcggcacaggttgtcaagtattgtcatcgtcactatccacagatgcaagttggtagcatgattactagaacgatggtttatccatataatagtgatcccaataatgtgcttgcagcaacgcaaacgatgcgtgaggtgtatgcatttagcgatattcaagtgcgtggagaataccctgaattcttgttaactaagctgaaaaaagcacatattacgattgaatttcaggagggtgatcaggaagtactacgtgagaatacggccgattttgtggcctttagttactactcttcaatttgcacggctagtaatgtggaaggcctgcgggtgaccaaggctaatcgaaccgttggcgtctataatcggtacttgcctgagagtgagtgggggtggcagattgatccagttggattgagactatctttaatcgatttgttcgatcgctaccaaaagccgttattcattgtcgaaaatggcctaggtgctgtggatgagttgagcagtgatcttcgtgttcatgacatatatcgaatcagttacttgcgccagcacattcggcagatgttaatagccattgcgaatgatggtgtggacttaatggggtactgtatgtggggaaccaccgatatgatatctgcgtcgtcaaaccaaatgtcaaagcggtatggtttaatctatgttgacttagatgataatggtgatggctcatataatcgatatttaaaggacagttatttctggtatcaagaattactaagctataagaatcaaattccagcaatttttttagatgaaaatagtggctctttgtcaaatcctgttgatgaatagcttttacagagttgaaagtcatgcgactttcaactctgtttttttcattggttttgttctcatttgccgtaacttaatacgtgaaatcatatgatggtaattacggaatccaaatgctgtgcgttgaatttgtttaatcattcgattcatgccttcgactgggccattcgtatagtccgattcactggcgttgagtacaaccactaagttctttttgaacgttagaatcacttttcgattaatacattattttgccaggagaagggattttcatttacacaaacttattgacactccctgcaaggcaatactatcggtgaattttaaagttagttaccagtaatacttatcaatgatttttagaccgttttcacaggatttacgtgcgccacaaatcagcgtcgttgctgattttgagtttatctgaaggaccagtcacctaatattcagtgatgaattgcaccaatttaggtggccgttcatctgccattcgagcgggttcccgactggaggggctggctgacaatgctcaagggcgaaattcttcttgtccgggcgggtttcccgggctagaagaagactcgtatttgaaattgcgcagtgggtttctgcgtgagttcaaatcgatgtccgccctgttccagcgttgtcagccagccccggaagtcggaataaggcacacatcggctgacgaacaaaaatccaccaactggcacgatttaatcatttttaatgctaaatcataattagcacaacgcgtgcttcatattaataggcataaaaaacagcccgaagccaactgcatccgtgatgcaagttagcttcgagctgttttttgatacacatacacgtgtctaaacggttcacgctgttttgaattcacaacgcttcgtttcacaccaattactcagttagcgcccgttgcacatcgattgtctccaataagctgaccgcgcaatcggcccccttgttaccgctcttaaaaccagcgcggtccatcgcctgttcaatggtgtcagtggtcaatacgccaaacatcaccggcgtgtcagtggccaggctgacggacgcgacgccggtggtcacaccgctacaaacgtagtcaaagtgtgcggtcgcaccgcgaatgacggcgcccaacgcaatcacgccatcgtagcgcttggtgttgatcattttctgtacggtcagtgggatttcaaacgcccccggcacccaggcgacatccatatcatccgcattaaccccgtgttgttgcaggctttcttgtgcaccagccagcaattgcttagtcacgaattcattgaaccgggccacgacgatgccgactttgagtccttgacctgtcatttgtcctttaaaagttgtcattagttaacctccgtaagtttgagttcatgattgaaacgatcccgcttcgtcttgagataggcataatcgtgttgattggctggaacttccaatggcacgcgttcgacgacttcgatgcctaatgcttgcagctgcatgaccttatccggattgttcgtgagtaaccgcaccttggtcacgccgagttgccgtaacatgacggcggcaacgtcgtaccggcgctcatccggtttaaaaccaagtttgacgttggcatcataggtatccgcaccttggtcttgcaaggcgtatgccgcaattttatttgccaagccaatgccgcgaccttcttgccgtaagtataaacaaacgccacgtttcgcctgattaattgttcgtagggccgcgtgtaattgtgcgccacagtcacaacgttgtgaccctaagacatcacccgtaaaacactcggaatgcaaccgcactagtacgggttcgtccccactaatatcaccggtttgtagtgctaacggtaattccgtgtgccccggaaccgtgaagcccgttaatttgaacgcaccggcctgagtgggcaaatcaactgtcggtgttgtgtcaagcttgaccgcacccgtttggatggcgtattgtaataaatcttcaatcgtaatcattggcatctgcagtccttccgccaatgattttaaatcgcgccggcgcgccattaagccgtttttcttgaccacttcacagatgtaggcaacgggcgagccaccggccaacttggccaacgtcaccgcagcttccgtatgaccgcgccgttctagtaagccgccagctcgcgcaatcagtggaaaaatatggccgggatgataaaagtcagttggttgactatcagttgaggccaacgcttgaatcgtcttggcacggtcggcagcagagattcccgtacttgtcgttcgatggtcagttgagacggtgaaggcagtcccgaatgcatcacgttcgccagtcatcggctttaagcccaagcgggtcgcaattgctggcgctaccgggacgcacaacaacccccgtgctgaggtaatcatgcgattaacggtcgcggtagtggctttggcggccaaaccgaccatgtcgccctctgcttcccgcgtttcatcatcagcgacaataatcaaatcaccgcgttttaatgcggccaaggcctgttcaacttttgtcatcgtatccatgttaatggctcccttctaaaacaacttgccgggctaagtatttgcccaaaatatcggtctccacattcaccgtatcgccaatctgtaacgcactgagggtcgtgacgtcttgcgaatgtggaatcaaatcaacttcaaaggtcgatgcagtcacggctacaacggtcaagctcacgccatcaaccgcaatcgaacccttaggaacgaccaacgcttgataatccgctggcaaactaatcaataatcgtaacgcgtgttcatctggcaccagctcctgaacctgaccacaatagtcgacatgcccctgaacaatgtgtccgtccagacgatcattgacctgcagcgcccgttccaaattaacttgagcccctgcgctcatctggcccagattcgtccggcgcgttgtttcgggcatgaccgcaacgctgaatgcatccggctgtagcgccgttaccgtcaaacaaatcccgttgaccgccacactgtctccaattttaagtgtgggtgtcacgattgtcggcgcagtaatcgtgagcgtcatctctaacgcgtcccgttgacactggctgacgcgacctttggcttgtacaattcctgaaaacatttactcgactccctttcgcacggcccgtagccgcaaatctgttcccagccacttcaatgtcggttgctcaaatgccagctgttcgattggtaccgctcccattactgctggcaaactggcaccgccaatcattgtgggtgcgatatagctgacccattcatcaatcaaattcgctgcaacgaaatccgcttgcaggtgcgcaccaccttcgaccaataacgactgccatccttgttgaacgcagagtttgctgatggccgccggtgtccaatcaccaattcgtacttccacgtttggtaacgcctgtaatgacgcatcactggcgctcgcctggcgacacaaaagccaggtttcaacagtggtttcccgtaacactcgccggtcacgcgccacggcactggtgttcagtacaatcagtcgaactggcggatgggtcatcgcgagtaaacggacggtcagttgcggatcatcgattgtcagggtgcgttcaccaatcaaaagtgcttgaaattgcgaacgcaaccgttgactatcggcataactggcttgattagaaatcaacgtccgcacgtcaccagcggcattggtcttaccatccagactcatcgcagtcttgagcgtcacccatggccgctgatgcgtataaaaatgattgtagtgcggattcaacgctcgtacttcctctggcagacaacccgtgacgacggccacgtcatgatccaacaaatactgacggcccttgccaccgacaaccggatgggggtccaactgcccaatcaccactttacgaatttcagcttgaacgatgcgctcacagcacggcggggtcttgccataatgcgaacaaggttcaagcgtgaccaccagtgtcgcatccttcgcctgttccgatgtcacttgccgtaaaacgtcaacttcagcgtggtcaccaccaaaataatgatgatagccttgtgctaagacttggccatccttgactagcaccgcaccaacttgcggattttgataagtcgcaactcccgccttttccgcctgagtgatggcgagttgcatccaatcagttaacattgcttcacctccgatagaatataaaacacccgactatcaaaattcgataatcgggtgtgagtgttcgctaaatagatttcaccagtagggtccagctaaataaaccttaatgaaggtcatgaatagctactactgcctagtaaaattaagccatttttcttctcccatccagactatactgtcggtcccagacttgcactgggtccaccgcgcgcacgcgggtcacggacttcaacatacgttgttaccgtcggtcgggaattgcaccctgccccgaagaaatcgtattcagttttcactttttataaaaacactttctgaacaaattatcaaatcgtcactttaatttcgacccgccgactgctgtgttaaactttcaataaatttatcgatacttgcttataaagtataactattttcagaaattttttacgaatttttatgtaaaattgagactattgaatgttagtctgatgatatttctagtatcggagttgggctaaatgggacaacaaaaaatacacaatcgccaaactagtcggtggccagtcgccatcctctcagggctgctatccatgatgattattggggtcgtctttgggtactaccacattacgccctttggcaaccataatttgctgataagtgatatgggcggtcaatacttatcgtttttcaccgcctatcgtcatgcaattcttgcacattcttttcaagcctattcattttcacagtcaatcggtggtaacgctttaccaaatatcgcgtattatttattaagccccttcaacttattaattttattttttccagcggcccatttaccggccgctttgagtttgctcatcatcgctaaaattggtgcgattggcatcagtatgacctggtttttgcaaacacatttcaatacacggcgttggtccacggctatttttggaacggcctttagctgctgcggattcgtcgcactcaattatttcacggtgatgtggttagacaccttgatctggctgccactggtcataatggggctggaccgcttgattgcaaccggacacggcgtacaattcttcggttggttctggctcagcatcgtcaccaattattatttaggttatatgaccggcctgttcgtcggttactatttcatttatcaattgttcgaaaacaaaccagccggtgaacgcatctggcagacgatccgcactcaatcaaccttgatttagcgctttatcttgacaaccttgttgtgtggcttgagtacgatgtttctgctcattccgactgggctgggcatgctgacaacggccaaaacggcggtcaagccttccagttacttgccggttttgcaaatcggctggaaaacgctcagtcaattcgggattggcgccgctaatttcaccacgcgcctggcccacgcgccaacgctgttcactagcacgctagttttactgctcgcagggtgcttcttcatccacccgcaactatcacgagcgcacaagtggcatggctttggtctgttactagccttatttttgagcatggcaattcggacactcgatacaatctggcacatgtttcaaacgcccgccggctttccgtaccggaacgccttcttcttcagcttcgcgctcatcataattgcttttgaggcctggcaagccggtccccgtcaggtcgcgcctgtctggaaatgggggttgccgattggactgatggtggccctgattttaggctggtggggccaacggcgtaaccttgaccaacgttctaaatataatcaatcattaggacggtcaattgaacagcgacccatcgtggttaatcgacgtaatcgcatcggtgattttgaattagatacaattgttggcccccgtgggcatagtaagacagttttattaaccttaatcgattgcaaatcacgtttcctttgggcctaccgattaaaaaaacggacagcagtaactgttaatgaagccctaaataagtttctagcaacttttaatggcccggtgcatagttttacgttggaccgtggcactgagtttagcggtctagtatcacttgaagcacaatacggtattaagacctattactgccatgcttatacgccagctgagcgcggcagtaatgaacgatttaatcggaacttacgctatttttatcctaaggggacttattttgagcacattagtgctcaagatttgacaactctgttactccaaattaaccaaagaccgcttaaagtactcaactggcaaacaccttgccaagtcatgctgactaatttgtcaaaaaatttggat

SEQ ID NO: 478 - DNA, 1816 bp, Unknown
  Metagenome-assembled genome
cttgttggttgcacaccaaggataacagaagaattggtccgggtgttttttaatttcacttagataatacaaaaccattagaaacaataattaaaactagacaaaatcgggtacgtttgacagtaccatgaagaattggaggaatcattcatgactaaaaaatacgttgctaacatcgtaccactaaacgcagaaggcattggaacggcaccccatggaactgccacctttgttgaagacggtgaccaattacacgtggcgattgaaatgtttgatacacctgcaaatacgcaacactgggaacatttccacggttttccagatggtaaggcggcccaaattgccacgatggcgcaggatgccaatcatgacggatttgtcgacttgccagaaactgaaccagtctcagggacaacgatggtgccatttgacaacgccccacatcacatggacgtgccaaatgataactacccagtcgctgacgcccaaggccactttgcctacgaaatcgatgtgccattagctgatttgcaagcgaagttcaaagaagtctttggtaccgatgacttggaactcgacaaacgggtcatctacattcacggcgtaccacaagacttggctttaccagccaccgttgctggtgaagttggcgcctacgatgcacacgtcaccttaccaattgcggttgggaagattgaagtcgcagactaacctaaaatttgaagtaagctaaaacataacgaccggatgagcctatcacatgacaggttcatccggtcgttatgtttatttctttagactatcaacggaagccttgaaaacgcgaaatcgattgacgattatggttccgactggcgaagcacgtccgttaattgttgccgaaaaattggcgtccagatattccgataacctaatcgggttggatgagcgtcgtcgaccattgctagtggttgggcgcgattttcagctttgaccactggatcttgccagaggtcaataatcgtgaagtgccactttttttgtaagactttcaattgctgcactaatttaccataattcgcatcgtgttttcgcacacaagtgaagaacacgattggcaccggccgtaattgacaatcccagaaatgcaatccgccgacccatcaacggtgacttgggactcaatgtttgatggctaggggcgtaactaggcaaattgcccgcaatcaaccgccccaccatcgtctcacgctgcaactgcttattcaccgttccgaccttgattgccgcctgcaacaactgcttaaattcttttttgtatcgaatcatattaaaaaatgctcctatgctattagtttacagggcagaagaaaatctgtccgtaaatctagcataagagcactggacttgaatctaaattagcaaagggatctcattctataaaagtttccgatagggaaaccaatattactcttgttgagggattacttgatccagggttcatttttagcaaggacgaattaaaaaaatatagcgatggacagatacggcagattgcaagaaataacttgaacaaatttagtaacgcagattacgcaaaaagatctcaatcggtgttcgccaatttaaacatttgagtggtcggcaattcaaataccagttaatttgaatcaattcatcatcggtaatctcatcaatcggttgaccttggggaatgaagcggcgtagtactcggttgcgattttcattactgcctcgttcatgtggcgaataagcgtgcgcaaagtacagcggaacaccggcctgttcttcaatcaaattgtagttggcgaattct

SEQ ID NO: 479 - DNA, 26316 bp, Unknown
  Metagenome-assembled genome
tgtggttcagattgatccattttgatttgtacaatatcgggttttgccaataaaaatcacctcaccaattatttgatgaggtaatcataacttggatttagttagtttgatagtcggtcagttatttggtgcttactttcttgttgccgaccatccgcttaattttagcggccgttatctggcggctattcatcgttgcatattcagtttcacgcaataatcgccgataatcagctaagcgctgggcacttaattcaccgttggcgatcgcagcctgtactgcgcaaccaggttcttgttcgtgctcgcaatcgttgaagcgacattgctgcgctaaactagtaatgtcaggaaaactttgcgcgatggcagtagtagtactgctagcgacaccaacaccacggattcctggtgaatcgatcaacgccgcaccgttaggcaaatagaaaagctgccgtgcagtcgttgtgtgccgacctttgtcatcgccaccacggactgctttggtactttgtagctgttgcgcggcgaggatattgagcagggtcgatttaccaacaccagaagaaccaacaaaaacggcggtggtcgttggttgtagataggcattcaattgttcacgtgctactaatggtgtcgtactagtcgtggtaacgattggtacaccaaaagcgatcgcttctaattcgagctgacgttggaccaataattcaggttctaaatcagctttagtcaagacaatcactggcgttgccccactatcccagactaaggtcaggtaacgttcgacacggttagtactgaagtcggcgttgagcgatattgtaataaaaaccgtcgtcacgttggcagcaatagcttgatcttgttggttactcgctcgtgttagtaaggtttgtcgtggcagtaaagtagtgatcaaaaatttatcttgatcatagacttgaccgctgacaaaatcaccaattagcggtaacgtatcagcgagctgcatccgtccagctaaggtggcttggtgcacactacggtcagcaaaaatcacttgatattgatcgtgactttgaaaaataattcgggcagtatttaatgaatcgttgggaaaattaagcatgtttagtcctccaatgtttttttaattcgacgtattggaggcgtcactacgactatttgtgcgcagtgtcctccctaaacataactgcttctggctttaacatattgcattgctcgctttctgattaagatggatttagtataacaaatttgggggcaaatagcaggactttgaatggctaaaaattaaacctatagaaaaagtgaaccatccaaatgaatgacttggatagctcactttttcattcgtcaacttgttgccgttctaaaatattgcctcgtttagcatcgatacgcatacgtaccgtatggtgcgcgcgactatggatcagcagttcataataggtgatctgtcgttggcgggctaaagtataaccaacaatgtgaccatcgttgatctcgctaatagcgatctgtttgatcgtagtcaatgatttcaagccgtttaagttgagtgttgcgcgctcagcgttttgcttggtcaatttagtgtgtgttttcttggtgatgatcggctgcattgcgttgaccgctaagtggtaatagcgctgatgctgtcgtgcttggacgtgatactgataaaagcgtccatgcttggtcaaactaatttgtaacaactgggcgtggggaagttctttgtgaactagccgcgcgacttgtttgccagaaactttggcggtgaagatcccctgactaggatcttggcgataaggtgctgccgcttttttagcggtgttaggttggacgataccgcaaccgctgagtagcagtaaaactaaaaacagcggccataaacgtttgaatttcacaaatgaattccttcctgatcgttaatttaattgcgaatgccgagcaaacgacgaatctctggcactgcacttttatcgccagtgaaaattaagtgatcgtcttgttcgataaaagtatcaccgtgtggagcgataaaatggccgttgcggtaaatccgactgatcgtgatattttcaataaaaggtaatgattgtagttcgcgaccggcgaagcgacggttgtgcacagtcacttcatataaaccggcgtcgttatcggtcaacaatttcagtgttgatggtgattcgatcatttcacgcagcatactgatgttgatgtcaaaactattatagatctcaaccccttgttcggcgagtacatcgtaacgatcatcagcgacgtcacgggcttcaaagcgagcaatgacccgcggcacttgttgtttgatggccgtcgttgctagccgaacgttgacgtcatgatcgatgtgaccgagtactaaaatatcggtagtaaaggcatcagatttttgtagcgtagcttcagttagatctggtagtaaagttacgttgttagcttcactattataggtccggtaattttttggctgatcggtcagcatgcgaatatcgtaccaaccttgcgataaacgttgtgcaaccgggatcgttaggatatttgtgccaataaatgtaactcgtgttttgaccaagtcttccttttctggctggtaaagttggttaaaaataattggtgaaaaaatacaagttaacacggcggctaaaacaaaagcacctgattgttgcgtggtaatcacatgtaagttttgtgctacctgcaaggttggtaaaactaaggtgatcgtggttgaggtcaaaaaaccactcgcaatcgcgttcttcatggtaaagcgttgccggaagatcagcacaggcactgctttggctagtaagaaacaaatgaaaaaaattgggatcagaatcagcgagtcacgatcagccagcaaggtgcgtagatttaatttggcaccagtagtaatgaagaaaatcggaatgaagaagccataaccgatcgaagttaatttatcccgcgtgactttgcttggttgtaataatttcattacgataccggctagaaaggcaccgagaatattttcagcaccgacctgttcggcaatcgtcactaaggtgaaaatcaggaaaaaggccaaacgaatatccaattgcgtggtcgttttatcaattttagcaaagaaacgatagatactgcgaaaacgcattaacagaataattgcggcaagaaagatcaataaaactaaccatagacgtgcagaatggccaccgtttaacgcagcatatgccgtcaaagctagtaatggaatgatttcacccagcgcagcagttagtagaatcgtttgtcccagcgccttgctgagtaattccttttcggttaacgccgcaatcacaacgcctagtgcaacggttgaaaatagaatcgtggctaataaaatatcgctgaacagaccggtgagctgtaataaccaaccaagtagaccggcgaccaataaaatactagcgtaactactgatcgctaattttaaaggagaccatttcgccggtggagtaccatttaagtttttttgcggtttaaacagatcaaagtcgatctccataccggataggaagatcaaaatgatcacacctaatgttgacagttgattcaggctagcggtcagtgaaacccagttaagtagacttttacctaaaataatgccgacgataatttcggcaaccgcagtcggaacgacagaaattttaaaacgtgccatgactagtggcgtcattagcgccgccaataaaacaatcaataatgataattggaccatgaagcggcctcctttagcttatatgcggaaattaattgttgcgctgtaaacttagttgcaaaagcaactgtcgcttgttttcgcaatacgtttgcgactcacgctaaataaatttacttttgatgaaattatataagccaacactaacacttggcaagagggctatgataacgatacttaataaaatcaacgaaaaatgggcttgaacaaatggcaacgcaccaaggtaatagcctagtaagctgccggtactgacccatagtgcaacgccaagaaagttgtaaagtgcaaaccgcggatgcgtcattttaaacatgcctgcgatcaaagggacgaatgtgcgaatcattgggatgaaacggccaaaaatcactgttttaccgccatgacgcacaaaaaaatcggttgcgttttgtaaacgatcgacccgaatatgacgtttgaaaaacttccagcgacctaaatggcgaccaatttcaaaattaaccgtgtcgccgatcaaagcagcaaagaaaaaagttaggctcaataaccagatatccagaaaaaagccatgccgtgacgctagcgtgctgctaataaaaataatcgattcaccaggtaaaaaggggaaaattactaagccggtttcggcgaagatcattaagaataaaatagcgtaactccagcgaccaaaatattgaaaaatcggtaataataacacttctaaatgggttaacccataaaggatggtgtgcaacatctgtgatccctcgcttatttgttactagtaatactttagagcgtgattgaaaaagcgtccagaatttgagcactagcctaacaagacgcagcaatctgccttttcaaccacgtttataccaaattattggtaaaaactaatctagcattaagttataaacagttcttagtttacgctttgccattgcttactgctagtattgacttttgagctttacgtgaatttaaaaaacaccatgtagccgcttagttgtatcgctttcgttgaagtgctaaaatggtttatccgaaattatttaatttggttaataacgagatagaaaacagtgaattgttttcagacttaacgacaaactaagattttcctattttggtataaaggtgtttttgtaacgagctttgcagcaatgacacaattcacgattatggagtggaaacttgtttttaattgagagagaggttggcaggacttatggctgatacggaaaaacaacgagaacaagcgcgtgttgacgatgtgatcacgaaaatcaaacgaacggaagcggagttagaaagtaaaattgccgctgctaagactgatgaaaaacgaatcaatgacaatttttacaacgatgtgcggttgagcgttggttcatatgaatcgatgatggataccgcgttatccattcgccagcaacaacaaatgctgaatgaacggaataatagttggcgccactcgactcaacaattggacgtcttacaacgattagagaagaccccttattttgcgcggatcgactttaaggagaccagtgctaaggcagcagaaacaatctatattggcttaagttcctttaccgataagcaggatcattttctggtttatgattggcgagcaccgatctcctcgatctactacgatggtaatttaggccgcgttacttaccaaacaccggatggtgaacaggcagttgatatcaccttgaagcggcaatttctgattgctgatggtgagatcaaaacgatgtttgatactcaagaaaccattggcgatcaaatgctgatggaagtgttaggtgagcaagcggacacgaagatgaagagtatcgtgactacgatccaacgggaacagaaccaaattattcgtgataccagtgcgcggctattatttgtgcagggggctgccggttccggtaaaacgtcagccatcatgcaacgggtggcgtatttactctatcgttatcgtggcaatctaaattctagtcaagtgatcatgttctcgccgaaccagttatttaatgattatgtgtccaacgtcttgcctgaactcggcgaacagaacatggtgcagttgacttactatcaatacgcggcgcggcggattcctagtctaaaagtcgaggacctgttcacccaatttgaaaaaaatgaatcagcggtcgataagcggatcaatcaacttaaaggtagcttagcctttttccgggcaactaaaaagtatgctaacagtttaggtaagagtggcatgcgtttccgcgatgttaagttgcgcaatgaagtgttcattgatcataaacggatcgaaaaaacttactacaaatacaatagtaattaccgcttaggcaatcgtttgaatgctactaaagaagaattactgcgttattttggtcatcggatcgacaccgaaatgaaggctaaatgggtcagtgaattcattcagaacttggatgaagaaggcatgcgcaaatggtatggcaatcatcctcgcaattttgaaaacggggataaagaatttcgtttcttggcgcggcgagtggtgacatctgcttttgatagtgtccggcgtggcgtgatccgcaatcgtttcttaaatattaaagcgcagtatattgatttcttgcggcaaattccacaaatcattaatttgaagcaattcaggttgactgaagaagaatggcaactaaacgtaaatcaagttttagcgcagttacgccaaaaacaattggcaaccgctgatgttacaccatacctttatctgtacgatttaatgacgggcaaacacggtgaccgcgagattcgctatctgtttattgatgaaattcaggattacacaccttatcaattaagtttcttgaaattcagcttcccgaacgcgcgctttactttgttaggtgatctgaatcaggctattttcacacaagaaagtagtcacagtttactgaaggagttagcaacgatgttcaagccggaggaaacgcgagtcgttcagttgacccagtcttatcggtcaacacagcagatcaccgattttaccaaagccattttacgcaatggtgaggcagtcacggccttcaatcgccaaggtgctttgccgaatgtgctgatcgcacaaaccgaggaaagattactcgctgcagtacaaaaacaattagccgagaatactgcggctaagcgtgttacggcaatcattaccaaaactttacctgaaagcaaagacctatacgaaaaattgcgggcgcaaggtgaaaaggtaactttgattcgttcagaaaatcagcgtttagctgccgggacgattatcgtgccttcatatttagccaaaggtttggaatttgatgcgatcattgcttggcaagtgacggctgcaaattacggtgctgacgatcaacggcaattgttgtacacgattgcttcacgcgcgatgcatcgcttgacgattctggcacaaggtgaactttcgccgctattggcagaagtacctaccgctgcctatacgttgaccaagttagactgagctaagttgcttttctagtgaaaacggttataatttaaattaattgaaagcaggggagctgttgtgaacagctgagaggaaaataaattttcgaccctttaaacctgattggttaagaccagcgtagggagctatttagacggtagaagcacatcctaggcaatgggatgtgcttttttgttgggctttcaagaaaaataaggaggtagagtatgcaactttcattattaacacaattacgtcagcagaatccagtggtgctgaacatttctaactttgtgactgtacaggatgtcgctaatggattgaatgcgattggcgcttcaccgatcatgtccgaggaggtcgcagaggctgaggctttggtgcaaatgagcggcgcagtagcattgaacttaggtgcttttacgcagcaacaattaacccagatccggcaaacgggtaagttggctaatcaatatcataagccactgatcgtggatcctgttgcaatcggtgcagtggcttatcggcgcacgattgccactcagttattgcaggattttcaagtcgatattattcgaggtaatgctggtgagattgcggctcttgctgatgtaacgtggcaggccaaaggaatcgatgctggagccggtgacggtgatttagttgcgatcgcgcaagcagctgcacagaaacagcattgtgtcgtgattttaagtggaccgactgacgtgataacggatggtcagcgagtcgttcaaattcaaaatggcacgccgttatttcaactacacgtgggctctggggatatgttatccagcattgttgccgcatttgcggcggttagtgctggtgattactttacagcggcgcaaacggcttgcttagtttttgcgagtgccggtgagcgtgtggcggcgcagttatctcaggagcgaccaggtacttttgcagcgcaattgatcgatgaactacatttgatcaccacagaagcggtggcgcagatcgcacgctatacagtgggaaaggatgaatagaatgacagaaattaatgcatttccacaaaccttgacgatcgccgggactgattccagtggtggtgcgggtattatggcggatatcaaaacaatgcaagaacggcatacatttgcggcagcagttgtggtcgcagttacggcgcagaatactttaggtgtgcaggactttatggcgttacctgctaaattgatcgatgaacaatttgcttcattggcggtggatttaaaaattagtgcatgcaaaacaggcatgctggctgatgctgaacacgttaaaattgtcgctgctaatttgcgtaagtatgattttggtccgttgacggttgatccagtgatgattgctaaaggcggggccccactattagcagcggatgcaattgacagtgttaagcaattattattgccgttggcgacattagtaacgcccaacctaccggaagcacaacgtttgacggggatgacgatctctaacgcggccgaaacggaagcagcagcgcactatttacaacaattaggcgctaaaaatgttttgatcaaaggtggtcacgctgaccaaagtgaagttcgtgattttgcattattggcgtcaggggattcgttctgggtcagcgcaccacgtgtggcgacaaagcgaacacatggcactggtgatacgttatcatcctgcattactgcggaattagcaaaaggaaaaacaatggcacaagcaattcggctggcaaaaaaatttgtggctgcggcaattgcagagacaattcaagtcggccatggtcacgggccacttaatcattgggcttatcgggaggcagaagcatgggactaacttttaaaacgacgcaattacaagcctattttgtttgtggtagtcaggatgtgcctggacgtgatttagttacggtagttaagaacgcaatcgcagctggaatcacggcatttcaatttcgggacaaaggagctggttcacaattaaccgccgcacaacgattggtgactgcacggcagttaaggataatgtgccaagcagcgcaaattccatttattgtggatgatgatgttgagcttgctctagcggtagcggctgatggtattcatgttggccaatcagatgagcaaattcaacgagtcgtgcaacaagttcaggggcaattatttatcggctactcctgctcaaatctagccgagatcacagcagctaatcaaattgttgggatcgattattatggtagtggaccagtgtttcaaactggatcaaaagcagatgcgagcccagtaattggtttagatggtttaactcaattggtggctgcggctaagcggccggtggttgccattggcggtattactgaatcacaattaacggcgatccgccaaaccggcgccgccggctcagcagtgatctccatgattgcacaaagtactgacttaaaacgaactgtaaaggcaatgcgccaggcttgaatatagccacgtgattgcgcgtattttaatggtcatcactttaaaatagggggagacagatgacagaagggaaaattttacgtagtcaatttttattgtgggtcggggcagctatttcgattgccgaaatggttacgggaacgttgctggcacctttaggattagctaaaggtgtggcggcaatcttagttggtcacgccatcggctgtttattatttttgttaccagcaggctatattggtgcgaaaaaacagcaaacggcgatccagtcaactgctgatacctttggtcaacagggcgtatgggccttttcactgctaaatgctttgcagcttttggggtggacggcagtaatgatcgtcaatgctgcacaggcaatgaatggggtcgcacgtcaattgtttaattttcatagttttttagtaatgagtcttgtggtggccgcctttatcgtgctttggctattaatggatacacagttattgttgcgaatcaataatttagtggtcagtctgttgtttttagggacattattgattctctttattattctacgtgcaccaacaacggctattcatttaagtgggacaacaatgtcatttggtgcggcggttgagctaaatgtaacaatggcattgtcttggttaccattaattggcgattatacgcgcgctactaagcgagcattgcccattgccttgactagttcgctgggttattttttaggtagttcctttatgttcttgatcggtttactgatagttacacgcactggagcgactggtgtaactaaactattagcaactagtggtcttggattagtggcattattgatcattattttttcgacagtgacaacgacttttatggacgcatattcggcggcaactaatatcggtcaactagtgcatattcggcgcactaatttacttgctattggggtgaccttagttggtctagtaattgcgctggtgatttcaatgacccgttacgaaaatttcttatatttcatcggttcagtgttcacgccgctatatgcgattgtgttcacgacttactttgtgactaagaagagtttacctaaggtggtcaatttaatattatggttgctaggtgtatggggctattatcagttgcaaaaagttgatctggagctaggtacgaccttcttattgttagttgtcatggcggtgttagttgtcatttgcagtcgaattcaacaatactgggcataacacgcgcatatcgtcgaataagttgcccccaatcaaacgtaaaattgtgctagaatatctgtaaggtatacaggcactattatggttggggggatgatatggatggaaaattatcaaatcagcttcaataataagatcaaacctgatacggtgacggtggcttacacggcgacacataaagagttggatggtcggcaacggattttatatcgtggagaagcagtttttcaacgcgacgtggtaccgtcgttattacttaaaactggggaagttgcgatccatgcgatcgagcaagtaatgatcggtttgaaaaagaattatcaattagttaaagtaacgtttgcgcaaccacagaattcaacgttactaggtgtacctaattttgaaacgtttagtcgttatctagttgagcgtaagttactgcattgtgtaccgacacatacggtttctggagagaccgtagttgatataaaatttgaacaagaattacgaattgggtaaataaaaacgagtttagcgtgaataaacgccgaactcgtttttatttagtcaatattttcaaagtcacgtgaccacacaacacccatgactttacggccagtgtggacgccgagtacagggcctaagctgctggtatcaatggttgcttccggaaaagtttgcttgaggtcagcgacccattcatcacttgttgcttgattatcgccgtcgatcacatcaatacgaacaggataatcgaccgtattgataaaatcattgatgtctgctttaatgtggctgaatgcccgccgcatagtccgttccttggctgccgcaatgatttgaccagcatcgttaaaccgtaggatgggtttgagtcgcagcatattaccgagaattgccgaagcattacttaagcggccagtacggactaaatgactaagatcgtcaaccacgaagtcaacgtgctgggtcgcccgtaattctgctagtgcggccatgatcgtttcaactgacttaccttcacgaactaacttggcggctagcatcgcttgattggcttctgcagcagtagtcaatttagaatcgaaggggtagaccttgatattggtaatattaggcaaataagcttcaagattactgataaagctagtgataccactggaaaggtgaatactgatcactgcttcatagccttgggcagccagatcgtcgtagacggcttgaatctgacccatggagatctgtgcagttgtgggcaattctttctcattagcgagtttttcgtaaaattctttattggtaatatcaacattttctttataagtatgttggccaaaaatgacagtaatgggaacaacagtaatgttattggcagcagcttgttctttagttaaataactggcactatcagtaacaacagcaattttcattttaaactccttttgacgtaaacattaaatttaagtttagcggactactatatttatatagcctaattatttttattgtagattataaaaagtgtgtagccttattttacgctagttgttaaagtattgcgactatgttttctgggtaagcgtgatggtaccgttttaaatcttaaaaagaggctatatattttaatatggtgtattttagtggtgaaaagtgcctagtttgaaaagaacttttacaggattttgtaactgtttaggttgagataaaatcaagtggtgtattgattcgttgggtattattaccactgagttctgttttagtgtgcagcactgatttgcgattaaatttaatgaaaacctgtgctataattctggtaatgcttacacgacataaaaactcgttacgcgggtaaaattctgtatgggggtagtcaaatgtctacgaaaagttgtcaatcatcgctggtaacgcaccaacatcgtgttcgctaccaagatctgaattcacatcagactttgcatggtgggcaattactccattttgtggatgatcaagtcgcagaatcagcgcgtcgttttggccatcaccgcgttgttactggtagtgttgatcgttttgattttattctaccgctacagtacggggaacaatttacaatcagcagttttgtcagtggtggtactcagcgttcgctggaagtgtatgcttatgtgctcaatgcacaacatgagttagctgcggaggcttttttgtcattgattagtatggtgcagcagccagattggccgcaagtgcgcccggaaagtaaattagagcaggttgtttgcgcgggctatgctcaacgctatgcagctaaccttgcacagcgccaagcaatcgctgctaggcaagctttattgtaagtcgtgtttggaaaatggtgcaaggttagcatttaccgtggattcaacctgaacatggttgaaaattctgagcgcttttcccaacacactctattttcggaggaacttggtttgcaaaatgaaatgaattattacaagattgaacgccatgaatggaaaaagttttatcgcaatggtatggcgccattatcgcaagcagatttggatcaggctaagtcgctgaatgatcggatctctttagctgacgttaaggaaatttatatgccactacgccatttgatccacgtttactacaatcaatatcaaagccaacagcaggatcgagcagactttctcagattacgctcacacaaagcaccatttattgttggtattgccggtagtgtcgctgttggtaaaagtacgacggcgcgtttgttggagatcttattgacgcgggcttatccgactaagaaaattcaaaatattacaacggatggctttttgtattcaaacgcggaattaaaaaagcgtggtttgttagcgcgcaaaggctttccagaaagttacaatatgaaacggttgattgcgttcatgaatgcagtcaaaaataatttagggccagtaaaagcaccgaaatattcgcatcaaagttacgatatcattgcgaacaagtacgatttgatcgattcaccagatattttgatcgttgaaggcatcaacgttttacaattacccagcaatcaacaaatctatgtcagtgacttttttgatttctcgatctatgtggacgccgatccagtgttgattgagcagtggtatttggatcgtttcaaggtattgttggataccgcttttactgatccgacgaattactattacccatatgcgatcggtgaccgtaaggctgcgatcgatatggctaagaatgtgtggatgaccaacgatttaccgaatttgcgtgattatatcttaccgactcgtagccgtgctgatgtgattctacataaaacgaataatcatcggatcaacgagatctatttacgtaagttttaattttttgaaacgatcattgaaaatgagagtcttcttcaaacagttgacctagagcgttgcaatcagtagaataggtttattgaaaaaagttatgaaagtcaatatattataatgaggtgaatttgttggcaacgacgaacatgcaagattttgataaaattatcgtgctcgatttcggtagtcagtacaaccaattaatcacccggcggattcgtgaattcgggatctattccgaattaatgtcgcataaaataactgcggcggagatcaaggcactgaatccaaaaggcattatcttttctggtggacccaatagtgtttatgatgaaggggccttccaagttgatctagaaatctaccaattgggtattccaatcttaggtatctgttatggtatgcaattaatggctcaggaccttcctggtggcgtggtcgaaaatgctaacaatagtgaatacggtcgtgccgatattcatgtgactgatccagatgccgttatgttcaaggatttgctaacagatcaatacgtttggatgagccacggcgacttagtgactaaggtacctgatggttttgtgcagacagcaactagcaagaactgcccaatcgcagcaatggctgatgataagcgtaaattctatggtttacagttccatactgaagtgcaaaacacagaatttggttcagaaattttacgtcactttgcctttgatgtagtaggtgcgcgcgataactggtcaatggatgattttatcgacttgcagattggaaaaattcgcaaacaagtcggtgaccgtaaagtcttattaggcttatctggtggggttgatagctccgttgtcggcgtattattgcacaaagcaatcggcgaccaattgactagcatttttgttgatcatggcttgttgcgcaaaggtgaagccaaacaagtgatggacagtttagccggcaaattcggtttaaacatcatcaaagttgacgcccaaaaacgcttcttggataaattaactggcgtttctgatccagaaaagaaacgtaagatcattggtaatgaatttatccaagtcttcaatgatgaagccactaagctaaaaggcattgacttcttagctcaaggtacgttgtatactgatgtcatcgaaagtggtactgatacggcccaaacaatcaagtcacatcataacgttggtggcttgcccgaagacatgcatttccaattgatcgaaccattgcggactttatttaaagatgaagcccgtgaattaggtgaaaaattaggtatgcctgaagctttagtttggcgtcaaccattccctggtcctggcttagggattcgtgtgatcggtgagattactgaagataagttggaaatcgtgcgcgacagtgatttgattctccgcgaagaaatcaaaaatgctggcttagaccgcgatatttggcaatactttactgttttaccaggcatccgtagcgttggcgtcatgggtgatggccggacttatgactatacagttggtattcgtgccgttaactcgatcgacgggatgaccgcagactttgctcgcattccatgggatgtgttacagaaaatctctgtgcggatcgttaacgaggtcgatcacgttaaccgtatcgtgtatgatattacctccaagccgccggcgactgtagagtgggaatagtagaagctaagatgtaaataccgttataccagtgtttgttgactcttttcttctgtagttcccgttgctggcaccgaaatggcatcagtaatgtgtttcttacccgtaaactgattacgagtgggggcaacgaccgaatgatctgccggcgtgaagtcaactagaccatttaggtgttgtgctgtctcaaagttactgtttggatataggtgtccataagttcctaaagttgtttgaatgtcttcatgtcccaaacgttccttaataattaatgggttttccccaatactgattaacaaggacgcatgagaatgtcgaagcgcgtggacacgaattcgatgaacattcgcagctttagaataaatgttgatcactttggacagtgatccgcgagtagttggtacaccattgtatgaaagcacaaaatctgttttaacttcagacgcttgaatctctttccactcggagagatattcaagcgtctttttgtctaacggaactgtccgaacgctggcacgagttttaagtgaagtaaattcataattaaacgcatttaaataataaagcgtcttgttgatccgtatcgtaccggctttaaaatcaacgtcttcccactgaagggcggttgcttcaccgatgcgggcaccggtcataaacagaagccaaattgtggtgaaattgaaacgctgatagtagtcattcagatccattaaagaaataactttctcaaactcggctttagtccagaaatcgactttcttcttttccttctttaaattgccaacaatttttgttggattctcttcacagaatcctagtatgattgcacgatcaaaaaccaaagataacaagcattgaactaggcgggtgtatgaattacttacttgactcttcatcatgatttgccatttctgtatatccaccggcgtgattttattaatgaaatactcgttaaatcctttgaattgctttcgaaagacgctcacacgactgtcaaaagtagcttttttgacatgaccttcataccaaggaatgaaaaattgctgacagaagtcaccaaaggtgatctgatctgttgaacctcctttaacgccatgcgccattaaatcacgataagcagtctttgcttcacgcattgttttaaatccgctacggcgtttttggacacgtttaccagttagttcatccacaccaatattggcacggaaatagtaggtgccgtcttttgttttttttattacttcggttgtctttgtcattatgattgctcctctgacgcagatgcaccgattttagctaactctgaaagagttcgcgcattgatcgtaagacctaatacttcttcaaccgcagttactggaacgcggcctagctttggtgactcgtaatatggacagcctttctgaaccattaacagttttgcgcgtctgataatgtctttagaagaccaaggtccataccctaaagccatgagttcatgtttagtcatagtgataacgtgaaccataatcagtctcctttcattggaagctagaccgtatatcttagcttccatattaacaggattgaggaataagtgcagctcaattgtgtcagaaaacttgctacccagttccgtcactaacggacataggaattgcacctctcctgcttacgtgggagcctcgcggaagtatcattatctacttaacttgtacgatcattagttgaaaatcgtaggtgaatcgtgggtggcgctcgcagttttggtcatggcgtccacggatcaacagttcaagttaagtaagaaagttagggtagcaatattcagttgccaaaggcctcgcagctcatattatctgctcactatatacatacaaataaaaaataaaaatgaaaccaaaaaagcagattaatcaaaaaaagattaatctgcttccttgtggttctataaataccgttcaaaattgaatttgtttacagtgcgaatgaagtgttcgcttagtatctgataacgatcttcgtcaaattgtaaatgaccccaacaagtaatgctgataattaatggctgaaattcttctagcatctccgccatagcatgtagatcaccatgttgcgccgcgtaaattgtttcagaataattcatcgtttttcgccctcctagagttagatttgggtcgtctaattcttaggagtgtgggggagaccgaatttttatggttaaactaatcgaagaatgttgcgctgattttgctcaacaccttacgatgctgtttggaaatcgcttgaccgctgacatggaaaatctgaccaattactttatctgaaagttgttcaacatatttatagtaaagcaatttcttttgaaaaacggttaacttggatattgaaatggctaggcgttcatcaataaaatattcttccagatggacagcttgttctgctgtgattagtttaataattggtggctcttcatcaatcggatattctactgttttctcgtttaagataatcttaagaacttgctgctgtgcttgagcgtagagtgagcgcgtcttattcacgagtgctagtttggcataatgtgaaaatgcttgtttgacatcttgatcagacataacaattcctccttttaccaaacaaatacttaaatattataaaaaatgaaaccgtacaaaaaataaattaaaactatttcgtcacttatgattgttagaaattgttttgagtcattatttcagcttcttatactgtcattgttgacattcatatatatagtgatacgattttggcttcaatgaagaatatgatgaaatttagattactggtagtcagtatggctcaactctcgtcgtcctctctactatttattgatggctgggcgaacgctgttaactcaatttttacagatgctttgtatgctttgctcaaaggagggatgtaaatgaacataccttagagatactcagtctgattgtgaattttggcactgtttttacgcataaagaataatttaaatgtaaaacttggcgccagaatatcgacttaacggtattttgtagagttataaagttaagctttggtagcacatttagatagttctccaccagaaccccgccaaaaattccgaaaacctttgaatattatcagaatttttttattggatagagtatggtaaattatgatgtttttaacttgatcgcagacaagtggaaaccaatttttaattagaagattctgctgaaattttgtataatcgcgaaaaagacgaatatgtacctgttttctagttactgaatacattgagagtgtaatattacgatttcactaaaaacggttgaatccttgattttgcaatgtttttgccatatatattttgagatagatgagcaaaataatcacaaaatagttttttgaccgaatttatgtgtcagtggtggttgatgtggacatgttgaaatagagattataaacttacgcttgaattatcagctttaatcaagttgagaattagtcacccaaatttaatattttactaaagtattgctaagagtgctctaataagaaatttaactataggaatttttttataccaggataattttataagttatttattgtgtgcaaggtagtcgaatgtgcgtattttgaaaataaagcttgacgtatacatagataatggtctatattctaaatatagatgcgcgtctatgtttacttcagcagtcataattcataaaggagcttacaaatggactatcaaaagtatgttcaaatgcttaaagcaatggccgatccaaatcgtttgaaaattattgatctactttcatgtggttctttgtgtgcttgtgatattttagagcattttgacttttcacagccgactttgtctcaccatatgaaagtattgcaaaatgctggtattgtagctgcacgtaaagagggaaaatggcagcattatacgttacgggcagaattcatactgacttttaagcaagatacggtgcaattattatcaaatgatgatcactgtatctgtcatgatgagggcaatggtgattgtcaagcatattcttctggaaaggttgttattaccaatgaaaagaattgaattatttgagccagcaatgtgttgttctactggggtttgtggtccgtccgtcgatcaaaaccttttaatgatcacgtctgcttttgaagctttacaaggtgttaaaacgattgaggctgatcgttacaaccttagtaatgatcccgctgttttcagtgaacgcgccgatattttagcggcgatcaaggacgatccagatgcagtattaccgatcacagttgttgatgggcaaatcgttaaaactggcgcttacccaacaattgatgaattatctgattatactgggctggtttttgtacctgctgagcagaccggcgggtgttgcggcggtgatagtggttgttgctaaattttactaaggtaagagatagcacagccatttcttttaaattatatatagatagatatctatgtaacgaaggagaataataatgcaagactatcaaccacaacatgcgaatttgactcattatttgttttttaccggtaaaggtggtgtcgggaaaacaacaacggctagcgcaacagctattaatttagcggatgcgggtactcgagtgatgctggtctcaactgatccagccagtaacttacaagatgttttcaatacggagttaaccaataagccgcaagcaattaaaggcgtaccaggattatttgccgctaactttgatccagtgactgccgtcggtgagtatcgggaaagtgttgttggcccttaccgtggcgtattaccggatgctgcaataaaaaacatggaagagcaattgtctggttcctgtacagtagagatcgcttcgtttaatgaatttgcgaattttttaaccgatcctactgttgatcagcgctttgattatattatttttgatacggcaccgactgggcatgcactgcggatgttacagttgccatcagcgtggcataattatttagatgaaaatgatcgtggcgcttcttgcctaggtcaattagctggtatgggtgaaaaaaaggcagtctacgctaaggccgtggaaactttaagcaatggcaagttaactacattgatgttggtgacgcggccacagaaggcgtcattacttgaggcagcaagggcagcacaagaactagccgctatcggtatgcagaatcaacagttgatcattaatggcacgctgaaagcaccgactgatcacgcttcgcaggctatttttgagcaacaacaggccgatttgcaacaaatgcccgctattttaaaagagtttgtacaatttgaggtaccattacgggcctacaatgtgactggcttgagtaaattacgcctagttttgcagtcagtacaaccggcattagccacttatccgccactgcttaataattatcccaacatagatgcgatcgttgccgatctgatcaagacggataaaaaaattattttcacgatgggtaaaggtggtgtcggtaaaactactgttgcggtgcagatcgcaaaaaaattggttgcccaacataaaaccgtgcatttagctaccactgatccggccgatcacctagatttttttaatacagacgatccggcagtgacgatcagtcatattgatgaacaacaagtgctaaaagattatcaagatgaagtgttggcaacggcacgccagaccatgaaagccgctgacgttgattatgtcgctgaagatctacgttcaccatgtacacaagaaattgtagttttccgcgcttttgcaaatattgtcgcacaaaataacagtgacgtggtggtgatcgatacggcgccaactggtcatacgttattactattagattcaactcaaagttatgctaaagaagttcagcgtaccgccggtgatgtgccgcaggcaattgttgacttattgccacggttgcaagatccccaacaaacggagatcgtgatggtgactttaccggaaacaacgccggtatatgaatcaatgcgcctcaatgaggatttaaatcgggcccaaattgctcatacatggtggttggtcaatcaaagtatgttggccgcacaaacgacacatccgtgtctgcaagcacgcgcacaaaatgaagttgaatggatcgaaaaagttaaggccgtttcagccaatcatttcgcggtcgaacagtggcaagcggattttgaacaaacgcgattaacgatttaaataaaggaatcaattgcgcgtgtgatataaggcgtccaatcaacaacgggaagtaagttctttttgctggattagcacgatatccgatagtcaccaaatagcgttgccaagaacgagcgacagtgactattcctgtggcaagaatcataccgcaggaaacatagcaaggtgaaaaccgctaagttgaaacctggtaagcggaaaaaggttactgtatggcacacgttttagctctatttttcggaagtacaaagaaggagttgggagaggaactatgcaagtcttttttgctgtttttatatttttactcacgttactattcgttatttggcagcctaaggggctatcaattggctggactgcaattggtggggcggtacttgcgttattatttcgggtcgtcacgtttaaagatgtcggtaccgttactggaatcgtttggaacgccactttatcatttgtcgccattattttgatctcattgattttagatgaaatcggctttttcgagtgggccgcgttacatatggcgcgattagctaaaggcaacggcgtgcgtatgtttattttgattgctattttaggtgcgatcgtagcggcgctttttgctaatgatggggctgcgttgatattaacgccgatcgttttagcaatggtacgagccttacattttgataaaaaaaaggttttcccgtttattattgctagtggctttattgccgatgcgacttcgttacctttagttgttagtaatctagtcaatatcgtttctgctgacttttttggtattacattttctgagtatgcgctaagaatgtggattcctgatcttttttcactaattgctagcatcggtattttatatttatatttccgtaaagctttgcccaaacgttatgatgtagaccaggttgctgcacccaaatctgcgattaaagatcaacggttatttaaattttcttgggtcgtgttagcggcgctactgattggctactttagcagtagtttcctaaatattcccgtttcatttattgcacttacgattgctttaattttcttgttggtcagccaacaaagtcattacgttgacactaaagcagtcattaaaggggcaccatggaacattgtcttcttttcaatcgggatgtacgtggtggtttatggtttacaaaacgttggcttgacggcactacttgctggagttatcgctaaaatggtaactggtggtcgttttgtggcaactatgggaatggggtatttagcagcgtttctgtcatcggctatgaataatatgccaacggtaatgatcaacgccttatcgatcaaaggtgccaatgtttcagggctaatgcaccaaactttagtttatgcaaatattattggttctgatctaggaccaaagatcacaccgatcggttctctagctacgttggtatggttacatgttttggcgcaaaaagacgtaaaaattgcttgggggacttattttaaaattggaatcacgatcacgatcccagtcctatttattacattatgtggtttatggttatcgttgagtctttttggttgagaaaggataatttgttatggggcaaactgagtataaacaacaaaattcatttaggaatcggctaaacataattgatactttagtgggccaggccgcaaagacagaaatagagtcaatttctgctgcttatctgattcaagctaaccaagaaattaatttacttgaattaaaatatggtagcgaattaacaatacaacagaatttgtacaaggtaaaagtagcctttttacaaatgaaccgattaatattaaataatctagcggtcagctattttcgtgattatgcacgggtagagaaagaatttgtacgatttcatcgtctgatatgcgcggtgaaaaatgattaaaattgaaatttttgaagaggcaatgtgttgcgcaactggtatttatggcctagtgtaaaaaaattgattcaaaccaccgcgattcaacgtcgtgttaacgcagatggtgaaaatataatcattcgcagaaatcttacacaaaatccaaatgcttttgttcgtgatcagcaagtaaatgatctatcagaaaagtatgaaatcatgatattaccaattactatggttaacggtataatttttaaataaaaggagtatccaacctttcaagcgttctcaaattatctacatcaagatttaagtcgggcatgcgtccattaacaaggtggaggaaactaattaaatggcaaataaagtggaaaaattattgatcattggtggtagtgacgctgggatttcagcggccttaaaagctaaagaactcaaaccggaactagcggttttggtattgttagcggatgagtatcccaatttatcaatttgcggtttaccttatgcagtcagtggagaggtgccaaattggcatttgctggctcaccgcaatttaaaagaattaacctcaactggtattgaatttcaaatgaacatgattgcagaaaaaattgatccacagcaacgtgaagttgtggcgcattcattagctggtgaattaaaaacttatcgttatgatcacctggttgtagcaactggggctaaacccaaactagcgaatattaaaggtgtggatttagcacgaacacaacgatctagtagtaaaattcgtgttctgcatacgatggcggattattttgcgatcgaaaaagatttagccacagccagtatccagaaggtggcaattgttggttctggctatattggaattgaaatggcagaagctttaaaaaaacgcaatttggatgttactatttttcaacgaggtgcagaaatactctctacagttgacaccgattttggtcgaattattcatcaaacgttgtccgctaatgcggtcaacgttatgactgagttaactgtttcagaaattaacgaaaatgatagtaatgtagaagttattgggttaaataagcagcaaaaaatggctacttatgcgtacgatttagtcttagttgtagttggggttcaaccaaatactgagctgcttgtcaatgccggtgttgagactggagttgcaggttcaatcaaggtcgatcaatacatgagaacctcactacctaatgtatgggcggctggtgatctggtggaaacaaaacactatttattaggtgaaacctacacaccattaggcacgaatgcgcataaacaaggaagaaccgctggctttaatgttgcaggggttcaacgggcctttaaaggtagtttagggacgcaggttctaaaagcgtttgatttagttgtcgtgcggactggattactaacgaacgaggctatacaggcaggatttgatccttttacagtaacaaccgctgttgatgatcataaagcatattttccgggtgcccaaaaaattaaaatcaagattactggtgataagaaaactggaaagcttctaggcgtacaattaattggtcattacggtagcgaagttgccaaacgtagtgatatttttgctacggcaatttttaatgatatgacagtggctgaaatcagtgatttggatttatcttattcaccaccagtcggatcaccttgggatgcagtacaaattgcagcacagaattgggaacaacaaaacatggagccgcggcagcaatcaaaacaataaaatccccttttaactggaattagaacggtacttcgtgttttctagattgataatatattgttttatttggcatttacttttattactctacagttagtgagcatcttattcgcaggatgatttaattaaaatggcagattgcaagaaataacttgaacaaatttagtaacgcagattacgcaaaaagatctcaatcggtgttcgccaagttaaacatttgagtggtcgggaattcaaataccagttaatttgaatcaattcatcatcggtaatctcatcaatcggttgacctttgggaatgaagcggcgtagtactcggttgcgattttcattac

SEQ ID NO: 480 - DNA, 1422 bp, Unknown
  Metagenome-assembled genome
tcctgctagtcctgagtttgaagactaaaaattagttaattcagttattacacgccattgcccaataattgggccagattattgggcagtgttcggataaattgatcgaagagttcatcaatgatggttgttgtgagccctaacttttcacctagaccagttaattggcgcatcaaccaagctaaagcgactgcgatctcaatatccggcaacgggcggccaaaattataaaataaatcgccaagcgttcgttcatcaacttgttcgcgttgatgcagcgctaaaatatcgtaactcatcatgaccatggccatatggccgcacagtccatcgtaactttggacttgggtttgatcaaaacgcaggtattgtttggctactttgaagtagccctcgatctgccagcgacgaccataaagttgaatgatttggtcaggttctagggtcgtttttgttgtacctaaaaccagatactgactgtgatctgttcggttaggaacgaaaactaatttaactttcatgggctgacctccaacttcgaaagtgacaatgggactataatgataattctgatgctgaggccatttactccgccgaaggcgctcgtacaacgatttaacatccatttggcgaccacgataacgaaaataaactttctcactgcgtttgagcatacctacaccaaactgaccgcgttgcagtaactcaaaaaatagtcttggtgaagcaaaccagctatcaaacagaacgtatttagttttaatgccagcacttaaagccgaatcaactagctctaaggcaacctcattcatttttcgtttggcttgtgctcgtcgctgtgcggctaatgtacgcggatcaaattggttgatcggacctaattgatttttggctttgccagatgacatcagcgcaaaatcaacgggcaagaaagtattcccatcactccaacctaaagttaacgtacgaaagccatgataatagcgctggtgattatgatcaaaaacccgagctaataactcagttttacgcgagaactcacgcttgaataaggaatcatctaggatgagcgcttgtgcacggcgggtatccgtaaagtgtttaacatattgaattagccgcactgcgagtaaaataactagacgttgccaatttgtatggcgattattgagacagttgcgggcggttttcttagtaaaatgtggatcagattcggcacgaaagatggaatagcgcgtaaaaatagtggtgatcagccattcaaacaggactggcacctgaataccacgagttttatggatattagcgcgacgtaaaacgtcaggtaactggaccaatttagaaaaatgttgcattgctaggtgaatattaggggtagaatgttgtatagtagacatggcacgaaaactcctctgtatgttt

SEQ ID NO: 481 - DNA, 1521 bp, Unknown
  Metagenome-assembled genome
ggcatcaaaataaaaaaacaacggacaagcatcaagctaaaaatgccgcctaacaaaagacaaccagatttctcaaaatcgagaagtttggttgtctttttaaaacgggtgattatttaccgcttacacaagaaaaacttacgccgtcgttaaacttatcaatataaagaagctcccacgccataattcagtgacgtaggagcttcttttgcaattctttctgccctatggcttagtgcacatagacagtgctagttaggcttcgggccaaacttgttttgcagtcgtgataactagctttaatttagcccattgttgctctgcagtcagttgattaccttcttcagtagaggcaaaaccacattgcgtcgacaacgctaaattagctaacggtacgtggtgtgccgcttcatgaattcgtttgatcaacgttgcttgatcttctaattcagggaatttagaagtcaccaagcccaatacgatccgtttcttcggttcatgattccagatttttgccaaaggcgcaaagtcaccggcacgatcgttatcgtattcaaggaacaaaccatcgtagtttaattcgcctaaataatcggcaacaacatcgtaaccgccagaaaacaggaaggttgaacggaaattaccgcgacaaatatgcgttgtaaccgttaaatcagttggcaaattggttaatagcttattgacaacgtacacgatatcttctgccatttgttcatattccttatgtgctgccgggtcatctttagtggcgtttaaccgatcgatcaaaaaggcccaggtggtgtcatctaattgaatgtattgacaacctaatgaataaaaacgcaataaagttttatgataagcggtagccagatcatctaaatagtcggtatgattggcatagaatttttccgcattatcactgcgattgtcacggaacaacatgcttggtgacggaatcgtttgtttagccactacgccatcaggaactaatgactgcaaataactaaatgcggcaaaaaacggatgatccggattgtaagccactttaccagtcaaggtgacattatccgtccgcgttttactaccgtggaacttgtaacttttttcataatcatatttatcgacgccggttaatccccataaaaagtcaaggtgccaccacgaacggctaaactcgccatcagtaactgcatgtaagcctagttctacctgtttagcgacaatttttttgatttctgcttgctgaactttttgtaattctgccgcgtcaatgtcacctgctttaaattgctcgtgagcctgcttaagtggtgctgtccgtaatagactaccaacctgatcaaaacgatatggtgctgttgccataaaaaattcctccccttgagtaaggtactgtcaaacgtacccgattttgtctagttttaattattgtttctaatggttttgtattatctaagtgaaattaaaaaacacccggaccaattcttctgttatccttggtgtgcaaccaacaag

SEQ ID NO: 482 - DNA, 28823 bp, Unknown
  Metagenome-assembled genome
agtttttattacgacgtcaaagcgccaaagaccacaacgacatgtcaacttcgacaccactttaccagaaaaaagcaaagtggtgaaccacgattccgtcgaatcatgattcaccactaatgttagtccgtttttatgtatacaagtgaccgcgatagttactatctaccaggccgcttgaatcatattgttcaatgattttctttagcattgggttccgccgtttctttgtcatggagtagtggtgaattcttagattggcggttgatccagagtacactggcttggccgagtagaataggagtgaacagcgctgcaacaataatctcaagtgttctcaacatagctaacatctcccttcactaaacgccgcctaaacggttgctgcacctggtaccatccaatcaaaggacagtagttgatggaagtgacggcccacaggaatccataggccggcggtcagtatatttttaagtgcagcccagaataacggatcctcacgctgcttttcagaagtcttaatggtcaaaacctcaccgttttccgccttggcgacgatctgcggataggtcacgctgactaattgagcagtgataatgttgcacatttttttatcgtaatcaagaatcatagttgctcatccctttatttaaattgatcgtttcttagtgaaaaccgcgaatagctgttgcgtctattttgtggtaaagtgcgtcaaattaaaacctgacttgctttagttgataaatacagtttaccgacactggcttaaagtaaccctaaaaaagtgtgatcaatttgtagcgatttgcttagaaaagacttaagggcttaagtaaagataaagaaaagcagccgtaccacctgatgtaggggcacgactgctctagttttgttaagcgtgtaattttaagatatcggcgatgatactgcgcatttgttccggcgtggtttcacgtttgtgtagaactggtgcgccaatcaattcgctgactgcatttggtagcggtaaattaatgaaatcggccaagcgctgatcggctaaaataccgtcagtagattcgcgctcaccagctaaggcagcgagcacggtattcggaaatttaaacggactagcagtcgagacggtaacggtcaatgttttgtcaccagtttcagcacgatactggcgggcaacggcggaagcaaccgctgtgtgtggatcgatcgtatattgattttcccgaaaaatccgattgatctctttagtggtggccgcttcgtcggcatacccggcgtaaaagtcattgaattcagcgcgcattgcttcgttgatctcataatgtccactggtactcagcgcatccatcaaacgcttggtttcgccactattatggccggtcaggcggaacaataaccgttctaagttgctggagactaaaatatccatcgatggtgatgaggtgacataaaattcacgattgcggttataactaccagtatggaaaaagtcagtcaaaacgttattgcggttagaggcacagatcagtttattaactggtaagcccaacaattttgcgtagtaagctgctaaaatattaccaaaattaccagttggtacactgatattgatcttgtcgcctaagttgatcgccttttgattcaataactgagtgtaagtataaatataataagcgatttgtggcactaagcggccgatattgatcgaattagctgatgagaattgataatgattgcgcgccaattcttgacggaacgcttgatcattgaagatagctttgacttgcgtttgcgcctggtcgaaattaccggtcaacgcaactaccgccgtgttttcaccagtttgcgtaatcatttgttgtttctgaattgggctgaccccatcacgtggatagaacacgatgattttcgttcccggaacatccgcaaagccggccatcgccgctttacctgtgtcgccggaagttgcggtaaggatcacaatatccttatcgacgtgatttttcttagcagcagtggtcatcaagtaaggcagcagcgataacgccatatctttaaaagcaatggttggcccatgaaacaattctagaaaatagccgtcctgagattggcgcaatggcgcgatcgccggcgtgtcgaattttttatcataagcttggttgatacaatcgcgcagctcctcttccgtaaaatcgctgaaaaaagcctgcatgacagtataggcaacttcttgataagaagcggtgcttaattttgcaaaatctaagtttagttgtggcatttcaactgggacgtagaggccaccatcaggggtgagtccttgtaaaattgcttgcgaagcagtaactgctttggcggctgcatcccgcgtactacgataaagtgtttccatattcaattctcctatttcacaattaaggttaatttattagccaaatacactaataaattttagatgttacactgttactcgtttttaaatatattgtttggcagatattcattattagaacttatttgctaaacagttttgacttcccgatgtcgattagactacgccaaaatacggcaagtctaagtcgcatgcggtgaccattcttgtggcaaagattaaggagcgtagttgcacagtccgcaactgcgtttcctcaactcaacccgtttcggtcaccgcaagaaacatggccctatttcacaattaaagttaatttattagctaggcaatgatgtctgtgcccgacgttgatgattcattagttgttttttgattgctttaatgtaaagttattcaagcgctacccaaatcataccatattgctgggtacttttttcactccagtgtataacttttatgcatttgaaatatttagcatatcatgagtaggtgatgagttaaagatgaaaattaaattaaaattagtgttgacattaaaaaaataaattgttaggataaggacatcaaatcaagcaaatcaatttactaaaaacaatttgaaagggagttgatcgttatgacgaaacaattaaataatcaatcgaacaactccttattctttgccctcctcctctagacaggactctacacatataagtgttgagtcctattcgttttagagaagtagggctcaacgcaaggcagcaatttagcttagcaccctatttcttaaccgagatagggtgctaatttttttgctgagagtgtttgaaaaagtgcttagcttctgagcactagtttagtaagacaataagcagcacgcagtgatgcgtttgacttacgtagctaggcgcaggaagctgctttttcaaacacgtttatgaaatcaaacctaaaatgaggagcgtattaaaaatgaaaaaaattcaattcttcgacacaaccttacgtgatggtgaacagacgatcggcgttaattttagtattgaacaaaaagtaacgattgcaaaacaattagaaaagtggggcgttgatgttattgaagcaggcttcccgatcgcttcaccggaagattttgcggcgtgtaaagctgtttccgaagcggtgacccacacaatgatcactggtttggcgcgttgtaaaaaggctgatatcgatgcctgcgttcaagcgacgaaaaatgcgcggatcaaacagatccacgtttttatcgctactagcccgatccatcgtgaagataagctacatatgaccaaggaagaagtcatcaccagtattactgaacatgtgacttatgctaaaaagtttttcgatatcgttcaattttcaccagaagatgcgacacgaacagagcttgacttcttagcggaagcagttcagaccgcaatcgatgctggcgctaccgtgatcaacattcccgatacggttggttacactaacccggctgaatttgcgcatttattccagtatttacgccagcatatcagtaactttgacgacattacattttcctcccattgccacaatgatttagggatggccactgcaaatacattagccgctatcgaaaatggggcgacgcgggttgaagggaccgtcaatggtattggcgaacacgctggcaacgttgcgttagaacaagtagcagccaacttttacgtacgccacgattattaccaatgcgaagataatatcaagctagaatacaccaaagaaaccagtgaaatggtcagccgcttctctgatatggcggtggctaacaaccagcccgttaccggcgtcaactgctttgcaatcgaatccggcattcaccaagatggcttcttgaagaacccacagacttacgaaattttgacaccagaaactgttggcatgccagcaacggctttaccattaggcaagttatctggcagccacgcggtgatggataaattaaatcacatcggctacaacgttgaccgtggcgatatgcggatccttttcccacgcttcaaagcaatcgctgatcaaaccaagttagtttccgacgcagaattacatgaaatgatgcaagaatataaaaaggacgtgatctcggcatgagcgcaacaattgcagtattacctggtgactatattggaccagaaattatgcaggctggcttagcagtattaaaagccgctgctgcagcaacgaattttgactatcagctaaaaacttatccgtttggtggtgctgcaatcgacgcaactggcgaaccgctgccggcagcgacattaaagggtgcgcaggccgccgatgccattttactggccgcaattggcgggccaaaatgggataacgcgacgcaacgacctgaagctgggttattggcgatccgtaaggcattaggcttattcgccaatatccggcccacccaggtattacctgccttagtgccgcgttcaccattaaaggccgacattgtcagcggcaccgattttgtgatcgtacgcgagctgactagtggcatttatttcggcgaaccgcgtgaattagctgccgatcacgctattgataccatggtctatcaagccagtgaaatcgagcgtatcctccgtgcgggctttgaattagcccaaacacggcgcaatcacgtcaccgtcgttgataaggctaacgttttagcgactagcaagctgtggcgccaaattgccgcacaagttgcacccgattatccaacggtgaccgtcgattacgagtacgttgatgctgccgcaatgaaaattttgcagcagccgacccattttgatgtgatcatcactgaaaatttatttggcgatattctgagtgacgaagcggcaacaattaccggttcgctggggacgattccatcagaaagccgtggtatcagcggtccaagtctatacgaaccgattcatggttccgcaccagatatcgccggtactggcaaagccgatccgctatccatgatcaactcgatcatgttaatgttgcgcaacagttttcaagccaatgcgactgccgacaaaattgcccaagccgtggcggcaaccttagcagcgggaatcatgacgccagatctaggcggcactgccaccacaacgtcaatgaccaacgcaattattgaacaaattacaacgaaagaagcgatgtactaatggcacaaacaatgtttgataaaatttgggataaacatgtgattacgggagaagcgggccaaccgcaactaatctatgttgatctacaccttgtgcacgaagtaacatcgcctcaggcttttgaaggtctacgggaaaataatcgaaccgtgcggcgtcctgagcgaactttcgccacgatggaccacaacgtaccgaccgaagatattttcaacgttaaagatgtgatctcccgcaagcaaatggataccctaagaaaaaattgtgaagaatttggcgttcggttagcggcgttaggtgaccggcagcaggggatcattcatgcgatcagtccgcaattagggctgacacagccaggacaagttgtggtttgtggtgattcacatacctcgacacacggtgccttcggttcgattgcctttggtattggtacttctgaagttgaacacgtttttgccacccaaacgatttggcaatccaagcctaaaacgatgggcattcacgttactggtaaattaccacaaggcgtttacgctaaagatctgatcatggcattgatcgcacaaaacggtgtcgattttgggactggctacgcgatcgaattttatggtgacacgatcgaccgtatgtcgatggaagagcgcatgactatctgcaacatggtgatcgaaggtggcgctaaatcaggcatcatcaagccagatcaaaccacgttcaattacgttgccggccgcgaatacgcgccgcaagatatggccgccgctagcgaatattggtcacaattttacactgatgatgaaagtgcctttgataaacaatatgattttgatgctacccaattggcgccatacgtttcctggggcacgaatccaggaatggcggtgccaatcgatcagccattccccgaaccagtggatatcaatatgcaaaaagcttacgactatgaaggattgaaaccaaatggccaagcccgtgatattgatctaggctttgtcttcatcggttcctgtaccaatggtcgtttatccgacttggagatcgccgctaacattatgcgcggtcggaaaatcgcaccgaacgtgactgcgttagttgtccccgcatcacgcgcgattcgcgatgaagccgaacgccgcggctatgctaaaattttccaagatgctggctgcgaatggcgtgaacccggctgctccgcttgtttaggtatgaaccctgaccaagtgcccgctggtgttcactgtgcctcaacgtctaatcgtaacttcgaaggtcgccaaggtgctggctcaatgacgcatttagccagtccagcaatggtcgccgctgcggcgatccacggccactttatcgatatccgtagcgaagcgatttagttggtattgatttatttgaaacgtggtaaaaagggcagattattgcgtatagctacgctagtcaaacgagtcacttcgtgtctcttattgcctagctaggctatactccataatctaggcgccttttttaccactctaatgaagggtggcattattatggaagcaatcaaaatcgaaacaggtaaaagtgttgccttaatgcgcaacgatattgatacagatcagatcattcctaagcaatttctgaaaaacattttaaaaacgggttacggtatccatgctttttatgattggcattatttaaaggaaagtggtcgaccaaatcccgattttattctgaataagccaagttctaaaggggctacgatcctagtgaccggtaataactttggctgcggctcgtcgcgtgagcatgcggcttgggcaattaaagactggggcttcaaggtgatcatcgctggtggttacagcgatattttctacatgaactgtacgaagaatggactattaccaattgtgttaccacaagcagcgcgtgatattctagccaaagcaacgcctgaagaaacgatcaccgttgatttagagcatcaaaaggtgaaatacaacgatcacgaatttgcctttgatatcaatccaacgtggaaagaaaaattcatcaacggaatcgatgatattgatctgactatgagccatgaacaagagattgaagcttttgaagcacagatccctagttttgggtaaagtgtgtcgcaaatggcacttagcttttgagcatagcctagatttaagatacacgtagtggttcgttgataatcgtagctaggtggaaaaagttgcctttttagacacgtttgatctgaatattgatgagataagtactaacaaaaagcggcgctgagacgatgactcggtgccgtttatttttaaaaatttagcatatgcgatgtttggcaaagcttgttagcttattttttgccgctaatttagcgtaaacgtagctagtgctcaaaatctgaacactctaggaggaacagcaaatggaaatcacttcattagaacagcgcatggacaatagcgctacaacgccattattttataaaattttcgctttagtttccggtggcatgttcctcgatgcaatcgatgtctatatggctagcggcgtcagtagtgttttactaaagtccggctggtcaaccttaatggaaaatacgatctttttgtcagtcggttttatgggcctattcattggctcgttgctagctggtcttgttggtgatcgttatggacgacggcgcgcttaccaaatgaatttgttactcttcggtggctttacctttttgggggcggttgcgcctaacatgatatttctgatcttctgccgatttttcagtagtgtgggtttaggttcggaaattgtgaccggctattcaatgttaaacgagtttgcgccaatcaaatcacgggggcgctggtgtgcagcagcttcgttgatcgccaattgtggcgcaccgatcaccatgttattatgcacagtcctaattcctaaatttagttggcggatcatgtttgttttagttggtgtgctggcaattgttttatggatcttgcgccgtgatattccagaatcaccacgctggttaatggcacaaaaacgttatccggaagcggaaaagatcattcaacaattggaaggtaatcatactcatcaacaggctgacttcgcgacaccagcagcatcagcaacgcacgaacctaaaataggtcgtagcctagttgtagccatcgttgccgtttcggcgacaatcatttgtcagtatacgttcacgacctgggtaccaacattattagtcaaacggggcatcaatgtggtcaattcattgagcttttcaacggtaatgatgttaggcgcaccaaccggcgccttgattggtgttttactagttgaccgtattggccgaaaaaaactgattgtgcctacttttattctaaccgctgtttttggattgctatacgctgtacaaactaatgcgacagcagtgatgatcgttggcttcttattgacgacctgtttttacgttttaatggctagtgtcgtcgccgtctacgtcgcggaattattcccgaccgcgtttcgcttccgtggctccggcatcgctaacgccaccgctaaattattgaccgtcggcatgccgtacgcggttgcggcgtttctaacttggtttagcgcatcgttgatttttgtgatgatcagtgcgatcgctttgatcgccgctattgttgtttggtggttaggtccagagacacggcaaaaagcgattcgttaagttgaaaaaggcactatttccgattgattggaagtagtgccttttttcagcgttgttgccaataattcaccgccgccccacgtaagttggcttcagcacggaactggcacaaacggacgtcagggcgcacggtggcgattgaaacttgattcatgatctgatcgactgccttctcaatgccaggtaacagcgctggattggcggagataccaccgcctataacgaagcattgtggatcgatactgtattgtagattaaaaatcgttttggctagtacgtggtagagctgttgtaatgcttgttgctcgtctttgtcaccggtgcccgccagatcaaaaatttcctgaccagttagtgttgtgtggtggctttgattgtagtattgcgccattttaacggcggtaccggcttcactaaccgtggcggtgtccgttgttagtatataaccgaattcgccacctagcaaatgttgtccgtggcggacttgaccgttaatgataatagcaccaccaacaccagtgccgatgaccaaaaagacgacatcttgcagaccttgcgcgataccggctgtaacttcggcaagggcggcacagtttgcatcgttttcgatagcgacgggcagaccaaagcgctgctcaagttcgggcacaattttgaagttgtgaatataggagatggtgctggctccacggataatgccggccggctgatcaactgcgcctggagagctgataccaatgccggttaaatcaaattgctgccgcatttgttgtacccattgagtgagtagcatgtaaaaatcagccaaattatctggtgttggctggctagatttagctataatttgttgttcctgccaaatacctaatttaatagtggtaccaccgatgtcgatcaagcctaaagccattatgaacaccccttattattagaacgttttcattaattataccttaatctattatcccaagaatcaaaaaaaacgccgtttctgttcaatttaaacagaagcggcgttacttatttctacttatctgctttgatcagcgcatcagtcacgattttcaactgtgcgcgcgttgcgtatggatcatagtagtacattttattaaatggcaactcgatgactcggttggctttgacggcagccagtgatttccaaagtggatttttcttcattgctactaacgctggatccttctgccctttagtgctggatgtggtaacgaacatataatgggcttggtatttaggcaaggattcaacggatatttctttgaatccagcaccggaatcaactttttgcaatggtttggatagtttgaagcctagtgctagcattgcttgggcgccacgactaaagccagagccataagcgtagagcttgttactttgcatttcataaacaccaaacgtactcttacggctgatcttcgccgcatttaaccgcttgatctgctttttcgctgcggtgttgaaggattttttgaaggctttggcttgtttaggccgatttaataacttcgcaaaatagttcattgaactggtgaattgctgcgttttttgataaggaatttgcacggttggggcaattttttccattttcttagtgtcgctttcgttattagtgatgatcaaatcaggctttagtttcaaaacagcttcggcgctcatcggtgtgccgacatcggtcatacttttgatcttagcttgatctaagtaaggattggccatctctaactttgttgaaccaaccacattaacgcctaatgccatcacttgacctaaataaaggccagcaacaacgcgtttaggatggttagggacttgaatcgtcccgttggccgctttaaaagcgtgtgtgtccgcagccacaactggacgtggtaaaaagataacaagtaaagcgaatgcagccagcaaaacactgacaaaacgctggaatttctttgacataataaagtctccctctatttctgtagaaaaatgccacaagcaatatggctaaaatttagattgtttcccgatcggactggtgtagcaataaataaatgaagtatggcatggtgatgactgccacgaccaatcctactggtaactgacttggtgcaaaaatattttctgccacgactgccgcgaacaagatcaagttgaccccgactaatgctgtaaccggtaaataaaagcggccgtgattgccgactaagcggcgggcaatatgtggtgccattaagccgacaaaactgatcgcgccaccaccagcaacggccaaaccggctaataaaacggctagcagtagtaacacttgccgcttaccagcgacgcctaagcctaacccgctggcagcttgctgacctaatgtcaacaggtcgctggcccataaaccgcgtatagtcaggggtaacaggatcagcagaccaatacttagcacggcaatgtaggaccaatcttggttccaaaaatcgccgctgatccagacgatcagtttatcgaaatcaaactgatttaattgcagctcaattaatagaatgatgccgtttaataaagttccactggcgatccccaacaataaaagttgtaagggttgctgcaagcgtcgttgaacgaaaacaatacaagcacccactaagctacctaaaacggcaaatagcggcagaccgtaagtttgactgagcggaatatgtaaattactgatcgccagaaaagttaccgcgcctaagctggctccagaattgatccccataatactagtgtcggccaacggattttcggttaccagttgtaggatcgcaccacttaaacttagacagatgccgcagatcaagctgagtgcgatctgcggtagacgaaattgtaatagaactaaatcggcttgtgcgctgccatggccggtaaggacttggccgatttcagaccaagtcaggtgaatgctgccgtgggtcagttggaaaataactaaaccgataaataataggctgaacgaggcgcaagtaatacgaaatcgttttttcatgttgtcagcgccccctgtttacgccagagaaaggcgaataagaataggccaccgagaattgcgcttaaggcgcctaaaggtagttcaaacggtgggcgcgctgatttcgccagcgcatcaccgaaactaagaaaggcgccaccagccagtagcacttggccgacagtttgtttaaagcgatgaccgctaagaatggcgatacattgcgggatgcctaagccaacgaaggcgatgttaccggctaccgcgacacagccaccagccgctaatacgatcatcagggaagctaaaatacgggtgccattgcgtttgctaccaaggctttgggctagttgatcatttaaagttaagatcgtcagcgaatcacgcagataaaatatcacgactaataacactaataaaatcacggccagcaaccagactgaatcataggtgatcccagagaaaccgccaaccaataaagtgcggtactgggcggtggtttgggtcagcaaactgacggcataagccacactaactaaaaagccagaaaaaatactgccaccgagaatcaagcgcagtggctgcataccgttacgggtcatcgatagccccagtacgacacaaaaggcgatcaatgcgccaaataaggcgagtccaaagcgggcaccgatggtaaaggggattcccagcacagtaccgacaattaaagctaagtttgcgccactgttgaccccaagaatggctggatcggcgattgggttacgcgaaatcgtttggagcagttggcctgccaccgcgagttctgcaccgactagtacgctagtgattgctcgcggtaaacgcactgatagaatcgtttgtgtttgtaagccggctttagggtggaccaaggtcagtgggctgaaccaagtcgggccgctacaaagattaataatgaagccaccgatcagtaaaatgatcaaaataagataaatttgccgtgtccgttgtgtcattgtcgcgcccccgcaggcgttgccaaaggatcaaaggtatcataacttgtgatcattggacagtgtaatcggggttcagccgccaccgttgcgtcgatctgaaagactttagctaacatgcgtgaggtgaaaatttgatcgggtcgaccttggtacatgacttggccggctttcaagcagaccaaaaaatcgcaaaagcgagccgcttgatttaaatcgtggagtacgataataatcgttttgtgctgcgtctgattaagttgctgcagtaatttcaaaatttctaactggtgggtcagatcgagataagtggtgggctcatctaatagtagaatgtcgctattttgggctaacgtcattgcgataaaggcgcgctgccgctgcccgccagagagattggacagccgccatttagccaagccctcaagattagcggcgataagcgcttgtttgattgctgcttcgtcttcggcctgcagaccgtgtaatggtttttggtaagcaaaacggccataagcgactaaatcgcgtaccaacgtgtcttctggagcttgcggattttgcggcagactggcgatattttgtgctcgtaattttggtcggtaatcggtgagtggtttgccgtttaaaattacggtgcccgcagcaggttgccgaaaaccggaaagtacattaagcaaggttgatttgccactgccattggggccaattagtccaatgatctggtggtccggaaattttatatttaaatgctcgatgatcatatgattcggataaccgatgcataagtcgtgcccttcaagttgtgtcataggacgttccctccttattttagattgaggtgagaatacactgatcaattttagttgctgttctggtgctcgtttttgaagtttattccctaaacaacgcagcggcagttaccgcagaaagtataattccagtctaacgaaaaagcgcttcattttaaacgagaataggaagacttttagataatgatgagctaaattagtttaagattaagaattgattaaaatgcatctgtttagctattcattttagcagaagaaacggcggctggctaggctaaatgaaaaaagttctcaattagaatgaggattaaataattcttattcatcctcagaggcttttcacttttaccgctatctgctatgctaatgaacaggaaattagtggcaaccaagctggtcatggctgaagctggtcctgagtggcagcaactttaaaaaagaacgagatcggagtaggtataatggtagaaaagaaaacgttggctgattatgaagtcgatattccaaaggtaagtgagttactaagtgatacaccagcaactaaaaagttctttgacgaattaacgccgggttaccagcgggaatgggcacgttatgtttttggcgccaaggctgaggcaactaagcaacgccacattgacgatatgcgcatgatcctggatgctggctataaatcaaaacgcggctacggtcagcgggctaaataattatctacaacgagttggcaaatgctgactcgtttttttgttttaaagtatgccaggcctaaatgatgggccaaagtgttggcgatactagactaatacgtgtgtagtgcctttaacatcgtttctgcaaattgctacgctgtcaaacgagtatcatgcaagtcgtgcgtcgcttgatttttctaattggaatagcagtaatgtaactaacatgaacttgatgctcaatgacatgatggcactgaaagaacttacagttggtcaaaagttcaacacaacgaacttaacggtaccaactgataaaaaactagtgctgccgaatacagttgctagttctgaccttacccaagcaaagatgtggcgcaatgtagatagtactcatggtgggtctgaggcggtaccagtgggagaagagttcactgcagcatttaattcagatagctcagcgactgattatacggtgccagatacctatatcctaaccacaaaagatgaaattggtatcaatgtgttcgtcaaagatgatagtggtaatggattagcaaatgtacaagttgaattaacgaatggaactactggcaaagtaacgactgcgataacggatgaaaatggacaagtaacatttttggcgcaggatgcaggcttgaattatacagttaagcaagtaactgctattgatggctacattaaaactgattcagatcaacaggtgatcacatcgttaaatatggctaataatagagtgacttttatcaataaatatgacggcatcacgcctgacttaccggtcaccggttccgccgatcgtttatggctgttgatcgttatgacactaattttggttagtggtggtgttactttaatcatccgcaccaaacgtcgtcgtgagcaaaatattgctgaattgaagaaactgcttaagtaagtaaggactaatttaagtagttctagtatttaaacagtggtgctgaatgaaatcagtagcgctgttttttatttctagctttaattctaagatttgatgaattagaacaaaaaggcagccaatccgagaaatagttctcagattggctgccttcgctgtttaactttgttcacaaggcagccttaagcagttacagtgccaacaattgcgcgcgcaactgtggatcggttgcataaaggtataaaccgtagcggccgcgttgcagcaaaacattgatcgaattaagaatgatctgctgtttgacttgtagagcttgttgcgcagtgagatcagcgcggcgtttaaaggcttcgtggtcttggtatttatcgggtaataattttagtcggttggttgtggcgtcataagtgactgatgggcccaaaataacaccaacatagttaaggtcaaagccttgaatcgtatagattgaaccgacttcatttaatgtttccgggcgctctgcccaagtgatatttgggtccatgttcttatcccaaggtaaccgaaaacctggcgcggtcacgtaataggtctgaccatcgagcttgtaaggaaagtcggctgtggcgaccagccgcgaaaggccatattcgtgatcacgttggcgcaattgctggtacatttgattggcatcagcgaagatccgtaaatcaaaactaggatcagttggtcgtggcaatagttgaccttgtgtgcctaatgcagttaaccactgttgtgttgctggttgggcgcacacgcggaattgttgtgttaaatgaaaaacttcgtggggctgttccgctaataatgctgctaacttagtctgatcccagtagcttttcatttttaaaacttggtgggtgtcgaaaactaaaataacaacgcggctgtgtttgcagatctcagctagttgattttcctgattaaaacgattgtagcggtcgcttttggtcaacaataagtgagcttcgtcaactaaaacaatgtctgcgtacgtcgcatgtttggtcatttggttgatgaatggtgttggcttcatgaagtcttttttacgcaaatttggttggtcagccgcaatttgcttgtaagttttcagcatttcgggatggttgactaacaaatagttattggtctggtaaaaagggctggcagcgtcattgcgggcctgctgaaggctattcattagtgagctgaggaccacacttttgccggtaccagcagcgccttcaatcacaaataaacctgtttgcggtgtagttaattgctgagtacaaaactggaatactcgttgctttagcgcttgttgctgcgcggataattttgtttctggagctaacttggttgtagcggtattttctagcaatgaattcagcctgctttctgcgactcactcagcacagaatctagggaatataatgattgattgctttttgtaagttgtgtatatcgagtaacgtaatttctgggaagattttgaatacgaaagaagcaaaggtatcgtgatgatacttgtaattcatttttccaatcgtgtaactagtgtcagcctgctggcggcgaacttcaaggtcgtagctggcttcggggtggagcacgatatatgtatcggtagtgatcggaatagcttcaatatgagtgtcggtaatcggcataatgctcaacttctttccaagtgatagccccatcatacaaacatacgttctgttttgtcaagctatttccgctaagaatgagctaagtttctcggcgcgtgatttacccaatatgtccgtaactccataagaatcagtgtacaaaaaaagcactagcatcgcaatgccagtgcagtttaaaaactatagatatttagcgtcaaattcaggatcttgggacgttagaatttttggaccgtctttggtgatcgccaaggtgtgttcatattgtgccgccattgaaccgtcttcggtgacgtaatattcccagttatctcgcggtgtcatccgggtcgttaaatgccaagtgccacgcgtgatcatcggttcgatggtgattgtcatcccttcgcgtaaacgtaaccctttaccggcttcaccataatgaggcacgctaggatcttcgtggatcgtaggttggataccgtgaccaatcaattcgcggacatcaccgtaattattttcaacttcagtatattgttggatcgcatggccaatatcaccgatccgattgccgatcactgcttgatcaatacctagatataaagcttttttagtaacttccattagacgttgattttctggtgagatttcaccaaccgcataggtccagcaagaatcactttcgtagccgtcaagattaacgcacatatcgactttaacgatatcgccgttttttaagtctaagccgcgccgtgggataccatgggcaacttcatcgttgacgctgacacaagtggcatatttgtagccatcaaaaccgatttctgaggcagtagcgccgtgtgattcgatatattggcgcgaaaatttttcaatttcccaagtcgatagccccggtttgatcaagtcgcgtaggcccaaatgaacaccagctaaaacagcgcctgacttgcgcataccctcaatttcacgtgctgattttaatgtaatcaaaatagtagcctccataatagtaatctctatcattgtaaacttttttcgtaaaaataacagcacttggctgtataatgagatcaagcgctaccgtggattaaattgctggtaattttgccattttttccttaaaataaaaattaaccaagcgttagtgcttattattcaataataggaggacacattatgaaattgatcgaagtaccagttaaagttaatgctagcttacgtaaaatgatccctaatacgatcgcgtacctctatggtgattcggcgatccgctattttcgcaagtattcgctaggtaacaccagcgtccactacgtcgataattttgaccatttagatgtgatcctgaccaacagcaatcgccgcatccgcgaagatgaaattaaatttgtctgcgagcggctgttaccggggcaacctatcagcgaaaccacacgcttcagcaaagatgagatcgaagcggcgcggcaccacaaaatccgctcaatgaaggatatcgtgatcatcgaagcacctaatccagcagaatagacaaaagtaacagcgtcaatcgcacttcaattgcggattgacgctgtttttatataatcgattgaagcttggtacatccgatatttctactaattggcttaaaatagagccttgtttttccgtgctgccaatttctatatttccgtgcgcagtgctgttagacttaaattaagccaaacacgaggaggaacacggatgctgcttagagttgaaacgatgactagcgaggttttctacatcaatgagaaccagatcacctatatcgagaagttagatgtcaccaagtcagatgaaaaaagcgcttggcaagtacatctagctggggaatcgcaggcaactttcagtgttaactacaatcaaatcacgcgccggccattcaaataaagattgcgcagataatcgggcaaaaggttatctgcgcaatctttttaagttcttgcgtgaatattttcttgcgtagctttttaatgtcaaactgtgtcattggggtttgctaaactttaaccaacgaataaactttggaggtagagcgatggcagatgaaaagaagttccccagcaatcagcgtattcttgatcttgttctacgcatgctgaatggtgaaataattacgtttgcaacgtggaaagcctactatcatggtaatgatcatgctaaacgtacttttcaacgagatatgcaagatattacgcatgcgttgaaaaagacgaattctaaacagcgtttggtcaggaagcatgatgaactgcgatcagaagacgagcgaactgaatacagtatcgtttgtactgccgtggaggatacggatgttgatcagcatccgcaaaatattggctagagttaaacgactaaaaagcgtggcaccaaggaaatcgacataaatctccttggtaccacgctttattttaaactagtttattgattcaaaatccaaataaacagtacaaagacaaagaataatgcgtacattaacgggtggacttctttaccgcgtttagcaaattaaagtatttaagctttgtttatagattgtttaactcgattggtgattggtacgaattgttaaaacatcagtgattgcatttcgaataacgtaatcagtcactgaaccaatcgtaatctgagttaacaaatttctgctagttgcagctaatataattaagtctatgtgatgatcttgactgaaatcgtgagcaataattctctttgggttgccgaatcgaatatgaatatcgcaattcggcacattcagatactctgcctttttctgtaagtaagttaaatgcttttctgtttgttcaaaaattttctgtgtgaaatcatctttacttttagccgaatcgaactcgtaatttttattccagatgtctaaaacacttaataataatatgtgtccgtgattcaaatttgcgatatgaacagcttcgttaaaagcttgttgtgcagctttaaaatcgtcaatagcaactagaatatcatgatatgcttgtaacattattagtagcctccttagtcgatatatagccaatattcctgatgatgttattctggataattatattaggtgggattaaatatgtttacatatacgaaatagtaccttgatattaggaaattctttctaatatcaaggtactattctctatagcaaaaaacttctttttttagatatgtctagcttaataagcatcgtcgataaattcgacattctttttctcaagtagtttgttgacccacgaacgatctgttgctccagctgaagatttttgcactttagcggcatcttttttagcgttatcttccgcagcatcaatgacatttggtgcatcctgctttggaattacaattacaccatcagcgtcacccaaaataatatcacctggattgattgaaataccaccaattgcaattggtacattgacttcgccaggaccttctttaaatggaccgcctggtgttgagcctgtggcatagattggtacatcacgctttgaaatttcatcaatatcacgaattggaccatcaattacaataccagctacttttttaaagtcggctaagtattcatacataatcaaacccataatagattgactacgatcaccttcattggataaaacaatgacatcaccaggttgtgccatgtttaatgcctgatgcaacatcaaattatcaccaggacgtgctttgactgttaatgcgacaccacacatttcttggctcggtgaagactgcaatttaatatcagaatgcaaggcacagagtcgattcattttatctgccacatttgcagcaggtaaagtagaaaaacgtttaactaatgctgagtcgggtaagttacgcttcaaataaacacgatttccaatactcataataaataacctcctagtttttttagaaatactctactttaaatattctgttgttcagctaactgcttgattagctatgaaagtaaaatagctggtaagtaattgttcagtcgttatatgtttgggcagtgtcccaatctattttttttactggccagcttggggttttaccttcgtagacttcttcgatgccttgtgcggattgataggaagcacggttagcggcctctactgttgccgcgccaatatgtggtgcaataactacattgtccatttgcaataatggattatcagcagggattggttcttctttcattacgtctaaaccagcacctgcaattacttgatgattcaaggcatcaactaggtcatcttgatttacaattgggccacgagctgtattgattaaaaacgcggttggcttcatttttgccagtgcagttttatcgataagtccttccgtgattttagtctttggaacgtgtaaagagacgtaatctgattctttaagaatacgatcaatgtcacgaacgacttctacaccttccggaaaatcttttgcaggcttatatggatcatatgctaataccctcatatgaaaaccgtctttacatttttgagctacgcgtgagccaacattaccgcaaccgataataccaactgtttttccttctaacatcgtttttggagttcgcaatttagcagtgtaatagtcctctacaaaacgtttttgtactttagtgaagtttcgtgatagatataacatatagaatactgctgtttctgctactgacatggaatttgctgtcggacaatacaatacctttacgccaaattcttttgcagcatctaaatcgactgtgtcgaaaccagcaccatgacgaacaacaacttttaattgatctgcagcttcaaaaacttcacgggtgattttagacagacgaactaccattgcatcgacgcctttgatgtcgtgaatcacattttctgtctccataccagagcctttaatcaagttatgcccatgttcgattaaataatcactgccgaccttttgaattggttgtggtaataaaatattccagcccataataaaattcctcctaaatttaatttaagcaatattgttaccaaataccgattaatttccagtatggtaaaccaataactaagaagataaatagtgcaacaatcgccataacggtcccaattttccaaaattctttttgagagacataatcagaagcaaagacgattaagccagctccgttgccataatgagttagtaacgcaccatatgctacaaagaaagctaataataatgataaaacggaaaggtttgctcgggtatttgctgccattgacaaaataacgggtaaaaacgaaactgcaaatgcactggtggaaacgaagaagtaacgtacaacaatgctgatcaataataaaatcactgttactagtaggccattaacatgtgataaatcgactgctttgctcaaaacgtcggctagccagttataaaaaccgccatcagccaagctagaagcaatgccataaaaggcaccgtaccaaactaaaatattccaagcgcctttaacgcccatagcatctttccagttcagtaaaccagttaaaaatagtagacctaagaaaacgaatccaaccgcttgagttgataaagcaataaaagttaattttggtccgaaaatccaacctaaaattgctaaaatgaagataataaatagtgtcttctcttttccactcattggacccatttcttgaagcttttgttgcgcttgcttctttacatctgttaattctgttagctcaggtttatagagcttatatactacataaggtgctgccaacaggaacaaaccagctggcaccactgctgctaaaaaccaactggtccaagtcagatggatgtgggccatttgtgcaatcagtgaaaccgaaatagcattagttgccatcccagtcataaaaattgcggatgttccttgcgaactaacgtaggatagaattgtgaaaaagccacctaagcgacgtgggtttttatttgggtacgagtcaacaccttcggcaatattttgaaagattggataaatgattgaaatgcgtgccgaattagaaccagttgctggacttaaaatcagatcggctaaaactaacaagtagcctaatcctaaagtagaattgccagctcgcataagtagattataggcgattcgattacctagtcccgttttaatgaatgctgttgctacaatggtgacggcccagatgaaccaagtcatgtcactgctgtaacctgacaacagcatttctggctttttaacaaacaacattgcaaaaccaacaataatcaatgtaattaccggtgctggtaatggtttaattatcaaacctaacaatacagctagataaattgcgaccatatgccaaatttctgtttttaacccggctggtgttggaatattccaaatgatcactgttagcactaaaataaaaactaacttaataatttttttagttgttattttcttttcagctgctgcatccatgttgtctctcctttacttaatcattactgtaatagttattattcgcgaatatatttcttcttgttaatagtcgaagaagtgagcatgctggagatctcatataaaataactattgctcacatataaatgtatacgctttcttgacgctggtctaattgataatttttacgacatatagattttatctatatgtcgtaattgaagtggtgttttttattaggtaaaaatagtatgaaaggatagatgattaaagaaaactcacttaatagtagtagacgtgattgtgtaataatgtttatcaggaatatagtctgagaaaatagattatatctagtgaatgctttaactatattagtctatctattcataaattgaggtaataaaaaagtagctcattccgttttgggaataaactacctaaataacttttatatgcttaacaaggcgtgcttttttgtctgtcgttttacaaaatgcgtaaattcggatactaattgtgattgatatgctttttttaaagttgccatgtataaaatcctgtttgatgcaggtgcagttaaagggataatttttatcggcagtgattcgagggttcctacataaggtactattgcaatacccaaattatttgaaactaatccagaaacagcctggatgccttcggcgtaagcgactactttagggtgcttatcgatttgtttaaatagattctttactagtgaataagcgccgctacttggtgcaaacataatatgatcatatttgattgtttgttctaaagtaagttccctttttttagcaagtatgtgattatttggcactatagtaactaagggctgtgatattactggaaaaaagtctatattttctgggtcgttaattttagcgcaaaagcaaacatcatagtttcccatttgcaactgttcaagcatatcaggagagtaacctgaactattactaaaacgaaaattacttagtttagcttgggtgtcatcatttaaaaaatcttgaactaagtggggaacccattgagtactcaaaacacgtaatgaagcaatacgaataactgctttatcgttataaagtgatcgtatctttgcaacaccattatcaattgtgattaaggcgtgctcaacttcatgagaaaagatacgaccgtattctgttagtgtgacagaacggccttgtttcttaaataatggtacttgtagttctaattctagtgttttgattgcattactcaagctgggctgagtgatatttaacttttcagctgtgtaagtatagttctcgtatttggaaagttctagaaaatagtgcaactgtgctaagttcaataatatacaccttcttgtcgaattgataagttatcgaagcggttaaataaattctatttatgaactaaatgacgatacctttattaactatataaaccctatcataaatagcttataaaatcttggagtttaagttctatttcttgatctcgctttattggaaatgtaggagatgaaaaagagacaatgccataaattattatggtattgtctctttttcgtggtctgctaataatgcttggttattgattcaaaatccaaataaacagtacaaagacaaagaataatgcgtacattaacgggtggacttctttaccgcgtttagcggcgatcatggtgattgggtaaacgatgaaacctaaggcaattccgtcagaaatactataagttagtggcattcctaagacaatcaagaaggcggggatggcaacctctaatttgtcccattcgatttcccgtagcgattgtgccatcaaaacaccaacgatgatcaaagctggtgcagtgacttggctggtgacaacggttaataatggtgagaagaacaaaccgacgatgaaaagtaagccagttgtcaccgcagttaacccggagcggccgccaactgcgatgccggccgaagattcaacgtaggccgatgttggtgaagttcccagcaatgagccaactaacatggagctagagtcagccaacaatgcgcggccaacacgaggcattttattattgaccatgaagcctgcttgttcagccaagccgaccaaagtgccggcggtatcgaagaacgtgaccagcaagaaggtcagcactactaccaataattgcaaggaattaatatcactaatatgaattgcaccgacgaggaaagtggatttaatactaggtgcactggcgagaatggcgcttggtgccgcaatcaaacctgtgatcaaaccgataatcgcagttgcgaccatgccgataaaaattgcgccaggcactttacgcaccattaaaatagcggtgatgatcaaaccgaagatcgtcagccaagtcgtgccaacgccaaatgaaccgagaccgacgacagttgatttattggcgacgatcaggccaccgtcatgtaggccaagaaaggcaataaacaaaccgatcccagcagcgatggctaattttaaattacgtggaattgcgttgatgatcgcttcgcgtaattttaagaccgtgatcaacatgaaaatcaatgaggccacaaatacgccggctaaggctgtttcccaaggaattttcataccgataacaactgagtatgtgaagaaggcattaacacctaatccaggtgcgatggcaatgggatatttagcgagaacacccatcagaatacagcctaaagcactggctaaagctgttgctgtgaaaacagcccctttattcattccggcagcgccgaggacggttgggttgacgaataaaatataagccatggaaataaaagtggtgaagccagccaagacttcacgccggacggttgtatgtagattgcttagatcaaagtaacgcactaaagtttctttcacaataattgccccttaatggtaaaaattaataagtgatcacaagaaatcgttcgtgtttatcttgcttacgagctaatattactatataacgttcgttattgcaatataaaacttaataatttgtttattttaataggtaatgttaactgtaactgagttaaatggttaggaaatgtggatttatagtggatttagattgattatacgaacaatgctgtagtctaaactgctgaatccactaaatacatcaacggcgctaaggtttggtatactgtcactaggtaggtgaatgcaatgtggcaaaacggtttacagtgatcgtgccagtttataatttagcggcgtatttgaataagtgtttagcgagtttgcaagcacagacgtacacgggtttcaatgtttggctgatcgatgatggctcgacggatgattctgtggcgatcatgcaagcttgggttaaaaaggactcgcggtttcatctgtggcggcaaccagctaatcaaggtgtttcggcagcacgcaatgttggcttgcggcaagcacagggggactacatttgttttgtggacggtgatgattggtgtgagccaacttatctagctggttttgcggaacagatggcacagccgcaagttgatatggctctttgtgggtattccacggatgatgatcattcgactaaggcgcaaaccaccaagttggaacataacggcttaaaggtgttgttaggtgacgataggcaacggatgctgacgcaacgccaaatgttggctactgtgcttaaacctagtggcgatattcgggggttcttgtggaataaatgttatcggctgggcgtgattcggcagcaacatttagtttttgacgaggaaatatcgctattagaggatcaattatttaatgtcgcgtacgtcctacaaacgcagcgtttttattatgtagccacaccacaatatcattatgtgatgcgtgagaatagtgcgatccataaatggacaccgcaaacgctgccagcggaattacaggcgttaagtcgtatccagcaactattgagccagcacccagagttacaatttagccgactattggcgcgccggcgcaaacagactcgccacaatctggttgcccgcttgcatcaaccgaccagaaaataagatgggaatggtttgtttatggtagaaagattagattacacgcaacaaaaagcatggccgtttactagtggtcaacaacaatcgccaattgcgctgacaatggcacctagcgatgtgatcgaggctgccgatttgttcgaatggcaagtgccttattatggtgaaacgcttagcgaccaggcaaataacatgcagttggctggtactggcttcgcaaaatttgatcaccgtaactatcgcttcgttcaactgcattttcacgcaccagccgagcatacgatcgaaggcaaacaagcagcgatggaatggcattttgtccacgagaacgcactgggtcaaaaagcagtagtggctgtgaccgcggtgattggtaaagaaaatccgcagctgaatcaattgttagcggcttttatcccgaaaacagctattccgttaccagaggcgatcttattgacctcattgttaccgacccgtgggctgatctaccgttatatcggctcactgaccacaccaccgttatccgaaggcgttgaatggtttgtggccgctgagccactaaccatatcggcggaacagttaaccgaatatcgcgaactatttccacaagataataatcgtgaacgacaaccgttaaatcagcggtcggtaatgggttatgacatcagtaaaggacacacagaaaccgaattttaattaagttaaaaagactgaccagttaattttcgcgcgttttataatcaagttagccaaatacttttagctaattgataaaataaaaaacaccaagacaaatctctgttatcattgatgctcctacacaaacaatgaaagaggttattgtcttgatgcaagaacagaataccacagtcagaaaaaaaggtcagcacctaacttcgtttgaacgaggcagaattgctacgctgcacagccaaggctat

SEQ ID NO: 483 - DNA, 8151 bp, Unknown
  Metagenome-assembled genome
agtttttattacgacgtcaaagcgccaaagaccacaacgacatgtcaacttcgacaccactttaccagaaaaaagcaaagtggtgaaccacgattccgtcgaatcatgattcaccactaatgttagtccgtttttttcattgaattcactccggaataatggtcaacagtcccataccataggctttttcacgaccaagtccatttactaaagtatttttaaaagtacttagatctgtaatttctaattgaccctcaaaagaaactcgactaagtttgacagtccggttaccacgtttgtgtaaaatcggaaaatcacgactaacaatatctacattatttagatttaacgctgcatcattgatagctaaatgctctttagacacaaatttaaagccagattttaaagcacgagaacctaaccattgtagctgttggtcactagttatatgaggatacactttaccacgcttacctgattgagtgactgaatacgtgggatttgcagttaaacgaaactgcgctctcattccttgttgaagatatgacaaaaatggatcataacttttcacttgtgctgaagaggcaataccatatcgcgctaatttttctaaatttggtttatgctcacttactaataacaaaaactgatgtttatcgccatcattatcttgtatagtatctaaacgccataagtgtcgcgagcgataattatcttgaaattcagtttcaaaacaatgttcaacccaattatgataagcacctaggtgcgtcaagtccttaatttttcgtctattattgaaatcaatttctactctcgaaaaatacataagcgctccctcctatagctgatcgaatatattatgagttgtcttagaaatagtctgattttttgttactggggccatctgttgtcctatttgactaatctctcgaaaactatattgccgcgagcgttggtcgaaagataagacatgatcacgtaccatccagcttctatgacctggtaataacgttgcatctgctatgatggttgcctcataattatgttcttgacgctgaaaccacgttgcagcctgccatggtaattgttgtagtgcagtcactggatccatatcatcaaaaaacttgcaacgtaaaactccagctggcggattagaacgacgacctaaaaataaggaaaatcttggatgcattaaagcatattgaatggcagaaatttggtcgacttcaccaccaatagctactacgaatactgcatcttgtaaatattcacgataagtcagtttgcgtgtatcttttttccactcaacggtttgaaattcattaagcatttgtccaggctgatcaattcgtgtagcaaagcttaatttattaagtggaataattctagaatcagtacgtttgtagcccaatgcagcagcaatcattccaattactgcactcttagtaggataatcattggttgttcgtcgagcaaaatgtgcatcattgccatacgcctgcaaaggtgcagtcaatttaattgttaatgttctcattttcaatcaccctttgcaggtacgttttaattcttgttaacagttcactaaaatcagtaactgattctccttgcactgctttagttttacttagaacaactgtcaacataggatcttcaataaatttttgtgtcacttcatattcattctctaaacgtttaacagatggttgaaaataaccatgctcagaagacacaggttcttcaaaagcagaaaccagatttacaggtgtatctgtatgcagcgtgaccataacatacccaggtaaagttttgttagcaaaagtattttgcttaccagtcggcattgacaatacaaaagtcttaatatagctcaacgcaccctgaattgctgcctgtacaccaacattactttcaagttcatgaaagtttaaattagcataacggtaaagtgttgcggaattatattcgattgagcccaacatagcagcccctgtagtatcatcttcttgaaggtcatctaaagctgtaaaataatcgtattctggtgtgatttcatgagttgatattgcatgtgctacttgagctgatgcgtcaacatttaattcgggattatctgcaaccatccggccaaaaagtgcaagatcaagtgattgattgccttttaaaaccttggttacttctttcttatctaattcatcatggttcagtgcatattgtgctaatttatccacttgaccttggctaatcattaaaagcgccccagtttgataattcttatcaaccttaatttttgcagttgttagtactgcttgtgctttttctaaggcactttcttcgtctagctcggtatttagttgttgcagtttacgcgatattaaaacaactgcatcttttgtgcgaattcctgtttgattgagattatccttattaaacgagattcgcattgctcgcttccaactttgtgacgatacacgagaacgagtaactccaccgtatagtgccgttttaggtgcacctgtatcatctcgatttaaatttgctgacggaacactttgtaagacatggatatctataaataaattattagtcatcattaattatcctttcacagtgaattcttcagagatacggccataatagtcttgcccccaacgaacggcaacgcgacgcgcctgttcaaaacttaattgatatcgatataaatcagcagctagtgctggataatcaatttttattgatctattttgggctttaacaatggctattatacgggccaacgcattgattgtacccgttatattagtcatgcctaaaagtgtggcaactcgtcgatccaaacgaacttgatccttttcactttgtcgcatcaatgccaatgccttgaataaagtcaaagcaccattatcgttatcccatgaatcagcagaaactaaagtttgctgtccctgttgatgttgagcataaaaatggacggctgaaaaaatagctacttctgcataagtcggttttcctgactgactcaacatgtcttcatctaatagcttaaaaagtatgggccatgtgaccctagccttatagtcagtaatactagttgagtcgcgaaagccaaccaaaatggctttatcaggatgaccattttggtatagctgtaagattactcttttagtgacaccacttattttatttaccaaattttccacctcacttttgatttaactcctgattaattctataaaccaatcgattatatgcagtaaagatattactcattttattctctgtagtaacgcaaccgatacgatctcgcgatgttgctgatgacattagaccatcagcacaatccaaaacaattgatcgtaatatttgctgccaactcattattttttcatcgcgatcatcttcattagttaaactagaaagccatattttgaacggcttattcagctgttcgtaaaattttgctgattctctgacgctgaactcatttcctgtcatgtttcgaatttcactgatagtttgtatgaatttccgataagctttgccgatgcgatcagttaaatcaattacctcttcaattcgtccaggccaaaactttgcggttcgagggtcattatcaaataatacagctgctgagatttccatatcatcaatccattcagctactggcgactgagaagtcgcattcccatcactgatcatcgctacggctcgcagatttatcaacgtttcagctttgatgaaatgacgctttttcattagcctgatccaggtcacaactccaggttgattatcaccgccatcatggttaacatcgacgtaatcgccaaaatttcgccacattgctttactcagcgattttattgacttgacagctggacgacgaacgtctattttttgatcatttttaacagttttccatacggtcattggttctagtaataaatcatctgtatcaaacattggaattccagcactgaaaatcacgggttgtccagcatcagaccattctagatgtaacaaacgcgtccaagtcgtatacaacgctgctaagttctttggttgtaattgttgcttacgaaactcaatataagtcattacatttgaatattcccaaactggttgttgcatcacatattcttctgactgtgaatcaactaaaacaagattaaataataagatttcaaacaaagatcgtccattaataaaaacaggacttaaactgtacaaccatcccttactacttgcaaatttatcttttgtctcaatcttggtcttatcggtaactccagtaaaattttgataagtgatcatccaacgaatcaaggcgggtaaagtgacgctgtttttatatgctgtcgttttaggcgcaaacaacgctggcgaattattactttcagaaataccgcgatcgatttgcttaattgcaactgtacctttgcctgttgcaacatgtttattaactggtaccaagctatcatattcaatttgagtagcctgataaaaaggatgctctccgaaaaaatcaaatcgagattgatatgcattcagataatcaattacagcggtggtaaatgcttttcgccggtacaaatcattccaagtctgttctagatcatcaggttcataattaggttcatcaatcgattcaacttgccatgatgacttgtttaatgtgagccatgaatatggttgatcagttacagcaacacgagaataaactgtctgcaaaatggctaataagaaacgtagaattgctagatcttgagtctccgtatcaccagccagctgacgatattcattagtattttcaaaaagttgttttagcgaaacactgtgtatttcgttactacttttgacaagtactttgatccacggttcattcactaagtcaaatgattgtctaatcattgtcttcccccttcttaataaagcttaagccataacgattagaataagtaatatcactatccaagaacgtggtatgactattttcgtctaataaaagtacaagtgtgccctttaaccaacgactttcttgccaactagcaaaatggttggcagttcgctgttccaatatctcaatagctttagaaatttgtccacgtgtgatcgcattaggtaaacggacgacttgttgcgcaatttggcgcgcttctgcatctaataaatcaacagctaaagactgaccatttaataaggtaacgtgctggccctgcttgatcaaaagaacaacttcaaatgattcttcaatatcacgtactgccgcattggcacgttgttcgtctttatctaccattgattgtgcctgctgtagccatccatgtaaatcagcgcgtcgtcggtaactcggctttttaattcgatatgtgttggccttttcttttgcttgagctattcttttgtcaaaaacctgtttttcttctactaagccaacaatatcaggatcatttttggaatcataaactgcttgaactaatggagaaatatcgtctggtaatactaaaattctaggtaaataataatcggtcttcatgagtaagtatcgttgataaattgcttcattaccttgtccataatggtgatcttgttcaattcccattacaatcaaatttggcgctctcaattttattggtcgcttacgttgatgccgatgcagccgaccagcacgctgcaacaacagatcaatcggtgctacgtctgtatacaaaatatcaaagtcaatatctagcgactgctctaatacttgcgtgccgatcacaatcattttttcaggtcgctgaccgttcttaccaatagttgcttgaaggcgttgttcaatagttgctctatctggtgccaaaaaagcagagtgtaaaacgatcataggaatatctactggtacaagttgggcaatagtctgcgctcgtttgactgtattgacgatgataccagcaattcctccaccatcaagtttcgctaaaatatcatcaattagagcttcatcggctatcgtgaatcgttcaacagttattcgctgcttttgttgatcattttttccaatgaattgagtgatttggtttattttattcccatcaagcattgttactagtggataagcatcagtctcttgccaagaattatccgttgcttgaatttctccttgattttttccagcagaataagcctcaattagagttttccgctttgcttttggtagcgttgctgataaaactatcacgggaacatgataggctcccagccaattcagcgttctatatagatactgattcatataagcatcataggcatggacttcatcgatcacgattacctttttactaagaccgatatgttttaaaactaggtgtttttgttttaacgataataatagtaattgatcaatggtcccaataacaaattcatcgagaattgcctttttcccagaaaaccattgattaataacaatatttgactgtccttcatcgtccatttcaagtgcatccttagcatcaggtaaattctgatacccttggttaaactgagatttaccatgcatcaatttaactgactgtgaagttgcattttcacgaatcaaatattgcatccattgtgtaactcgatcaaacatcgcatctgaggttgcctgcgttggtaacccaaagaataatccgttttggccttttttataggctacttgttctgcggccaataaggctgtttctgttttacccagtcccatcggtgcttcgataataattattccaggatcaattgctgcttcgatggcttcagtaattgtgcgttgaactggtcgtgctgaaaactgccaccttatttgatacggatctggtttgagactaactggttgcggttcccattcattagttaattgccaagttaaccatgctgattcaaaacgctgttcttcatcgatatcatcgactccacaactaattttgatcaatggaaataatggcttattaatatcatcatttaaattttcactggaagctagccaatcagccacaatcaaaagcccattaagtaaaactgcttggacctggtcaatttgcggaatttcttgactacttttaaaccccgcactggttaatccatactcaaacagctgtctctgtacctgctgccaacaggattgaaccgactgatcatgatcactttgccaataattctttgtatgttgctcaatatcctcatcaggtgtttcattaagcggtttaccatgatgaccaccaactattgctgttatagaagctggtactccatacgctaataaaattgcttctccagctagagcatggggtgatgccttcctagatgctaattgtagatcctgtaaatcattgaatccagaatgtactaatttcattattaattcattatctaaattattattttcttcagacgtattgccaaacgacggtttagtttgcatagctggagttgcttttccgatatcatgggtaagtccgataaaactaattagagataatactttctcttcaccgaaattcgtttctagcaacctacgttgactattgcttaaccagtgattatatagttggacaattactttttcagtatcttttaaatgtgtcagcagtggcagccaatatggtaatccatcaatgactcttttcttagcccataaagctttcgtttttatattaaaattatttgttattccaaccaccctctaattattataatagaatcataacgtttgtttattatttaagcaagcgttttcttcaatgaatattaaaattgggcctctgagagcgcaatcaaaaatactccctatcataaataatgtcactaaacttaggtcggttgacaaatacaagattagccaagattgtctttgtcgttgtaattagcgtccaaacttaactattttgatttcttgccaaaattattcagcccaaacaaacaataaccctgaattattcatagttcataaaaatcccgtcagttttcgtattttttcgaaaactgacgggtatgtctttatcttttgctgaaatacgatgtttatcagttctagctagtgagatctttcaactaactcagaattgctttgaacttttggatacacttgtcccttggttgtacagatttttttaattttgccggttattcaatagcctg

SEQ ID NO: 484 - DNA, 24855 bp, Unknown
  Metagenome-assembled genome
tgatggtatctttagattgggtcatgaagtccgtcctaacttattggttttgtcacttataagtttaaggcttcatggcctttttggtctagttattttggtgttgcacttacattgtaaatccggcataattagtgatgcagctaaacttataaaaaagacttgcaatgtccgccgatttcagataaaatatttaatgttgaaaaacacatggaggagtagcgaagtggctaaacgcggcggactgtaaatccgctccttcgggttcggtggttcgaatccactctcctccattgattgggatatagccaagcggtaaggcaacagactttgactctgtcatgcgctggttcgaatccagctatcccagtaattaaagcgtataacggttgaactaaaaggtgacttttggttcaaccgttttttttgtcgcaatattagggaatttatctattgtttcttcgcaagtaatggccatacttaaaattaaggggatattataaatggcgtactgggtgtacgtatttgtcgtagtcttagttttttaaggcgctgttaatgtctagaaaaggcggcgcttcagcgtcgttattgttaaggaggtaacttgttgtgggacagacaatgtttgataagctgtggaatcagcacgtagtcaccggtaaggctggtgagccgcaattgatctatgttgatctgcaattgatccacgaagtaacgtcaccgcaggcgtttgaaggattacgggaaagtcaccgcaccgtacgccatccggagaagacctttgccacgttggatcataatgtaccgactgaggatatttttaatattcaagatgtgatctcgcgcaaacaaatcgaaacgctagaaaagaatactaaagagtttggcattcagctggctgatctcggcgacaaagatcaaggcatcgttcatgtgatcggacctgagttaggcttgactcacccgggaatggtgatcgtgtgcggtgattcacacactgccacccatggcgcgtttggctcgatcgcatttggtatcggcaccagtgaggtcgaacatgtcctcgccacgcaaacgatttggcaaactaagcctaagtcaatgggcgtgcatgttcacggtcagctacctaaaggtgtctacgcgaaggacatcattttaggcttgattgcacgggaaggtgtcgcgtttggaactggctatgccatcgaatattatggcgatacgatcgatcgtcttagtatggaagaacggatgagtatttgcaatatgaccatcgagggcggggccaaatatggctgtatcaagccagatcagaccacgtttgattacgttgccggccggccctatacgccgaaaaatcttgcagcggcgatcacatattggcgacaattctacaccgatagtgttgctgactatgatcaagtgatcgattttgatgtcagtcagttggcgccaatggtttcatggggaacgaatccggggatgacgattccggtggatgccgaattgccggccaatacggatgataatacgcaaaaagcctacgactacattgggttagcgcctggtcagaagattaccgatattccgatcacctatgcctttttcggttcttgcaccaatggtcgtttatcggaccttaaagttgaagcggcggttttagaaggccaccacattgatcctaatgtacgggcgttggtggtacccggctcgcgacgggttaaattagccgccgaagaactgggattggacaaaattttcacagcagctgggtgtgaatggcgtgagccgggttgctccgcttgcttggcgatgaatccggataaagtacctgccggcgcccattgtgcttcgacgaccaaccgtaattttgaaggtcgtcaaggtgccggcgcgcggacgcatttagctagtccagctatggttgcttatgcggcgttgaatggccattttgtcgatatcagggaggtggcgcaagcatgaagccaatgacaaaaattacgagtccaattgtggcggtcatgaccaataatgttgatactgatcagttggtgccccgcgatgcgttaaaggaaactagcaaaacggatctagcagcaacgttatttcacggtcaacgctatctggcctccggtgcgaaaaatcctgactttccactgaatgatccaacacgggcagctgcgcagatcttgatcaccggtgagaactttggcatgggctcagtttgggaacaggcagtttgggcgttgcgtgattatggttttcgcgccgtgatcgccaaaagttttaacgacattttttacatgaactgtattaaaaatggcgtgctgccgctcacactagccgccgccgactgcgattggttagccgcattaccggcaactacagtagtgacgatcgatttggcacaactgacggttcaggcagctgacaaacaatttaaatttacgattgacccgctgtggcaggataaattgttgcagggcattacggatattgaaatgactgatagttttgatgcccagatcgcccaatttgaacaacaacaaaataagaccgaataaagcttaacgagagatcatggcctaagtgattaggtgccgatctcttttttgtatggcggaactagctaaattcatctggttttgcacgctttttcttagcctattgacagcgctactaaagtccgctaggctcaacttaactagataacgaaagtaggcgtaatgatgaaaattgggtttattggtgccggtaatatggcacgggcgatcatggtcggtttgtgccggcagaaatacgtggccacaacggatattttggtacacagtgcgcacgcggccaactatcaatcgtttgcggcggaccacggcttgacggcgatgaccagcaatgcggcattagtcgagcaagcggatattgtgatcttagcagtaccagcggcacaaacgttagatatcgtggcttcgctgcaagatgaattggccagtcatgaaccaattttggtttcagttgcaggtggaatctctttggcacagttacaggaaaactcagacagcactggcttgagtattgtccgggcgatgccaaacgtcaacgtggcgattgggcaagggatgactgctttggttactagtccaattacgcctgctgctgattttgctcaagtggaacaacttttccaagccttaggcgataccactccgttggcagagaaggacttcgcaacttttagcgctttggctggtagcgctccggcgtacgcctatttatttattgattcgttagcgcgagcaggtgttaagtatggtttagacaaagaaattgcaactaagatcgctgcgcaaacagtactaggtagtgcagctaacgttgcggaaagcagtaccaatccgtggggcttgatcgatcaagtctcttcacctggtggcacgacggtggctggtttattagcgatggaagaagctggcttaatgacggcggtagtcaaaggaatcgacgccacgattgctaaagaaaatgccgaatagcgttgaccaacgcttgaagttttggtctataccgattataatgaagttattcatttaaagcaggtgagtatttttagatacgcgccggttttaggtcacgggatttttactgcggtaaaggttacctcaattaggaaaaggtggaataaatcaatgagtacaaaagtgttgaagcacgccacaatttatactggtgacgatatcatcgatgatggttttgttcgttttgatgacaaaattttagcggttggatcaatggaagatttcaaaaattatcctggcgatgaggtaattttggcaactggtaagacgatcattcctggatttatcgatgtgcacagtcacggtggttatggtttcgacgccatggatggtaatgcggacgagatcgacgctatggtcaaaaaaatgacgcaaaacgaaggtatcacgacttactttgccacaacaatgacacaatccaacgccaatattgaaaaagcaatgcgtggcgttaaggaagcggcagaccgtaatccagtgatcaaaggcgttcatttggaaggcccattcatttccgctaaatttaaaggtgcacaaccagaagagtacatcaaagatcctgatcctgaattacttgaccattggaacgaattagctggcggtttggttaaattgatcacttacgcgccagaagatgatcacgccaaagagttcgaagattattgtttagcgcataatattgtgccagctgttggtcacagtaacgctactcgtgaacaattattgaccagcaaggcgagccacgctacccatttgtacaacgcgcaacgcgaattcaaacatcgtgaacctggtgttactggccacgttatgttggaaaacaacatgtacgctgaattgatcatggatggtttccatatcgtaccagatatgctagaacttgctttcgaccaaaagggcccagaacgcatcgaattagtcactgactcgatgcgctcaaaagggatgccagagggcgaaagtgaactcggcggtcaaaaagtttttgttaaagacaagcaagctcgcttagctgatggcacattggctggttccgttttggaataccctgatgcattcaagaatgccttgaagttcaccgaagctgacctttatgacgctgttttgatgagttcagttaaccaggcccgcgaattcggtctagatagcaaaggcggcatcgctgtcggtaaagacgctgatatgaacattatcgataacgctgctaacttgttagaaacatacagctacggccgtcattttgttcgcaacgctgactaaaattttaaacgtaacgagacagagttcgcgattaacgtccgaactctgttttaataaactttcgtcggtagttgctttttaacgctgctttagactatattattcttgattaagatatttatttggaaggaggtccaatatggaatcaccagtctatatccagatccataattcgatcaaacgtgacattgaagccggtaaatgggcagttggcgatcgcattccctccgagcgcgaattatcagtaacgttcggcgttagtcggatgacattacgccaagccattcaaaccttagtcgatgaaggcattttagaacgccgcgttggtgccggtacctatgttgccaaccaaaaagttcaggaaaaaatgtccggtgtcaccagttttactgacatcatgttagcacaaggtaagaagccatctagcaaaacagtttcttatcatgttgccagcccttcgctatcagaaaaagaaaaacttcagttgactgaagatgcccaggtgctgcgaatggaacgaattcgttacgctgatgacgtgccgatcagtttcgaagttgccactgtgcccgaagaattggtgcgtgagtttagcaagccggagattaccagttcgctatatcgtaccttggagcgcaaggccggtttaactttaggtggtgcacaacaaacggtcacggcccaagttgcttccgaacgcatcgctgaactacttgatattaaacgcggcgatccaattctgcggttacgtcagatttcattcttgaagagcggcgaaccgttcgaatatgtgcgtactcaatacgtcggtagtcgctttgaattttatttggaacgttaaaaaagcgtccattggctaagctgtcaatggacgctttttggcgtgtgtttatttaaacgcttggttggcgaaatgtattgcttgacgtcgtttttttgcgtttgtattctgcggttatcgtagcggaaattcgtaatcgtacttatagtatttagtgtatactacaagttaaaaatggtaagtgaggtgacgggatgttaggcaaacgggtagagcgccgtaacttattaataatcggcgccattttattagttatttttttgtacctgtctaggtttggtttcgatccaacaacggatgacgcttactttaaggcacaggcggcacaattttcgattggtgactatttacattggcgctacacacgttggactggccggttgttgccagagtttgtgctttattatatttttcatttaccggtcggtttctttcatttattgaatttaggttttggctggttattagcatattcgttgttaaggattactcagcaaaaaattacttggccacaaatgtgtctgttgccaatattgcttggttacgtaaattttgtggtgctgcatgacggctttttgtggctaacgggtgcggttaattatttatgggcagcggcgctgggggcttacgcgctgattccttttgcggatagttattttaaaggtgagctgatcaaacgaggttggcactatctgatcgcagcggctttattttcgttgatcaatgaacaatttattgtttgcgcatttggtatcagccttacttattgggtgctgacactttatcatcgtcaacgcatacaagtgataccattgttaaactcggtattttttgctgctggattactttttatgtatttagcaccgggtaatcaattacgaattgttgctgaaacaaaacattggtttcctaatttttataatttgactctttggggacattttagagtaggggttagttggttatttacggctttgaatcaaaactttttgtggctgttattattgattgctgtattggcaacaactttgctggggactcgacgactacgctttggattctatacgggttatttactttttatcgctggttatttagtgcagccaggtattttcaacaattttaatttaattaatacgacaacgatgactacatcaatcagccactttattttttgcttgattccgtaccttttttggagtggctttttactactgttacttagtaatataatgttagttgcggcgcagccaatctttttggcgctatgctgtgctgcggctttattatcaagtatgatcatgtggttttcaccaacgatttatggttcgggtaaccgggtgtttgcagcaatggcgattctgttgattgttgttgtgctatcgttgataaaacaactatttcagcggtatccccagtatcaaacacaaatttaccaactattattagttttacctgtgattaattatttaagccacttattttagcggataaataaatgaatattcgtttaagtttatagttattagtatcaattgaagtcaatttttcatacaataaatacgatatggttcttgatagtattacgaagaatagttttgaaacgcaatgaaaggtagaagacaatgaatacacaagtaactgcagtaattgtcacctataatcggttagctttgctaaaagaaagcattgccgcggtactcgcacagacttattcggttactaaattattggtgatcaataataatagtactgatgataccgccgcttatttagcgacgttaactgatccgcggctgcaagtggtcaatttgacgaaaaatcttggcggttctggcggatttactttgggattgcaacgcggttttaatgaaacgaccagtgatttagtttggctaatggatgatgatacgattcctgacccgactgcgttggccgaattagtatatgctgccgaagcgctgaacggtgagtttggttttctcagttctaatgtgcgcttagctgatggaacgccgaacaacgtgccagaaactgcgaaaaattggtcggctaaatcggataatggcctgattcaattggcgtcagggtcatttgtctctttgctagtgccacgtgccgcagttgcggcggagggtttgtcgatccctgagtttttcatttggttcgacgatattgaatttacacggcgcctagcccgttttgcgccggcatacatggtgttagcggctaatgtgctacataaaaccaagggtggccgtgagccggatattttaactgatcgtcctgaacgactgcatctttattactattatttccgcaataaatattatttggaacgggttactgatggtcgcaaaggcgcttttaaagagtcttaccgcaactttagtaagctagtccaagtgttattggggcgtcaaccaaaacgttggcgtaaggctagtattatcattcgtggttggtccgcgggcaaacgtttccgaccaacgattcgacaaataaaatcaaagtgaggtgcggtagttgcaactaacagcggtgatcgttttttatcaaacagagttatacgcagcgccaaccttacaaactttagccaaaagtatgacgcctgagttaaaggattttttagcacagattcattttgtcctctatgataattcggctcaaccgcatacaaccgcccagttaacgtggctgcctgattttgaatatcagcatgatccgcgcaacctgggtattgcaacggcctataatgcggggctaaaagtggcgcagcagaatgatagtcagttcttgtggttgctagatcaagatactgcgttgaccacggattttatcaatgaattgcagcagcaagtagctaagaatttgcctgtacaggctattgtgccacagattaaagctagtggtgtgttaatgtcaccgcgcgatattcgctcgccgtttaaggtggtgccattaacaacgggccaacagcaacacgttttggcgattaactcagcagcacttgtacgcgttgattttctacgccagttaggtggcttcagtcaagattttcaattagattttcttgataattggctgttctaccaaattgcgcaacggcaaggacaggttcaagtactgtccagcgttttacaacatcaattatcagtcatgcacacccaacaaattaaaatgccacgttatcagagcattatcacagctgaatggcgctattatcatcaatatcagaaaatcagtgaatggcagtatcgaggtcatttggtgttacgttttgccagtcaattattgatcaaacgtgatttaactaaagcccgttacttgtttaaatttatttttggttatcaccctaagtaagtcatatatttgcagtaatccattttgtggtaaactattgaaggttagtttacgtcatttttgactgtcaataaataatgatcagcagtgtctggcatgccatattatgtcactgctgattggtaaatttctgggacagaaatcaagctttaattttgagtaggaggaacattcaaatgaaaggtatcattcttgccggcggctcgggaacccgcctgtatcccgtcactcgggcgatttcgaaacaattgatcccggtttacgataaaccaatgatctattatccgctgtccagcttaatgttagcgggaattcaagatatttgcatcatttccacgcctaaggacacgccacggtttgaagaattatttcaggacgggcatgaattagggttgaatatttcgtacaaggtccaagaaaagcccaacggattggcggaagcttttctgttagcggaagattttattgccggtgattcggtttgtttgatcctcggcgataatattttctatggcggtggcttgtccaaaatgttacaggaagcggcggctaaaaccgtcggcgccaccgtctttggttatcatgtcaatgatccagaacgttttggggtggtggattttgatgaaaaccatcacgccatttcgatcgtcgaaaagccagaacacccaaccagtaactacgcggtcactggcttgtatttctacgataatcaagtagtggatattgctaaaaagatcaaaccatcgccacggggcgagttagagatcactgacgtcaatcaagaatatttgcgtcggggccagctggatgtgcaattaatgggtcgtggctttgcttggttagataccggtacccacgcttcattgcaacaggcatccagcttcatcgaaactatccaaacgcggcaaaatttggaagtcgcttgcttggaagaaattgcttaccggatgggctacatcggcaaagataagttattagagttagcgcagccactgaagaaaacggagtatgggcagtacatgatccgcttagcgactgatcagttggagtatttaggctagcacgtttaggcaaactcagaaacatataaggagagactcatgaacgttttaaaaacaaacttacaagatgtccgtatcgtggaaaccgatgtgttcggcgatcaccgcggctttttcacggaaacttacaccaaaaataaatttattgcggcgggaatcgacaacgacttcactcaagataatcaatccttatcggtcgaacctggcgtgttgcgcgggatgcattaccaattagcgccttatgcgcaaactaagttattgcgcgctattacaggggtgatctatgacgttttagttgatgtccgtaaaggttcaccgacatacggccagtgggaaggttatattttaagcgaatacaaccaccgccaattattggtgcctaaaggctttgcccacggctttgtgacgttgacgccgaacgtgaatgtagcctataaagtggatggctactacgaacccaaagccgatcgtggcatcgcctatgatgaccctgatattggcattgtttggccaatgccattggatcatttggtcttgtcggaaaaggaccaacatcatcctcgtttgaaagacgctgaattgaactttacttgggaggccaaagcataatgaaccttttagttaccggtggggccggctttatcggcgctaatttcgtccactacatgttggacgcccatccagaagatacgatcgttaacttggacttattgacctatgccggcaatagccataatttggacgatctgaaagacgaaccgcgtcatcattttgttcacggtaatatcacgaatcgtgaattagtcacccatttggtccatgaattcaatatcgatggcatcatcaactttgcggccgaatcccatgtggatcgttcgatcttgcatccagaagtcttcatcgaaaccaatgttcaaggaacattggcgctattagatgtggcgaaaaaagaaaacgtgggtaagtatcttcaagtttccaccgatgaagtttacgggacattaggtgcagaaggttactttgcagaaacctcacccctacagccaaactcgccatactccgctagtaaagcttctgccgatatgatcgtgcgggcttactacgaaacgtacggtttgaacgtgaatatcacgcgctgttccaacaactacggtccttaccaattccccgaaaagttgattccattaatggtctccaacggcatggaaggcaaggacttgccgatttatggtgatggtaaaaacatccgcgattggttatacgttaccgatcattgccgtgccatcgatttagttttccgcgaaggcaaaaaaggtgaagtctacaatgtgggtggtcataacgaacgaaccaacaaccaaattgtccatcggattattgaagccttggacttaccagattcccggatcaagtatgtggctgatcgcttaggtcatgatcgtcgttacgctatcgatcccaagaagatcgaaactgaactgggttgggaaccagaatatacgtttgatactgggatcgtcaagaccatcaaatggtaccaagataatgaagcttggtggcagccattgaaggcccgcgctggcttgaagtaacagaataaatggggtagggcaaatgcacagctaaatgtgaagacgtttgccctgctttttcatacatacgaatcaatataataacaagggccatgtttcttgcggtacgaactttgccacaagaatggtcactgactggaacattaggctttattagcgtgttgtgctaataaattaccttaaatatggaataggggattttcaattatgcgaattttaattactggtgctaatggccaattaggcactgaattacgtcatttattagacgcgcgcgaaaccgactatcgggcaaccgatagccatgaattagatattaccgacaaaacagcagttgacgcttacttcaaagattttcagccccaagtggtttatcactgtgctgcttacacggcagttgacgctgccgaagaagcaccaggcaaggcaatcaatcaaaaagttaacgttgacggaacggcaaatattgccgcggcagctaataaagttggggcaatcgtggtttacatcagtaccgattatgtatttgccggcgaccaagctgcggagtgcaccgttgacgcgcaaccagcaccacgaaatgaatatgggcgtgccaaatatgaaggtgaacaagcggtccaacgtttagctgataaatactatattattcgaacttcgtgggtctacggcgaatatggtaagaactttgtttacacgatgttgaaattagcccagacgcatgatcatttaacggtggtcaatgatcaatttggccggccatcatggacacggacgctggctgaatttatgacctacgctttagatcatcaattggactatggcatctatcatttatccaatgacaatagttgtaactggtatgagtttgcccaagcgatcctgaaagataaggacgtcaccgtcagcccagtaacttcggcagaatatccacaaaaagcttggcggccacggcactcaattttggatctcagtaagaccaaagccactggtttcaaaatcccaacttggcaagaagcgttagccgcatttatgcaagaaattaatgcctaacattataatcgacacttcggaaaaggtgagtccatgttagaaaacaaaaaaattaattggcgtgaaatcagcaatgttttgaaacggcgtgcgttgatcgaaattatcgtggtactgatcattttggtggctggctttttcgcgttacatttacgacgcgcgacaccagctgcaccggctaaatacgatgctaatagccaagttttattaactttgccagaaagtaagcagcaagtggtgttggatcaaacggttaacccacaatatgtcaacacttttgcggcagcgattcaaacagatacgattgcccgacctgtgcagaaaaaattagcagctaagggcattaaagtttcgttacgcaaattggaaaaacaggttaatgtgcatacgaataataataattcgttgattgagatcaatgttacaaccaatcaaagaacaaccgcgaaacaaaccgcacaggtgtacgcacaagttgctagtgagaacgtgcgctctttaatgggcattggtcgagggaaagtgttagctcaaccacgagtcaaccaagttctagcaatccaaaaattaccggtcaaacagatcatcgttttgattgtggcagctttggttttaggtttagctagtggctgtggactggaaatcctagatcgacggattcgtagccggtattttgctgaaacaacgttaggcagtcaaccacttgttttggacgtgcaaccaacggcggtacaattagctgctgtgcgcaatactttggatatggcaacaccaccagcaacgactttagtggcgcaattaccagtgactagctcgaaacagcaggcggcagtccaggctttagcacagcagtatgctgctacaggcgagcgtgttttattgatcgatttggcaactgatgcggcagcagtacaacaattagctttgccagcgacaccagctgattatcagggcaacaatgtggcgcgtttaccacaaacgacaacgactaatactttgcttacgttgcaggaactggaactaagtttggcgcgtttcaaaaaagatttccagcgggttatttttgttgcaactggcgcacagactgcaggcaatcaacaattggctttgcatgtggcggatgcacggttaaccttattgcagcagggtgtaacgactaaaaaggccgcttatactttacagcaacaatcgcaacaaacgacgccggttaatattgtgttatatttaggcaattgaggtgtgtaaatgaccgagccgagtgcaacattaaagcgattttttaatttagtgaaagtagttattgtgagtgcggtggtctttggcatcgtgggccttgtgttcagcatcgtttggcacccacgtgtgacaactgaatatcatagtcaggcgctgatcagtctaactaaagtgcgccgacaaaaagtcggccaagttaactatgttcgttattctaatggtagtgaattgacgcaattgtttagtgacacattcaaagcacccacgactagtaaagcgttgcgccgtgaactgaaaaaagctgacttggcgaccgaactagcgcaaccaggcaaaatcaccgtacacacatcatataattcaggtttgatccagatcaatgttacggatgacaaacgcaagacggcaatcaaagccgctaaccttgccgctaccgtagcagttaagcaatttgaaaagcagtatcgactaaaaaatagccgggtactcgcgcgtgcaaccagcgcagaccgccgggcaacgacgatctcaaggagtgaattgataatgaaatttatgtttgcaggtatcttgcttggttttctctggatgtttgtccgtgaactgtggcagcgccacgttacttcaaggtaaggttgggatagtgtgtatttattagcagcaacaacgatcacttatatgacgaatttagtggcgggattacgccgtcccaagtaccgctgggctgagtggttgtttttaatatgcttgatcatcctacttggcggtaatacgcagaatgccgactttttcacttatcaatggctataccaagcgcatattccctatggggagccagggtatcgcgtattgacccgtattggtccgatgctaggcttggattatcgtcaatttcggctagttttagcggcaattttcttagttgttttatatataggtgtaaaaaaattaacgacccattcggcagtgtttctggctttttatttttgttatccgtttttcttagacttgatccaactgcgtaacttcatgatgatggcgttgttagtctacgccagccatttcttgttggaaaaaacgtatcgtaatttaacgttgtttactttttttgttttgctcggtgctagtttgcaagttctcggtgtactctacttattagtgattccgttgtactattttgattcatggaacctatggaaaattggcctgctcagtatcgtctttttggcatcagtcatagtgatggtgccggcgtttagccaattattacttgaattattaggccaattacacctgagccacttatcactgtactttgtgcagaaggtgcgtttaggttacttaccgttttggttgttcagtatttttgatttagtctttacctatttcagttatcattatttaactgagcgtcagttattgacgccgcggcaacggcaaatcatttggttgatgtttacttttacggtggtcggtgtgctaacaatgccaatgtacacttacgaattttcattcgctcgtgcgttacgtgatgtgattccatttatgatcgttgcctttttgatcacattagacgcgctaccacgcaaacaatacttgcgctggttgtacatcggaatttttctggcttatgtgttggcggtggtttattttgaaatggtgcccttactccacgacacaatcatcccggcattcagcaacaactggctcctaggtagctaaagtaatactgcttatgctaaaatacttgttgtctgcggaatatacgtaaggtgtggcacgctttttgccacaagaacggtgactgtcgctcgttctaagtaacactggttaacaagtatcggacattgaattcatctgccaattagaacgtgcttgccgttgtcgattggactaagccgaagtgcggcaagcccaagtcgcaagtctgaaccatcagaaatttattgtgtagtggaaaggaatttaaacatgaaagattatgattatttagtcgttggtgctggcttgttcggcgcaacttttgcctatgaggcggctaagcggggtaagcgggtcaaagtgattgaaaaagacgatcatatttccggccatatttataccgaagaaaaatcaggtatccaggtccataaatttggagcgcatattttccatactagtatcaaaaaaacttgggattttgtgcaacaatttgctgaatttaatcggtacactaacgagccggtagctaattacaaaggtgaattatacaatctgccatttaatatgaacacgttcaataaaatgtggggcgtgatcacaccagcagaagccaaggctaaaatcgaggaacaacgcaaagttcttggcgacaaacgtccagaaaacctagaagaacaggcaatttctttgattggaacggatatttacgaaaagttgatcaagggctatactgaaaagcaatggggccggaaagctactgaattaccagctttcattattcgtcgtttaccagtacgttatatttacgataacaactattttaacgacacttaccaaggtattccaattggcggttacacgcaaatcgttgaaaaaatgttggctgatccattgatcgatgttgaattaaatcaggactttttcgctaacaaagacagttacttggcggattatccacgggtcgtctttacggggatgatcgatcaattctttaactatcaattaggtgaactagaataccgtggcttgcgttttgaagaagaagagctagatattgacaattatcaaggtaatgcggttattaattataccgatgctgagacaccatatacccggatcatcgaacacaaacacttcgagttcggtaaaggtgataaaaataagacgatcattacgcgtgaatatccagagacttggcaaaagggtgatgaaccttactatccagttaatgataagcgtaacaatagtttattcaaacaatatcgcgagttagccgcaacccagccaaacgtgatttttggcggacgcttaggccaatacaaatattacaatatggaccaagtcatcgaagcggcgcaaaaagtcgttacacgagaatttggtgccgacgcagagtagttaataaagggttgaagagcggctgatcgctttttgacccttattttgaagttaacgtatgatctggctaaatgaaaagttggtttatggagcactttttagccagattgttaaaaaatgtagtaagagagggttgtatccttctttaatagtgaagtagaggtggagcaaatggcaccaataacggttagtattgtgacctataatagtgaacatgtttttgaggcgatcgcgcgctttaaaacagagatcatggttcattatccggtgactctacgcatttttgataatcattcggtgcctgcgtatgtcaaaaagttacaggcactagcagatgagcgcatcattattacggcagctgaggataatcacggttttggttttggccataacgttaatctggttcaaagtactgatccgtattttgtctgttgcaatcccgatatattgatcaatcgcgctagttttgtggcaatgtatgactttattgacgtccatcccgaagtcagtatgatcacaccgaaaattaccgatcccgatggtaaagtacagtacttgattcgcgcgaaattagatgtttttgattatctgttgcgtttcattcggtatgattttgtgaaacgtttgtttgccaaacgaattgcgcgctatgaatgccggaatttaagtgacgaacggcaacaaatcaaattcggctctggcgcctttatgtttctacgcgccagcatgatgcggcaaattggcggtttcgacgagcgttttttcatgtattttgaagacaacgatctgtgcatgcgtatcaatcaggctggtgggcaaattttttatctgcctgacgcgccagtcgtccactactacgcccgtgattcacataagagtactcgtggttttaagttgtttttgacatcgatgtaccgctatttcaataaatggggctggcgctggttttagatagagtggctgaaggagcgcctagattatggcgtgtaacttactacttcgctacccaatcgagaaagagaaaaggagtcttgtgatgctttcagtttgtatggcaacctataatggcgcccaaacggtggctcgtcagttgaattcaattttaccgcaactagatgcgcaggatgaagtggtgatcgtcgatgatcgttccactgatgatacagtagcggtaatcaaacaaactgttgctgccagtgacgttcatgtgcgtttgtcagttaatcaagtcaatcaaggaccaatcaaaagctttgctcgtgcactgcaacaagcccagggtgacttagtttttctatccgatcaagatgatatttggtttgaagataaggtagcacaggtggtggctgcttttcagcgccagcacgctgatttgatcgttcacgatggagtggtggtcgatgccaaacagcagcagatcgccgcttcgtggaatcaatacaatcacaatcaactgccgcaatcggtgacgaataatttactgaaaaatggctatacgggtgcgatgatggccgttagtcaacgtttattacagtacgcgctgccgttccctgagcaaatcgaaatgcacgatcagtggttatttttagtggcgcaacggtatcacttaaaaacggtggtgctaccgcaaccgttgatgaactatgtgcgccatggcgataatgttaccggtatgcaacggcggggactggcgacgatgttacgcggccgctggcggatgtggcgggcttaccggcaattatcagacaaatagtcgcaactaataggtaaaaatgctagaatatctttaaaactaaaagtggagaatgatgatgactaaattatatccggatgacagttacacactgcataccgatttataccaaatcaatatgatgttgacctattggcaagaagggattcacaaccgacaggcggtttttgaatgttacttccgggagatgccgtttggcaatgggtacgcgattttcgccggtttggaacatgtcgttcgttttatccagcaactttcattcacggattccgatattgcttatttgcgggaagctgaggattatccagaagaatttttaacttatttgaaaaactttaaatttacggggacgattcgctctgcggtcgaaggcgacctcgtgttcaataacgagccgatcttacaagttgaagggccattggcggactgtcagttggtggaaacagctctattgaatattgttaattatcaaacattgatcgccactaaggcggcgcggattcgttcagtcgtcggcaccgatagtgtcatggaatttgggacgcggcgggcgcaagaaatggatgccgcgctgtggggcacgcgagccgcttacattggcggttttgacgccacaagtaatgttcgcgctggtaaaatttttggtattcctgtcagcggtacccacgcgcattccttgatccaagcttatcgtagtgattaccgtggtttcaaggcttatgcggagacacataaggactgcgtttttcttgttgacacctacgacacactgaaaagtggtgtgcccaatgcgattcgcgtagccaatgaaatgggtgacaaaatcaatttcttaggtgtacggatcgattctggtgatatggcgtatatttctaagcgtgtgcgccaacaattagacgaggctggctaccctgaagctaagatttacgcgtccaatgatcttgatgaaaaaaccattcagaacttgaaaatgcagcacgccaagatcgatgtttggggtgtggggacgcatttgatcacggcttatgatcagccagctttaggtgcggtttataaattagtcgcgattgaggacgaaaatgggaccatgcaggacacggtcaagttatccagcaacgccattaaagtttccacacctggtaaaaagcaagtttggcggatcacgaaaaaagctgacggcaagtccgaaggtgattacgtgactttctgggatgaaaatccgttggcagaagaatcgttgtacatgttccaccctaattacacttacatcaataaaaccgttactaattttaatgcgcggccattattgcggacgatctatcatgacggtcaattggtttatgagttgccggaattgtcggagattcgccgctattctgccgcaatgctggagtctttatgggatgaatacaagcgtgatttgaacccacaagattacccagtcgatttagcgccaactttatatgatcacaagatgaaaatcattcagcaagtacgtgaccaagccaatggtaaaaaagcttagaagtctaaagcgacgcaaaccaatgcgccgcttttttgtatctcagtctgacgtggcatgtcaggttaaaagactgctttctgcggggagcgtggtataatggggtatactaaattggtgatttaaggagttgaatccattgcgtccattacaaaaagaaattattgcagcaatgaaaacacaaccggggatcgatccgcaagctgagatccgtaaaagtgttgattttatgaaggcttatctgaaaaagtacccgtttgttaaaacgttggtgctggggatctccggtgggcaagattctacgttagcgggacggcttggtcaaatggccgctgaagagatgcgcgctgaaactggcgatgccgcttatcggtttatcgcagtgcgcttgccttatggcgaacaagctgatgaaagtgatgcgatggcggcaatcaattttattcaggccgatgaaacgatgcgtgtcaatatcaagccagcggtcgatgcgactttgacagcattagaagctaatcaattatcgatcaatgattttaacaaaggtaatatcaaagcacgtcagcggatgatcgcgcagtacgggatcgctggggcgcggcagggtgtcgttttaggcacagatcattccgctgaatcgatcactggtttctacacaaaattcggtgacggtggggctgatttggtgccgctatatcgtttggataaacggcaaggcaagcaaatgcttaaagcgctaggcgcaccggaacatctttatttaaaggtgccaacggcagacttggaagaagatcggccagcgttgccggatgaggttgcactgggtgtgcgttatgatgagatcgacgattatttggaaggtaaggacgttgcgccagatgccgcagaaaaaattgaaggctggtatctgaaaacagcgcataaacgtcatttgccaattactatttttgataatttctggcggtaaccgatttttttacttgtaaaatagataatcaatcagttatactaagcttaaatcataggggagtaacttgcgaccacacatggccgtgataacgtcgtcaacaaggaagtctacccgacttttctggtgttatcttaaagagtgagacttatgtgtgtttctgcaacatacatgggcctcactttttgtatgctgcgaatccatcaaagggggaattatttttggcccaagagaagaagttttacagcagaagtacagcagaagtacaggcttcactccacaccgatgaacaaggtttaactaaggcgaaagcggacaagcgtctgcgtgaaggcggcgccaatagcctagttgctaagcggcgcaaaacgatcattgaacggtttattgatcagtttaaggatttcatgatcgcggtgttattagtcgctgcgatcgtggccgcttttagtggtgaaattgccgacgcggtcattattttactggttgtagttttaaatgctattttcggtgttttccaagaagtccaagccgaggctgctatcgacgcactgaaagaaatgtcggcgccgatggctcatgtccggcgcgatggtgaattactcacgatcaaaagtgaagacgtggtgcccggtgatatcgtcttacttgaagctggcgatgtggtgccggccgatctacgcttgattgctgcgcagactttgcgtgttgaggaagcagctttgactggggaatcagtaccggttgaaaagcaaaccggcgtactcgacgttaaagctgatgaaaaagtcagtctaggcgaccaaacgaatatggcatttatgaacagtaacatcaccaatggtcgtggaactggggtcgtggtggctaccgggatgcaaacggaagtcgggcggatcgctggaatgttgaatcaagctgacgaaacgaagacgccattacaggaaaatcttaattctttagggaaaacgttaacgtggttgatcttattcttatccgttttaatttttgcccttggtttacttaaccaacgagaaaccgtattaaatatgttattaacggcgatctccttggcagtcgcagcgattcctgaaggtttaccagcaatcgtgacggttaccttagcgttaggtacacgacgaatggcgaaacggaatgcgatcgtgcgtaagttaccggcagtagaaactttaggcagcaccgatattattgcttccgataaaaccgggacgttgacccaaaacaaaatgaccgttgaacggttatttaccaacaatcgcttagaagttgccagtgaaagtaaggcaactttggatgacatgacggtacaaatcatgacgttggctaatgataccaaaatcgataaggacggcaagctgctcggtgatccaaccgagaccgcactagtccaatttggcttgactcataagttggacgtgccagcgttgttagaacgtttaccacgggtcaatgaagtaccgtttgattcagaacgtaagttgatgacaacgattcacgagttggctgatgggcgctatttagtggctaccaaaggtgcaccagatcagttgttacaacgagcaacacaatatgaagtcgatggtaccgttgaaccaatggacgataaagaacgtgatttgatattaaacaccaatacgcagctagcacggcaagccttgcgtgttttgggaatggcgtataaaattgtcaccgaactcccagaaacggttgatacgaacacggtagagcaggagatgatctttactggcttgatcgggatgatcgatcctgagcggccggaggttgaagaagctgttcgtgaagccaaagaagccggcattcggccaatgatgatcactggtgaccatcgtgagactgctgaagcgattgccaaacgtttaggcatcattggggatcatgatgaaaaagcaatcatcagcggtaacgaattggatgaaatgagtgacgatgaatttgctaagcgagttggcgattactcggtttatgcccgcgttgcgcctgaacataaggtacggatcgtcaatgcttggcagaaacgaggtaaagtcgtggctatgactggtgacggggtcaacgatgcccctgcgctaaaagccgctgatatcgggatcggtatggggatcactgggacggaagtatcgaagaacgcttccgatatggtcttagccgatgataatttctccacgatcgtagttgcggtggaagaaggccggaaagtctttgctaatattcaaaaagcaatccagtacttgttatcagctaacttaggtgaagttttaaccttgttcatgatgacaattctcggctggcaaattcttgcgccggttcagattttgtggatcaatttagttaccgatacattcccagccatcgctttagggatcgaaccaatggaacgcgatattatgaaacgcaaaccgcgcggtcgtaaatcaaatttcttatccggcggtttaagtcaatcgattatttatcaaggtttgctggaaggtgcgatcacgctgatcgtttattggatcgggattacttatccaatgcacgccagtgatagtttagcccacgctgatgcgttgacaatggcctttgcaaccttaggcttgattcagttgttccatgcctttaacgtgaaatcaatttacgggacgattttccataaagggattttcgctaatcattcatttaactgggcgatcttagcttccacggttttaatggcagcaacgatcctgattccagggtttaaccaattattccacgtcacaccgcttgattggcatcaatggttgaccgtgttgggcggttccttctcgatcgtgatcattgtcgaaatcgtgaagttcgtgcaacgacgcatgggtatgaataaataattttatagtgaggtcggagtaaatatggtaaaagtaaaacaagttatggcgcattatgcgcaggtcattgatcaaatgattcagacgacagagcgcctgacgactgatctcaatggtgattatgagctgctgaagtcagctattgccaccgatacgatcggcgatatcagcaacgatcaatggacgagcattaaagccaacttcgatcgcggcgttgctgattaccaagctaatttggccacggtcaaagcagtgcgcccaccagctaaagcgttaggcattcaccatttattgctgagtgcctacacggattatgttgccggttgtgtccaaatggcggctagtgttgatgccaccgcacatacgatcgacactgcggcatttgctgcagcggaaaagcaacaagacgatagttcgttggcattaaacaagcaaattgcgcggattgcacagttgttacaataagcagatgaaaagtgtcggccgagaggcttggcacttttttatttggtagattgtaaaatttaagttgaacatattagtggacagaaaaacccataaaggtctttaatggtgtcaccacaacattccactagaaagaaggacctttatgggcaccactattttatcatttga

SEQ ID NO: 485 - DNA, 14437 bp, Unknown
  Metagenome-assembled genome
agatggaccaattttgaaaaatgagcaaaagaatgatgaatatcagtgtcattgtattgtatagtagacataggcatgaaactcctctgtatggtttttgtttagacgctttaagtatacagatgtggatggtttcatgtctatttttgtagcaaaaaagccctaacagatcagggcttaagtggaaatattaactttcaacctttagtttatgaaactaaacatccaatgtgctaggatcagtagctttggctgcagttttatttttagccttatcttttgctttttcgtcagttccagctttgctatcttcagtagttggttctgcaataccataagcttcgcgaactttctgtttgatctccgccataacctctggatgatcagctaaataattcttggcattttcacgaccttgaccgattcgatcattgccgtaagaataccatgaaccacttttatcgacgatatctttttcaaccgccatatcaactaattcacctgtttgtgagatccccacaccatacataatatcaactaaagcaactttaaatggtggtgcgaccttatttttaacgactttgatcttaacacggttaccaataatattagtgccttccttgatctgttcagcacgacgtacttctaggcgcaccgttgcgtagaatttcaatgcccgaccaccaggagttgtttcgggattaccaaacatgatcccaactttttcacggatctggttaatgaagatggcgatagttttcgtcttattaattgaaccagaaagtttccgcaatgcttgtgacatcaaacgtgcctgtaagcccacgtgggaatcaccgatttcgccttcaatttctgctcgtggtactagagcagcaacagaatcgacaactacaatatcaatagcaccactagaaactagcgcatcagcaatttctaagccttgttcaccagtatctggttgtgataacaatagatcatcgatgttgacccctaaattagaagcatacttcggatccatcgcattttcggcatcaatataggctgcagttccgccttgtttttgaacttcagcgacagcgtgcaatgcaaccgtggttttacccgaactttctggaccataaatttcaatgattcgtccacgtggatacccaccaacacctagcgcttcatcaagcgctaatgaaccggtagaaaccgtggaaacttgcgtatcgactttctcaccaagacgcataattgaacctttaccaaagttcttctcaatctttttaagcgcattatctaatgccgctttacgttcatcagccaagtgagaacctccttaaattgtcactaattatcttcatttcattgtaaacaattaagcgaactacttattgcttcacaactaatcataccgaaaccgattctaaaaagcaagcaaaaagtgaacaaatgttcccgctatttatcggtgtccaacagatgataaagtaagtcaaaaccagttaacgcactttgctgccgaacaaaatttcgtgtgcgtgagaaaacgaatttacgtgcaaacggaatttgatcacgataagcaataccaatataaaccgtaccagctggctgaccttctaacttatcaggaccagcaacccctgtaaaggagattccaatatctgatttaagtaataacttagcttgtcgggccattgcaatcgcggtttcttcactgacgacaccgtatttatgcagatactctggtgagatctgtaataaattggctttttcagctaaggaataagtgacaaaacccccattaaaaatatcagaagcaccgctgacattagctaacatactttgaaaaagcccagcagtcaaactttccgccgcggtgatcgtcaacccacgctttttcagcaaagtaactacaacttgctccagagaattatgttcaccataaccatagaagtattgaccgacccgggcttgaactttagtttctaattcagccaataattgatcagcagtcgcctgatccgtagcttcagcagttaatcgtaacgtaacttcattggttttagcataaggggcaatcgtgggattagtttgttggtcgatcaaatccgctaattgtgtgactagcgctgattcaccgataccatgaaagcgaagcacccgtgaatcgagcacattagcctgcttaaactgcttgatcaacaacggacgagctgaatctgtaaacatggcttccaattcacttggtggtcctggcaataacatataggtatgtgctggtgcctgataaagtgcccccacagccatgccgactggattttttaaaggtatactattagccggtagcattgcttgcaaacgattattttcagtcattggttgctgtgagcgcgcaaagaaagcttcaatataagccatagccggtttatcaaccaccaatttttcattaaggtgtgccgctaaagtttgcttcgttaaatcgtctttagttggacccaagccaccagttaaaatgatcaaatcactacgactatcagccaattggattgctgcttccagacgtgccgtattatccccgacgactgattgataataaacatcgatccctagatcagccaactcacgggccacaaacggtgttgtcgtattcgtgatctcgcctaaaagaatctccgtgcccactgcaatgatctctgctcgcattatttttgcccccaccatttaatatacgtcattttattcatttctattttagcttactacttttttcgtcaaaaaaacacgcacagtcagtgtacgtgttcaaaatactatttgaatgaatcagcaaaaacatgccgactatgcacaaaataatcaacaccagaataaattgtgaagaataagcaaacatacaataacgttaatgccatcggaaaatgtaaattattgaaaaagacattattcaagaataaaaagatgatcgcaaacatttgggttgttgttttgatcttacctggcattgccgccgctaaaacaacgtgctcattactttctgccagtaacaaccgcaatccggtgattgccaattcgcgacaaacaatgattgcaatgacccaagcaggcgccttacccattccaactaaaatgataaaagcagtcatgactagcattttatcagctaatggatccgcaaacttaccaaagttagtcactaaatgctgactccgcgcaattttaccgtcaataaaatcagtgattgaggcaacagcaaaaataaccgtgccaatgatctgagtccacggaatcacagtcccagcaacgtttgcgctgccccaactccaaggaaccagcactaccaacatgaacaacgggatcatgaagatccgcacgatcgtcaatcgattaggtacattcatttaaataattctccttcacaacttagagtgagctgaaaaagcgctagcaacagtgctttttcaaccacgtttacgctaaattagcgatcaaaattagctttacaattttttccaagtacaacttaggtaatttttaatacatcacgcataaaaatagcacacctaactttattctactatgttaaaccttagcatagtccggcgcaaataataaatttagcgtcgcttagaaatatcgttattgtgctatttaataagcttagttactagtttgggttgtggcttgactgctacttgtggctgcactactgctagcagcggcagtcgtcatcgtaacggtgatcgtcttaacaaacccaccaacattgttgggatcaaggttgaagtttttaccattgatcttggctttggtattttcagcattacccgtttgaattgtaaatgaagtcgtcccacttggaattgtgatcgactgtggtgcactctgcaaagtcccttgccaaatttgtgtgccaccagcagtaacggctacccaagctgtcttagtatcactagcatgcaacactaaagtattattagttggtgcattgctgtaggtaaaggccgctgatgttgtcgtttctgaagtaacggtcatcttcggcttagttgttgactttttattagccgagctagctttcttagctgatgacgatgatgcggcctgtgaagaactgctactactttgactagatgctttacttgaagattcggaagaaactgtcatcgaagaactttcttggatgacactcttattccgatcacgattaccgatagcaaaggcatagatcacacccacgatcacaacaacaacagcaacaataataattgtcggtaggtagcggctaaagcgcgcaaacccattatcgtgattacgcgttcgtgtccgcgtattggccttattttcgtcttccgtcggctcaatatattcttgtggttgcggctgcggaatcgtatcgttgaactcattcagcagttgctcactatctaagccaacggtatccgcatactgtttgacgaaggcgcgcacataaaaatcgccgggcagcgcctcaaagttaccttcctcaatcgcaattaaataacgtttctgaattttagtgatctgctgcagatcatccaaagtgtaacccttgtcgatccgtgcgtcacgtaatttttgtcctatttcactcattgatcctcttccacctatcgcccttttacaagaatttcaattttagtatagcatagaaaaataaatcttttcactaagattttccttacagtaatctaatttaaacaattctttaaagagtggtaaaaaagcgtccagattatgacgtatagccttgccaagcaataaaagacacacaatggcttgtttgactaacgcagttgtacgtaataatctgttttttaccacgttttcaccaacctaacagtattccctaaactcaatcgtagaaaatcaactttttaatatattgccataaaaaaccgccatttacttacgccaaccaccagttacgtacaaggtctgtccagtcaaatagcccgcttcttttttcagtaaagcactgatccaataggcgacttcatccggcttagccaaacgactgattggaatctcactgcgcaattgatttttggcatcggcatcaaacaactgattcattttcgtatcaacagcacctggcgccacaacgttgaccgtaatgcctaatgaagcgacctcgcgggcataagcgttggcaaaagctgactgcgctcctttgacggtactataagctacttccagagcactgccactaccgccataaactgagccaacaaaaacgatccggccatagtcgctatgcgctagtttctcactaagccgctgacaaagcaacattggtgttttgacgtgcatttcccacaaacgttctagttgcacggcagtcgtctcttgaaacaacccgtaagtcgtagtaccagcggcaaaaatcacggcatcgacttggaatagttgactcacgatttgatctaattgcgtttcatcagtgagatcatatgctaacgtgaaaaaatcctgtcgcgggtattgctgaataaaatccgcctgtaactgttgaaccggcgctgcatgttgaaaatagtgtagatacagggaccagccggcggcagccaactgacgagctacggcttgaccaatatcaccggacgccccaatgatcaaagctgaacgattcattcaactccatccccagccagtggttcaatatgaaacacactcagcgcttcgctgcgtacaaactgttgcaacgctgcctggatatcagctaacgtgatctcatcaataatattgactagatcaaacagacttgcatcgccaaaatcatcgccagagtaagtgttagcaatgtattccaaggcgttcattgattgcagcgtccgacctaaagcttcttttttaaccaacgctaagcggcctgcatttaaatctgggttagtggtggccttttccaacaagctgatcatcgcatcggaaaactcctggggcttttcagtatccccacttaacgtggcaaaatgataagtccgcgccagatctagttcataaccaaaactgtcatcaaccacaccttgatcgtacaattgtaagtagttctgtgaagaatcaccaaacaacatatcaaacaataaattcagttcagttcgatattttaagcccgcacgatcctgtgtaactggggttagccctttgatcccaacaatactcttcccgcgcttaactggcaattcagtaacgcgatacggaataatatcgctaccatcggcagcttcctcagggaattgccgctggatcggctcggccggtgggaaagtttttgcagcttgattagcttcaatccacgctaaagtttctgccggatcaatattgccgaccacaaacaaattcatattactaggctggtaaaaagtccggtaagctgtatatagttgctctggcgtgatcttagcaattgaatcgatcgttccggcaatgtcctcatgtaacggatgcttaggatacaaattctcaataataccaaaaaatagtcgccagttaggatcatcctcgtacatttcaatttcttgaccaatgatacctttttccttgttgaccgaagcctcagtaaaataaggctcctgcacaaaatctaacaacgtcattaaattagtttgaatattgtcagttgcggaaaataaataactggtacgggtaaagctagtaaatgcatttgcgctagcaccattatggctaaaaacctcgaaaatatcgccggcctttttttcaaataacttatgttcgagaaaatgcgcgataccagctgggactgctgtatattcactttcacttgtcggcacaaaataattatcgatcgaaccataattagtcgtcattacggcgtaagtcttatggtagccagctttaggcaacagggttacccgtaaaccattagccaatgtttgttggtacagggtttcgtctagggtagcataatgtgtcgtttccattatttgtcccctcctttactgctcaagaaataaatggcctgcagcttaattgtttgcgcggccgccacgatctgttgcttcgaaactgcgtccaatgcggcaataaaatcagccgtcgaaactgccgcttcaggaactagctgacgaacgagcgcttgtgttgtaagattaccagcactatctagaccagtaatgtattgatttttaattgtagctcgagtttgcgctaataattcatcgctaaactcacctgcttgcagagttgccaattgtgctgcgataatttccttgacgcgcgtcacatttgtcgcatcgatcccggtttgtacagtgatcaacccacgaaaggcgtcatacgcacttgaggcataataagctaaactagccttttctcgtacattagtgaataataacgacattggtgagccgccaaaaataccgtttgctaacaacaacgcataataatcaggttgataatagtaagttggcacttgataagccaaattcaacttagcttgattagttggctgcacctcagtttgctcagcgacagtatctaacaaagcttgctgataaaataccgtcggttgtgtgactgtccgcgctgctaatggtaaatcagctagtaaagtggttaccgccgacacatcaacatcccctaacaccgtgatcgccacttggtcatgtgccaacatttgttgatagtaacgataaagactactagctgtgattggttctagatcattgacgttaccaaagctaggcaaacgttgcgccgaactattttcaaaatagagttgttgtaattgcaaactagcgtaagcttgcttgttatcataaactgaagccaaataagcagccatattggtcttttcccgatcaaaagttgccgtgtcaaaatgtccaacactaacattaggccgccacaatacttgttttaagaaagctaaaccttctgtcaaaaccgctgtttcaccaggtaaaaacttatcattgaccacggtcattacgaccgaaaaaacgtgtgtgttgccacgtttactaaccgaaataccaaaattagccccgtacatcgctgataatttagccgccaaatcagcttgagttggataatcctggctattggtctctaacaagctagctagcaacgaacgctgtgtgatcgtctctgcttgtagcggtgcaataaaattgagtacgatccgcgttgttttaaactgtgtcgatggcagaacggtcaacgagacgccgtctgctaatgtttttttagttaccataatgtacctcacttatgattattaatctaatcagcatactgatcatgcttgacttgagtcttgctcgtcatccgggttttgcacgtaaactttacgcggcttacttccttcagctggaccaacgatcccccgttgttccatctcatcaacgatccgtgctgctcggttatagccaatacggaaacgccgttgtagcatggaaatgctagctgtttgtagttgtgcaactagtttgactgcatcagggaaaagttcatcatctgcttgactaaccgtttcctctgctggctgatcatcggggatcaatcgttcatcatattctgccgtacgctgtgccgtgataaaaccgaccactgcttcaacatctttagcagaaatataggcaccctggacccgggtcggcttattttgtcccattggtagatacaacatatccccacgacccagtagcttctccgcaccagtactatcaatgatcgtccgcgaatcaatacctgaagaaacagcaaacgccatccgactaggcacgttagctttgatcaaaccggtaataacatcaactgatggccgctgtgttgccaagatcatgtgaattccagctgcacggcccatctgtgctaaacgaacgattgcatcttcaacttcattcgacgaaaccatcattaaatccgctaactcatccacaattgccacaatatagggcattgagggtaatggctgttcagtatcctgatcttgctgctgaacggcttgattatactccgtgatattccgtttaccactttgagcaaataattcataacgtcgttccatttcagcaacgaccttgtgtagtgcctgcgccgcttttttagcatcagacacaactggtgtcaacaaatgcggtacaccattataaaccgataattcaacctttttcggatcgatcatcattagtttaacttcatgcggtttagcagtcatcaaaatcccagtgataatatcattgatcatcacagatttaccactaccagtggagccggcgatcaataaatgcggcatcttgctgatatcgaccatgatcacattaccagaaatatcacgaccaactggaactgataaaattttaccaggatgtggtggctgtgcttcaaagacatcacggaaagaaacagtagcgactgccttatttggcacttcgatcccaattaatgatttaccgggaatcggcgcctcgatccgcacatctttagccgccaaagctaaagcaagatcatcagtcaaacttacaattttactgactttgacaccgattgctggtttgatctcatatttagttactgccggtcctaaattcacatttttaacttcaacatcaataccaaaactgtcaaaagtctgttttaatttttgtgtgttctgcttgatcgtggcatactcttcgctttgatctgttggcggtatcgcctgcaacagatcagcactaggtagttcataatcctgatcagctactgcctccgcaaataaagcgggtgcttcactagtcggtgcagccgccgcactagccggtcctgctgctaattgatccaaatcaacttttgcttgtgctgattgcatctgttccgccgccacattgattgttggtgtatccggcgtaactgacgaacgctgtgccactggcttaggcaaatcttttgaagctggttcagacttcaccgctgtcggtgcagttggctttgctttaggtactcgtgtttttagtttttgtacccgtggacctaactgtttgccagcttgccataatccttgagcaccagcccataaacgctgaccgcaccactcaaccaggcgtaccaaacgcaatactgcatcacgaacaacagtaaatggaatatcaaaaatcagcaacaaaccgccaagtacaccaataattgccagcaagtaagtgccaaactgaccaactagaaaataactaatgctgtagccagttgcccctagcatcccgccaccaagcattgttgtgacacttgcacgctgaaaatcagcaactagaaagcgccaagtcaccgccataaattgactgtgtaattccaattgcgcaaacatgactgcatctaaaaaacataataaactaaaataagttagactgacaccagccacgcgcttgccagaaacggtaggaccatgacccgcgaccaataagaataaaccgtataagcccaagatagctgctaaaaacggataagtatcaccaactaaaacccgaatcaagttagctaactgattaccaataaagccccatttaaaaatggcgaataaactgagtaaaataaaaatcaaaccgatcacattgaccgttacaggtgagttttttgtggtagttttccgccgcttactagcggcagtcgtgcgcttgcgccgtggcttttttctcgttgccacttaacacacctactttcttgaaaagacttctctacccattatacacaaacttttgtttgcttgggtcgcaacttataaaaaatgtaaaaagccttagctgatctagttatcggctaaaccagctaaagcttttctaggttatcttttaaaactaaatcaattgatcatttctaattacgcacaaatgtggttgaaaaagcaactcattgtctagttaatttcggtaatttttcaacacatctgctaattagttatcgtcgggcgtgatcttttcgaagggttcactatcgtcgtcatcttcagcatgaaaatctaactgtaccccctgatccaacgcaactgcagttacttgataggttagggtttcgatatactcaactaatggacgcgataagcgctgcatgtcagcagcagccaaatcatctggcgtgccattgaaatcaaggatctgaatgatctgcgtaatctgaccactgacggcgaagccttccagaacaacttcaaacggaactgcaaactgaaaaattttaccacgagccataatttcatccgcaccatcacccgttgcagtgacttcattaatattaacttgaacgtcggttttaggtgccgtatccggtgcaacacggtcgtaatggaaatgttcgaccacaacttgttcacgattagttttcattggttgcctactttctaaattgaattagtctttttgttccattgctgcttttagtgcttgagccaaggcactttcgcctggttcatcgtcttggttgaccttctgtaataagcggcgctcttcatgcttgttcatccgctttttacctttgaccgctccgactttttcagtgatattacagtgagtacatttgaagtaatcgcccttttcaccagacaataacaccatttttttatggcattgcgggcaacgatggttggttactttagggtcacgccgacgataataatcacaattctgattactgcacactagtaaaaccccattgcgggtggatttctcccgtaattttgagccacatttaggacaaactttcatcgtcaaattaaagtctttatagtccgctgaactccgtttgacttctttcactagatcagtagttgcgtgacggatctgtgcaataaaatcacgcttctgcaatttgccttgtgcgatttgctctaactgttgttcccacttagcggttaaatcaggcgtggtcaggcgtgggttaaccaatttaagtaattgttgcccttttggtgtcaccgccaaatgtgtgccaacacgctccatcaaaccagagttaactagtttttcgatgatctcagcacgggttgctggcgtacctaaaccttttttctccatctgcactaataaattagcttcactcaacggcttcggtgcttgggtcagttgtttatttaagttgacgctaccttgtaattgcgcaccaacttttaatggtgtcacggtcgtcgttgccaagtcatatttaaaactggcttgtgttacctgcgtctgcttaagaacaaaaccctgactgagctgatacgtaaactgagtttcaatataatccggcaaaaataggccgataaagcgtcccaaaatcatatcatagattttcttttcatcactagaaaataattccggttgtggcatctgttcagtagggatcaagccataatgatcggtcactttagcgtcattgaaaacatgcttctgcaccaccggcgcttttctgccagctaatggtttagccaacggttcgtaacgactaactgccgctaaacgctccgtcattgttgcccgtaagtcagtcgtcaaatacttcgaatctgtccgcggataagtgaccaccttataacgttcatataacgtctgtaacaagttcagcgtttttttggccgagaattgaaaccgttggttggcgtctttttgtagttcagtcagatcataaggcaatggtgccttctgatgcttgcttttttctttcacggcggtgacttgatagctggccgcttgcaattgtttttgctgtttctgagctgagaccaagtccaaatgtggattgccgcttaactgcgcgtcaccatgcttagtctgcagactcaatgtataatacgtttccggcttgaacttgctgattttttcagcttgcgcggcaactaaacctaatgtgggcgtctgtactcgcccagccgataagctatcattatattttacagttaatgcccgcgtcacgtttaaaccgaccaaccagtctgctgctgaacgtgcttgcgcggcagcatagagattatcgtaatccttacttggccgcaaatgagcaaagccttcacgaaccgctttatcagtttgtgacgagatccataatcgcttcactggcttgtcaaaatgcaaataatccaagatccagcgagcaactaattcgccttcccgtcccgcatcggttgcgataactgcggcacccacatctttgcgcttagctagttcgccgattgccttcaattgtggccgtgtctttggtaatggcttgatctgcattttctctggcatcaatggtaaagtatctaacgaccattcttgccattcatgcttataatcctctggcattttcaaagtcaataaatgtcctaacgcccaagtaacaatataatcgtcgccgctataataatgacgacttttttgattcgcttttaaaacccgtgccaacgattcagcaacactaggtttttccgcgataactaatgttttcatctatacctcgatctcatttaaatttagggtaggagctatgactgatggcataacttttttgctcttccgaacactaccaccatcagaaaaacaggattatttcaatttatcatgttcgtagcgatgcgcccgttctaaaccagtaaaagcttgctggcgcaaggcttcgtaaatgataatggccgctgaattagataaattcaacgcgcgtacattttccgtcatcgggatccgcaacgctttttcagggttggcccgcataaatggttcaggtaaaccggttgtttccttaccaaataagaagtaatgatctatatcggtgtcggtataatcaacatccgtatacgtttttgaagagaatttactgatcaaatacagccgtgcatccgctggtaatgaagcgataaaagcatctaaactttcgtgataagtaatatcaactttttcccagtaatcaaggccagcccgtttcatgtgcttatcatcagtagaaaaacccaacggttcaattaaatgtaaatgtgtatccgttgcagcacaggtccgtgcaatgttcccggtgttggccggcattaatggttcataaagtgcaatatggttagtcaattttcttacttccttttccagtagcttagtgcgtgtttgaaaaatttgcttttttaaacacgtttacgttaaattaacggtaaaaactaatttaacattacaaagacactctagcttattcgtgaatccgtagcttctattataacgatagctagtggtatttttcaaactagagtgttagaaatcttacgtacaaaaaaatcagccactgtacagcagctgactgattgatttattttgcgtttcgcacccggtatttagttaacagataactgaacaatgcgatatttaaattaacaatctaaaccgtgaaagttcaaaacccagctaaacctgattgcactaagttattttagcccaagattaaacacaagcagctccttgaagtatacttgagtcgtctaaaccacgatacaaaggagtgcttg

SEQ ID NO: 486 - DNA, 2073 bp, Unknown
  Metagenome-assembled genome
tggatggagcgtcatccgatgcctaagacccttcaagaactcgagaagctggttgaagaaggtattgaatactttaatcaccacaaccgttcggcacaaagaaacggcctcactccagatgaatactggaatgaagccgcttagaaacagattcaattttttattatttcatctgtcaacttgacagggcctagtgcaaaaaagcgtctttttcatgtgcttataacaactgttatttaaagaatatgaatggtttgtcgccgatttttaatcggatcttttgctgctaatgcagcttcataattaccttggcaaacttgttttaatacttcataggaagcacaatcttcaatcataataccataatcttgtgtaggatcagcataattgtagatgactgtggaagggtgtttttgaatttgcatttcgcaggcgatacgttgatcagcctcaaaactttcagcggttaatttagaacggcgatcttcatggaacatttctgaatccaaaccattatcagcggctaaacgactgattaaatcatcagtatagcgttcatgatgaaaattcagctcggcctgtaggtccattaaaaattcctggccacgacgcttaccttggaatagcgccgctttgtaatctaatgcggctgcataaactttttgaaagatttgattacggatagttaaatcgtgcgtgttgagctggttccgttgcattacatcttctacagtgtgtaaattaaccaatggtaaaaattgataatgtacggtgtcatgatgctcttcagcaacttttaaaactgagcgttctgcctctaggcattgttcgcctaatggattaacaaataaatagatttctaacacgattacgtcccccatgttggttgaaacttactaaacattttcaactagttcataaacatactttaacaaaataaatgaaattttcaatcaaaaagcattcgttcaagatttgcatactgattttcaagtgatatgttttgaaaatgtacaacagcacgtgcgactttattagtggttttgcgtggttcaatttgttgtgtattaagtaaattacggaaagttgtggatgtactagcggtgtcttgcacctctagctctaactcgtgatcaaaggtagtatcagcataactagtccgatcgaggaccaataagcccgccgataagattgcttgctggcgttcagtctgcgcataaccgatcaattgaagttgtgtacgatcaatattatatttttgtaaatactgactgacttgactaggttgttgaatttgtacctgttgtgcaacggataaaggtaatggatcggtgatttcccacaaatcatgttcaccatgcgctggtacttttaatgtttgctcagcgcgatccttaaacaaacgtaaccgcaggccccaaccgcgttgttttagttcttgggttgcagtgtcaaaatataaattagtttgtttaaatggtatggtaaatgagtaggcttgttgtaaacgttgatactcactcgcggtcaataagtttttaaattcgcgttcggcttgttggctcattgatgagcatcctttctaatcttgaccacataattcaggttagtttattaagtgaatagactaaataaacgctggcagccgttctcatgacagaaattgaaacatacttacaaagcgcacttacataatcactcagagcaagtctacactgattatcgggcaaaatgcaagcaatacgctgctgaatgatttatgctaaaatagtgtgagatatatcatgtaacgcgtggtgctagttcgtcataaaatcaaaaaagcctaaattgtataccaatatcgtcaattcaatctttaattgaaaaccaaatagactacgggtgagattggtttcaatcccaaattgctgggctaaaattgaaaagcgtgactctattgtccgccgtaacgccttgagttgacgcttattatgctgtttagcacctttcatattagaacgataaggcgtccataagttatagcctagggccctaaaactggtcttgagttttttcccaacataaccaaca

SEQ ID NO: 487 - DNA, 15209 bp, Unknown
  Metagenome-assembled genome
tgatggtatctttagattgggtcatgaagtccgtcctaacttattggttttgtcacttataagtttaaggcttcatggcctttttggtctagttattttggtgttgcacttacattgtaaatccggcattatttaacctcgacttctacatccgcaaagtacttgctaaagtgagcaacgtaatgacccttttgtaaatgtggtggcaagaggaaggtaccgctagaaactttagtaccggcgggataagcaacgccttgttcagccaatttaccaactagccattttagtgagtttaaagggttgcctaaaacttcggatgatttaccagtgcctaattctttgccgtctaaagttagggtacaatcaacggttgctaaatcggcaactgtaactttttcggtcgtatcagctccgtaaacaacgcggccaccaacagcgccatcggccacgaccaagtatttagaaagggctgggaaccaatcactgaaacgagaatcaggtaattcaacaccagcagcgacgccaactttagctagtaattgttccagtgtatcactaggtaaaagggcttctttagcagtgaaaaccatttcgacttctaacaatggatccattaaatcactgagtggcaactgggctgggctactgagccaagctgatttagtttcagcaccgtaaaaaggtgagtcagagtcgaacattttttgcgtttcctcagaagttagactgactttataaccagctactggttcttttttgagttcagtaaaggcatgttggacacgataagcagtatcaaagtcaggaacagaagcttcccagtcactggcctttaggggcttttgtgtggttaaggcctgatgtaaagcgttagcgaccttagtttcagttgcggattgaacagttaatgtattttcactcataaaaaagatctccctaaagatagatttaaacttgttactaaaaaagcgccccagaaatacaattgtatttccgggacgctacggcgcggtaccacccaaattcttactgttattactaacaataacttagtcacgtacggttattcacgatacgctagcagggtaatggctgcagccaatgggcgttacttaaattcgacccataactcagaggtgattttcattgattgatgactaattccctttcacctaacggaactcgctgctagtcgaaatcaactactcttcctcttcttagtaactcatttatttttaatttaaatctaatatagtcgcctttaatcgatctgtcaagcacaaaaaaataactgacgtagaagctcacgtcagttattacttgttatttaatttctttttcgtaaatataatcacgggtcatcggtaagtatttaccagaagcaccttttgaaattaagaactgaatgacatcgatattaccggattcgaatgaagcagcagccgcttggagataaacatcccacatgcggataaagcgttcatcttgtaatttggcaatttcatcacggtgttcgttgaaattcttgtcccaaatttctagcgtgtgttggtagtgccggcgtaaaggctcaacatcatcaatttgtaaaccagcatcaatgatatgttgcgtattttcaactaagccaggaacgtagccaccagggaagatatacttagttagccaagcgttagtggcaccaccttgttgccgcgtgataccgtggatcaaagcgacaccatcgtctttaaggtatttggcaactgttttaaagtaaagttccaaattttcttgaccaacgtgttcgaacatcccaactgaagtgacgtaatcaaatggttcgtgcttcaattcgcgatagtcgactaattggacatcagccacatcctctaaaccacgatcagcaatttgtttagtgacgtagttgtattgttcttggctcaatgtgatcccagtaacttttaaaccatattcttcagcagccgttaacatcaaagttccccagccacagccaatatctaataatgtccgaccagcttgtgggtctaacttgttgatgatatggcgaactttattcatttgagcttgctctaatgtgtcttcaggtgtttggaaataggcacaagagtaggtcatggttgaatccaaccataattggtagaagtcattaccgacatcatagtggctctgcacgtcttctttactgtgcttttcgttatgtgattgttttggtaagaaacgaatgtacttcgagttgcgcataaaactatctgcgttctcgtaagctgcggttagtaatttttgaatactatatgggccgccagtgatttcgatctttccatccatataaccttcacctaaagccagcgaagcgttgttcaagatctctttcatcgggattgcttctttaagcgtgatcgtaacttcgggctcaccatcgccgtaaaccgcgctcttaccatcccaataattaactttaactggaatgttgaatgaatgaccgaaaagagtcttatagaacgttttttcaagcattgaaactatccttcctctcgtaaaaaatgcttataaaacataagcataaaaacagtatacgcttattttttagcgctgataagtaagttgcagaaattattgtgcgaaaatggtatacttgctagcagaatagtaaacgaattatcgctggctaataagaagaaactaaattttgtgtggctataatttgccataagagtgaatgctatcgattagactaggccaaagagcggcaagtctaagtcgcatcggccgtaacaacaaatttattagcgcacttggctaataaattaccttaattgtgaagtagagccatgtttcttgcggtaagtattttgccacaagaatggccatcgtccgtaacaacaaaatttattagcgcacttggctaataaattaccttaattgtgaagtagaaaggtaggctaattaatttgcaagtgcttgatttaatgaataaacgtcgtcgtggtgaaaaactaactacggcagaaattacttttattacgaaagcaattgtcgccaaagagatgacgactgcgcaggtgggggcctttttagatacgtttagttatcacgatatggaaactacggcggagctgactgatttaacgatggcgttggcatattctggtggaatctatgatcttagtgatttgccggggatcaaagttgcgccgttaacaactgatggtttaggcgacaaaactagtttagttttattaccgttggttgctagcttaggcgtaccgattttgcaagttgtgacacctttggctgaagaaatgactagtcctttggcgcgcttagctgcagtgccgcagttacggactaaattggccgctgatgaatttgtgacgactttgaaaaaggttaacgcagtagctgcggcaccagtggctgaattagcgccgttacagcaacaacttgctaaactagaaatagaaacagacacgactgcggtaccggcattactgacgagtcacttacttagcctagcaatcgctgctggtgccgatgcattggtcgttgatattaagaccggcaataacggcttatcactgaaacaagcacaacaagtcgctaaattagcggttgcggttggtgctgaagtgggccggcgaactttagcggtgatttccgatcttaatcaaccgatcggtgatgccgttggtgccagttgggaaattcgtgaagtgatcgctaccttaaaaggcggtggtccagctgacctacgtgagctagtgctttcactgggggcacaattagctgtcttagggggctatcttgggaccgttgctgatgcacgtgaagctttgagtgccaatttagaaaacggtcaagcactagctaaattccatgagtggctagttgcccaagacggcgatgccagtattgtggaacaacctgatttattagcgactgcagaatttacggcaacagcgcgggcaccacgctcaggctatatagcagcatgggatatggcacaattaaagcagttgcggcaattacttgggcaaaccgctggtgttggttttgttttgaataaggaaatcggcgactcagttgaagccggtgaaactttggcaactgtttatagtgcggcggctgatattcaaccagtattaaaattagcacagcaggcggccacgattgcggataaggcgccggaacatcgtttattgtacgatgtgatcgatagtgccttggaacaaactgattaaactgaagctcggcaaattttgctgggcttttttatatttactaatagatgataacgattacaggctgtgctataatagggcgttatcaagtgctgtgttttatagatcaaatagctttgaaataggggtgggggaatgactttattagaattacaagatattggttatcagattgcggggcaaaatgtgttgcagcacattgaactcactgtagcagcacaggattatattacgatcacaggtccgtcaggtagtggtaaaagcacgttattacgcgtaattgccggacttttaactagaactagcggccagttattgctggctggcaaagagtgggcggaatatgatccgattttatatcgacgcgaggtttcatatgcggtgcaacagccgcaattatttggacaaaccgtagccgataatctccggtttccgtttcaaatccggcagcaggattttgatcaaaaacgagctgttgcggcgctggccagtgtgaatttaccagccgcttatctagataagccgatcaatgatctgtccggtggggagcgccagcgggtcgctattttacgcaatctactttttccaccacaaatcttgttattagatgagatcagtacaggactagataatgagaataaagcgatcctgcatcaggaaattatgcgcgtcaatcaggaaaatggggtaacgattttggcggtgacccacgataatgaggagatcagtggtgccaatcgattgattaaaatcgtggctggaaaaatggaggcgaatcaatgaatttagcggtcagtaatactactttgatttttgccgctttactcgtttttgtggcgttgtatatcggctatcgtgaaaagttaggcgtcgataaagacattataatcggcgtcgtgcgggcaattattcaactggttgtggttggttacttattgaaatacgtttttcgcatcaataatgtgtggctgactttgattttgatcttgattattatttttaacgccgcatataatgccaataaacgggctgctggtattcggcatgcattgccaatttcattgttggcgattttatcaagtaccggattaaccttagcggtgctggttttttcgggttcaattcgtttcattccatcacaaatgattcccatctctggtatgatcgccagtaattcaatggtggcgatcggcctttgttaccgtaacatgaatagtagctttcgtgatcgacgtcaacaggtgctagaacgtttggccctaggtgctgatttacgactagcttcgatcgatatcgttcgtgaaagtattcgtactgggatggcaccaacaattgattcagctaaaactgtaggtattgtgagcttgccagggatgatgtccggtttgatttttgctggcgtcgatcctgtacacgcaattaaataccaaattttagtgacgttcatgttattgtcggcgaccagtattgggtcggtgattgcttgttacttggcgtataagcaattttataatgaacagaagcagttgttgtaggcataaaagattgaatggttcagcggtaagctttgcggcttacgctggacttttttaattgaacatgaatcagaaaattaaaattggttaagctaggggttgtgacataagtaatttatgttcaactcctttttgcacttctgaataatattgttaaaactatgccacaaggcaaattttttcgtttagctacggccaaccaataatccactgtgtgcatttatacgccgccttaggctaatttctaaaaaatggacgcttgatgtcacacgtttatttttattctactttctatatttttattctattaaatcgtattgagactcactatactataactgtagtaaagctagaccagttaactttaattgcgattaaaataatatttttactatataccaattgtatctgatactattccaatgctttttttaaacttgaccagtaaataacgagcttaatcaatgttagcgttttcgttatgctataagtatagaaagcaaggaggtaattagtatgttagcaaattggttagaattacaaggtaaaacggtggtcgtaacgggtggctcttctggtattggtgatgcgatcgtgcgtgagttagtcacacaaaatgtaaacgttgttaatgctgatttaaaagaaggcaaatttcaggctaagaacctaatgtttgtccaaacagatgtcacttcacctgcagcagttgaatctttagttgaacaagttgtggctaaatatggaacaatcgatggattggtcaataatgctggtattaatttgccacggctattggtagacgataaacaaccaaagggacaatatgaattaactgaagctgccttcaataagatgtttgcggtcaatgttaaaagcgttttcttaatgagccaagcagttgggcggattttagtgcacaagcacgagggtgtcattgttaatatgtcatctgaagcaggacttgaaggctcgattggtcaaagtgtttattcagctactaagggcgcgattaatggctttacgcggtcatgggcaaaggaacttggccagtataatgtgcgcgtagttgggattgcaccaggaatcatggaagcaactggtttgcgcacaccggcttatgaagaagctttagcctatacacggcataaaacggttgaacaattacgtgctggctataagagtacaagtacgacaccacttggccgtagtgggcatttgtcagaagttgctgatttagtttgttactatttatccaatcgttccagctatattactggggtaacgacaaatgttgctggcgggaaatcgcgtggttagatggttgatttaagctagcaatattaatttatagaaatgaggcgtagcgcgaatggacaatcaagattatcgtttattgaagcgatttatcactcgtgagtcaattcccgtggctgaattgattgctagtgaaaatatttcgcagaaaactttacagaaacgtttggcaaagttaaatgagaatatacatggtattggccaaattaaggaacggcatggtcgctattttcttcaagttattgattatcatggcttgagtcgactgcaatccggttatttacgtgaatcactagactttaacgatagtgaaaaacggcaggcctatattattcagcaattagtaacgacaaccggctatgttgttcaagatgatttagctgatacattaatgatcagtcgcagtaccttaagcaaggatttagacaaattacggcgtacgttatgtgtttacgatgcagaaattgtggcgcaatctaatcatggtattaagttagttctagaccaggcttatcaattgccattactattactcaatgaggtctatgattattttgcggctaattatccgttaacgcccgcggtgcagcaagcgttagccgctgtttcaaaccagatcaatgatcaaacgaccgccacacgtttacagaagttgaccgctattatgtcgtttttgtggcgggatgatcggcaaattgatttacatgtagcccattatcaaaatttagtaagattaacgtcagagtggcagcaattatttcgcgctttatcggcgcaacgccaaactaatttgacggcaactgaacaagactttatttgttttcctgttaatttaaagtattcatcgttgttatctcgttccttagtcgcgcaacaattagataagaatcaagctttattacagcaaatcaagcgccagatcgaggtacatgttcaagttgaattagattatgctgaattttatacgcaagtcaaatatcatttactttttctgtgttatcgtagtttgtttaacatgcctgctagcgaaatttttaccaacgagatcattaagaattatcccgttgcagctgaattggcattgattgcactgaatacattagagcagggattaggtgccattattccgaccacagaagcgacttatttaacggtatattttcagttagctttggatgcggttcaagatcaacagcatgtcgcacaacaagttggaatcgtcggtaacattggcttaggtgctcagcactttttgaaaaagcagctagcggaggtctttgctgatcaaattaaggtagttgccataaccgataaagcgcaattgaagcaacctgatttacctttcttattaattttttctgatcaaccattggatttaggggataatcggattccagtgattcgaatcgatgatttatttagaacagaagagttgaccactaaaatcactttatcgctagtccataaagcaattatggcgcaagcatgtcatttgcaaataacttatttgacaccgcaagctgattatcaagcaaccgttgatcaaatgattgaacaggccacacttaaaggcgaattggctcctagttttaagcagatgtggcatcaacgcgaacttcagggcagtagtgttttcgaaaatgggattgcattgccccatacgatcaatgaaatcgccaaaccagtcatttttctacaaattggtatcttacaaaagccattgctggtaaataagcgcaaagtacatttgattttcttactaggtattccgcaacagttaaatcaacagctgaatcgagtattggatacgttgtatgattttatttttagtgtggtccgtcaggaaaatgtcttacaaaatctgttgcattatcgtctggatcaaccgattgaacaactaacggaggggatttaatgctgattattattttgattattttcgttgcctttattctacaggccggactgggatttttacagttacgaaattttactcaccattatcaggctcttcggcggcaaggacgagtgttgattggacgcaatcctaaacgattgcaagcgggcacgttacttttgattactttagatcaagatggcgtgattcgcgcctgccaattaatgaaaggggttactatttttgctcgttttcaaacggtgactcgcttcaatggacagtcctttctggaagtagctacagattataagcagctagcacgtgagtccagattattaagacaatgtttattgaatgcttatcaaacgttgatcaaatatcacagtggtcagttaaacgagcatgattttagcggtcaaacgaacttttttgatttgccactaatcacttatattcgtaatcaactacaacactttggccattatctaaagaaagtaggcagttaatatgcattatattacagattttgcatcaggttttatgaacttattccagactggtgctaagacttttattagttggatgtcaacgatcgtaccagtggttttgttattgttggttttaatgaatacgatcattgcctttttaggcgaagagcgaatggaaaaaatcgctaaggcatcgtcaagaaatgttttgactcgttatatgttattaccatttctagcggcattcatgctaggcaatccaatgtcgtttacgctaggtcgatttatgccagagttttacaagcccagctattatgcggcaatggcgcagtttaaccataccagtaatggggttttcccgcatattaatccaggtgaattattcatttggatgggcattgcacagggggtccaaaaattaggcttgaatacgatggatctagccatacgttacttgttagttggtttgattatgaacttcattggcggctgggtcaccgacttgacgactgcatatgtttgcaagtcaagcggcgtgaccttatccaaacaagttgcacttaattctaaagccactgaataatttcgaacatcaaggaggtttgcatcatgagttggcataatattcgtattgtaaaaggtagtggcggctacggtgggccactaaccattaccccaactgaacagaagcataaatttatctatgttaccggcggcgaacgtccaagcatcgtggataaaattgaaaaattaactggtatgaaagcagtcgacggctttaaaaccgcaattcctgacgaagaaactgcgctggctgttattgactgtggtggtaccttgcgctgtggtatttatcccaagaagggaatcttgacggtgaatgtattgcctactggtaaaagcggtcccttgcaacaatttattcatcccgaaatttatgtttcagcagttggcgataaacaaattacgttagttgatgagactgctactgaaccagccgctgctgaaactgaaaccgaaaaggcggccgtaactgagactcctaaatacgaaaccgggaaaaatattactgaccagctacaacataaaagtattatcgccaaaattgggatcggtgctggtaaagttgttgcaacgtttaatcaggccgcaaaggattctgtccaaactgtgatcaatacaattattccttttatggcatttgttgccctattaattggtattattcaaggatctgggatcggcaagatctttgctaagttaatgtcgcctttagctggcaatgtgattggtttatgtgtgatcggattcatttgttccttaccgttcttgtcaccattgttaggtcctggtgcagttattggtcaagttgtgggtacattaattggtttggaaattggtaaaggcaatattccaccacaatatgctttaccagcactattcgcaatcaatacgcaaaacgcttgtgattttattccagttggtttgggattagaggaagcagaagccaaaacggttgaagtcggtgtgccgtcagtgctttattcccgctttatcaatggggtgccacgggtgatcgttgcttggttagctagttttggcttatacgcgaagtaataaattaatcgggaggaattcaatatggatcagactaaaacagttgtttttgaaacgcacgtgaatgagattgggactgaagctaaagactttgctgcaattaacatgatgattttcttcggtaatgaagcaccagcagctttgcgtccttcgtgctatttaattgatgtggtgccagtacaacagaccattgtccctggcatggtgttgttaattgatcagcaagcttacaaagtaaccgcggttggcggcgaagttcagactaatttaagcaatttaggtcatatctctgttgtttttaatggcgcaactaaaccagagctagcagggacaatgtatgtggaagctaaggattatcctgttgtcagtgttggcagtcaagtccaattattagcctaataaaaatgagccgcttttgggctcattttttagtggcgaaatttagaaggagtagtaccagtatagtgacgaaaaacccgggtgaagtggcttggatcagcaaaatttaacatagtggcgatttcttgaattgggcggttggaaaactttaagagataacggccttcgactaccttacgttgtaaaataaattgttttagtgataagccagtggcttgtttgatcgtgtgtgataaagtcgccggtgcacagtttaatgccgcagccacttgttcaacgcttagtggctgataaatatgttgttgcaggtactgttctacttggtagacagtagtgggtagttgttggcgttgataacgttgtaccaagtgtgtgtagtaagcgatgatttgtagagtaaaatctttgtaattttttaaatcaactgatttttctgcttcgcgaatcaacttatcgcctttgaaataagattcgccagctgggacaccaccagcattagcagcacgagaaacgataacgactgtgacaataataaattccttaatgcgtctaagcggatcattgcttaacataccaatatattccgggatcgctaataattgatcacctaaactggttgcacgatttaaattaccggcagtaattgcggcgagtaataacttttcgcgctcataaatactgttcatttcttgataatgcgtgacttcgttagtttttaattcctctaatagtaaatcacgtaatgaataatcggcgatcaatttatctaattttggtgttaaatggatttttggcgtggctgccttatgatatagcgctaaataaatcgttgtggctaatttgcggacataatctttatcaatggcagtatgactaatacttggtgcgtccaatgaaataaaacacagccaaaagccattccaatggtgttctgttaatttaggcatacataaaattagtagttgccaatgcgtcactgtgaataactgtggttgggctgatttaaataatggcagtcgctgcaccacttgggttgggtgtaatgtgacggccatatcgcgttgcacttgggtgatcaattgtccagagctagtaaattcacaaaacgaaaaatttaataactggctaaattgttgcattaaactaagctgtggatttgtttgtaccatgaatgtactcctttgttcgttaagtagtataaacttattataacggtttcagccgttttgttttcaataaagtcggttgtaacttttttataataaacagaaatgctttctgcaaatagttttatttaataagtttttcatgaaagtaatcgttttctgaaaaatataccaaaaaactctgttatacttaatgtacacactagattagataagcattgacttttagcaattagctttgatatataccaatttcaatagtggtatttatgctacttaattttaatagcttatttcaggaatacaggtgtgtaattttggctagaacgtgatttgtgagtatgttggaggtctttggatgaaaacttattttcagcgtatgggtcgctcgctaatgctgcctgttgcaactttaccggcggcagcgatcttagttggtattggtcattggttaccagaaaattgggccgcagcgcagtttttacaagctggtggtaacgcaattttgactaatttggcgttgttatttgccgttgggttaggtttaggaatgtcgcaagataaagatggttcagctgctttagctggtgtcgtagcgtttattgttcctacatatgtcttggctccagcgcaagtatcaactttattaggcattacaacagcgaaggttgatccggcgtttgcggcgatttcttctaacgtatttatcggtattattgccggattagttgcggcgacgatgtataatcgtttccatgaagttaagctgccaatggcgatctcatttttcagtgggaaacgtttggtgccgatcatggctgctttaacgatgctggttatttcgttagtcttactatttgtttggccgccgatttatcaggcgttagttgccttcggtaaatttattgttggcttaggtgctgttggggctggattatatggtttcttcgatcgtttgttgattccaaccggcttacatcaagcattaaactcagttttctggtttaatgttgccggaatcaacgatattggcaatttctgggctagtaaaggaacgcgtggcattaccgggatgtacatggctggttttttcccagtgatgatgtttggtttgcctgccggcgcgtacgcaatttatcgcaatgcacggccagaacggaaaaaggaaaccgcgtcattaatgttggccgcgggctttgcttccttctttactggggtcactgaaccgctagagttttcctttatgtttgtggcttggccgctatatgtgatccacgcagttttcactggtttatcattagctttcgcggctgccatgcactggaccgctggtttcacttttagtggcggcttggtcgactttatcttgagtttgaaagtaccgattgccaatcaaccattgatgttgttggtacaaggtgttgtgatggcagtgatctactactttggttttgattttgccattaagaaatttaatttaatgacgccgggacgcgaagcgatagctaccaataatgatgccactgtgggcgtcgctattggggatgacgatgacaaatattcgattgccgccaagaaaatttacgcagcgattggtggcaccgataatattaaggtagtcgataactgcacgactcgcttgcgcttacagctaaatgatacggcgaaaatcgatcaaaatgcgatcaaggctgcaggcgttgctggcttaaacgttttagataaaactaatctacagattgttgtggggacggaagttcagtttgttgccgatgctttggctaaaataaatcaagccaaggtaccacttgatcaaattgaatcaacagcagctccggtggcaatgccagtcactggcgatgtaactgttggggcgaccgaaactttgtacagcgtggctaacggacaatacgttgcaatcgaggatgtgaatgattcaacgtttgcacagaaaatgttaggtgatggttttgccattgagccggatagtggtgaaattgtggctccagttgacgctaaagtgatgtcggtttttccgactaaacacgcgattggttttaaaactgcagcgggcttggagatcttgctccacatgggcattgatacggtacaactaaacggtgaaccatttgaagtaactgttgcagcagaccaagaggttaagcacggggatgtcgtggctcacgttgatttagatgccatcaaagctgccggaaagcagacaacgatgatcgtgatcattaccaatatggcgcatgtcggctatctaaaggtagcaccagtgactgcaaaattagtaacgaatacagcagtagcccaggtgacaactaaataaggtttaagcacactctgatctgagtgtgcttttttctacgattagtcaagagaaacctctattttatggggttctcttttttttgccggatttacaatgtaagtgcaacaccaaaataactagaccaaaaaggccatgaagccttaaacttataagtgacaaaaccaataagttaggacggacttcatgacccaatctaaagataccatca

SEQ ID NO: 488 - DNA, 2375 bp, Unknown
  Metagenome-assembled genome
cctgatggcccaatcaagccataaatcattccagccggcagtgtcaaatcaatctgattgagcacttgctgatgaccaaagtgcttgctgacctgcttggcgatgacataatccgttgccattttaagaaccctctttctcaaagtgagtgtatactcactcacttaatggctttagtataatcagtacatctcggtttgtcacattaaaatgagttatcactcacttattttgtttccggcccatttgtcaccgcattgtaaaatcgagtaggaggtaattgtaagttaccgtcctctcacaccaccgtacgtacggttccgtatacggcggttcaataatttaagcactctgaatttgctggagcgtctgactcaagttaatgagtccacgacgttccagctctttgttagttagggtacggcacagcgttttactatgcgctgtccgccagtaccctttacgcgtgttagcggatagcttagcttcatctttcgtaaatcctaatccgctcaagttgttctctctagttttggctttcttccattgtttccaaatgtactggcgaatacgtgaccgcagccacgcatctaattccgtgatgaaccgcttcattctacccaagctgtaatactgcaaccaaccgcgcatcttttgacgaatctctgccattatttggtcttcggatacaccacgattacgcttagtcagccgcctcaatgcttgtttaactcgctgcttcgctgaccacaccggatagggaaaagccctgcctttagtgtgacccaacgtaaaacctaagaacttcattctgttggtggcgaccacttgtgtcttttcctgattgagcgtgagttttaactcatgctcgagaaaacgagtcacactagcgaggactcgttggcccgcgcgtggacttttaacaaagatattgcagtcatcggcgtaacggacaaattcatgaccgcgcctagctagttcttggtcgaattcgttgagataaatattcgctaacagtggcgagatcggcccgccttgcggtgtgcctttctcactgcgttcaaacaattgcccattcatggtgccactagtcagaaaacggcgaatgagccgtagtatccagcggtcactaattcgctgcttgagaaacttcataagcatgtcatgattaaccgtatcgaagtaggccttcaaatccagatcaaccacatagtgataacccgcattatctagctgaacgaccttgttgaactgcgtcatgtgcactgcgttggggtcgaaaaccaaaactattgttggcgaatatctgttcatatatcggcgaaaggacctgggccacggcctactggactagccggtcgatcacggtcggaatgccaagcttacgcgttccaccgttgggctttggaattgagacttgcttgactggtgccggtttataagtcccattggccaattctgcgagtaattcttcgcgatgtactttcaggtacggtttcaattcatcaacggtcataccgtcaactccggccgcccctttgttcctgaccacacgttgataagccaaattcaggttgttgcgggccaaaactaatgcttgaaactgagtgccactcatcttttctccttcaccggaggcgatactacgcgccccagtttgtctttggtcttccagacctatcatccgctggcggtcagcttgttctgttttctgcgattttcgcatcgtcttcacttccagtcgcaatatgagttattattgtttggtccttcatggttacccactactatgacctcggctgactcctgtacacttaaccagccatttctgacttgctttgaactcatatttccttgtcatttgggtattccctaagaaaatcaggattgtgtgtacaggtctccccgggtaagaacgtcaactttcgtaccatgtcaccgtcagctttactgtcgtaacttcgggtagtatcggacttcagtgtgtttggccaccttatccagttacttccggccttatagctgcttcttgttcatcggtgcagtactttgctcatcaggcttccttcagtcttcacctcacgataaaggccttgcctttggctagcggttccgactactacggcccgcagtggactttcaccacctagttgacgcccatgccgggcgcaccaaaaatgcgccaccccgttgttgggatgtcgcattttaattaaatagcagcactgatataagcgttagcaatgttttagaacctgtctagtatctgctgaatctggtagaattgtggaaaaccgactgaggagtttgtcatgccagattatccaagcaatatttctcgagcgcaatttgcgttaatacaacctgatttagaa

SEQ ID NO: 489 - DNA, 5188 bp, Unknown
  Metagenome-assembled genome
tgggatcaatttaatataccctaaaatactatttttagattggctactaccaatattgccgctttgatctgggtaaagaaaaaagaaagctgattatatcaactttcccttgactaatggtagaaaaagaccaaaacaagcgttacctaacgtaaccgttgttttggcccaccgcaattaattaatatatgcgcagaagtggatgctcctatctatgcttgattcatattttcaaatttatataagtgacatggtaaaatttttatacgttcaaaggccttcaagccgatcaacggcgcacagcaattttattcactcacttttcccaacacttaaaagtctaccaggaaggtatgaattttgtgtgaataaagcctaatataatcctaaagaaaacgattactaagttaattaattaaagttagattagcaatttaggcgtaaagatggttaaatatttaataattagaatgtcgtaaaagacaggttgtggctaaatttatggttgagaaattgtgcttgatcaggtttagctggtgtaatgggggaatttaaatgcaaataaagtttcagcgggcacaacatagcgatttaccatttattgttaaagtttataacgaaacagtggcaagccgaatggtgactgctgatttagaaccagtgacggtggcccagcgtgagccatggtttgcggcacatcaacaacggcgacggcctttgtggttgatcacagcagacgggcaaccagctggttggctgagtttatcggattattatggacgcgcggcgtaccacaatacggttgaaatcagtctctatattgatgaacagtttcgcggtcaacatatcggtcagcaaagtctggcttttgttgagcaacaagcaccgacattaggtatcaaaacggttttgagttttatttttggtcacaatcaacccagcctacatttatttacgaagcaaggttatcgtcaatggggaaagttaccccaagtagctgaattagatggtgagcttcgtgatctggtcattttaggtaaacaaatcaattagaaacggggaattaacatgcgttacgtaacagcaggagaatcacatgggcctaaattaacggcagtgatcgaagggatacccgctggtttaactttatctgcggataaaatcaatgcagcattggctcggcgccagcaaggctatggtcgcggtaatcggatgaagatcgaacatgatcaagtggagattgtttctggcgtacgccaccaaaaaacattaggtgcaccgatcacgttacaggtgactaaccgcgattacgcccattgggatgaaatcatgagcccaactgcagcagcaacaccggaaaatacgatccgccaggtgaccaagccacggcctggccatgcggacttagttgggggacaaaaataccaacaacgtgatctacgcaatattttggaacgctctagtgcgcgggaaacaacgatgcgtgtggcggtcggtagtgtttgccagcagttattggcagcaatcgatgtcgaagtgctcgggtttgttcaacagttaggtggtatctacgctgatccaactaaattaccagaattaggtgatctagcggccgttcgtgcagtcaccgaagccagtgacgtcagaacctatgatgaagctgctgccgctaagatccgcgatctgatcgatgtcactaaaaaagctggtgataccttaggtggtgttgtcgaagtcgttgccactaatctaccagctggtttggggagttatgtgagcgcagatactaaattagatgcaaaaattgcccagtcgatcattagtatcaatgcctttaaaggggttgaatttggtgacggcttcggtttagcggatcatcccggtagtgaagatatggacgaaattttgtacacatcagaacgcggtttctaccggggcagcaatcatttaggcggctttgaaggcggcatgaccaatggtgaaccgattattgttaaaggggtcatgaagccaattcctacgttgtacaaaccactgaatagtgttgatatcgcgactaagcaagcttataaagccaatgtagaacgctccgataccacggcggtgccggcagcagcagtcgtcgctgaagcaatggtatcgatcacgttagcggaagccgttttagctaaatttgacgctgatgccttaccacgtctacaagcacaagttgcagcttatcggaaagaattagccgcatactaaaactagacttttgcgatcaaaatagggggttattatggataaagcattaattgccaatgcgcaagggctacacgggaccttaacgattcctggtgataaaagtatttcgcatcgtagcatcatgtttggtgcattagctgaaggaaccacggtgatcgatcattttcttttctctgatgattgcaagcgcacattagctgcgtttcaagcgttgggggtaccgatcacgatcgagggtgatcaagtcacaatcactggggttggtttgaacgggttaaaggcgcccaaagagccaattgatctcggtaactcaggcacgtccacgcgtttattgctgggtttactgagtaagcagccatttccaatcgatttttttggtgatgcttctttgagcaagcggccgatgcaacgggtgatcggcccattaagtcaaatgggggcgcagatcacggcgactgctgatgattttttaccgttgacgattgcagcgaatacccaactaaatgcagttgaaatgacagtaccggtggctagtgcgcaggttaaaagcgcgctgatttttgccgccttacaagccgatggtatttcgaaattaactgaaattgcccagacacgtgatcatactgagcggatgctacgccaattcggcggtgaaatcgaaaaagatgggttaacgctgaccatcaaaccacagaatcattttgtcgcgcaacaattccgtgtaccaggcgatatgtcgtcagcggccttttttgcgttggcagcgaccctcgtttctaatagtgaactgcggctggcccaagttggcttgaataagacgcggacaggctttttggatgttttgagtcgcatgggtgccgacattcacgttgaaaatgttgattcgcgtatcgacgaagttagtggtgatctggtggtaatttcaagtgctttaaaggcaaccacggttcatggtgctgagatcgccaacgtgatcgacgaaattcctttgatcgcattggcggcaacgcaagccgaaggcactactgagatcagtgatgccgctgaattaagggtcaaagaaactgaccgtatcgaaaccgtggcgacggagttacgtaaattaggagctaacatcgaaactaagccggatgggatgatcattcatgggccaacaccattgcgtgctgtaactagcgatacggtagattcacatggtgatcatcgtattggtttaatgttggcagtggctgctttattgagtcacagccaattaacgctgcatgatgccgctgcgattaatgtctcttatcccagttttttcaccgacttaaaacaggtattagattaaaatagcatcaagtaaacgttttcctaaacttattttcaaaaaaagcggtcatattttgttgttatttgaaatgtaagatgatatcattttagatgaattgtgggtgctggtgtcgccctatttaatcacaccgataatcactaaggagggacatatttaatgtctaaatcagtagtaattgaaagtgttaaagcacgtgaagtctttgattctcgcggtaacccaactgtcgaagctgatgttgttttaactgacggtactttgggccgtgcatccgttccatcaggtgcttcaacaggtgaattagaagcaactgaattacgtgatggtggtagccgtcttttaggtaaaggcgttagcaaagccgttaacaacgttaacacagaaatcaatgatgccttgaagggtgtttcaccatacaaccaagctgcaattgatcaaatcatgatcgacttggatggtacacctaacaaagcacgtttgggtgccaatgctatcttaggcgtttctatggcaactgcacgtgctgctgcactttcattggatacaccattgtaccgttatttgggcggggtaaacattgaattaccacaaacattccataacgttatcaacggtggtgcgcatgccgacaacggtatcgatttccaagaattcatgatcacaccgatcaagaagactagcttccgtgatggtatcgaaaaaatcgctgacacttaccatactttgaaaaaagtcttggaagatgctggtttccaaactggcttaggcgacgaaggtggctttgctcctgacttgaagaacactgacgaagctgtttcaatgctttacaaagcaatcgaacaagctggttacgtgcctggtgaagatatcggtatcgctttagatgctgcttcatcagaattctacaacgaagaaactggcatttacacatttgaaggccatgaattcaatgctgaccaattacgtgattattacgtaaatgacttattgaagaaattcccagctatcatttctatcgaagatccattctccgaaaatgattgggataacttcgctaagttcactgaagaagttggcgatcgtgttcaattagttggtgacgatatcttcgttacaaacccatctatcttccgtaaagggatcaagaagggtgttgctaactcaatcttaatcaagttgaaccaaatcggtactgtttctgaatcaatcgaagcaattcgtttggctaagaacaacggctacacaacaatgatctctcatcgttcaggtgaaacagaagatacattcgttgctgacttcgccgttgccgtttctggtggcgaattgaagactggtgctatggcacgttcagaacgtgttgcgaaatataaccaattattacgcatcgaagaagaacttgaaggccaagcacacgttgctcattttccacacaacgttgactttgactaatcaaatataacgattttaggctctttgtcaaatcctgttgatgaatagcttttacagagttgaaagtcatgcgactttcaactctgtttttttcattggttttgttctcatttgccgtaacttaatacgtgaaatcatatgatggtaattacggaatccaaa

SEQ ID NO: 490 - DNA, 4034 bp, Unknown
  Metagenome-assembled genome
ccacgtaaactatttggttataaatcagccaatgaattcatggctgagcagctactcgcatgaccaccacctagaccacttataagtgaagtttagcaagtgttgcacttgatttgacaattcgggagtttttagaaaacaactgcaggatacattaaatacgttacttcaagccgagttaacttctgttctaggctacgatccttatgatcgtcaaggtttcaactctggtaactctcgaaatggccaatattttcgtcaaattgattcagagtatggaaagctgagtatctgtgtcccacgtgatcgcaagggcaagtttaaggctaacttaatcccaccttattctcgaagagtagatgcactggaaacgacgattatacagttatacgaaaaaggaattacaactcgagaaatagctgacttaatcgagaagatgtatggaactcattattcacccactacgatttccaacattacagccattgttgaggatcaagtgactgcttatcatcagcggcggtttagttcgacagactacgtctgtcttttccttgatgcaacttatgtgcccttacgtcgtgatacggttcaaaaagagtcggtttatgtcgctttaggtattaaagcagatggtcataaagaaattttagattactgtattgcaccaacggaaaattcagaagtttggtccgaattactaactggtttagtcagtcgtggtattaaacacgtccagttagtcatcgcagatggcttagttggcttggattcagcgcttaaccacaattatcctcaagctaaatttcaacgctgtctgatccatatgtcacgaaatatcatgcagaaagttcgtgtaaacgaccgtgcagaggtcgttaatgagttcaaagaactccacagagcaaaaacacgtgatgaagcccagctaattttaaatcgttttatcgatcattgggagtcaaagtatcctcgaatggttagaaatttagccagtacgtctaatttactaaccttcttagaatttcctccgagtattcgcagaacaatttactcaacgaacattattgaatcattcaataaaaagctgaagcgcaagacaaaagtcaaagaacaatttctaaatgaatcagcacttgaccgtttccttgcgacaattatcttagaatacaacgagaaatacttcggcagagctcataatggctttaagcagtgccaagatactttagaatcaatgttttaagctagacaaaatgatacgcagaagtcttcttgttatttacacaaacttcttgacactcccgttagaaccgtggcatctatactgttgtccatgatagtctatgttttgatgctaatagtattgaaaaatgatcttattttagaaactatctataaagtaaggaagaataggcggtttttttcgtaagcgcaccagaaaaatcgtattgtcacgactggtggcggtatgaatggattgagttcaaaaaactagacatgaataggactataaagtttgatattacctattccagagcatatgcctggacgtagaaatacgagcaagcaaacgattggacggccctaaaggaccggcgtggcaagaccaggggtaggcaaccagccgaccgtgaggaacagttactcaaagagattcgggacctcaaagctaaattacgtgaaagagaggttcggattgccttctcaaaaaaattgatcgaaataagcaaccgggaggtgaagcggccaaacgatatcaagcggttcaagaaatgaccagcagtggcgagtacacagttagtgaaacggcccgagctgcgggaatcagtcggcaagcgtattacaaatggttaaatcgtagattatcgctacgcgaacagcaggaacgggaagtactggaggagatcaagcgaatcgaaaaacggcatcaagatagtgttggatacgataagatggttcgtctattgaataaagagggccaattaagttacagagtggggattaagcgggttagcaggattatgaaaattaatggaattcgggcggattaccggcagccaaaaaaggaccgccagggagcaaaacaaacctatcaagatgaaaacctactaaatcggcaatttaagcaagaaaagccgaatcaggtttgggtaacagatacaacagaactgacttacgggaccgctaataaagtccgtctacacgccatcttagatctatatggacaaaggccagcagcatggttaatctcaccaacggagaccagtgaagccgcaatcaaagtctttaaccaagccgctaaggctagtggaaccactccagaaatgatccatacggatcgtggagcggcatatacgtccaccaattacaacgaagctctccgtcaggagaaggtaaggcatagcctatcggcgcctgggacaccagcggataacaccgtaatggaacactggtgggcagattttaaaagcatctggctcgagcatcgtccaaaggcgcaaactctagcagagttacaggaacaggttcgtgctggaataatgtacttcacgaatcagttcatttccgctaaaagaaatgaccaaaccgtggcggaatattaccacgatttggtcggataagaaaaattgtgttttcgtttttataagtgtcaacttgacaggggatagtaccgtgaggatacttaggattaggacgagtgtattaaggtaccgtgtatgagattatcaaaagtggagataatatggtaaaagtaaagttatcaatgatagttcccgtttacaacgctgaaaagtatttggaagtatgtttggaaagtgttctagttggtaaattcgataaagaactagtagaagtactattaattgatgatggatccacggataggagctcggatatttgtgactactatgctaaaagatatagttttatagagacttatcatatagaaaacagagggcaatcaaatgctagaaactatgctcttgaatatgcgcgaggtaagtggatctcatatgtagattgcgatgatcttgtagtaaatgactacttaagcactgttttgtcgttagtagaaaaattgaacgataacgatattttgatgtttaggtttaagaaattttcggaatatagggaaattgatttagatactaactataattcagacgaagtgaagaggatctcaaaggatgaagctatgtatgatttgaccctgaaggaatgggataatttcttgtggaataaaatatggccaaaagaaatcattgagagagttgctttgccagttggtaaaatttttgaggatatgtcaacggtgtatcaatatttcgaaatagcagataatattgttgtttataatgaaatattgtatttatatcggctaaatgagctaagttcaacacatagtaataatctatcttttaggtataaatcaatcaaggaagttgtcaatgccaggagagaacaaatctcattttttgaaaaaaatggatatatcgatgccaaattaaacgctattaacaatctggtatatgacgcgatctctttaattatgtacacagaaacatacaagtatgtaaagggcgaagaatatcagtattctaaggatgtaataaaagcttatactccgcacataaaagaaaatggcgttaaaatttggctatttataaagctctatagctaccttcctcaaatctttaaattctatagcaagatccattttaagaagaagttttcataggtgtttagtatatgaaaaaaaaacattagacttaaatgcagtacttaatggatttcggagtgtactgaatttattgtttcccatcatcacatttccatatgtatctcgagttctatctgtgaatgggatgggaatatatagtttttcgatgaactatataaactattttggtcccctgtcaataaaatagacaatttaaatagagacttttttgtcctatgccacgactaaattttgaatttgagtttgatactcatcttcaagttgctttggtgatttgaatccacagtgactg

SEQ ID NO: 491 - DNA, 19524 bp, Unknown
  Metagenome-assembled genome
tgataaaatagtggtgcccataaaggtccttctttctagtggaatgttgtggtgacaccattaaagacctttatgggtttttctgtccactaatatgttcaacttaaattttacaatctaccttttacaataaagttgtccaaaatagaatgcttattcgtcatacttttagtgctggttatattttttaaataaaaaagaacttgaacatgattgtccaagttcttttggtattaatggtcaaagcataattaattatttactttttcagcacctaaacgctgagtaaagttcttagaaataacaacgagatcgtctgcgtaatcgcgcaaagaacgataactattgtaagtagcttccattaacgagccaatattacaaccagtgacaacttgcactttgtcgttatgataagctaattcggcgcaaactttaaatggtgtaccaccgaagatatcagtgaacaatacggttggttcgcctggtttaacttccttagctaaagccttcttatagtcagcttcggccataccattttcaaaatttacgaatttataattatcgggaataattgaaagtaggttgagggtatttttgatcccatctgcgaaactgccgtgacctgtgataattgttgtgtattgtgccataatgcattcctccattttactttagcctataggagtcggtttttaagttttaaaaactggcttgtgattcctatactcttatgaaagcatttttatgaataaatgtcaacgcttacacgatttattaaacggctttttgcaagattgtaatgtggaattagcttggtacagcaaccgattacactaatttaaataaaaatatcgtcttgcagctggcggcgaccaaacgcaaggcgatatctgaaaaatcatttaattttcatgaatattattggcgagtttcaattccgttttccttaaaagcacgatcggctaagtctttcaattctttacctgacttagacattgcggcttgttcggtttcattcagtggtaattcgatgatatgtttaagcccaccgcggttgatcactgctggtgtgccgatataaatatcatctaaaccgtactgaccttgcatataagcggaaagggtgatgatggcattttcatcatcaaagattgctttggtgatccgcgctaaggcagcagcgatgccatagaatgttgcaccttttttctcgatgatatcgtaagctgcgtcacggacgctaacgaagatcttatcaagatcagcttgagtcacttcaggatgatgttccatgaattcgctcatccgttcgccaccgaaagttaaatgtgaccaaacagagaattcagaatcaccgtgttcacccatgatgtagccgtgcactgaacgtgcagcgacaccaactaattcagcgactgcttggcgtaagcgagcagtatctaaggaagttcctgaaccaataacgcgttcttgtgggaagccggataatttccaagtggcgtaagttaagatgtcaactgggttggctgcgactaagaaaataccgtcaaagccagattcgacgattggatcaacgattgatttaagaatttttaggtttttactaacgagatcaagacgtgtttcacctggtttttgtggtgcaccagcagtgatcacaacgacatcggcgtctttagcatcagcataagtgccggcatagatcgtttttggtgagttccaggctaacgcatgggaaagatccagtgcgtcaccttccgttttttccttcgcaatatcgacgatggcaatttcttgcgcaataccttgtaagacaagtgcaaaggcataactagagcctaccgcaccgtcaccgaccaaaagcactttttgatgtttttcagttgccaagatagctttcatcccttcttgtggagcaattattttttggaaatttcatcatagcatacccagtttgatttgcctaagaaaaagtgaaaaatctaatgaaaatgcaaagatttaacttaaaagttattttaggataaaattatagtttatctttttgcggttcctgttaacgaaaaactaatatatgatgacttctaaattccatgtaccaacagcacagtaatgcgttagtgggtatgttataatagccaataataattctgttgtaaccggcaatttaattttgccggtcgttttcgtgtcatgatttttaagaacgcgaaaaatatagataaggtggagagttcacaaatgaaaatgatcgttggtttaggtaatcctggcaaaaaatatgaacaaactaaacataatgttggttttatgactatagatcgaatggcagcagcacatcaggtcacgtttagtcataatcaatttgaagcaaattacgccacttactttgaaaatgatgaaaaagtttacttagttaagccgcagacttttatgaatgattctgggcgagcagttaagccattgatgacctactaccagatccagttggctgagctgatggtggtttatgatgatatggacttagtgcccggacgtctgcgcttacgggagcatggttcagctggtggtcataacggcattaaaagtttgatcagtttcttgcagacatctgattttaatcgcgtacggattggtacagggcatcctgaacggcgtagcgtggtcgattgggtcctatcaccctttagtgatgaggcacggccattagttgatcggagtattgataccgccatcgaggcacttgaagattgggtcaaaggcgctgatttcatgcaggtaatgaatcattacaatcggaagggatagttatggatttaacagaactgcttttacaagcaccgaaaattaaagattggctaggtcaggtgacaccgcatagtcggcagttagttactggtttacaggactcggcgcgctcattattgctcagtgctattttacgagctaagaagcagccaatgttagtggtaacaaatagtttatttaatgcgagtcagttagtggatgatttgacgaatttattgccggaaacacaggttaaattattcccggtagacgaagtgatggcggcacaagtagcagtcagctcacctgaatatcggagtgagcgggtacaggcgctgacttttttggcgcaacagcagccggggatcgtggttgcttctctagctggaattcgccaattattaccaacaccggaaatgtggcgggctagtgctttgaccatcaaacctggcggcgagttagatccgctgcaattacggcaacagctagttggcatgggctatactcgcgaacagctagttggtcgccctggcgagtttgcgatgcgcggcgatattattgatatctacccattgacagccgccaatcccgtgcgaatcgatttatttgatacggaagtcgactcattacggtattttgaagcaagcacgcaacgcagtattgaaaatttatctgagtttaccttgttgccagcaacagattttttggtgacgccagaattactgcaacaggcggcaccgacagtcaaaaaagcctatcaaactgagttagccactttgaaagaagccagtgaacggactgccctgacggatcatttaacgccagtgatcgcagccttggaaaagggcgaagtagtccctgaattagtgcgttatcgcgatttgatctatgcaccggccgctaatttaaccgattatctaccggatgatggcttagtgattttagatgattatccgcggatgcaagaaagcgaaactgaattagccgcggacgcagcacaatggttatctgaggaattagctaatcagcgaatgctgcacagccaaagcgtcagtacagagttgaaaactttgttacgtaaaaataagcacacgcatctttatttgaccttgttccaaaaagggatgggtaatttacgtttagatcagatccttgacttacaaaatcgcgacatgcaacaattttttggccaaatgccgctcttaaaggcggaaattgatcgttggcaagtgcaacagcaaacggttgtggtgatggttggcgatgatgagcggcgggaacgtgtcggtcgtattttgcgtgactttaagatgcaagccacgttggcaaaacctgatacactgcaaccgcaacaagtacagatcgttgccgcaacgctacaaaatggatttgaattacccgatgccaatctggttgtgatcaccgaaaaagaattattcaatcaaccaattaagaagcgagtgcggcggcaaacactagctaacgctgaacgaatcaaaagttacaatgagctgaatcctggcgattacgtagttcacgttaatcacgggatcggtaagtacgtggggatgcagacgctagaagttgatggtgcgcatcaagactacattacgatcttgtaccaagataacgctaaactgttcattccagttagccagctcaatttggttcagaaatatgttgcctcagaaggtaaaacgccacgggtcaataaacttggcggtagtgaatgggctaaaaccaaacgcaaagtcagttctaaaatcgaagacattgcagatgatctgatcgaattgtacgcgcaacgggaagccgaaaaagggtacgcattctcaccagataatgaataccagcgcgaatttgaggacgcttttccctacacggaaactgatgaccagctgcggagtgtagctgagatcaagcacgatatggagcggccgaagccaatggatcgactgttggtcggtgatgttggttttggtaaaactgaagtggctttacgggcgatttttaaagcaattcaagacggcaaacaagcggcctttttagtaccgacaacaattttggcgcagcagcattttgatacaatgatgcaacgcttcgctgattttccggtgcaagtcgaattgttatcgcgtttccggacggccaagcagatcaaggcttcgttagcggcaatcaaaagtggtcaagccgatgtagttatcgggacccaccgtattttatcgaaggacgttgaatttcgtgatcttggcttgttggtggttgatgaagagcagcgttttggtgttaaggccaaagaacggctaaaaacattgcgttctaatgtcgatgtattgacgatgaccgcaacgccgattccccggacgttgaatatgtcaatggttggggtgcgtgatctatccgtgatcgagacgccaccagctaatcggtatccagtgcagacttatgtaatggaacaaaatgcaggggcactacgttctggaattgaacgtgaattggcgcgcggtggtcaagtgttctatttgcataatcgagtagaggatatcgaacgaacagtggctaatattgaggcactagtgccggaagcaaccgtcacttatgcccatggtcagatgactgaggcacagttggagaacacgttatatgaatttgtgcatggtcagtatgatgtgatcgtgactacgacaatcatcgaaaacggtgttaatatgccaaatgtcaatacattatttgtagaagacgctgaccatatgggcttggcgcagctatatcagttgcggggtcgggttggtcggagcagtcgggtaggctatgcttatttcatgtaccgacaggataaggtgctaactgaaatcagtgagaaacggctagcagcgatccgagattttactgaactagggtccggcttcaaaattgctatgcgtgatttgtcgattcgcggtgctggtaatttattaggtaagcagcagcacggttttattgattcagttggctacgatctgtactcgcagatgctggcggatgctgtcgcccagaaacaaggcaaagccgtgcaagctaaaagtgatgctgaacttgatttaggtatcgaggcttatttgcctagtgagtacatcactgatcaacggcagaaaattgaattgtacaagcgtgtgcgcgaattatctagtccggctgacttggaagaattgcaggctgatctgtttgatcgcttcggggattatccggatccagttgcccatttactggcgatcggcttattgaaagtctatgcggatcaagcgttagttgaacgtattcgccacgttgaccaacagttgcgggttgaattatcggctaaaggaacgcgccagatcgcaccagaagatgtgtttaaggcgttaagtaaaactaaattaaaggccactgttaagatggacggcgataaattagtgatcaccttgatcattcagccgaaaatgcgccaaccggattggctggaagaactaactcagttcttaacgggtctggctgccatcgttcaacaggcgacacctgcatgagctatattgttagcgtgggtgtagccgtcaagcaagttgctagatgcggagtagaggtgagtgatgcaaaataaacaaatgaagcacgtcgtcaatggcgcatttatcttatcgctggcagccctgattgcgaagatcttgagcgctgtgtatcgcgtgccctttcaaaatttagttgggaatactggcttttacgtttaccagcagatctatccgttatacggaattggtatgacctttgcgttatctggcttacccgtttttatttccaaactgattgccgaacaaactgattctgggtggcaacgtgaaacgttgcgccgtagtgccgtacttttgacatttctatcggtgctaattttcatcggtttacaagttggcgcagagcagattgcgcagtcaatgggtgaccatcagttagcgccattgatcgatgcagtcgcatggatgtttctttttatgccatggttggccgttagtcgtggctttttccaaggtcgttttatcatggtaccgacggcgttgtcacaagtcattgagcagatcgtacgcgtggccgttattctgattgctgcagtttgggcagtgcaggggcactggtctgtttataaaatgggaacctgggcgatgagcggtgcggcttttggggcattggcttctagtggtgtgctgctttatttttggtggcggcgtgaacgacaaccacagggcaatatgagtgaagtagcggtcccgcgttatcgcgatttattgcgtcgcttcttagctgaaggtggttcgttgtgcctatttgcatcgttgatcgtcttgctacagttagtcgattccttttcagttaaaaataatttagttgtggctgggctcggtcaagcggcggctaaaagcttaaaaggggtatatgatcgtgggcagccattagttcaacttggtttagtcttggcaacggccttatccacgtcactgttgcctagtttgaccagagcgctacaacgacaacggcaaaatgagttttatcgacaagcagtgatgatgattcgattgagctgtgcgttttctgtggcggccgctggtgggttgattgccttgatgcccggtgttaatcgactattatttggggatacccacggtgatcttgcgttaggcttatatatgttgagtattgttttagttgccttgatctcaagttacagcagtgttttccaaagcttaggcgaatatcatttacccacagtggctttactacttgggttagtcgtcaaattagcgatcaatggctgggcagtgcgacagtggcagatcaatggggccagtggcgcaacagttttcgcattggcagttatgttttggctgctttggtggcgttcgcgtaattatattcgccaggcactattccggcagaattttttaggtaagctatttgtctgcactggtggaatggtattagtagttggtgttttgtacgcgcaacttgtacaatggttacaacctggccgtttagccaccgggggcttagttttactttgtgttgcattaggtggcggcttgttcctttttctggcgcgtaagttgcgcctgctaactattcgtgaatggctggcgttgccattaggtaagaaatttttacgccgattcaaatagtagtacatcgcgctgtatttttgacataaaattaaccactattgagaggaagttaaatattatgcgtttagataagtttttaaaagtatcgcggatcatcaaacgacggaccgttgctaaagaaattgccgataaaggtcgtattttgatcaatgacaaagtggccaaatcttccacggacgtttcggttggtgatatcatcacaatcaaatttggcaataaaacgttgacggttaaagtcaatgccttgttggaaacaactaaaaaggatgcggctgaacaaatgtatgaaatcgtttcagaaacttttgccgaaaagttttaagcatacgggctggaagctaataacgttattagcaaaaaacactaatattaattgaattttatgaaataatagttgtttctgcgtggacactacgaggaaagcttgctatactttgggtagaaatcaggtgtggtttagaacaccgatggaacagcagtttaaggctgcctagagtgtgtgaaaaattgatactgcgtcagtatttatgctttaatttagcgtaaacgtggttgaaaaaatagattatgagctacgttaagtcaaagatcttattgattagaccggctgtcggtcatgatttaagcacttttccaacacacttgcatactttgaatgaaagtgaggatgcggttatgttgcttactcagaaaaaaaagccaactaaacaatcagctaaagcgacagttgacccctatactgagattgaacgtgcacgacaacaaaagcaagcgcggacgcattatgtgcatcgggtgcacaagcgacgaatcatattgttgtttgcgttattagccgcaatctttttggtatgtggcgtgcagatctatcaagcacgacaatcgttagcaacaactaatgcccaagttgccaccaaaaaagttaaacttaaaaaaaatcaagcgcagcaacgtaaattaaaattacaggaatcacagttgaaaaacgatgattatttacaacaggtcattcggcaaaagtactattattcaaagaataatgagactatttatagtttgccacaggataaagccccgacgatctcaacaaaataaaaccattgtaagacgcttgcaacgaccctttcctgtgctatacttatgagtacatgatttaaggaggaaaaacttttttatgtcaattgaagtcggagctaaagtttctggtaaggtttctggaatcacgaattttggtgcgtttatcgatttaggtaatcgtaagacaggcctagttcatattagtgaaatttcggatagctatgttaaagatattcatgatgttctttctgttggcgatgaagtcacagttaaggttatgtccgttggtgatgacggtaagatcggtttatcgatccgcaaggcggttgataagccggctactgaacaccaagagcacaacaatcatcacgcaccacatcgttcaaatgattctaatccgcggcagaataatcgttccaatcatactagctcacatacatcaggtcgagctaatggtggtcggcgccattttcaagaaaccaagaaggaagactttgacgatcttttatccgatttccttaaagacagtgaagcacgtttaactgacttaaagcgaaatactgaaggcaagcgcggtggccgtggcggtcgtcgtagttaatatacaaagtcagcgagctcgggatttcctgagctcgttttttagttgagtgaaagtgaggtggtttacatgcaagacgcatttacggcccatatcgagcaattgcagttgtggcgtgcgcagacaccagtattagtggcggtatcaacaggagcggattcaatggcgttactcgacttactagcgcatttaccagtagcactacgcccgcaaatcaatgtcgttcatgtcaatcatcagttacgagcagccagcgtgcgcgaagccgcttttttgactgattattgtgctaggcatggctggccactttatcagaccaagtggccaatggcggaacatccagtacacggtactgaggcggcggcacgggcgtttcgctatgcttattttgctcaggtcttacagcaacagaagatttcagtattgctgacggcacatcacgcggatgatcagttagagacgctattgatgcgtttagtgcgtggtggtgatatccagcaattagcggcgatcgcaacgcagcgtccctttcaccaggcaaagttggtgcgaccactattagcatttacgcggcaacaattacgtacttatgtagccgcgcgaaagctgacttttttcgaggacgagacgaaccaagatccgcgatttacgcgtaatcgtttgcggcaacgggtggtgccggtattgaaacaaatgcaaccattggcggctgaacatgcggccgattatgttgtgcaactgcaacggttattacgggtaaatcagcgccaaatggatcaggttctagctgattgtggtgattttttagcgattggctatcggggcgatttgactcagtggcagcaattagatactgacgttcagtatctggcattggagcgactcttaacacgtttgttggtgcaacaaggcatcacggttaagcagcggcaaaaaaaagaattgcagcaattgttgcagcattcgcgcgcgcagacaactttaaatttagccgctggttggcaatttgtgaaaagttatcaggcgtttacgatcatgcccgctacaacagcagtggaccaaacgagttacaccttggcaccaggagcgacttgccaagtgaacgggctgcaagtgagtttacaggcgggaaccgctactgtatcagaagctgacgatagtttagaggtttggttagcgtcggctgaattaccgctaaaaattcgtcaccgacaaccaggcgatcgcttatcattgcgcaatggtcatcaaaaaattaatcgaattttgatcgatcaaaaaattccgcagcagcaacgggaccgcctgtggttgatcacaacgcagcaaaataccgtactttggctactagatgtgaaaaaatcgcaattgtttaacccgcaacaaactgataaaatacattacagactaattattaaaaaataaggttgattgcctgtgtttatggtaagctgtttgttgagtactactgctaataaacagcttaaatgtgtctagaaatagtgtgaaaaagatactgtctcaaaatggacaattaaggcgcaactagtgtaaattggagaggagtttactgatgcatcaggatattgaaagtattctgtacgatcaagaagcaattgcccaagtaaccgcgcgcttaggacaacaattgaccactgattatgcaggaaaaaatccactggtgatctgtgttttaaagggtgcgatgctatttatggcggatcttgtccggcagatcgatacgcatttagagatggatttcttagatgtttccagttatcaaggtggtacagagtcgactggtgaggtcaagattattaaggatcttgatacgccgatcaaggatcgtgacgttttgattgtggaagatattgtggatacgggacgcactttgaattatttggttgacctacttaagtatcgtcaagctaaatcagttaagatctgtactttattgaataagccagagacccgtgttgttcctgttgaagcagactatgtcggttttaaggtgcctaatgcctttttagttggttatggtctagattatgctgaacaataccgtaacttaccgtacattggtattttaaaagcttcagtttaccaaaataaataaagcatttttagtgtcacacggtagtgattcgtacataaaaggttgaacgatcataatcttggtagatcactgcacaaactgatactaagctggtgcataaaatctgaatgcttttccaaaccaactctggtttaagccctgtatttgcagaaaatcagtacgtcaatactgatgaaattcatcaaacgaaataatagtcaatgaaagtcaaatatgctattatcaataactgaaatgatatgacaaggtatcatttttaaatcgaaatagtaatttggaaacggaggtcacgtatgaataataagcgaaatggactttttcgcaatagtctgttttatattgttattttcctaagtttgattgggatcatttacttcttctcaaacgggcagtcaaattcgcagtctaaagaattacagtctagtgaatttattagccaattaagaaataacaagatcaaagactttagtgtacagccaaataatggtgtctataagatcaccggtgactatcgcaaagcgcaaaaagtttcctcaaatagcggcgggtttggtttagtgccaaattcgaagacaagtgttaagagctttacaacagtcatgttggatagcgattcacaagtagcacaagtcgttcgtttagctgaaaagaataatattaagatggataccaaggctgaagagtcaagtggtttctggattcaaattttgttgtacgctctaccgttagtgatgatcattttcttcttctacatgatgatgggtcaagctggtcaaggtggcggcaacaaccgggttatgaactttggtaaatccaaggtcaaacctgccgataaaaaagccaataaagttcgtttctctgatgtggccggtgccgaagaagagaaacaagaattggttgaagtcgttgaattcttaaaggatccacgtaagtttgtctccctaggtgcccgcataccggcaggtgtcttgttggagggtcctcctggtactggtaaaactttgctggctaaagcagttgccggtgaagctggcgttccgttctactcgatctcaggttctgacttcgttgaaatgttcgtcggtgttggtgctagccgtgttcgtgacttgtttgaacaagctaagaagagtgcgccagcaattatctttattgatgaaattgatgccgttggtcgtaagcgtggtaatggcatgggtggcggtcacgatgaacgtgaacaaaccttaaaccaattgttagttgaacttgatggttttactggtagtgaaggggttatcgtcattgcggcaactaaccgttctgatgtccttgatccagccttacttcgtcccggccgttttgaccgtaagattttggtcggcagtcctgacgttaaaggccgtgaagctattttgaaagtacatgctaagaataagccattggccgatgatgttgatttgaaggttttggctaagacgacaccaggttttgttggtgctgatctggaaaacttattgaacgaagcggctttagttgcggctcgccgtgataagaagaagatcgacgctgctgatgttgatgaagctgaagatcgggtgatcgctggtcctgctaagcgtgatcgggttatcagtcctaaagaacgtaatatggtggctttccatgaagctggccatacgatcgttggtttagtcttaagtgattcacgtgtcgttcgtaaagtaaccatcgtaccacgtggccgcgcaggcggttatgcaatcatgttgccacgtgaagatcaattcttgatgactaagaaagaattgactgaacaaatcgttggtttgcttggtggacggacggccgaagaaattattttcggtactcaatcaactggggcttctaatgactttgaacaggcaacccaattagcacgagcaatggtgactcaatacgggatgagcgctaaattaggtgacattcagtatgaaggtcccgcaatgcagcaaacagaatttggcgttcgaccatattctgaagcaactgcaactgcaattgatgatgaagttcgtcgaattatgaacgaagcacatcaacaagcttacgaaattattcaagcacatcgagatcagcataagttgatcgctgaagaattgctcaagcgcgaaaccttgaatgaaaaacaaattctcagcttgttcaacactggtgaaatgcccgatgaagctggtacggaagaatttccaagtgaaaaggcagcaacttttgaacaatccaagcaagaattggaacgtcaagatgctgaaaaacaagtgaaagataagcaaaataccgatggttctgattcagcaacagcacaatcagatgattcggctgcaactgctgactcaaccgctgctgattctgcgtccgcgcaatctgacgttgcttctaacgccgattcagctgactcgcaatcagatgacgatcataatgcataaaacaaagggctggagcaaatgttccggcccttcgtttcgtaaaaaatttacaataaaataagggagcgcgattaacgaatgcgtgattatttagttaaaagtatggcttaccatggtacggtgcgtgcttttgcagtcgatgccagtggcgttgttgccgaagcacaacggcgtcatggaacgtggagcgcttcatctgcagcacttggccgcacactggtggcaacattgttaatgagtactgccggcctacaagatgaacaaaaaatgacagttaaagtactgggcaacggtccggctggcgccatcgttgctgatggtaacgctcatggtacagtaaaagggtatattcaaaatcctcatgtacatttaccactgaacgaaaaaaagcatattgatgtccggggtgcagttgggactgctggtacgatcgcagtcactaaagatctaggcctagcccaaccatttaccggacaaaccccgatcgtttctggtgaactcggtgatgactttacttactacatggcgagttcagaacagattccttcagcagttggcgtgtctgtatttgtgaatccagataacaccatcgaagttgctggcggttttctgattgaaatgatgcctggtgcggatgatgaagttgcggccgacttagaggctaagctaaaaacaattcctttggtttcggaatcgttacgccaaggaaaaacgccggaaatgattttacaggagatttttgggaccgacttggaaatcctagacacattgccggttgcgtttaaatgtgattgctccaaagcgcgttttggtaaatcgatcgcagcattgaaaccaaccgaaattcaagcaatgatcgatgaagatcatggtgcagaagcagtttgtcagttctgtgggactaagtatcaatttagtgctgcggagttacaaacacttaaagataactacgaaggatagatgtaagctagatgcggccaatcaatggtcgcatctttttttctgaaacaagcgagctagtcggttttcgttggtggtgatttgtgctatgatacaaaagatgtttctgaaaaaagtgcgtaggtactttgaataatgaatgcgtagaaatgtggtgcaaaaagcagttcacgctacttaacaactctagtcaacgctccgctgaagcgtatcttatgtctaagtccggttaagtgccgtgatctaaacgctttttgcctcacgctgaattttatttaaaaggtggtcaattaaaatggaatggcagatcggtaatgttaagattcccaatcaagttgtcgttgcaccaatggcgggcatcacaaacgccgctttccgggtgatttgtcggcagtttggtgcaggcttagtggtttgtgaaatgatcagtgatcgcgggattctacatcacaatacaaaaacgttaagcatgttgttcgttgatccaacggaacatccggttagtgtgcagatttttggtgggacgaaggaaaccttggttgaagcagctaagtttgttgatcagcataccggtgccgatattattgatatcaatatgggttgcccagtcaataaagttgtgaaaactgatgctggcgcacgctggttgcttgatccgaataaagtgtatgagatggtttctgccgtaacggctgcagtgagcaagccagttaccgtgaaaatgcggactggttgggatgaagatcatatttacgcagttaaaaatgctatggctgctgaaaaagctggtgccgcagcactcgcaatgcacggtcggacccgtaaacaaatgtatagtggccacgctgattggaatattttaaaagatgtgcgcgaccatatttcaattccgtttatggggaatggcgatgtgcgcacaccagaagatgcaaaacggatgctggatgaagtcggtgcaaccgcagtgatgatcggccgggctgccttaggcaatccgtggatcttgaaacagacggcagaatatttggatgacggtattcttttgccacaaccaacgccacggcaaaaaattgctacagctaaagcacatttgcatcgtttagttgaattaaaaggtgaacacaccggagtacacgaatttcggacttcctctgcttattatttgaaggggattgcacgagcagctaaaacaaaggtagcggtcaatcaggctgagactgaagctgaagttgatatgatctttgatgatttcgttgaacaaaccgaagcacgtgagttagaacgggctaaataaacggtaaaaaccaaaatgggcttgcaatttaaagcttaaatcggcaaaatatagatatgtatgacgttgaaatggaggaattatagtggctaagaacggtcaaaaaccgactgaaatgaatgaccaattgcgggttcgccgcgaaaagatggatgaattgcgcacagaaggtatcgatcccttcggtcagcgttttgaacgtgacgcaacgagtcaacagattcgtgaacgttacgctgatgaatcaaaggagcaattagaggcggaagaacatattgtcacaattgctggacgtatgatgactaaacgtggaaaagggaaggtcggttttgcagactttgcagaccgtgacggccggattcaagtttatgtacgtaaagatcgagttggcgaagaaaactaccatattttcaagcgctctgatttaggtgacattatgggtattactggtgatgtcatgaaaactgatactggagaactaactgttcgtgcaagtcatgtgactttcttgactaaggcattacgtccattaccagataagtatcatggtttacaaaatgttgaacaaaagtatcggcagcgttatttggatttgatcgctaaccgcgacagttttgatcgctttatgaagcgtagcaagatcgtcagtgcagttcgtgaatacttagataaaaatgagttcgttgaagtggagactccagtattgcacacgcaagctggtggtgcttcggcacggccatttattacgcatcataatgctttgaatatcgatttgtatttgcggatcgcattagaattgcatctcaagcgtttgattgttggtgggatggaacgtgtctacgaaatcggtcgtgttttccgtaacgaagggatcgatactaagcacaatccagaatttacgatgctagaaacttatgcggcttattgggatcttagcgatgtaatggatgaaactgaaggtatcgtccgtttcgctgcccaaaaagttaacggtactggtcagatcacttatcaaggtcaaccaatcgacttggacaaaccatttgctcgtgcgcatatggttgatttgatcaaagaaaagactggtgttgacttctggccagaaatgactgtcgaacaagcacagaaattagctgatgaacatgatgttaagtatgaaaaatggtggcaagtgggccacatcatcaacactttctttgaagactttgttgaagcaactttgacccagccaacctttgtttacggacatccaatcgaaatctcaccattggcgaaaaaggatccgaaagacccacgttttgttcagcggtttgagttattcattcacggtggcgagtatgccaatgcctttaccgaattaaatgatccaatcgatcaaaaggcacggtttgaagcacaggcaactgaacgtgaagaaggtaacgacgaagctcatggtattgatgaagattacgttgaagctttggaatatgggatgccgcctactggtgggttaggtattgggattgatcgtttagtgatgttattaactgatgtcgactcaattcgtgatgtccaacttttcccaaccatgcgtccggaaaaagcattatctgatgaagaattgtaattagattgacgaataatatggttataaggttagtgtacacaagctaccttgggtaacatatattatgtggaaagctaaaaaagagtcgcgatataaatatatgtcgcggctctttttgtactgaaaaaccagctaagtcgttgaacttaactggctttattttagtcggtgagatagattttcttcagatcggtaatgtcctgggagctcagttgcaagtaatcgtgtaaataaccggatagcgaaccagctagttcattgatcgttgtccaagctgtttctaagtattcaggataaacagacattaaatcacgcacgccagcaacctgtgccgcagttattcctggataagcctcaacttgcgccatattaagtgcaaattgttgggcggatgcttgctgtgtgagcagataatctgcagtgatctgcgtcaatggaacgcctaaagcgccaagaaataacgctgcaccaattccagtacgatctttgcctgcagtgcagtggaagagtaaactacgctcagcggcctcattagctagtaaataagcaaagaattgacgataggtctgttgtgcatgagcatcgctaattaaattgcgataaacctggatcatctgcttatgaccgtcaggatcgcgacgcaattcgtttagcagcgcttgcggtgcaattgaatttttagtttcgtcgactgcaaaaacgggtaagaattgatagcgactttttgcagggactcgatctggtgcagctgctttttcttctggcgaacggaagtcgatgattagctgtagtccatattcgttgagccagtttagatcgacatcactcagatcattaagttgtgcggcccgaatcactttgtgccactttacttgttgaccggaaattgtctgataaccaccaagttcgcggaagttataacctttttctagtggtaaaatgcgcggataactcataattacacctgtttctataaatagttgattcttattttaagtgatttggtcagaaaacacaaagaaagctgaagtgacggaagttaaaaagtggttatttactcatttagccgaacattcaaacaaaatagatggaaaatgtcggtgaaactaattttttcatgaaattccttgacggtatttaaaaaggctggtatagtattctttgttgtcaattaaggaaatcacgtcattaaaaaagtttttaaaactttttgttgacagatcttgcttaacttgataaactaataaagttgtcacttgttgagttattcattcctatttgcataaagatgcagagggaaagcttgatttaacaagacataacgaaatcagaaatgaacgtcttgaatatttattcaaaaagttcttgacaagcttcgctcgtcatgataaactgattaagttgtgttgaacaacaaggtagacctttgaaaactgaacaaagtttcgac

SEQ ID NO: 492 - DNA, 1866 bp, Unknown
  Metagenome-assembled genome
aactaacgaaaatactaacggcttgcttcgcgaatatttgccaaaaggaactgaccttgattcaattactgaccgccggatacaagcatatgcagaacaaatgaataatcgtccccgtaaatgtcttggatggaaaacgccttatgaaatattctttaatgtagtgttgcacttaatttgacaattcaagcaccaaaaattgatgtaatagcaaatagttcgatgctttggatattggaaggaattgacggtaagtttagataccatatacaagaagatatcatcaatgacgtaggattaaagaaattcggtggcttatgagattagcagatttttgccacattactgaattgcacgattaggttaaaaattgttggcaatttggtgtgaattatctcaagggaaactatgaggataattctagtgttttaatcattagggtacttcactggaaaaactggttttgctttttaaaaaaataatattgatgctgagtagtgtataattctgcatgattactaatttaaggggatattatgagagagataacgagcaaagaaaataaaaatattctagttgggttgatgcaacatatagatgacgtttgttctagtaacaatattaaatattccttatcaggtgggagcttattaggcgcaattcgacatcaaggctttataccatgggatgatgatgccgacattatgttaacaaggggaaactatgaaaaattaaaaaaatgtttaattaaagagcacaatccgaagtacgtgttattaacagaggaagatgtaggttattattatcaattcataaaattgtgcgatagtaggacggtattaaaaactttatcacccattgatgaaaatataccttacatgggggtgtatattgatatatttccaatagatcgcttaccttcagatagtaacactctatatgaacattatgcacaagtacaaaagttgtggcgaaatacgttattttcggttccgggattatattaccaaagcccaaaattatggaagaaatttttaaagttttttgtttatggagtatctgcccttttaattaaacacgcacacaccacaaaagaatggaaatcaattacaaaaagggaattaacgaaatacaacaattcagatggtaagatggggggcgttattttgtctgaatatggaaaaaaggaaataattccatacagaacatttgaggaatacaaaaaaattagttttggttcatactcgtttgaaatcatttctgatttcaatgtttacttggagagtctttatggtgattatatgacacttccacctttagataaaaggaaacctaagcatgcttatattgaatattggaaagattaacaaaaatgagaaatttgataacgtttataaaaacatcaagaatttatatgctgaggaatatacttgcaaaattaattttccctttatgttgcctatatatactaagcagagagcgtaaaatatcttgtgtaaatggtagattgtaattggctaaatcaggggagaattggtttctccttgaatgatctacctgaacatggcgtacgccaacggcgtaaccatgtcagtacgaccctaagggggaatgcgtatgggacgaaaatctctaggaagcatgtcatatgtcagtatacgaagcattgacggtgctatttatggcagggacctttttagtgtctttgctaagctacatcgacaatcatcataaataggatgggcctagaataaaaagtgtacaagttaaatagagactctgatttagtataattaaggaagtaaattggaggatcaaataatgacgaagcacagttatgacaaggaatttaaggaacaggccgtt

SEQ ID NO: 493 - DNA, 7901 bp, Unknown
  Metagenome-assembled genome
tcaaacacccaaagcgcttttctccgctgcttccgccggttaagttaagtccataaaatatgaatattaatgaaaatattgatttaataggatttatcgtgtggctaatttgttcttgcaatttggggtttacattttcactataaactcatctggttttttgtaaatgctttcatttactttaaatcgacacaatttcgtgaaaactgtcttacattagtaactacgggaaatcttttgaaaataattttttcacaatgaaaggattttataaaggtatagggccttaagtaattgtgtaagcgatgaaagaatgactttggtcaaagttgaagttttacttgagattaaaatcgatggtctacctgaatttgtcggtaaatggagggatttcgtggtaaacttcagatggagaagcttgccaataaatgaaaaaggaaacgctcatgattacaataaaagatattgcgcgtcgggctggtgtctcagtctcaaccgcctcacgtgcgctaaataataattcaagaattagccttaaaacgcgtgaacgaatccaaaaactcgccaaggatcttgattatctgccaaattataccgctaagaacctgactcgcggtgaagcaaacgtcgtcggagttatttttccaacggtggaaagttcctcaccggagaatccgttctatattgatatgctccgaggcatcaatcagtcgctagtcgcccgacactatgttttatcaattgcgattgggagccgagttgaagaggtccttgctaacgtgacggccatggttcaacaggcaaaggtcaaacggttcgttctactatatacggatgagaatgatccggtcgttgactatttgcgtcgcgaaaatttggactttgtggttattggtcagccagttggagatttgccggatcgatacgtcgataacgacaatgttcaggctgggcgagatgccacaatggcaattcttcaaaatggcggggttcgaaacccactatttgttgaatccgaatatgagtggcaatacgagcgaaatcgccgaatgggctacgaaaaggcgatggcggaagtccaattagaaccgctagtatttagattaccaaaacgcgtttctgaaacagcagtcgaggtatttttgaatcagcaccaagaggtcgatgcggtaattgcaaccgacgatgttggcttgctgcggtttaatcgggtttggagcaaaattcgacacacaaagaaaattccgatgatgagtttcaataagagtgagctactagcgttgattgaccaagatgtccgcatggttgatatgcggccggaaatgctgggcagtcgcgcggtagaattgttatttaccgatcgaaatgttcaaaaattaattgtgcagtacgagttgtgagcaacaactcttttttattttatttttgtgcaaacggttgcgcaaattatcaaagcggtttataattcattttgttaagaaaaatgggttcacataacccaaataaacagggggtgacaaatcatggaaaatgattcagcacaaggcaacacggctacaacgccaaaaaccaagccaatgccaaaattgtctatcgcgacaatttggatgattagtttcggattcttcggtgttcaaatggctttctctttacaatcttcacaaatggggcggatcttccaaactttgggagctgatccaaccaaattaggtttcttctttattcttcctccactagcaggtttagtggttcaaccattagttggctattattcagataaaacgtggatgcctaaaattggtcgtcgattaccttaccttttgatgggatcgttagtcgccgtcatcgttatgttcttactaccaaactctggtagcttaggatttggttatggatcacttgcagcactttggttcggtgccatcacaattctcttcatggatttatcgtctaacgttgccatgcaaccattcaagatgatggtcggggacatggtgaatgatgagcaaaaaggatttgcttactcaatccaaagtttcttatcaaatagtggttcagtgctagctgcaattttcccatacctcttaactggtttgggtgttgctaacattgcgccaaagggtgtcattccgaactcagttattttctcattctatacaggtgccgttatcttagttatctgtagtgccttcactattttgagagttaaagaatatacacccgcagaatataacgcctatcacggtattactgaagcagatgttcaagaaaaagttggtttatttacacttttgaaacgtgctcctaaagtattctggacgttaactcttgttcaattcttctgctggatggccttccaatacctttggacttatggtgcaggtgccgtcgccaagaacgtttggcgcgcaacagatcctgcaagtgctggctatcaagccggtgccaactggttcggtgttctatccgcaatttacgctttagctgccgttgtttggtcattagttcttgctaagatgccaaatgacaagcacaagccaatgtacgcaactagtttagtattaggtgccgttgggtttgcctcaattttcgttgttcataatcaatgggttctcatcctctcattctgcttgattggtatttcatgggccgcaatgatgatgttcccattcaccattttgaccaacgcactttcaggtgccaacatgggctcgtaccttggtctattcaacggaagtatctgtttaccacaaatcgttgcttcagtattgagtttcgctttgttcccattgatgggctcatcaatgccagggatggttctcttagccggtatcttgatgttagtcggtgccttctcagtaagcagtattaaagaagtattcgcataaaaattaaaggagtctgaatgatgaaacgaacatttgacgtatcaccgtggcacattgtgaccactaaacttaatccagacgataaacgtcttcaagaatcaatgaccagtcttgcaaatggtaacctcggcatgcgtggattctttgaggaaggttacagtggcgacacgcttcccggaatctacattggtggcgtttggtttccagataagacaaaggttggctggtggaaaaacggctatcctaagtactttggcaaagtgattaatgcaatcaactttatcaaggttggcattaaaatcaacggtgaagttgttgatttggctaaggacaaggtgagtgacttcaaccttgatttagatatgcaacaggccgttctcgaacgggctttcactgttgaaaagggtggcgcaaaggttcagatttcatttgaacgatttgtcagtgctgcaactaaggaactcgttgttcaagggattatcttgaagaatgtgggttctaaagaagctaaggttgaattcagttcatccgttgatgctgatgtacaaaatgaagacgccaattacgatgaaaagttctgggacgttttgaaagttgctaagactgataatgaagccgaagttattgcggaaacaaagccaaacgactttggaacaccacaatttacggttggtgctttatcaacagttgtcacggactggaacagtgagtctgcagaccaaaccgatgtctcagcgacgaaccattttagcggaacactggctgctggtgagcaaacaattatccagaagcgcacagttgttgtgtcatcacgtgacttccctaaacaagctgatcttgaggctcgtttaacccaattaaataaagaaatttctgcaacatcatacagtgatttattcaacgcccacaaagctgtttgggcaaatcgctggaacgtttctgatgttaaaattgctggcgacgatgaagcgcaacaaggaattcgttttaacctattccagctcttctcaacgtactatggcgaggattctcgtttgaacatcggacctaaaggctttaccggtgaaaaatacggtggtgccacatactgggatacagaggcctttgcggttcccgtttaccttggtgttacggatccaaatgttaccaaaaacttgttgaagtatcgttaccaacaaattgacggtgccttccataatgctaaggaacagggccttaagggtgctttatacccaatggttacgtttgatgggattgaatctcataacgaatgggaaattacatttgaggaaattcaccgtaacggcgacattgcctacgcaatttacaactacacaaactacactggtgacaagtcatacgttcagcatgaaggcgccaaggtcttaacggagatttcacgtttctgggctgaccgggttcacttctcagaacggaatggcaagtacatgattcatggtgttactggccctgatgagtacgaaaataacgttgataacaactggtataccaacattttggcacaatggacgtttaaatatacgcttgaaattttgccagaggttgcaccagaagttgctaaagacttaaacgtcactgacgctgaaaagaaacagtggcaagacattgtggacagaatgtaccttcctgaagacaagaagttaggaattttcgttcaacacgatggcttcctagacaaggatatcaagccagtcagctcacttcctaaggatcaattgccacttaaccaaaactggtcatgggacaaaattcttcgttcaccatacatcaaacaagccgatgttcttcaaggaatctgggactttattgatgactttacacctgaacagaagaaagccaactttgatttctatgagccattaacggttcatgaatcaagtttgtcagcttcaatccatgccattttggcagctgatcttcattgtgaagaaaaggcaaccgaattgtatgaacggacagctcgtctcgatttggataactacaataatgacacggtcgatggtttgcacatcacagctatgaccggtggctggttagccattgttcaaggattcgctggcatgcgagttcgcaacggtgagttacactatgcaccattcctacctaagaaatggcagtcataccagttccgtcaattgttccgcggtcgtttgattgaggtaacggttgatcagtctggtacgaagcttgacttgctcgatggcgacccaattacggttgacctcgatggtaagaaggaagagcttaaataggactaaaaaaagggcaagagtgggaaactgctcttcgccttttttattaaaagaaagtgggtgagactggtggaatcgactgttaaagattttggccatttagaaaatggtgagttagtcaaagaatttacgattacaaataaaaatggtgtgagcctccgcacaatcagttacggagcaacctggactggctactttgtgacaccagagaagaatatcattttaaattttgataacgtgcacgaatatgaaacgaatccctttcatttaggaaacaccattggtcgggtggcaggacggttgagcggccatacgtttaacgtcgctggattcagggtcaatttgaagccaaacgaaaataaaaatgtgctacacagtggtaacacgggcattgatcggctcaattggcatggcgagattattctagacgaccaatctgccaaaattcgatataccatgcaacagaaagcaatttttcctgggacgttggaaatggccatcacctattctttagatgaggataaccatgtttccgtacaatatgagggacgcagcaacgtggaaaccctatttaatccgatgacgcatgtttactttaatttggatggaccggacgcgccaatcaaggatgaattcttgaagatagttgcggataggcatatcgtggtaaatgaagaaaagattccaacgggtgaaatacaggtcgttgaaaataccccgtttgattttacaaaccttgttaagctgggcgatcaatgtgaaaaacttggcggcaacgaacagtttgatgatgcctttaaaaagccggatacatcgctaggcgtaacaccaagcttgttactagttgatagcgcaaagcagcatcaattagaaatgggcagtgatcgcaatggcgtcattatttttaacgtcaatcccgattgcattggcaaagatgcggattggcttgctgctcatccagataacggactggctgtggaattgcaaacggtcccagatgcgattcaccacgacggatttggcgacattgttttacccgctaatcaaactaaaacttacacatcaacttattactattcggagggataaccatgaagtttgaagatattaagggatttgcatttgatttggacggcgtcattgctgatagtgcccgattgcacgctaaggcatggcaccaaacggcggatgaagttcattcagaatggacaccagaactagcggaagccttgaagggtgtcagccgcatggattcactggaaatgattttgaaggcgggtggccatgaaaatgactacaccgaggatgaaaaggtggctttggctaccgaaaagaacaccaagtatttgaagctggttgaatcattaacgccagatgacgtgctaccagggatgaaagccttcttagacgaattaaaagctagcggctataaaatgtccgtcgcttcagcctcaaagaacgcccctgcaattttgaagcagttgaaaattaccgactactttgaaggcgtggttgatccagccaaattgcatgccggaaaaccagatccagaaatcttcagtttggcggccggtgtgatggacttagcaccagaagttgttgccggtctagaagattcaggtgctggcattaagtcaattaatgctgcgggtgaactttcaatcgggattggtaatcaattgatggaagcggatgtgcgctttgcggatacgagtgaagtttcgttaaaaaatattaaagctaaattaggctaatcattgagccggcactgtttttagggctctctgtcaaatcctgttgatagatagttttacagaactagaagctaagcggcttctagttctgtttttgtatttggttttgttctcgtttgttgaagcttaatccgcgagattaaatgatggaaatttctaaatccaaacgcagtccgctgaatctgcttaatcatccgattaataccttcaattggaccgttagaatacttagattcactggcattcaagacaatttccagattacttttaaacgtttttagtgtttccttcatttgaaaacttaggttttcatttttgtagagatagtagacaatgccatctttgtcatgatttttaagacaggacatgataccttgcagcgcatcgtatgtgctcgaaatagtgtcatcagtgtcaagctccatttgtactcgcccttgttgagttaactgctgtcgtaaatgacgatcatagaaagtttggctgacttctagttcatcaaagtgcttcaaatatagtttccatgagaacttaagcagtcgatattcgatagatttcttgtcatattttttcattgtctgaactctagtctggttgaatgcccgcgtcatcatggcgataatgtggaatcgatcaacgacaatttctgcgtttggaaacatttccttaacgatatctttatagtaactattgagatccagagttacggtttgaacccgttttcgggtattgatatggaatctattaaagtactcaataatgctttttttacgcgcgttttataatcaagttagccaaatacttttagctaattgataaaataaaaaacaccaagacaaatctctgttatcattgatgctcctacacaaacaatgaaagaggttattgtcttgatgcaagaacagaataccacagtcagaaaaaaaggtcagcacctaacttcgtttgaacgaggcagaattgctacgctgcacagccaaggctat

SEQ ID NO: 494 - DNA, 1162 bp, Unknown
  Metagenome-assembled genome
cattgttaagcgtatagtgataggtcttctgaacaaagtctttcacttttaatgcacattcataagccgctacctttttccccttgatgattgccagcatttcatcactcaggtcaccaatcgtgtgctttttatcattttccatcatgtattgccaaaagaattttaaatgcgtaacgaagcgattataatcgagcgaatcgcgatcaatttcaactgataattgataggtcacaatacttgtaatcttcttaatgaaattaataattttattaaattcatccaattggtcacctaattcgccgctaatgatatgaatcgcaatgaatccagcttcatcatctggtagggtaacatcacaggtaccgttgattagttgaatcgcccattgtccaatctgatattcttttggataataactgcgaatttcccataagaattgattagtcaacattaaaccagatttaattcgatcaacactagacgaaatatgatcagttagcgcaatatacacactatctgtcagctcgatattttcatcagactctgctttatcaacaatctgtttagcgatttgaaaatactggattggaatttcgttaaccatgtccaaaatcagcttctgatcacctcgactaatgggggtaaacattttgtatatcttactttcgtcaacggtatcattgaaatgttttccatatgcgattgcttttccaataacaatcatttcttgatgatcatcattatgggttataaacgcattattattaagcacctttttgattcgcatcattctcatctccattcaacttgaaaatttccataaaaaaagcccacttagcctgtcgactaagtgggttttgtgtagctcctgaacactgctattacaatcccagttaattactattaatgcacaaatcaatgatagcgttttctcagccgtgtgtcaactgccgttcaacttaaatattatcgtctaaaggttgaaagtatcaaatagaccgtaaccattgatgtcaaacggttatggcacggtatattactagtttccacttcattgagcattaccgagtagcctggccaggctactcggtaatgcttttataaattcgtcaaaaataatagttaatgtttcaaccgccatgtcgagtttttcacctag

SEQ ID NO: 495 - DNA, 30593 bp, Unknown
  Metagenome-assembled genome
tcttcaatcagttgaagaactttcgcaggattgcaacgcgttatgataagctcgctcatgtttatctggctacggtctacattgcctcaatttgcatcttacttaagtagttttcagacggaccctagtacggctattggaaacgattttattataggtcctttagctaatactgacaatttttttggcttgaaaaagctaccgtaaaatgaacttgcggtagctttgagcttagatgataaaagtagttacgttgggattgatgatgccacgatcgtagcgtccactgactaagtaaggcatgattttaccggcatcagcatcttctaatttgatcgtattatgcatgacagaagaagccacgtgataccaagctgcaccaagtggtttgattacctttagttcgccatagggatcatcctcagaagaggctactttaatccttaggctgccgggttctaagcgatcagtgatcaccgattgctgtgtactaactagtgctgcatcgtgaaatacgttcgtgccgtcagcagcttgatccatttgatatttgtagaacaaacttgcttgttcgacttgactgtttaatttgagttggctaaagatttgttgtgcagtttgcggatcgttgggtgtcccagcagtccaagtgacttctagtaggcgtacaccatggcgttcgacgattgctgttgcttgttggtcattacgacggatctccatgtggtcggccatttttttaggaatccctgcaccttcacgaccagaaataataccagtttcagcgccaggaccatgcagcatcaaattaaacggataagcgccaaccactttatcgcgatagttagctaatacataaaggactgattctaaatagggtccaccaaagctaggcttacccatctggactacatagccacaaaccataggtgcgacaagttttaatggtggtggtaataatttagcaagtacttcagctggtgcggcgtaagcgaacatgatcccttcttgatcatccaaacgaggacgaactaggaattgtttcatttcactaggatcgataagaaaactactcatcattgcttcctcctctacattaagccattcataacggaaacatcagggccatcaccattaactattcgtttgacgcggtcaccgatcagtgtattgaagactgggtgagtcaaaatataaaattcgtcatcctcaatagcttgaaaaaccgtcagtgcaattgaatcgatcggcatcccagtttcgatcacatatttagcgaattgttggccacccttgaagattgcactttgataataaggatcatcaggtgcttgatatcgttctggccgccgatcttcggtatgataaaggtcagtttgtacaaagccagggcacatgacggaaagtttgatattagcgttagcgcgttgtaaatcgtaggcggtagcttcagttaagccaacactggcaaatttactagcgtggtatgctggcatccctggcgtatcgatcaaaccagcgatcgaagcaacattaacgatatggcacgctgttttttgtttgcgcatgatcgggataacacgctgcatcgcataaacttggctcatcacgttaacatgcatgatccattcccagtcacgtgaggggagttgccaaaccgttcctggtagtgcaataccagcatcattgatcaataaatcaatttgaccgaaacgagccatggcggctttgaccattttatcaacgtcttcttctaatgaaacatcgacagtaatactttcgacttgggcaccaaggtcagctacttgctggacagaacgcttcaaggcgggttcatcgatgtcagctaaaactaatttcattccccgacgtgcagcttcttgggcaagctcagcgccaaaaccatgagctgcaccagtgatcaaggcaacgcgattcttaaattccttcattatagattcctcctaggcggtattgaaaagtattactaggttggttttcacaatttatatgtggttgaaaaatcacgaaataagcttttcaacacaggttaactaaaagttttgcttagtcattcgcaaaaacgtaggctttcgtatagccatcacgcattgcctcagcgacacggccgctagcttcagcgtcaccgatgattttagtttgatcaaaagcggcaataaatggtgcgctaatgcttgtgtctggcgtaacacctaatgctaaaataacggtgtcagcgacaatatcactcatcccgtgatcgatcatatcaagaactttgacgccatgttcaccagcgccaactaaacgtttgccggtcatgatcgttggttcgtatttatttaaccgctgcattaagtcaagcaaaatcgtcgggttaacaccggcaccaacttttgcctgcatttcaacgatcgtaacttcgtggccttcaccagctagtttttcagcggtttctaagccggtcatactgccaccgatcacggtgactttaccgctgaccggcgccttaccatagagataatcttcggcagtgatcacatttttgccagccattccaggtaattggggaacaattggttttgcaccgctagcgatgaagacgccagctggttgcagcgctcggactttttccacggttgctttttcgtttaaatgaagctcaatattttggttcgcttcaacttgattgatcaattgctgatttaatagggtgatcttatcctttaatggtgtcttatcagcggtattcaaagtgccgcctaaaactttgtgttgttcgaaaagcgtaactttgaagccgcgttcagctaaagtcttcgctgcggtcatcccgccaggaccaccgccaatcacagctactgtgcgttgagcaccattatgatttaaggtcgcaaattcacgttcacggcctagtcgtggattgaccgcacagatgatatgtttaccggcttgtaaggcaccaaagcatagtaaacagccaatacaggttgtgatttgattgctatggccggtagccgctttacgggcccaatcaggatcagccaaagtcgcgcgggcaacgccaatgtaatcacaaacgtcatcagtcagtaattgttcagcgatttcaggtgttttaatgttgttaacggcaatcactgggatcttaacgttcgccttgatcgttttggcgagctcttttttccagccttgagcgtaggaaccaggctcaacgatcgttggggcactttcatagataccactagaaacgttgattgcgtcaatgccatagctctctaaagtacgcgcaattttgacgctatcggcaatctttaagccgccagcgacaaattcatctgcgctgatccgtacactgatcggaaagtcagcaccgcacatatatttgatcccggcgataatttcttgaagaaagcgcagccggttatgaaagctacccccataacgatcggttcgttgattagaatagggtgagaggaattgattgagcaaatacccgtgggcggcatgaatttcaacaccatcgatcccagcagttttagcgatcacggcgcctttgataaaggctttaactaaggcttgtacctcttctgttgataatgctcgtggaacttccttaacggttttatctgcaatcgcagaaggcgcaactatttgttcaccatttagtaattgcgaagtggtttcacgtccagggtgatgcaattgaacaaaaattttcgtatcatatttatgcacggcatcggctaagcgctgtaattgcgggatttgtttaggatcagtcacggctaattgcttgtaagttgcaacgccgtatttgtcatcaattcgggtcacttcagtgatgatcaagccgacacccccgcgagcacgttcttcgtaataacgaataatatcatcgctagcctcaccattagtacgtgcgagtgaaacccccattgcgggcatcacaacatgattttttaatgtgagtttaccaattcggccgggttgaaacagttgcggaaagtcagtcatcaagaaaacctccttaaattgtgaagaaataaacttaattgaacggtttgtttttgaatacatcttcacaatagcatagtgaattgctatgattaaggtacagttcgtccagtttttatcaaataaactgtgcaatttgcctagtgggttgagtgctaaggggtgcggggtatgaaatatagtgaactagtaagcaaacttgaaaagaaatttattttaaccgatattcaaatccatcaagataatgagatcaacacgattcaaattgggaacggcacacagccgcatactctatatattgaacaagcggtagcaggaccacttaaattagtcagttgtgccgatcatgcatgcgttcgttgtccttgtatcagccagacatctacgaacctaagtaatcaagccgttgtcgctttattcaatgacgccaacgaagtattagcagctgagcaacaacaggaggtgttgtttagtggcattttgcagtatagcttgacgcatgatcatcaagcggtgatcgattttgcggcgacacagcttaataatacgttgatgatcattgacgataattatcgagtgttggcttattcgcacacttttccatttccagatccgttgtggcaacaaaatattgaccagggttattcgcggctagattttattcaaggcatcaaaaaaatgttggcgcaaactaagccttctgcgcaagccagttatcgttttccttgtccagtttcaccgtatcaacgtttagtggcacgcttgtactttcagcatgaattagttgggtatgttgtaatgttcaatgatcagcaggattttaccgttgcgcagcagcaattactgccgcggactggccaagttttaagtgatttattaggtcgcgcggcggcgtttaaggattatcaggtgtcagtaagagcacaactattaagcgacttattagaaggaatcaacgttaacgcgatcaaagttaacgcgcagatcgttggctatacagtgccacaaagcatgtgtttagtagttttaaaagcagcagatcaattggcacgactgtgtcagaaaatgcgggaacgtttccctgaggcgttggtcgtagtttatcaggaacgggtcgtggcgttattaccagggtcgttgccgacactaaaaaaaatcacttggtctgatttgcaacaacagctgcaatgccaagtgatcgtttcgaattgctatcatgatttttttgctaccaaagcgcagtatattatcactcgccatacggaaaagcttagtttacagttacaggatcaggcccagttgcttttttgccgcgattattattttgcgatcatgttagatcgtatcaaacaacgtgatgtattgactgcctttattgatcctggtgtgcaacaattacagcagtatgacttagcaaaccagactgaattgatcacgacgctggcgcagtatattcgttgtggtggcaatcaaacaataacagccgagcgcttatttattcaccgcaatacgttattaaatcgattacacaaaatcgaggatttgacgggcttggaccttaaggatagccaattgtggtttcagctggaatgcagcttacaaatgcagcgtttgttagctagtttgaatcagtagttttcttccgttcataagtcaccattacacccggaccaaaaaccgtggttgattttaattgcagtagcaatggctttgtgcgttggccaaataggggaacgcctttaccaagaataactggtgcggtgaatagctggtattcatcgatcaaatcggcttcgatcaatggctgaataacagaaccgccgccgaaaatccaaatacctttaccggacccttggcgtaattttttgacaagttcaaccacagaaccgttgatgaaatggcgctttggtaaatcggttttgtcttgatgggtgagaatataattgtctttttcagcataggggaaggtggggcttaacttcagggcgtcacgataagaagttgcgcccatgacgatcgtatcaatactggacatgaattgatcgtagccccaatcgagatcgaagcccacggtagcgtcgatccaatccacactaccgtgctcgtcagcaatgtaaccatcgatcgtggtggcgagttgcagaatcacttttttgggcattatacagcctcctaaatcatatttagatgaaaaaacgatctgtctaaatggcagatcgtcagtataacattatttatcggtagcgttaataaccagatgctcattaacaaaagcgttgagcccgagatcacttaattcacgaccgtagccggaatttttgaccccaccaaatggtaattctggtaaggataaccagccagagttaacaaaggacatcccagtttcaatctgttcagccacataagcagcgtgtcttgggtctttcgagaagacagaaccgcccaagccataactagaatcgttagctaaagcaattgcttcggcgtcgttttcgactttataaacaacggctactgggccaaacatttcctcgttatagattggattgtctttagtgacgtcagttaaaatcgttggtgggaagaattgaccaggtaagtcaattggttcgttaccatagtagacttttgcaccagcagcgactgctttttttacttggccgactaatttttctttagcccgctgtgacgatagtggtgctaaggtagtctctttgtccaacggatcacccggcttaaccgctgcaaaaccagcttttaagttctccaagaattcatcgtaatatttagctgtaacgatgaaacgtttggaagaggtgcagacttggccagcattatataaacgcgcttgtggtgaaacttttttgactaaatcaaaatcagcatcatctagaacgataaaggcgtcattaccgcccagttccatcgttgatttcttcaagttttcaccggcaactttggcgactgaactaccgccgcgttctgaaccggttaacgctaccccagtaacacggggatcagcgatcgctttagcaacttgatcgtagctaacaaataggttcttgaagctgccagcaggcgcaccagctttttgcactaatttatcaaaggcatcagctgagccaggggtgttagaagcgtgcttgaggatcattggattgccgaccataaagttaggggcaaatacccgcacgatttggtaaagtggaaaattccacggttcaaccgcaaagataaccccggtcgcttgtttagcataataagcattaccagcatcagttttcagtggtactggttttaaaagatcaacggcgtggtcagcgtagtaatcaacgatgcttgcacataagtcgacttcgccttccgcttcactcaataatttgcccatttctttggtcatgatcgtcgctaattcttgtttttccgcccgtaacaagtcagcgaccttccttaaatatggtgcccgcgttgatacgggatcgttgcgccattgatgatataatttatcaccagcagccaacgcctgttcaagctcagcgtcagttgcgtcgggatatgtctttaaaacctcattcgaatatggattaattgattggtatgccattgtgtaacctccctttcatatacaaaccattatagcggttgcagaaagcggcttcaaccattttgagcaaatttttataagtggtatagtttatcatttcacatatatacgctattgaagcggaatttatttaatcatttttcaaaaattggtctatctagcgcatagctggcaatcgcgcttgacatcggttacaattatgatgattaattaatgagcaacatgctaaaaatgatgctaggaagtgatttacgtgaaaatttctcatgtcgcgatctatgtcgatgatctcgaaaaaatgcgtgacttttatgaaacttattttgcggcgcaggccaatacaaaatatcataatccacgtaccggcttgtcgacttactttttaagctttgctgaccaaacacgattagaaattatgcagcgcccagatattttagaacatcccactaaattattacagggttacacgcacgttgcgtttagtgtgggtgattcagcggcggtggacgccctgacgactaaattagcgcaggctgattaccaagtgatcagtgggccgcgaacgaccggggatggctattacgaaagtgttgtccttgatccagaagggaaccaaattgaaattacgatttaaaaaatcgccgtgcaaccaaattaggctgcacggcgattttgtttagtgttatttgatgacgatatctttggcagtaacgtcagaaccgaagtatggcttcaagttttgattgtagttcttttcaaagaaaccgttgttgttcaatttagtaatttctttgttcgtccagttcaacaggctcttattgccttttttgatccctggtgcgatgtattgatttggacctaaatgtttgataccaacggtgtacttaggattgttcttgacccaagcatataagtaagagttatcatcagctaaagcagcagcacgaccgtttttcaaagcgttaaactgttgtgtctttgaatcgtatttttgcaaagtggcacctttggaattcttagtgaaatattgttctgccgtggtccctttgttgacgatcaagtttttacctttcaattggctgactttagtgatcggcttgctcttaggtgaaataactccgatcgagactttcatgtaaggcttggcgaacgaaatcacttgtttccgttcaggtgtaacggtgaaattagctaagacgaggtcaactttattagagttgagtgcgtcgacccggctatccgcgttaacttgtacgtatttaactttaacgccgagatccttaccaacctgtttggctagggcaatatcataaccttggcgcttaccatttttgtcgacccaaccataaggtggcaagtcaccaaaaactgcaattttgatcgtgccgcgttttttgatcgcgctgacgctagtcgtttctgctgcttgtgctggctgagcaaagcccgcaaataaaccaaataatgtaaccaaagccaaaaaggctgcaatcaaacgtgtgtgtttcttcataaaaaaatccccccaaaatttaaataagtgctgaaacgtggttgaaaaagccctgttactcattttcggcaacgctccgtaatctaagtgcttttgcaacagattctttagaaatccatactattcaagaatagttgggcccgttcggtttgtggctgcgtgaagaattgtttgcctggtgtgcgttcgagaatatggccgtcttccaggaaaataacttgatcagcgatctcacgggcgaaattcatttcgtgtgtgacgactaacatggtcatcttttgcttcgccaagttgcgcataacttccaaaacaccgcggaccatttctggatctagcgaagcggtcacttcgtcgaataacataaactcaggattcaacgctagggcgcggacgatggcgatccgttgtttttgaccgccagaaagttgtcgtggataagcagcttggtaatcagctagccccacctcctctaataatttaattgcttgcgccttggcttctgccttagcgcggtgttgcacttttagcggaccgagcaaaatattgtccagtaccgttaaattaggaaataaatcgtaactttgaaaaaccatgccgattttttgccgtagttgttgccaagttttcgggctaggggtaacgggctggccggagaaggtcagctgaccgctttgaaagtcctctaagccgttgaggcagcggatcagcgtacttttaccagaaccagaaggccccagtaagacggtgacactgccagttggaacggttaaattaatatcgtgtaaaatgtggacatcgccgtatgatttttcgagatgttccacctgtaataatggcgtggccataacagttcgctcctttatgcgttattattttgtcgccgctcgagatgccgggcccaagccgaaagcgggtagcaaagtaagaaatataaaatgaaaattaatccgtacacccagaaagcgccgtcgggataatgctgacggttggcttcgataatttgctgaccgatattgatcacatccatgacgctgatcagtagcagtagtgaagtcgttttgatcacccgggtcattaagttgatcgtcgccggaatcatcaagccaattgcttgtggtaataggacataacgaaaaagctgtggtccattgagcccaatggcgattccagcttcacgttggtgttgcggtaccgagatcaaggcaccacgaacgatatcactcatttcagccccgacccacaaagcgaaaactaacatggcaactgcctgagcgttcaaattgacgttaaagtttttcggtaaaatataatagaacagaaatagtagaacgacagtaggtacgatgcggaagaattccaaatacaatcgcaagatcactcgcaaaatgggattcttcactgttcttaaagcaccgagaaagattcctaacgcaattccgaagaccaacgctacgatcgaaatctttgccgagatccataaaccgccaagtaaacggctaaaattagtgccggcaaataaaatattaattcccgaatgtgccacgacgcgccctcctctctaaccaagtcagtatcaatgataatgggatcaagataatcgcgtatgcaatcactaaaacaaacaaggattcatcggtatgatagtataaaccgatttgatccagtgccgtattggttaactctggaatcgcaatgacggtaaaaatcgaggtttccttgatcagaaaaatcacattagcagcgattgctggtacgctaagggttaatccttggggaaacacgacataacgggcgagctgtccgcggctgagaccgatggctaaccctgattccacttgaattttagcgacgccttgtagtccaccataaatcgcctcagccatgtagcttccaccaaggaagatcaagccgctgattccagctgcggtggcagaaattttgattccaagctccggaaaggcgtaatagatgaagaataattgaatcaataagggcgtatttcgcgaaatctcggtgtacgcggcactgatttggcgtaacacaggcactttaaaataacgtagaaaactggcgatcaggccgacgataatagcgccgataataccatagaatgaaagtttaagcgttagccagaaagcttgcgcaaaaacaggaatactttgttggatgacagtccaattcataatgacacctccaaataaaaaaccgacaccgcaaaaagcagtgtcgggacgtaatgacgtgttaccacccagatttgttcgtaccttgcgatccgaacctcattcagtcatagactgtgcagtgtatcgcctgcaaaacgactaagtcagcttccgtaaaccgactagtaaagctccaagttcatcttcaatcataaaataacgcttctttacaccaaaatagaagctcactgtagttactttataatctactcttctcttcatagcttaatctttctaacttaattttaatattacactatttttaaggtgtgtcaacgggcttatttacaaaaagtcaggaaattagtatgctgaaagcaagatccatttagaaccatgctttaacttggtatttttgccataattgaatggacaccgactgcgacttggacttgccagagtcttcggcttagtccaatcgacagcgggaagcaagatctgtttagcaaataagatccagtaatgaatgtttgccaaatgataatttccagaaaacgagcgatagtgtaacatcagaaattaattaacggacttggctaattaactttaatagtgaaatagggagcgatcacgcaatggttcaaccaaaaattacggcaccgcgtttagcggctgacttaccgctgggtacacttgatttaagtgatgaagcctttattcaaaatgtacgtttagaaaatcagcacgtcagtgagcaagcttttaccggtgtttattttaaaggtgtacagtttgaccacgtcacgtttgatcaaattaattttgaacgttttgaattgcaggatgtgatttttacacactgtacatttttaaattcggaaatgatcgaagctagtttcaagcgggtagtatttaatgattgtaagctaactggtagcaactttgcgggtgcggtttttaatgaacttagcttcaccaattgcaaggcggactatttgagcttggccggagcacggttacgccacgtccaatttacacaaacagacctgagtgaattggactttagtgaagtcaactggcagtcacttagttttactgactgtcagttgacccacgccaattttttacatacgcgtttgaaggcgctggattttagccataacgaaactagtggtattagttatagtttagacttgttgcgcgggatgattatttcgccgcagcaagctttagatttagcgttggcgttaggggtaacaatcaacgatgagccttgagtctgattcagaaaaagactataatctgatatatcagccgatcctaaatctggtgcttggcactgcaaaaatatccgtgaccaccctgtatagataagtactaatatacaatcacggatactgtatatatgaaaggacttgaatatgccattaccgaaaaaagtttccagttcatctaaattaaacgcaaaagatcgtgtttatcagcaattgcgtgcttggatcatcactgggacattagccccgcaagagaaaatctctgatcaagcgattgctgccttatttggggtcagccggacacccgtgcgtgaggcgttacaattgctggcaacgcaggagtttgtcgaaatgattccgcgaagtgcaacgcgtgtgacggctgtcgctactgatcagatcagcgcaatttatcgaccactggcagcgttacaaggcttggcggctgaactagctgcgactaagatcacggcgactgaattagaacggctaactgcgctaaatcagcgttacgaacaggctcagcaacaaaatcagccacaagcggtgttagttgctgataacgacttccataactttattttgcaagtcgctgctaatcagtacgtcagtgaattttcccagctggtcaatgcccacgcacaacggatcgagaatttttatctagatcagttgaacgtgcaacagccagacgcggtacgcgagcataatgagatcattatggcgatcgctgctgatgatgcggtcgctgcacgggaacaaatggaacgtaattggttatgttcattgcgtatgcttgaagcctgcgttaaaaatgaaggctaattaaaaaagtagtcaccaattcggttgaaatttggtggctactttttttattatttgctaaccggaatgcgcaattcaacaacagcatcagcgggattgccgttcagcagagcttcgatcacaaagctgtcttccttatagagttgcgggttttctggtaaaattttgctgaaaaattggccaatcagttgataattggcggctagggccaccttggccagttaggacaacgtaatcaccagcaggtacagtacgtgtttctgcagctgtgggtgtcactgttgtattggcaccggcaaaatattcgagttgttcatcggtcacgccactaagggcgtagccaattttatcgcgactagcgctcattagttcaccaaattggccgctttgggctaaggtcataaaatggtggctttttaaggtagaaacttcttgaatattagccatagttggtaaagggagttgtgctgcgtagccggtgatcgttaccgtggggaattgtttgatcgtatagttttgtgtcatgatatccttctttctgttagcgtacagcacgggatttttgatgttgcccgctaaattgctgctacgcgtcactttaaaaattttagggctaaagttaagctcatgtgtagtagaataacaggtaatacctgacaaaaagctgtcatattttatgaaaaggtggcaaaaagatgcgaatcagtcgtttgatcaatattatgctgattttattgcgcaaagaattgatttcagcgcgggagctagcgacgttattggaagtcactgaacgtacgatctatcgggatgttgaggcgttaagtatggcgggtctaccagtttatacgacccgtgggcgcaatggtggcatcggcttattacccaactataaaatcgcccaaaattttctaacggctagtgatgtacgcaatctactaacggcgttgtccagcgtgcagacattgatcgaaacgccagagatcaaagcgactgtgcagaagttacaagcgatgtacggtactgacgagtttactgaacttttgatccaagatgtgaattggcaaggggcggcagagatcaaagcattagcgcagcaatttagccaggccatcaagcaacatcagttagtcgaatttatgtacagtgaccgtaacggtaagttaagtcagcgccaggttgagccataccgcttggcctataaaggtgaccgttggtatttgcagggctatagcgtggaacgtcaggatttccgtaccttccgcttagcgcggatggagtcagtacaggttttgaccgctgaatttgtgccgcggtcgctgccaatggcgcagctggtctttagcaataagtttccccacgccgagctaacgacgatcaccgttcgcgcggccaatagtgtgcgcgatgtttttgcggaacgttatggtagtacggcgatcaaacagctgacagacggccattttgcggcaacgctgactctaccaaataacgaatctgcttatcgctttattttgtcgctcggaaataaggtcaaaattatgagtggggcggcttttcgcagtggcttcaaaacttatttagcgcaggtgaatcaactgtatcgggataattgaagcctgattaccatgcgttgtgtgcttttttggtataatttgggctgccgtagcgtgcttttttaattggcaaagggcggttagctgtaaataaccttgattgaggggctggaattgtggaagctgtttttgcgatcgttttactattaggtgcggtggtggccgccaatattttatacggactctattcaaaaattcccttagcattctatcagatcggcatgggcttgctgtttaccttattaccgttataccatcattatcaacttgatccatcgatttttctgtacgcgatcatcacgccgctgatgtttaatgatgcgcaaaatacgtcacggcgcagtttatcgcgtaatttaggcacaacgttatccttagcaatcactttagttgtggtgaccgttttagctttaggtttcagtattcacgccttattaccactgtttacgctgccgctagcctttgcgttaggggcaattgtcagtccaaccgatgcagtggcggtaaaatcgatcacggctagtatctcattgcccaaacggatcatgaatacgttggaaaatgagtcactatttaatgatgcaacagggatcgttgctttagcgttaagtttggctgctttccgaactggtcatttttcgcttggtcaggggatcactgactttctgtatgtctttttaggtggcttgttggtcggtgcggtgttaggttatctgattgtccatttacggattctgttgcggcatttaaatattggtgcggtgcaaattctattgccgattcagattttaacgccgtttgtggtttattttatcgctgagcatatcggcacatccggtattttagcggtggtggctgcggggctgatccatggcatcgagcaggaccatttaaagttgacttcaactaaagtgcaatttgtttcgcagacaacttggcagatcattagtgatattttgaatggcttcgtctttgttttgctaggcttaacgctaccgacagttatttacgcgttgagtacgcaacatacagagcagtttttcattttgcttgggctagccttgctgatctatttagttgcgtgggcgctgcgctttggctgggtttatttgggcttcgttaaagtatttagtcgttcattgtcaaaacggacgatcagtgcattgatcgctaccggtggcattcacggaacgatgacgttatccttggcactgtcattgccatttacagtggctggaaaagcttttccgctgcgggatgaacttatctttgtcgctgctagtgtgatcttatttagcctgcttgtgcccacttttgtcatgccttggttagtgcctaaaccacagccgactaaagcgccgatcaatttgcgtttggtgcgtaatgatatgttggaatacgcgatcatgcaattgaaaaataatcctgatgcggattcagttgctcagcaagcagttttaggaacgctgtaccggtaaaaaaaagattcgacacggccagcgcgacagcaggtcgcagcaatttttactcaagctgaagcggccgaacaagctgcaatagcagaactgaaacaacgcggtgacttaacgccagaaatggaagcgtggtaccaacgctttttgacgaccagtaactatatggcgcagcattcagcttggcgcttatggtttgcgcgacttaaattgatttttaaatttcgtagccgctttttcaaaaagaagcaaaattacgcacagatacagcacaagcgtgcattaacgatcgatcagttgaagcagcaacgacagcaaatggtcgtggttgaagaatatggttataacgcagttagtacctttttgaatcagtagacgacaccagaaaactatgccgcaatttcgctggtgcggcgcacttataatgtgcgccaccgccgttttagtaattcggaaaccgcgaatcaagcgcaaactcatctcttcatcgcggcatttcaatatgaatatgattacgttgaaaatcaggtgcgtgatcaacagatcgaccatgccaccgccagcgcactacgcgaacagatttcatatgatgaaattgtttatatgcaaaatagtcgtgatcgtgattaaaagttattgcgtagtttactgaatagtgacactcaattaaaactgagtctgcacataagatttaagtaataatactttcgcaacgatttctgcctatgctatactgaattatcaagaaatactgctaagttagtttttagcgctagtttagccgcttttttaacgcaaagaatacggaggatgatgtacttcatggaaaaacaaccaactgtcccacccgatgcgaaacctggaccggcgccgctatttacgcaaagcgaaacgcaggtgttgactaagttcgacagcgatctcgaacaaggacttagcgcaaccacagcgagtaaacttttagcaaaaaatggccccaatgaattgactgcgcacgttacccccaaatgggtgatgtttttgcggcaattcaataatgtgatcatttatattctgttgtttgcggcggcgttaacgttgctactgcgacactattctgatgcgatcgttattggcttagtcgtcatcattaacgcactgattggttattttcaagaagtcaatgctagtaattcactagaaaaaattaagtcgctgctgtctaccgaagcaacggttattcgcgacggacagcgcaccgatattccggctagccagctggtgatcggcgatatcgtttatttagaagccggcgataacgtgccggcagatatgcgcttgctggatgccgataatttgcggatccaagaagctgcgctgaccggtgaggccgattcggtgctgaaaacttttgcaccgttgaccgatgcacgcacaccgctagctgagcggactaacatggcctatgccagtacggcggtgactaatggtagtgccactgggatcgtggtcgcaactggccatgatactgagttaggccagatcgctgatgacgtcagcaatgttaaggctgcgaagacgccattgatgaaggaattagacgatcttggtaaatggatctcgtatttcattatcgggatcgcgatcgccttatttgtctttggttggtggatcaacctctatgccttgccgacactagccttagccgtggtgaccatggtggttggttcgttgccggaaggattgccggcatcgacctcggtaattttagccatgggtgtcaataaaatggcgaagcataatgccatcgttaaaacactgccggcagtggaaactttaggagcagtcgatgtgatcgccaccgataaaacggggacgttgactaagaatgaaatgacggcgcaggatattatcacgcagcgccatcattaccaggttaccgggactggctatgcgccagaaggacaaatcttgttgaaccaacagccggttgaaatggatacggacgttatgctatccaagttgttgcttgctggttttgaggctaacgacacgatgctgcagcaagaagatggccactgggtgatcaatggtgagccgacggatggtgcgtttttgaccttataccataagggcctaggcgcagcagcaccagctgtgactgaattggatcggataccgtttgactcggattatcgttatatcgcacgcctagatatcaatgaacaagggcagcacgagatctttatcaagggtgcccccgataaattgtatgaaatggccgctgctgctgatccgtattttgaccaagatcattggaatgatgtgatccaagatttgacccatcaaggtaagcgggtcgtggccgtggggcataaaatcgttggcgctgacgtcaatgaagtgacccatgagattttacggcagggtatcaactttcttggaatcgtggggatcattgatccaccacgggaagaagtaatcgcggcattgaaagaaatgcggaccgcggggatcaaggtaaaaatgatcactggggaccatccggatacagcagctgcgattggccgtcaactaggcttagcggatgatattcagtcgatcactggggcagaattggatcaaatgacccccgaagagttgcgcgaaaatattaatcgttacgatgtttttgcccgcacaacgccaagcaataagttagcgatcattgatgcctaccagcaaaccggtaaagtaaccgcgatgactggtgatggggtcaatgatgcaccagcgctgaaaaaagctgatatcggggtggcgatggggatcaaagggaccgacgtggctaaggatgctgcggatatgatcctagtcgatgataactttaccacgatgaccaaagcgattcgcgaaggccggcggctgtacactaatattaagaagacgatcgctttcttattaccaacgagttttgcggaagggttgatcgttgcctttagtattttaatgcagcaaccactgccattagtaccaacgcaattactatggatcaacatggtttctgcgatcacgatccagtttgcctttatctttgagccagaggaacaaggtatcatgcagcggccaccgcgtaaaacggggacgtcgttattaaataagcatgatgtgttccaaatgacatatgtctccatattaatcgctggtatgggcttgtgggccttcgattggctgactgctggtggcgtttcgcatattattgccagcacgatcaccgtcaacattattgtgttaggtaaagtcttctacttgttcaatattcggacaccgcatctcgccttttctcgtcatttttggagtaacccgatggcttttgccacgattgctttattaatggccttacaactattattggtttacttgccatttatgcagggcgtctttaaaaccggcaatatgaattggggccagtgggggattgcgattgccgcagggtttgttaccttgatcgtaaccgaaaccgataaaattattcgaattttaatcgaccatcgtcggcgttcagcgatgcgttaatattggagttaagcgtgctttcaagtgcgcttaactttttttgcattaaaatgtaaccgctaactttaaaaataattaaaaaatcttttaatgcgataaaatcgctgtttatgcactaggccctgtcaagttgacagatgaaataataaaaaattgaatctgtttctaagcggcttcattctagtattcatctggagtgaggccgtttctttgtgccgaacggttgtggtgattaaagtattcaataccttcttcaaccagcttctcgagttcttgaagggtcttaggcatcggatgacgctccatccaacgcaatttaaactcattccaccaacgttccatcggcgcgttatcgtatggtgtgcctggacgagacatactgcgtatcacatcgtaacggcctagaaagttgttgaaggcaccagatgtataagctgagccgcgatccgtatgaatcaatggatgaacgtctccaacacgatcaaatgcacgttggaacacttcgatttccgcagctgaggtttcggtaatgctgaggttgtgtgccaagagaaggcgtccatagagatcaagaacgccactcagtcgaattttgtattcaccattcgggccgaatctcaattcagtcgagtcagacaaccaaactttgttaggcgcgtccgtatcaaaattttggtttaagacattgtcttggacgtactgctcactagctttttgacgactgtgtttcttgactcgaatctgacacctcagtccaagctctcgcatcacacgccgaaccattttataggtaacttcaaacgtaatcgattcatcatgctgtagattcactaagagattcccagcaccgatgctctgatgatggaaatcaaaccagtattgtatccgttccttgagttgacgatcacgaacttcccaagctgtttcttcacgctttaagcctttgtagtaagcctgccggcttacgccgacaacagctaataacttggtaagcgcaccgcgcttgccttgactgacctctttgattgcgacgtaggccagttgatgctgtttattcaccccttgcgctgaagttccagcaatttttttgcgaattgttccaccaattctttatctttaagctcagcttccagctggcggatgcgaagatttgccttatcgagatcagtcaattcagactcgtccctgtgatgaccacggttatcgacgagggcctcataaccaccgttcttggccttaagcacccaagatcgtgcttgctgataggagacttgaaagtgctctgcggcctcagcgtatgaatgtttatgtttgactacgtactcaacgatttcaattcgttcttcgaaagttgtcttcttaggcatagtggggacccgctttctggacggcgatgccgtcaaaggtttgtcctcattatacttggtaacccagttttgtgcttgggtagcgttacgcagaccatatctgtccgccaactcaccaaatgtaccttctccatttaagtacgcaaagacaactgtatgcttcaactccttactatagtgaatattcttctttgcttcttgcaggccttctagaccatctctttgataacgtatcaaccaacttctaagtgtatctttaccgattccatgccgcctttcataagtagccctagggagccccgactgctgataatcttcaattaaattgagcttctcgagaactgtgaacttagatctggacatacaaaaatccctccataatcatcagatgaattattgtatttcatctgacaaccacaaagggattatcgcatttatgatgctttcattaattgtggttttttgtgctaattaacgataacattttcattatgaatattataaaaaatcgatttgcactaactgaaagtaaatgctaagcttagaccccaagcaaggtttagtcgctgcaatcactttgattttcgcgggtttcggtgccaaaacattggccgatagtttctggtccgggcataccgatgttgaggcgatcaacgctgctttggataagatcaacggccaaatacaaactaaaaataaagcattagctgacgcaaagacggctttaactgacaaacaaaatgaattaacgacggcacaacagaacttgacaactgcgcaacaagatctaaccaatagcaaggcgcaagtcacggcgctacaacagcaatataatacattaaagaatcaatacgacacggatacaagttccctacagcaacaaattcagcagaaaatcactgaaggtaatgaaaaagtagccgctaaacagacagaacttgctgctaaataagcagaagttacggataagcaacaagcattggacactgctaaccagacgattgctggcctaaacactaaaattactgatttaacgcagcaattagatacggctaacaaggccgctagcagtaaatctgctgaactgactcaatccgaacgtgacgcattgcaagcaaaacaagatgtctgccagacacgcgcaaaggctgaaagcatctctaacgctaatgaataaattgaaaaaatgagctagaccatcactggtttagctcattttacatacacacgcttaaatttaatcggggtcatctggttgtagcttcaatagatgcggtttaccgtagtaatagccttggcgtaggttgatttttaattggttagccgtagcgtcatccgtggcgtcctcaataccctccaaaatgaaacgtagattatgcttagcagcaagatcacgccaaaaaattactttttgctgcatggcggacatttggaatgaggtggtaaaatcttgtagcgcaaacttgatctcggtggcgtaaggaatcagtggttcaatgtgagctaattgattttcgccagtgccaacgtcatctaaactgacttccatgcagcggatcgtgaagttttcgatcatcggcagcaactgctcggtgcgccagtgttcatcgcctggttcttcagttaattcgacgactaatttaactgggcgcaactgcatttgtgaacggatgattgcctcatcgatctgcgaatccattaattgggtacggttgagattgacggaaaccgaaccgatctttaatgccaattgtttggtcgtagctaccagcgtttcggcgatgatcttcgctggtatatcggagaaatgctgtggtggtcgccagccatcggtggtgtactttttcatcaataattcatagccgatcagcgagttattgattttgtctaattgtggttggataaaataacgatacattgtatactcactttcatgcgcttagttacagcgtaaatccacttcaacaatagtaacctaatggtctatgttctagattctcatagcttgtttattctataacgtattataatataaattgaacatattggtttagctttttgttttgaataaacaatttcatgaaaggaaaattattatgaaagtaattgtagttggttgtacgcacgccggaacggtagcggtgacacagattttgcaagaacatccagaagccgaagtcacagtttatgagcgtcatgataatgtttcgtttctatcgtgcggaatctcgctatacttaggcggtcaggtgaagcgtttggaggacatgttttattctagtccataacagttgcgcgatttaggtgctaaagtaaaaatgaagcacgatgttttgaagatcgatgctaaggctaaaacggtgacgagcgcagatttggtgacgacagagttgaccactgaatcctatgataaattaatcatggccacaggttcttacgtggtggtaccaccgttggtcggtattgataattcacgggtgttattgtgcaaagattatgcacaagcgcaggaaatttataaaacagcgcaaaaccataaacacgtggcgatcgttggtggtggttatgtcggggttgaactagctgaaagctatgctgacacggaccatgaagtcacgttgatccaaagtcgtgatcagcttttaaataattatgtagataaagccttggcggataaaatcgccgcaatgttaactgaccacggggtacacgtttatttaaatgagcgcgcacaggcttttagtggggccgagcaagttgttgttgagactaatgccggaaaacatgaggcggatcttgtgatcgtttgtacgggctttgtggctaatacggagcgcttgcgtggtcaagtggatatggatcgccgcggtgccattattaccaatgagtatctgcaaacatcagatccagatatttatgcggccggtgatgcttgcacggtacattacaatccaactggtaaatcagcttacatcccattagcatctaatgcagtgcgccagggtattctagcggtaactaatatttttggtcatatacagaaatatatgggaacccaatgcacttcggcaatggcaatttttgggcacactttagcttcgactggtttgactttaagtgcggctaaagcagctggttttgatgcagcagccgtaacttttcatgagaactatcggccagaatatatgccatccacagccatgttaacgatcgtgctggtttatgatcgtgccaatcgccgcatcttaggggcacaactattcagtaaacatgaagtggcgcaatcagctaatacgatctcggtttgcattcaaaatcaaaatacgatcgatgatttagcttacgtggacatgttgttccagcctaactatgatcagccgtttaattatttaaacttagttgcgcaaatggcagttgcccaggaaaagcaagctcagtgaatttgactaaataaactaaaaaacgtttgggcaggataattcctaacccaaacgtttttaattggcttcatttaggaaaccttgttgctgtagtactgctaatagttcgcgccgtggcgtttttgaaagcaacgcaccgcggattacttgagtgaaatcagcttgccgagcgttgtgactgcgcgcttgataatactgctgtaaggtttgctgataatcggctaacgcagcagtataggcagttggctcttgataaccattagtgaaatgaactgccgcttccggtaaacgtggcttgagttcgttttgtccgttgggatagccaactaataacccgaatactggcatcgttaatttaggcaagtgtagtaattcgatcaatttggcggcatcgtttagcacactgccgagtactacggcacctaaccctaggctttccgcggccgtaatcaagttttggctggctaaggtggcgtcttcaacacttgctaggaagcggtcagcgccgcctaaaagttctggtgtcagtccttgttggcgtgctaaagttgcattgcgatgctggtcagcgatcacgatcagcaggtaaccgttttgctgaacgaatggcatcgtggtgatcgccgcaatttgttgtcgcaaggccgggtcagtaacgctgataaaactataggcttgtaagaaaatacttgatgatgcgtgttgtgccgtggtgatcaactgtgagactgtttctgcgcttactggctgtgtagtaaaatcgcgttgtgagcgatgttgattaagtaattcaagtgtgttgttcatggggtaaaagctcctaattcatatgcagattattttgacaatgaatcaagcttagcatttttagctaaataataccgtcagtttgcttgctaaattaaagaagaaaggctaggcttgtgcttaaaaatatacggctgatcatgcaataaatgattagcgcttgtagtcaattagaaatgtgaggttcaggcaatgcatcattttacgcgtcaagatctatcggcacgacaacaatataaatttatcagtggtagtattattccgcggccgatcgcctgggtgaccaccttggctggtgctgtggtcaacttagtttccagtattcccggtagtgaacccctgatgacgctagcaatcgggcgtaaaacaccgcagcagccgaaggatactgcggctaatttattagcaaccggagaagccgtggtgcacattgtttctgctgacttggttgagcaaatgaatgctactgcggctaatttaccagcgtctgaaagtgaagttgttgccacgcaattagatttggtgactagtcattcagttgcggtaccaggtttagcagccgctaaaattcgctttgaatccacggtctatcagcatttagtgatcaacgatcataccgggcaggcgatggctgatttatttgtactgcgggtcagtgatttttattttgctgatgaagtgttcgatgcgacgcatgattatattttaccagctgcgttaaaaccggtagctcgcttagctggtgccgagtacgctgaattaggaccgacctatcaactaacgcggccccagtaagttatttatttttacgatcgcgttgggcaatcaattggcgccggcgcttgaggcgcttgacccagaagccaccattgaaggtcgttggttccagcgagagcataaaagcccgtggattaaaggccagaaccatatcgtaaatcgttttttcatctttacgcggcactaaaacttccagtaccatccgggcaccgtcacgaccaataccgtcaaattcggtcacgccatagccggcatcacgcaataaatggaccaatgtttttttgtcttggttttcttcgccttggggaatgatgatctgcacgatcacataaccaatggcgagccaacgatcgatcagcatacctaggccgatcccgagcccaaaacccagtgcgtaagccactaggtagagcggattagccaaactatttaaaacgtaattcaatcccatcgtgtataaagtgatctcgaccatgccaaaaaagggtgccacccagatcaaccctttattttgaaaaatcaaacgtagtgtgttgatcgtgaggtaaagtacgttaatgccgaaaactaagaagataaagccgatattaatatgcatatatgagcgctcctttatttcacaactaaaccaatatcagatgttaaagctacatgagccaattctaaactggtaacagccaatcagcaaatcttattaaaaaagcggcacaagtttaggcttgcgccgcttttggggttgcgctatgcaacgtatgttgagtgatgatctggtataaaatcgcacgaatcgctgccttttgcgtcagaacttcggcactatcagtggcgctaaataaggccgttgttggctggaccaggctagccagttctgtgttgcttagctcaatgaagcgatcgtaggctgtttgcgcattcgttgtggtgaccgcttgttggattccagcgtggatcgcctccagcggaaataccgccttaaacagactcacaatgatgatctcagctaaatgtgtccgagtgtagtgttttttgtcgggatgatgaacgattttgcgtttgacgtagctattaaccatacttttggtcaatggttcgatgcccagtggtcgtaaatagcgatcagtttcggtgatcacttgatccatataaagatcaaattcaggaagctcatgccattcaggtaagcgaactgccgctaattcgcttaaccaagtattgaaatcagtctctgccattatttttcccccaagatagtttatctctattatgccatataaaaaaataattgcatcatctagactttgtgtctacgtgtggtaaactatagttaaagataaacaaatagtagggggcatttttatgactgcgaatatgaagcatcaagttgtcgtattggaaatttggaatgcaattacgcatggtgtcggctttatcggtagtgttgtgatgtttgttttattaattcggcgcggtttgtctgagccggaaccaggattattagcattgataatttatggaatcacactaatgttgctttatttagcgtcgactttataccattgtttatcactaacccgggcccggcgcgtatttcaaatttttgatcattgtaatatttatttgctgattgccggaacgtataccccttattgtttattggcgatccgtggcggctttggcttagggatgtgtctggcgatctggggtctagcgctagccggtattgggctacatattctgagtggggcccggcaacaaaaattagaaacaacgatctatgttgtgatggggtggctgtgtttaatggcgatgcgcccattatatctgcatttaggcacactaggttttagtttattagttgccggtggggtgacctttacgcttggtgccgtgatctatagctttcctaaagttccatacttacacttgatttggcactttttagttatgctgggaacgaccctgatgttttgctcgatttattggtttatttaacaacaatatctattttcaggttattttgaacataattttaaacttatttcagttttcgagacagaatgcttgagagtataaaatagtttgtgtaaatgaataaaagtcctgttgaaaagggaatcccttccccgtatgattaaatcatccaaatcaaaccaaaacggagggattccccatggatcagtttaccaaaaatctaaccaaaactctattgttaaatggcgatgttaaagaactttttcgtcaacaactcgaaacggctattaatcacatcttgcaagctgaactaactgccttacttggttatgatccttatgaccgcagtggctttaatactggcaattctcgtaatggccagtattatcgtttaattgactctgaatatggtaagttgaaaattgctgtgccgcgtgaccgtaaaggccattttcataaccacctgcttccagcctattctcgtcgtcaggacgctttagaaacaacaatcattcagctttattccaagggcgttacgacccgtgaaattacagatttgattgaaaaaatgtatggctcttattattcacctactactgtttctaatatcactgctcaggtaacaaaacagattgaagcttttcatcaacgaactattaaggcaaactatgtttgtcttttcttagatgcaacttacttacctttgcgccgcgattcagttcaaagagaagcggtctatattgctttaggtattacatctgtcggcatcaaagaagttcttgattatcgaatcgctccaagtgaaaatgcaggagtttggtcagaaatggcagaagatcttaaaaaacgtggattagaacaagtccagttgatcattgcagatggaatggttggtctgcagccagcattattgcacgctttcccgaaagctaaattccaaagatgcctagtacatgttatgcgcaatattggttcgcatgtgcgtttaaaagatcgtgaggcgatcttaaatgactttaaagagttgcattcagcgaccgatgtaactgcagcacacaagatcttaaatgatttttatggtgcatgggggaaatcgtattccaatctgatccagcaacttaaatccattgaaaatgaactattagctttcctgagttttcccccggccattcgaccaacaatttattcaaccaatatcttagaatcactgaacaaaagaatcaaacgcaagaccaaaccaaaggaacaatttccaaacgaaaaatctttagacaatttcattggagttcaagtcataagctataacgaaaagtacttcaatcgtagccatcgcggatttggtcaagtcaaagacacgttagaatcacttttcgattaatacattattttgccaggagaagggattttcatttacacaaacttcttgacactcccaaaaactcatctcctaaaacgacttagcttttaaagtcatcaatgtttggacttattcccgtacacagaatcgaactgcgtctagtcaccagaacgggaagcggcatttaatttagtaaattaaattgagtgaataatcgcactaatcccagtaatcataaagaataatcctactaggtaatagattgataagattgaaaaggcgggataaatcaataaaagaacacctaaaataatgccaattacggataaaatcacgtcaaccataaaatacttttcgttaactaacttgataatgttcgaaagccataacgatattattgaatccatcaagaacataattgcaaacgaaattgcaacaaatagaatgccaaactttccgttgaacaacattaaaattccgataataatgtcaacgaccgcgttaaaaacgacccatccagaattttctaaagcacctctaagaacggttaacttgtaaatcccggacaaaattgcggtaattgctgcaataacgactaccgcactgaaggttgctaggggatttcttaaagaaatgaccgcaacgaaaatacttaagatcccgacgacaaacataaatgggtcaaatctgtccaataacttattcatataaaattcctcccaataatgtaggtactgtcaaacgtacccgattttgtctagttttaattattgtttctaatggttttgtattatctaagtgaaattaaaaaacacccggaccaattcttctgttatccttggtgtgcaaccaacaag

SEQ ID NO: 496 - DNA, 33499 bp, Unknown
  Metagenome-assembled genome
tgatttaatgctttccagggttcaaataagttattaatcgcgattaatgatttatttgagctgtggaaggtaaacgcggttctgaatgtctcttaaaatctgtctcaaatattgacttcaatccaatcaaggatgatttcaattcacgcactcatatagagtgcgacggcatctgtcctaattcgtaatgatcggcgattactatttcaattcacgcactcatatagagtgcgaccgcaaaatatagttttaacataatttgttttctatatcttgtggataatattaattaggaaagtaaaaaatcaataaagtgcaataaaacaaaaaagaaccagtgatttaaggtgcgaaacaaactgaaaaagtatgtgcactttccactcgcactttgtaaatcttttaccaaggtaattaatgctatcattgaaattttatcatcattattgcatcggtgccagttatgttaagtaaataattaaatcaagcagtactgcaaatataagcgcttacatagtgccgtatacttgctactatattcttaagtactttgttattttaaaataattaatgggatgatttatttggaatatactgaggatgactttttgatgatctcggggattcagcattttcgattttgtcagcggcagtgggcgttgatccatattgaacaggcatggcaggataacttattgacatttgatggtcagatattacatacaaaagcagatcaaccggaaattcgggagaagcgaaatgataaattgattgtgcgatcactaccagtacattcacgtgaattaggcttgactggaatctgtgatgttgtcgagtttacggaggctactgatggtgtatcaatttttggtagtcataaaaaatatttaccacaaccaatcgaatataagcatgggcataagaaatatgacctatccgatacgttgcaattattggcgcaagctgtttgtttagaagaaatgttgggttgtcaaataacatctggtggtgttttttatcaaaaaacacgtcgtcgtgaagtgattgaatttactgcaaatttacgtgaacagctcaagaaaacgacgaggttaatgcatcaatattggactaagcgctatacaccgagagtgaagactggggcctggtgtaaaagctgttcattggctgatatatgtttacctgagttgttatctaagcaaacggtacaaagctatttgcggcggaggctggatgaatgaaaaaattattgaatacactatttgtcacgacaccagatgcatacttattcttagatggtggaaatattggaattcgtgcggatgaacagattttaggaaaagttccgttgcttaatttggaaggagtcgttacttttggccgttctggggcgagtccagcacttatgaatgagtgtatgcaaaattcgattccattaacttttctatcaccgcaaggtaagttgttaggccgcgttattggtacaagccgcggcaatgttgttttgcgtaagcgacaataccatattgctgaagatccagtagcaagtagtttgatcgcgcgtaattttattattggcaaaatttataatcaacgctggatgctggaacgagcaactcgtgatcatgggttagttattgatacgccacggttcaaatcagtatctggtcaatttaaggaagtcactcagcagatcatgcaatgtgatgatctggaaacaattcgtggcgtagaaggtaatgcggcgacacaatattatggcttatttgaccaattgatcttacagcaaaaggatgctttcaattttcatgggcgtaatcggcggccaccattagataatgtgaatgcactactttctttcgcctatactttattggcacatgatgttgcagctgcacttgagacggttggtttagatgcttatgttggctttatgcatcaagatcgtccgggacgaatatcattagctttggacttaatggaagagttacgcggtgtttatgccgaccgttttgtgttgcgtttgatcaataaacgaattgtttcagcaaaggattttcagaagaaagaaaatggggctgttttattgcgcgaagaggggcgtaaacggttcttaactgaatggcagacacgtaaacaggatatgatcgtacatccatatttaaatgaaaaaattgcttggggactggtgccatattgtcaagcattactactagcgcggtatttacgtgatgatttagatgcatacccaccatttttatggaagtaggtgaacagaaatgttaattgttgcagcttatgatatcgcaattacttctgaaggtgggactcggcgattgaaccgcgttgctaaaacgtgtttgcgctatggacagcgcgtgcagaattcagtttttgaatgtttgatcgacgatttaacgtttgctaaaatgcgtcaagaactgaccgcactgattgatcctgaattagatagtttacgtttttataatttaggtactcgctacgaaaataaggtaattcatatcggtgtcaaggaagtacaggatttagctggaccgttgattctttaatggtgctaattaaaaaatctgccaaccaggtatctggtggcagattttttgctattcatgatcgagttcttcactaataaagcctttatcctcatcttcgtgtgcactatctttattttcatcatagagtaactgatctaaatggctttcttcctgatcattgttttcattaggattaggcactgaatctggcgttttttttggttctttttcaccgggttccattggattgtcattttgttcatcataactcatattactatcagcagcaccactacgctgttcatcttgcttgaaattctccttgatctgatcatcgtgcattacggtcacatccttagttgaattttaggttcaaatttactatatcggctggcgggggaccatgcaactttcatgcacaaaaaaggctgcctacaaaataggacagcggcttacttagttatctaacttcaactgccacgtcgttaggcatgacttggcgtaattgggtcagcaaggtttccattgtttgggtgaacactaaactgatgcggcgattgcgtttagttctgaagacggcgatcacgcggctacgattacccggcatgggttgctggatcaaagtgatcgtttctagatccgtaaagcggaccgcagtggcgtagaaaataccgttagtgatcacacgctcaggggtcagcccaccaataccagagatgatattgatcaggataaaggccgcagtaaagacaatatatgaccagtcattgaccatgctggttgtgagcaagattccgaagacaacgccgtagcctaaagaccagtaattatattttgcacgcaaagtgatttgtgattgccaatagatcgatacggccgcactggccagcaccattaaatctaatatccaccaaaaaatagtcattgagttgactccttaaattagaatgtttaaactcattataacgtagttcttgcgttcactggtgaaaaaagtgtgcggaatttaagaaggtgacgattatcgcaatcgaattgaatgaaagtaattttatagcgttcgtcaaatcaggcgatgtactggtcgacttttgggcagcctggtgcgttccttgtcaaaaaatgaccccgatcttattggcctgtgagcaggccttgccccagttaagcgtcggtcgtttaaatgtggacgattacccgcaattgaccaaaaagttgcaagttcaaggtttgccaacgctattattgtttcaaaatggtgagccggtggcgcgggtcagtggctttcaacctaagtcgcgcttacttgattatttacaacgtagattggggcgtgaacagcatgcttagtggggttgaacggcgaacacagatcaaggaacagttgctggcggcacaaaaaccgcttagcgccaatttttttgccggtcaatttaaggtcagtcgccagacgatcgttggtgatattgcgctattacgtgctagtggcgaggccatcactgctgctttcaacggttatctgtaccggaatgagcaggcagtatttaccggaaaaatcgtttgtaagcacacaccggcagaaacagagaccgaattgcgtttggttgttgccaatggtgggcaggtactagatgtgacggttgcgcatgagctttacggtgaactaactggacagttgaatttaactaataatcaggagatcacgcggtttatgcacaattaccgaactaagcaggcacatttgctatcagaattgactgccggcgtccatctacatacgatcagttgtgccgatgcagcgcagtttaatgtgatcaaagcaaaactggcggatgcgggaattttgtattcagcggattaaaaaactcacgactgaatttgccgtgagcttagttgtctatttaagtcagcttaccagctggcttttttaatacccggaatctggccacgatgtgcgtattcacgaaaattaattcgtgataaaccgaatttacgcatataaccgtgggggcgaccgtcgaggacatcgcggttatgcatgcgggtcggtgaagcgttgcgcgggagacggctcagcgcagtgtaatcatgcgctgcctttaattcagcgcgttgtgccgcgtaacgttcaacggtagccgcaatttttgctgccttggcgatttttgatttttttgccattggtaccctccgtaaaaagatttatattaaacgatttgaattattctcactcaattaagcccagttagtgtaccatttttgccggtagtgaccaactgatttgttgtcgaaattttaagttgactaggttgacaagacacctgagtatgctattctatttccattaggtgacaagacacctaaaatagtatacaagtaggcggaaaaatgcaaaaagttagtgaaggtaaactgttgacggtggctgggtttgcgtggttgtttgatgcgttagatgtgggtttgttatcgtttattattgcggcgttaaaaagtgaatggcaactgaatactgtacaaatgggttggctgggcagtatcagttcgatcgggatggcagttggtgccttattttttggtattttagctgatcgcattggtcggcgcgatgttttagtattaacgttgttattattttctatcggtagtgggatttctgttttggcgactagtttcaccatttttgcaattattcgtttttttgttggtgctggccttggcggtgaactgccggtggcgtcaacgttggtttccgaaagcgttgcgccagaaaagcgcgggcgcatcgtggttttattggagagtttttgggccggcggttggatctgtgcggcgttgatcgcttattttataattccgcgtttcggctggcgtgttgccgctttaggcactgccttgacggcggtttatgcgctatacattcgctggcaaattcatgagccagtgacggttgctaaaagtgagcggccaactttattgcaaaatatttgtgcggtttggtcagcgccatacgctaaggctacattaatgttgtggttattatggtttgcggtggtcttttcatactatgggatgtttctctggttacctagtgttttagtgctgaaagggtacagtctgttaaatagtttcggttatgtactggcgatgacgttggcgcaattaccgggttatttcaccgcggcatggttgatcgaaaagtggggccgtaaatgggtactgatcgtgtatttgttagggacggcgttaagcgcctattattttggtcatgccgccagtttaggaaatttgttagtttccggcgctttgctgtcgttttttgatttaggtgcttggggtgcgttgtacgcttattcaccagagcagtatcccactgccattcgtggaactggaaccgggatggccgcagcctttggtcggatcggcggtattgtggggccgctgttagtgggttacttattaaccgcgcaggtcagcgttaatgcaatcttcgctatttttactggggcgatcattatcggtattttagcggtggcgttattaggtgaggaaacgcgcggtcgtgttttggcgtagtgctttaaaaggaaagcgtggctaaaaatagtcacgctttttattgtactgcttgttatacatgatataatacaactaaaataaagaaacgggtgagcaaatgcggttacgaattgatgtggccagtgaagtgctgctttatcagcagatccatgatcaaattattttaggcttagcggctggggcgttgcggccaggtgaagccttaccggcggtgcgccagttggccgatgaattaaacgtaaatatgctaacggtggcaaagggatacaacttgttgaagtctgagggctacttgatcagtgatcgtagccaagggacacgagtggcggctgattttcaagccgatacgatatttatgcaggcactacaaacacagttacacttactgacggcggcggccaagattcgcggcttatcagtccaagatgtgcagcagttagtaactgaacagtatcgtggttttacgaagggggaatgactatgctgaattggatctttgttggtttaaatatttttgtggcggtggtgatggcggccacagctatgctgccagctaaaccgcataaaaatgtgatcttggaaacgacattgcctggggcacagttaaagcaccctgcagtgcgccaactaacgcaacagtacactaagcaattatggtggttagcattattttttagtttagttggtctgccgttgatctttgttcactttgattcattagcgttactttattttgttttattattattcggtttgatcggtgctttttatggaaccgaagttcattttattcataaaatgaatcgacttaaacggtagcaaggctgggcgttgccggctaccacggaaaaggtggtcgatacgcagttagttttgactaaaaatcggcgcttgctgtcgctcaactggtttggcggtagtgggtcactgttattgatcggtttagtcagtaactattttacgctgggctgggcaactagttggcctttgatgttagctttgctcctttgctgggggctgtttctactattatattgggtcgttgctgctttaccagtgcgtgcattgacgacgcaaccggaacatgaccgagcacttaatgatgcttatcggcaaacctggtcgcgccaaatggttattggcagttatatgctaggggtgctgccgctggtggtcactttaacgacgatcactttcagcattatttacgtctatttagttctggtcattattttttgcgtgtacttggtctatgatttgattcgtgaacgtaattttgaagatcggctgctaggtgaatttgcgctgaagacaacggctgatgaagatcgtttctggcgttacgcgatgtataataatcccagcgaccgccgtctatttgtaccagatcgggtcggcactaatatttcgttaaatttaggtcggccagccggcaaaatcataggcggtgtgacgctagttttggtgctaggtttactttttggcgttgttggtaatttattggcgttggattttggtggtggtggtattcgcgccagtgcaaccactgagcaagtcacattaaaagcgccaggtacggctaccagtcagatcaagcggcagcagatcaagtaggtacgtttattgcaacaattaccggtcggtgcggtacggatgaatgggatcggcacgactcattttgctttaggtaactttcgcgtggagaaacgggcggcaaaattatatgtggctcaagatactggagcggttttgctgatccgcacaaaacagcgtgattattattttgccgcgaaacaaccacaagaaacgcgccgtttatatcgggcactgcaataataaaaggccgggacttttgtcctagccttttatcaattatttaccgagaccggcgaacattaattgtttgtaagcctcaacgccaggctgatcgaacggattgatctgcgccagcgttgccgagataaagacggcgtattcgaaaaaatagaataaactaccgatactagtaacgtctaactcggccaaatgcaactcgataatgggtacgccgctttcctgatgcgcggtgatcgtcgcatcttcagcgattttgttgatctgccaaaggcctaagccgtttaaataatcaagatcatcgttgacaccactaagctggatcgttaaatcagtttgcggttgatcaatgatcaccatggtttccaataattgccgttgaccttgttgaatatactggccaacggaatgaagatcttcagaataggtcagcgcaacggggaacaggccgctacattgtttaccttcactttcggcaaaaagttgtgtccaccaacgaccaaagtaatctaattgcggttcaaaatgggccaatacttcgatattcttgccatggtgtaatagaaaattacgcagtgtggcgtattgaaaagcgggattattgatggtgatatcggtttgcagcgcggtccgcatttgcatggccccgtgaaccaatgcggtgatgtcgatcccggcgacggccattggaaacaggccaacgttgctaaaggcggagaaccggctaccggtatcggtgggaaaagtgagaaaagcgtagccttcagcttgtgctaatttttccaaattactgccgtgcgtgccggtgacgattagatgtttggcataagcagcaccgtatttttgttgtaggaatggtttgaagattcggtagccgattcccggttccagcgtggtgaaatttttggcgatcacatcgacatagacctctttatccgctagatccgcgagtaagcgccgataaataatcaggtgaaaggttagtgccggcataaatgatctgcacctgatcgtgcttttgaccaaaggcttcaataacggcacgtgcggcctgattggcgccaccaacaccaatgatcacaagaacatcggcgtaggcttgtactttagctgccagttctttcaggtgttcctgctccattgaatcagcccactcagtgacggtcaaccagccgagatccgcactattagttggatcagcggcttgaacgtggtgcaaactatccagatttgtttgttgataagtattaaatttagtgtcagcgaattgcgaatcggtttttaagttaacggtgagcataagataacttccttttgcgcggccgtgatggtttatcgcgccgccttattttgatcagccaaagagtaccggcaatcgattgtcacctatcatataatcactaacttaaatggaactaaagagtgtgacataaggcgcccagcttttgagaattagcctagagcggcgaataattcacgtagtggattatttgacgatcgtagctaagcggaaaaagttgccttatgtcacaactcctgttaacacgtgcctttaattcacgggctaattgtgtgcaagttgaacgatttttgcagggtgctgtggctgcgcttgcgctgggataccaaccgccgtgtgatcagccgcaacgtcatcaaggaccaccgcgccagcaccaattttagcattgtcatggatcgtgatcggaccgagaatttgcgcgtgggcaccaatcagtacgttgttacccacttggggatgacggcggccattggtggcgtggcgcgaacccagggtgacaccgtgtaagatcgtcacgttatcacccacgatagcagtttcgccgatcacaacgccggcaccatgatcaataaaaagctgccggccgatctgggcgccgggatgaatttcgatcccggtaatttttttggcccaatgcgcactgagactagcggctaaataaaaatgatgttggtaaagccagtgtgaaaaacgatgccacgtcagcgcatgcaatccagagtatgtcagtaaaacttccagtaaactgtgcgccgctggatcacgtcgttgaatggccttcgcggtggcaaacatgatgggttcctcctttattagaatcgatttattgcttatagtgcagcaaaggcttggtctaaatcagcgatcagatcggtaatatcttctaggccaactgataaccggatcagttcatcttgaataccattggctaaacgaatttcacggggaattgagccatgagtcatcactgccggcacttcgatcaaactttctagtgagcctaagctttcggccaaagccactaacttcaaactttcaacgaaagttttggcgtctaaaccagcttgtaattcaaaggagatcatcccgccaaagccatccatttgcgctttggccgttgcataatcttcagtaccaggctgaccaggataatagattttagccacttttgtttgtttttccaaatagtggaaaacggcttgggtgttagcttcatgggcccgcatccggacgcctaatgttttaatgccgcgttgtaataaccaactatcttgggggccaaggatcgcgccgatcgcgttttgtaaaaagccaatgcgttccgctaaatcattatcgttagtgacggctaggccagccacgagatcactatgaccaccaaggtatttggaggcgctatgcaccacaatatcggcgccaagttccagtgggcgttggttgtacggtgtggcgaacgtgttatcaacgatcgtcagcagatcatgctttttagctagactgctaagtgctttcaaatcagaaacgtgtagcagcgggttagtgggggtttctaaatataaggctttggtgttatcttggatggccgcagcaacggcatccaggtcacgtgtgtcgacagcagtaaaggtcaagccttggcgaaccattacttgatttagcaagcggaaagtaccgccgtaaacatcgttgccgacaactaaatgatcaccttgtgaaaatagggataaaacagcatgaatagctgctgaaccggaagcaaaggcaaaaccagctacgccgccttcaagatcggcgattaattgttctacggcattgcgggttgggttaccggtgcgggcgtattcccatttaggttcgccaccaagaacatgttgatggaaagtggaactttggtagatcggcacactaacggcacctgtatctttgtcttcgctaacgccgccgtggatcaaggttgtatcaaatttcatgttaaattcctccattttctactgataaatattttcgctaagataacgttcgctgctgtctggaaaaatagtgatgatgttgctgccagctggtagtgtagcagctacttgtagactggcggccaatgcagcgccactagagctaccaacgagtaagccatgttcctgtgccaataatttaacgttggcaaaggcatcatcatcgctgatcgtgtagatttgatcgattttgacgtcttggaaaaaaggtggtacaaattcaacgccaatcccttcggtgcggtgactatgctcggggccaccattaaggatcgagccttcaggttcaacggtataagccttaacttgcggcaggcgatcctgtaaatattttgcaatacctgcaaaggtaccaccactaccagcaccagcgacaaaggcatcgatcttggtgcctaggtcagcagtcaattcagggcctaaagtatcgtaataagcctgcggattcgctggattcttaaactgcatcgggacgaaactgttcggtgttgccgccgccaattcttccgctttagcgatagcgcctttgataccagcagcagttggcgtattgatcaacttagcgccaagtgctttcatcaacgtttgtttttcaaagctgaatttttccggtactaccagaatgactggtaagtgatgttgttgggctgccagtgccacaccaatgccagtattgccggcagttggttcgatgatcgttgtaccagtagtgatcttaccttgtttaatgccggcttcaatcatggccacaccgaggcgatctttaatgctaccaccagggttaaacatttctaatttggcataaatatggctgtcgtttggaaccggtaaatccaattctaacaagggtgtgtcgccgatcaattggttgacgttttgatagatcatagtacttcctcttttcttgggcgcaagtttaggatagaaaaaaggcgcggatttgttttaaacaaatctgcgcctttcacaattcaactgattaagataagctgctaaccgaattatttttgggtagcacaatcagtgtatcgcgaaagacgcggtacacaacaacatacgctagcattgacaaacgttaagttgaacattgattgtgcctccttaattcaaagttgctctcatccgtccggattgattactccttcagaatacgggctagtcgaatgattgtcaagtgaaaaatttattttgttaaaaatttgccattacgcaactactgctcatggataccggttagtagctgcgcttcggttaaatttagtgtgatcaccgctgtgtagggtaaaaatttggctaattagcagatagattaggataaagcacgttttggtcggccattacgagatcaaaaataatgtattggggtcgtgcacgttgcatgattacaaccaagtcactagttcataaatagcttaataaaagcccataaaaagttattttttattactattagtgacgaaagttttctggaaaccattggttaattttcacagcagttggaatggtaaatccttcagtttgggtcgataaaaggttagttgatagggttgcttatagtggatcaaaagcacttaatatgggtaataataggctgccataggctgccaatagcgagtcaccagtaatggaaccactgacaaactcttttcattctggtgcatcataatttcagtggttggcgtaatttaaccgccaatggaaatgcgaccatggtatcagcaataactggtacaacattaatcgggatgccgactaatcctggtaccagtgagtacaatagggtgttagtgacaaaatagccagcccaccactaaaagtgcgaataaatataaccatcgctaaaccatgaactattagagcgaaggccatattgtgaatagccggaaattagatccagtaaaaagccgtttagctaattgatttgtttgtataaaataacctcccaaattgaatgatttcagtatttcttaattgcacttactttgacaagtaaaaaaagtttaggtatgcttaaaccaacgttaataaaaaatgtaaattgatttttatattaatgttaatttacttgaataaattagattatttttgataataagatttgttttagttaccataaaactttaagaaagtagtgttactgtgataatacgagaagcaacacctgatgatgcgggccagatagcccccttaatcaatttgatttatgatgaaatgcaattagacgagctagaagacgttccagaaggtgacttactgaaggtcatcagggcagcttaccagttaccgacttatttgtcggggatggcgactaccgtggtggccgaaatcaaccaacggatcgtgggcgtggctttcggttatcccgataaaaatgaggataatgtcgacgccatattgacgaagatctcccagcgcgtcaaaagttttcaaacccaacccttgattcctgattccgaagcattcaataatgaatggtaccttgattcgatcgccgttgaccctaattatcagggcaaagggatcggcagtcagctgcttaaagccttgccccgttttgtgaaaaatagtgggttaacaacgatcggcttgaacgttgactttgctaatcctggcgcaaagcgtttgtatcagggccatgactttgaaacggtcgggacaatgatgatcggggatcatcattattatcacatgcaacttgacttagacgatgcaccggcaattgccagctagtcgtgtcatggccaactattcgcaaccgagtagttggctttttttaatgcgtttaagcttgagtggacttacaacctagaaaaataatttatactaagaataaataatagtgatatcatttttttcgggtaatttaaaggggcgctggtaatggttctgcatttgtttaatacgtttttctggtcgtttttctttgcaatcggctatatttcaatttatcggcgaattgaagagggcacgattcgctggtaccgttcgaaacaagtgatgctaagatttggtgaattggctttagtcgtctatgcgagttcagttgaaattagtttgcggatcctacatcattttttaacgaccaatctgtggacgatggtcaatttacaaacggtggttgcgttgtatacttgtttgacgctgcgtaacaaaggtgccaacctacttttcttgttagtgacactggcaacatttggctcctacggtacgttaacttgggggctatggttggccttgatcggtttgttgatcattttatttgtggtcaacctgcaaagtgcgtggttagttggcagtcttagccgctacttggcatttgtcctgccatttggcacgtttacttggctgctattcaaggccttttatgcgtttagctggcaatcactgttggtgcagttgttttgttacgtttgcgttgagacaatcgtttttcaatacagtatcttgctaaagaatcgcggtgcggctagcgccaagttgatctacgaaacgatgcatgatcggttgaccggcgtgcctaattgggcgaagttcaatcaggattttcagctgtatcatgaactaatgttgagtacccagatcaatgagatcgttttggtggcgatcgatatcgatcattttaaacagatcaacgatacgtatgggcatttagccggcaatgcggtgttgaccagctttgcccataacctacaaacctatattcaccaagtaaattcggaatgggaagtttaccgtgctggtggcgaggaatttaatgtgatcatggccgggatcgaccaagccgcagcaaaacaggtggttgaagcttatcgccagcaattacatgagctacacgtcatgtatgaaggaaataagatcaacgttaccgcctcggtgggcatgactaagctgcaaggcaacgatgtgcaggccgaagatacgatcaaacgggcggaccagtatttgtatcaagctaagcaagctgggcgtgacgcggtcattgcgggctattgaataagaaaacctcaggaaaagattcccgaggttttttagttacgcaattgaggtgctgtgtaaaggctgtttacgttctggataaagtgattctgcaatgtggttgactgcagtcggtgcttcaccaaagcccgcggcgatcagtttggttttgccggagtaggtaacactatcgccaatgccataaatacccgcgatcgtagtcgccatattctggtcaacgggtaaggcccgatgttctagcggtaagccccaatcgcgcagaacgtgattatcagcggtaaagccgtagttgaccagtagggcgtcaacattcaatgtttgttcagcagaacctttagcttgtttcagttgtagcgccaaacctgttgcctacttggtcaattgcgtgatgttgtaaggtgtgactaattcaacactggaggcttccagtcgcttcacatttgcctctaaaccgcgaaaacgcggccggcgatgaatcaaataaactttttgtgcaacggcttctagggtcaacgcccaatcaatcgccgaatcaccgccaccagcgatcgccaccgttttgccggtaaaatcagcgacatttttaacgaagtaaaagacttctttaccgtctaacttagggtcataattaactgccagcggtcgtggggaaaaggcaccaccgccgatggcaacaatgatctgtcgagtatgggtgatgcgtttagtcgtagtcaaaataaactcgtcgttgtttttttctaagccaagcacttcttcgtcgcagaaaacttgtggcttgaaatcggtgaattgtagcatctgttcctgcaaactatggaccaattcgcgacctttaatgtgcggaaaaccagccacatcgcgaatgatcttttccggataaagcgcagcaacttggccgcctaactggggtaaactttcgatcagctgggtatccagctcacgtaatccggcgtagaatgcggcaaacataccgatcgggccgccaccgatcacggttaagtcataaagatgcgtatcttgctgcattgagcgtcctcctattgttcattaaagttaattttagtcggtgtcgctaatcttaaatctgtgccagtgcttgatccaaatcagcgatcaagtcatcaacgttttcgatcccaatcgataaacgaatcaaatctggcgtgatccccgtttgtttcagctcttccgcatttaattgggcatgggtcgttgaagcgggatgaatgatcaaagaatgggcgtcaccaacgttagccaataaggagaacagctcaaggtgttcgatcaaggctttaccagcggcctcgccgcctttaagcccaatggtgaagatcgaacccgcacctttaggaaaatatttttcggccaagtcatggtacgggctgtcggctaattcgggatagttgacccaagcgaccttgggatgctcgtttaagtagttgacgatcttgcgggcgttgctgacatgacgctcaacccgtagcgataagctttccaggccttggatcaacaagaacgaattgaagggactgatcgtaccaccgagatcacgcaaggattgagcgcgcactttcgtggtaaataccgctggggcaacgtcggtccaaactaagtcattatattgtggatcaggtgtggtgaaaccagggtaacggccgctagccgcataatcaaattgaccgttttctacgatcacaccgcccatggtcgtgccgtggccgccgataaatttagtcgccgaatgaacgaccacgtcaacaccgtgatcaagtggttggatcaagtatggtgtgccgaaagtattatcggcgattaggatcaagccgtgcttatgggcaattgcggccacagcctctaggtcgatcaagttgatgcccgggttaccgatggtttctacatacaaagctttggtgtgctcattgatcgcagtttcaaagttagccggatcatcagggtcaacgaaatgcgtcgtgatacccagctttttcaaagtgacgctgaacagattgtaagtgccaccgtacaaggtgcttgctgacacaatttcgtcaccagcatcagccacattaaggatcgccgcggtaatcgccgcggagcctgtcgctaaagcaacaccggcagtcccattttccaaagccgctactcgtttttccaacacatcggtggtcggattagttaagcgggtgtaaatattaccggcgtcggtcaaagcaaagcggccagcggcttgggcggcgtctttgaacacgtaagaagtggtttggtaaattggtacagcgcgggcaccagtttcatcgaccgtttgaccagcagtaacttgtaatgtttcaaaatttaattttttactcatgataaagcctccagttttttgtttagagtgattgaaaaagcgggtagattatgtaataatctgctttttcaactacgtttacgctaaagcagacataagctaactttgcgttttttgtcacatattgtttatgtaactttggtgcaacgatcctggtgcactcgcctccttcttcttgcgcaaataaaaaccgccgcccccgtgctaaatcagcacaagggacgacggtcatcgcgttaccacccaaattcgtatcgacctcacgatcaataccttaaaaagtacagttatatactcggcaaagtatcgcttgctaacggtgcggctgcactggctccaagttcatcttcatcaagcttgtgctgtttctttccaccaactgaaactcgctgtaaacacaaacaagactactcttcttttcgtcgccatgaatattaacttgtgtgttaaactagcatcatctttttttaatgtcaagctcatttttaaaattaattattttatcgatcttatgctaaaatgacctatagcgttgatatataactgtttctaaagaaaattggctaaggtaactaaagacgctaatttaagggccctttatggaagttaaaaaaatgaccaaaatattttctaattagcggcttgacaaattcaattaaattcccgtatgctaacgcttgatcagaattaaataaaccgacattgaacagaagagtaattggtgctgaaaaggcagtgacccttggcaagtggaaaaagggcttggcggtactgacgaagatgagctgggagtcgcggctaagttaacgcttagtcgccggtagcaaccgttattttgctaggtatcaactggtactgactgagatgtgtattgtgagatatgcatgaaatagggtggcaacacgacgaaacgtccctttgcaaataatttatttgcgtcggggcgtttttttgtggccaaaaaaacattgaaaggatgatcgccatgaatttacaacaaatgcgctacgttttggcagtagccgccaatggcagttttcgtgaagctgccaaggcgctatacatttcacaaccaagtttgtcccatggtatcaagcaattagaacaagagttagacgcgccactttttgaacgaacgcgccaagggacgattttaacggctgccgggcaagactttgttgctagtgcacaaaaaatcgtgcagcaggtcgatcatttgcagcaacattttacgacaaccgaagccgagcagcattatttttcggttgctgggcagcactatgattttattgcgttggcagtttgccaagtcttaaagcagtacagtgattatcgttatattcgcatttttgaaagtacagcactggaagtgatcaaggatgtggaacactatcacagtgaattagggatcattttcttaagtgactataaccagtcgcggttgctgcgcttatttaagcaagatgaattagtgtacgaagaattaggcgtttttcaaactcatatttttatacgtactgatcatccgctggctaaaaaaactacgatcaatttggctgatttggcaccgtatccgcaagttcgctttacgcaagaagcctcttaccctgatttggccgaggacccgctggaagcgccgacgactggggcagtgatcgcaacaagtgatcgggccaccatgagccgcatcgtcgcccgcaccgatgcctacggttctggttccggtattttggaagcaccagaggcacaaggcttgatcatgcggccgttgcagcattcgccgaaaaatagaatgatcattttgcgccgaaaaggccacgaactatcggagatcggccaatattttgtgactgcgctgcgggcttactttgccagtcagcatggcagtctatttaaatagtgtgatagaaaataactatccagcgctaaagccactggctatagcggttcagcagcgactttgatcaaattttaacgagctgatagcgtggctaaataaaaattaactatggatcaagctttgacaacctgcggggaaatgactagcataacgagtaatcaaacagcaatgtgatcgcaggatgagtacaaccaaattatcgcaaagcgagttccgctcagtgtaagggaatcgatagttagttggaagatggtcttgacgcggatttacttgtgagccttttggtaaacaagtaacggcaccaaccgttaaattgggatgcacgcaaagcgtgcagcataaggttttaactgtaaagttagaataaattaaggtggtaccacgcgttggcgtcctttccgaatatttcaggaggggcgctttttttagttcaactgaaggggatgagcggaataagtgggaataatgttcaggactaatatatacgattttgacttttatctaaaaaagaaatctaaattcagcactgtgaagagtcagtgataatacagattatattacatgaaagagttgatgaatatggacaaaaccaaacgattagaattctatggcggcccgatcgtcgggttgctgccgatcgctattttcattgttgccatcggctacattactttaggcctgaaattttattcagtaagttcctttgcgatccccacgcttgccggtttgatggtgacctactttctagccaaaaatcggcaacagtattggcaaactgcgatcaatggtctagccaataaagggatcgccaagctgatttttgttttcctgatcatcgggatctttactcgcctgttggtggtcggtaaaaccggccaaggctttgtctggctgggcacgactttaggactacatggtgccagttttgccattttagcttttctgggcaccgcgatcttttccctaggttccggcgtgccctttgccgccttgttcgccgccaccacggttttctacgttcctggcgtcatgctgggcgtcaatccggcgatcatggctggtacgatcgtcggcggtgttttcttcggcgatggcatttcgcctaattcccagttgaccaccgcagttttacaaatggaaactgattctaaaactggcaaaagcgctgacctggttaaaatgctacgccaacaggtcggctgggtttgcagcgtagcggccgtgacgatcgttttcctgattttgtttgccggtaaaggcggcacgactcaatcagcggcggcgttaagtaaatttgctgatccggcgggcctatggatgttgatccccgttttagtcgttgcgatcatgtgtatcaaaacccgtgatgtgctggcctcattgacaactggtattatcatcggcctgatcatcggtttagccactggcctgttcggcttgcaggacatcatcagtttgaacgttaaaacggccaccatcaccggcattttcgaagacggcatcaatagcatgttaccgatctcgctctccacgatctttctcagcggctcgatcgcggtgatgcaacaaagcggcatcatcatgatcttatgtgatcggctgaccaagcataaatttgtgcagacccccttaggtgccgaactcgtcaccgcactcggcatggggctagtcaatatcgtacaatgtggcgctttattgccgggcattttgctttatggtgactttgccgatcgaatcggtcacgtggctaagatctcacccgaacggcgcgcctatatgttagtggtgatctcgatgtcacttaccggcattctgccgatcaacagtattttcatcatgggtattctcggacaaattcgtagcttacacaccgcttttccgtcggtggccgtacccagcgccaacgcgatttttagcggtaccttctattgttggatcatcacggcgctgtggttatgctgggtcctgcttggttggggccgcagcttcgaagcgagtgccaaacccaaccgtaagcttaccgcgacacgcaaaaaaatcaccgtcctggaaagcaacgactaaaacgtatttttaaatcaagttaacgtaaaatctaagcgactttaagcataagaaatggagtgttgacctatgggcgaacccttagtatttccaactggaacagtgcgttacgatccaactaaagcttggaacggctacaccttagttccaacgatcaatgacggtattttattattcgatatgaacggcaatgaagtgcgccgatggaattttcaaggcttccctcctaaaatgctccccggcggccacatcatcggtaactccggcatgcgctaccctgaaaacggcatgcaagatggcgtcaacttagcccaaatcgattacgacggccagctggaatgggaattcgatcattttgaaaaaattgacgatcccggccatgatcatcggtggatggcgcgccaacatcatgattttcaacgggaaggccaaagcgtttattattcacctgacgaacgacctaagatcaattccggtaagaccttgatcctcggtcaccgcaccatccataacccgttgatctctgataaaaagttattggacgatgtagtctatgaggttgattgggccggtaaggtgctttggcaatggagtatcgccgaccattttagcgagtttggctttgatgaagccgctaaaaacgttttggcacgtaatcccaatatgcgtgcgcctgatggtggggttggtgattttatgcacaccaattgtgtcagttatttaggccctaatcattggtatgacgctggtgaccaacggtttaaaccgactaatttgattctagatagtcgcgaggccaatgtgcttttcattgtcgatcatgatagtggccatatcgtttggcaattaggccctgattacgtgcacgatgcccaggccgcggccatcggccagatcatcggtcagcacagtctgcacatgatcccgcaaggcttgcctggcgccggtaacttattagttttcgataacggcggctgggcaggctacggcacgcctaatcccggtagtctcgatggcgccaaaaatgccttacgtgattatagtcgtattctagagctcaacccagtcactatgaaagtcgtgtggtcagtcacgccgcaggacctcggcttcaatatgccggttgatagcagtaaattttacagcccgtacgtttctaatgtgcaacgcctgcccaacggcaataccttgatcgacgaaggttccgacggccacgtttttgagctcacccccgattatgaagtggtgtgggaatggatctcgccttatttcacccataatgaaactggccctaaaggcaacatgatctaccgtgccttccgctatccctatagttacgtgccgcaagaaccaacgcccaccgaagtgccgatcgccccggtagacaataccaccttccggctccctggcgctggtcaaaaaggcgctaaaaaagtggtcagtgtggctggcaccttgccctactacccagatgttgccctatgtgtggctacactcgatgagaccaacgaagtgcaagcgctaaaaaagcaacgccatttatttactctggaccgcaaaacttttagtgaacttgatcaaactagttttgcccaacagatccaagccgctaccactgaccaactacagatcgtcatgtttggcgctgaacgctgcgcccactgtaaagttgtccatccgctactaaagcgtgcactgaccactgaattcgccgctgactttacatcctattacgtcgatgtcgacgcaacccctgagttagtcgtcaccttgggtattctcggcactcccgtagtgatcgtctttagcgccggcagtgagctgacccgtttccggggtgaattagattacgctgggatccgcgcttttttaagtgataccttggttaaagcagaatagagaagaccgtgaaaataattctacggtcgctgaatgatcttatttttagaatacagtaaggaggacttttacttatgagttatcaagtgacatgggcggacgctaaactcaataaaaatgagcaaagtaaattaaacgaagacggcttagatatttttcgagacttacctgaattggtcaagcaccccttcgccgcgatcgataaaagctattatatgtactttaaatttgctgggttgacggtacaaaagccgcaggaacagggcaacttcatgatgcgggtgaaaattcctggcggcatcattaatgttaaacaagcgcgacatttggcggcgatcgcggctgagtatggtcatgatcaactagatttgaccacgcggcaagcggcgcagtatcactggatcccctttgccaagttaccagaagtctttgccggtatcaacgcagtcggtttgactacccaaggtgccgaaggtgatattacccgtaacgtgatcgataatccattatcaggaattgatccggatgaattattcgatacgcggccaaccgttcgccgcgtccaccgactattccaaggaaaccgcgactactctaacctaccgcgtaaatttaaaatctcgatcaatagcaatatctataacgccggcaacgcggagatcaacgatttggctttcgtaccagcaatcaaaaaaatcaacggccgcacggttaaaggctttaatgttaaagtcggcggtggcctaggaatgcgtccttacttaggccttggtctggatatttttgtcacgcgttcgcaagtggcggcagtagccgaagcggcggtgcaactttaccgtgacaacggctaccggcgcagtcgctccaaagcacggttgaagtttttgatccaagattggggcgttgccgagttcgaaactaagctacgtgaaaaagtgcctgatttagccactgctggcgatagtgcagtagtcggttggtccaatggcactgccttagggattcatgaacaacgccaagcaggttactattatgtgggcgtcagtattcctgccggtcggttacaaaccgctgattttagcgcctttgtcgatctggcggaaaaatatggtcgggacgagattcgctttgatcatggtcaaaacttgttgatcccttatattgcagctgccgatctgccagcagttaaggcggcaccaattttcaaaaagttttcttaccagccccatagtttggttgattttgggacaacttgtaccggtgctgaatattgtaatctggcttacacccacactaaggagattttcgcgccgctgttgaaacgattagatgcacagtttagctttgagcagccggtacatatcaccttaacgggttgcggtaatggctgcgcgcaccgtagtgttgccgatattggtattgaaggcctgactgctaaaacaaaagacggtcaacgagcagaagcctttaaaattgcggttggcggtagtttgttagccggcggccatttcaatgaagttttgaaaggtaaactatttaccgaccaactttatggtgccttggccgcattgttggctgattatcaaacacagcaattggctgctgaaacttactatgcctattttcaacgcttaggcattgcgcatttccaagctattttggatcaatatttggctcaagcggcttaagcattgccatgtttcaacttagcgccttttgctttagttgaatggacaccgtccgaaaccttaaaatttattagcgtccttggctaataaatcaccttaattgtgaagtaggagcgatttgcatatgaaaattaaaataatatacaccagtgtaaccggtaacacacaggaaacggttgaagttttaagtgatgctttaacagcacaggatattgatgtagcagtttttgatagcgaggatggggttgaggtggaagattttttcacggcggccgatgcctatgttttggcaacctttactgatggcgatggtgaggtgcccgatggtattttagacttttatgatgatattgctgagtttgacctaactgatataccagtcgctgtgttgggtactggtgacaccagctatgacgacttctgtcaggccgtcgatttattagctgggcaatgtacgactagcggggcacatttagccgtacctacattaaaaattgagctggcacctgatgatgaggcggttgcagcgattgaacagtttgcccaacaattgacacagcaggtcgcagcagaataggaactgatcgtgctaaattagcatgatcgcaggggggcaacattatggcgcaaggtattttatatgtgttacatggtcggcgtaacaaaattccgcaagcaaatttacgtttattacaggaactgatgcacgagttgtcacaaccgcaagtgatcagttttttagaaggtgatcagcaaactttggaggctggtttggtacagttgcaacaacaagtcgaagatgtgatcgttgtgccagtcctattattcgcggcgacacatgtgcgccaagatataccacagcggctaaaagcgcaccaaaggctaggtgtgacgatcacggtgctagaacctttggccaccaccacggcggtttttaactttttgcaacaacaattgactcgggcttgtcaggctttgccacagcggccgatattattgattgcacacgggacaccacattttgtggagccttaccagcaattgcaaaatttagctgcacagttgcaacaacaattaccagtaccggtgatcgcggctaattatattggtgcgcatcgatttactgaattattagttgatcaaactgagccggtgatcgtacaacggctctttttaaccgatggtcgtattgcgtgtaaaatcaagcgtgcagtacagcaacaggtaccgaccgcgttatttttaccgacattggaaaatcaaatcacggtcaagcaagcaattttggagcggctgactacagtaatggcgccaatacaagtttaatggcaaataaaaacgacccgcgggccgtttttttagtctaagtcgtgtttggaaaatattgctaagctggtttttaacactaatttagcttaaacgtggccaaaaaagcattggcactgaaaacacgacttagcaagtatctgatttaatgcccatttatttaagtagaacttgtttctaacgagtcacagactacgttgggcgcttttaaacacacgttaatcagctgctttagcgccaaagcggctttttagcacaccgatgatcgctggaatcaaggaaactacgataataccgagaatgatcgcagaaaaatgggccttgactactgggatattgccgaagaaataacccgcgccgcagcataatgcggcccacgcgacacaggcgatcagattatagcgaatgaattggcggtaggaaaaacctgagccggccgcaacaaacgggacgaaagttcgaatgatcggcatgaaacgcgctaagatgatcgacatcgcaccgtgtttgtcgaagaaggtttgtcccttggctaagctttcttcattgataaaacgacggaaccagcgataacgcgataaaattcgttcagcattgtggccgatccagaaattactggagtcaccaccgatacaagcaaccaaaaagaccgcaacgaaaaaccaaatattaagatgatactcagggttagccgccaaagcactagccgcaaaaagcaatgaatcgccaggtagaaatggtaagatcaccgcacccgtttcaataaaaatgatcgcgaataaaataaaataggttgagttgccaaaagtattaacgatcgttaccaaatgactatcgatatgcaaaataaaatcgatcagtatactcataacttagttttcctccaattttcaggtcaaatctgttatgagtgtagcagaaaaaggcttagctgtctgtagtttttaaatcatttaagtttttcgaaaaaaagcttgcataaatattttttaggtaagataattaaaaatgatctaagcgtgttaattcaaaactaattctggatgacacgttgcacttggacagaaaaatatagaaggtgagcccgtgaattatgtagttgtggcgttatttgcgtttttaggtggcggctgtcgttatttattaagtagttggtcaacaacgtttccttggggaacgctggtcgttaatttaattggttgtttcgtattagtttggttaacacaatatttagcgtatattttaccattatcagaacgctttgttctcggtgcggggacaggtttcgttggtgcattcacgactttttcgaccttcagtttagaaacgatcaattttgtgcaaacgcaacaatactggtcggccttattgtatgtcacgcttagcgtatttggtggcttagcttgtgccagtgcaggattattagttggtcaattggcacgtggaaaggcaggcgtacgaccgtgatcaatttcgttttggttggtagcggcgctgctttaggcgcctgcgcacgctatcatttaggtgaattaggcaaacggtatttaaaaatcgattttccggcagtgactttatttttaaatctcaccggcagttttatcttggcttacctttttggtcatcatttagcaaccccattatacttattccttggtacggggattttaggtggttatacgaccttttcgacgtttaattctgagttggtcttattatggcaacgccagcgctatcaagccatgttgtggtacggtgctagcagctatgtttgtggcttattggcggcagttgctggtatctggttagccacgattaaatgagtaagctctcattatttttttgctagaatattaggttaaattgttatgataacccttacaaatggttgttaggggagagcaacaatgctaaatcgacataatgttctatttatttacttagtttttctcggtttacaattcgtggcgatcgattcattttgtccaaatacaccagtcggcgacagctctatcgcaattgtgggggaaagcgatgatggtgaagcgggcagtgccggtaataaaggaaaggccggatttgttggacggcaaggtaaatctggccattctacagcggtggttcaagcagcaaagaaaagaacgagtgagttcaagcagcaggtagcggcgttggaaaaaaaggagctatcggtcaaaggcctagcgatgatgattttcggcttggaggcgatcatgacattaccgcttgttgtgtttggcgtgatgagtcttaatctggaggccaagcaggcgcggcagcgtacgcaaaacaagagcaaacgtaccgctgtggtgcgggcgtatacctaaactatataggaacagaagtggcagttcatcattaattttgatgagctgctttttatattaccaaaatagcgaacgtacgtttttattttggcgcgagtgtgttattatttgtgagaataatagttcaacaaagtagttcaagtcatacactaatttggcgtatcgcgtcttaacaggataaaggaggctgaatgttgactgaagcagaaatcttagcgctatctttggcggcaggtcagccgcaaacctttaaattgacccagacgttttggcgccatcgctatcaggtcgatccgcaaagttggctggtgaattttgaacgtgcaggtctattacgactaactgtgtcgtctgaacttagtttgcagcaaaaaacggtcgcagaactaaaaaggttgttgcaggcgcatgatttaaaagtaagtggtcgtaaagcagtattgatcgcgcgtttacaaacggcgctaacagcagcagaattgacagcgtattttccgcagaccttctatcagttaacaccaaccggcgccgaactagtcgtgcaaaatcattatgtgcgctggatccatgatcattatgtggccgggatcgttgattttgctgccgctaaacgggcgaatttaccgaaaaatttagatttggtggcaactttaacttggttattggatgctgcgcaggtacaggccgattcggattggccacaatattattatattgaacatttacggtttcagtttgcttggcaaaatcagctggtcggcacggcgttaaacgcagtactagactgtatccgcttgaagctagctggtttatcgcaggccgaagaaaagacagtggcgtcactggatctagcgacaacggcctataaggtagagccgttttatacttatatattacagcggatcatgcaggactattcacttgaagtgacggacattatggcagcctttgcccagcgttgccagttacttcaggtgccacgccaattattcagcgatcacgaaatgcaacaacttttgcactggactttaactgatcaaaggcaactgatccagcaatgctatcggcagaaacaaaaacaattgcgcgaaacgtcggcgtaactgttagttaagggctgaacatgatacaatgtaagtgttaaaccggtcggttgaatttggtcaatcatgatatagaagccatgtttcttgcggtgactgtcgctcgtttcaggcaacgttgtttggcaagtataggatattgaacttatttgctaaacaaaacgtgcttgccgatgtcgattggactaaaccgaaaaacggtaagtccaagtcgcaccgaaacgggttgagttgcggaaacgcagttgcggactgtgcaactacgctccttaaaattgccacaagaatggccactatcgctcgtttttaacaacactttcagcaagtatcggacattgagctaatttgctaagtaggacgtgcttcacgatgttgattggactagtgccgaagtgcggcaagtccaagtcgcatcggccgaaacatcaaaaatttttggtacaaaaattatccactatatgtggagtagaggagcgagtcatatgtttaaagaaaagtcagcaaagtcacagcacccagcttgtcatgcgatgcatggtcatcattatttaatggatcatccgcagttattgttgccactggcggttattcatgtgatcccgttagcgttatttattcatggagcgtttaaatatgcgaatttacatgaaaaacgtaaacttgaacaagaacgaactaagcagatcaagtatcgtgcgctgcctagtcggcaaaagtgaggctgaagtgagtgaagactaaagctaataagtttgttgtctatttttttatgtatttattaccattagcattgttagatttcttttggatcgtaatgctacaaaaagcggtgcggctgggttaccgaaataatttattacagattcgaatgaacagctttgaaatgttactgacagctttgatcgtagcggtggtgttcaattatctttggcaatacttagtcaaaagtgtgaccaaaagtttgcacgatcaaacacctgatcattttggcggattgcttaaggggtttttagggatacctggttggcttaacttagtggttgcagttgttattgcctttgttttgacgatcatcgtgccgcggcatctactcatcattgaaattcgtagttggctagtattgctctgtgcttacggggcaatcggctcgttttataatggtcaggatgatttgatccacatcgttaacggagtcgatcgctgggccggtgacaatcataatgtttaatagcttaatattgggacaaaaattaaccactattgtggagtagagccatgtttcttgcggcacgatttttgccacaagaatggccatcgtccgtagcatcagaatttttggtgcaaaaattaaccactattgtggagtagagccatgtttcttgcggcacgatttttgccacaagaatggtcatcgtccgtagcatcagaaatttttggaacaaaaattaaccactattgtggagtagaggggaaatattgtgaacaaatactatcagatcagcttttattttaatggcggtgtgcgggccagttatcatcaacaatacgattcagtagaattggcacaacaagcaatcaatgcagcatttaccaaaaaagaattattgcagatcgacggcagcgtaattaataccggtaaagcactcggttatgcggttacacctgctaataccgtaacaccggatcaaacggttatctgggatatgctttaaaccgaaagctcaggtaaaactgggattttttatttggagttagaatcttagtaaacgctttacaggtgattaattaagtgttacagtcatactgtaaaattattaattacaatataaaagtgctttgaaaagaggctacgattttggcgaattatcagtttttacagccctatacttttcattcaggagtaacattgaaaaatcgtatcgtgattccaccaatgacggaaacgatgagctttcatgacggtaatgttaccagtgatgaattaaattattttagcatccataccggtggtgccggaatgtttgtaacaccagtggcaaatgtaaatgcgctcggcaaaggttttgaagggcagcttagtgtggctgctgatgagtttattcccagtttgagccgggtcgcacacacgatacagcaaaacggaaccaaagcaattttgcagattttttcggctggacggatgagtaatagtcgtattctacggggggaacagccagtgagtgcgagtgagattcctgcaccgcggccacattcagaaacgccccatgcattgaccgagacggaaatcgagcaaacaatcagtgattttggtaacgctgttcgtcgggcaatcattgccgggtttgatggcgttgaattacatggtgcgaatacttatttgttacaacagtttttctcaccgcactctaaccaacggactgatcgttggggtggtagtttagcaaagcggatgctctttccgctcgcagttatccaatgttcacaacaagtgattgcgaaatatgcaactaaaccatttttgttaggttatcgcatttcgccagaagaagttgagcagccaggcatccgtattgctgatacacttgcctttattcgggttttacgtgaacaaaaattggactacttacatgtttcaatgggggacgcgtggcgaacgtcattaaatgataaaaatgatccacagccattgatcgaaaaaattaaggctgctgctggaaccaatttaccattgatctcagtcggtaatttgcggacgccagctgaagttgaaaaggttatggccgctggaattccattggcggctttaggtcgtgaaagtttagctgagccgcattgggtacagaaggtacaagcgggtgaagcggcacaattacgttatcaaatcagtgcggcagattgcgctgagttgggaattcaacccccattttgggcatttttatctaaattaatgggtcatcacggcaatccagataatcaacggcaacgtgatgcacagcatttagataaattgtttagttgatgatttcactggcttttaccgtagctttcttgtatgataatacacataaggtggcgatgaaatgcttagaaaaacaaagaattttcttaaagcaaatgggttccattataagaaaaaatatctttcacccttagtcgcgccggaaaactattacgttttgaagttcggtaagaatcatttgaataatcgttatatcgttcaatatagctatacttggaccggacgaatgaaagtaactcagatcgatttgcgattacacgggcaaaaaagaccaagagttttcgcaaatgaggcgcagctattaagttatctaaaaaagcatttgaaatgacgactgagggcaacctaaactttagaaaaagtcagcgttaaaatagtcgctgacttttttgttcctgatttattcacaaagatatgcaaaatacccatcaaacacatgcatcacgcgtttgatgggtattttgtattttcaccttttaagtacacaaaaagagcctcagctctggtatagttaaattgct

SEQ ID NO: 497 - DNA, 16511 bp, Unknown
  Metagenome-assembled genome
tcaaatgataaaatagtggtgcccataaaggtccttctttctagtggaatgttgtggtgacaccattaaagacctttatgggtttttctgtccactaatatgttcaacttaaattttacaatctaccttttaataaaaaactgcttaaaaaaagtatattccttcagcaaaaaaatgccaaacgaacatactttaaggttaaatcaatgtggctgccgtatgcagatcaaccggctgcgcctgatacataaatgcctgcgtgacaaaaccttgccgcaactcaggtgtcatcgcctgccagtgaaagggatggatcggaaacgagaacagactaccatcactgttgatattttgcacgtaaaagatctgaaagcgcggaaatgataaattgtcttcaatcaacgccacgattgcctgttctaacgcattcgtacgcggtaaggctagcgtcgctaattggcgcttgaattcactgatttgttcaacggttaatggcgcttgcataatggcttgcttagttgccgcatacaatgctaataattcagtcattgaaacaccgccttatttcgtcaatttatttttctgagcataggctaataggttttggcaaacttcatgggtcaaaatactggatgctgggctaaccggattgacttgttgcccttgaaccgccgcaataaaagcacgaatcagtggtgcgaaaccacggcgttccaaattaggcgtccaatccggaaatacttgctgcgtcgtgaccccatttgcttggacactgtacgttgctagatccgtcacttgggcaataccctgtggattctgtaattcagccgtttcactattcgcccccgcctgcatattcagcaacgcataggcggtcgcagtcggcgtttccagtactacgctagcctgctgcaatagaccatcctgcgccaagacacgatagtgataatgcgtcggcgtttggcccagtaaaaacagtgccgtatctacaacatggggcatcagatcaaatagcacaaacggtactggctgtgcggttgcgacacgattcttctgtactaaaaccgtttgtgctggctgccgttgttgtaacttggcattaagcggcgcaaaccgccgattaaaacctgctgttaacaataaaccttgttgtgctgccaattggtacaagcgtttcacttcagccgcattatcgctaactggtttatccacgtagacatgaaccccagcgcgcaaacatttctcaatataggttgcgtgggtcggtgtcggcgtgtgaataaaaattgccgttggctgctgcgctaataaggcatctagatccgcagccgtatgagcaaagccgaacttttgctgtaagttttttaattttgctacgttgcgggtacataatacccaatcaacttgatcctgcaattgtgccattaccggtagataggccttttgggcgatattacctaacccgagtacgccaatttttaacatctgctcacctcatttatttttattctagcgtttcgttagcgctaacacaaccgatagactgcaacgcaaccactaatatgcggcccaaggacgactttgctactgtggcgtagtagctaggcgccttatgtcacactctgactcgttttgcgttagtcagctatttttcactatcccccgcccaaaagcgctgcagattctccaccaactgtgctgccacctgatccggtgcaacgtggtgtgcctgcgataacgcctgaattccagaatccatgatccgtggataagcactcaacggtagttcttgattcaaggcccaagcgatactgtccattccgtccgactccaataaaactttgtccagcggtaccgcatttaacaagtaatgaacgctctcctcagtggcaaatgacggcccaatactgaaatagcagcctaacgccaagtaatcctcaatatattcagtactagaataccaatgcaataaatacgtgttaaaatacgtcttcaaaattcgtagcgtttcttgctccatccctttagtgtggatgatcaccggcttgtgtgcttgttccgcgtaagctagttgcttggtaaaaatttgctgctgcagttgcggatctgttctagtccaaacgttgtccaacccaatctcaccgatcaccggtacctgtgctaaaatcggtgccatgtcggtccacgtaacttggtcgacctgccagggatgaataccagcacttaagcgtaaacgccggctattaccgacccaactttgattacgggtaaactctgctggtgtgccacaattaatcgtggcgtagattttttctcgttttaatagacgaacgtaactttgttcttctgtatgcgtatgcgcatcaattaattgcatgttcaaactccattctaagtgaccaacttctctttcaattctaacattaatctcactaattatttgccaattgaaagcagatttacggtatactattaccattggagggaattacatgcaaaaattagtcaaaatcacaactatttttacgttaagtgtgggattactcggtgccagcgcacagccagttgcggcggctaaagctaaaaccgtcaaggcacagatcacattaacggttgatcataagaaagtcagcaccaaaaaagtgacaaccaccagcaagcaaacactgatgaaagtcatgaaacaacattatcagatcaaggaagacaacgggatgatcaccgcgatcaatgggcataaacagaataccaaagcacaaaagtactggctgtacaaaatcaacggtaaagatgccactaaaggggctgctgcaacttatctaaaaaacaacgataaggttagcttcacgctaaatgccagcaagtaaatcacgttataccccacgttacattgctgttgtttcgttgatcacagcattatgtgtcgtcggtcgttacttatttcagtttctacccaatatccaaccagtcaccgacatcattattttcatgaccttgagttttggcgtcgttaccggcggttatatcgcgattctatcgatcttgatctccaacgttttactcggttttgggatctggaccttaccacaaattttcgcctatctcatggtcgttggtctgacttggctatttggacattggccatacttgcgccgtcatctttgggtacaagcggcgttcagtttatttgccggctacctgtacggtttctgcgttagtattggccaatacccactactaggcggttggccgcaatttgtcgcttattatattgccgggttgtatttcgacaccttccatgccgttggtaatctggtattgtactttattctaattccaccgttaagcaaaattattccccgcttgcggctagattaaggagaaaatatgaaaacaattgacgactataccgcaactttaccatcgatgcagcaggaagtggcacaaatcatgcgcgaactactgcacgacgcagcgccacaagcgactgagactattgcctataatatgccggccattaagcaaaacggtaaagtattggtttattttgccccgacgaagcagcatttaggcttctacccaacaccagaaccaatcgtagcttttgcggaacaactacgcggttatcaaaccagcaaagggacgattcagttaccttacgatcaaccgctgccggtaaaattaatcaagcaaattgtcgcttaccgaatcaagcaagttaatggttagtcgctccccccgcagcttttgtgttggggggattttttatttagataagtatttggctaattttggcgtatgttatcgataatgactttgtttttttctgatcaccgcacatattgattgccggacatgccggtaaaagtagggtttcgtaatatcgctgctgatctactgggcaaacaactgaaagtccacgtagttggcactaaaaaaagaccgttaaggaactacgacatagcgcagcttcttaacggtctcccgaatattatagttaaagtatctcaacgtactaaagttaataaccacggtgtcacatagctttcaatcgctgcagccaataataaaccaggcaccacaatcatcagataccaacgcagcagcggtcggataaacggccaccatggtaaacgaccaatccaatcataacggcgtttgcgccaattgcgcgtacgactacgaatatagtaatttaactggctagctaaggccaacgcaaaggcaaaacaagaaatctcaaaaataccatgcggtactaaacccgctaaaatcagcattcccacacgcgtttgtcccgcgttcacataaagcacaaggccgatactcgctgccgttccaactaaattaagccagtataatagtggcacaggaatcaggctcagcacaaatacgatcagaactgcccgttcattgtgccaagcgatgcgcaaaaacatctgccagttggaatcacttttgataccactgaccgcacgtttcaacgcgcgctggatcgttgctatatctggctggacccacgctaagatcgcatagaccagcgccgcgacaatgaacaacaccgcccatgcactcaataagttagtccatatttgccggcggcgccattgtcgtagttcggtcgttttgtccataagtcacctactttttctttttaggcaacttattggcgctatcagttttaaccactaatacatccgtgattgccgctcgattaacgtacgacgccactgaaccgatcagcatccgctcaactgcatttaaaccagttgcaccgatcatgatcagatcatttttatgctcctgtggaaaatcgcgggcaatgaccgttttcggattgccaaagcgaatatgaatgtcaatatcatgaaaatcactatctttttcgattcgagtcactaagttatctaaataagttttcacatcttcagacattttatagatgacgtcaccatcgacaaagccggaatagctgacctcaaattgttgcgtagccaaaacgtccaacacatccaaatgtgcctcgttgcgtttggcaacttcaacagcctttgccaaagctaattctgcttcttcagaaccatctactggcactaaaatattgcgatattcttgtagcataacgatcatcctcctcagttgttgtcctgacgttcacacttatattatagtccaaatccgcaaattatgccgcattcaaaataccacgccagactcatttgcgtttataactggcagctaaggccaagccagcatcaagtaacatcccaatggccatcatatacatcgccaacatattctgtccaaaaacaaccaccagcaacaaaacaagataaaaaacaaagaaaaataaagctaaatgacgtgaacggcccatgaccatcacttcccttttacatgtgcatgcccattttggcgtaggattccataccgcccatccagagctggtccattggcacaccgcgctctttggacaaagcctgcatcatcgtgtccatatccattaatttataattaggctcagggttatcggcggtgtacgccaaaatctgcgccatcatgccaccatcctcgtgttcaataatatggcaatggtacatgtacagcccgggtagatcgaatttaacttttatccgcaccgtttcgccagggttaacgccgactgtgtccttataaccgtgttcattaggatacggttcgtgcccgttacgggagatcacgttgaactgggtgccgtgcatgtggaaaggatggaccataccgccattcatcgtgttggtattggtaatatcccaatattgaacgtcgccgactttttgccgcgcatcgatccgctgcatggcaaactttttgccatcgatcataacttgctcgtccatccccgacatcacaactttacggactggcaggccgggtgtaacggttggatcagtaatatcaactaaatgttctggtaattgcgtatcatcaggtgcaaattgatggatacggaaacgaactaacggcacatcatccgaatacaaagtgacttcggtacccggtttgtattggctaaaatcaacgatcacttcggcccgttccgcacaagtcagcattaatttagtcaacttaactggtgccggcatgatcccaccgtcagagccaatctgagtaaaggccaaatcatcactaaagtgcaaccgccattcacgccgattagcgccatccaagatgcgtaaccgcaggcgttgtgtggtgacatcaaagtaaggattgactgtgccattgatcaaggcagtcggtccttggacaccatcgggatcatagtcagcgcgataatcccactgattattttcgtgaaagcgccgatcttgcaagatcaacggaatatcgtcaacaccccaatgacgtggaaacggcaatttggcttcaacttcatccttgactaggaccattgccgctaaaccatgatagacttgagcggccgtttctggacagggatgggcgtgtaaccagactgtggccgcaggttgatcaagcgtaaagtcgatctggctgctttggccgggataaactggcgcgtgacagccaccatctacgtagggcccgatcacattgagaccatgccagtgaaaagtcgttagctccggcagttcatttttcaaagtgacgtgaatatgctttcctttttcaaaaacgattgtctgacctaaaacactattgttgtagccccaggttttcgtttttgcgccgggcagaaattgggtttcaccagtttgcgccgccacggtataatacgtatccgtggcggtttctttgtctggcttgagtagtggtggtacgttcaatggctgctgtggcacctttgcctcttctaatgggacatagccgccgtcatgagtattaaacgcggactcatcgaagaaataatcagtataaaccttatcagacatcacaatcgtcctttccaaacttattttgtattcactttcattataacactgcatctaaaacttaaaagtttggcaagccgaattacatgcgtatttattgagttaggcggtcagcccttgctacactgaccatatcatagaggaggttgctaaatgactgataacaaattaatcgctgtccttgtcactaacggtgttgaagatgtcgaactcactagcccacgtgaagcgctgagtaaggaaggctatcaattatgtttgatcggccaacgtgctggtgagattattcaaggtaaaaaaggcacaccctttttgatcgaacgcggcattgatgaagtacaaccacaagatttccgcgcactattcattcccggtggcttttcacctgatcagttacgcggcgatcaacgctttgttgattttaccaaagcttttctggaacaaaagcggcaaatttttgccatttgtcatggaccacagttatttatccaaactggtttggccgcacaattagaactcaccgcctacaaaaccgtccaaccagacttggcttacgccggcgcaacggtaaaaaatcagcccgttgttgttagtgaccatttgattaccagccgtaaccctaatgatttacccgccttcaatcaggcaatcgtttccgcattaactgaataacaaaaaaagcatccagcgactggatgcttttttgttaggctagtgttcaaaatctgagcactttttcaaacacacgctaggccataacgcctaaagtttgtaaaattagataaacgttcaagatgatcaagatgatcgcgatgatccaagcaatgtacttgacccaactgcggttcgcataatctcccatcaaatccttgttactcgtgaaaataactagtggaatgatggcaaatggtagcgcaacactcaagaatacctgagagaacgtcagtagattttcaattcgcgcttcgttgccatgatagtagatcgcaaaaatcaatactggcaaaactgaaagcaaacgggtcaacaaacgctgcgcccatagtggcatttttaaatgaatgaagccttccataatgatctggccggataaggtcccggtaatcgtcgaactttgccccgatgatagtaaggcaatggcgaacaagctacttagcaatggactcgcaatcgcgccgacaatatttttatcatttaaagcattaaataaatcgacgaaccgacctaagtcgctattagtcccaaagaacaatgccgcccctaagatcaacagtaaactgttcacaacaaaggctaacgttagctgaatattagagtcagcaacggtaaagcgaatcgctttggccaaactctttttatcagtccgatcgtacttccgcgtctgtgaaatggatgagcccaaatacaagttatgcggcataaccgttgcaccgacaatacctaatgacaagtacaacatacctttgttggtcatgatatcaatattaggtacataaccggcaaaaatctgcggaatgtctggccgtgcaagaattacttcataggtgaagacgatcaaaatgatcaccactaaaccggcaacaatggcttcaatcttgcgaaagcctaacttcatcaataataatagcaataaaacgtcaaatgcagtgatgatgatgccgacgatcagtggaaacccgaaaagtaatttcagcgcgatcccggaaccaatgatctcggccatatcggtggccatgattgctagctcggtgacgatccacaggaagatccccatacctttactcgtacgttcccgggtcaactgcgctaaatctttcccagtgacgatccctaaccgcgccgccatagcttgtagcaacatagcaatcaaactagagatcaagatcaccgttagcaaggtgtatttatattgtgccccaccggcgatcgaggtgatccagttacctggatccatgtatcctacggcaaccagcgtccctggcccagtgaaggctaacagcgtccgccaataaccggcgttctctggcacctcaacactaccgtttacttcatccaaactcttgttatcactatcagtggtatacaagaaatgtttcttctcccgcggcgatttcttcgttggttgttgactcatttcaagccctctcttccagttaatttttcaatgtagtgcagtaacatcaggcaataattaaggtgccgctgctactggataactgagttaattccgaattacagtgtaccgctttaccggtggatgtcaaacggatattaaaatttgatgccgaatcaatgatgctttcatgaaaatgccgtgattattttcatttgatcccagacccatatcaaatttagcacataatcagttgaatagatagtttcggaccttatcataagtccactacacattgtacactaaaatatgttaaagtaaataaaaagtttaggctaacttaactttttatatttaagcgttaaattaatcatcaaagtaacgcgtaaatgcgattattagactagattttttgaatcacttcgcgtacgctgagaacaaatagtttaaccctaaaaggagtgatctgatgcataatttagcaatattggcggtcatactaggtttactgggttttatcggcttcatttggcaagccttaaaattaccccgcgagcagcgctcattaaaaagtgtctttaatatctatggttcttggctgatcaatccaatcagttggttgtttatcgtgtcattagtcctaattttctacgtttattggaaccgttaaaatagtatgcatataaaaaaggctcgatccaacgcggatctgagcctttttaaccgcctttaacttgaacgataccgtagaataattctagtagatcacgtaaattctttgtgatcgatttaccgttttcccactgataatttggcgtttcagtcaaaacatcatcaggcaaagcctgactagtgatcactagatcagctggataagttaagccgtcaataaacttaagtgcaaagggactaaatgatttcaaacaattgatcacccgattatgaattgacggatcaaccgctaaccacaaacaaaccgttaattcttgtacttcgatgaatggtgctaaaatcaacgacagattcgtcgttaacaactgcacctgccgcgctggcaacaaaggtaaactcaggcggatcgcttgcttgatctcggcagtctgtttactcgccggtggtgtcatcaatgaccagatcacaaccggcagatcacaagtgatcacatagctgacacaagcattcaaataactgcctaacccagtgtaataatgtgttgacgaagtcaaattcagatcggcgatcaagcgctcactcaatccttcaatggtatgccaattcgcaacttttgctggcggccagaaataaggtgaatggcgcagaatttcatttagccaagtcaattcacgaaccaattccgactcggaaaagttcatctctgtggctaaattacttaaaacagtcgtttgtgtgatttcaattaattgaacgtaaccaattttgtcaatcataaagccatttaaaatacgccctaaggtgacttgaatataggccaactgcatcgcctgccggggtgattgcgccgtggccggtaaattaaaatatttactagcactcgacagccattgcttgatctctggcatcagctcagacacgtcttcagcgacatcagaaaaaagataccagtagaaaagcctgatctgccgctcatccccacgtaaacgaacatgactgagatcaaggcgaatatcgcgctgcgccaaaaaagtcttcaagtttttcagacgccgctgcaatgtggatcgactaatcgataagtcacttaagatctgatctaatgaagtcacatctgcctgataggtcgcatagataatttgataaggcactgattgtttgatcaataattgtctatacgcactcgcgctcattgaatagcgctgatcaggtggtgcatcagtcgtcagatcattaggtaacgatcgaaaagtacgataaaactcaacatagctcataccatcttgttccgccaatgcagctagatttaaatctccagcaatattagttgcacgaaacaccttaagctcgcgttgtttttgtggcgttaagaatacgttatccagcatcagtcagtaatcactcctttttaattaaatacggatcaagttggtagccaatattgacatcagaaaaaataatctattctattagccgacaataatcacttgtctacaattatacattactctactgaattttcacctcatgattgaccaaacaaatgtactttagtgataaaaatgcagaaaaacaagtggattttcccaacgttaacgaggtttatacgtaccaatatcaaatatacattatttttaaaaaaaatacaaaaagccattaaatcagcctataactgatttaatggtttaattgtttatgtggtgttgttttgactcgcgttttcttttgtttaccataatgaatcaataaagtgatcccaatcgcggcaatcaaaatagcgacaaaccaactagctgggatttcaatatcaatttgcggaatcgctaggaataattttaccgcaatgatggcgatcaaataataagccatcggttccaattcaggaatataccgtatcactttcagaatcagctgagcaaccccacgcatgactaaaataccgatcaaaccgccgatcagcacgataatcggcttacttgagaccgctaatgccgctagaaccgaatcaactgaaaaaatggcgtccataaaaacgatctgtataactgctagccataatttgctactaccacccgttttttgctgctgattgtgccgctggtaaaaaaagtgtactgacaaatataacagataaattgccccgacaactttgatccaccaaactttgatcagaaaagttcccagcccaatcatcaagaagcgcataacatatgaaccccatagcccataaatcaacgctttttccttttgccgcagcgtcggtaacttttgcgtttgtgccgctaaaacaactgcattatccaccgacaataaacactcgatcatgatcaatgaaaaaataatcgcccaatcagcccctgaggtcacgacattttcccaagcgtgcaggctaaaaaacggcccgtacagctcgactaaccagtgtaacatgtagaccctccctttgcttctgttctatagtgtagcatagtttttcagaaaacaaaggtgccagtatgaaaacttaactaaaaggccatttagtgtccatgcctaaagtttagcaaacactggataaaccgccatatcaagcaaatgcttatcaaaagcattgcgcgcctcttcagcagtatttagctgaccagtgaaaattggtcgttcagtatccaaggcaaaaatacggaacaaatattcatggtagcccgtattctgcactggggccacaccgcggaaacgatgcatcgttttttgttgctgcggtgcatctgctgcgatccgctttatgtccggtactaatggcataacggtccagtagctataaccagcatttaatggatgttcgtcagtaaagaacaaagccattgatttggtacctgccgggataccatcccattccaacgttggtaattgtgcctgcccaccaatgtccttcgccataaactgtttgggcaacacactaaaaggtgcaaactcacgcgcagcgatctggaaagtttcgttctccaaaccttcaaacaccaacagacgattttcatcaaaccactcataaatatgttgggtcaccaccgctacaaaaaaggtagttacgtagatttcctgattagtcccaaacggcgccgcgtccaaatggtaggtcaccccattcaaccgtaatgtctgtgttccaatggtaaaatcaaacaaattacctttgtaagtgccattaacattaaagccttgcatctgaatcggctgtttaatttctttgaataacgtttttagtggtacataaatttgtgaattcgacatgatgcccgttgccgatatttctagatcgtcgatcacgatttttaccggtaaattccactgatagtagctccgtagtcgtgcttcaattgcttcagccatgttggtcatcctattctacttattttgatccgaatttccggactagttttattataagcgaaagcgctgaagcttgactaccactgcgcgtgaatttaaggattttgtgagaaaataatatcgtcaaaatttagaaactcaattaatccagacaagctcacctttaagccccatttaagctcaccccattatgcttgctaatatcaattaaagggagctgatcaatcatgaaaaaacacgttatcttaggtgctattatcggattaagtttgttgggcagcatgccacactcacccgttcaagcagcggcggtcacaactagcagtatacccgtgatcacaacgaaccaattgactacaacgccgccaacacccagagtcaatccctacgtcggtctaacaacgaccaatgaagccatcgtttataccacccaaagcagcgcgacgagcgaaaccagcagccgcaccaaggtcatttaaaagaaggccttgctgaccacgatcacgaacactagtaaaatacacgacgcactgccggcagctaaaaaggctttgccgccgcgttggccgatcacacggaaattaacgctcatccctagcgccgccatcgccatgcctaaaaagaggtaggccaacttaactaaagcggccagtgttgccgcgcctaaaggcaaaaaggtaccgcaaatactagctaaaatgaagccgcccatgaaccacggaatcggtaatttatgcgcgccagccgccgtgtttaactgatttttgcgttggtaccagatgccgatgatcaaagccgctggcgccagcagtagtacccgcgataatttggtgatgatcgctgtatcgaggctgactggcccgccggcactaccagcagcgactgcgtgggcgatttcgtgtagtgagccgccggtcatcacgccaaattgttgcggcgtcatgtgcaatagcggctttaagcccaattcgatcagcgtgaaaaccgtccccaaaatagcgacgatcgccaccgccagtacttcatcctcccgcttttgctcggcttgggctggcgtagctggtaattgcggcgagatgcccatcaccgccgcggcaccacagatcccagtgccactggcagctaaaattgccaaacgttgcgacacgcctagcttgcgtgctaacttataagtgagcgtgatcgtgccactgaccacaaaaatcgctaacaaaatcgttttgacaccggcctgcgctaagtcgatcaaattcaatttaaaacctaacaaaatgatccctaaacgcaaaaacttattggaaataaagccaattcccgcctgtgcctgctgtaccaccggctgaaagacctgcaagatcatccctaaaactagcgctaacaccaacgcaccgatgacctgtaaatacggaaacccagctaaaaaactccctaacagtgaacaaaacaacgttaaagccaccgccaaataaaaacgacctgattttaataaacctaacacagttgaacgccccttccatagttatttaagcttagcagttatttgctataagaaaaaattagtaattattgtacgctaataagttaagcttataattaaatctggaggtgtttttttatgttagatcgaaaaatgacgactttcgcacgcttggcgcaaacaggctcctacacggccacggcgcagcaactttttgtgacccaaccggcggtgacccagcagatcaaagcgctggaaaatgaactgggactatcattggtcagctatgaacacgcccaattgacgatcacgccggccggccagcaattagccgactacatcaataaaattgaccacgaaagtcaaaaattattgacccaactacgcgcgccggtacaaccaatgatcaaactcggctgtacccgttccttaagtgcttttctactgactagtgttttacaacaattacaggaccaagggcaacagatccgctgccaaattgccaataccgataccattttaaaggctttgaccgccggcacgatcgattttggcttagtggaaggtaattttgataaaaataaatttgcttctatccgactacgccgtgaaccctttatcggcgtgacttttgcgaataatccattgcttaaacaaaaacagccacttaacctaaatgagttattaacacaaaccctgctagtgcgcgaacccggttctggcacacgggaaatttttgcaaactggcttaccatgcaaaacgcgcagatcacggatttcaaacaagtgatcgagatcgccacgccaacgccgatcatccaattattgactgctggctgcggaattagtttcatgtatcaatcactggtcaccgctgaattagccactggtcagctagtcaaattaccggtgcgcggttttgagttacagcacgagatcaacctagtttatccaaaagagagctattttacagcgcagtaccaggcaattgcggcgcaggtccattaatggtggactggctcattcgtcgctgcaggcaaacgacgatatttttccgccataatggcacggtaattagcgggaattgaagtccacgggataaacgataggcgcttaacgtacagtcctttatgttgaataagcacataatgcttatttggtggtgcttgaccgccttgaaatgataaccgcgtccctgcaccaaaaggactatcaacgacccaaatgtcagtatacgggtcgggcacctgcagttttgcggtacttttttgatactggttaccgccattttaggtgacctttgctggtaatgttgcgtaaccagttgtcaacgctaaaaacggattgaagcgatcgacccattgattgcggtattgatagacgttgaaaaaaatcaataaaccaaccatcgcgaccaccaacgtaattaaaatgcgctgataaactttctttacttttaaatcacgatcgattcttttaatagttggcgtgtcgccacgcaaaaactcgtctaacgagatttgaaaaagctcactaagttgcagcaataacgcaatatctggataactgcggccagtttcccagctagagatcgtcttgtccgatacattcaatttttccgccaacattttctgcgtccagcctttttgcaaccgatagctttttaactgttgttttaatcccacaaattcgctccccttttgttaaatcaaccataacctaaataaccctatttgccgctcttattctagtagaatcagcgctaggctttgtagatagcctatatttataaactacgccaaaatttagtgcacactttaatttaaaaataaaaattgcgttgctattaaaaagtgaccacctagcaactgctagttgatcactttaatttaactatccattgccacttcaagtgaaattaagcgcgctagaaagcgcgcttaattatcga

SEQ ID NO: 498 - DNA, 27636 bp, Unknown
  Metagenome-assembled genome
tttttcacattctaaaagcagaagtttatgatcaaaaacagttcgataccttggcggaattaacccaagccgtagcgaactggattcaatattataatttcacgagaatcaaaacaaaactgggtggtaagagcccggttaaataccgtgttcttaccacccagaaagttgcttaaagtttcgtccaatatttggggttcacttcattgggctgctttttttattcagcggaaaagatagtagtcaattatgtattggtagcgcataataagacgagaaatcaaagtgaaaagagtgaaaaagtgttacaagcaagaaaaacaaaagtgacttggtctgcggcacagtggcagcaatacgaaagtcgtggcgtgcagttggaccagtacgccgtttttgaaaacacggatcaaacagtagcttggtatggctttggtgcagtagcaacttatacccctagctcaccggcggcttttacagcggtggcggcatgggtaaagcaattgcggcagcaactagcaagtacggtgtctagccaggatattgccattctaggtggctttgctttttctacaccaggtgccacacagcataacggatggggcgcgctggctaatggttattttatgttgccgcgtttcttggtcaaacgttctggtgggcaaaccgagttgattgaattgtctgcagcagcttttgcctcggctgatcttttagctgattttgaacaatttttgccggctatagtgcaacctggggtcgaagtggacttactacaacaggttgaagatgccgcatcttggcagcaagctgtacagcaggtggttacacggctacaaactgacgcgtatttacaaaaagttgttttggcgcggactttaatggtgacggcagctcaaccgttcagtgtgacacaactactcttagcattacgtcaagtacatacacaggtctatcatttggtactcaaggttgctgatcaattgttcattagtgcgacaccggagcgtctagtagcagtgcaaggtcaacacttagccacagctgccgttgctggtacgaccgcgcggggagtagatgcagccaccgatgcggcgttaggggctgccttgctaaaggaccagaagaatcgtgctgagcaacagatcgtggtcacggcaattcagcagcggctacaaaatttgacaacggaattagtgttaccagcgcggccgcaattgttaaagagtcaacaggtgcagcatttgtatacaccgatcaccgccaaactacagccagcagctgatttatttacggcagtggcggcgttacatccaactccagcattaggtggtcagccagcagcattggcgttgccattgatccaacagttggaaccagaatatcgcggtttattcggtgcgccttttggctatgcaacattagccggtgacggtgaatttgcagtggcaattcgctcgatgctggtgcagcagcaacaagcgtttttatttgccggtgcgggaatcgtggctgcttcaaaaccggctgctgaggttcgcgaaactactttgaagtttcagccgatgctacaactattgcgaggtgttgatcatgcaaaatgaaacattaacgttaaatacgcaccgtttgatcagtgggttgatcgcgcagggggtccaccaatttgtgatttcacctggctcgcggtcaacaccagtagcactattgattgcggagcgggtacagcagcagccagcgctacggctttttgttgatgtagatgaacgttcggcggccttttttgcgctgggtatggccaaaacgcagcaagttccggtggctctagtttgtacttcgggcactgcagctgccgaatatttaccagctttagccgaggcgcgtttattacatattccgttgatcgttttgaccactgatcggccgctggaattaactaatattggtgcaccgcaggcaatcgatcaaactgaactatatgggaagcaagtcaaacaatcacagcggcttgaactacaacagccgggaacgactaacgcggacttcattgcgtttcaaagtcagcgcagcgtattgacagcaatggctttgccccgtggtccgattcagcttaacttaccactacgcaaaccgttgttaccagacttaggcgttacgccgccgcaaatcaaaacagtgacagtaccccaagcaacggtgaccttagcgccgactgctttgactgaactggcaggtcagctacaaggtaagcgtgtcttattgattgctggtccagaagaagactccgcttaccgagcaaccttgttagcattaagtcaaaaatgtcattggccacttttggcagatagtttagctaatctacggggacgcggtgcggtgatcagtaactttgatctgctttttcaagcgcgaaccacattgccggctgccttacaaccggatgtgatcattcggtttggtagcacgcccgtttcagcgccattgatgacgtggctggagcaacaaacggtgccgttttatttggttggggcacaacggcaaatggctgactatagtcgggccaccacccatgttttggcagcagatgagcagctgctattggcggaacttttggcggtgatgccagcccaagatgcaacctatttagctaattggcagcaatatgcgcagcgactgcagaccaagctaactgtgccaactgagttaaatgaagtgacgagcgtgcaggtgttggattgtttattgccagcaactagtcgcctatttatcagcaatagtatgccgattcgcgatgtggaagatttttattctggtcaggcggtacgtgagctttactgtaatcgcggtgctaatggtattgatggtgtagtttcgacggccgcgggtatggcgactttaggtggcgccaattatttattgatcggtgatctagccctattccatgatatgaatggtttgatgatgttacgccgctatcaattaccattgacaattgtggtaatcaataataacggtggcggtattttctcattcttaccacaggcagctgcaactgattattttgaagatctatttggtacgccacaagcacttgatctggcgcaagttgcagctctatatcagcgctcgtaccaaaaagtcactacactggtcgaatttgaacaagcgctgcagatgcaggtgcaatttattgaagtgatttcgcaacgcgcagataatttacaattacatcggcgtttggttagttgcttgaaacaggagttgagcggtgatgattaaacgcacatgcaatattcggggtcaaatttatcgattgacgacttggggacagccgcaagcacaagcatggttatttttacatgggtttatgggcagcgcggctgattttgcccccattgctgcggaactaaacggttatcgcatctgcttggatttaatcggttttggaccacaagcaccaactgtgcctgcacgacgcttaagtatggttgcacagataaccgatctaaccttaatattagctgaattaggcgtgacgcaggtcaaattagttggctactcaatgggcggccgtttagcgctgggttttaccttagcacagccacaattggttcctcatttgtacttagaaagtagtacggctggtctagccgatcggcagcagcgtgaacagcggcaacgccatgaccatgaattggcggttcagctccgtactactggattgccagcttttgtggccgtatgggaacaactaccgttatttgctagtcaacggcaaatgccgccgatacagcaacaccggatgcggcaacagcgcttacaacaaaacccggaaaatttagcggcttcgctggaacaaatgggtactggtagtcaacctaacttttggtcacagcttccgcaaatgacgacaccgacaaccttgatcgtcggtggccgggatcaaaagttttatcagattgggcagcggttgcgaaaattgataccaaaagccaagttagtggtattgactgatgctggacacaatactcattttgaagtgccggaacaatttattaacctgctaaaggacggttgctaatgcaaataacccaaatacaattacaacagatcagcctgccgttacagacgccatttgttaccgctcatggcacgaccaaattacggatcacaacgttagtcaccgtttatttggacaacggtcatagtggtgtgggcgagctcaccgcctttacggatagccgttatttaccggaaacccaagctagtgcgtggacggttttgcagcacgaaattgcgccgttattgcgtggctttgagtttacacggccaagcgaactggcgacctatttacagcagcaattacgtggcaaccaacttgcttgtgccgcggtggaaacggcagtgtgggcagcatatgcaaagcgacaacagcagccgttagctcaactgcttggcggtaacgtgcggccaattccagttggtattagcttaggtcattttgcgacaacgactaaattattagcccgggtcacggttagtgtggctgctggttatcagcgggtcaagttaaaattgacaggaccggctgatgtggcccaagttgcggctgttcgggcaagatatccacaattaacgctgatggttgatgccaattcggcgttcacgcctgctgatttgccagcactacagcagctggatcaacttgatttggctttgatcgaacagccattggctaacgatgactttgttcaacacgcgtggttgcagcaacagttacatactgctatttgtttagatgaaaatattttaacgttggctgatgctcaaacagcggtggccttgaaaagctgtcgcgcgatcaacttaaaaattacccgtgtcggtggattaacgactgcattggccattgttgctttttgtcagcagcagcaaatacaagtttggtgcggcggtatgttggcgagcggtgttagccgggcctttgatttggctttggctagtcgtatagaatttacgctaccaggtgatatttcggccagcgcgcgttattttaaacaagatgttttgcagcaaccattagaattacggcatggttgcctacaactagccgctacaccaggcttaggcgtcacggttgatcagcaagtggtacaacagcatttgcttaaagaaaaatggttacggctataaaaaagaacgcaaatcaatgcgttcttttttgcatatattgatgccaataataaagtggtaatccaatagcagtcaatcctaggccggtaaaagcaaggctcggctgtgttaaaaaggtggctactaaaatgaatagaccaccggctaaagctaacaatgggataactgggtagccgggtactttgtatggtcgcaccatctctggttcgcgccggcgtaaaataaaaacagcgataaaaatcaagcaactgaagatccaaatcacgaataccagcatatcagtcaataaatcaaaactgccaagtaacatcataatgatcgccactgctaattcaaataatccggccaggtagggaaccttggtgtgtgtggttaagcgccgtaaatattgactgaacggtaattgattttcgtaagccaaggcaaaggggatgcgcatacccgttagcgtgtagccgttgatcgcaccgtaaacagaaatcaaaatgccaatcgtcactaatttaccgcctaaattaccaaatatctgaaaggccgcatcagccgccgcattaagattaccttgcaaagcggtcagtggtaaagtccggagaaaaacaaaattaatcaccacatagatcaatgtgatcaaggctaaaccaagtacaatcgctaacggtaggtcgcgctttggccgttttaattcaccagcaatactaccaacgttgagccaaccatcataggcaaacattgtagccaacaagctactacctaaggcggtccagaaattatgttccggtgctgctgtcaatggtaacaacgaaaaatggactggagctgggactagtaagccgaaaataacgatcaaggcgatcggaatcaatttgaaaatcaaagtcacgacttgcagcgccccgccaacacgcgcaccaagaaaattgatcagcgtcagactgacggcacatagaatcgctagtggaatcagtaatccagcggttaaatgaaataaattgatcaactgcgtgctaaaaacgattgaaagtgccgcaacattggctggaaaatagatcagcatttgtgcccaacctaataaaaatgcccacggtttgccataagtgtattcaatatatttgattgctccgccagtttggggtatggcagtggctaattcagcaaccgttaagccggcacaaattgttaggagaccgccgagcagccaaacaaataaagtgagattagctgtgcctgcttcagtggtgacactggcaactttgaagaagacaccaccgccgatcactgtgcccattaccgttgctaaggctgaagctaagcccatctcgcgttttaagccattttgttccattaataaaaatcctcactaaaatagaataatcggattatagcatggctttctgaaaattcagtgaaagttgcttagaaatcaaagcgaaaaaagaagtaccacaacgtcagtagacttaattgtctagtgatgctgtggtacttcagaaggactattttttatcgacggcgtggccaccaaattgattacgtaaagctgcaactactttacctgtgtaggtatcatcttctagtgaacggtaacgattcattaagcttgccgcaataactggtgtgggtacctgcaagcggatggcttcttctaatgtccatttaccttcaccggaggagtacattttaccttgtaaatgtttcaagcctggatcttccttgaaggccgctgcagccaattccataagccaactgcggatcactgagccgtggttccacatatcggcaaccgcagcatgatcatatttgtattcactgtgttccaacacgtcaaaaccttcagcaattgcctgcatcatgccgtattcgataccattatggatcatttttaaatagtggccgctaccgactgcaccggtataaagataaccagcaggcgccgcgattgactgaaaaataggttcgatcgttttgaataagtcttgatcgccaccgatcataaagttaccaccatttaatgcgccggccataccgccagaggttccaacatcgaagaagttaatgcctttggtagccagtaattcgctatgcgcgatcgagtcgcgataaaaagaattgccgccatcgatgacaatatcgccagcggataactgctggcttaattcagtaatcacactttgggtgattttacccgccggcaccattacccaaatgatccgtagtgttgctaattgtgcaattaattcggttgtatctgaagccggctgcgcaccaactttagcggcttgtgcccgcgcggtttcatctaaatcatacgcaatgacttggtggtcgtggttttgcagattagtcaccaaatttaagcccatcttacctaaaccgatcatccctagtttcatgttgcgtccttctttcgtaaaagttatcgactgcagtatacgaaaatatttttctaaaatcaagtgcattttaatgaaaatatttttccaacagtttcatttatgttatactaaatctaatgaaaaagtctactgtatagcatttgcttgaaaaattttcttgcggtcgtagtaagaatattggggcaaagaagcgccttgtatgacttatttgctaatttaagtagcggtagcgcggaggtgaaccggatgaatgagatcagtcagcgggtacagcaatttgcggctgagctatccagtgcagaaaagaaacttgcgacatttttgcagcagtcacaaaatctacctgatcatttaacgattagcagtttagcccaggctagtaaagtttccacagcgacagtttcgcgctttgctaaaagtttgggttacgcaaattttgcggcattacgggtggcattgatcagtgaagtccaacgaaatggggcattgtttgaggaagtggaggctaatgacgacgcgttgaccgtggcccataaggtctttgctgctaaccaacattcattgagtagcacactagcgttactggatcaaagtgatctggagcaagcggtcaaattactgactgcggcgcgcaaagtgagtttctttggtctcggtggctcgaatgttgtagctgcggatgcttatcataaattcatgcggacaccactagatgtgaattttaatactgattttcatttgcaattaatgcaggcagcacggctacaagcacaagattgtgcggtggtgatttcgcacacgggtcgggatgagcaagtgttgcaattggttcaccagttacaagcacatcaggtacccttgatcgtactcaccagttttgctaaatcaccactggcgcagaaaagtacggtcacatttatttctatggctgatgagtctaagtatcgttctgaggcactgtcttcaatgttggcacagatcagtatcatggataccttatttttactagtcagcttggctttaccagcaaaaacgcaggtcaccttcaaccaaattcgccaagtgattgggcagacgcggcgcggcaaataaaaaagtcgcacctgagtcagcgcgactgtgaacaatttaatgtttattttgttgaattgggtaagtacggtgatccgcttcgtcatagatctcaaatggacgttcgtaggcggctgtaatctgtaattcataaccgtactgatcaagaaataatagttgatgggctgttaaagtcgtgacggtaccggctaatggatgatcatcgatactgatggctaattgtggtgaaattttaagttggtggtggcgggcttgtttgatatcataaaaaagccatgtacccacatagatcgctgtggggtcatttttttgtgccgctttagcgggtaacttaaatttgaattgttgaagccgctgcagcaagctttggctacggtcaaaaacatttctaaacattcgcctagcaccttcttagtgattagcccaagtgactaattttcactcgatttttagaccgctttccggcggcatgcaacgcccagctgagtagttattttattaatttcataataacacgtttaggtgctttgtggctgaaaagacagtgaatattgttgtgatttttgtgcacattcaaatcagcgcatgtttatcgctttttaggcgtaactaaggtaaaattaagccagaaagtaacgcagacaatgtggcagtaataatggcaaattgagtagtaagtctattcagatgaggaaaggtgaggttatgttaaaacttggtattattggcacgaatttcattacggatcaatttattgaggcagcgttggctaccggcaactatcaattgacaaccgtttattcacgtagtcaagaaaaagcccaagcagtagcagataaatatcaggctagcgaaacgtttactgatatcgatcgctttttcgctgaaggtgcatttgaagtggtttatattgcgtcaccgaatagcttgcattttcaacaggctaagttggcaatcgctgccgacaagcatgtgatcgttgaaaagccggccttttccaatccaaccgaaatggcgaatattacggcattattgtccaataagccacatttattcttgtttgaagctgcgcggcacatccacgaacctaattttaaggttgtgcaaacggccattaaacaattggataaattgcaaggggcagtactgacttatatgaaatactcatcccgctacgataaatttttagcaggtgaagaacccaatatcttctcgccaagcttttctggcggcgcattgcaggacctaggcgtttatgtgatttatgatgcgattgcttggtttggtgtgccggaagcgacacactactatgcaagcttattaccaaatgggattgatggtcgtggaacggctgttttacggtacgccgactttgacctaacgttaatggtgggtaaaaatgcaacttcttatttaccatcagaaatctacggtttgaaggaaacgttggaactaggtaataacgcagctgacttacaatcagttaaattgcaccgcggcgctgaaactaaagtattgagcaccccaccagaaactaacccaatgatcgcggaagcacaagatttttaccggatcatcaccgaaaatgatcgtgcagcagctgcggaaaatgcgcaacttagtcgtcaggtcaaccaactattgtatgatttacgccgttcagcaggaatcgtatttgctgcggatatagaggagcagaaaaaataatggtcagcaaaatttttgaaccagtttggcaagaactaggctttgatgcaccaaccgcaattcaaaatgcggtctacgaacctttgaaaaccgatgattccatcttgggcttggcaccaactggctctgggaaaaccttagcttttgctttacctttgatggaaaaaattgtgccaggggatggcttacaactattgatcttagcaccagctcaggaattagccatgcaggagcgtaccgcaattcaaccatttgcccaagctgcaggtttgaagatccaagcggttgctggcggagcgaatattcgccgccaaattgaacgtttgaaacaaaaaccagaagttctggtggcgacgccaggacggttattggaacttatcgatcagcgcaaagttaaaatgcataaattgcaaacaatcgtgatcgacgaagctgacaaactgttgacggatgaaagtcgagaaatgacgcgtgatgttgttcgccgagcgccaggagaaacgcaactggcgttcttttctgcgacgaaaattccggtgctggatgaactgccaaaatggttcggcgtaccggtaaccctttttgatgttcgtgctgaagacaatagtgctggcgaggttcaacatttatttttggaagcgccaattcgtaagcgggtcgacttgttacggcggctaagccatatcgatgatttttacggcttggtcttctttgctactttagctgaactggaaaaagtggctaaagttttacaacatcagcatgtacccgttgcaattttagacagtgatctacggcaaacagagcgggaaaaggccctaactggattgcgcaaacggcagatcaaattattgctaacaactgacgtttctggacgtggattagatattgcagctttgccagcggtggtcaattatgatctgccgattgatttgatcacttatatccatcgagcagggcgtactggccggatgggccacgccgggatggtggttacgttaggtaatgagcgccaattccgtgatctcaaacagttagtgcgcagtcgctatcaggttgcgcaaggctatttataccaaggaacactgaccacaactaagccagcgcatgaacaacatccgctgaagaagaaaaagccggcgccaatggcagctaaaccagtaacaccggttaagccaaagaagaaaaagcaacggcaacgtaaccgattaaataaaggtaaacgaagaaagacgaacgaaggcgacaaaaatgattgagcataatgttgctgaagtcatgaccatcatgactagtagtacgcaggcgcatagtttgttggaggcggcgttaacggcagctaaaactaatgattttgtattggcacggcataagctgcaagctgctgatgacgcgctgaccggagcgcacaatgcacagacaactttattgacgcgggaagcgcgcgggcagacggtaccgatgacgttactgttgatccacgcgcaagatcatttaatgagtacggtcacgtatcgggatgcggttagcgaaatgatcacgctgtatcaaaaaattgcgggtcttttagcagaaaaaacgtctgattaattttaatttggctgtgagtagcgtatactaacaagcagaaaatagcattattaatacggacttttttgatggtgaccgtaagttttacgcggagaagtataatgttgggttgctacgtaatgtttttgtggccaacaaaatgatgattgtccgtaacatcagagattttttggtacaaaaaataaccacgtttgtggggtagaaccatgtttcttgcggtacggtctttgccacaagaatggctatcgcccgtaacatcagagattttttggtacaaaaaataaccacgtttgtggagtagaggtgatcgtaaatgagaattgaacagttattgaacgttcctgccgcattcttgtatcatcaaattattgatgcggaactttttgaaattcacgcgcacactggtcgccagctaactgctgctcagttagagggctttacttatcaaaaacaattagatgatgcaacgcgggctcaggtaacgatcaccaaaaatgtgctgaatcgtagctatcattatcaaatggtgactgagttcaatcgttacgaagttaagtatgatatgttaccgatcgaaactgataaaagtaagatcgtttacgaagaaaaagtcattgcgcgcgcttggcaacagcggctgcttgattttgtcagtaatacgttacttggcggtttgcggcggcataactttagaaaaatgtttcaacaaattgaaaagtcatattagtgcaaaaaagtccgccagtttcctggtggactttttttgcttaaagcttgatcattgggtgttcgccacgatgattgcaaatcttttttgattcacgaatatgtgtccgattgtacccagcaatgtataatgcgatcaaggcgatcgtaataaaagctgccataatttcacttccctacatgtatatggcgcttcgggcaaaacaactaaaaagggtgttagattacctttttaggtttatttggtcggaaaagactagcatagtactttgccaacttgctcaaatattcatactagaataacataatttagcggatttgtaaccctttttgcctaaactacggttacaaagggagttcagtatttacaagaacccaaaatcatgaaataatagatcacatggccccttagctcagcaggatagagcaatcgcctcctaagcgataggtcaccggttcgattccagtaggggtcatagtcgcaataagcagatcaattgaagcgcttgacttggttagatattcagtctaatcagtttcggtagctttacgttgatctgcttatttttattcccatttatatagtggaccaccgttcagcttgcgttcgttgatttcttctaacgctaacggaagggatcgtggttgtggccgttggatactatcggcaaaatttttcggccatttgcggagacgccggccgaaacttttctttgcaggtttagtcactaatacaacctccttacagtataagccgaaaagcaaatcaaattattatttgtgcttgcggtctaacttttctttggcgtcttcaaacgatgcttcagccgtgtctttagcatccgcaacttttttctttgctttgcctagtaagtcttgcgctttacctttagtttcctgctttttgtcaccggtagctttaccagcagctttgtttaatttaccttctgcctgtgttttagcgctatctaaacgttcttctttagtcattgaaattcctccttgtaattgagttatattacttataattagtataacttcaacccaaatatgaaggcaaaataaatgcagcgcaaaatttacgctgcaaagtagtgacgttttttaatattgatctaacaatcccggtacccaattaccattgcggaaaatggggattagtcggtcatctttggtgtaggcatcaatggccatgtcaggtgcgccaaccatgaaatagacgtgtaattgacttgtattgagcgcggctgctttcaattgagcatcgatcatactagtaccgtctttgattgagaagggataggcgctaccaaaggctaagtgattagcggcgttttcgtcaaaaagagtattatagaaaattagccctgaacgtgcgattggtgttgcttctggtaccaatgccagttcacctaaatgctgtgctccggcatcggtggctaataaatgatctaaggcagattgtccatgatcggcatgagctgcagtgatcctaccgttagtgaatgtgaagaccataccatcgatgatcgtgccagcataacttaaaggcttggtcgccgtaacggtaccgtcaacgcgataacgatctggtgcggtgaaaatctcttcagttggcatattcggcataaatgtttgcccgtgactattttcagaggttgcaccgctccaattataatttttgggaagaccaattgtgaggtcggttttggcagaatagtaatgtaatcgatcaaggggtaattgatttagttttgttgcgtaggctttcagttcagcagcgtgttgttgccaagcagcgataggatcaggttgatcgatccgtgtgatcttgaagatcaattgccataattttgtcaccgcgacattgggcggcaaatcaggaaaaacgtggtgtgcccaatccacccctgcggcagcaactaccgtccagctaaagcgattggcttgtaaagcttgcattagcggctgtttgatctgtgcttgagtttgctgtaagcagcaattcgttcggctggtaggccacttaaattactgggatcggccgacataacgacgattcgtgttgctgctttgtctaaccaatcattaacttgtgcggtggcaacctgatcgacagttgtcatccgttcagtggctgcatgagcgataaaagcttgttgtgtcgcagtatcttgccagtttacgatcacctcagcggcgccacgttgataagccgcagtggtaatcaaatgggcaagttcactttgttcaacttcgatttgtaacatcaccgtttggccaggctggacattaccgccgactgcgacgatcagttcggcgtactgctgtaattgttgtttaaaatgagacatagttagttcctccgtttcacaactcagaaatagggatcatttgacgttaatacgcttcgtcctgaatattcacttgttatctaaaatgttatcaatgcatagctgcaagtatagtgtcgttcgactacttaagccggaaaacttcaaatcgtgttcgttaaaaattcataagcttttgttattgtaaggataatcaaaatattaggggcgtgcgtcatggttagaaaaaagcagattacacgagaaagaattttaacaggtgcttatcaattagtggttgctcaaggctttactcattttactgcgcgaaatgtggcgcacgcaattcattgttcaacccaacccctatatcaagaattcggttcaatggcaaacttaaaacaggcaattttgttaaagctacaacattacttagtgaacgaagtgtacaaccgccaagttactggcaatcggatgctggatatggcactggactatattaaatttgctcaagataatcctgaattgtatcatgcgattttcgttgaggatcattttggaaccaatgcgatgcatgattttacttactgttatggtcaacgattgctggcacattataaaccagctaaacaactgtccgccgccgctagtgaaaatgtcatcactgggatgtggatcattgcccagggaattgcttcgttggtatcatctagtttcattacgatcagtgagaagcaagccatcaatttattgcgtgctgcgctatatgacttcatccacaataatcgtttggaagatggtcagatcacagtcaattcattacaacaattagatcaactaaccaaaatatgaaaaaagggttgccggcagttgccaacaactcttttcagattacatatctgctgctttttctgctaagcttttagcaaaagcttctaagtgttcaatgtcgtcttcttcggcttcgagatcgactttaacgatatcggcaccttttgttgcaccagttttttcgaaagcagctgcgaaatcatcaaccgatttgccaaagctgtcatcgtagaaggtatcgccggaaccacagacaccataaaccttaccgctaagatcttcatcttgtagatcttcataaaaatcaacggcttcatcaggtaattcgccgtcaccatatgtatatgttgcgacaatacagatatcaacgtctgcgaagtcttcggtatcagcttgtgaaatttcactaacgtcaacatcgacgcctaaattttccaaagcctcagaaacaatatcggcaatttcttcattattgccggtcatacttgcataaataatttttgcactagccatctgatcgctcctttaactcattgttttcgattaacaaaatccggcgagcgcctgttatttaaggttgttcgtctatttatttgtttggttcgattcagattgattatagcaaagattctgatagatgaaaatgttcccgcgtgaattagttctgttaggaaccattctgctttcgtgctaaaataggaaggacgctattttttagcgcgattttttagtgaaggcgaggcaacgattggctatgaaaaaagcgcagcgaccgattccaatgagtcggcggcaacgcggcgggcgcttcatttatttactgatggcacaattaaaaacgtcaggaatcaatgatgcagctgtagtggtggctttttgggagttactatcgctgtttccgttaattatttttgcgggtaacgtggtcccattattacacattgatggtcaaaatatacttgattatgcaatcactgcagtaccaccaacgattgccaaacagattttaccgattgcagaacactttatgcctaaaagtggtagtaataatagcttgttatcaattggggcgatcgggacttggtgggctggtagccgcggtatcaacgcgttaaaacggatgatggatcgtacttatggtgtattaggacaacaaaacccaattttgttgcggatgatctcgctgtttatgacggttttattggcgattgctttagttgcgatcgtggtcgttttcagctttggtcaacaggtgttggattggatcacaccgctattaaatattcctgatacgttgtcgagttggttcagtacattaaaatggccggtaacgtcagcggcagtttttttgatgttggtattgatctactatgtattgccgaatgttaaattacgtttacgtagcgttctgccaggagcttttttgacgacttttggttggttgctattatcacaattattttcgttatatgtgcgatactttgctcaaacggtgctcagttacggaacagtcggtttctttattgttttgttgctgtggttggatttttccgcctggatcatgatgtttggtgcgatgatcaacgtcgttgtgcagtacaccttttttggcgaaattggtcgcaataaaggccggatgcaacatattcattcgccgaaaaaggatgaagctgccgataaagcacaaaatacggtataataagtgagaagaacaacctgattcaaaaaattaagctttgatcaaggaggagtattttcataatgaaggttcgtaaagcaattattccagccgcaggactggggacacgtttgttgccagcaacgaaagcgatggctaaagaaatgttgccgatcgtcgatgtgccaacgattcaatttttagtcgaggaagctaaggcagccgggatcgaggatatcttgatcatcaccggtaaaggcaagcgaccaattgaagatcattttgactcagtgcctgaattggaaatggttttgaagaatcggcataaggataagttattgaaattagttgaaagtaccaccgatatcggggtacggttattctttattcggcaatcttatcctaaaggtctcggcgatgcagttcgtttggctcaggacttcgttgccgacgaaccatttgtggttatgcttggcgatgacattacacaatccaaggtcccattgactaagcagttgatgaacgattatgataaaacccacgcttccacgttagcggttattaaagtgccgcatgatgaagtttctaagtatggggtcattaagcccgttgcggaaacggaaaaagggttatacaacgttcaaagttttgttgaaaaacctaaaccagagcaagcacctagcgatttagctatcatcgggcgttacttgtttacaccggaaatttttgatagcttaaatattcaaaaaccggatgctggcggtgaaattcagctgaccgatgccattgatcatatgaataaaacccaacgcgtatttgcccgtgaatttaccggcaaacgttatgatacagggaacaagctgggctacttaacgactaatattgaatttggtctgcaacatcccgagatcaaagacgaattgcgcgattacattattaaattagggcataagttaagccaaaaatagtaggtaataaaataaacgttcaggtgatcagaagtgatccttgaaagtttattattttacttgaattttaccgcagttccataagcagcaatggtttccataccgtcagtgatcgagtcggagtcaaaacgcatcatgaccacggcatcagcgcctaaagcaactgcattttcacggagccgctcaattgctacatcacgcgcttccgtcaataaatcagtgtaagcgtggatctcgccaccagcgagactctttaagccagcaccaatattgcgagcaatgtttttagattgcgtggttaagccaaacacttcgctaatgatttcatattcatgcccaggaatgtgctcagtggtggtgactaaaattttatcggccataaaatcacctcctaaggaaatttaagtttcaacctaagtttatcattgtaagcgatttaacgatagatatttcttttttctaaccggactacggcttcgacgcgtgccgtttgtggaaacatgtcgatcgattgaatatagtcaacggcatagacttcactaagacggactaaatcgcgggctaaagttgacggattacaactgatatagacaaatttttgtgggcgactatcaagtattgcgtgcaacaaagcttgatctaagccagtccggggtggatcaacgactaaagcatcaggtgcaaaacccgcggccaaccactgtggtaataattcctcagccttaccgacttcgtatttagcattatcgatgtgatttaagttagcattttcctgggcatcggcaattgctgccggcacaatgtccataccgcggacttcgctagcggtatccgccagtgacaaaccaatcgtaccaacaccacaataagcatccactaagctttcgtggggagctaattgtaatgcttcgcgtgctagagcatacatcttagctgtttgggcaggattgagctggaaaaaagcacgggcagataatttaaaagtcaggccggacagtgtttccgtaatataatcatcgccggcaagattgaaggtttcttcaccccagatcagcgaagttcgtccttgattcagattttgcataatcgacgtgatctgtggcattttggtgtgaatgcggctcagcaactcacgtttatgtggtaatttacgtgaattggtgatgaaagtgagttgcaggtgcccagtactaaatgattcgcggacgactaaggttttgacgataccagaattttgttcttcattgtagatcggtacctttaattcttctaacaatgccactacataccgaataacttgcatcgtggctggccgttgcgtgctaaaagttttcaaatcgactaattgatggctatgttcttgatataaaccggcggcaacatgaccgtttagttcacgtacctggaactgagccttatcacgatattcatatggctcagccataccgatcgttgggcgtagcttgtaatgttgataaccgcgtggcttgaatttttccagcgattggcgaataacatcgactttaaaggctaattgagcagggtagcttaaatgttctagctcgataccaccaacatgaccatagtaatcagcgtcacgaggctcaactcgctgtggactttttttacgtagtgtatgaattttagcgttaacgtatttgggtgccgtggcagtgacttcggctacaatgacttcatcaggtaaagcgccttttacgaagacaatcgtccgcttgtaatagccgattccttcaccgttgatgccgagccgtttgattgtcaaaggaaaacgctggccaacttgaatgtcatgaaaataagtaatttctggcatatttgcctcctagatagatttaaataaagtttttcgttaaatttgctgttttagtataacatagctcaattggagtacaagcaacgcgaacaaacatttgcatctactattaggcttgatataatgaaaatagcttaatggagagtgtgacgtaagacgcccagctactacgccacagtagtggttgattttcgtaccgaaaataaaaccgccaagttgaaacatggcacacgttttaactatattgttcggaagtgcaaagaagacgtcggccataaattaattatgacacaacgtcctaattatgtaggtaaggaggcggtacgtgatgccaacaattacaaaaattacgacgcagaaacgtaaaggacgctacaatatttaccttgatgaggaatatgcttttccagtcagtgaaagtgtgctgattaagtttcgcttaactaaaggcatggaagtgcctgcggaattgcgcgctgagatcgataccgctgaggctcatgcacaagcctatcagttagcactaaattatttgtcgtatcaattgcgtacagagatggaagtgcgtatctacctaaaacaacacgatattccagtggcggtacggcaacaagtcattcaacgcttgtatgaactaaatctcttggatgatgccggatatgcggctagttatgtgcgcaccgcgatgcgcaccagtgataagggcccccaagtgattcgaaccaaattacgcgaaaaaggggtcaaaccagaattgatcactaatgctttggatttatttactactaatgatctactggctaacgggttgaaattagctgaaaaattagctaaacgctatcggcaacaaagttttcagaatcggcaacagaaaattcgactaggtctacggcaaaaaggatttgatgctgatgtgactaatcaaattattagtcagctagaattagttcgggatgacgatacagaatggacagcactagttgaacaaggtgaaaaagtttggcggaaaacagcacgctacagtggctatgaacggaaacaaaaggctaagcagcaactttatcgtaaaggatttgcattggatcaaattgatcactttttaactgaaaagcaagctgaaacagaataatcgagcgcgtttactgaaaatctaggaataaagtttcgtcatttgcagtaaactttgatataatgttcatgataattcggtgttatcaacttcaacgtaatgaacgtcagaaagtaggttagcgcatgcgtattccgaaagaaggggaatcggtcgcgatccaaagttataaacatgacggaagtttacaccggacgtggcgtgacacgatgattttaaaaacatcggagaacgagataattggtgttaatgatcatactttggtaacggagtcagatggacggcgatggctaacgcgggaaccggcaattatatttttccaccaacattattggtttaatgtcattgccatgatccgtgataacggggtttcttattattgtaatctggcctcgccgtttgtattagaccgtgaagcactgaagtatattgattatgacctggatgtcaaagtttttccggatggcgaaagaaaattattggatgtcgatgaatatgaagccaatagcaaacgttggcattactccaatgcgacagacaagattttgaaggctaatgtcaatatcttggtcgattggtctgatcaccataagggacctttctcgcaagaatatattgatatttggtatcaacgttacctggaacttgcccaccggtaagcggaagtcaattggatctatgcacaataaaaaacgactaagacgatttttgtcttagtcgtttttttgcgctggttgttgaacaaagcgaacatataaagcactgatcgccagggtaaatagtagccggccaataaagtaagttaaggtgatctgaccattgagcgcgagtccgttaagcagcgcgcataccagtagaccaacgattccgctccagaaaaaccagcgactaaaatgagttaagtataaaagtagggcaaagcctaaattaacaaccatcagtggcacagaaagttcacccataataccgctggtaagcgcgccgatcaacatactgagcgcgtataaatagattaaaatttgagtcatcaaccgcatggttactggctcctttcattttgcttgagcggatggctaatcaagttttttttgcatttcatgatgggggataccagcgtctaaaaagccaggtcgtgcggttcgactgaagcctaatcgttcgtaaaaacctaatgcatgatcttgtccacctaaagtcagtgttaaacgatcgtgttggcgggcataatcttctaacgcggcaaataattcacgcccataatcgtgaccgcggtgctcgcgtaaaatagccacgcgttgaacgtgatagccgccagcttcaggtaataaacgggctgtagcgactggttgctgcccaatgtaaccgacaaaatgaatcgttttgtcttcattttcaatttctaaatcgatcggcacgtgctgctcttgtacaaaaacagttttgcggatcgcaagtgcgtcgtgataaatcggactatttaaatcagtagtttggcgaatttccataagtacgctccctattttaaaataagtattggttttgctgactaaactagcagcgtagattcgaacgacaacttcagacggctgtgcaggcttaaataatcgctgtacgctgttggttgtgtactaagtttggtagaatgattataacattatctacaaaaactggcggcgctaatttattgattttggatgaagtctagcgttagctaccggttaaactttacgtggttttaacactcacgctaaccattgattaacccaaatttaaatttaatggataaggagctttgctgatgtttgaacagattcgtcattcacggctgatgttttggtcactagaattgttgatcgtggcgactttaattttcatgtgtacaaagatcggcttcattttttcaccgattggcacatttattgccaccttatttgtaccgatcctgatctcgggatttttattttatctatttaatccactggtcaagttgttaggccatctgaaaatttctcgtaattgggcaattttgatcgtattcgtcattttctttggcggtttggctttgatcatctgggcggtgatccctaacttggtcaatcaaatcacccagttactgagtaatttaccaacggttgcgaaagatatggaacatctagctaaaagcttgatgaagaacccgcttttaaaaaaggtggatctggaaaaagcaatcaccgatatgaacctttcgtttagcagtatcatgcaatctctgttaaaatatttcaccagtagcatcggttcagttgtcgggacggtgactagtgttgcggtgactgcaatcacaattccggtgatgctgttttatatgttgaaggatggacatcgcttgattcctaatgtgcagcggctacttccggcaaagtatcgagctgaagctactgatctgttgttaaaaatgggcgacacgatctcctcgtatatcgccggtcaactgattgaatgtttgtttgttggcgtctttacttttcttggttacctattggtcgggatgccttatagtttcttacttggttttattgccggtttgtgcaatattatgccgtatgttggtccgtattttggcattgcacccgcattgatcattgcggtgacggtttcgccgatgatggtgattttagttgtggtgatcgtcgtcgttgttcagcagatcgatggtaactttgtttaccccaatgtgatcgggcgcacgctgtcgatccatccgctgacgatcattgtattgttgctagtagctggtaatattgctggcttgctgggaatgatattagccattccgttttacgccatcgtcaaaaccgtcgtgcaatatttctggggaatttaccaattgcgtgaacaagtcaaaattgcggaagtgtcaccgaaaagtcatgatcagttataagtaataattaacgagggaaaattgaaaaataccgggtttcatgctaagatttgacaatagatgaagtgatcggagtggatgtgtcgatgagttctgacccggatagtcatatatggggacagttgatcgtattaattgtttgtttagttttaagtttgttgtttgcaacgttagcatttttaatgactaacgtatcaacacagcgcttagacgaggaagcaaaaacgggtgataataaagctgcccgtgttttaaaattactgcaacgacaggcgactgttttggtggcattacgcagttttacggtgggcaccgaattgattgccagtgtgacgctttttaacttagttcgcacttggttgccaataacgggaacgggtatggtcgttgtgtggctcgtcatttttgtgttcgctattttgctattattggtgattgccaatttattaccgcagcaaattgcgttacacaatcctgagcaactagctaaacgctatagtggcatcattttaagcttgcaacgtattttacagccgtggtcgtggttgctattattcattacgcggggattggcacgtttgctgggcttaccatttcataatgaggtcaagcgtgagttaagccgtgaagaaatgattgaaatgatcgagcacggttctaaatctggtgcgatcgaagccgacgaatttcaaatgtttgaaggcattatcgatatgcaggataaaatggcgcgtgaggtgatggtgccacggacggatgcctttatgttaaatattgaggatgacgatgcggctaatatcaagcaaatcttggagcaaaattattcacggattccgatctatcgtagtgataaggataaagtgattggtgtcgtccacatcaagaagttattgcagcgggcccaccaagtcggttttgctaatgtcaaaatcgctgacgtgatgcaagaaccattgtttgttccagaaaccatcatgatcgaccgtttactttatgaatttaagaaaacacaaaatcaattgagtattttacgtgatgaatacggtggtttagtcggtttagtttcaatcgaggatctattggaagagatcgttggtgagattgatgatgaaactgatgaagccgaagttttgtaccgacagattgatccacggcattatgtcgttaaaggaaatatgccgttagatgattttaatgagttatttgctactgaaattgatagtccagatgtggatacgattgctggttataccttagctgaattaggcactattcctgatcttggtgagcagttaactttaaaattaacgaatggcattgaattacaaactggggcagttgaaggttcacgtttacttgaggtgttggtgactttacctgaagataagccggctacccccgcaaaagcagaagagtgaaacaactagaattcgagtcgctgactcgaattttttatggaaggaaacgattatggataaaaaagaattaacaacggcggttgaccggcggcggacttttgcaattatctcccatcctgatgctggtaaaacgacgatcacggagcagttattgctttttggtggcgtcattcgtaaggcgggtacggtcaagggtaaaaaatcaggacaattcgctaaatctgattggatggagatcgaaaagcaacgtgggatctcggtaaccagttcagtcttgcaatttgattatcaaggtaaacggatcaatattttggatacgcctgggcatgaggatttctctgaagatacgtatcggactttgatggccgtcgattctgcggtgatggtaattgatgcggctaagggaatcgaaccacagacaaagaagttatttaaagtttgtcggatgcgcggtattccaattttcacttttatgaataaattagatcgtgatggtcgtgaacctatggatctgatcgatgaattagaagaattattggatatcgaggcatttccaatgaattggccaatcggtatgggaaaaggccttgaaggtttatacgatattcataaacaacgtgttgagttataccatgaagacgcaaacggacagcgttacttaccagtcgatgaagacggtcagattgttggtgaacatccgttgaagaaggaatcgatttatcagcaagcgttggagaacgttcagttattactggaagccggtaataaatttgatgcagataaagtcgcccgtggggaacaaacaccagtcttctttggttccgcattaaccaactttggggtcaaaacatttctggaaagctacttagagtatgcgccagcaccagcggcacataaaacacaagcaggtgacatggtggcaccaactgcggataacttctccggttttgtttttaagattcaggcgaatatgaatcctaatcaccgtgatcggattgcttttattcgaatctgttccggtgaatttgatcgcggcatggatgtgacgttacagcggacccagcgtaaattacgtttggccaattcaacggagtttatggcggatagccgtgaaagtgttgaaacggcagtggcaggcgatattgttggtctatatgatacggggaacttccagattggcgatacgatctataccggtaagcaaaatatccagtttgaaaacttacctcaatttacgccggaattattcgttaaggttaccgccaagaacgtgatgaagcagaagtcgttccacaaaggaatggagcaattggttcaagaaggtgccgtgcaactttaccggacctatacgaccaatgattatgtactaggtgccgtcggccaattgcaatttgaagtcttccaatttcggatgaaaaatgaatataattcggatgttgtgatggaaccgatgggtgaaaaaattgcccgttggatcgatcctgagcaattagacgagaaaatgtcctcgtcacggaaccttttggtacgtgatcgtagtggggcaccattgttcttgtttgaaaatcaatttgctgagcgctggttcaaacagaagtatcccgatattaaattaacggaaaaactgtctacggatactgtcggggcataataaaaaatcgtagccttgcgataatccctttgtggttgttagatgaaatacaataattcatctgatgattatggagggatttttgtatgtccagatctaagttcacagttctcgagaagctcaatttaattgaagattatcagcagtcggggctccctagggctact

SEQ ID NO: 499 - DNA, 7402 bp, Unknown
  Metagenome-assembled genome
gacatcatggtaaatcgcgccataaaaaaggttatgaggaacgtcgcgggaagattcctatatcgcatacactccaagaacgacctgagtctgccaataagcggactcagattggccactgggagctcgatactgtagctggcaaaactggcagatcttgtgtggtcacaatggttgaccgttgttcaagatacttaataatgcacaaagcagctaagaaaaactcagccagtgtgaccactactattcgaagactactaaaagatctgccaccagaacacttgggtacgattacgcccgaccgtggcaaggaattcgctaaacatcatcaactaactgaagaatttggtattgagttttactttccaaatcctcatgccccgtggcaacgtgggtcaaatgaaaatacaaatggcttaatccgcgagtacctgcctaaaaatcaagatatggatccaatttcggataccgtcattttagaattcgttgatcgggtgaataaaaggccacggaaatgtttaaattggaaaacaccatatgagatctatcataatcaaaaattgcacttaatttgacaattcaaggcgcataaataaaatagacctacgtccttttaattcattattctgtactagtagctgcctgctgcctttttttctacaatactcattaaataacggcttaaactggtgtctgttggctttttaccgtatgcttaaataaaagcatgtttggaggaagtcggatggcgccaattgttgagatcgaacacctgaccaaaaaattcggatcgcgtgtagtggtagatgatgtttcctttgtagtacaaccagggacaattttaggattattgggaccaaatggggctggtaagtctacggttatcaatatgattgtgggtttgttacggaaaaccgccggtgaagtcaggttgttcggtcaagtagcggaaggcaaccaggaattgcgaaaaaggattggtatggtcccgcaagaattggcattgtattatgatttaagtgcggaagaaaatgttcgctatttcggtggcttatatggcttgcgcggtaaagctttgaaaagtgctactgaagatgcgcttaagttagttggtttgtgggaacgtaaaaaggataagccggcaaccttttctggcggtatgcagcgccgcttgaatattgcaatgggaattgtgcaccaaccggagtttgtgatcatggatgaaccaacggtaggcattgatccacagtcacgtaattatattatggaaacaattgagcaaatgcgtcgggacggtaaaactttgatctacaccagtcactatatggaagaagtggaacgattagccgatacaatcgtgatcattgatcagggtaaagtcattgcaactggtactgagccggaattagttaatttagtgacggcacaaaaaaatattctgatcaccgttgcaaacccgcaagccgtgatactggctgatattaagcagcagcctggggtgatcaaagcgagcttgactgcgacgcagctgttgatcacagtcacagtggaaagtaatgatctgaatcaattattgctgaccttgatccagcagagtgtggtcgtcaacagtgtcgatcagcaacagatcgacctagaaacggtctttttaaatctgactggccgcaatttgcgcgataagtaggtgaaaatatgaatctacccatcatcattcgtacgtttgtacagcaattacgtgataaaggcacatacatttattttttacttttcccactgaccttgatgctggttttagggtcgattttgcaaggggtttttgctggttcaacagttgaagaaaaggttgaaccaattacggtccagtatgtggttgaagatcaagcgttaggaggacagttcaaaatggctgtccgcgagctttcatcaactaaaatcaagtttaatcaaagcgcggatcgtgctagtgcggtgcgagcgctgcgtgctgggaaagcggatgcctattttaatattggtgataagattgttgtgcgcaccaaccaactatccgatgtacaattgacgctgttgaaaagttatttagtggaaatgttccaatcgattcgattaatggctggcgcgcaacgttttaatgtgccaccggcggaattatttacattaccagcagagttaaatgatgcgttgaaagtagatcaaacgaatctaaagaagccagcgacttcgtatcaatattatgcggtcgcgatgattgcgctgtttattttatatatggcagaaaatggtctggaaatgtttagtaaaggtcggcgccagaaaacgttgcagcgcgaattgatcagtccgcttggccggcaaaaattgatcaattccacttttgctggtcatgcgctattaggtttttgcgtggtgttggtccagatgctgatcacacaagtgttgtttaaagttccgtggcagcagcagttcggttttgcctttataagtttatcagctttgatgttgttattcctgacactgggggttttcttagagacgatcggtaaaggggtgggcatgggtattatgcagattatcatccaagtagcggcatttttaggtggtggttattttccagttagtgaaacaatgatgaacttttcaccgctgggctggatcatgggcccgctgcgggaggcattgtggactaataatcctttacagtggcgtggcgtattcttgtgcttgttgatcacggttattttgtattgtggcatgtcgctagtgctgaaccgcagggaggaattctaaatgaaagctattctatggatcatccgtgagcgcttcgtcatttggcggcatcatccattgcaggtgctttttctgcttggcgtgccggtgctaagtattgtgatgtacttatttatttacaataatagtggtgcggccaacacgttaacgatgggaatcgttgatcgtgatcagtcggcgtatagtcagcaatttgttgctaatttcgataaacgtatgactgtaaaaaaaatgaccagtgttaaggcagctgataaagcactagctgatcaggagattaccgctaatattgtaattccggaagattttgccacaaaaattcgggccggcgaattggcacctttgaccttacgcagttttcaacaaggtgaagcaatcgatggcattaaggatacggcaaaaaatacgtataatgaagttttagcggtagcaaaatttgcgcgcaatagtaatgaaaaagtagcgttcgactatgttaaaactacgacgccactagaatttaaacggtttgcgacggatgatgcgagcaaagcgatgagtattcaaattttaggctttatgctgatgatgttactgtatcagtccggtaattttggcgctaattcaattcaaaatgagcgccgtaacaaaatttatcagcgtatgctgacgacaccggtaccgcggggtgcttattttgctggtaccgcgatatttgcttttttagcgatgctatttgaagtaatctttacagtggttctgatgacagtagtgtttcacatcgacattggtttagcagcacttcagcttagtggcttgttagccagttttgggttggtcggtgtagcctggtcaattgcgatcggtgtaaattcgcctagcacattagttgccagtgggatacaaaatattttatttacgatcacatcgttactatctggcgccttgatccccagtgaaataatgccagaatttatgactaaaattgctcgcctgacgccacaattttgggtattggatgccattcgccaattacaagcgcgggctgattttaccgtaattctactcaatttagcagtactagctgcttttggattacttttctttggaatcgcgatctacgggctaatgagcaaacagaaaattggcgtttttgactaattaaatggccctaaaaagacagatatgtttgtctttttagggccatttttttatatgtagtgcacgttaaattagatatttttaatcctaaatgactttacaaaactatagaatcctgtataattattaatgttgttatggcccgttggtcaagtggttaagacaccgccctttcacggcggtaacatgggttcaaatcccgtacgggtcatggttcaatgccgtcttagctcagttggtagagcatcggtatcgtaaaccgagggtcacaggttcgactcctgcagacggcataaaattttcaaaaaccgacaataacattgttattgtcggtttttttagtgtaagccgaataacggtaaagcattttgacactatggtataaattaatttgagtataaatattgtgcaagccgacaattacttcttgattgtcggcttttttagtatagctactaatactgttttatttttatcggtataccgtatcaataaatacgatttttaatataatttgtttggcatacctaaaaaagtattcaaattatctaatttgtgttgtataatggtgttggccaaatgaatcgatggccagaaaggtgtgtagtagtatgggaaaaaacgaaacaacaccgcgtaagcataaactgattcaatacgcgaatgggccttcattagaggagatcaatggctcggtcgaggtgcctaaaggcaaagggtttctgcgaactttgtttatgtattctgggccgggggcgttggtggcagttggttatatggatcccgggaattggtcgacgtcgatcactggtgggcaaaattttcagtacttattgatgtctgttatcttgatgtcaagtttgatcgcgatgttactgcaatacatggcggctaaacttggcatcgtgagtcagatggatcttgctcaggcgattcgtgcgcgtaccagtaaagccttgggaatcgtgctctggttactgacagaattggcgatcatggcgaccgatattgccgaggtcattggcgctgcaatcgccttgtacttactttttcacattccgttagtgatcgccgtttttgtcacagttttagatgttttgttattgctattattgaccaaaattggttttcgcaaaattgaagcgatcgtggtttgcttgattttagttattttactggtattcgtttatcaagtagcgttatcgcatcccgactggggcggggtttttgctggcttgttgccgcgagcagaaactttttctagtgcaactaagatcggtgggcagacacctttgactggggctttaggtattattggtgctacggtgatgccacataatttgtacttgcattcggcaatttcgcagacgcggcagattgatcacgatgatgaagatgatgtggcacggacagttcgatttgctagctgggactccaatattcagttgaccgctgccttcttcgtcaatgcactattattgatcatgggcgttgcggtattcaaaactggcgcagtgaaagatccgtcattcttcggtttattccaagctttgtcagatacgtcaacgttgagtaatggtttattgatcagcgtggcgcggtcaggtgttttatcaacactgtttgcggtcgctttgttagcttctggacaaaactcaacgattactggaacgctaactggtcaggtaattatggaaggcttcgtgcatatgcggatgccgttatggttacggcggttagtgacgcgtttgatttcagtgatcccagttttgatctgtgtcatgatgaccagtggtaagagtgcgatcgatgagcatactgccttgaatacattgatgaataattcgcaggtcttccttgcttttgcattaccattttcaatgttgccgctgttgatgatgaccgatagtgctgtggaaatgggtcagcgatttaagaatacgttgtgggtcaaagtgttgggctggatctcggtgattggcctgacttatctcaacttgatcggcctgcctggtcagatcgaaggattcttcggcgccaatgccagtaaggcgcagttgctgctagccgataatattgcttatttattgatcgcggcagtattggccttgttgacgtggactgtttttgacctataccgcggcaacaaaaaatacgccgccaaaatggcgcttagtaccaattagtgatttagctgtacgattttcgttaaaaattattgtttagtgaggaggacaagcaaatgaaattttcgcgaattttagttggcgtggatgattcacaggacgcattgttggcctttaaatatgcggtcgatcaagcgaaacaagatcaggctgaattgatcatcgtttcaattttggaaaacgaggaaatgaatgtttacgaggccttaagcaaggattatgttcatggtgagcgcgctgaattggaacaacacgtgtcgagttatcaacggcaggcgcgggaagccggcgttgaaatggtccgtacaatcgtttctgaaggtgagcccggcgaggtgatcgtcaaggacattattccccacgttgagccggatttattggtcgtcggttccgaggcaaaaaaaggtttggcccaacattttggtagtcaggccgcttacatggctaaatacgcgccgatctcggtgttggtgatccggtgaataaaaggcggtgctaaatttagcgccgtctttttggtcgcaataagatcagcctaacaaaactggggtccaaaaaaagacgccatctttgatcagtactttgagttgcggttgtaattttgcgcgtaagttttgtggtacgatcgcttcaatgatcagtggggcgttgtgatggccgacttttggccgccagacaacttggtcttggccgtagccagcgctggcctgactgacggttgcccacttgatctgttgttgctgtagcaggcggagtaattggtcaacgttatcggcaccgagaaaatggcgggtgcgcctagtgaaaattttcagtaaataagctggggccgtggcggcgctatccacaatggtaaattgaccgtggtcaccgactaattggtggatcggctgctgtagttgttgggcaactggtgcggtaacgacgctttctagtgtcatggtggcattatcggtggcggtgccgtcgaattcatcgtcatgtaagtgggcttgctgatccaagctgatattactttgctgaatggtaaagccaacattgtagcgctggaaaagttgacttaaactttgtaatagattttgtttttgcgctgtttgatcataggcaccacaagtgatgcgaataagctgttcggccatacgcgatccctcctaaaaaaataggtactgtcaaacgtacccgattttgtctagttttaattattgtttctaatggttttgtattatctaagtgaaattaaaaaacacccggaccaattcttctgttatccttggtgtgcaaccaacaag

SEQ ID NO: 500 - DNA, 10857 bp, Unknown
  Metagenome-assembled genome
caatttttaaatggcttatcgattcaaacttcggcgctgatcacgctgagcatgagcaatagttgaaggttaatttttaggctgtaaagcttggtggactaagggattactcgaattggaactttcacgacttagctgctatgaaaaaacaggttggtacccagaaaaatgggtccaacctgttttatttttggcgcttgattttagttaacgcccacgagatgatcagaacaaaaataatggcaccagcaatggctggtaatagtgctaaatctgcgatctgcgggccccaattgccaaataacgtttcgccgagccaggcaccgatcagcccagcaataatattgccgagccagcctaacggtagatcacggctagtaatcgcacctgctaacgcaccgatcactgcgccaacgatcaatagccaaattaaatgaaacacagacacacctcctcaattagtcttgccgttaccgcgatgatcatgcttatggtaaaagctggacaatattctaatttcagcatacggggttcaacagttgacccgcaataaatatgcatacatttcataattagaaacgtatgcatattatttgtttttacatatagctgctggaataattaaagtaatcatcctacatgaagggaggtcacacccatgccggaattgattaaaattgcttccaccgccaatcatacgtttgtgacacctctgatgaccttatacgtctctattttagaacataatccagcggtcgatttcgagtttttcatcatcgatgatgcactacaaccaatcgattatcgctatttaaataccctgtgccaatactatcctaattgccgacgcatcaactttttacgtgttgatccagctggttacgccagggccgctaccagtcaccgcatcattcaatccgcctattatcgtattgacttaccagaaactttacgtaatcatgaacgactgctttaccttgattgtgatatgatctgtcgcggtaaattattgccattatggcaccaaaacctgcacggccgcattcttggtgccgtagaagatgccggttacgttgaagcgcgcttagataaaatgcagatcccccatcaggaaaaatgctacttcaattctggtttgatgttgattgatgtagcacaatggcgccggcataaagtttcgcaacgagtcaaagcatttatcgctgcccacgccgattaattacgctaccacgatcaagatgcgttaaatgctattttagccgatcactggctacgattgcacccgaaatataatgctcaatcacgcttactttggcgtgagcagcaacatcgtgaacctgctgaagaacaacgcaacgaagccgctcgccaagcaccagtattgctccattattcgggttaccgtaaaccctggaatgctactgaccatcatccggcagcggcgactttcaacgcgtatcagccattggtccagcaattaaaacttaaaactagtgaaccaacaccatttaaaatgaatagcagaacacaaaaataaagactgcgataaccgcagtctttattttagtttaacgctaatttttcaattgcctgggccacaccgtcatgatcattatccgttgtaatatgctgagctgccgtcttaatgctgtcaatcgcattacccatagccacaccggtgccagcgtattcgatcatgcttagatcgttgccctgatcaccgatcgccatcacattagctgccgttaaccccaattgctcagccaacttagccagcgcattccctttattcacgttcttgcgcgtcacttctaggaaaaatggtgcgctacgcataaagttgaatcgttgcgtaaacggcgcaaacaacgtcttttgcgctaaagctgcggtgatcaactctggctgatcaataaacatccctttcggcatcggcacatcacgcatttcctctggcgtccggtaagagacaggaataccaaccaaactagattcataaatcgtatattcgccaatatcccgattagccgtataaagccgctcattattttcaatttgaaaatgtagttctaaacgtcgtgctaaggcttctaattcaatataatcagcgtagtccaacgcctcttcggtcaacacattgcccgccgttgtcgcgaccgaagcgccattgaaggtgagcacatactccgttgcttgattatccaaacctagctgttgcaaataagctgtgacgccgatcaacggccgaccagtgcttaagacaactttgattccttgcgcagttgctgccttgatggctttgatcgttgccggtgccaattcattttgtgaagtcagtaaagttttatcaatatcgatggcaataatttttatcacgattatgctcctattccgcatttaaggccgaggttgtgacataagtcgtttatgcccaactctttttttgcacttccgaacaatatagttaaaacgtgttcacggtctacagaaagctggtctcattccacatttccttggtgaaatggctaccgtcattgctacttaactgggtcacactagtattgtccagcaccccgtggcgccgaatctcacttagcggcacacccaacacacgttgcaataacgtcatcagcaaaaccccatgactagcgatcagcacattgccttgaggattttcctgaaaaatttgcagtaacgcccgccgcccacgctgctctaagtcggtataactttccgcatgcacaaccgttgcatcgaaaagctccggctgtttgaaatagtactggcattgctgctcctgctgatgatccgctaaaacatcaccatcccaatcacctaaattgatctcgcgtaagtcagctaaaatcgttgtcggtacctgtggcgcttggttgaccgccaagacattttctagagttgcctgcgcccgctgtagcggcgacgtataagcgtgggtaaacttaatattctgtaaaaaacgcccggctcgccgcgcaccagcaattccgaccgtcgccaatggtgtatcaataccgctgccgcaaaaacggtgctgctgatttaacggcgttacaccatggcggatgaaataaaattcagtcactcagtccacctccacaatagttatcattgtttaaatagtatcattgggactgctaggctgcaaatacaaaaaaagccgtcatagcgacgacttttacaatatcggcgacaacaaccgcgaaaaacgttgtttgatcgtcagccaataagattgttgctcaatttcttttttcgttaataaccgacaatcaaccatatcagtggtgaaaatccgcgcaagttgtttagccactttaatatcgtacatgaaagcattgacttcaaaattcaatttatagctgcggaaatcttgattggctgaaccaacactggaaatcttaccgtccatgactgctgttttggcgtgcaaaaagcctttttcgtaaatgtagatcttcacaccggcagcaaataagatctgggcatagtactgggttgcccgataaataaatggatgatctggcatgtgtggaatcatgatgcgcacatcgatccctgattgcgccgcgattgtcagtgctgacagcacactttcatctggtaccaggtatggtgactgtagccaaatactcttcttggccattgaaatcattttaatgtaaccagccttgatttgttcacggtccgaagttggccccgaagtgacgatctgcaaggccgtgctggcatttttcggttgcagcggcttaggaaaataatccaattgatagcgcacatgtcggtcagcttggaccgaaacattccaatccatgatgaagcgcgtttgtagtgctaaaactgcattaccgatgatccgtaaatgagtatcgcgccagtaaccaaattttggcatccgcccaagatattgatcaccgacgttaaagccaccggtatagccgatcttaccatcgatcaccacaattttacggtgacagtgataattcaagcgcgttttggtgatcgaactatgcgaagtgataaacgtcgctgcttgaccacctaattgttccaaacgacggaaccatttcttggtcgtaccgtgggaaccgaacgcatcatacaacacgcgcacctctacaccttgtgcagccttttcttccagtatacctaacagttgctggccaatctgatcgctgtagatcgtgtagtattcaatatgtacactgtgtttagcttggtgaatatcctcaaataatgcggcaaactttttatcgccatcagtaaaaatttcgacctgattacgcttagtcagcggtgcattatcagttttctcaaacaagcgcaccatactactggcattggcagtcactttttccgacaatggtgttttaaattcaacatcgtcatgctgctgcatggcgatcatttcttccaaaccagttcgatcttgatgttcgatcgtgaataatttttcacgacccattccgcgacctaagaaaatatacagtaagaagccgacgatcggtaataacaccaaaaccagtagccatgcccaagttgaagaaatatcacgatgttggcgaaaaaccgttacgatcgccaaaaacgcattcaaagtgacgacgacgtccacaatgatttgtacccaactcatctaatccatcccttcgtcgttgtgtttcgatgttcttcattatacgcttcttaggctaaaaaccgaatcatttaccccaaacctagcttcactcgcggcagcgcacttgctctaaagtgctataattaatagttattagattgattattaaaatgaaaggaaatcaaaatatggcacagcagaactccagccaacaagtggtggatgccaacggtcaaccgtataatcggttattgttagtggcaaccctgctcgttggtactttttcgacttttattatgcaaacgatcctcaccactgcatttccaactttgatgcggtatttcaatatcactgccgacaccgtacagtggctgaccactggcttcatgttggtcatggggatcatgatccctgtctccgcgtggttacttagccgcttcaattctaaatatctttatttaaccgcaatgggtttgttttggatcggtactttcgtttgttacatggccaatagcttcggcgtcttacttgccggtcgtttgatcgaagccatgggtgttggtatttcagcgccagtttttcaaacgatcatgttatcgatttttccaccacaaaaacgcggtaccgccatgggtttagccggcattgttatcggtttagcccctgctatcgggccgacattatctggatggatcttacttaattattcctggcggatgctatttttggttatcttgccggtcaacggcgccgtttttattctggccttattcacgatgcacaaagttttaccaactgcaaaaactgccattgatgttttatccgtcattgtctcaacgattggttttggtagtttactttatgccttttcttcagttgggtcgtccagttggggtaacccgaaagtcttgattccactagtcatcggcttggtgttcgtcgccttatttgttcggcgacaactgcacatggacaagcccttattggaattacgggtcttcggtgtcaaagctttctcgctatccgcaattttaaccgccgtcgcttacatggcaatgatgggtgctgaaatggttttacccttatacattcagacgatccgcggcgaatccgcttttcattctggcttgattttactgccgggagcggtgatgatggggatcatgagcccgatcactgggcggatttttgaccgtattggtgccaaacgcttgtcgatcaccggtatggtcctattgacagtcggtaccgcctttttcgtgacgatgaccgctaaaacaccaattatctacattaccgttttatatacgatgcggatgttcgggatcactatggttaccatgccggtaacaactaccgggatgaatgcactaccgttaaatttaattggtcatgggactgccgttaacaacactactcgccaagtcgctgcttcaatggggacagcgattttgatcagtgttttgactaacgtcactaacgctcaatcaccagctaaatccttgttaaaacaagcgccgttagcttatcagcaacatatgatcaatgcaactttgtccggctatcatgcagcttttgtcgtctccttgcttttctgtgcagtcggtttagtactcaccttcatgttacccaatgctaatcatcaaaaggaggcgcgctaatgatcattgtcattttgacgctcgctatttttgttttcagcggtagtatgatttttatgcgtcgtggcttgcgtcgccagctagtcaacgtttttagtttactcgtgatcgtcgccagcatcggcctgatcattgccaacgacaatcaccactttggcatggagaaagtcagccatacacaaacgtacacgttgcaaagtagtgtggcgacccctggtgttcagctattgctttaccacaagctgggtactggcaacgaacgaatctatctttaccgaacgacgcatagtactaagttactaaaaactgcgactcataacagtcaggtaactgtaaaacagaatgcgcaacgcgcgcaactccagctacgtacaacacgctgggtttaccagaataaactgatgacggcactttttggtattactaacgaaaatcaccaattagctaatcgccattatcaatttaatttaccggcaacttggcatgtgatcagtacgaacactgcacaaaataagtaataaaaatggagttgaacataagtcatttatgttcaactccatttttttatactctcttttaattattcaatttaaaatgattttaagccgagcacttcgcccaacttttgcccagcggcaacccgggtctttaattgatccatatcaaaaataatgccagtgatttcgtgatccaagaaatcaaagcgttcataataaatatatggggcttcgtcggcagcgtggaaagcgtcactgatttgcgtagtaaactgcttagcccagtcatcatcctgcaacttagcaaaatccttacgcgtaacgtaccctttttctttgatcaacttaactgcctgatcaactaacgccgaatcaatttttgctaccttttctgctacatttgctgctgccataatttatcgcttcctattttattacattatacccagaattgggtggcaagcccattactgtatgcctttagtatagttctttttgcggaggatgtggctatcgttgctcgattaattatggcataatgaagtcaataacgatgaaacgcaaagtaggtggcctcatgcaaatacccgggaaaaagcggcgcttgccattaccgcgaattttgacgcttggctttttagtcctcatcttaattggtggactattattaatgctgccgctggcaactcggtctggacacacaacaccgtttatcgacgctatttttacggccacatctgcgacttgtattaccggtctaactaccgttaacaccgcagcgcattggtctttatttggtcaaagtgtgattttagcgctgatcgaaatcggtggcttggggttcatgacattcagcgttctgccttttgtcttattaaaacgacgggttgatctgaccacgcgcttattgatcaaggaatcattgaattttgaaaaattagccgacgttagtagcgtgatgaaatacgttattggcttgtcgttggcgattcaaagcttgggtgcagccctattatttattgatttttatccgcgttatggtttcagtcgcggattattcatgagtgttttccattcagcatcagctttttgtaacgctggctttgatttattcggcaatagcttagagagccggcctaacgatgtttatttgctcttagtgatcagtgctttagtgatcgccgggggactaggttttttggtttggcgcgatctgttgttattcaatcgtcgtaaacgtttgtcgctgcacactaaactagccctaagtaccactggcgttttattagccggcggcttcgtctttttcctattgaccgaagataacctggccgtgctggcaccccatgtttctaccggtaatcgtttgatcaatactttctttcttgcggtcacgccccgcaccgctgggctgacaaccattccttacagtgaaatctcgatcgctggtattttgttgacaatcgtcttaatgttcatcggcggaacacctggttctacggccggtgggatcaaaaccaccacgctaggattactgaccttacaaacttgggcggtactgcgcggtaatcgcgatgtggaatttggtcatcgtcgttttagcgaccaaaatattctccgtgctttaatgttagttttcatcagtttaacttcagtaatcgtagcgggggtcatattgactgctacagaaacgattcccacgcgttacggcctagaatacgtgatctttgaggtgatctcagcctttagtactgccggcatgaccatgggcttaacgccgcatttgaccgtgatcggcaaattgatcattatgctgttaatgttcctcggccgggtcggtatttacaccgtgatgtttaccgtcctcaacgccagtcatccccgaaaagggtatcgttacccagctgaaaatgtgatgctcggttaatttgcacgcaaaggagaccacgtaataatgaaacaaaattttgcagtgatcggtttgggccgttttggcactagtatttgtcgggtattagccgcggagcaacaagaagtcttagctatcgatattaatgaagaccgcgttaacgacttagccgacgtcgcaacggaagccatcgttgccgatgcccaagatgaagagacattacgttcactggagatcggtaaatttgatcatgtgatcgtggcgattggtaaaaatattcaagccaatattttagttacactgatcgtcaaagaactaggtgtccccgatatcaccgctaaagccgaaaacgatactcatgcgcgcgttttgacgcgaatcggtgctgaccaagtggtccaccctgaacgcgatatgggtgagcgcgtggcccatcatttattatcaccaaacatccttaattacttagcaatcaatgatgatgtcaccatggccgaagttaagatcaccagttccgcttttgtgggcaaaagtctgaccgagctgaatttccaccagcgcttcggcttaactgtgatcgccatccaacacggtgacaatgtgaccgtttcaccagccggtactgacgttgtgcagttgaacgatgagatttctgtggtcggtccgacccgggccgttgaagaattaaatgatcgaatgagttcccgctaaacgacgcaatcaagacacaaccttttcattaaatttttcgttaactactatattaactagattctataatgctacaatagggctctaaaaaagatcgaggcgtgaataatgtgcagataacgaaaaaattaaaattgatctggttactgctactgttagttgcagtcgttgccatacaaccgcaacacaccacgtcggcggtccaacattatcaccgaccgaccttattgattcatggtctcgctgctggcagcgccacctatgaccattttgtcgcccgcgctgaacgaactgatcgtggtcaatacgcgctgaccgccagaatcacaccacaaaataaagttcatcttttaggtcattgggatcccaacgaccctcatcctttgatcaaagtcgtttttatcgacaatatggcctcgtggcagcgtaatgcaatgtggctgaatcacttattacacgtactcaaaaacaaatataacattcgttcttttgatgcggtggctcattctcggggcaacttagacttgttaatggcttacggccagcagcatctcttgaaattaaaacgcgcggtacttgtctcagtgccggcaaacggtgcgctgggccgcggcgatgaactaggtgctaatcgtattttaaaggatggtcaacctaaattagagcgtccagcttaccatgatcttgtccagctgcgacccacctttccacctggcgttcatgtattgaacatcatgggtaatgatggcaatggcacgcacagcgatggccgcgtcaccaacgtttctagtcgttcattaaaacctgcattaggcatgcggctagcttcctaccataaccttgtcgttcatggtcgttttgctactcaccatacgatcattcgtcgcaacgccaaagcacagcgtgctgccatgaatttcttatggcattagttaaagcacaccacactaaccaaaaaagagcggcacaaccattgactggctgtgccgctctttttaacgtttatttagcactgactaacttcattttaccaaagctaatcacagctttgttctgtaagtcttggatattcatgctatcagttttggcatcgtaatcggtaatattaactaacgctgaattttcgtaaactttctcgatcacaccggagaagtccgcttccatattgccgttagccttgcaacgtacagtattgcctacttgaatgtccatctcgattcctccatctcatgcagctgataatatagcgcatatattaccgcgtctatagaaggaatgcaagcaaaatatatagcaaatcaccaagtttttacttacccgaattgtcaaatcaagtgcaacacttgctaaacttcacttataagtggtctaggtggtggtcatgcgagtagctgctcagccatgaattcattggctgatttataaccaaatagtttacgtggc

SEQ ID NO: 501 - DNA, 43606 bp, Unknown
  Metagenome-assembled genome
cttagttttttcattatttaaactgaccccaataatcatcatctgattcaacaatttcatcgtcaggtaaaacatggcgtttaattaactgatcacgtgcaattgcatattctaacgaaccttctttagcttttaatgctcgttctagccagtccattttttcttgtgaaacgatggctactgcgcgactatttgaacgagcaatataaacggtttcgtcttcgtcattaactttatctaaatatttttttaggttagcgcgaaaatcgctctgtgttagtgctaatgtcatatttaccaccctttcattgtacttaatattgtacttaatattgtactttaatttgtactaaaaatcaattttttaaggagctaaaactatgcaacaagttgtcttacccatcaaagattcaaacgttctcaaagaggtgcaagataccttactcaacaactttaaagctggccggcgtaactatacagtttttcaagttggcaaagcgacactgttgcgagtcagtgatgtcatgcgcttaaaacaaaccgatattttcaatccggacggttctattaaacaaaatgcgttcattcacgaccgaaaaacgggtaagcctaataccttgtatcttaaaccagttcaaacagagctcttattgtaccgtcaatggctacttgatcatagactagcctctgaatggctctttccttccattcaacaccccgagcgccatattacagaaaaacaattttacaaaatcatgagtaaggttggcgatctgttaggaattaattatctagggacccacacaatgcgcaaaaccggggcttatcgcgtctacacgcaatcaaattataatattggcttagtcatgaatctgctcaatcattccagtgaggcgatgactttagcttatttaggcttagaccaggctagtactgaaacgatgctggataaaattgattttggttaggaggccggctttatggatttagattttaaatcaaacaagtatgatctttttgatgattggcatcaaaacaagactaaacaagcctttacacaaaaaagatgggcctaaatttaggtccagctgatttattaggcatttaataacaattgataagcatagcgcggttcctttggttcgtgcatgtagataataccacgatattcaaacccattctgcttgatcacgtgctgcatgcctaaattctcaggatgcgtatcgatacggacatcggcgtagcctaattgcagcgacaatgttagtaaattggtgatcagcgtttccgataaatgttgtccgcggtagccagccgctacggcgatgcggtgaatcgaggtataagtggcgtcggcagcgcccagccacgtcccccgatcgatcactttataattatcgtcgataccttgcaataatgacgccgtaccaacgatcacgccatcgcgtaccatcacgtaattcacaccagcggccacgtcagcagccatatcattttgttccggataaccatgctgccattgatccacattttgttgctttaaatatgctttcgcttcatctataattttcatgatgactggtagatcagtcatttttgcttgccgcaaataagttgttgtcacaacctttgccccctattccactattaaggtttatttattagcataaatcgctaataaattttgatgttgctggcggtgtccattcaactatggctcagtacgccaagttgaaacatggccctattccactattaaggtttatttattagcataaatcgctaataaattttgatgttgctggcggtgtccattcaactatggctcagtacgccaagttgaaacatggccctattccactattaaggtttatttattagcataaatcgctaataaattttgatgttgctggcggtgtccattcaactatggctcagtacgccaagttgaaacatggccctattccactattaaggtttatttattagcacagaccgctaataaattttgatgttgctggcggtgtccattcaactatggctcagtacgccaagttgaaacatggccctattccactattaaggtttatttattagcacagaccgctaataaattttgatgttgctggcggtgtccattcaactatggctcaatgcgccaagttgaaacatggccccgcctaacgctgatctaacagggtcaatcagcattaatttctgcatccaactattatcaacatttatgcagcgaatttcaagcgaaaagttctaaattttgcgtcgctctcacgaaaatttaatttcaagcgaggaataaaagatgtacgtcggttattttgattcattttacgatctaccccaattaaataaacacctgcgttgtcattggcgtgcctattacccagccaaaaaggtgggcatcaaagcaccgatcgcagctgggaaattccccttgatcttaacgcttaatttaccagccgattgtgggcaaattttagccgctgccggcaatatcgtgtgtcagctacaatttccgcagcgccacgccacaacccctaacgactatccgcaatggctcgccgaacatccccagctcgtcgcagccaacaaacaagccgtcaaacaaagtttgctggtgatcgagcaattactctcgccccaccaaatcaacagcgcccccttacaagcacacattcgtcctcagcaagtcggtgcttgtggttatggttttggcggcagtgtcgccttagaattactgcgccgctcacatctcattatggcggccagcggggccacaagttatttagccagtcaaaaatgggctagcccttgtgagcaaccgcaactactgattcaaagccctgctaagccaggcttatcaccaatttttaagcgcgctagaaaacgcgcttatctttacaccactcctcaattaacaccagcaaaactaaccacgcttagccgttctttttttgctgctagctttgcgcatcagccatttgacttcgcccagcttttctaagtaaatcatgagcattccgctaaataaccgtgttaaactgaaaataggattaactagtgtgtgtctggaaaaacgtttaaatttttcacctacgtttaggcaaaattagcgataaaaactaattttgtagtccttgcccaacaccacctagtgtaactgctaaaaaacactcttatgaaagcgaggaattccatgtcggttgatgaacagtaccaaattcatttacaacagcttaaacacaaagaacccggttttgtcgaaacaatttatgccttaggtaatggccacctcggtgtgcgggccagtaacccactgcagggtaactcgcctgcctatcccggcagccccggtttatttattaacggcttttacgacttgacgccgatcacttatggcgaggcgtacttcggctatgcccgcaataatcagacgatttgtgagctgccggacccccgctatctaattttcagcgttgacggcgtgcgttcggatgaaactccctaccaaattgaaatgattgataagacgtgggacatggctagtggcttgttgctggaaactttccacgtcaccacaccgacggctaaagaattcacattgacactggaatcttttgcctcgcaggcagaacgtcatttatatgtgatccgctacgatatccggacattgaactttagcgggtcggtaactgtaattaaacagcatgcctacgttaatcagcaaattgctcgtgacaataccgatatgcggcgcgctcaacgcggcaatactttgctccaaacttatttgcctgccgcagcgccaacaatgcggatcagtacgcaaaaaagtcaattgagtttgttgatgacgatgcagtatctcggtagcgatccccgggtccagctcaatgcccataccgatatccctaattacgagatccaattgcaactcacgcctgagcgtagcgcccaatttagttttggttattcactgggcgagatccacaaccagctctcatttgaagtcaaccaagcacgctacattgaaaaatcattggcccgcctggatggtgaaagtttttctagtttatttgctgcttcagcggcccgaactcgccaattctggcaggacagtgatgtgatcattgaaggcgatccaattttacaaaagggcattcgcttcaacttatatcacctctatcaagctgctggtcgtgatcatagcaccgatattcccgctaaaggtttgactggcgctggctatgaaggccattatttctgggatacggaaatgtacatgttgccgtttttcatttatacgcagccacagattgctaaggccttacttggctatcgttatgcgacactagccgaagccggccaacgtgcgcgcgaaatggcgatcaaatcaggcgttctctttccgtggcgcacgatcagtggtgaagaggcgagcgcttatttcccagcgggcacggcccagatccatatcaatgctaatattgcttacgctaccgaccaatatattcgtgccaccgccgacactgattttctggtcagtgctggcttcgaactgattttagaaaccgcgcgcttttggctagcgtatggcaattacgctgaccacggtccccaagctggtcattttgtgatcaaccgagtcaccggccccgacgaatacacggcgctgatcgacaataattattacaccaaccgcatggcccagcacaacttgcgtttagcggtcaaatatgccgctgaattaaaacaattggcaccagataaattagccgaattggcggtcactgatacggaattggcggcatttaaaaaggcggcagccaatatgtacctcccctacgacgcccgacaccaaatcaaactacaagatgataacgcgctgaatcggccgcgctttgatttaaaaaacgagccggcaactaattttccgttgttgctacactatcatcccctggtcctttatcgctaccaggtcaacaaacaagccgatacgctaatgagtgactttttattcccattggatcaagatgaagcccaattacgccgtgattacgactattacgaagggatcactacccatgattcctcattgtcacgggcgattttcagtattctcgccaaccgaattcacgatccagacaaggcgcaagcgtactttttagataccgccttaactgatttgactgatttacaaggtaattcggaagacggtattcacgcggccaacatgggtggcagttggctctcactgatttatggctttgctggtatgcattacggcactgacggtttgacatttgcgccccaactaccagctggttggttccgacttagtttcaagatcaaatatcgtggccggcagatcgatattgacatcaatcaaaaaaccgccacttttaacttgctgagcggtgcaccactaactttatattgtggcccagaagcctgtgatctcagtcaaaagatgccagttactgttgacatcaaacatgcctaaaagttgataaattaagatttacgttctactattattagtaacgggtgctcatttgattacgttaaaacttattgtggtgatcaaagtagcagcaccctttttggcgaaaataatggtgtcctgatcaggcaccgctgtttaatgaaaacgatcggaacgatgctacaagaatttagcataaacgtgtttaaaaaagcagctttttgcgcctagctgccatgctgcttgcggtatggttttacaacatttaagattttcgtttcagaaatctcttgtggcgcagtagctagtgctcaaatctaagcacttttttaaacactctgtagaaaggcagtggatattgtgaaagttatttcattacgcgtcactgatgatgcaatcgtgctggcctatgtgcgggccaacaaacagcgccagcaaagcgtgattgcttatgatccgcaacaaagtatcggtgacaacttagagaaaattcgcgaacggctagtcggcatcaattttgatgttgcggtgatcgagaatcccttagcctatgaattctctgacacgatcgttggtatcaaccatcagcgaatcgacattggcctggctttgaccaatatgcttaacgtgccagccgttagccaacaaatggtcaagactttggggctagctaagacagctgcccgtaaacaattttacaatcaatggcatttggattattacggccaatacaccggcaaacgtaactatgggcaggaatcaatgctgaccttaggtaacggctttttcggcttgcggggtagttatgttgaggctaaagctgatgatgacaactatccaggcacctatgttgctggcttttacaaccaactgaccactaagatcaatgatcgtgatgtcgtcaacgaagacctggtcaatttaccgaatgggcagtacttaactttcggcgtcgatcaccagacaccatttaaaatcaaagcagaaaatattcaagatatttatcgcagtctcgacctgcaaactggcgagttacgcaccaccatgttagtgcaattagcaactggtcacgccttgcgcgtggttacaaccaaagttgccgacatgcataactggcatcaatacgcgattcgttatcaattgacgccgctaaacttctccggcagtctacaaatttactccgagatcgacggcagtgtgatcaacagcaatgttgaacgctaccgcaacttcaattcgcgtcattttgacgtaaacgaaatgagcaccgctggccatgaagcttatctggccggccaaactaaaacttcacagatcaagttcgttgtcggcagcaagttgactaactgtaatgatgtcccaactgaattgaccacacacaaccgccctgacgtaattgcccaagaattatccctcgacgtcacgcaaaatcaatcgtacacttttgaaaaaaatgtggctttatttaccagtttggagactaccgctgatttaatgaccgccaccgctaacgagctgcatcaagcttcattccaggctagcgaacaacacagtgatgacttttggcaagatatttggcacaacgccgacattcagatcgatggtgatctgaccagccaaaaactgactcgggtcaatattttccataccttcgtttcagccacgcaaatagctaaccagcatctagatgcttcagttggtgcccgtggactacacggtgaagcttaccgtggtcacgttttctgggatgaaatgtttattattcctttctatacattgcattatccaaaattagcgcggcagttgttgatgtatcgctaccaccggcttgatgcggcgaagaaatatgccgccagtgaaggttaccaaggcgctatgttcccatggcaatcaggtcaatatggtgatgaacaatctcaattcgttcatttaaatccgctgacgcaacaatgggaccctgacaacagtcgcctacaacgccacgtttctttagcagttgcctacaacgtttgggtttactaccatttagctaatgaccgtgagtttatgcaaaaatacggtatccaaatgttactggacattgcccgtttctgggtcagcaaggccgagtacaattcaacgaccaaacgctatgatattaaaaaagttatgggccctgatgagttccacgaaggctatccaaatagtgacgaagaaggcttgaccaacaatgcttacaccaacattatggtcagctggcttttcgaaaccattgcttatcttcggggtaatgtagtgccagaaacaacctttaccaaggcgatgcaagtagctggtatcaacgacgccctgtacaaaaagatgggaacaattggccataagttgaccttagatgtggattcagctggcgtgatcggccaattccaaggctacttcaagttaccaacattgaactttgaaaattaccgtaagaagtacggtgatatttcgcggttagatcggatattgaaagccgaaggacgtacaccagatgcttatcaagtcgctaaacaagccgatgcactgatggccttttacaatttcgacttgacccacgtcaaccaaattcttaaacaaatgggttacgatctaccaaatgagttcttgactcgtaatattgaatactaccttgatcggactacccatggatcaacattatcccggatcgtttacgcggtgttgaccttagttgacggtaatatggatcaatcgtggcacctcttttcacaagcgttgctctccgattattacgatattcaaggtgggacgaccgccgaaggaatccatctgggcgtaatggcagcgaccttaatgttggagacgcgtaactatgccggtgtcgatgagttaaccgatatgatcaacatcgcgcctaatttaccggcgcattggcgcagtatcgccttccgtcaatatttccgcggcacccaatatcatttccagatcacgcaaaaagcgatcacagttactgccgatcaagcggctaaagtccgcgtcgctggtcacgaactgttactcaccgccaagcagccgctgaccgtcgattatcaagggcaacccctgaccacgatcagcaaagcaaaatagagcatgttttaaaacataaaggaggcactacccatggtaaaatttacagatattaaaggttttgtattcgatctagatggcgtcgtcaccgatacatcccgttatcacgcgaaagcttggggccaactggccgacaaattaggcgttgattatccagagttaggtgatgcggtcaaagggattagccggatggacgcactggaaatgatcctaaaaaaaggtggcttggaaaacaactattctgaagccgaaaaagaagcgctggcggcagaaaaaaatgccaattatgtcaacctgatccaaaatatgagtgctaaagatattttgcccggtatggccgactttttagctgagctcaaggataagggatacggcatttcattagcttctgcgtcaaagaacgcacctacgattttagaaaaaatcggcctcagcgactatttcactaaagccgttgacccggcaactttgaaatatggtaagccagatcctgagatcttcatcaaaggcgcgcagctacttgatctgatgccggctcaatgtatcggcttagaagacgcagccgccggtattgctggtatcaatgccgctggtgagacctcagtcggcatcggtgatcctgaattattgcatgacgcaacgatcaactttaccgatactagtcaggtctccttggctaatattgaaaaagcaatgcaataaaaattaaagcaaaactaggcaatgattttctgaagtatagttattaagtacacgtaagcctagcgagtcaggatccattccggtgctgacgtatggaacgagtacgctgtatgcttacttggtaattcgtaattttcaagccaatcaaatcatttctaaacaaaataccagtaaaaacaggtttaactgcttttactggtatttttgcgtacaactaaatttggtatgtgccaccgcggccagatgaatggaatctaacctgcttcgtttcactcatcggtcaaaaaagagccatttcaaccactgctcgttttttaattgctgctaaatcaacactaatagcggtaatcaaacttaatcggtgacgtgtttgcccccaccattgacattcatgcgaatcaaataagtcaatccaaatgaagcaaacaggaaaaccgttacgaccaaatatggatagtgataattcatatctagtagcgcgccggacatgatcggcccgatgacattaccgacactggtcagcgacatatttaagccgttgatcaagccttgattgcctgaactagccttcgtcagcagcgttgtgatcgccggccgtagtaagtcgaacgctgtgaacacgatcaaggttgcgacgacaacttcccacttactatgtgccaaaatgatccagatcgtaccgacaaagctgaagaagaaacaatagcgaatgacccgcgtttcgttgaaagcgaccactaaacgatcgaacagcgccacctgcatgaataacgagatcagcccgttcaacgtcagtaccagcgcaatattacccagcgtgaaatggaaaacttcattaacgtagatgctgtagatactttcaaagccttggagcccaaatgaagaaactaagatcatcacaaatagcagaatcaccgacttggtcaaaaaagccttgatatcgcctttagaaggtgattttccttttgcagcaacaatatcatccgccagcaattcatcttcatgaggtaacatgaccaataaagcgatcgtgctcagcagaccgagcactgcagcgctccagaacggcgctttatagtcgatattagccagcacaccaccaagaccagggccgaggatcaggccgccgctaaacgccgctgatagccagccgatcactttggcccgctgactacgtgtggtaatatcagccgccatcgccatcgccgttggtgtcaccattgctgccgataaaccaccgacagttcgcgaaatgttgaacatatataatttattcgtcaacgcaaataagatctccgacaccataaataagaacaaaccagcagccaacatcggcttgcggccaattcgatcagatatccgacctacgattggtgaagcaataaactgggcaaacgcaaataaggcgctcatgatccccatatctgttgcgcttaaatgcagctcgtttttgataaatggcataactggaatcactagtccaatgcctaaacaaaccaagaactcactaaaaatcaaaatgaaaatcgcccgttttgccttcgctgtcatattgaccacactccttattattattgaatttttaacgccgtcaaaaaatggtcgccgctagatccagcaaccatttttcgcaatccaatccagtataccggtagacggtattcaatagcaagcaagagtatctggaaaaagtccaactactaaatatagattaaaaaaattttggtgcacaacggcaattttagtggaaaaaaatttttatcaattttttaaagcgcttaatcaggggctgcgcaagttttcagtcgtttttcactgataaccatatatagtatcttaaataaaaatgtgctaccatataatgtattgaattgaacggaggcaccagatatgcaaatgacatcaacaccaattaaaatcggcttgaccaatgatttcgtcgaacaagttaaacaagaagtccaaccacattggggtaaattaggctgggttacatataaacgcacatacgctcgctggatcccggaacaaaatcggactgaggaatggttcgaaactgttaaacgtgtcgttgaaggtaatattaaccttgacccacggctgcataacggtgacgtgacgccggaattatttgaggaattaacgactgaagcacaacaactctatcgtttgatctatggcttaggcgcaacgccatctggccgtaacttgtggatctccggtactgactatcaaaagcgtaacggcgatgccttgaacaattgttggttcatcgctattcggccgcaagcttatggtgacagtcatattgtgcctgattatttggacccagaacaaccagccgtttcaatgccattttcatttatgtttgaccaattaatgaaaggcggcggtgttggtttctctgttgtcccatcaaatatcagccagttgccacccgttgcggctaagatcaaacttagtgtattgatcggcaaagaaagcgactcttaccaagattctttggccttaggtgcggttgaccgcgatcaatggttggctgaaaataacgtcgctgacaccttgtactatgaactaccagatacacgtgaaggctgggttttagctaacgcgcacatgatcgacgcgcattttacgtccactaacccaacgcaagctaaacaagtcgttttagacatgactcaaatccgccctaaaggcgcacgaatccacggtttcggtggtactgcttcaggcccaatgccattgatcagcatgttgatcgacagtaatgatgttttaaacgaagctgttggtcggcaattaactggcgttgaatgcactgacctcggtaacatgatcggcaaagccgttgttgccggtaacgtacggcgctcagctgaattagctttaggcggcgcagaagatgatgcctttatcacgatgaagcaagatcaagaaaagctttaccatcatcgttgggcttctaacaacagtattgccgttgattctagcttcactgactacggtcccgtagccgattcgattttgcataatggtgaacctggtatcgttaacttagaattatcccaaaactatgggcggatcgctgatggccgtcaagaaggcattgatggcagtgttgaaggcactaacccttgtggcgaaatctcgttgagtaacggcgaaccatgtaacttatttgaagtcttcccttctgttgcccaagaacaaggttggcaattagaagatgcctttgctttaggcacgcgctacaccaagcggatcacttttagccattacgattgggaagtttcccgtaaaatgattgctaaaaaccggcggatcggtatttcaatgtcggggatccaagattggatcttagatgaatttggccaacgcgtcgtgactggcttcacaccagctatcgatcctgaaactgacgaaacgttccagaaaccagtttacgatcaaaaggccgttcaacggtttgatgctttgtatcaggcaatcgctaaagctgatcaggactattctgatacgcttggttgccagccatcgatcaaacacactacggttaaaccatcggggaccgtcgctaaattagctggcgtttccgaagggatgcatttccattatgccggctacttgatccaacggattcggttccaagatagcgatccattgttaccagcattaaaggcttgtggttatcgcatcgaacctgatgtttacactgatcatacaatgtgtgttgagttcccagttaaggccgctaacgctgacaatccaaactttgcttctgccggcagtgtttctgtcgctgaacaatttgcgacgcaagcgttcttgcagacttactggtccgataacgccgtcagttgtaccgctactttccaaccagaagaagcggaccaattagctggcttgttgaaacaatatcgtcacaccactaaatcaacttcaatgttgccatacagtggcggcgacttgaaacaagcacccaaagaacccattgatgcagcaacttatgaagctcgttgcgcagagatcagcggcgatgttgaagcaacatttgctcaactacatccccaagaacaaaaagatcttgtattggtcgatcagactgactgcgaaagcggcgcctgcccagtacgttaataaataagaaaacgccttgcaagttatggcctgcaaggcgttttttgtgctttcgagcgcgcttgatattgcgcttaacttttttaaacatctacatgatgctttaactgcggaaaaacgtgtccgtctgaccatttcatcagcacaccctgtgccgtcaatgctagcaccgttccatagccgattgcctctaacttgccagtggcaacaaaagccatcaccgtgatcaataatggcggcgtatagctggcccactgccccaaaatcgccgaaccttttaaaaatttgaaccgcaaaatgtacgacagatcatcattaggatgcatgatgatattcgctcgctgataaatcgagactgctgccgacaaaattaagatccccagcgtatcaataactaggcgccaaactaaactgagttggggcacacctaaccaattccagactaacgtaaaaaacgataccatgtaactaaacggaatcgtgtacaataaattggaaactagccgtcgacgatcgaagtgtcccaacaatagctgattaactatcgtgatcacgatcccatagatgaatagggttgtccctagcggaatatggatccaatttgataaattgaccgaagagcctgtccaaacagcgctacctaaatgcgtcgcgatcgttagcccattaccagcagcgttcataaaaatcgagagaactaaaaagtccatccgctgccgaaaatcctgcatttttgccatttgtccatcccttttctaccatcaataacttccattttaacactaaaaaaacggagttgtgacataagtaatttatgcccaactccgtctttgcacttccaaacaattcagtatgaaaatcaactattactgtgacgttgcgttacgtcacactctctttgcaatgttaaccaaagaaaacaaagtaaccgatcactaagatccctaacacgatccggtaccaaccgaaagctttgaagtcgtttttcttgatgtaacttaacaagaaacgaatcgataagtaagcgacgataaaggagaccaccacgccgacgagtaaaacaacactttgcaagccaactaagctattaccgtgatcatagaatttgtagatttttaatagcgaagcgcctaacatggtgggaatcgccataaagaaagaaaattccgttgcgacataacgggaagtcccaataatgatcgcaccaaggatcgttgcccctgaacgcgaagtccccggaatcaatgataatagttggaagacaccgataaacagcgccgttttgtacggtaatgtattcaaatcagcgaatttcggcgttaaacccttgttgtgattttcgataacgatgaacaaaatcccataaatgatcaaggtcgctgaaacgacagcccaattcatcaaatgtgcgtccatccagtcatttagtggcaacccaacgatcacagatggaatcaccgccaataatactttccaccataacgtccaagtctgcgaccgttctagctgacttttccgaccagacagcggatttaatttatggaaatagaacaccaccaccgccaagatcgcacctaactgaatcaccacgttgaacatatcgataaaggccttcgactcgtgcagctgaataaattcgttgaccaacacaatatggcctgtcgaactgatcggcaggaactcggtgatcccttcaacgatcccgaggatcactgctttaataatgtctaacaaaagtatgtacctcatttcaaaaatttattatatgtaaaatgcggaataaggaaaatccttgttccggctggaaaacaaagtttatatatcaccattttccttgatctggcgctcggtcagataggcatccaaataatcgaataccaactcgccaatactatcaagggaaaaactgacctgatcttctgcttcaaaaccatcgtcatcatcggtttcactactattgatcaagcgtagtgtcactaaatcaccgtcaaaacgcagcggaataccgataaatgtcgccggatcgtgacgcagccgcaaccggatcactcgagcaaatacccgtgactgctggatcaagctcgcaaataaatcggtggtcccatcaaacaaacgctcatcattaagcactggttgcttaacaaaatgccgttgccgattaactttaaggaaaaattgcatcatttgcaagtaatcggcttgggtcgtcaagcgttgaatttcatcgatccgcagtaaaacataaccaccaaactgaccattcatatcgatcaaattaaataacaccgtctcttggttcagtgtattaacggtgccgacaaagaaattatcatcatcattaccggtatagatcatcaccaattcctgacccttttgcgctaaccgtaattgctgcccgatgaccaacggcaccgtaaaatcgacggtgtccaaatgttgtttcggtgctacctcacggacatatttacccactagtgttaattctttaccttgcaattcaatgatctgaatatcacttaatgccacggtgactagccgctgcgtactaaaatcgaatttatcgaacacattcaccgttaccgtatcagtggtcacatgctggattgaaccttccataaaggtttcaccattgcctaagatcaacaacataaaatactgttggttaagtgcttgctgtagcaattgcggtaatagatcaaaatgatcattaaaatctaacttttgtggtgtgagcttgatgaactgctctaattgcgcatttttgatgcgaaaagccatattagtcagatcttggccatctaattcgacctcactgatcaccgctaacgccaagtaaacggcgccatcgcgtagcccaccatcatcatacgtattgagcaccactgcagtatcattcactgtagcaacgtagccggtataaacgacttcctgcgcttcctgataaatattgacgagtaaatgttccgtttgggcagtttccaaatcagttaaaattgaattcattgcgcgacacctcactttctggcattagtccacttatcattataccgacaaaagaccagaaacgatagcatttatgcgcaaaattaaagcgtgcgttaaaactaaattagccacactttagttacgcgcacgccgtaaccaattaacaccccacacgataccgccaatcaagagtgctgcgaaaattaatttaaagaacaagctgaagacaattggaattaaatgtaacactaacgctaaaacaaacagaccaacaaagaccataccgacgatccggaaaaattcattcataatggagagcctcactttttaagtttaattgctgtctccattttaaagggcgatcgcggtagcgtcctcagtccaaagctttatttttagatgcgaccatttgccagaattggtcgatctggttagtcagttgcgctaccgagtaacaacgctgaaaatgttgccagtgggcaggaaagagttgcgtgtagcgcgagctagcaaagcgctgatccaacagtagaatcacgccgacatcatggctgccgcggatcaaacgcccagccgcctgcaaaacatggttcattcctggcagttggtaggcatatggaaagcccgttccctgctgcgcatcaaaataatcgcgcactaaattacgctcagtcgataaccccggcaagccaacaccgacaatcgccacaccgatcaagcgctccccttttagatcaattccttcagaaaaaatgccgccaagcacacaaaaaccgactaaggtttctgttggttgtacggtaaattgtgctaaaaagtcagcgcgctgtgtttcatccatttgcgttgcttggctgatcgtttttaactgtggatacgtcgccgcaaaggctgcctgcaccgtttctaaataactatatgacggtaaaaaaactaaatagttaccgactttagcattgaccattgccccaatactggcgatgatccgatccaaattttgttcccgctgccggtaagtagtctgaatatagggcgtgaccagtaacgcttggttttggctgggaaatggtgaggctaagcgaaacgtcaaactatccgcattgttaccgagcacttgctggtaataactcagcggtgataaggttgctgagaataaaattgcccccgcacctaaaccaagtgcacgatctaaaaaagcactgggatccagacagagctgcttcacggttgtctggcgcagtttatgatcatacaacaccagcgactgataagtttcatcatataaatcagcgatcttcaaataagttaagctggcaaaataagcatccagcaacgtatccactaaaggattatcttgatattcagccaaccaatcatggaccttagcgacccaatcagctaaggcctgattgactgaatctagcggcgcttgcccagtcatttcggtgatatcatcgtcacgcagcggtttactgatcttagtcagggcacgcttaactttatgggtcaacttttcaagcgcgcttgttccggcgcttgattctgtttttgcctgttgcaggacggcctgaaaggtttgactactaacactagccgaatacatatcccgcgaacggctaactaaattatgcacttcatcgactaagaaaaaattatcgcgatcaggttcgctaaaaaagcgctgtagataaacgatcgggtcaaacagatagttataatcgcaaataataacgtcagcaaataagctggcgtccagcgaaaattcaaatggatcaacggtatgtttgcgcgcatattcctcgatcaccgtacgcgtcaattgattttcatgcatcagcagatcacgtagcgctggcttgacacgatcataataacctagcatataaggattatttcctggagccaaatcaacctcttccgcaaaagtgatcttgtccttagcagtcagcgtaatgcttttcagctgcatcccttgctgactcaataaagccaaagcatcctcggcgacttgccgtgtactttgtttagccgttaaataaaaaacccgctggatcttgtcttcacctaaagccttgattgccggaaatagcgtcgagatcgttttaccggttccggtcggcgcctcaacaaataatcgtttctgcaataagatcgacttatacacggccaccgctaattcgcgctgaccttgccgatatgctaaaaacggaaaatcgatctgtttaaccgtggtatttcgctgggcgcgccattgatcacgtaatactaaccattcttcatattcagcgatcaattgttggaaaaacgccgttaattcagcttgctgcataactttggttttagtggtcacaacttcggtggtggtctgaaaataagtaagttgcagcgttactgcagccagatctttttgttgtgccaaaatatagccataaacttgcgcttgaccccaatataactgcaatgtattttcactaacttcggcaaaatccagatccgaagttttaatttcttcaattgtataatcttcatcagtggtgtggctgatgccatcggcgcgaccatcgatcgtgtactcgcggccactcatcgtcactgactgcttcaaataaacttctttttcgtaatcatcaccgcgctgtttttgtaagcgacgatggatccgcgcaccatttagcgccgtattttgactgccttggcgttggttgagatcacctgagcgcaagacaaattcgactaattcacggacgccaattcgcgtggtcgccatgcgcttcatccccttttcacaagtacttcattataacaaaaaaggcggtcgctgatcaccgccttcgattactatttatctgctattttaaattcggcatgcccatcttgcatcaacccatagattcgttgctgctcatttaaatcgccgaaatctaatgccatttcgccatcgacttcggtggttccttcaaaacgttgcgctacgaaatgacgtaacaaagaatttcgtttagcaaacaaagccactttctctacagcagcagctaatgtataaccttcatcaaggaactgtttgatcccaataatcctgattgctgtttttaaattatattgtcgactaacgccgtctttttctggtaaggaactgatgtaaccacgcttttcccagtagcgtagttgtcgtggcgaaatagctgtcatccgactgatctgactaataccaaagatcagtttatccacatcgattcccaatttagattttaaactcattatgaaaactccttattttacataatcatgatcagttcttagtataaacccgctaactaactggctaaatgctacaagtattatctcacagttaacattcttgtcaaacgtaaagctacaagtgtcaagttacttgacaatcaaaaacgttaggtttatagttttcaacagtgattttttcatgaaagagggactagaacttggctaaaacgcaatctttagatgccaatggcaaaccatataatcgtggtcttttgctagcaacggtcatcattgggacatttgcgacggtgctgacacaaactttattggccaccgcatatccaaccttaatggacgcttttgacatttctaccgccacagtacagtggctaacaactggctttttgctggttaacgggatcatgatcccaatcagtgcttggctgatcaatcgtttcaattccaagtatctctatattagtgctatggttattttcttcattgggacttggatctgttggcaagcgcctaatttcgcaatgttacttactggccgcttagttgaagcggttggggtcggtttatcaatgccattaatgcagaccatcgccctttcgatcttcccaccacaacaacgtggggcagcgatgggggcagttggtttagcaattggactagcaccagcgattgggcccacactttctggttgggtcattgatacttacaattggcgtgttttattcagcatgatcttaccaattgccggaatcgttattatcgcttccttctttaccatgcgtaaagttttggaaacttccaaaccatccttggatattttatctgccgtcctttcaacgattggtttcgggagtttattgtatggcttttccgaagtcggtactgaaggctgggggagttcgatcgttatcatcggcatcgcagtcggagtcgtatttatcgccttatttgcttggcgccagcttaaaatggcaaatccattcttggaattacatgttttccaaacgccagcatttacacttgctacaattctaagtggtgtcgtcaacatggcgatggtcggtgctgaaatggtgctaccgatgtatatccagaccgttcgtggcgagtcagcgttccattccggcttgaccttacttcctggggcgatcatgatcgggatcatgagtcccattactggacgtatttttgatcgtttaggtgcacgttacttagcaatcactgggatgaccttattaacgatcggcacgattccatttattttcttaaccaaatcaacaccgatgatcaatgtgatcattttatacgccattcggatgttcgggatcgcgatggtcatgatgccagtgacaaccgccggaatgaacgctttaccattacatttgatcagtcatgggactgccgtcaacaacacgttacggcaggtagccagttccgttgggacggccattttgatcagtgtcttaacgaacgtgacgaacaatcaaatgcctggcaaacacgttttgcataacttaccattacaatacaaagatcaagcaatgagtgccgttgtttccggctataaggctgctttcattgttgcggctttattctgtgcgattggtttattcgtcacattctttgttcacgacaaaaaagcgcctagtgttacaggaggtgacaaataatgttgatcgtactcgttttattaagcgcacttttattcgcgatcgtcacaatttcgactaatcagcgcagtgcagcccgtaatgctatcaccggtgtattgttagtattattggtcggttcgatcgcccttttattcactaacgataaccaacattgggggatgaaaaccgtcaccactacaacggaaaaaccattgacgtcagcttccaatatgtctggcgctaacttactgttgtatcaagcacttggtaatggtaaagaaaaaatctttatctacaaaactaacacacaacagaaaaaagtagctactacccaagccgatattaaaactacgagcaaagtgaccagaagcaatacgaaaaacgctaagctagtgactaaaacgcaacgctacgtttatcgtaatggcttctaccgtgcgttatttgccggtgtcgacaataatcatgccttcaaatcacggcaacatgaatttaaagtgggcaataactgggtcgttctcagtaccacacaagccaaaacactacaaaaacaggctaaaacttcacaggctaagttaaaagcgcaattagctgcagcagttaaagctaaaatggtcgctgctttgaaacagaatccacagatgaccactgaacaacaacaggctttacaaaagcaatatactgccgccgcacaaaaacaagcacaacagcaagttttagcgcagttacaaaaagaatcattgaagtaatttaaaagtcagcccttgcggctgacttttttatttgccacattattgacacagtgtcacctcgctgttagaatgacgttattgacacggtgtcacttttgattattaacatataaataatcagcttcaaaggaggacttcaatggtttcgacgactttcaaaaacttagcacctgataaacaagcacgaatccaagctgcgctgctaaacgaattttcggcccatccattagcggacgcacaggttgcgcggatcgtacagcaagcacagatcgcgcggggcgctttctataaatattttaccgatctaaccgatgcttaccgctatttgtatcatcaagttatgctagaagttcatagcgctattccgcgggccgcatttaaaacctttacgcccgccgtttatttacaggcggttcgcgactttgtcgatcaagccgctgatagtcagtatcgcgaattgatcaaacgtcatttgacccaaaacgaggctttattagcagcgccaaggcagccagtgatggatattcctgacgctgtctgggcagctggtattttaagccacgaaacgatcaaacaggtgttgttatacccagatactaaaaaagcggcgcttgatcgtttagccagcgcgcttgaagctttagcaagaaaggatgagtagatgtttttagctttaaaagaaatcaaacatgaaaaattacgttatagcttgattattgcgatgatcgtcctgatcagctatttgatttttgttttgaccagcttggcacttggcctagcccgccaaaacaccgatgcgatcgactcttggtctagccaacgaatcacgttaaatcaagacgccaatattaatctcagtcaatcgctgatcaccaaagcgcaattggcaaaggcaaaattaagtcaccaagaagcttacttaggtcaagctgctgtcgtggccaccgccaaaggacgagaaaaggattcagctcaattcatcggtttaaacgctgatcaatttatcgcccagaatttgaaactatccgccggtcacaaaccgaccaccgaccaagagatcgttgtcgatacagcttttaaagaagacggctacaaactaggcgattacctacaactcaactcgtttgctaaaaaatttcggatcgttggttttactgaaaatgccaagttaaatgtggcaccagtagtttacggcacaatgactgcgtggcatcaattaaagaatcttggtcctgaatttgccgccagtgcgatcgtctcacagcgcaacacatttaaggtcaacaatccgcaacttaagcaatacaccacgcaaacctttatcgataaattaccgggttactcagcccaaaattcgacctttacctttatgatcgccttcttgatgatcatttcattgatcgttattgcggttttcctttacattttaaccgtacaaaaattgcaaaattatgcggttttacgtgcgcagggaattccggccaaaacattggtcaacgcgacgatcagtcaagcgttggtactggttattagtggcttaattattggcaccttgttgactgcaataaccgccgtagcgattccggctagtgtgcccatggcttttgatatcccaattttagccgccgtagcgttaggtttagtcttcactggtattatcggcgcgctagtcccagtacgaacaattttacacgtagatccagtcagtgttataggaggttagccatgagtgccattcaattaaccagtatcaataaattcttcggtcaaaaatctagtcgtgtccacgtcttgcatgatatcaactttacggctaacgcaggcgaacttagcctggtgatcgggccatcaggttcaggtaaaagtacttttctcacgattgctggcggcttacaaacaccaaatagcggcaccgtcgctttaaatcaccaaaccttgactgatttaagcgccaaacaacgtgatgccctgcgcttaaataaaattggcttcattctacaagcctataatttagtcccctacctaactgtccgcgaacagtttagcttagtcgaccgtgtcaaaaagcaagacaacttaagtgcgaccgacctagccagtttattggctaaattggggatcactgaactacaaaacaagtatcccgctgaactctctggcggccaaaaacagcgagtggcgatcgctcgcgccttatacacggatcccgcgatcatactagctgacgaacctaccgccgcactggacagtgaacgggttaaagaagttggtcaattattggccgacctagccaaaagtcagaataaggcgatcgttgtggtcactcacgacctgcgattgcgcgagtacgctgatcaagtttatgaactgctcgacggtaaaatcagtaaaagtgtttagaaaatgcgttgtccccaaaatcaggggcaacgcattttctgtctttatttaaacaactgatcgatttgctgatactcagctgccgttaattttatatccagcgcctgtgcattggccgttacttgggccgcttttttcgcgccgggaatcacaacaccgatctgcggattttgtacataccaagcgagtacgacctgagcaatcgtggctgcgtgggcatccgctactgactgtaattgggccacctttttgacgatcattgcgaaacggtcaccttgaaaatcaggattcttatgccgaatatcattagccgggaaagtcacatcagcatgatatttaccagttaataaacctgatgccaatggaaaatacggtacaaaactgattttctgttgctgcaaatacggtagcaagtcggcttcagcctcccgatgcaacagactatattgatcttcaaccacatcaacatacccatcgcgattagcttccttgacttgcgccaaactaaagttagaaacaccaactgcgcggatcttgccagcttgtttaagatcatttaatgcggagaccgcttcatctttaggcgtctgctggtccgggaaatggatataaaaaatatccaaatagtcggtctgtaagcgccgcaaactatcatcaactgcttgccgcaggaatttaggtgaattatttagctcaacttcaccactagaaagatcttgcgccgcctttgaagctactaccacttgatgccgatcatagtcttttaaaacttgaccgattaactcttcagaatggcctaacccataggcaaacgcggtatctaacaatgtgatcccagcctcaagaccagtacgtacgattgctttaccggtatcatcctctagatcaggaaataaattagtaccacccactgcattggtgcctaaaccaagtggtactgtggtgacggctgatttaccgatcgtaacttgttctgtcattaacacaccctccttgatcattcaatataactaccgtaccactttcgtgtaaaaagcgtcaaaaaaagagtctaccacatgatagactcttttcaagcgcgcttaaaagtgcgcttagccagtaactttagcgattcgaccttgttcgatataaacgctaaggatcgcaatatcagctggattgaccccactgatccgcgttgcttgcgcaatcgtttctggttggatcttctttaatttttgatgtgcttcagtagctagaccattgatcgcatcatagtcgatattatccggaatatgtttagcttccatccgcttcaaacgcgctacacgttcttccgcttttttgatgtagcccgcatacttcaattgaatttcaatttgttcgatcacacgacgatccaatgattcggccggtgccggaataaattgtaaaacatccgcataagtcacttctggccgccgcaaaaattcactggccaaaacgccatccttcaatggcgtaccacccttgctagtcaaaaaggcattaaccgcatcattgggcttgatccgtaccgaattcaagcgcgctaattcattttcgatcgcagcttttttagccaagaatttagcgtaacgagcatccgaaattaaacctaactcatgaccacgttctgttaaacgcaggtcagcgttatcatgacgtaaaatcaagcggtattcagcgcggctagtcaacaagcgataaggttcattggtgcccttagtcactagatcgtcgaccatgacaccaatataagcgtcactgcgtttcagaataaatggttcttcgattcctttagctcgtaagccagcattgatcccggctaataagccttgaccggcagcttcttcataacccgaagtcccgttcatctgaccagctgtaaataagttacgcaaaactttggtttccaatgttggccgtaattggtaaggttccaccacatcatattcgatggcataaccaggacgcatcatttgggcatgctctaacccagcaactgaatgtagcatttgttgctgaacttcttctggcattgaagtcgagaagccttgaacgtaccattcttccgtattccgaccttcaggttctaagaacaattgatggtgatccttgtcagcaaaacgaacgaccttatcttcgatcgatgggcaataacgcggccccacaccttcgattacaccagaaaacattggcgcccgatctaagttgtcgcgaatgattttatgggttgttggattagtataagtcaaccagcacgaaatttgatctttcaagtagattgaatctggcgtatcgtaactaaaatgattaacttctttatcaccaggttgttcttccgtaaccgaataatcgatcgtagtgccatcaacgcgtggtggtgtccctgtcttgaaacggcgtaacttaaagccttcatcgagcaagcttaaagatagtttatttgaaggctgcgagttatttggaccagaagcgtacattaattcaccgataatgatcttaccacgtgaagcggtcccggcagccaagacaacacttttcgcatgatagcgggcgccagtgttggcaacgatcccgacacaagcaccatcttcaaccaataaacgatcggccgtaccttggcgtaatgtcaaatggggttggttttcaatcgtatctttcatagcttgatgataagcatgcttatcggcttgtgcccgtaatgcacggactgcaggacctttacctgtattgagcatccgcatttggacataagttttatcaatattgtgggccatctcgccgcctaaggcatcgatctcacgaacaacgattcctttagctgggccaccaactgatgggttacatggcataaaagcaaccatatccaaattgatcgttaataataaggtttcattacccatgcgtgccgctgccaaagcagcttcagaaccagcatgtcccgcaccgacaacgatcacatcgtagttctgcgcatcatattcgcgtacttccatctcttaagttccctccattattaaggtcagcgccatttcgagcgcgcttaacttcttactgctagtttttattttcctaaacagaattgactaaatagttgattgagcaattcatcttgataagcatcgccggtaatctcacctaataagtcccagcaacgagtcatatcgatttgaaccagatcaacgggcatttctgccttgattccagctaaaacatcgtctaacgcttgcttggcttgattgagtaaaccgatttggcgtgcattactgaccaacgttgtactctggctattatcgataccaccccagaataaattagcgattctttgctccagttgatcgacaccagtcgctgttaatgcggagatcgcaataatattttctggcgccacggtttgttgcaactctgcttcgtctaattttaccggtaaatcggttttgtttagaatcactagtcgtttcttatcttgcgtagctgctaataaagtacgatcttcatcagttaaagcctcactattattcaaaataagcaaaactaagtcggcttgtgtgattgcttgtttagaacgctcaacaccaattttttcgactttatcgtcggtttcacgaataccagctgtatcgatcaatttaagtggcacatcgcgcacattaacgtattcctcgatcacatcccgggtcgttcccgcaacatcggtcacaatagccttatcttcatggagcaaatagttcagcaaactggatttacccacgttaggccgaccaacgatcgctgtggctaagccttcccgcaacactttaccttggctagctgtagctaataattgttcgatctgttttttgaccattgttgctttttccagcaacatttttgtcgtcatggtttcaacagcatcatactcagggtaatcaatattaacttcgacctgtgctaacgcatccaggatctcttggcgaatatttttgatcaaacgcgataagtttccatccaactgattaaccgccacttgcatggctcggtcagttttagcgcgaatcagatccataactgactcagcttgcgtcaaatcgatccgtccgttgagaaatgcccgcttggtaaattcacctggctcggctaagcgcgcgccatgactaagtaacaattgtaaaacatgattggtcgccacaatgccgccatgagtattgatctcgaccatttcttcacgggtatacgtcttaggtgcccgcaataccgaaaccatgacttcgtcgatgacttcaccattttctggatcaacgatgtgtccataattgatcgtgtgactagcaactttttgtagatcacgacctttaaaaatcttctctgcaatcggtaatgcatcttcaccagataaccggacgatcgaaatcgcaccttcgcccggcggggttgaaatagccgcgatcgtatcaaactctgtggttgtattcgccatgaaatagcttcccttctaatttttttcaacaaaaaaagcgcctacaccacgccccttgaatgcggaacgtgacaaagcactttgactactttatcgaactcatatttaagccctactataaaagttgacttaccatttgtcaacgattttttattcaaacgcaaaatcaagcgcgcttaaatcgatatattcagcgatttacttaggtgcgatcaccacgtagcggtgtggttcctcaccttctgaataggtgatcacatgtggactatcagccaaatgcgcatggatctgcttacgctcaaatgatggcattggctctagcaaagtcgcttgcccggttgcgatggcctcacgcgctgttttatcagctaagcgcgccaaaattccgttacgtcgttcccgataatcacctacgtttagtaatagggtaaacttcgaatgcgcatgatgattcaaataaacttgccctaaatattgcaaagcattgatggttttaccatggtgaccgatcagtaaaccttcttttttagtgatcaactgaatcgttaatcgattttttgaagctcgttctaacttcaattgtgctggcgcatcgattgccgccgccattgcacttaaatacgctttaactgcctgcaaggcccgctcatcgtcgcgtttgtgtgctggcgtcatttgctgcggctgcggtgcagttggcgcggttaccgcagccgctaccttactcggcttggcttgtggcttgacagctgttttaggtggcgttaccggcaaagctgttaatgaaacaattgctggcttacggccaatgccgagaaaacctttgcgaccttccgacacgacctctacattgactgcatcacgttctaaattcagatgcgtcagccctttttgaatggcagcttggatcgtacttccttcaaatgtcggcataaaaaaagctccttgtcttttcattgttctgtggttcaacttaactacaacctggtcgcgctaaactgccagttgtttcaatgattctagcgtaaaacgaacttttcactcacttacttaagtcacgttttaaaatcagcgcccagttagtttttattcctgatttacggtaaatcaagtggaaaaacaaatttccaaacactctctagtctacacaatttcagtccgtaaaaccagtagacgatccatgcacaaaataaaaagcgtacccccaccgcggagatacgccaacgtttaaaaattatttacgcttcttaccccggcgtgcttttgctagttgtcgctccaggtcgcgttttttttgttctttagcttcccgctcagcacgtaacttgaacggattcattagtaacaacgtttggccaacggaaaaggcgttggtcacaacccagtaaacagctaaagctgaaggtaaactgatcgccataaacaagatcatgaccggcatcccccagagtaacagtacattctggataccagattgttgtacctgacccatcatggtcaatttggaagtcgcaaaagtcagcaacgccgccaaaactggcaaaatgaaatacggatcagctttacctaattccatccacaagaaggtccctgaacgtaaaacggaagtccgttgaataccttggtacaaggcaatcaatactggcatctgtaccaataaaggtagcatacttgcaaacggatgaacaccagcgtccttataaagcttagacatttcaccttgcaacttctgttgtgtttcaacatctcgtgaagaatacttggtctgcaaagccttcatttgcggttgaatatccatcatttttcgtgaactgttcatctgatactgcatcaacggcaaaatgatgatccgaataataatggtgaagacgatgatcccgacaccgtagctaccaccaaataaattggatagccaaacgattgcccgcgaaaaattccaaataatgtaatgatcccaaaaaccagtactattaccagtaactggcttcgtactacaaccagataagaataaaactaaggtaaagagcccagcagcgccgagcagtcgtttcttctttttcacgcttattccctcacttcatccgttagtaagccagccagagttaaaacgtgcactaagtttgccttagcttccggctgtgtcaatcgatcagcgctaggccgcgcgatgaccaaaaaatcaacgtctgttttcaattgtggtttcagttcctgcagactttggcggatccgccgctttacctgattgcgatgcaccgcgttaccgatacgcttccccaccgaaataccaacgcgaaaatgcttttgccctggtcgttccatccggtaaacaatataattccgattagctttggaatcgccggtctggaaaacggtttggaaatctgcttcttttttgactcgataagattttctcatgacgtatttgattactccaagtccatatgtactgtgagcaaacaattgcttactcactcaaaaataataaaaaagaccactgagggtcagtggtctatgcagacaatacttttctacctttacggcgtctacgttgtaacacattacgaccgttgcttgtgctcattcgtttcataaaaccatggacacgttcacgatgacgtttctttggttggtatgtgcgtttcattgccatgtgcgattaaccccctcgcaaaaaattaagtttacatatttaatcagttattttctagtataacgaacttaatagactgacgtcaatagcaattaccagaatataatagcatatcccgtccataaatgaaactacaaaaaaataaagttatccacaaaataaagtgaacaagctaattttcctgtggatatcttgttgattaggactaaatttgctaaaagctacccacaaacatttccccagtttatccacagaatcacagactggtaaaaaacgatccaccacttgtaatcagctgtgcataacccgtgaaacatttgctatattggggtttaaaaatcacagtttactgttaataattaatttcattgcccatgttatgcacaagcataaccagcctgtggataacacttttaaacagcttgttcataaactaaagtgacttttttattatggcgaaagttgtggaaaactttttttgagaatgctaaactgaagatacgtttttagaaaaggaggcgtttttgtgcctgaattggaagagttatgggctatcattcgggatgaactccagcgttcgcttacccccgtggggtataaaacttgggtcaccaccgcgaaaccaatcgcgttaaatcagaatcagctcattatcgaagttcctgaagatctgcaaaaagattattgggaacgcaacctggctacaaaagtggttgaatatgtttatcaacataccggcggcgagatcacaccgatcattcagactgccaatcacgatgaaatccgacaaaccactaccacatcgccgcaagaagaagtaggggagcgtaataccgccacgatcacaccgacatttatgcggccgacgcatttaaatagtcggtatacttttgacacgtttgttaccggtaagggtaatcaaatggcgcacgcagcggctttagtcgtttctgaagaaccagggacgatgtataatccgctgttcttttatggtggcgtgggattaggtaaaactcacttaatgcatgcgatcggccaccaaatgttagcattacggccagatgcaaaggttaaatacgtgacgtcagaggcttttgccaacgattttatcaattcgatccaaacacggcagcaagagcagttccgtcaagaatatcgcagtgtcgatctactattagtggatgatattcaatttttcgccgataaagaaggaacgcaagaggagttttttcatacctttaatgcactttacgatgataagaagcaaatcgtgctgacttcagatcgcctaccaaacgagattccgaagctgcaggagcgcttggtttcacggtttaagtggggactatccgttgatattacgccgccagatctggaaacccggatcgccattctacggaataaagcggatgcggaacaattacagatcccagatgagaccttaagctatattgctggtcagatcgattctaatattcgcgaattagaaggggctttggtccgcgttcaagcctatgccacaatgaagcacctgacgatttcgactagtttagccgcggacgcgttaaagaatctgaaattagcggggaaaaataatgaactgtcgatcgctgatattcaaaatgaagttgctaagtactatgaagtttcagtagctgatcttaaaggaaagaaacgggtcaaaacaatcgtgatgccgcggcagatcgccatgtatctggcgcgcgagatgactgataattcattacctaagatcggtaaatcctttggtggcaaagaccacactactgtaattcatgcacacgaaaaaatcgcccaagcgttagaacaaaatgagcgactacaaaatgatgtccgcgaactaaaaaataatttacgcaccaattaaagaatggtcgcaaaaatttttagttcaaatcaaagaggttataattttaagcacatgtggataagtgcttagttgtccacgaagatatccacaggttatgcacatgtggatatctttattgtctaagcgattttttagttttccacagcattaacagcccctactactattacttaaaaatcttttatataatataactaacactaaccgtgaacggttttagttcgcggacacaaaacaaggaggttcttcatcaaatgcaattctctattaaaagatcgcttttcattaaaaacctaaatgatgttcagcgagcaatttcttcaaaaacgacaattccaatactaacggggttgaaattagtgttaactgaagctggcttgatgctaacgggtagcgacgctgatatttcgattgaagcgttcatctcagctgatgacgaaaaaaatgaattagaagttggttcaaccggttcaatcgttttacctgctcgtttcttcggtgaaattgttaaaaagttacctgaagatacattaactttagaagttaaagataatttccaaaccgaattacgttctggcccagctgcttttacgatcaatggcctagacgccaataattaccctaatttgccagtgatcgatactgacaaacaagtggtattagatgcggcggtcttaaaacaattgatcgctcaaaccgtaatcgcggtttctaaccaagaaagtcggccaattctgaccgggatccatttagttttagcgaatcaagaacttttagcggttgccactgatagccatcgcttgagtcaacgtaagatccaactcgacatcgacgctgatattcactacgatgtgatcattcctggtaaaagcctagtcgaattatcccggacattaggtgacgatgtggaaaacgttgagatgcggatcgctgaaaaccaagtcttatttgttgccggcacaacatccttctattcacggttgttagaaggcaactatccagaaacttcacgcttgatcccaactagttcatcgacacaagttgaattcaacgcgccacaattattgtcagcgatcgaacgggcttccttgttatcacatgaaagtcacaataacgtggttaagttagcgctagatccagcaaccaacaaggtaactatttatgggaattcaccggatgttggtaatgtagaagaatcactaaatggtcaaaacctttctggtgaagaattagaaatttcgtttaacccagattatatgaaagatgctttacgttccttcggccaaacggaaattcgcgtggcgttcatgtcagcgttacgcccattcacattagtcccaacagaagatgccgatcattttattcaattgatcaccccagtacgaaccttttagacgcaaaatagtgttgcttaattgcagcactatttttttatgtcaaaaatttggtaaaaaacaactgaatcagctcataagcgcttattttttaattttagcgatttttagtattactagtgtcttttgcttatttcaaattaactagcgttagacggcgaaaattagccgattagattgtactttcgtgaataaacaggtataataataagtagtaataaaacggtcattgaccgttttacagcctatgaacagggcggcagacaatcggtggcgtcctatttcataatggaagcgtggggatatcgttttgaagaaaattgtctacctcgagacagcttatttaacgctaggacagttattaaaggaacaagctttaattgactccggcggtcaagctaagtggtttttacgtgagcagactgtttttgtaaatggaataccggaagatcggcggggccgcaaattagtggctggcgatgcggttgaaattctagatacaggcagcttttttttgcggtcagcaacttcggataaggctgatgaataatgtacctcgatcatttgcaattaactgattatcgcaattacgcacgcctcgacgttgatttttcgtcaggcgtgaatgttttgctcggtgaaaatgcccaaggcaagacgaacctgctagaagcaatctatgtgttggccctgactaaaagtcaccgcacgcataacgagaaggatttcatcaggtggcaggctgactttgctaagatcactggattggtacaaaaaagtagtggtaaagtaccgctggaattggtgatcagcaaaaagggcaaaaaagccaagatcaatcatctggaacaggctaagctttcccaatatgttggacagctgaatgtgatcttgtttgccccggaagatctttccttagtgaaaggtgcaccttcagttcgtcggcgctttattgatatggaatttggccagatgagtcccaaatatttatacaatatcagccaatacaaaacggttttgcggcaacgtaatcaatatttaaaacagttaaagtataaacaagcgacggatcgcgtttttttggaagttctgtccgatcaattggctgaatacggcagttcgatcattcaacagcggttggattttctagctaaattggaaggctgggcccaagtattgcaccacgatattagtaaaggtcgtgagcagctgacgtttgaatatgtcagtcagttgaaagaaactagcttacagcaggcacttcatgctgatgtggctcatgagatcgaacagggaacgactttagttggcccgcaccgcgatgatgtccgttttttggtgaatggcaaaaacgtacagacctttggctcacaagggcaacagcggacgactgccttatcagttaagttagcggagatcgatttgatgaaggaacaaactggcgagtatccagttttgttgttggatgatgtgttgtcagaattggatgatatgcggcagacgcatttgctcaaggcaatccaaaataaagtccaaacttttttgactaccaccagtttaagtggtgtggctaaaacgatgatcgaagcaccgcgcgtctttcaaatcgcgcacggtgaattgcaacagacggcagatacggaatgatcaatcaatataactatgtttcttgcggtgaccgaaacggtttgagctgagacgcagtcgtgggcgttgtccactttgttggcggcaatcgtgctcatcaaaaacatggcaagccgaaaaccggcattaagtcgcaacgctacgagcatcagaagcgtttattagcgagttgtgctaataaatgatcattttcagagagatagaggaggaaaactcacttgacggatgcagaaaaaaaagaagaacgtttagaagaactggccaagtcgtatgatgctagtcagatccaagtcctagaaggcctagaagctgtacgaaaacgtcctgggatgtatatcgggaccacgacttcacaaggtttacaccatttggtttgggaaatcgttgataatgggatcgatgaagccttagcgggtttcgctgacgagatcaatgtaacggttgaaaaagacaattcgatccgtgtgactgataatggtcggggaatccccgtcgatattcagcaaaagactggccggcccgcggttgaaacaatttttactgtgctacatgctggtggtaaatttggcggcggcggatataaagtctctggtgggctgcatggtgtcggtgcctctgttgttaacgcgctatcgtctaagttgacggtcgaagtgatcaaggaaggccatcgttactacatggactttaagcgtggtaaagtagcgactcaattaaaagagatcggcaccgcgcctgaacatgaacacgggacaattgttcgtttctggcccgatccagatattttccaagaaacgaccgtttatgacattaagattttgacgacacgaatccgtgaattggcctttttgaacaaaggtttgcggatcacgatcgaagatctacgtggtgaagaaccaagtaaacaagaattccactatgaaggtgggatcaagagttacgttgagttcttggacaatggtaaacaggatctgttccctgagccgatctatgttgaaggtgttgaaaaagggattacggtggaagttgcactgcaatataccgaagattatcacactaatttgatgacctttaccaacaacattcatacctacgaaggtgggacccatgaagctggttttaaaaccgctttgactcgggtgatcaacgattatgctcataaaaacggcttgatgaaggaaaacgaaggtaatttatccggtgaagatgtgcgtgaagggatgactgcagttgtcagcatcaagcatccagatccacaatttgaaggccagactaagactaagttaggtaattcagatgcgcggacagtcacggatcatacttttgctgaaaccttctctcgttacttgatggagaatcctaaaattgcgaagcaagtggtcgataaaggtttattggcttcgaaagcgcgcttagcagctaaacgggcccgggaagttacgcggaagaaatctggtttggaaattagtaatttacccggtaaattagctgataattctagtaaagatccagaaatttctgaattatttatcgtcgaaggggattctgccggcggttctgctaaacaaggacgctcacgtttgactcaagcaattttgccgatccgtgggaaaattttgaacgtggaaaaagcctcaattgatcgtattttagccaatgaagaaattcgaacgttatttacggcgatggggactggttttggcgatgaatttgatttggccaaagcacgttaccacaaattgatcatcatgaccgatgccgatgtcgatggtgctcatattcggactttgctgctgaccttgttctatcgctttatgcggccagtggttgaagctgggtatgtctatattgcgcagccaccgttgtatcaagtacgtcaaggtaagatgcaacgctatattgattctgatgaagaattagaacagattttaggcaccttacagccaagtcctaaaccagttattcagcgttataaaggtctaggtgaaatggatgcgtcacaattgtgggaaacgactatggacccagattaccgccgtttgttgcgagtcgatgtcactgatgctaaggaagctgatgaagtcttctcaatgttgatgggcgataaagttgatccacggcggaagttcattgaagaaaacgctcattacgttgaaaacttagacgtttagcctaaattatttggaaagtacaattaatttagttgacagctaacactaaatattttcgccacgtgcacttttgaccttaattaaagtgcgctagctaacggattttttgaagggagttaaatagttaatggcagatgaaccacaaaatcggcgaatccaagacgtcaacttagccaaaacgatgcgaacctcatttcttgattatgcgatgagtgttatcgtggcacgggctttgcctgacgtacgtgatggacttaaaccggtccatcggcggattctttacgggatgagtgaattaggtgtcaccccagataagccgtacaaaaaatccgcacgtattgtcggtgatgtcatgggtaaatttcatcctcatggtgactcggcgatctatgaatcaatggtacggatggcacaagacttcagttatcgctacatgttagttgatggtcatggtaacttcggttctgtcgatggtgatggcgcggccgcaatgcggtataccgaagcacggatgagcaagatcgccacagaaatgttgcgtgacatcaataaagatacgatcgattatcaagataactatgacggtactgaaaaggaacccgttgttttacccgcacgttttcctaacctgttagttaacggggccactgggatcgcggttgggatggcaacaaatattccgccacacaatttagctgaagtcatcagcggattacacctgttgatggataatcctgatgcgacgacggctgacttgatggaagcaattccaggacctgattttccaactggcggtttagttatgggtaagtcgggaattcggcgtgcttacgaaaccggtaaaggcacgattaccttgcgggccaaaactgagattcaagaagaaaaaaacggtaaacagcggatcattgtgacggaaattccgtatatggtcaataaggctaagttagtcgaacggattgctgaattagctcgtgataaacgcttagaaggcatcactgacttaaacgatgaatctgatcgtgatggtatgcggatcgttatcgatattcgtcgtgatatgtccgcttcggtcgttttaaataatttatataaattaacgccaatgcagacgtcatttggttttaatatgctggcaatcgtcgataatacgccgcgcttgttatcactgaaagaaattctgcaatattacctgaagcatcaggaacaagtgatccggcggcggactgaatttgatctgcgtaaagcgaaagcacgcgcacacatcttagctggtttgcgaattgcattggatcatatcgatgagatcattcgcatcattcgtagttcgaagactggtgaagtcgcgaaatcattattgatcgaacgctatgaattagacgacaaacaagcacaagccattttggatatgcggttggttcgtttgactggattggaacgggacaaggttgaagcagaatacgcggaattgatgaagaaaatcgctgattaccaagatattttggctaaacctgaacggatccacaacattatttatcaagaattattggaaattcagaacaagtttggcgacaaacggcggactgaattattagttggtgaagtcttgagtcttgaagacgaagatttgatcgaagaagaagatgttgtgatcaccttgactcataacggctacatcaagcggttaccagcgtctgaatttaagacgcaaaatcgtggtggtcgtgggatccaaggaatggggatgcacgatgatgactttatcgaacatctagttttcacctcgacccatgatatgctgctattcttcaccaataccgggaaagtttatcaagctaaaggctatgagattcctgaatatggtcgaacggctaaaggaatcccagtgatcaacttactggagatcgattctggtgaacgaatccaaacggtagttaacgtcgctgctggtgccagtgataattatctgatgtttacgacacgcgaaggggtcaccaaacggaccgccgttagtgaattccacaatattcgtagtaacggtcttaaagccatcacgttgaaagaaagcgatgagctgatcaacgtttgcttgactgatggtaaacaaaacatcattatcgggacccatttaggttatgccgttagctttgctgaaacggcagtgcgttcaatgggccgttcagccactggtgttcgcgggattcgtttacgtgaaggcgattatgtggttggttctgacattctctcgccagacagtgaagtcttgatcatttctgaaaaaggctatggtaaacggacgccagctgcacaatacccaatcaagggtcgtggcggtaaagggatcaagacggtcaacgtcagcgccaaaaatggcccattagctggtttagcaacagttaagggtgacgaagacattatgttgatcaccaatactggtgtggtaattcgtttccatgtacgtgatgtttcgcaaactggtcgggccaccttaggggtgcgtttgatccgtgtcgatgacgaagctaaagtggcaacgatggctaaggttgctgctgaagatgaagcggcagcaccggaagaaaccattgctgatgggactgcatcaagcgcaacaactgagcaaggttcagcccaagtcgatgaattagttcgtcgtgctgaagctgatcaaaatgatgaccaagattaaatttaaagacaaataaagcatttctgcgtagtttatatatagacgacgaggaaatgcttttttgtgttgagttttgttgattgaggaactttttggctgctggatcgtttgtggtagccgaaaaattaaatgttgcacaggtgactggtaacagacttaacgtaggggtgtctgatggcaactgtctgagaaaaaaagaaaacaaagttgaaacttcaggtggtgcatgctataattttattttgtgagtatctaaggttttagattctccttgttcttacatttgggtaaggaccttaaagaccataaggaggtgaacagtcatggctcaatcaaagaaatatgaaattctttacatcgtacgtcctgatattgaagaagcagccaaagcggccttagttgaacgttttgacactatcttaagcgataacggtgctgaagtggttgaatcaaaggactggtcgaaacggcgcttagcgtacgaaattaagaagtatcgcgaaggtttataccatttagttaaggttacaactgaagacgataaagcgcttaatgaattcgaccgtctggctaagatcaatgatgacattttacgtcacatgatcacacgcgtagaagaataattaaacattataaaaatttataagagaggggagcgataggatgatcaatcgagtagtcctaattggacgtttgacccgggatgctgaattacgttataccagtggtggtgcagcagttgcttcattcactttagcagttaatcgccagttcactaaccgtaatggggaacgtgaagctgactttatcaactgtgtgatgtggcgtaaatcagccgagaactttactaattttacccataaaggatcattagtaggaatcgaaggtcggattcaaacacggaattatgacaacgctgaaggtcaacgtgtttacgtgactgaagttgttgccgataacttctcattgttagaatcacgttctgctgacgaacatcgtcaaagtactggcggtggccaaagttctggtggttataacaataataatcagtctaacggctttagcagcagtaacaacgcattcaactcagctcctcaatcaacaactaatccggctcctagcaatggtcctgccagcagcgcaaatagcaatccgaatgatccatttgcaaataatggtgaatcgattgatatttccgatgatgacttgccattctagtaactggtaatttgagggaggaataagctatggctcaacaacgtagaggcggacgtcgtcgtcgtaaagttgattttatcgctgctaatcatattgaacatatcgattacaaagatactgacttattacgtcgttttatttcagaacgtggtaagattttgccacgtcgggtaactggcacaagtgccaagaaccaacgtaaaatcacgatcgcaatcaagcgggcacgtatcatggcattattgccattcgttgccgaagatactggtatgtaaaaaggatccggggaaacctggatttttttttaccttgaatttatgcttcacgtgaaacatttttaagctgacaaacgttgatttgtcggctttttgttttgttctggcacaaactcggcacactctgaaagattttcattctgatagcactgtgaccaatccttccagtcgtttagaagcctcaatgtcactcttggggtagaggtgaccgtaaatctctaaagtcgtccgcacatccttgtgcccaaggcgatctcgaatcactaacggattctccccaagactgattagcagtgaggcgtgcgagtgccgcaatgcgtgggcagtcacagtcggcactttagccaactcaccgtagtcatggacaatatcattgatgtaggtgctgtttagcggcgcaccgtcttgggatagaacaaactccgagcgggtcatcaatcgctgatcttcgtaccactcttccaagtaatcaatcgtttgcttatcaatactggatgtaagctgattcctgagacaacttttaagagagggtataatgaataaatcatctctcaaaaggaaggaatttttacatgccaactcgttacgacaaagaattcaaacaaaacattatcaacctatataagcaaggcgaatcagctgcccaactggccagagaatatggcattggctattcaacagttcataagtggatccagggccaggccaa

SEQ ID NO: 502 - DNA, 15448 bp, Unknown
  Metagenome-assembled genome
ggcgatttaactataacagaatcgaggttctttttgtgcacttaaaaggtgttaagcaataatttagtggtgccgcgggctaacaaggttttgcggcagttaaacaggtactgtaaataatctaggttatacagtggtaattaaattaaactttctgcacttatttatgatacattttaaattctaagaacttatcattataaataccgaccatccgattacctaggtcagcgtaaacctgtaatttgctgatcacttgattgctaggataaaattgcttatcatcagcaattgctttaggcaacaacgctttggccggctcgtttggtgtggcataacccacgtattctgcattttgggcagcattttccggctcaagcataaaattcaagaacgcataaattgctttatagtgtttggccgttttcgggatcactaaattatcaaaccacaggttgctgccttctgttggcacaacgtaatgcaaatgtgaattattggccatcatttcagcagcttcacctgaccaagtcacagccactgccgcttcattttgtgccatgtacattttgatctcatcagccacaactgctttaacattaggcatcagcccttccaacttcagcttagcctgttccagctcagcaatattagtcgtattgactgaatggccttgtgagatcagcgccatccccataatatcacgggcactatcaactaacataatgttattacgcaatttaggtgaccatagatcattccaatgttgaatctgcgacccattgatcatttgatcgttataaatgattcccagtgtgccccagaaatacggtaccgaatagcgattctgcggatcaaacgaaagattacggaaataaggatcgatgttatcaaagcctttgagccgcttgtgatcgattggcaccaatagatttgctttacgcattttttcgatcatatattcagaaggcactgccagatcataattggtaccgccttgctgaattttcgtgaacatcgcttcattactgtcaaaagtttccacttggactttgtaacctgtttgcttttggaactttttcagtaatgctggatcaatataatcgccccaattgtagagcgttaacgtcccgctactggtcgcgccttgcgacttttgtaactgactactccctactgctaataaagcacaaaaagcaataatggctaaagcaaaactgactaaacgtttcatttgatcaacttcgcccccattcgattacgccggcgctcttttttcgagctattgtactgttcaatgaagtaatagccaccgatcaacaataacgagaacaagaacatcagggctgataaagcgttgacctcaagactgattccttgccgtgcgcgcgcgtaaatttcaaccgatagggtttcaaaaccattaccagtcacaaagaaggtgacggcaaaatcatccaacgaataggtgaacgccataaagtagccggtcaaaatgccaggtgtgataaaaggaaaaataacccgcgtcagtacctgaaaattagtggcccctaagtcagtggcagcatcgatcaatgaatgattcatttcatttaacttaggtaaaaccatcaagacaacgattgggatcgaaaaagcaatatgactgagcaacactgagctaaagccgagacgtaaacctaaaaaggtgaagaagatcaaaaaactagcaccaatgatgacatctggtgaaaccatcaaaatattgtttagcgataaaatcgaatttttcagccagactttttttacgctataaatagctagtgcacctaatgtgccaatgattgtcgccaacaatgaggatagtaaggcaatcaacagcgtatccaatacaatttcgatcatccgtgtatcggcgaataactcggcgtagtgctgccaagaaaatccactaaaccgcgtcatcgtcgttcctgaattgaacgagtaaaaaatcaaataaaaaattggcgcgtacaacaataagaaaaccaaccacaaataaacattgcgccaatcataccatttacgtttcattcgtggtggccccccttcttgcgccgctcaccagtcgcaaacatgatcacaaccatcgctatgatcagaacaaccccaatggttgaacccataccccagttttgtgtgaccagaaaatgttcttcaatcgccgtccctaaagtaatgaccttattaccaccgatcaagcgcgtcaacatgaagagtgacagtgacggaatgaagacagcctgcacaccagctttgaccccgtttaatgtcaacgggaaaatcactttagaaaacgtctgccagttagtcgcgccaagatcacggctggcattgaccaacgatgggttcaattcgtcgattgcgttaaagatcggcaagatcataaatggaatttcaatgtatgccgccacaaaaatgaagcttgatttggtgaataagatctgttgcggcccaatgccgataaattcaaagaaacgatttgctgctccggcttgactaaaaataccaataaacgcgtacgcttttaataacaaattgatccaagtcggcaaaataatcaatagtagccacagttgcttatggcgcgtttgacttaaccaatacgccgtcggatagctgatcagtaacgtcaccaaggtaataataaaagcataccagatcgagttaaatgtcatccgtaaataagtccctgaaccaaaataatcctgataattacttaatgtgaactggccactgatgttaaaaaatgattgataaacgatcagcaccaatggcgcgatcacaaacagtaacaaccacagaacatagggtacgctgtaaaaagcattatacttcttcatcgtcgtccccctcgtagctttctagccgggcatcaaagtcctcttctgattcaccgaagcgcatgacgtgaatatcctctggctcaaaataaatacccacttgctgaccaacttctgatttacgtactgaatggatcaaccattcattaccgaccgcatcgtgactcatgatctcataaatatcaccgcggaacacctgtgtatctacggtcactgttaatttacttttttccaacgaagtcagaactaaatcttccggccgcaaaaccacttcaaccggttcgttaggtcgcatcccagcatcagcacattcaaattgatggcctaaaatttctacttggtaatcggcgatcatacgacctttgatgatgttactttcaccaataaagtcagcgacaaaatggttgatcggttcatcatagatatcgacaggatcaccttgttgcaagatttccccgtcattcatgacgaagatctcatcactcatcgctagagcttcaccttgatcatgggtcacaaaaacaaaggtaatgcctaatcgttgctgtaactggcgtaattcaacttgcatttgcgtccgtaatttagcgtctaacgccgataatggctcatctaataacaacacttcaggctcattgacaattgcccgtgcaatcgccactcgctgctgctgaccaccggataactcactgatctcccggtcgccaaaacccgataattgtaccaaccgcaaagcttctaaaactttttcttgaatgactttcttagccgtttttttcaacgccaaaccaaacgccacattatcaaacacatttaaatgtgggaataaagcgtaatcttgaaaaacagtattaactttacgcttatttgctggtagatcattaatttttttgcctttaaattcaatcgtcccggcacttgcgtcagtaaagcctgccagaatacgcaaaatcgtggtcttgccacaaccagatgggcccagcaacgtataaaatttaccttgttctaattcaaagtcaatctgctttaacgccatcgtttccccataacgcttgtttacaccactaaacttgataattgtattggccaacttaactgtcacgctcccttttgtttacacgttatataattgattataagttataaaaactgattgaataatttaacgttaacgctttatcactgctttgaacagcatcatcaattataatctaagctgctatttttttaaaccatttaatcacttgttaaaccgtcatggaaaggattacaattacaggtaaagttattccttaaattattggccattttcgcgccatgcattagaaaacgttttaaaatacttactcacgcttttaggaggcgcactgatgaaatatcaagcacttgaactacaactaaacgataccaaagtaacaccaacctttattgaacagcaattgccagaactggcagcagatcaagtgaccgttaaagttgcctattcagatattaattacaaggatgcgttgatgctgaatgcacgtagtggggttttacgtaattatccacagattcccgggatcgatgccgctggtaccgtagtggccagtaatagcgctgcatttaaagttgatcaaaaagtgctgatcaccggctttgattttggtattagtgcacccggaggttacgctgaatttatcacggtgccggcagattggttggtcactttacccgaaaagctaacaccgcaagaagccatgtggtatggtaccgccggttttaccgccgcattatcagtacgtgcattgcttaaatacgatttttcactggatgctcccctactaatcactggcgcaactggtggggttggtggctgggctaccgcaattttacatcaattaggctaccgtaatctaaccgctgtcagccgcaatcaagccgctaccgattatctacatcagttgggcgccaccatggtgatcacgccagacgaattggctgatccacgacataaaccgctacaaaagcaaaaattcagtggtgtggtcgacgcagtgggtggcgacttgttagccgaaatcttgccgcaagttagttacagcggcatcgtcgctttatccggtaatgctggtggtaataaattagccaccaccacgttaccctttattctacgtggcattcgcctacaggggattgattcagttagctacccagcaaacaaacgtgatgcagtctggcagcaattagcaactgattttaaacctgccaatcgggaattgttacaatataaaaccattgatttcaatcaattacccacaactttagctaactttttagctgaaaaacatcaaggacgtaccttggttagcatctaaaaaatcagcagaccgacaaaaaattacggtctgctgattttttatttcacatcttcacctaataacaatgcattttctgagtaattgacatactgccgtaacttggccgctaatgcccaagaaatataaccttgctcgaccatattctggataccgctacgctccgccgccaatgctttaaaacgcagaccacgcatagtacgatcataatcagctcgccgcgaatgctggccagtttgttcgcggtgcaaatgcttgagctgttcgatgcggttgcgataactaacaatgatctggtagatcacttgacgattatagtgagctgccttggccgcaggttgtttcaagtaagttgacaacgccttgataccccctttagccgtttctttttcaataaacaaacgttcattataatacggtccattaaaacgtacccggactaacttcagccggacgtgactaaaccaagtttccacccgatgaattcgggtaaagaaatttggtcgctgtaatttatggggcaaattagcgaccatttgcaaccgttgcgttaggtgcttttgaaattgttgatagctgcgttcctgaattttaccatcctgccacagctggtccaaaacatccttctcaccttgcaacgcgattcgccgcaaggttaactcttcatctaaaaatggcgcaagctgttcttccggctgataagcggcctgcaaccgtcgcaccatttcctgatattcagtgatcagatcgtagacgacccgctgattttcagggcgccgttcgctttccaaccgattgatcgccaagcgtagcgtataaatacgcgcctcactctccgacattttcgagtcagctgttgcaactgccgccgtatccatgtcactatcaactgccggttcagtgccccgggtcgtgatcgaaacatgactgcgcgtcagtaatggaataaagacaacggccatcaataaacttaaaatgatcactccggcagcgatgaacagcattaacgcccgttcagggaatgcagcaccagaggccaacgtatagggtactgacaaaacaccggccatggtgattgcaccacgaacaccggacaaacctgacaataacgccacacttaaattaggtcggtgctgattttctttgtccttcaaccatttaatggtcacgttagccagcgtccacaatacgcgaatcaagaaaatgaccagccaaactaaaataatgtcgccaattgctacccaagtattgtcgctaggattgcgaattgtttgggtcattgctaaaggtagctcgataccaagaatcaagaagacgatcccgtttaataagtacacggcaatatcccatgtccgttcagtcacaattttcagctcgggcaaataatccaacaatgctggttgggaaaaattatacacgattcccgcgctgaccactgcaatcacgccggatgcgtggagcaattcttcaaccaccaaataaacgataaacggggtcacgatctgcaatacggtatgcagtaccacatcattaatgccttgctgcaacataaatgttcgtatggcttggatcaccgccatcagtaacatccccatcagcgctcccacaatggaaatatagaagaaatcaccagcagcttgttgccaagaaaaagccccagtcactgccgctgcgattccatatttaaagccgatcaaaccactggcgtcgttgatcaaactctctccactaaccaaatgtaacacgttgctgggcaatttagcctgctcggaaatcgactgcacggccaccggatcggttggcgaaataatcgccgctaaggcaatactggcagctaatggtaaatctggcaccaaaaaatgaataaaccagccaccgacaaacatggtcacaaagactaagaaaatcgcgttcataatgatgggtccgcgtaacgcccataattcgcgtttgggaaaatggcgaccatcgttgaacagtaacggtgcgatgaacaagagcataaaccaatctgtccgtagtggaatcgttactttaaaggctaacgctaacaataaacccaacgtaatttgaatcaaactaaccggtagaaacgtcagataatggctgatcacgttggaaataagtacgacgctgactaacatgataacggcttctaatatgttcaatggcaccaactcctttaaatgaacttcacaagtaatgtaactttctactagcttaaatgtttactgcttaaatacctgatactgacggtggctttttgacaaaaattaggcaaaaacacttggaaaaaccaatcaaaatagatgctttcacctggcacagtatcaccagcaacaccgtaattttactggcgcaataccgcctatcgctaattttcacaaaaaaagctgacctcacattgaagtcagctgttaactatccaatcaaatcttcgccgataatgcggacttcaggttccaacgcaacgccaaactggtcaaacaccactgtttgcacgtgacgaatcaaattaatataatccgttgctgtaccgttgcctaagttgaccataaatccggcgtgcttagtagaaacttggacaccgccaataatatggccttgtaacccggcttcgtggatcaatttaccagtgaagtagccggtcggtcgcttaaagatactaccacaagaaggatattccagtggttgcttagccgaacgccgtgcgttgaaatcagccatttgagctttgatcgttgcttgatcacccttcgccaaggcaaaagttgcggctaaaacaatactatgattttcttgaataatactatgccgatatgcaaaatgtaaagcagttcgacttagctcactgacggtgccatcgggtagcagaacagtaaccgtggctactgcatcactcatttcaccaccataggcaccagcattcataaacatggcaccacccacactaccaggaattccagcagcaaattcgattcccgtcaaactagcatcagccgccgcaatcgtagtatcaattaattttgcaccagcttgtgcgtaaagcgtcgtgccggtaactttgatcacagccattgaagtcaggatcagtactaaaccgcgaataccgccatctttgacgatcagattgctggcgttaccgattaccgtcaaaggcaaatgtgcagtgtgcgcgtaagtgactagcgactgcacctcagcaatgcttttcggaaacgctaaaatatcagcctttccacccgttttagtatacgtatagcggcttaacggttccgccaatttaatttcgatctgcggaaataattcggctaaggttggttctttttgcaacatcctgcacgcattcctttcgtgaactaaagtaaatcacttatatttaatttaacgtcaatatggcgcaaaaatcagactgccacgccagatcatccatccatcacacaaagtgatcaaaatctgggccctgttgcgccacgctctaatttatattttagcatgaaaaaaaaccttttaatagtctgcaactgtccctttagtttcaccttaatcttttgtagaatgagggggatagtaaaactaaacgggagtgaacgctttgaaatttatttcgtggaacgtcaatggtttacgtgcagtcgttaaaaagaactttatggaattttttgaacaacaggatgccgattttttctgtattcaagaaactaagttacaagccggtcaaattgaattgaccttgccgggctactaccaatattggaattatgccgaacgcaaaggctactccggcaccgccattttcactaaacacgaaccactgaacgtcacctatggcatgggcgttgccgaacatgatcaagaaggccgcctgatcaccctagaatataaagatttttacttactcacctgctatacacctaattcacaaactaaattaaaacggctggattatcggatgtcatgggaagacgcttttcgcagctacatcagcacactaaatcagaaaaagccagtgatcttctgcggtgacttaaacgttgcccatgaaccaattgatttgaaaaacgataaaaccaatcatcacaacgctggcttttccgatgaagaacgcgcaaagttcagtcagctgcttgccgccggttttaccgatagcttccgttatttctaccctgatcaagtgacttattcttggtggagctatcgctttaatgcccgccaaaacaatgctgggtggcgaatcgactattttgtcactgccgatcaactacaaccacaattagcggatgcagctatcttaactgatgttcttggttccgatcactgccccgtcatgctaaccactaagctagaactacaggcatagttgctttacaaagccaggatttgttcctataatagcgacacaagtttaagtatgagtattttaatgaaataggtgaaaaaaatgaacttcgtggctatggattttgaaactgccaatagtaaacgttacagtgcgtgttcgctagccttgactgttgttcgcaacgatcagattgtcgatgaattttattcgttgatcaagcctgatacgccgtttttctggcgtaacactcagattcacggtatccataccgccgatgtggccgatgcacctgattttccaactttatggccgcacatcgcgccgttattccaacgtgatcgcttgattgttgcgcacaacgctaattttgatattggcgttttacgtagtagtttagaacattaccagctaccaacaccacaatatttagcgttggatacggtccggacgagccgcaaattttatcctgagttcactaaccataaattagacactctgtgtcaagaactcaacatcgaattgaatcaccaccataacgccttggatgatagtcgggcctgcgccaatattttgttacacgaggcacaacaatttggtcctgagcggctcaaattatttgtaaaagttatcgtttaagctaaaaacgttgccactttcagtgtgacaacgttttttacttgctctgatgatcaattaatcttgccatgtgaatcaccgtttgaaagccatcttgtgcatcgtaaaaaccacgttcagatcggccttctacctgaaaatttagcttttgatacagttgataggcccgttgattacgctcctgcactgtcaattccaaccggcgaatcaatggattagcttgtgcccaagttaaaacttcttctaatagtgcagtccccagtccgtacccccagaattcgtgaagtacagccacgccgacttctccgatatgctgaatttctggtgctaaactagccgcaacccgcgccataccgaccagttgaccatcaaactccgccactagtaataaattattagcggtttgacttaattgctgtaattgtgctgcttctgcgcttactgaactatctagatcagtcgcatcagctaataaaaaaggcgtttcttggtctaattgccgcaataattttaataaagccgcggcatccgccggcttaacggcacgtaatgtcacttcttcactcatagcgtttgcgccagttgtgtaaccaaagccgcatagcgttgtccttgcggctgaaaaacaagttcccgctgctcatcattagttgcacttttattgatcgtgatctgcagatactctgctggccattcatcttcaatgaactgaggccattcgaccactgaaacaccgtcgccattaaaatattcttctaaaccaagctcgtctccgccaccattttctaaacggtaaacatccatatggtacaacggaattcggcccgcagtatactcgcggatcagcgtaaatgtgggacttttgacatattgctgaatacccaatgcactggccaaacctttagtgaaggtggttttgccagcacctaagtcaccttgcaaaaaaatcacactgcctggctggactaaacggccaacagccgcacccacttgctgtgttgcggcatcactggctaccgtatatttaaacatgtaatcacgtcctctatctcacaatttaagttacttttgttaatacaaaagttctgatgttcgtggcaatgcgacttggacttgcttggttttagcattagtccaatcgacatcgggaagcaagtactgttaggcgaatacattaatatccaatacttgctaaaaaacgttgttgaaaacgggtaacagtgaccattcttgtggcaaagttcctgccgcaagaaacatggctctatctcacgatttaagttacttttgttaccacaaaagttctgtgcccaatctgttccgttaaatttgacttcattataacaaaaaaacacgtcaccgcgaaggcaacgtgcttagttaagtctttagtcgatcagtgtttgcgctgctgtgatgatggctaatttatagacatcctcttcactagcaccacgggataaatcagaaactggcttgttcagcccttgcaatactggaccgattgcttcgaagccgccaaaacgttgggcaatcttatagccgatgttacctgattgtaattcagggaaaacaaagacggttgcgttacccgcaactttagaatcaggagccttttgttgagcgaccgctggtacaaaggcagcatcaaactgtaattcaccatcgatcgaataagctgatgctgaagcttgagctaacttagtggcttcttggactttagtcaccgcgtcagctttagctgagcctttagttgagaaactcagcattgccactcgtggttcaatatcaaataattcggctgttttagctgaagtaacggcaatttcagccaactcttcagcgctaggatcaatattgatcgcgcaatcagcgaataagtagcgttgttcacctttttgcatgatgaacgcaccacttgtgcggctaacaccgggtttagttttgatgatttgtaaagctggccgaacagtatcgccagttggatgcaccgcaccagaaaccatcccatcagctaagccagtataaaccagcatcgtaccaaaatagttcggatctttgagcattttttcagcctgttccgtcgtatttttgcctttgcgccgttcaacaaatgcggccactaagtcatcaaaattagcagcagtttctgggttgatagtttcaacaccgctaagatcaaaatgatgggcagtagcaactttttcaatttcagctgggtcacctaagacaattgaatgtaacagattgtcgtgctgtaatcgtacagctgcccccaaaacacgcgcctccgcaccttcagggaaaacgatcttaatttgcttacctgtaacttttgcagtcaaactttcaaataaatccacaatcatgcctccatttcacttgatacttcgatgatacaacgcttacattaaaaagaacagctaaatttttaagctgttggctgatcttcgtccacatgtgccggtaaacgccagtcgatcggcgtttcgccaaatttttctaaagccgcatttgtttgtgaaaatgggtgcgaaccaaaaaaaccataccgagcagaaaacggactcggatgtgccgccgtcagtaccacgtttttcgtctcatcgatcaaagcacgcttagctttagcggcattaccccagagaataaagacgactttcccgcgctgcgataatttttcaattgctttgtcggtcaactgttcccaacctttacctttgtgcgaaaaagcctgaccacgccgaaccgtcaacacagaatttaacagcagcacgccttgatcggcccacgatttcaaatagccgtgttccaccggcgcaataccgagatcatcctgcaattccttataaatattctgcaacgatggtggtaagcggacaccaggacgcaccgcaaaactgacccccatcccctgatttggattatgataaggatcttggcctaatataaccaccttgacctgactaaacggcgtccattcaaaagctgtaaaaatgtgatacatgtcaggataaaccgtttgtgtagcgtattcttgttttaaaaattgatgtaactgtgcgtagtacgcctgttcaaattctggcttcaaaacagtttgccaatcattatgaataattgttttcatactcaacgcctctatcccacttaaataatcgttttttaaccaaagttcactaataaacttctgctgttcatagtgctggccattcatgcggtaaaaatcgtaccacaagaaacatggttccttatctagtttaccgattttccaactagattgccactagcaattgccagtttgtacccaagcgataacggtttcgcctcgaccccaaaatatgctaaactaagatgaacagaaacggaggaatctgctgtgatctcacttattgcatccgatatggatggtaccctacttaacgaaaaaatgaccgtcccaccagaaaatgccgctgcaatcaaaaaagcagcccaacgggggatcaaatttattgttgccactggccgtagctatggtgaagcaaaacctttgatcgagagcgttggtatcgaggcaccaatcattgccatgaatggtgcacaagtttttgatgaacaaggcaaggttattagcaccgttagcatcaataaaaccgttattcgcaagatctttcatttgctcaaatcaaagggcttatactttgaagtgatgaccaatcaaggcactgtctctgacagtaaaatgcgccgtattcaaaacgttgcatcactgctagtcgatctgcaaacaaccgatagctttaagattgcggtctcgctggcctcagcgcgcttggagttaatgaatatcacttacgttgattcttacgaaaaactactggacgaccctaaagtgacgattctgaaggtgattgccttcagcgcggagaaacaaaaggtactacagccggtcactaaagagttaatgaccctaggtaatttagcaattactgctagctcagccagcaatatcgaaatcaatcacagcaacgcacaaaaaggtgttgccttagaaacttatgctaaaagtctaagcattccgatgacgcaagtgatgtcgatcggtgataatttaaatgatgcttcaatgctggaagcagccagcgtgagttttgctatgggcaatgcaactgaagaaatcaaagaagttgcccgctacctgacagatactaacgttaatcatggtgtcggcaaagccatcgaacgggcgatcaccgagaatttaagctagtacgtgtaatctgacaatgagagtgtgacaaaaggcgcccagctactacttcacagttgcagttgattttcatactgaaaatccctgatgtttcggacgttgaccatttttgtagtggcaatcatgtgcgccaagaaaatagtaagtccaagtgcagtgaatccaagttgtagcgccacgaacatcaaaacttttgttattaacaaaataaccgaagcagtgagatagaggtgaggttgcttgttgcgtttatacatcaaagaacaattgatggccactaaaggtgtgccgttgatcgttcgcgatgaaaaaaataatcccgtgtacttgatcactggtcgttggggcttacgccaagacgcctttactttgtatacgatcagcggtcgttacgtcgctgaaatcaaacaaacgaccttaggcctattcccccgttttgacctttatctgggtaaggaaaaagtcggcgcagtcaagaaaatgtatggtgtctggcatcaatttcagttcgtcagcgaactgaattggatcattatgggtgatctgaccaatcatcattacaaaatctatcaccgcaccgaaacgttactggtgttggataaagcaattttagccgatggtgattactatgaactggcaattacccatcccgaggacgcaccaatttgcctgctactcagtttagtcttagatcattggtccattcgacgtgacaaatcaccactaaaacgtggtgtaaccaatccaatttatgatgtttaacgttaaaaagcatgcactaccgagcaaattcagctcaggcaagtgcatgctttttaatatctaccaatacgcgtggtgctagttcgtcataaaatcaaaaaagccgccggatttacaatgtaagtgcaacaccgaaacaactagaccaaaaaggccatgaagccttaaacttataagcgacgaaaccaataagttaggacggacttcatgacccaatttaaagataccatca

SEQ ID NO: 503 - DNA, 33484 bp, Unknown
  Metagenome-assembled genome
gacaactttattagtttatcaagttaagcaagatctgtcaacaaaaagttttaaaaacttttttcaacgacacgagctataactgacaacaacaaatactatatcaacatttcgcggtagcgtcaagaaaaaaatttcgaatttagtatatttataccaaaattagctcacttagttaaaatgtgggaccccgctcatatcgatctgcgtcaataaaccgcgtaatgtcttaggatgttcaaaggtataactctttgcttgaagcgaggtaatgttctctgacaattgctgagctgcaatattcccccactcaaacacaaacagtgaaacatcctgatcctcgatgatcacattacttaactcacctaaacgtagatcattaacgttcaatcctaattgatctttgattgcagccaagattgttgccaatggtgttcgtccatcttcctgatcagccaacattaaatgatagtctgccgccgactttgtaactaagaatttaggcgcaccagttttatcgatcaacatgatcgtccccgcaacttgtttcataatagcttcctctctgcctcacttaaaaataacactttttgataatcatttaactaagataaaattgctaattgaaatccagctctgcctagtcaaaaagattattcgtgaactaactcttctagtgctgttgctacccacactggtaaccgttccgcaatcggtttaaatccagtatgctcatcgcgactagtccaatagtacttacgtcgattatgatctgaatgcgtaggtgtcggtaccaaggtacggcgcgacaaactgattttttgggtgaactcatcaatatctaatacctgaacttggatctgctgaccaacatgcaaaatctgatgaatgtctttaacgtaaccatgctgacattcagaaatgtgaatcaggccctgggtttcatcgtccaacgcaataaatgctccatacggttgaatgcccgtcaccgttcccttaacaatatcgccaatatgataagtcaatacaattcagctcccttccatttcattaagattcagttcttataaagtaactactacaaaagcaggttcaataattaatgcttgttgcacctatctatccataaatgcgtaacagccaatctaacatgatattatagctgagggatacacaggctgcaagttaactaaaaaaatagtggcgcctaagtcagcttgacctagtccaccactattttattaatctgtgatcgttacagtttccataacaacgtcgcttaatggtttatcttgcatatcacgcttaacttggctgatcttttcgacaatgtcgaggccagataaaacttgaccaaaaacagtatgccggtgatcgagccacggtgtgcccccatttttataagcgtcaataatttcagctggatagcctgcgccttccatttgttggatcatattagcaggtacatccgtattggtaacgatgaagaattggctaccattggtattagggccagcattagccattgatagtgccccgtttaaattgaaaacttcattagagaactcatctgcaaatggtccaccaaagctgctttcaccaccagcaccagttccagtcggatcgccaccttgaatcatgaaatcagggatcacccgatgaaatgttacgccattataataatcctttttggctaaggcaatgaaattttctacagtcttaggcgcttgttctggaaaaagttgaacgacgatttcaccaaggttggttttgatcgttgctttagggccggttacttcatttaatgctaattgaggatagctcattttttgacctccgcgacactagactaatcttcatctagttaatattttttatctgcatcattataacatgaacttagtactacttcgtaataaattcatgtcaaactcattgaccgccccttgttcttaactattattttgtgctagagtagcaattattgataagtttactatataggaggaggcaacattttgtctgagtctgaacatatttatgatattactgtgatcggtggcggccctgtcggcatgttcaccgcattttatgctggtatgcgccagttagataccttggtcgttgaaagcttacctgaactaggtggccaagttagtaccttatatccagaaaaaattattcgcgatgtcgctggctttgctggcattaagggtggtcaattaatcagcgcattgcacaagcaaatgaccgtctttcctgattttacaccaactgttgcgaccaatgaagaagttactgcgattgacaaaactgatgatatcttcgtattaactacgactaagggacaatataagtcgcgtagtgttgtcgttgcaattggcggtggttcctttgccccacgcaaactcgcaatcgattatgacccagctctagaagatcagaaaattttctacttcgtcaaaaatgtcgctgattttgctgataaaacagttgccatcgctggtggcggtgactctgcgatcgactgggcgctgaccttagaaggtattgccaaaaaagtttacttgatccatcggcgcgatcaattccgcgggttagaatcaagcgtcgaacgtttacatcaaggaaccgttgaattaatgacaccctatctgatcgacggggtcactgatggtcctgaactgagcctagaccttaaaaaagtcaaaagtgaagatcacgttgatttagctgttgacgccttactagtcaactacggttttaccgccgataaccacgctttacggaaatggggattaccactagatcatcgcttattgaaagttgatgcgaatatggaaaccagcatccctggtgtttatggtatcggtgattgtgtgacctatcctggcaaagtgaagttaattgccgccgggtttggcgaagcaccaactgcaatcaacgatattgcgatcaagctttacccagaacgtcgtcagccactacacagtacacagatggaccattaatatgacaccaaaacaattaaaattatacgaaaccacattgaagttgttgactcagcgcggcgtaaccctagacgctattgctgaactcgtcatgtttttgcaaaaagactatattgaacacttaaccttaccggagtgtcgcaacagcgttgaagttgtgctgcataaacgtgaaattcaaaatgctattatgactggtattcagttagacctattggctgaacagaagcaattgatgacaccactacaggaaatcattgaagccgatgaaggattgtacggtattgatgaagtaatggcgttgagtatcgtcaatgtttacggatcgatcggctcaaccaattacggctacatcgataaaatcaagccgggcattctcgctaagttaaacgctcatgaaccaggtatcctccatacttttctcgatgatctagttggggctgtagctgccgctgcagccagtcgtctcgcccacgccaatcctgaagaagaagatatttattaatacaaaataggactaaaactgcttctgcggctttagtcctatttttatcaacttggctatacgttgctacttttttccggtatactaactggacacaaaccaattaacttaaaaggagacagttatgccccaattaattgattttattttgcacattgacgaacatctagtgacgatcgttaaccaattcggtaattcaacttacctcgtattgttcttaatgatcttcattgaaaccggtgtggtgatcttgccgtttttgccgggggattcattattatttgccgctagtgcgttagccgccaatcaggccttcaacctaaacatttggttactgttagcggtgttctttgccgctgcagtactcggtgatagcgttaattatgaaatcggtaagcgcgttggtttggccgccagcaacaattcatttttcggtcgtttccttgatcagcagaagttgaacaaagctgaagccttcttcaacaaacacggtggcaaaacgattgcaatcgcgcgcttcatgccattcattcgtacctttgccccatttatttctggtggtagccatatgaattatcgcaagtttatccattataatgtactgggcggttttctctgggtggcactatgttgtactgccggctacttctttggcaacatccccgttgtgcaagataatttctcattagttgttttaggcattatcggtatctcactattaccaattattgtgacttactgccgtggtcgacttaaccgcaagccagaatcactgtagttagctttcataacaaatagacgctacatctgccataacgacagacgcagcgtctattttagttggtttaaagctcgccgaccaatcagccaagctaccaataggcagccctcaaataaaataatcgccaaaataaaacagtgcatgaaaaacgtttctggcaacacattaataattggatctgtcactggatcaaatagccaatcttgattgcggaacaacacttgatgaaaatcggtgaaaaaggtttgaaaattagctaataaaagtagcaataacccaaacgggatcacggccattaccgttaccggacgcattagttgccacaataacttttgacgccgcaattgacgcaagaaatagacgcttagcagcgttgtgactactaaaaccagattattcaccaaaactaattgttttacgtcagcaaaatgctgcgctcctgcatatgaactaggaaaatcactcatttgtaaatgctgcacccagggaaacatcacataacttagcatttggtgataattgcgcatcaagcgggcaacactcatcggtacatcagtcaggatcccgagtaaatggacatccaaacgatatagccaagttgagccaaacgttaacaaaatcacccagctaagcaaacagaaaaacaagcacacccaccacaggccgcgcttgatccgatagccggctaaacttcccattgatctaaattctcaacttcataagtcggtttaaccgccacttgctcaatatccgccggcttggaataaccggtataaaccaacaaggtatccacaccagtattaatccccgccataatgtcagtattataattatcaccgaccatgattgcttcagacttgtctaaaccaaaatgcgccaaagccgcttccaacatgattggctccggtttacctacataagtcgccttttgctgtgttgagcgttcaactaacgcaatcactgagccagcgccaggaacaaggccacgctcattcggtaaattagtgtccgcgttagtcccaataaatttagccccgcgctggatggccaaagttgctttttcaaacttacgataagtgacatcccagtccaaaccaaccacaacgtaatctggccggtattcatcaaaggagaagccttgattcaaaattgcttgtttcaagcctaattcgccaatagcgtaaaccttttttcctaagtttaatcgcttcaaataatcagcggtagctaagccagcagtataaacgttttctggtgcaattttcatgtcgtaattagccgttagattccgggctaccgtttcaggtgtttgcgttgtattattcgttaaaactaaaaaagggatcccggctgcctgcaaacgtgcaataaagcgcgccgccgctggaatcttttctttaccgcgatataatgtaccatctaaatcaataaaataagccttatatttcttctgcatgctagttatttattcccttcacaattaatgcactttcttagttggtttagttgccttttgctttctgatcgtaaaatggcgtttgcgcggcgatttattattagtctccgcccgcacatttttacgtttcagtggatcagcttgctcacgccgttcactagtgtgtgcttgttgccgccgtcgtggtgaacgtgtccgccgccgttttgagctattaccagtactattgtctcgtttgggcgtacctaaacgctgcaacacaaaataagcacaaccaaaattacaatactcatataaataatcttctaacgttgtgatcaattggtcacggtgggcccgcttattattttcagcataaaaaccctttagccgcaactgttcgtagccccaatcgccgacgatataatcatatttcgttaaaatatcactaaaacgagcagccaacttgtccttatcaaagccatcatggtaattagccaccagttcatacggccgaccatcgatcgtcaacatattgtccgattccatcaaaactcgctcaatttctggcgtatcgtcagtttgaacggctgcggtgatctcagcagccaaattgatcgtagctggcctttcagttgctttaggctgttttttttcagtgttcatccgtgcacctcactttaactcactatgctttaaataatccgcaatcgcattgcgtaaaacgccagggaaaagcacctccgtttcaccaacaatttcaattgtcgggaaaaacggaaaatacaaataagtatccaccgcggccatagtatagacacgatcgggatctagtggctggccacgccatttaaccgtacggtcggccgaatcccagctcaacccctgataaaccatgtcgccaaataacttaccacgaaaacccaatccatgcaattcaaagtggcgtaaaaacaagcgcgctttttcgatttcttgcaccaagcgccaaacatcatagccgcgtagccgaatacgcaataaatgcatcgcgtgcggtaaagcttgatgtagatcatcagccgtgatgatgcccttcttaaaaggcgctaaaaatattcccgtattcaaaaaggccacatccgtcccagctgcctgagcaacggcgtgtaaagcaactgtcatttgcggtgaattccccacaggttgtgcgctcaatgtttttgataacgtcgcaattttttggcgctttagttgttggtgcccatggcgacgataaccagcaatttcagcacgatcacctggtgccaccggtaactcactggttttaaccacgccggcctgccttgtcaacacacgatggtgggcatcgattgttaatgtaatatgaccaatatactgcccatagcgacccgccgccgctaacagcgattgattaactaataaaccattgatcagcaaatgatgggtgtggcttccaataatgacggtgattgctggatagtttttagcaatccatttatccacatctaagcctaaatgtgacaatagaactaaaacatcggctttacccgctaactccgccaacaactctggtaacacttgttgcgctaactcaggttcccatccatttggccgataagtcgaaatatacggagctgtcagcccaaacaaagcgatacgtgtaccagcggcagttgtaatgatcttagtccgcaacgcccattttggcggttgcttcgttttccgatcccgcaaattagctaaaacaacgtcaaaattagcttgatcataaagctgatttaactgctcctgtgaattaccaataccttcgttgttaccaatagtcaccgcatcgtaaccaatttgattaaacagtgccacgtttgcgcgaccgtcagttgcctcggtcaaagggtgaacccgatccattgcatccccaatatccaacgtcaccacagttgacccgctttgacgcaattttgtttgctcagctaataaccaacgccgaattcggggccagtgttccaagtgtgaatgtatatcattcgtatgcaaaatatggatactttccgtcatgactaatactcctctactccacaattaaggtagataattagccaaaaccactaattacccttgatgctgcaggcgatgtccattcaactaaagcaaaacctgcttagttgaaacatggcgctactccacaattaaggtaggtaattagccaaaaccactaattatccttgatgctacgggcgatggccattcaactaaagcaaaactcgcttagttgaaacatggcgctaccacaaattaagatctgctttattagccccttaaattgcttattcaaaccaattcaaatattacactaatattagcttagagtgaaaagcaatcagcgtcaagtcacttactctgattgcccatattgttgaaaaacgcgcttaaccgccgcaacctgatctgcttgcaacagcggcaataattgtggaaataaactatattccagataggccaacgtcatctgtcccgcctgatatttgatcagcgcaagctgcaaaagatcagctacaacttgtttattttgcggcagcgcacgcgtcgtaattgcttcttgaaatttgatcaatgattttactggtactgtcataaccatccctccaaaacctaacttattttaagctaatgataatcgaggtaagattaaaaatcaatgtgactactaataaaaaattaatttttgtgttgcttcgctaatagcgccgctttttttgtgtaaatttcgaaaatttctgccaccgataatggtgttccaaacggtaatttatgcgccaacaagtccaattctggtgcgtccacaccaacattaatattttcagctaacggtacactagaatgatgaatatgcccgtgtaaattcatggtttgcttaactatgcccatcattaatggataatgcgtcataaaaaactgaaaatgattagctttgatcaaaacaccaacatcgtgaaactgaaattttggtcgtcctggagcgatcattgagttatgctttgccaaaaacttgaacaaagcacgattatcatggttccctttgatcaagatcaactgcccatttaattgttgtaaaacttctaatacttcgtcattacctggataattacttggtcgcatagcaatatcccctaaatgatagacaatatcgcgatcagtaactcgctgattccatgctgttataattgcttgattcatttcttcaaccgaatcaaacaaacgcggcgcaaaatcattgttacctaataattgttcatgaaaaaaatgtgtatctgctgtaaagtattgcatcgaatcacccacttattaaaaccgtttcttcaagcataaccttaatcaactaaaaaaacagcgaatcagatcaatttcacaataaaaaaagaggttaaagcaaattaatatttgccttaacctcttttcgatcatatgactgtccaggttgggttcgaaccaacgacctacggtttaacagaccggtattctaccgctgaactactggacaattaataactcaacatataaatttatatcatattttcctcattattgcaaagatttatttagaaaaaaatcagttaattattattaattacatgaatatgctataaacaagcactttgtatatgaaaaactatgagaaaagtttcctgcattttctcataaaattaaccaacatgattttcacgaataatcgttttataatcctgttcactttgggcatttggttccggtagccattcctgccactcagtaaaatcctcagctggtaaagtaaaatgctcatttaaatatttttcatacgccacgactgcagttgaacggggaatatttaactgaataatccgtacttgcttaattaaaccacgaatcgcggctaattcagcccgtccattcatcaacatattacttatatccaagtaagttgttccatcattacgcataatttcctgaatcaaatcaattgttatcaagtgtttttcccccaatatctaagccagcaatgcaactgtaaaggtcaatgtcgctaaaaccactgtcagtttgctcatagtggcgtaaacgcccttctttttggaaatgattatgtgtcagcacacgttgtgaagcaatattatctggcaaaacgtaggcttctaaacgctgcaactgtaaatgttggaagacatcagccgccaatgcacccactaactcagtaccaaaaccatggtgccacgctttagttaccaactcataaccaatttcagctcgttgcaactgccaattaatttcattataaccacaagtgccgatcaggcgttgttgataccaaataccataccgcaccgcactatcgccatcggccgcttgactaaacagatcaaccatttgcctagcttcagcaattgattgcattggttcaatgttcataaaatgtgtcacttgtggatcggaccacagttcgaataaagtcggcaactctgcagttgttaaaacgcgcaactgtaagttggtcgtttctaaattttgtgctaagcgcatcaattttctcctatcccacaattaaggtacgtcgttataaaattcgtagtttaaaccgttcgctgcgacttattgctagctcatttaatcgaccgcgataagtaagtttgagttagcaaatccctaaaccaactaatcacattgttgcgattgcatagtagtcgctggcataagcatatgcacacaccaataaaacattaatatcaataacctattctagttgcttttacgtcacttgccaagtcccttaaaaacaaaaacatatagatgatagtgactttggggaaaccacctaaaaaagtcatctataacaaccttaatgtaaaaggatttatagatgactgcacaaaaataaccactgtctgcggaacagtggttggcataagagagaaagagaattgatttaaaggtaatgatgaaataccttacaagatgaatatacccgtttataaattaattgtcaacgattttttgtaactgctttcaaatcaacgaaataaaaacacctcctgggtgtgtggaggtgtctttatccgcattgatcaataaataatcaatcggttttaacacagtgtgttagaggaaataaataaatggttatctataaattagcacttaaatgtgagaaagtctagtttaattttaatttaatttaaatttttctaatcaaaatcaaattttatcgtcagttaataaaattggtgcctcacccgttgctagtggtgctgttaatttaaatgtttgcgtaaaagtgtaatcacgtaacttcaataaatcagcctttaaagtttcatattgtgctaatgtcattactgcttgataatagcccgttacatatttaccctgatactcaacttgcaacaacgcttttttattatcagttgttgtggttggtttaaaacctacttgtgctactcccgtattaacggccggaactagtaaaaataaaagtacactttcagcattaggatcatcctttgtgatcagttcgcgtaaatcagtttcgttttttacagctactttcatatttaaagttccttcctctgctaaacaacatttagtcaaatgcatgtaaacattgcgtgatcaaatcaacaaattttgtccgatcaatatctagtaagatttcagcattgattggcttaccggttagttcataataatcaatgatcgtctcgccacgtgtcaatgtaccagtagtttcaatatctaaattacgctttacggtgtcaaacaatgttggttcgatcagccaagcaatcgtacatggatcgtgcactggtgtccccttgaatccccactttggctggctgtagtaaatatgatagaagtccagcaaatcagcaatcgctttggcaactgggttaccaatttcgcgaaatgcagtgacatcggcgggcagaatctgtgccttatgggtcacatctaacccagccatcaccagtggtacgcctgtatcgatcactaatttagctgcttccggatcgacaaacatattgaattcgacttgtggggtccaattgcctaagcccattgcaccgcccataaaaacgatctgcgctaatttatcttttagttctgggtgaactgacaagaataacgccgcattcgtcattggtccggtaacgactaaggtcactggttcatcactcgcacgtaacgtttgcgcgatcaattcaaccgctggaatcggttgcgccgcaaaggcaggttcaggtaattcagtcccatccaacccagtttcaccatgaacactttcagcaatctgtagattttgtaataatggcttttgatttcctccagcaactggaatatccgtctgccctaatagcgtcaacatacgcaacacattattcagcgttttttgcggtgtttggttccccgctgacgctgtgaccgccaacaaatcaatttctggggacgcaacagccatcattaacgcaattgcatcatcgtggcctggatcacaatctaaaataatcttctttaccatttatgagcacctctacttcactattaaggatatttattagccaaatacgctaataaattctgatgttacgaacgatgtccattcaactactactccgtaatcagcgtgagttatttgcaaagtccgcaaatatcttttaatactacggacgttgcccattcttgtggcaaaacccctaccgcaagaaacctggcaaggcgagatgcgctgcgttgaatcatggcgctacttcactattaatgacacttagcgaggagcgtcactatttagtttaagctttaagatcacgataatttggacgttctggcgcttgtaacactttaggaccatcagcgtagccgacgatgacggtgttcacaacatttaaaaataatccgtgttctacgatgcccacttgctgattgaggtactgtgctaagcggaaagcatcatcgatttgacctagatgtaaatcgatcacataatttttagaatctgttaagacgcgctgcccagcttgctcccgaaatgcaggatgcagacctttagcagctaaacgtttaaataattgttgactaccataggggatcacttctaatggcaacggaaaactacctaattttggcgccattttggattcatccacgatccacatattgcgtttagaattgattgccacgattttctcaaataaatgagcggcaccgccacctttgattccttgaaaatcagcatcgatctgatcagcaccatcgatcgttaaatcaatctgatctacttcatccacagccttgattggaatgcctaacttacggccttgtgctgcagttcgatccgatgtcggtacaccgacgatctttagaccttctttggcgacacgacggcctaaggcatcaaccataaatttaaccgtactgccagttcctaggccaacgaccatcccgtcttttacataagttgcggctagatcgccgaccatttttttcagttcatcttgagtcatcatttattcctctctatcaggcaattttagttatgggcaaataaagcagttaagcgatgcataaaacgttgtaaatacttcggtacatccacatttacggctacttgaacgttagtggttggtaaatcaagacggtcaacatccccaactgtccgcgcagcaaatggcgcctccgtttcaactttcatattaaggccgattgtttggactagacttggatccaaagctacgcccactgctaaaggatcatgtagcgcacaaccatgtaattgcggattcaatgcagcatacgcatcaatataataatcgacgatattcgcgaaagccacactagatttcgtgccgagatcacgccataattgcgtttcttttttagttaataaggtgcgcaaggtaacatccaagcccaccatcgttaaattaaacgggctccgcagaacctgatccgccgcagctggatcttgattaatattggcttcacctacctcagtcacattaccaggcacagtcagcgcaccgcccataaaagtaacgttgccgaccaaagccgttatttctggcgcttgggctaaagccgccgccaaattagtcatcggtccagttggtacaatgatcaagtcgtcaccatattgacgtgctgcttcgatcatgaaatcaaccgctgatttattctctactgcacgttgggcagttggtaagctcacctcgccaataccgttgacgccatgaatgtctttgctaacctgcataacatcgaaatgatcagtcgtcgatgaatgtggtaagcctaagtaaacgggaatatccgtccgccccagcaactctaagatccgcaaactattttggccagcttcagctgtaaccacgttaccgtacgtgctggtaataccaatcaaatcaacctcatcgcttgctaacgcataagcaattgccaatgcatcatcgatcccagtatccaaatctaagatcatttttttctgcgccatcattattccctctttcattaaccactaagccgttattgttccctctttttcacgctaatcatacataaaaatcatagcatagcccctgagcgatttcaatctacacagaaagcgctttattttagtgctaaataaaaagttagcccgtagactaacttttaattaaaacctaattttaaattgtaagcgttcgctcatggtttaccaaacgaaaacaccgacgatccccgctgacagcaaggaaactaaaataccggaaagtaataagtaaccgacattagccgagatcaaatcattcttttccttatcaactaagcccttgaaggcaccgataatcataccgaccgttgagaagttagcgaatgaagttaggaaaaccgtcaacattgccttaaaatgtggcgcatagttgttgattgagcctgttactttacccatgactacaaattcgttggttactaattttgtccccatgaattgagcaaacttgaaggcatcgtcaacgttcaacccggtcaaccaagcaaatgggaacatgatgattcctaagatgtgttccaacgttagccaaggattgatcaacattaagattttatcgattaaggcagctaaagccacgaaggcaataacattagccgcgatgatcaaaataagacgaccagcacctagaatggaatcacctaagaaggagaaaaatggttcccgtttagctggagcgtccgtatcactggcatcactactgttactcccagtcatccgcgcaatcgtgtcttcttctggcgtaacagttagtgggttaagtagattagtcacaataatagcgttaataatattaatcggtacggccgttaaaatatattggcctggcatcatctgtgtataagccccaaggattgaagccgtcacacaactcattgacatcatcgccaaggttaaatcacgttctgccttcatttgtttcaattgtaagctagaaacagccaaggcttctgtattgcctaagaacatcatttcaacggcgaaaaatgattcaaactttggttgaccagtaattacagctaagccacggccaatccatttaataataaaaggtagtacaccaatataagttaaaatatcaaataatggcacgatcattaaaattggtaatagtgcgctggtaacaaagtccatctgcttaacgttgacccagcttgctaatgcaaacgcgatcccttcataagcaacatcaactaaccagttaaagccatctgcggccgccttaacaatatcagtaccaactgagaaactggtaaagaaccaagcaataacaaggtttataactaacattaaaataatcgaacgccatttgatgttgcgccgattctttgagaaagcaaatgcaatggcgagaaaaataaagatcccgacaatattgacagctaagtacatcccatatccttctttcttttattttacagcagtgccagccggtcctcccttcaatactcaacaacacttgagcaacaatctgaaaatagtatactagaaaagcgacgggaaagacagtacttttctacagcattgcccggctagctaagtttacattcaatttgcaaatcagctatactggagcaacggcttaaaacgcctaaacgttttgccaaaatttttaggaatgtggttttatttcattgaaaaaaattatgattctacttaaattacccttgattaaattaccgctgagcctattattttgtttcggtagttttttgattctcagtggcttcacagtgatcggccaccgtggtgatcccctgcaagcccctgaagagacatttgaaagttttaatgacgcgtttgccgacggcgctaaatatgcagagttagatctgcgggagagtaaagatggcaccttaattatttcgcatgattccaatcttgagcgtgtcagtggccaagacatcagcatcagtaaaactgattttaatcaattacaacaggtcaaacaaagtaatggtgaatcgatccactcactagcggaattatttgcgtattaccagaaccaaccacagacgcgctttgttttggaaactaaaaaaagcaaaaagaataaaccgactgatatggaagctaaggttgcggaactagtgcaacaatatcacatggaaaatcgggtcatggtacagtcgttttctgcagctagtgtcgtttcctttagtcaattattgccaacggtcccgcgctatttactggctaacgaactaagtgatattaattttgacaccttgcaagtcgtcaccggtattgatattgatgctaccttggccacgccagcatttatccaacaaatgcacgcgctgaacaagcaggtactggtgtggagtgatattgaagagcaagctagcgcattagccaatattagtttgaccgatattgacggcatcgtgaccaactatgctcaactcgccagtgcctataatcaagcaaaaagtacgacaaccatgtcgcccttagatataactagtgccacggtcagtgcgacgcatgccgttgctagcgtgaccaacccttatttaacgttaaatgctgggcaaccgttaactgcacagcggacctattcattaagtaccttagtcaccaacccacaacatagttatgccgcactcgatcagcaacgctgggccgataccgactacttaaattttggcagcgatgccttattagcggtcccttacctcaatggttctgccagcctgcgttacggtcaaactgcgctaccattagttgctagtcccagtgcaccccaacaagtcgttgctcatttaataccgggcgaagcagctaccattaccgccgttaaactaattaacggccgcccatggttggaactcaatcagcatggttggttaccagccgaacagacttcgatcactttagctactggcgaagcgcaaatacagtaccaacaattgttaccggacgcaaagctgactaatattaaattaccacgtttacgtgattatttaccgctgacgcaggcaacactaccattaagcactttacaaaaatatttactgactcccgcacccgtttatctacaagtacaattccaaccacaaaataattgatggaggcttcttatgcaaattcgccatgtacaaccaactgacttatcaaccttgattgaaatcgaaaaggctggctttgccccagcaaaagcggctactcctgctgcttttaaaaatcgcattgatacgatcagcgacacatttttagtggccactgaacaagaccaagtgatcggttttattaacggtccagtgatcgaccaactttatttgaccgatgatcttttcacaaccactaagcctaatcccgttagtggtggctatcaaagtgtcctcggcttagcggttgcaccagcttggcgtcatcacggtgtggcccaacaacttttaagtgaactagcccaacaagctcagcagcaccaacgacgcgcagtcactttaacttgtgagcatcgattgatcccattttatgaagctgccggctttcacaatgacggccaatcagcatcaacgcacggtagtgttatctggtataatatggtgcaggccctgaattaaggacttttatcggtaaactagtatcaagaataataattttaactgtgagatagaggaggcctttacgtggaaaatcctgttgccccgactgccttggtgaccgctgtgcaggaggcgattccagatgatgctgttttagcgcacatcacaacgttatttaaagtcctaggtgacaagactcgtgcacgaattctttacgccttatacgaatccgagctatcggtctccggcatcgttgcggtgttggatatgtcgcaatcatccgtttcacatcaattacaaacgctaaaacaagctggtttagttaaaaatcggcgtgctggtaagatgatctactattcattagccgatcaccacgttatcagcatctttagccaagttattcaacatgttaatgaagatcaaaattaagctaagtaaccgctggtcagttgcttagcttttttggtaaacaaaaaagctgctaatgcagcttttcatattttacattcaattacgcttccccgttccattcggctttaaattcagctagaaaagctaacattacttgctgccgttgtgcagcaatttttttagcacttggtgtgttcatgctggcttgcaataacagtagcttctcataaaagtgattgatcactggactttgctgccggtaagcggctttatccatctgggttcgcggcttgatggctggatcatatagcggtgccccagtgtgaccgccataataaaaagtacgtgcaattccaattgcgccaattgcatctaatcgatcagcgtcttgcacgatctggccacttaaaggtaaggcctgtttatgtaccaaatttttactgaaggacaaacgatcaatgatcagccaaatttctgtttgttgttcatcgctcacttgttccgcagctaaaaagtcacgcaactgttgccgggctactgccacgtcagcgacaactttatcatcgatcacgtcatgtagcgttgccgccaataaaggcacaaacgcagcgacgtgctcttgctggcaaagcgtcttcgtcaaacagaccacacgctgaatatggtcaatactgtgcccgctatgatcttgccctaatacttgctgcatataagttgttgccgcagccaattgtttctgttgtaactcattcataatttaactcctctgctcagcaaaagctgggcctatttatttaaatattgttcgcgtgtgatggcgtgtagacagccgtcgacaaactgatgacgcatcaaaatagtctgatgtagtaccccttcctgctgcatccctactgcggccatcaccttagctgaagcttgattttccggttcatgcaaggcatagatacgctgcatacttgtttggtgaaacagcatatccaacaatgccgtcacactttcctgcatataaccgcgatgctgataagctggattaagtacatacgtcagactcgctttacgattattttcatcgatatcaagcaattgcactgcaccgatcagttgattattttcatttaaagcaatgccgtattgtccggctggtcgtgccatgaaaaaatccaagatggcctttttactatcaaccaagctatgattgactggaaatacgtagtgtgcggttgctggatcactggcatagtcaaacattgcggccgtatccgccagtgtaactggtcgtaatttaactcgtgacgctggcacacttggttgctcaagtaactcctgtaccaaaactcccatcaatcagaccccttttctaattaaagctgtgtttttaattgcctaattggtcaaatatgatacgctgatagtgtttattttatcttatttggaagcaggtgcaacaacatgacgattgattgggaaaaagaagttaaacaacgcgaaccagaaatgttagccgatctcgcggaattaattgcgatcgattcttcacgtgatgatgaacataaaacagctaccgcgcctttaggcgaaggaccacgggatgcactccgcaaagtgctctcatttggtgaacgcgatggttttacgactaaaaatattgataacttagctggccgaatcgaatatggcgacggcgccgaagccttaggcatctttgcacacatggacgtcgttcccgctggtgatggttgggatacagaaccatttaaattaactgaacaagacggaaaattgattggtcgcggaactagtgacgataaaggaccttcaattgccgcttattacggcttaaaaattgtccgtgacctgggtttaccattgagcaaaaaagtgcaattgatttttggtactgatgaagagtctgattggaccggcttaaatcgttatcaagaaacacaaaaaatgcctgattttagtttttcgccagacgctgaatttccgatcatcaatggtgaaaaaggaatcactgatctaaccatcaagttccctactttggcgcagagtacaacggcagctttgaatttgcaaagtttcgaagctggcttgcgtagcaacatggttccacaaaaagcaaccgcagttgtaactggcgctactgaactgaatacggcttttgatgcctttttagctgctaatccagttactggtcaaattactcaaaatgacgaccaaacaacgatcactgtattaggtaaagttgctcattcaatggcccctgaaggtgggatcaacgctgccacttatctggctacgttcttagctgaccttaacttagatcaagctggtaaagcctacgttacggtgattaaagactatttccatcaagctgatcgtgggcagcatttaaacatcgcccacacggatgaaattatgggtgatttaaccgctagtcctgacttattccattatcaagtaggacaagtacctgatattttattgaatgtccgctatccaaaaggtattgatgccgcaacgatcactaaaaatattcagcaaaccttggctgaatatcaagttgagatcactgccagcgctcattcgatgacaccacactatgttgcacctgatgatccattggtcgcaaccctattgtcggtttttgaagcacgcaccggccaacccggtcatcaagccgtcgttggtggtggcacttatggccgactattaaaacgtggggtcgcttttggtgctttgttcgatgaaaccaagaacgttatgcaccaagcaaacgagtacactttaaaggctgacttcttgaaagcagcggcaatctacgcccaagctattttcgagctagccaaataagcataaataaagacgcctattactaggcgtttttatttttcctttgaattgatgatttttgacttgtcgtactaaaaaacgagaatgtgccataaggcgcccaattactactttgctaataaggttgagctatttgcaaaaaaacacaactagctttgatgctgcgggcgctgacattctcgtggcaaaaatcataccgcaggaaacatagcaaggcgaaaaccgccaagtggaaacaaggtaaacggaaaaagttgccttatgtcacacgttttagctgtattatttggaagtaaaagaaggagttgaacataaattacttatgtctcaactccgttttttacacaattaatttaacagcgcaactccagcagtcaagtaagtcgcaaacaatagccaaagtaggtacggccacagcagaataacactccgctccttggtttgctgaatcagccaacctaacaaaccgaccatcactaagataatcaatagtcctaaccaataggcattaaaacggaaaaagacgatactccataaaaagtttaaagtaatttgaccaccaaataataaccaccgtaaattagttgtacgtgttttactggtccacaaatgataggcgtaaattcctaacagtaaatatagtacaggccagacgatgccaaaaagaaacgatggtggtgccagtggtggtttattcagtccgaggtaaatagctttaatatcaccagccaaccagctggaaagcatcccaattaattcaaccacaataattgaaagtgccaagcgaccccattttattttgctcacaacatcagcctccttcagatttaataatgactctaattcagcttaacaaaatgttgggaccggataaaatgatatgcagacataaaaagggatggtccacaacgaaccatcccttaaccaaactaacgtgaaatcacaacgactaataacatttcgctgtcgatactgtcggaagtgttgatcggcgttaacttaacgtcaactaattcacgatcctcttcactgacatccaataacactttgttcaaccgcttttccaattcctggggataagtggtaaaaaccttgctttgataatgcatttacttgcttgctccttctaataatattatgctaattagagaatgttacggctagcatccgccaatgactgacatttactgtcttgacattaatagtggtataacaacataaaacgttccaacaaaactagcgtttgctcagtaaatttttgttgtgcggcagccaattcttcagtgaaaaatttttcatgtactcggcgccaataagctaacgtccgatcaccctcaccttcggcaaaggcgtgatcggcactgacatcacaaaaaggcactacatcaactgcagtagtccgaatgattgcaaccgcctgctggtgaccgtctaaaatcacgctatagtcaccaacttgcggtaaaggcatgttggtcagtccgtataacgcataatttgatgctgtcgcggttttcttacgcttaagcactaaattagctaagtcatcggccatttgcggtgttgccccaaatgaccaagcatcaaagtcagctttgacttcaggatgctcggtaataaaggcgtgccacattttgattgctgattcattttccatattgctgctccctcattcctaatctaattataggaaattctaacagctttgacaatcaacgatttacagtcaaattagcgatatactgatttaagccacctatcaaccattaaattacaaagtagaggcgataaaaattgaaaaaatttgaatactatcatcccatgatgagtgcccattacactctagattggctgacgcaaaccccattaaaggtcattcacgccgccattccgactgaacgctcaatgaccgaaatggctcaggtcgtcagtaaagcaatgcaactggtcatgcataatcaagctctgatctggggcatcgtgcaacgtgataatcaacaatttgctggtgtagccagtttgtcgatcgacacagtcgcacaatgcgctgaactcaagtttatttatcaggcggaccgcttgcctgttgctggacgtaatgagatcatcgactacttggccgcatttacgtttgcggaactcgaattacctcattttgtgatcacacttgcggctaccgataacgcactacgacaaaacttgatcacgcaaggttatcaaactactaaacagccccagaagctaataaaaaacaagtaacttcaaaaaagtcacctgtcagcggttacagaaagatgcgtaaattacgcttattgatcacaattgtttcagcactagtctgcttatggtgctgccgcaataagtgtttcactaattgctgtaatttaccgtcgtcttcttttagtttagccagcacatcagtattgattttgagcactaatttctccttggtgttcggtacgtcgaccgtgacttgttttgttttcaaatcggccggatcaaacttatgctgtaaaaaatcttgccatgtcacaaaaaagcccccttttatctcattatagaccatttaacataataaaggttatgttaacttgatattgatcaataatttgtgcacttttttaattgatcaagtccattaaatccttatccgaacggagtctacggtaatgtcaactcaagaaaaattattaacgcttttattagaacaccccaccgaatatctttctggtgaacgtttaggccaagaactaggtgtttcccgcactgctatttggaaggccattcaagccttaaaggcagctggttaccagttagaaactaaagcacatcaaggttatcggtaccaatcagccgatattctgagcgcaccggtgattcgccaggatttagcacctgagttagcgcaaattcctttgaatatttttccgcagttaccttccaccaatcaaactgccaaaaaagcagccgctgacaatgtagctactccccaaatttttattgcggatcaacaaactgctggctacggccgttacgggcgaaattttgtctcaccggaacaaaaaggtatctatatgtcgctactgctaaaacccgctcatccattgactgatgttggcttattgaccactgccgtagccaccgccgtttttcgtgcaatcaaggcaacaactggtattgtcgtcgatattaaatgggtcaatgatctttattatcaggataaaaaaatttgtggtattttgtctgaagccatcactgattttgaaagccaacagatcagtcatctcgtgattggaatcgggcttaattttgctacgacccctttgattcctgctgaactacagaataaggttggtgcgctttttcaaagccaaccatcgattacccgtaatcagttgatcagtgcgatcatcacccaatttttcgacctttatcagacttatcctgatggtgcttttttaaatgaataccgtgcgcattcacttttaatcggccgtaaagttacactgcaacaaggtcagcaaaccattaccggtactgtcaagacaatcaatgacactggtgaattagtgttgattaccactgctggtgagcaagtcttcggttccggtgaagtcaccaaagttcatttttagggtccaagtttcaaagtggcagtcccttcctgaaacatgttaagctgaagttatcaaataactggtacttaaaccaaggcgttctaggatcaatcagctaaagcgcataaacaggaggtaaccttatgaccacaacaacatttactgatctcaaaacattgctcagcgaactagatcaaggtccctttgtctcactttacttttcgatggccccagcgcggcaagccgataaaaatcgcttaacgatcaaacaactttttaaaagtgcagccactcagtttagccaggattttcctgacctagattggcaaccctacgaacaacaactaacgccattattgaccgatattccttattggcaagatgagttgccaactagctttggtatcattactagcgctgcgcacaccacggtattgcgtttagatactactgttgaatcacaagcttgcgttagtagctggcccaacctattaccacagattgcggctcaacaattagcttttaactttgacttattgtgcttaaatcaagatagtttccaactattccaggttaatacgggggtcccagaagcaatcagcctaccggatgacgcgccaacgacattgcaaaaagctctgggaacagaagtcagcggtggcgaccttaatttccacgcacatacagggggtcatggcgaacacgttagctaccacggtcataacactgctgacgccgaaaaagaaatcgatcatcgcaactattatcaggccgtagccgattatatccgagaaataacggccaaacggcggcgggcactggttttattcgcactaccagaaaatcagagtctctttcgccccttagctaagaatatttacctagcagaacatttaacgatcgaacgatcaccgatcagtttaacgaacagtgaactaaccactgcgcttaaaccactccaaactaaatggcaagctgaattattatcgatcgttcatgaacgatatgacttagccgctaaccaaaaactgatcgtaagcgaaccagaagaactgcgcaatgccgctttagctggacaaattgatacattattgattgatcaagcccagttgactggtacaacaccagattggctattagagatctgcgaccaagtattacgctatcaaggtcgcgtgcgcatcttcccaacggcagattatccagctgctgaagcggtaaccgcaatcaaacgttaccgttaattcgtaacatgtataaaaagttaccttggacaaatccatcaaggtaactttttatttgcgcacagtttaataaattcttaagtctactcacttatgacccattttattgtgttaattttggccgaagtctttcattttgattaccattaccaatttttcggcgcaaataaaattcaatctgttataatacgtagagtatttagatttttaaggtgggatgatgttgaaggaccatagatctagaaccgatcagcgccaacagcggcgacctgatgggttctttccgcggctagtacagctgcttggccgaatatggcattacataaaacggcgtctgagctttcctgacgtcatactaaaagaaacggcaacaaccaaagaaacaatcttttattatctcgatattagtatcagtgtcgcccgtagtttactgttacacttgctatcatttgggttagtcgttggtgcgctggggttaggcttaggtctcggttactttgctgccttgatcagccacgataacattcctaattacacaacaatgaagcgtgagatcaatagtaattatgaagcatcgaatctttatttcgctaatgatgtgcgtttaggctcgatgcgaactaatttagttagtcagtcggtatcgatcaatcagatctcacctaacttaactaaagcaatcacctcaaccgaagaccaatacttctatcaacataaagggatcgtgcctaaatcagttttccgggcactcctgtctagcttaaccggtattggtgttcaaactggtggttccacgctgacccaacagttagtaaaaatgcaaattttgaattcggaaactacatttaaacgtaaagcaaccgaaattctactagcattacgggtcgacaaatacttttctaaaactgaaattttacaggcttacttaaatgccgccacttttggtcgtaacaataaagggcaaaatgtggctggggtcgaagaagccgctgaaggcttgtttggtgttcacgccagtcaagtcaatgtggctcaggccgcctttatcgcgggcctacctcagagtccatcggtttatacgccttatactaacaccggtaagttgaaaaagaacatcgaatacggcctagaacgtaaagatgtagttcttttccgaatgtatcgcgacaataagatcagctacaagacttatcaagcagcgaaaaagtacgatctaaccaaagattttctgcctaaagcaaataatccgcaacaaagtgttaagtatggctacgtttataacctcttgacacaacaagcaaaagggattatcaaaaagcaactttaccaagctgacggtctgaccgccgctaaggttaataaagatggtgccctttccgaacaatacgacgaacaggcagaacagctattggctaatcgtggttatcatatttacagtacgatcaacaaaccgatctataacgccatgcaacaagttgttaaacaacaaggttcaactttaggtcaaacctactatgatacagcaaccgatgccagcggaaatattgttaaagtgaaggaacaagttcaaaatggtagtgtgctcttgaataaccaaaccggtgccgtacttggctttattggtggccgtagctattccagtagccaattaaaccacgcctttgatacaatgcgttcacctggttcatcgatcaaaccattagccgtctatgcaccagcgatcgaacgtaagatcattggctcagagactaagttggccgactttaaagttaattttaatggctacaagccaaccgactatggatcaacgattcaaaatcggttcatcaatgcgcgtgaagctttgaaatattcttacaatattccagcagtcaatctgtacaacgaagttcgtaatcaaggttcagtcaaaccttatctcgaaaagatgggaatcacttcgttgactgccaatgattacaaaaacttaggtttagcgcttggtgggactgattatggggtcacggtggccgacgctgcaagtgcctactctacgctttctaacggtgggacccataccgattcttatgtgatcgataaaattaccgatgctaatggcaaagtggtttaccaacacaaagcaaaatcaactaaagtcttctcagcagcaactgcctacatcacttctaatatgatgcactccgtagtatcttcggggacggctagtcaaattccgggtgaaaccgtctttgacacgactaacttagttggtaaaacggggacatctaatgacaatcgtgatagttggtttgttggtagtacaccaacagttaccttggctacttggacaggttacgacaactataatggttcctcgtataatctaactgattcatctagtgagattaccaaccagttctggtctaaccttgctaatgccgtttacaatgcggatagcagcgtaatgggtacaaccaaaacgcgtaaaagaccaagtggcgtcacgactgcctcggtggttaaatcaacaggacagttacctggacaattaacggtcgctggtcaaagcgtctttgccagtggcactaaaacgacttcgtattatgccggttggagcccaagtaaaacgaaagagaaatttgggatcggtggtagcacttctaattactcaactttctggaaaaattacattaatggtaataacgctgacggcgccctttatggtggcgaagtcattcctgatgaatacactgaaggcaataccactactggtatcggtcagagtacgaccgcaacaacaaattagcgcaaaaaaataagcctgcattgcaggtttatttttttatacttatttagttgtaccgcgttcaacgataccataaggtaagaggatcgtttggttatcaatgtcttccttattcatcatcttagtcaacaaccgcattgcaacggcaccaatatcatataatggttgcgtgatcgagctcatcttcggccgtgaaatttcagttaatttagaatcgttgctggtgatcaattcaaaatcatcaggcacgttgacgccatcatcaccggcaccattcaataagccaattgctaattcatcgtcgccgatcactgcagcagttgcaccagctgccttgacccgatcccagattgcttcgccagctttataactgtattcagtttcaaaaaccaaattaggatcgtaagcaattttagcttgagctaaggctttcttgtaacctttcaaacgatattggccgttgatcggttcgtttaagctacccgtaacaaacgcaatcttttcgttaccatgacgaaccaaagtactggtagcttcatcaattgcttcaacgtaatcaatgttaacactagccacttgttcgtctggatcaactgaaccggccaaaacgattggtgtctttgagcgcgcaaattcagtccgaatgctgtctgtgatctgattgcccatgaagatgaccccatcgacttgtttagccaacaaagtattcaatacttggatttctttttggccgttttcatctgaattagccaaaataatattgtacttgtacattgttgccacatcatcgatcccgcgagccaatgatgagaagtaaatgttagtgacatcgggaatgatcacgccgacggttgtcgtctttttactagctaagccccgcgcaacagcattaggccggtagtctaaacgatcaatgacttcaagaaccttctttctagttgctggtttaacattggggttaccgttcacgacacgtgagacggttgccattgaaacgttagcttcacgcgcaacgtcataaatggtgatagtttgtttatccattagagattcctcgctttgttttcattaattttcatggaattaccttttataatttaacaaaattcgcaaacaaatgcaagcgtttcaaatgcttttttcataaaacttacatgcttgttttcataatcagttgtgaattaaattgaaaatttgtgaaacgttaattatgctatactgaaatagaattaagaaaggatgattacttatgaatcatttgcaaaatttgcaaaactggttagcgactaatcgttatgatgtcgcctacatcagtaatccaactaacgtggcctacttctctggtttctttgctgatccagaagaacgggtacaagcgttactggtttttcctgatcaagaccccttctattttggcccccaactagaagttgaggctgtcaaagctagcggttggacttaccctgcttatggctacctcgaccatgaagatgcctttgctttgatcgccaaacaagttgaacaacggcaagcacaacctaaacgttgggccattgaaaaagatgatcttccctttggtcgttacgaagtgttacaacaagcatttccgcaggcttccttccctggcgatgctagccgcttcattgaacgagcaaaattgatcaaaacatcggatgaaattgcggaaatggtggctgccggtaaagaagcagattatgcctttgaagttggtttcaaagcgattcaagctgggcggacagaacaagaagtcgttgccgagatcgaatatgccttaatgaagcgtggcgtcatgcaaatgagttttgacaccatcgtacaggccggtgctgatgcagctgatccacatgaaggtcctaaagccacaaaaattcagccaaatgaactgattttatttgacttaggaaccgtccataacggctacatgagtgatgctacccggacagttgccattggtcaaccagatgaaaaagcactagacattcacaaagtttgtttagaagcacaattgaccgcccaagcagcagctaaaccaggtttgactgcagctgaattggatcacattgcccgcagtgtgatcactaaagctggttatggtgactactttattcaccgtttaggccacggtattggcacttcaacccatgagtttccttcaatcatggaaggcaacaacatggaattacaaccaggcatgtgcttctcaatcgagccggggatctacattccaggggttgccggtgtgcggatcgaagactgtatccatatcactgaagacggcaatgaaccatttacccatacacctaaagaattacaatacattaagtagtaacaatcttaagaccacaaaaataagcgcctagctaaaaatagcttgggcgcttatttgtacagagctaattaattatttttcagtcgtttcatcactagtaagtgcttctgacgttgctgaagctgcttcactggttacatcagcatttttagcttccgcgaacgcactttgtccttcaaggttgatgtctgcataatcattagactcatcatccttcaagtcagctgcggaatccttagcttcttctgctgctgatttaacttctccagcggcactagttgctgtttcacctaaatcgttaaacgtatcgccagcaatatcagcgaattcatcagttgtttcgtcagcaaaatcagcataatcagccgctttatcacgaaactgattgactttacgcgctaaattatcccgtaattcgtcacttgactcaggtgctaacaaacgagttgccgcaaatgctgctgcgccaccaagtaaaaatccaaatagaaaatgtccttttgccattataaatcgctcccttgttgtgtatttacttctgaatcagtagttgctttgtgctggcgccgtttacgataaagccgcaaagcactagcaccaacacggctaagtgccgaagctttggcggtcgttgcaccaacattggatattttatccactaagttatggcttgcttcgttaagatcagaaacactagcccctagatcaccagctgcttggaaaactggatctaagttagccaccttgccattaacatcgtccaacaacacatttgctttcgtcagcaaaccttcgacttctttagaaagtgtgtccacatccccagtgacgacggttactgttcgcgttgcttcattgactgttgcttgaatttctttcatcactttagtcacgcgccgcaataaaatcacgagcccgatcactaaaattagaaatgcgatggctgcaatcaatccagcaatttcaccaccagtcatagcatagcctcctctgtcccacaatagtgagtaatttttgtgccaaaagttttggctattccgctaaggtagtccaccgcacactgacagcttaaacaccctcgatcatcacccaaaacatggcgctacaaattaataaacgagcactccaactgattttatatcaattctacagtgcccgatacaggtgaaatgattatttcaaccagtatctgatgtttttaggatagcatcatttaacgctttcttcaacgattgtccatgtaatttggcatctttaactattttttgctacactaagaccagattattagaaattaggtggaaattttggctgttgaaccattattgatcgtgaccagctcagtgacaaaacaaacgaatctattgactcgcttcatacaaaatattcagtgggaaaatattattggtaaaattgtcgcggtaacgatcgaattattacttttaagtgtcctattttggatcattaatcgcatcacacgtctggtgctcgaacgtagctttaataattacaaaacaaaacggaatttaagtgaaggccgttcacaaacgatctacacattgattctcaatagttttaagtatttgatcttcttcttttatctttatgctattttgagtattcttggcgtccccgttggcactttgatcgccagtgctggtatcttgagtgtcgctattggcctaggtgcgcaaagtttagttaaagacttcttatccgggttttttattttattggaacagcaactggatgttggcgatcatatcaaagtaggcacgatcgaaggaaccgttatggcagtgggcttacgcacgacacaggtcaaaagctttgatggcacattaaactttatccctaacagtaatattaacatcgttagcaacctgtcccgtagtaatatgcgcgtgcagatcgacgtgcggttattccctgatactgattcagagcaagtacaaacagttttaactaaggtcaatcaagaattagcacctaaataccctgagattcaatccggccccgatgtttttggtctagttgatctaggtaatggtaattttgcggtgcgagtgctgctatacacccaaaatggcgctcaaggtcggattcaaagtgactttttagcagcatatattgcggcactaagtgacgctggtattaaattaccaaccaccccactaccaagtacgctctaagcaaaatatgattttaaaccttgtaaaaagatttggttaacttgagccaaatcttttattttaggcagattgcaagaaataacttgaacaaatttagtaacgcagattacgcaaaaagatctcaatcggtgttcgccaatttaaacatttgagtggtcgggaattcaaataccagttaatttgaatcaa

SEQ ID NO: 504 - DNA, 10189 bp, Unknown
  Metagenome-assembled genome
tgtttgaacccactttagtgggttcttttagtcgtatggtcaattttcttcgcataagttggtcaattctttcgccgagtgtggtcaatttttacgctcacttggttaattcacgatgccgccttcacttagtgtaaggcttacagatataaaataactatatatgaaatactgcctaatagtctaacctgattattaggcagtattttgcattaatactattttaagttttcggctggattaaataattttataagtgctctgttaatcaataaagataaaatctttgaggagctgataaagtaattcaatttcataatcttgaactttgatattaaacttccgctcgactggttggaagattccactagaaagtgaaaagaaatcttgttcttgatcagttaatggagttcttttgataacgcttttagattttttagaattcataatcattcgttcaaacattagtgataaatgcatatataaatttaattttaatcttggagtaaattttacattgtagaagtcttcgtagtgtgaaacgatagcttgactctcttggataacaacatccggattcaaaatctgtaaacgccctcgaatgccttcgattgataaaaacttcaataagcgatcaatcaataaattacttgatcgttcattttcaccagcattcagtaagactgtttgtagtcttattgaagtcgacttatcaaagatattgtaaatattcataatatcaattcccatatccccgttaacgtctgtggtggttaagattaactgggtatttgagaaaaactggcgatcatgattttttagtaacgcgtgcagttttttataatcaagagcaatcacttttagtgatggtgatagtgtcgattcaattagtttttttagttcttctgaaaggccgacacccgacatacaggcgacgataatatttttttggtttgacaacccttcgtagtattgcgcatcagtagttaaactatacttttggctggcttcagcaattgattgaaatgcttcgttacgttgaatacgcaacccaatatcaagcgccattgcagttgtaacgttgttaacaactaatagttcttgcttagatatctttttaatttccctgaacatttgccgtaaagagcccatatcaaatagaattatgtttccttttgggaaagaatcttgattaactaagtagttttgcacataagaattgattttatcaagagagatatcgataggcatgtcgaaggcttcaaaaaagtaattaccagttaatgtattgacaacctgttggatacttgaagctgtgttctctccatgggcgagtaaaattgcgttgtagtgcacggattctattttatcctcacattgtgccatgagtataaaaaatggcaggtagtaataagcgtcttgtgcatattgtggggttaacttggtcaagaatttttggaacagataatgacttcttgggtaacgatttttgattgcagcctgaagtttatgcgttgtttcagacatcggtagattatcgctgcaaagatttgaaaatataaatgccaaagcaacattacgccaaaaagtattatcttttgggaagttaatgccgtattgatgagtaatgtacttatttgagtcttgttcgatcgtttttgcaaatgcttctaacagcgatttactgatagtagtatctatttgattaagtaccttaagcaccaaaaagttttgttcagttatggtttccccacaaagtagtgagtcagaaagtttattaaataagctatcaacagttgggctaagttgtagtgcgctagtgattaaagtagtgatgcatgtttgcaacaagtgttgattgggcattatagagattgaatttttagtagacttactaattactaactggttagttgtaggcgttttagcatatgttttagcgcataataattggattcggttgttaagccctctaatattatcgctgtgattgagtgtagctaactttatgaattcactaggagaaacaagaatttctcttccgatttgattagattgttgttgcaaaaacattgcaacaaatgtgattcgttcattaaatggtcgattgccaagtggaatcaaattaatctgcacggccgcactattaaaatattcatgattgatattaattttttcagtaaccgtcgaaaaaatgtaccgaatattagcgtctttctgctgattggtctggacgagcagagagtgttgatcagccgagcttaattcctgtaaatttttaatatataaatagcaattcttaagtgacttaccaacagtgaaacgttgggtagttatctgtatttctttttttaatgtgtctgacctatctttataatttgcacaatcaatagattcaaaaacagcctctttagtgaatatttggcgacgtattgattcacgatagatagcttgtgcaaatgctagtttgcccgtaccgtgcggcccagtaatgaaaattggcaagccatgaactggataaacgattgcctctatggcgtgttgaacatcagcgctcaaactaccatgggaacctattaatttatcaaaagccgagctttcacgcttgatctgccaatatacaggccgactgccagtttttaacagtttaccttgtttctctaattttgataagtaactactcgttacaccgcgagtcaggccaacgatattagctgcttgtttagttgtgatacgttcattaggaaattgctgcgcaattgccgtgtaaagtttttctacagcattcaacaaaatcactccttaagcactattgatgataattaaacacacgtacttaaattattttaacttatatacgtttaatataagtacagctcttgtttggtctagataaacataggaaatactttgtaaataatttaattgactaggcacagtaccttagtagtgatggtcacagctaaggtatagaataattttattattttttctaaaatatatatccaatattttttatagagaaaggtcctaaaacaaatagccgttgtctgttggatatagcagcttttcgatagaatttgagaaatatatttgccgtgaacaattaatactacttttaagcactattagcgataattaagcacaatatttaagtgactttttagttgaatgtgcttaatataaatattgtaaacgttaacttaaatttggtctagtcaaacataagaaatgttttacaaaaatttaattgaaagggtgtgttttatttgtggtgataaccacagtatgtttaagaaatgtttttccactgggcgagtattagcgctttctgtgaaaacatataatcataatttttacagggggaagagaataaatgaaatatttattactcgtcagtcacggtgacttttcaaggggactgaaacaaactttaggaatgtttgcgggtgatgcgattaagtctgttattgcgcttgggctacaacccgatgagtctgccgcagcgctaggaactcgttttgaagcaatgctaatggaactgccagatgatgcacaatttattattttagctgatattattggcggtagcccgcttacaactgtctgtaacgttctgagtaaacagggtaaattgcgagatagccttataactggtggtatgaattttccaatggcgctgacagcaatgatgtctaaggatgtaatgacaagcactgatttaaaagtaaagatactatcagatgctactggggcaattagattttttgatacatcaacttcatcagaattatctgatgacgatatttaagggggatgtaataatggcaatttcttttgtacgtattgatgatcgaatgattcatggattgattacagttcgctggggtaaggaatatccttgtgatggtattattgctgtcaatgataaagctgccaataatcagattttatcagaggcatacaaggcggcatctgataaaaagacatttgtttggacgcttgagcattttgaacaggtaaaggacaaagttttgaattctgaaactaaatattttttgattactaaaaatccacaagatatgaaaaaaatcctggtggatatgcattttaaaccaggaaatatcacaactgttgtcgtgggtcctggaaatgatcgtgaaaatgcaatcaagttaggtgacaatcagtcatttacgcaggaggaaggagacgacttagaaaagattgaaaatagcggctataaagtagaatttgcattactaccagatcaacgaataggcagttggagcaaattcaagtcaaaatttggttactaaacaactgatttgtaaaaaaggggatatcaaaatgacaattagttggattcaagctgcaattttaggcttattcgcttgtttatgttctaactcatgtatggcaggtcaagcggttgggaactatactattggccgtccattagttggtggtcttatctgtggtcttattcttggaaatattcaattagggatagcttgtggtgttgcgatgcaattagtatatatcgcgcttgttacaccgggtggtacagtttctgctgatgtacgtgcaatttcttatatcggaattcctttagcaatggttgccatctcttcacaaggtttaaatccgcttggaggaagcgctgctaatcttgccaagtcagtgggaacattggttggaaccgttgggacagttctttactatgctgttgctactatgaacctagtttggcaatcatttggttggaaagatgttcacaatggaaagcttgataaattaactgctgttaacttcggttggccgtggatttctcacgcaatattttcatttttaccaacaatgttgtttacttattatggggcaacagccgtgactgctttacgaaatgctttgcctatggacggtgttgccatgatgactttattcactgttggcggtatgctgccatgcgttgggattgcaattttacttcgtcaaattattggaaaagcagttgattttattcccttccttgtaggctttacgttagcggcttcgttacatctaaatttagtttctgtcacagttatttcattactgtttgcggttatcatgtatgaagttgaaatggctaaggaatcaggaccacatgatggacttacatctgaaggaccaactgatgataatgaggaggatatttgatcatggaaaatactaataattcaaatcagcttgatcataagacgctgacgaaatctttccatcggtggttttggggtgctttaacatgtttctctcaagaacatatgcagacctttggatatatggcttcaatgttaccaatcttgaaaaaattgtatcctaaacatgaagatcaggttaaagcaattaaagcatacacagcgtttttcaatactaatccaatgttggggactgttattgtaggaattacagctagtatggaacaagcccgtgctaatggtaaagaaattgatggtgaaactattaatgacatgcgtgcaggacttatggggccaattgctggaattggggattctctgattgatggaactctcattcccatactcttaggaatttcattgggaatgtcgtctggtggctctccacttggagctatattttatattgttgcttgggtattaattgcttattttggtcagcgttttctatattttcgaggatatcgatttggtgatcaggcggttagtttcttggttggtaaacaaggagctgctatccgtcgggcaattggtgttgttggtagtatggttgttggtggtgttctggcttcatgggtaaatgtcacaacttcgcttaaattacgtggcactaatggtaaggtctttttaaatcttcaaaataaactggatagtatttatccgggaatattaacggttattgtaacgctattttgctggtggttaatgacgaagaagcatgtatcggctatttggacgatgcttattttggtagtaatatcacttattggtgttttaattggtgttttcaatcctggtctttcatattaagacgcaatttgggataggcgaaaggaaattgaaatgacaattcaagaaatgaaaaaaggatatgaacaggaagttacctatcaaaagcatatgcttagaaatttgggttattggtttcagctttggacgatcatcagtggaattggaattgtcctaacttattttttctaccgtcaaaatttatggctgtgtatattaggcattaccctctttgtgataggaacactaggaatgttagtgtttggttatgcaggttggaaagggcagcaaaatattcatgcacttattgatgactttgataagaaaattgaatattttcaataaaaccaataggtagtttgattataattagctgagcaaataattttggtaacttgtatagcgctaaacgttacttgcaaggctttactaaaattcgctattacgaaatagcattgatcatagacatgtacgctagattaaaattctcattgacttttcatcttcagctttctataatgaaaagcaatatcaatcgtcgctgaagagatgagtcgttgatgcattactacagaaagcctagggtgctgtaactaggtgtaatgttggcgataaatggtcttggagatatgtttgcatgcacggccgtccgccgttattgggactgtgagagacgtttagtaacgtaaaaaaaggtggtaccgcgataattcgccctttgtggagtcaaactctgcaaggggcttttttgttgcgaacgaaaggggtttgaccaatgaaaaagtggcaaaaattaggtttagcagttgctataggattaagttttttgttagtcagtgtaccaacacatgcagccgataaaacgattcgcttaggtagttcgccaggaccatatagcgaattatttctgaagggcatcaagccgattttggaaaaggaaggctacaccgttaaaaatacgtcgttttctgatttattacaggctgatattgcgttgagccaaggccaattggatcttagtgttgatcagcatactgcgtacatggataattttaacgaaaataaaaaggctgatttagtagctttcacaccgattccaactgtcccaacggcgatttttcccggcgaacgcaaaacgctaaaagccgttaaaaatggcgacaaaattggcatccctaatgatccagctaatacagcacgcgcttaccggctgttagaaaaagccggctggatcaaattacgcaaaggtgttgatccgctgcaagctaccaaaagtgatattgccaagaacccgcaccatttgaaatttatggaaatggattcagcacagattccacgtaatctgcgagatttagcttacggcgtcgtgcccggcagcattgcttacagtgccaaattaaagcctagtgccagcttgctccacgaaaatgtggtcaaacaatacgaactggttgccgtcaccactaaagaaaagcaaaatcagccgtgggtcaaggcagttaaaaaggcttaccgctccaaggcgtttaagcagtatttgaagaaacacaacaccaatgattattggttcgtccccaaggaattgaaataatatagtagtaaggaaggaatttgacgatgagtaaagaaccatggcaggaacaaattgaaaccattttagcgcaggctggcaaccgcagtgacgaccaacaaactggggcaatcgccgcaccgctgtacttttcgacggcatttcgtcatcaaggcttaggccaatcgactggctatgattattcgcgggtacagacaccaacgcgtgaattgttggaatcggttttggcgactatggaacacgcccagcatgcctatgcgttaagttctggtatggccgcgatccagttggtgttctcccaatttaaaacgggtgagcatattattacttctgatgatctgtatgggggtagtttccgctattttgatcagttgactgccaattaccaagtggagtttagccagtgggatggtcaggattatgctgaattagccgcgttgatccagcctaacactaaagctatttggctcgaaacaccgtcaaatccaaccatgaagtcgatcgatatcgctaaaacagctaagttagcgcatgagcatggcttacaattgatcgtcgacaataccttctatacaccgctactgcaacagccgctattgctcggtgctgatgtagtggtacacagcgcgacaaaatatatgtctgggcacaacgatattttagccggcgcagtgatgttaaacgacgctgccgtcgctgaaaagttgacctttaatttagtcactactggggcagtgttagatccctttagctgttggctgctactacggagtttaaagacaatgccgctacgcttacgccagcaacaagctaatgcccaagccttagtgtcgtttttagaaaaatcagcagcggttgctaaagtcctttatcctggtcaaggggcgatgatcagcttttatttagcggcgacgcactcggtggctgagtttttgcagcaactcaaggtgatctcctttgctgaaagtcttggcggcgtggaaagtttgctgaccgtgcccgatgaacaaacgcatcacgacatgccaatcgaacagcgccgtgcgctaggtatcacgccgaacttgttgcggttgtcggttggtatcgaaagtgcagtcgatctgcagcgtgatttggaacaagcttttgccgctagtgaaatttagttggcgttcctgctaaaagtcggtacaataaggaagataacagaaatggagattccgatattatgaaattagctgactttttccaaacggctgtgatcgctggtgaaccagtgatgactagcggttatacactaaaaactaaggggttaccggttttacatttaccattgccggctttagcacagatctactatgattatttttatggtactcggtacgtgacacaaaattttgaaatgaataaaatggaattggccgatattaaggatgagctacatttaagtgatatttccaatcaattattccaacaagatctcaagcagatcgttgttgaagtcgatatccggccggatgaaaaacaggttattttagcttttcgccatgatggctaaagcaaaaccgcgtctattgcaggcgcggttttttatttactgttttaatttggtgttaatggcagcaatatctttacgcgctaaacgcatgaagatcagccacatgactaggtagatcatgcagaaaatgataaagaaaaaaagtaaacttagtatctgcaatggaaaccagccacacagaatcgctaacggggtgaatgaaaataaggtgattagaaaatggctgatcgtcatccgggtgatgctccagtgttcgcgcgtgaaaattaagctggtgacactgaatacaacgccaatcagtccccacaatattgccgagctagccactgctagagttgtattagaaaagttggccataaagttacttggggcggggacatacgcaacatgattcaataatgagaaaacaatcgagaaccaaaatccgataaattcaccaacgataaaaccgaaaatagttaagcttgtaatttttttcataagcctaaacgctcctttaattgtttgacgtagcgacgcgaggtataagttttaatatttgtggctaagttgatttgaatcaagccgttgaaggtcaattcaagattgacgatcgttttaatattaatgatctcactatgtgaaatacgtaaaaagtcagtaggtagttgtttctcaagctgatataaccgttctttgatcagatagcatgatgtctctgtttgtgcatagattgccttagtttcactataaaaacgaatgatgtgttgtggttgtagcgggaccattttttcagcagcgtagccaataatataagcaacttcatcctgttgaattttggcgattgtttggttaatcgcagtggtgatggttggggtatggatgacagcaaaaggtggttgtgctgtgtcatcaagttcaattggtcccctgtcaataaaatagacaatttaaatagagacttttttgtcctatgccacgactaaattttgaatttgagtttgatactcatcttcaagttgctttggtgatttgaatccacagtgactg

SEQ ID NO: 505 - DNA, 21324 bp, Unknown
  Metagenome-assembled genome
cagaaagtggtgtggtggcgatagcaagaaggatacacctgttcccatgtcgaacacagaagttaagcttcttagcgccgagagtagttgggggagcaccccctgcgagggtaggacgttgccacgcacttttaaaaaggcagtcaagtcagtaattgacttggctgttttttttgtgcgcataaataaaatcagccagcgcatatggctgactgatcaattgaagattaactaatttgtttgctagttgttaagcgtagcgttttaggtgcatatttccaatattcattacgcaatggatgtgggcgaacaccaaactcgatccatggcttactccggccagagtaatggatcagcactggcgcctgccgggcttcttcagcaaggatttcgccaggagctaagggatgaacttgttcgtgacgaatcaaacgtgattgcatattatatttagggtgtaaataataccatttatcagccaagacggcgttcagtgcgtcctgatcatggtattttagtttttcaggatgatgattgatgaaggccatcactttacttgtcagattttcatcacgccaacgttttagatcaattaacatgacaccggagttgaagtaaaatggctgttccgctttgattcccatctcagctaagcgcggaacgtagccagcgtcttcaaccgcagcaattactttaccatttaaattagtctgccatagttcactaatatcactggtacagatcaaatcacaatcaagataaaggatacgatctaattccggtaataggtctgcagtataaatgcgatagtaagctgatttgacgatacgttcatcggttacgacctgttggaaaagtgattcatcaactgataagtaggcgactttatgacaattggtataatctatttccaagcgattaagttgtagcttatcttcggcagtcagttgatcggcaaagatataaaaggcgaaatcgttggtcggattattaacgagaattgagcgatagagtgtggctaatggggtaacgaaattcgaattagtggttgaaacgatcgaaatcatggtcataaacgttcctcctcgtaaatattgtctgctactgaaacgtctataggttaccttagtagctatgaatattatgacatggttatagacttgattagttaaactatacaaaatagcaactagttacgacaacttttatgcatgaaacgggctgtatctaagtggaaaagcatgcatttaaattgcaaccggccgagctttgatgctaatctggagatgtaccataataatcaattctataagaaaggactgattgatatgcttcacttactatgggtattaattgttggtgcggttatcggggtcatcgctggtgcaatcacgagtcgtgacttgcctttaggctggatcggtaatattattgccggtttagtcggttcttggctcggtgagatgatcttaggtagctggggaccgatgattgcaggtatggcaattattccatcaattatcggtgccgttgtcctcgtattgatcgtctccgtgattatcggtacgcggaaaaagaaaagttagttggataattgaccacctatggaaggttgactagccaaaatagttatcattcggaaccgcaaagatttgatggaatagagggaggaatgcgatgtgcgcccaattttcaaatttgcgcttggtttgctggcatttctaggcctgttagaagcgatttggtttggtctgttgattgagcccatggctaactggtcaggccaattgatgcagtggcagcaagaacaaatttggttgtcctgggtcggcttaggtttggcgatcattgcgggactaatttttctggtcttgctgtttatcgcattatttaaacggtcaacgaccactagcttgaacatgaaaactaagcacgggcagctaaatatcagtcgtactgcagtggaaaaatctgttaagtatgctgtacaggagcagcacccagtgactgaagttgatgtggccgttcaattgcttaagcacaaagctttagccaatgcgcaggttaatgccactttaacgagtacaactaatgatttagtcggcgccagtcaacgaatcgagaaaacagccaaacgtgaattaactgaacgcctaggtgttccagtgaaaaatattgatgttcatttgttaaccgtcgaccaacgtaagcaaccaatgacagacgtgatttaatgaggtgagtaaatgcagcgagaaatgaaaggcgcgctcattggcctgatctgcggcattatctggatcatgctaggtttttggcagctaattttgattctgttgttgagtgcgatcggttttctaatcggtcgttatagtgaacgattaccagaattaaagcgctggttgttgcaagttcttgagcgctgaataatgtagttgaattggtgtttgtaggttttatagcaagaagtctgctgaatagccagtgagatagaggaggtattcgatggatcaaccaaaagtacaaaaacgtaaattgacgtttgaggataatgtgatcaaaaaaatcgccggtaatgtttccggtgatattgacggtattttatcgatgaacggtggtttgatgagcaacattgccgaacgtttccggagtgatgcggatgtgactaagggcatcgatgctgaagtaggtcaaaaacaagttgcgttggatatggaagcaactttagaatatggtgccaatgcacgtgtcatttttgaccaactctgtgaccgcgtttatcaagcgttgaaacagatgactggtttggaattgatcgagctaaatttaaacgtgactgatatcatgactaaacgtgaatgggctaatcaaacgagtgaaggcaaaaaagaaactaaggaccgggttaactaaattagtgttaaacgaaaggatgactaacaaaatatggacgaaaaaatgaagaataatgcgccacaagccatcgaaagtgaattaaattataacgaagacgtgatcgcaaaaattgttggtcggacgatgacgacaatccctggtgttttaacggttgaggggaatgtgatcgaaaacttagctgatcgtttccgtgataatgatgaccctactaaaggggtaaaagtggacttagatgacgatgcacaaactgcaacgttggaattaagcgcaacattggaatatgggcgtaacgcacctaaaattttcgatgaagcagttaataaagtgcaggcagaagttacacgaatgactgacgtaaagctgactagctttaaaatgacggttactgatatgctgactaaggaagaatggcaagctcagcaggataaagcaaatcagaataagtcagaataatattaaaaggttaggacattaaattgacctaacctttttatttgcattcaatttacaacacctctagtctaaagtatgataaaataattgactgctggaataaattttactggcgacagaaacggtgcgtcggtttaaaatccgtactgtttttttaaagtatatttaggctaaattagtgaaactataccttagcaaagtgctttaatattattaaaatagaaatagaggaggtcgtttgaatggatgcagaaactaagcagcaggaacaagcgcgcgtaactgatgtgatcgctaaaattgagcaacgattgcaagataaaaacgcacaattggaccaggcacatcgtgagactacctcgattgaacgaaattatggcgataacacgcgggtcaatattactgaagcggatgaccgaatcgaaactaatgctgccgtgcagcagcaaaaacaattagttgcacagactgttgaaaatgagtcaatcttaaaacagcagatcagtcaattaaaggatctacagcagtcaccttattttggcagaatcgatattgatgaagcgggtgatcgcgatacattatatattgggacctcgtcatttattgatgctaaacagaactttttagtttatgattggcgggcgccaatctcgggtatttactacaatggcacactgggtaaagtgagttatgaaacgccgactggcccggtacaagctgaattactgaagaagcggcaatttttgatcgagcacggtaaaattgaaaatttatttgataccaacgaaacagttggcgatagtatgctgcaacatgtattaggtgctgatagtgatgaatatatgcgtaatattgttgcgacaatccaacaggaacagaatgatattattcgtgatacgaaacatgatattttgatcgtacagggggtagctggttcagggaaaacatcggctatactgcagcggatcgcttttctactgtatcatagccgcgaatcgttaaattctgagcagatgattttattttcaccgaatcgcttattcagtcattatatttcggaagtgcttcccagtttaggtgaaaaaaatatgcgtcaggtcactttagccgaatttttggagcagcgcttttctggcctacgggtggagaccttgtttgatcgctatgaacaggatcaatctagctttcctagaacagcacaaaaaattcgacgctataaagaaagttatacgtacattcaggctgtggaacattatttgcgccaagcccaaccgcaacaattagcctttacggatgtatattttgaaggtcgcgctttcttcactaaggcagaaattgcagcaatttatgcccggctaccagttaaaatgttggcggcggataaattcctcgcaactaagaacacgttgatcaagcggctgaagcggcgcattcatgaggaagctaaagctgattgggtggcggcagaagttgatatgctcgatgaagatcgttatcggagtattgtcggtgagcaacgctttgacagtggtgatgatgagtttcaatttattgctgaaaaactggtgcgtgaccgcttagccattgtttatgacgcattgtacaacgattattttattgatatgtacgagcagtatgctgattttatgcgccaggccacaccgaacgatgtgaccgctaaggtttggcagactatgattgcgagctacaagcaacaattagaacggcaccatttacgtttagaggatgctgcgccattgctgtatttgcgcgattgtctgaccggtagtgggcagaatcacgcgatgcaacatctatttattgatgaaatgcaagattacacgatggcacaattagcttacatcaagcacgcttttcctaaagctaaattaactttattaggcgatcgtgcgcaggatttatttaccgcccactaccgacaaaatgattttattgatgaattgacgactattttccagactcacagcatcaatttgatcacgttgaataaaagttaccgctcgaccttcccgatcacgacttttgcggcagcgttattgccagctggaaatgagatccaggcctttactcgcgatggtcataagccactgttggttatgacggactcaacggctgatagtttgcagcagatcactaaacaatgtcggcgtttactcttacagcacgaaacagtcgcagttttgactaaggatcgtgcaacaagtgcgcgattgtatgcacggttaaagttggatgttgagacaacgctgatgacggacgctgatcgcgctttgcccaagggcgttttgattttaccaatttatttagcgaagggcttagaatttgatgcagtcgttgcttatgatgtatctgctgtgcattttaatgcagagggtgatcgtgatatcttatatacaatcgcttcacgggcgatgcatgaattagtgctgatcagtaccggtgcgccatgtcaatttattgatgctgtaccagcagaaatgctagctcgggatactgtattaccggcaaacgaattatcctgattaaaggtgttgcattcatttagaatatataatatactatttaggcagtgttctgatcagactgtttaattgtatatttatgccgtcttagctcagcaggtagagcgcatccatggtaaggatgaggtcgtcggttcgaatccgatagacggcttaagttgagaaagctgataacgataaagttatcggctttttttgtcgttcaatttagctaaaaacgacataatatttcgtttaagcaagaaagtagctatccaggttataaaatcaatggtattctattagtggatggttattgtatataaaggagaagggcaatatctatggttaaattattaaataaattcaagcagcaacagttggttaaacatttagccagccaaactgaagtgaatttacattttgctagggctaacgcggactatacagtctgtcaatacgggacggaatttggtaatggaatcgttgtggtaattgatttagcggatagtgaattacgggtgcatcaaagcggtggaaaaacgcagtatctgccattggcgaatgccaatacagagctatatgatcttctttgtgaagagcgcgatcatcgggcaatcaacgcaattatcccagattagtttggcgttttagtggcgtcattgaattacataataaaataagtcttgtcagaaagtgtcgttgcagcttcagcaaagttacgcagtaattgagcatagtcgaacacggtgactgacactttgacaccgcaccatgaaatcggtacaattaagttaatatgttgacggggaagagtagccgtaagtggatctaaagcgagtcattggttagtgcaaaatggcgattgctaacggtgaatgggccctggagtgccagcgtgaattaagtagcggtggcggtgtttgcgccttaagcaagagtggtgtcgcagtagcggcacaatttaggtggtaccacgacattgagcgtcctattgatagtaatatcaataggactttttttatgaaagaaggaaatggatatgacaaaaaaagtaattttaacgggtgatcggccaactggtaagttgcacattggacactatatcggttcattaaaaacgcgggtggctatgcagaattctggtgattatgatccttacatcatgattgcggacatgcaggcattaactgacaacgcgcgtgatccagaaaagattcggcatagcttgttgcaggttgccttagattatttagcggtaggaatcgatccggctaaatcgacgatcttagttcagtcgcagattccagctttaaatgaattgacgatgcactatttgaatattgtcaatgtgtcgcggttgaatcgcaacccaacggttaaaagtgaaattcaacaaaaaggtttcggtcaaagtatccccgctggctttttgatttatccagttagtcaggcagctgatattacggcttttaaggctagcgtggttccggttggcgatgatcaagaaccgatgttagagcaaacccgcgagatcgtgcgcagtttcaataatatttatcaacgggatgtattggttgaacctgagggcgtttttccacctaaaggtcaaggtcgattacctggcttagacggtaatgctaaaatgagtaaatcactgaataacgctatttacttagctgattctgctgacgagatccaaaagaaagttatgtcgatgtacactgatcctaaccatattcatgttgaagatccaggccaagttgaaggtaacgtagttttcacatatttggatgttttcgctgaggatcaggcccatgttgctgaattaaaagcacagtatcaagccggtggtttaggtgatgttaagttgaaacgctatttgaacgaagtcttacaggctgctttagcgccaattcgtcagcgtcgtgaagaattggcgcaggattctgctgcggtgtatgatattctggctaagggtagcgctaaagcaaatgaagttgccaataagactttagctgaagtgcgggccgcaattggtatcaattatttcgattaatgtgaggcagttatattgatctagcgtatgcttcagcgtaaactaatttcaaccaataacgaatgtaggtgacagaatggaacttgagcaatttatgcacgagcttgcgtctaaggcaccaactcctggtggcggtggtgcgagtgctttaagtggtgccactgcagcagcgttggctagtatggtggtcaatttgacccaaggtaaaaagaaatacgcggtctatacagatgagctggcacagattttaacgacaacgcagcaactgatcacagatttattggcgcagattcctgccgatgctgcagcttttgcaccgttagcggacgcctatcgcattccgaaagaagcgccgcaacgtgcggcaattttagaggcagcactggctcaagcgacgtcagtgccattagctgttttacggcaattagacagtttagtccctttgattgaaagtttagtgactaagggcagccaaatcatgcaaagtgacgttggcgtagcggcagttacttgtcgtagcgccttagagggtgcagtactaaacgtctacatcaatacgcgtttaatgcatgaccgccagcaagcgttggcgttaaatgctgaggcagcagcattggtcaatgataatgtgatccgctgtcagcgcgtctatcaacaggttatggctaagctacaataagtatgcggtgatgatttcttgaaatggaagtgatctggtgaaaattctcagtggtcatccagtagttcaacatttatttactgctttggaaacgccagttgcacaattacgtgcacaaggtattgtgccttgtttagctttgattcgtgttggcgcagatccggctgcacagagctatgcacggacgattcaaaatcggtttgctaaagcccaagttgccgttcagatagtagattttccaacggatgtgcaaccaacgatagtggtgcaggcaatcaaacaactgaatcaagatactgccgtccatgggatcatggttttacagcctctgccgtcacagttagcggtggcacaattggccgaagtgatcgcaccagccaaagatgttgacagtatcagtcggctgaatcaggcggccaactattttgacatcgaaagtggtttttatccttgtacggctgaggcagtaatggcgctgttggactattatcagatcaatttagcgggtcagcgcgtgactgtggtcggcaaaagcatggttgtaggcaagccagtggcattagcactgatgaatcgtgatgccaccgtgacggtggcgcataagttgactctggacttgcagcagacttgtcaaaatgcagatgtgatcgtcgcctgtgcaggtgttcccaatttgatcgatgaaaccatggtccatgcggggcaagtgatcatcgacgttggaatcaatcgcgttaatggacgcttagttggtgatgtcgattggccagcaattcacccaatcgtggcagcagcaacgcctgtacctggtggtgtagggacgatcaccacctcaattttattgaaacacacggttcaaagtgcttggttacagcaacccagcgctcaaccgctaataattgaatagaataagttgttccgtcgtgcaagcaccggtttttttgttaaaatgaaattgagtaaccgttttataatgggggtggcaaaatggtgcagccaaaactttttggtgcgatcgtaatgagtgcacaaagtcttgatttgagtatcgttaatttgcgaacattagaagtgatcgaacgagtcagcgcgccggtggccttaggtgagcgtttattttctgatggtgggatcgattttgatgcagttaacgcagcaatcgaggcgttacgcggttttcaacaattgatgcgtgattatggggtcagtgacgaacgagtagtagctagccacacgattacgtcagcagaaaatatcaattttgtgcgtgatcaaatttatacgaaaacgggattaacggttcattttacaacggtcagtgaagaattactatttcgttatgaagccgctgcggtttatttgcctaattttaagcgtttatgtcagcagaatactgttttactgcaattaggcgctagctcgattacgttaatggtctttcagcatggtgaattgactttaactcgggagttgcaattaggcccgatgcaggtggcacaacgcatggccgaactggaacatcgcgcaacggcttatgaagatattttagccgactatatccattccaagttattggatattttgcgctttttaccacaggtggcctttactcaagtgatcttaatggggtcaaaattgaccttgctggaaaatatgattccgcaaggccagcgaagtttggcaatcacccatcagcaattcaatcagcgttaccatcaagtgatgacattgtcaccgcaagaattacaaaatgacgaacaattaccagaaattgaggctaatgaggtcgcgccgaccttcttattattagacgagatttttgatactttgcataccgaaacgatttggttgtcgaatattaaattgctcgatggttttgtggtgcatttaggtagtcataatggcaaatataagcaatgggactttgatgcggcagtgatcgcggcaacacaacacgtggcagcacgctacaatattgatagtgcccaccaaaagcaagttttgaaatttgcggtgcagttatttgatcgtttacgtaagattcacggcttaggccggcgggagcgcttattattacaactggcggcaatcttgcaagatacggggctgtacttagatgcgaatcagcacgcttttcattccgaatatattattcgtgcaagtgaaattctgggattggatcatacggagcaattgatcgtggctgcagtggcccgttaccatagctcggcggcaccgtcggcggatctgagccattttaatcagttaccgttgattcaacgcttagtgattgctaagctggccgcaattttacggttggctgatgcgctggatgacagtcatcaaaccaaaattagcgctatcagtgttagtattcgccgcacgacggtcacaattactgccactgcgcaaacggatattgagttagagaaatggactttcgctcagaaagctgacttctttactaatgtttatgggctgcagccgattttacagcggaaggggagtttatgatgaattttgctaagccggaatattttgttaatcgtgaattaagctgggtcgattttgatgatcgcgtactggaagaagcccgcgacaaaaacaatccgttgttggaacgggtccgctttctcggaatcacccaaagtaatttagacgaatttttcatggtgcgggtggcttcgctgcggaaaatgcaagcagtggcctattccaaacccgatgctgccgggatgtcaccgaccacgcagttagcggcgctaagtgccaaaattcatcccctcgttgaaaaacagtattcgacgtggacgcggtcattgttacctcaattggaaaaagtgggcatcaatttattagactatagccaactgtcaaaaaaacaattgagtttttgtagtcagtattttcatcaagtactctatcccgttttgacgccgctagctgtggatgcatcacggccgttcccgtttattggcaataatacgctgaatttagcgctacgtttagttaaggctgatgtcgcggagaaaaaagatcgccgttttgccatggtccaagtgcccgatgtttttccacgggtggttactttacctggcgaaaatcaatttattctattggaagaagtgatcaagccatttatcggcgaattatttactggcttcaaagttaaagaagtccagacttttcgcgtgatccgtgatatggattttgatgtggccgaagaagatgcttctgatttaatgaaagaaatcgtccatcagctggcgatgcgtgagcacacgaaagtgatgcgcttagagttagcagccgaaactagcaaaacattgcgtaaacgcttgatcaaggcgctagcagtccacgaagccgatgtgtacgatatcaaaggccccatcgacttgactgttttaagtaagttagtcaaagctgttaaaaatcatcctgaattattatatcaaccgtttaaagcttatacgcagccggcgttgcggcaaaccgatctgtttgcggcgattcgccaacaagatctgtttctgcatcacccctatgatagctttgatccggtggtgcagctgatcaagcaagctgccaatgatccagcaacgctggctattaagatgacgctgtaccgcgtgtccagcgattcgccaatcattcagtatcttggggcggcggcacaaaatggtaagcaggtcaccgtgctagttgaattaaaggcccgttttgacgaagaaaacaacgtgcattgggccaccgaattggaaaagaaaggctgccatgtgatttacggcttagtcggtttgaaaacacattgtaaattgctgttgatcgttcgtcgcgaaagtgatggcattcgccggtacatgcatatggccaccggtaattataatgatgtgaccgcacgcttgtacacggatatgggcttattcacggctgatccgaaaatgggcgtcgacgcttcgaacatttttaatatgctgtcaggcttttctgaacccgatcattttgctgaattaaacattgcgccgctgacgttgcgcaagtttttgaatgcgcgcttcgacgatgaaattgccaacgccaaagccggtaaaaaagcaatgattcggatgaaaatgaactctttgtcagacaaacaaatgatcgaaaaaatctacgaagccgctgctgccggagtcaaagttgatttgatcattcgtggcatctgttgtttgaaggtcgggttacctggtatcagtgagaacgtaacggttcattcgatcgtcggccgtttcttggaacacagtcgcatctactatttttatgctggtggcgaggaaaaactatacctttcgtcagccgatttaatgaatcgtaatctcagtcggcgggtcgagttattatttccaattttgcagcctaatattaaagcacaaatcgtacaaatttatgagttaatgtggcaagacaacttaaaaacgcgagttctgcaagctgatggcagttatcaaaaagtcgatcggcggggattagcgccattggatgtgcaggcgcatttagtgacggtggcgaatactgaacaaaaagcggcaaccactaagccagcaacaccaccgacgcattttacgccaatgaaaaagccatggtcgccggtagatgacgattagtagtttaagtaaagatattcaatttgaataaaaggaagcgtacaggatggaaaattttgtggtcatcgatctaggctctaactcggtacggatgtcagtgacggaaattgatagtgatggtagttttcgtgcggtccaacagcataaagaaatggtacgtttatcggaagatatgggcacggaaaagatcttacaggagccggcgattgagcggacaatcgccgcgctgcaaaaatttgcggcaatctatcaacagttgccaaatgtaactttgcgtgcagtggcaacggcagcggtccgcagcgctaaaaatcaaaaaaagtttattaagcgtgtcgcggacgaggttgatggcttgaaaatcgaagtgatccccggcacaatggaggcttactacgactatttaggtgttatcaacaccttgccggtcaccaattgtgtcattatggacactggtggtgctagctgtgaattagtcctggtacaaaatggcaaggtccagaatctgatcagtttaccgatcggtgcggttaatttgaccgaaactttttataagaatggcgttgatcagttaaaagcagaggatctgttctgggagactacttttgtgaatcggttattcaatggtgtttggtggctgcatcgtggccaaaatttaccgatcattgccttaggggggagtaatcggacactagccaaaattcaacgcaagggtaaaaatgtgctgaattttgaagatattcatggttttcgcatgaatgttgctgaggtcaatgatgtctacgctaaagtgatcagtaaagacttggcgggacgtaaaaaaattcctggcttagctaaggatcgggccgatattattgctggtggtatgaccccaattgtgacgattttacgttttcttgactctgatcgagtggttttctcgcagaatggggtacgtgaaggcattctgtacgagcacatcagtcaattgcaggagcagggggatgtgcagtaaagttaactaaaaatggtgctgcaatcaattaaggttgcagcaccatttttagttatttgaccatgaaattcattgcggacaagaaatcatggatccgttccgttggttcggtgaagaaggttttgggatcaccactgtagagaatctcgccttcttctaagaagatgatttgatcagcaacaccgcgagcaaattccatattgtgtgtcaccacgatcatcgagttgtgttcttgggcgagctttaataagacgcgcaaaacgtcagcttctagctcaggatccagcgctgaagttggctcgtcgaagaacatatacttcggtttcatcgctaaagcgcgggcgatggcaacacgctgctgttgaccgccggacaacgccgtcggaaattgatccgctttgtccgctaaaccaacttgggctaataagcctttagccgttgaagtcgctgcagccggtgattgtttcaaaacgtgaatcggcgcttcagtaacgttttttaaaacagataaatgagggaataaattgaaactttggaaaaccatcccagtttggcggcgaatactcagaatatctttttcggcaattgctttactaaaatctaattctagatcatcgaagtggtacaagccgctttccggccgctccagtaaattcaatgagcgtagtaacgtcgatttaccggaaccagaaggaccaacgatcacggtggttttatgttcaggaaaggcgatgttcacgtcgtttagcgcgtggcgctcgccgtaaattttattaacgtgttcaagttttagcatagggccctccttaaattaatgttgtgttggaacatagcgtgacgtccatttttccaagtagccttgtaggatcgtcagtacggtacagatcactagataaacgagcgcaaccagtgaatataacagtaggggttcgtaggttttagctgagatctgttgaccaacagtgaacatttctacgatcgtgatgctggaagccaatgaggtgtccttaactaaaccgataaatgagttggataatggtggtaaagaaacacgtacggcttgcggtaaaataatgcggaaaagtacttgacgtcgggtcatgcctagcgttaaggcagcttcccattgaccattaggaatcgacaaaatcgctgcacggatcgtttccgaactgtaggcaccgacatttagtgtgaaagtaatgattgctgcagtccacgggctaaactgaacacccaggttaggtaaaccgaagaaaacaataaataattgaactaatagtggtgtgctacggaaaatccaaacataaccccaaaataagccgcgaataatttggaatggtccacggatcggcgataagcgcaccatcgcggtgagcaatgccaatagtaagccgagaacaaatgaaattaaggttagtgggatcgtgtattggatcgcggcggtaatgatctgtggtaaagcagaggtcacgatttcccaagtactgctcgacatgaaaaacatcctttcgtgcgatatatgtagaaagagtggaccagctggtattcatccggatttggatgacgccatgacccgctgtcccactctcaaacgtgcatcgttattttttagttacatcagtaccaaagtatttttgtgatattttctttaaagtaccatctttttgtagactctttagggctttattaacggatttgttcaaattcttatctttcttattcaacatacccgcgatttcttgtgtttctaattttgaaccaccggagatcaatttgattttagcattaggcttttgcttcaaataagcaccaaatgcttcaactgagttgatcgtcccatcggcacgaccttgttcaactaattcgatcgattgttcaaaaccactacttgagacgatcgatgcacctaaattacgtgcatcggtcgcattattactagaagtagtttgggccatctttttacctttgatatccgtgatcttcttaatatctttattgccctttttaactgctaattcggacttgctgtaaatatacggagtggtgaaacggtatttggctttacgttgtttagttacagccatgtcgttcaatacgagatcgtatttattaacgtttaaaccggcgatcagtgagtcaaattgtgtttcgacaaagacaggtttgagcttcattttctttgcaacggccttaccgacttcaacttcgtaaccagtcagtttgccatcttcatggtagccataaggttgataggtgccttccaaaccgatctggagggtgccctttttatttagttcagcggtgacggctttactagctgcgtgagttggtgttgctgcaggtgcgacggccaacaaaaaggctgctgctgttgccccgagaatccccaaaaactttttcattatctaaatccacctcaattaatattttaataacttacaaatcgtcaacaagcataagtatataacatttcaaggcattttttaaccaagttgatgaattttcttaatgagtgacgtgttaaaatgaaatacaaatcgttataaagggtgaattaatcatcttaatcaatgtgcgcgtgggatgaataggaaagttaagccagtacctattttggcatagaatcttatcacattaacatgttacttaaaggagtgcttttcttggccaagaaattttatcaacttaatcgtttacaacggatcacctatttagttaaaaataaaatgctaacactgcgggatgcagcattttttactaatcatactggattaactcaagaacgagctgggcaattggtggaaaatcagttgaccacttttgctttgccagaagggattgcgcgcaacgtactggtcaacggcaagttacatcaggtgccaatggtgactgaagagccttcagtgattgctgctgccagtaatggggctcgcttagctgcatttggtggcggctttacggcaacgcagccacaacggctgttgattgggcagatcgtgctaactgaggtgctggatattgcaacaatcacggctcagatcactgatcaagaagcacaactgttacaagtggctgatcaggcgcatccctcactgaaaaaacggggtggcggagcacgttggctgcgggtacgtcagttgagcacacaagagctttcaattgatttagcagttgatgtgcagcaagcaatgggggctaacatgttaaattctatgttggaggcagtggctgattacttgcaaactaaattggcgctgaccccgttgatgagtattttgtcgaattatatacctgaaagcacggtgacagctactgttgcgataccggtagctgttttggcgactgcaactatttccggggcaaccgtggcagcgaaaatagtagcggctagccatattgcccagatagatccatatcgggcggttacgcataacaaaggtattatgaatggtattgatgcagtggtactggcctttggtaatgattttcgcgcaattgaagctggtgttcatgcttatgctgcgcgtgatggtcagtatcgtggccttagccattggcaggtcaatggtgctgaactgcggggagaattgactttaccgttaccagtcggttttgttggtggtgcgactaaattattaccggcggtgttacctaaccagcgcttagccgcagtcgattcagctgaagagttaatgcaagtaatctgcgcactaggcttagcccaaaatttagcggctttaaaggcattggtaaccactggtattcagcagggccatatgttattgcaggctaaaagtttagctgtgaccgctggtgcgcaaccaaacgaagttacagcagtggttgcagctttacaacaggcgacaacgatggatctcgctacggctaaacgattattggtacaattgcgtcagttacaataattgctggtctaaaaataagtatctttttctatgtaattttcacattatagttatgagataaagtttgaatttaatgcaaattagcgcttttatttcaccactgatagattgatcgatttacttgctagtatatttattgcgcgctaaattaaaatgaattatattaaagatacactcctaataggttattatcaggtgaatgactgactgtcgaaacgacggtcggtcatttatttatatttttgaatgctgctgttagcgtccaattattatttactaggcctattttgcttattgaaagaaaaaatttatttttatgacaacgactattgatttaaccgcttacttattgttataataactatgatgttagcaagaggagtggttaaatcatgggatatcgtaatggggaacgtgatgaattaactttaaccgtcgttgagccgtggcaacgtcagtcgggtgagtattatttactactccaagatcgaaagggccagcagtatgaatggcagcagagttacccgcggcgattatttgaacatacagggtcagcttttcgcttgtgtaccggtgatcagttagtagttaaatttactgtacgagtgttattgcagaatcagcattatagtattcaacatgtttttattaagcaaattcgccatcttgttgcgcgtcctgatttaccaccagaaaaacagcgtgaattaaaacgattagaggctgaattagctgaaggtaagtcgttatacgaaacttattaaaattaagcaatatattgaagtgaaatcagttatcaactagttcaacagcggtattcagcaatctgctcacccaattagttgctatgactggtttttttatttttgttgtatcgcgccatcgccaattagtttcgttagtttagtcgtggtgttagagtggaagcaagggaggaggaatcagcgatgaaacatagttataaattggctgcgacggtcgtgatcggtattgtcgcgttgatcttgcaatttgtttttgggcaaccagtaatagcgcaaatcttggtcactggtttagggacattgatggcattttcgatgttaattgagatgattagaacgctgcgttcaggtaaatacggtattgatttattggcgatcatggccattgtcgctactttagcggtgggcgaatactgggctagtttgctggtcttggttatgctgactggtggtgattcactggaagattatgctgcgcagcgtgccggcttggaattaaaatcgttattggataattcgccgcaggtcgcgcaccaactagtgaatgatcagctaaccgatatcccagtaactgcggtaaaagttggtgatcatttggtggttaagccaggggagatcgtgccggtggatggacgtgtcctgagtggtgtttctagttttaatgaggcgtcactgaccggtgaagcacggccgattgaaaagccagtcggcgctgaattattatcgggttcgcttaacggtgatatttccgtgacgatggtcgttgatcaaattgctgctaacagccagtatcaagcgattattaagctagttaaacaatcagaagcgcagccagctcactttgtacggatggctgatcgttatgcggtaccgttcactttgatctcactattgattgccggcgcagcatgggtgttctctggcgatccagtacggtttgcggaagtgctggtggttgcatcgccatgcccgctgatcttggcggcaccaatcgcgctagttgcagggatgagtcgggctagccggaacggtattattgttaaaactggcacgactattgaaaaattagcccgtgcccgcacgatcgcctttgataaaacagggacgatcactcaaggccagttaacggtagctaaggttgtgcctctagcacatttgagtgctgctgaattattacaattggcggctagcgcagagcaacaatcaagccatattttagcgcgttcgttggttgattacgttggaacaactgagttactgccactgagccatttaaatgaagtaactggggctggtgttaccgctgacgtggcggcgcaccatgttaaagtcggcaaattgaattatgtggcaccgcaagtgactaaatcaccgactcagcaaaccgcgattcacgttgtggttgatgaaacttatgttggttatattgaatttagcgaccaagttcgtcctgaagctgcggcgacgattacgcgtttacggcaactgggtttgcaacaagtgattatgctgactggtgatcaggcaaccactgcacaaacaatcgcacaggctgttggtgtggataaagttcacgctggttgtttaccacaggataaaattaatttacttaaggcggtagcacccgaacaacagccggtgatcatggtcggtgatggggtcaatgatgcgccatcgctaacggcagctgacgtgggaatcgcaatgggcgctcatggtgccacggctgccagcgagtcggccgacgcggttattttgaaggatgaccttagccgagtggcacgtgcagtgacgattgcccaagaaacaatgcgcatcgcaaaaagtgacgtcttaactggtatcgtgatcttggttattttaatgttgatcgcggcaactggcgtgatcccagccttacttggtgcgcttttccaagaggcagttgatacgatcacaattttattagcgctacgggcacggcgagatcggcaaccaatggtaccgactactatcagcaaattaagttaatattgattaattgagtgtcaaaagttaactattttatgagctggaataatttactattactgatttagacagcggcagaaaatatgcgtagattgagttgtaaatttagcaacggtgcagtcactttttaatgaatgatcagactagccatgggttttcttattaggtaacttagcagcaaacttgcaggttgtgaagtgaacccccggtattggaccaaaatccaataccgggggttttactatgaccaaatataccaagcagtttaaactacatgttgttcaagactatctgacgtcctcattaggttttatcttgatcgctagaaagtaccagatcaaaagtcatgcga

SEQ ID NO: 506 - DNA, 8858 bp, Unknown
  Metagenome-assembled genome
acatgaaagcagtgtttcaaacgttcaaaaagaacttagtggttgtactcaacgccagtgaatcggactatacgaatggcccagtcgaaggcatgaatcgaatgattaaacaaattcaacgcacagcatttggattccgtaattaccatcatatgatttcacgtattaagttacggcaaatgcgaacaaaaccaatgaaaaaaacagagttgaaagtcgcatgactttcaactctgtaaaagctattcatcaacaggatttgacaaagagccaatataagttactagcgctagtataactacagtatagcagtttttttcggcatttgcacaccaaggggttactgcgcgctaaattgagtttggtttcatataaaaccaactattgatcttgctaacttgccacaccacctgagccgctggtatggcattttttacaccgttggcttaccacaaactcatttaattggcaaaaatagccgctaaaattagcgactatcgcaactctattttcccgcaacataccggtaccggatcgcggtacgcatggtgacccctgccggtagcacaatactaccgaacgcagcgtggtgtacggcatccggcagtgcctgtgcttcggtggctagcgcgtcataagcgccaccgttgcccgctaaattagcggtgtaaatgactagcccgttgcgctcggaaaagatttcaacgtggcgcttaccggcaatatccccaacctgtgcgatcggggtcgtggcgctaggcttgactaaataggcatcgtcaaactcggtgccaccattttcttgggcaagtcgttgcagcgcttggcccattggtttcgcactcgtgaaatcgtaggcgctacctttaacatctagtaattgcccagtcggtgtcttatcagcgcgtagttcagcgcgcttgacaccgttaatttgcagccactgctgatcgatcgagcacttttggccgtcagttacgttccaataaacgtggttcgtcgggttaaacagtgtatctgccgtgctgtgtgcgatgaactcgatggtcacttcatcgtcagccgttaaggtatatttaaccgtcaacgttaagtcgcctggatactgatcaagcgcgcttgaaatctgccgagtaaaaataaccccactgctggtggcagtgtcaaacggcgtccccacaaaattcagcgtgctgaatccatgcgtaccaccatggatcgcattgcctttttcagtggtttccaactgataagattggccatttaattcgacttgaccatccttgatccgaccggcaacgcggccgatcaccttgcctaattgtgaatcagtagcgacgtacgccgccaaattatcgtaatgataaatcaattgttgccgttgtgcgctctcgatcacagaaaattcttgccaagtcgcacctaaactcaaaacagctaagtgggtcccattttggttggtggcaacaaagcgctggatcgttttcccttcgtgttgcccaaaatcttcaactgtaactgccattaaaacacctccgtaaattaaaaaaaacgtgttgcctcagtactcagttgctgcgccgagcgatctggtacaacacgtcaaaatcctatgctgtttgtgtgctggcacggaaaacaagttcagtgccgagctcgacgcgttgtggtacccggggtcgttgcgcgcgttgcaacaatagatcgactgcagttgtgcccattaagcgggtggccacatgcaccgagcttaattcggggtaaacatatttagccagcgcagtatcattgaagctaaataaactaacccgcgctggcacggcgatttttgcctcttgcaacgcctttaacgcgcctgtcgccattggatcattggccacgaaaaacgcatgcggtaattgcgcccctaggtcggcaatcgcttgtttcattgtctggtaaccgccttggttggtaaaatcactggcaaagcacaattcagattggtaagcgtgatgggcggtcattgcggcactaaacgcttggtagcgtggatcagcaattttccgctgaccgtcggtggtcgtctcgatgccatagatcagaccgatatcagactgcgactgttgccaaaaaaaatcaacaacttgacgcactgactggtcaaaatcggtcaagacactatcaaagccggcggcaaattggtcatcgtcaacaaagactaaattatcggtcaaagtcgccaactcattgacctgagcggcactaaatttacccacggcgatcacgccgtcgatctcttcggtcagctgatcgatattattttgaaaaatacgcgtcactgctagttggtgctgttgactgcgttgttcgatgccgaggcggatcgccatgtagtacagatcgtcttgttcgtgcgcttccgagtaccactgtacgatcgcgattttgcgcattttcgttgtgctgggcgctttggggtgacgtattttcgtgtaattcagttcttccgcgaccgcaaagattcgcttacgggtggccgccccgacggacagcgactgatcataattgagcacgcgcgagaccgttgtcagcgagacgccagccgcgtgggcaatatctttcaatgtggttgccatgaaaattcctcccaaaggtacaccgtttttgttacgtcctattataccacctaaaacgaattagcctagttggtcaacaaaccgtttaaatgcggcttgtccgtcggtggtctgcttaaagacgccggcatcttctaagacgcgggcgaaaactaagccgagctcgcggtccaagatttcgtgtacattttcagcggtaaaggtgtaacgttgctgcaaatcagcgacccacggctggtggtacgcggcgatttcaaccggttggccgactaaataatcagcgactgcctgcatttccgtctttaaacgcgctggtaaaatagcccggcccataacttcgatcaaaccaatattttcctttttgatgtgttgaacatcgggatggggatgaaaaatgccatcaggatattgtgtggaagtttgattatcacgcaatactaagtccagcacatactgctgatcgcgacggtacgcgatcggcgtaatcgtatggtggcgtgtttgccctgtataagcacgaacgtcgacactttcgtcagaataatcacgccaagtttgctggatcgctgttgctgcattgactaatttttctggtgtatcactggttaagcgaattgttgctagcggccatttaacgataccagcttgtacgccagccacagtgaattcctgaatgatcggtgctttcatcattggaaaaacgtggcgacccccttgatagtgatcatgcgtcaacattgaaccaccaacgatcggcaaatcggcgttgctcccgacaaagtaatgcggcaacatccgcacgatctctaataaattagtgaatgtgtgctgattgatcaccattggtcggtgttcttgattgagaaaaatagcgtgctcgttaaaataagcgtacggtgagtactgaaaaccccaagtctcgccgccaagggtaaaccgaatgatccggtgattactgcgcgctgggtaacctagccgaccaagatagccttcattttccatgcataactggcatttaggataatcagtttgtgcctgatgctgtgccgctgcaattgccttaggatccttttccggtttcgataaattgatcgtgatctctaagtcaccataatttgttgtcactgggaaaacaacatttttagcaatcgcacgagttttgatgtaatcattttgccgactcaattgatagaaataatcggttgctgccaatggactgacttgataatgattccaaaaagcgccgttgactgttgatggccgtggcgtaaccagatccattagctcagcatccaagatttcccgagctgtcggtgtatcttcaattttctgattagcgactgccgcatcgagtaacgcagccgctaaatccaacaaatccggcgtgtcgtcagttggtaactgctcaccgactaaagcataaacccggttagttaaataaaaccgatccagcggttgatactcctgattcaattttaaaatatgtgtcacaaattgaactgctaaatctgccatactatttggcctccccatagccgtgcggatggctttgtttccagttccatgccgtgcgaataatttcttgaatattgtcatactgcggttgccagcctaaagtagcacgagctttgtcgctagctgcaatcaatgttgcgggatcaccaggccgccgcggagctttggttgctggaattggttgccccgtcactttacgagcagcttccaagatttcctgattagaaaaaccagtggctgagcccaaattaaaggcatcactagcgccacctttagctaaatacgctaacgctaaaatatgcgcgtccgctaaatcaaccacatggacgtaatcgcggacattagtgccatccttagttgggtaatcggaaccaaaaatcttcaattcgtctcgttcgccagctgccacttgcaaaataatcggaaccaaatgtgtttctggatggtgatcttcaccgatggttccatcagctttagcaccggcaacattgaagtagcgcaaagccacaaatttgatgccataagctaaatcagcccagtgcataattttttccatggctaatttgctttcaccataaggattagttggcacttgcggatcagtctctttaattggaatctgttttggttcgccatacgttgcggctgttgacgaaaagacaatttgcttgacgttatgccgttccatgacttccaacaaattgatcatcccggcagtattattatcgaaatatttcagcggtacccgcatcgattctggcactactgaaaatgcggcaaaatgaaccacgctatcaattttttccgtggtaaaaacttgttccaagaaattcgtatcccgcacatcaccataataaaaacgagcttgtgtatttaccgctgcacgatggccggttaccaaattatccacaaccgccacatcaaagcccttttccaccaatcgatcaactgtatgcgagccaatatagccagcaccacctaaaactaaaactgtcatttgaagaatcctcccatagttttcatttagcgtaaacgcggctgaaaagcccgatgttcggtgtctagcaagtatctaatttattacacgtttattaaacagaccttgcttcccgatatagattagcctaagctcagtcgcactgcacattttttatcgcctggctaggctattccgaacacgctttcagcacactttctaatcttcgatttcacgaggtccgtcagcaatttcagccacatagaacgttggtgcgtagccgattacttgctcatacgtggtgccaacatttttctggaatgcagctacttggtctttagcgacgatggcgatggcacagccaccaaatccagcaccagtcatccgggcgccaagtacgccaggttgttcccaagcagtttcaaccaaggtatccagttctttaccggttacttcataatcataatgcaacgaaacgtgagaagcgttgaccaattggccgaatgtagctaaatcatttttgcttaatgcagtcgttgcttgcagggcgcgctgattttcaaaaacagcatggcgagcccggcgtaatagcgtatcatcattgatcaaataggcagcacgatcaaaactatccttatccaaatcacctaatgacttgattggcagtttttcctgtaacttcgccaacgctgcctcacattcaccacgacgttcattgtacttagaatcttgtaattcacgccgtttgttcgtgttcataatcacaatcacacgatcgcctaattctactgggctgtattcatacttcatcgtattagtatctagtaaaattgcttggttggctttacccatcccaatggcaaactggtccatgatgcctgaatttacaccgatatagtcattctctacttttttaccagtgctgactaagtccaactgcgaaatatctaaattgaaaacagttcgagcaatcgttcccatcaataattcgatcgaagcggatgaagaaagcccagcaccatcaggtaaattgccatgaacgtataaatcaaaaccatgatccattttgaagccagcctgactgagctcgtaaagcatcccttttggataattagtccaaccagctgtcttttgataagctaaatcagtaatatcaaacgttactgtgccctgatcagggacgttggcagaatacatccgtaccgtagtatcttgtcggctggcatagactccgtatgtgcctaagctaatggcacaaggaaaaacatggccaccattgtaatccgtatgttcaccgatcaagttgattcgcccaggtgaaaagaaaacgcgttccggttcagttttaaaataagctttaaattcattacgtagatctgctgtgttcatggtagtacctcctggttttactaaactttactatcttatgctgtcagtatagtctaaagcggtttcaaattcaaggtcaacaccgaaaaaggtatgctacttaacctgaatttgctcgctatgactagttttgttcactttgtgctgcttttaatttagtttccaattcagtaacgattgcttgatgcttagcttctgataacttcactttaaataagtagaccaaagctgcaattacgatcaatacaattggtgcgaaaaacatataacttctaaaattcaatagttggccagcgctaatactgcttggtttggcattgccgatcataccagaatgaactgccgctaaacccacaacactattagcgatcgcaccggcaactttatccaacaatggtcgtacggataaagtgaccgattcatttcgtgtgccatttttcaattggccgtattcaacactatcggtgatcgtcattaaagcagctaagaaaatcattgggtatgggaagaagaaaataccgacggcaatcagaaccgcaattacattgtggcccgccaacaagaagatagcgtatccaattaacatcatcacgatgccaccgacataaatagctcggcgtttgatcaaagcaactaatgctgggaataaagagacggatacaatgcctagtaccgctgtgatcaccccgactaaccaataataattagcgtgtccgagtacgtattggaaataataagctaaaagtgagttagtaacgacataacttaacgcgaacaagaagtaagaaagtgataaccacattaattgatcgtttttggctaacaccttgaaaacatcgcggaaacggactttttcgctatttgcacgaatcaagctcttcttctctttagtgcccattgctgtcgcaagcgcccccaagaaagagatcaaagcaataactaccgcaaagccgatccagccagcatgagttttggtgtcgccatgggtccctgagaatagctgggagaaaaagacgatcagcgggaagataatgatcggtaccccttgggctcctagcgtagaacctaagcgaccaattgtcccaaatgttgcccgcactttagaatctacacttaaagccggtaacatggaccaaaatgaaatgtctttgaacgagtagaaaatatctaggattacaaaagataaaccgaataaaaccagatacagtaccggatttttagtggttaacccaccaaaatcagtaaaaacgacgaccaacatcaccgaactaaccgcggcacctagcaacagccaaggtttgaattttccccagcgcgtttcagtattatcgactgcaccaccgatcaacggatcaaacataatttcaactaaccgaattcctgtcatcaacaccgtcacataaccgatcattcgcgcattaaacgccttatcagccgtatcgaataactgactagttatgaacaacatcaagtaagtacttaacgtttggtaaaatgcatcatgtccgaatgcgcctaaagcatatgaagtatattgttttacatgtttcatattcttaatctcccttaaatcctattttggatattgttaagttaacgtagttgaaaaagccaattgctgcgcctagttaggccagtactcaaaagccgaacactttttcaccacacgctatttttgctcaataccgccgctcgataattttttgtagaattgcatcacgttgggtttgcttagccacatcaaattgtgttttttctagatcattgaaatcttgagctaacataagcgcttccaaatataaccgtaattggcgcttgatatagactaaatcatcctcgtcatcctttttgggacttcctggtaatatcatttgggcaaactctttcggatcaatgatgatcttttcatcctttttagtcatctaaatcgctccattctatacttagcagtaaatttactgttaaacttctatattattttcggtaacgataggtagtgcaatagattctatgcgctttatctgtaaccgatttctaaattatagaccagttttagtgaaacttcaacctgattttactgaaatattactgtaataaaaaagcttagacaacttggattgtctaagcttcgctgtaacgttaaactagatatctaaaggttgaaagttaatatttccacttaagccctgatctgttaggacttttttgctacaaaaatagacatgaaaccattcacatctgtatacttaaagcgtctaaacaaaaaccatacagaggagtttcatgcctatgtctactatacaatacaatgacactgatattcatcattcttttgctcatttttcaaaattggtccatct

SEQ ID NO: 507 - DNA, 3813 bp, Unknown
  Metagenome-assembled genome
ggcatcaaaataaaaaaacaacggacaagcatcaagctaaaaatgccgcctaacaaaagacaaccagatttctcaaaatcgagaagtttggttgtctttttaaaacgggtgattatttaccgcttacggggaaccggcaaaacattgctgaccgtgatgacggcgatcgcagcatataaatttgcacaacaaaaaaccttagtcgttgacacaatggccgaccaaacggcgaccagacttttacaaaagaaaatccccgcgctggatacagcaacggggatcgacttattgacaacgaccatcactacttttcaacaacaggtcacccaattacaggctagttacgattatatttttcttgacgcaaccaccgctgatggcttggccttagctgatcaggtgattctgttaactgcagcagatgccttcgcgcttcgttcggctcaacgattgcaagcaagtatcaccccgatcaagtttagcgggattattcaaacggcgatttttgatcgtatcgatgtgattcaaccaagtaaagacattgcgccacaggacttatttagtttgccgttagctaatttaggcggctttactgatgaacaccggcgtagtggtatcgatatcgacgacgaggatgatgaatttgcctgggcctacttcgccgaggttttcaacgaattaaccgagcggagcgcctttattactgctaacggttcgctgactggcttcacttatacgccaaaatacgttgatgacacggggatcactgcagctggctatgcgttaacattttgatttgccgccaaaccgtccaaagccttgatcacaatctgtaattgtgctgcatcgaattactgcagcttttttgcaatctaatcatgttccagcgcgcttaatcagccagggtcaattcaatactgccagcccaagtgacggctagcgggtcgaatgctgatagcaaacggttatttaccattataatgaagccaaatcaaaacgcgcgttttataattaagttagccacccagccaaaatggtaaaaaaaagacaccaagacgaaaaattcaggtatcattgaagttcctacaacaaacaatgaaagaagttttcgtcttgatgcaagaacagtctatcacaccacgcccaaaaggtcaccatttatcggaaatcgaacgcggtcaaatcgccgcttggcacattgaaggatgctcaacacggcaaatagcgattcgattaggcgtctgccaccagaccgtcaataatgagctcaagcgtggtcgagtcacgcaagttaaacgcgttaataatcagaaacactactttgaaatttacagccctgaagccgctcagaatcgctatgaaataaagcggcaaaactgtggacgtccattaaaatttagccaagtgacggctttcttagcctactttgatgataagttctgccatgagggctggtcgccggacgctgctgttggttatgcccgtaagcaccggttatttaagccggccaaaatggtctgtacgaagactttgtacaactatatcgatgcacaactgttggagatccgtaaccttgatctgctggaaaaaacaaaacgccggacgacccaacaccactcgcaccaacatcagcgcctactcggtcgtagtattgaagaacggccaaagcgagtagaaacgcgccacgagtttggtcattttgagatcgatactgtcattggcaaacgtgctggtagcgagagtgtcctattaacgtttaccgaacgtaaaacgcgctatgagattgtccgcttgatcgagggtaaagacgctgaatctgtggcttatgccatgcaaaatattacggctgaattcggtgacgttatgcggacagttacggcggataacggaacagagttcaccacgctaacggctgcgcttgagggtattgccgagacttattatgcccacccttatagctcggccgaacgcgccactaatgaggtccacaatcgtatactcagacgttactttcctaaggggcaatcactcgatctagctacacccagtctggtccgtcaagctgaatctcggctcaaccatctcccgcgccgcttacttaagttctgtacaccagctgaagtatttcgaaaggaattagcacgtgcgcgcaaaggccgagccgcctaatcctgatccacctggaactcccatgagccctttcgtctgtgtgctttatcggtactggctaacttactattgcaatttgcgagccaaatcaaaaagcgtcaactgacgaaaattcagtttatcgtcaattggcgcttcttttctgttagtaatattgcttgtaaaccgcaattgctaacgcttggattaataagtagaaactcaagctactcagtattatcaattagtctttttctttgcctagccagctaactattatatgataaagatagctaaaagtgccccatcgattcctaattttcatcgcaccattgttgcatttccgcctagccatttacgaggaggaacgaacatggatacgctcaaaaattatttggcaagtaaattcgcttctgtcccgtacacccccgccacagaaaaagccaaggctgatctactcgcaaaaatgactacccgctatcaggaactgttggctgccggtaaaaatgaaaacgaagcgctaggcactgtgatcaacgaatttgattcgatcgaagacctattagttgccgctaccgcaccaaccacagcaactaaaaataacctcacgttaaccgaagtcgaaactttttggcgtagcaccaagcgattagccttagcggtcgccggcggtattttaagcatcgccttaggtgttggcgccatgatcgccctagtaccaacagcctttagttggttaggtgttttattaatgctgattggtgtgattattggaatcagcttatttattacgattggtatggcgcacgtgcgcgtaaaagtccccctggataagcggggaatcaccacagaacttcaagccaccgcccgccagcggcagcaagactatactagcggctttactattgctttagtcgccggcgtggccttatgtattttcgccttgtttccaccgattctgcaagcagtctggcaagtgacgaacttcgacctgctgagcggcgccgcttttatctggatccttggtagtggtgttttcgccattatctacggtagcgtcatttatgcgggttacacgcggatcgcgcaggccgatactttttatgcgctcgccgatgctgatgaccgggccttaaacgatttgaagcaacgcaatccaaaaatgcatctcttcttatatcaagcctactggccactgatcatactcgcttactttatcatttcatttgtttttggcctctggtccgtatcatggttgattttcccgatcgccggtgtcttgtttggggttattcgtaactatgctttgttagcacctaaaaattaaactcgttgtccgcttaaagaatccgctaatgggttcttttttattatgcggcagattgcaagaaataacttgaacaaatttagtaacgcagattacgcaaaaagatttcaatcggtgttcgccaatttaaacatttgagtggtcgggaattcaaataccagttaatttgaatcaattcatcatcggtaatctcatcaatcggttgaccttggggaatgaagcggcgtagtactcggttgcgattttcattactgcctcgttcatgtggcgaataagcgtgcgcaaagtacagcggaacaccggcctgttcttcaatcaaattgtagttggcgaattct

SEQ ID NO: 508 - DNA, 12315 bp, Unknown
  Metagenome-assembled genome
agtttttattacgacgtcaaagcgccaaagaccacaacgacatgtcaacttcgacaccactttaccagaaaaaagcaaagtggtgaaccacgattccgtcgaatcatgattcaccactaatgttagtccgtttttatgtccattcaatatcgtcagatccttgagctctatggcaagaaaaaaacgcaacgtaatatagctgcgccatgactagttattcacgagctaaggtaggcagaggtcattcaccgggctaacgcacagcagctacaccaaccattcatagacacaatggaaatcatactgatgaatcacccattttattgtcgaatgatttattttttgtaaaaaacaaacgtgggaattaaaaaatgttcgcttttgtagaaaatttaactatttttcaaagttaatagtctacttttaccgaatcattgtactaaaaaccatgaaaaatccaagaacagaatgtatttattgattttgaagacacgccctaaccaaccgaattttaagaatcaggcaaaataatcgttaaaagcagattatgagaatagccaggcactgactaagtaatttagtaggtgtctagctatttgtttgagcttaattgattgtttccgcaccaagcagccgtaaaatggcctccgcgctactatcgtgtaaacataaataatgaacaaattgcaaaaattgactggcatcggcggcacgataccaatagtcgcctagtgcgtaaattttgtcagtggcgtataagggttggcccaaaaaatcgcgctgggcaagttcgtgatttagattaacggtcaaatcgttcatgtgattgcaccttcctattttattttaaggttgtggcattagtccgatcgacaacggcaaggtatggccgcaaaaaacatggctataactcaaaattctcgcccaacatattttctagttcccgccgccatttgtgggcggcaaggacaaccacgcaatcattggtgcgcatattgcggatgatcagcgcggtgtcactgcgatcgagttcgcggactaggcggttaaggtgggtcttagcggtactaacagttaaagttttgatcataatgagcctcctaattttgtattaatgacgtaattctggtggtacgacgtcttgttgcatgctgatctgaccattgccgatcgccacatctttttcctcgactaactgcggcgtgaagcgcatttggctaggttcaaaggtgaaggccaactcggtcaggcggccggagcggtttttacgaaaaatgagatcaacgtggcggacggttttgcgttcctcggcgttggtgatcggataaaggaagctgacgatattggaatcttgttcgatactgccagattcacgtaaatcggctagctgtggcgtgcggtcaacgcgtttttccagttcgcggttcagttgagagaataaaatgatcgggatgttcaattcgttggtcagtagcttcaattcgcgggtgatcatttcgatttcttggcggcggtcgtggcgcgcggcgatgcgatccagactgatgatctgtaaataatcgatcaccgcaatataattgccggccatggcgtgttgggcgtggtcacggatcactttgatgatctgcggcagcaccagtaatttatcgtggagctgtaagtgttgttggtctaactgatcgatcgtggtgcggacttgttgtttctcggtatcgtttaaattaaaggcgggatcagtaaacttgccgaccgcgacgccagtttgtaaggcgacggtgcgttgataattgtcggtggcggtcatttccagtgaaaacaggtcaacgttgagttccggttggtattgcagtgcccgttgaattaagttgatagcaaaggctgatttaccaattcctgggcgggcaccgatcgtccacaaaaccccaccgcgtaagccgccattgagtacttgatcgatattaataaaagttttgattccgctaggctgcggtgtttctaaagcttgcaacagatcattaccgtgttccttgatgtcgcgggtgggtaatttgggctgattcagttcggtcagttggttgctcaattgttgtagcagcgccaaattatccgcgctcggcgttttgaaataattttgggcggcgtcttggacttgattttgaacggcccaaaaatgtagcgtgcgtaaactatcttgaaaaacagtttcgtcattgacaggttgttctaagctgcaccattcgtcggcctcaaaacttaacgggtaagcagcttggaagcggcgttgtaactcgatccaattgcggtagggaccaggttcgaccagtaaaaactgaataaattcacggcagctttgcgtggtgaaccaactagcgtcgatggtgacggtttttagcgcttccggatgatggagtaaatagtgcaccacgttagtgtccaagggcatggccgatcacctccatttcggcacgatcagtattgaccgcatcatcagcggcgcggcggatcgctaggtcgatattgccactacaaacgttgaatagcgtttttaaataatcagtgcgcgtttgtgctttggcggatttaacgtgcggtgccggtggcgcttccagtaaatactgattaaacttggggccgaacaaggtttgtggccggataaatttccagtagtcgccaccttgccagtccttgattttccagttgattacttgcttgatctgtttcatcgttactttttgccgaaatagttcggccagtaatagctgggtctcggtggtagcggtaaattctttgccggattgttgttgcaaataggcgagaattttttgcgtgctggcggccaagcgttggcgttgctccggcgtgtaggtttgtagactcagcggcgtgatgctggttggttgttcctgtttggtattaaccgatgctgaagcggcggtttaattaggcgtttcaaagttaaacttggctaatccatgatagttggcggctacttctggtggtacaacatgttgtgcccaatggcatttaacgatgccctagaaaacaaaaaactgatctttggcgtattaaagaagtgccatattacccggcagcagcctgactttgacgattattttcaagaatgtctgctagcttacgttgacgcctactgccaatatgagcaggaacaaccgccgatcagccgtaaaaattatttatacaccaaactatgccaacatacgatcgacctctggcgtaaacaagttcgctatcagcaattttgtagtatgggggatacagaagctggtagccagagtatgccagtgacgactcgcttggccttacaagaactgcaccacgaattgaaccaaggggagcagcatgttctagaaatgctataccttaatagtttttcacaagcagagatctgccaacaattacaggttgatcggcggaccgtttatcgctggcgtaaaggcgttcaagcgaaggccagtaagttttttaaaaaataatgtcccaaatcgacttgctcaaacgtatatataagtgaaggctaaaatggcggccgctgaattttaccttcaaaataaattcactatataggaggtcatcccatggctattttgaaaactgacttgcagatcaaaaccgtcggcgacaacatcgacggcgaagcgacgtacaagtttgtcaacgtcaaagaaggcaccacgaccgaacaactggataaattcggcaaaaccatcgccgaactagccgacgaaggctacagcgccgccgtcactgttgtgtatgatcgacacgactacgcaggctagagcgcctaatttagcacgtttccactacccttgagtaacgcgcaccgcccatttccgccgccaagcgtacgcccctacgctaaattgcggaaacataattatctactactacgcaatagcggatgatgtattagccaagaccactaatacatcttgatgctacgggcgttgtccattcttgtgacaaaatccgtgccacaagaaacatggcactactacgcactacccctaatccaccacagagaggagcattcctatgaaacaacttgatatggagttcaagaacgaaatcggtaaaacgaaacatatgcgcctgaactacgcttcccagaccctggacgaaaccacggtcaaaacagcgatgcaaacgatcgctaacttgaagatgtttgagttggaagcggtcaatccgtacgcaacgccgatcaaggcgcagtacattgaacgcactgtaacgccaatttttggcggtgaagttgaagccgccgacgttaaggtcacggaataatcgttgtacgcaaagaagccacacttttgttgagtgtggcttctttgtgttgatcattcaacttataaaaaataattgaataggactagaacatggcggtcaactttggtttaggagaatcgttgcggcagaaattatagatcagatatacacaaaacgaccacatcaagatataacgtgactgttttgtgttgctgaaactatttatttgacttaaatatgtaccacttactaaagaaataattagctacgacgacgaccacattatcaatgattttcgtcaatacaggattggcatgtaaaacggatatgcctaaccacatcatgaaaacatccatgattaatgataagatacggaaaaagaaaaacgaactcatttctttgatcaaatcggtaaagccgtgcgttttggaagagaatacccaaagcttgttagtgatgtaggcgaataatacagaaagaaaccaagcaatgatattagcgacttggtaattcattattgggttcagtagggcaaagacaataatgttgatcagcgtagttaaaccgccaaaaactaaatagctgatgacagatcgatatttttttattaattgaatgataatgattcactccttagtctgactagataaatttacccataactccgtgtagtgtcaaccttacataaaattttatcggtaaggacttgatgttaaccgttatttcaacgataattagctctagacaagtttaatggaggataaaatgacaaagaagctttcactagtcgtaccatgctttaatgaagaacaaacaattccacttttttatgcggcgttgcaggcggttaaaccacaattacgtggtgccgaattagaatattggttcgttaatgatggttcacgtgacacaaccttagaagtgttgcgtgacttacaacaaaaagaccccgaacaggtccattacatttcattttcacgtaatttcggtaaagaagcagcgctttacgccggcttacaagcaacgactggtgactatgttgcagtaatggatgcagatttgcaagacccgccagaacaattagctgaaatgatggccggtattgaagatgaaggctatgatgttgttggaacacggcggatcgatcgcggcggcgaaccaatgattcgttcatttttcgctaacggtttttattggttcattaataaaatttcatcgacgccaatcaaaaatggcgtgcgtgattttcgtttgatgactcgccaagtagtggacgcagtgttatcaatgagtgaatataatcgcttttctaagggaattttaagttgggtcggttttaaaaccaagtacctcagctatgaaaatcgtgatcgagttggtggtaaaacctcgtggtcattttggaaattattgcgctactcgatcgatggaatcattgatttttcagatgcaccattgaatttagcgactttggttggctttctttcgttcttagtctcattaatgggggttatcttcgttattgtgcgtaagatcatttatggcggctcggtcactggctgggcttcaatggtctcaattattttgatgatcggcggattgcagctattgtgtctggggattttaggtaaatatattggcagtatttacctagaagcgaaaaaacggccaatttatattattaaggaaaagaaataaattggctattggcttagtcgttgaactgatcaagttagtggcttgatttgaattatatctacgaaattaaaaatctaagtcagatcaatggttttacaatgatgcttattttttcaaaaataactgaaccttaaaaaaacaaaccgcgcaatttgcgtggctttttgctaaactaggtaatgtcggtttaccgatagtgaaatcagttctggaggtagcaatgatgatgagtaattcaacgcgcgatggactttcgtttggggaatttctgttggcgttaggccgttactggtacatatggttggtcacggcattaatcgtgacggcaggggcttttgcctggggtaaacgaacaacggtaccgacgtattcggcaaccagtacggtgatgatctatcatcccaataacgatcctaatcagcgcaacgcggatattttagcgatggcgtcgtaccgtaagctggccaaaagtacaacaatcgtgcagccggtacaagaacagttgctcaaggccaaaggttatcagggcaatatggatacgttgaccgctggtattagtactgcggtggcacaaaatacattaaacttacaattaaaggtacagggaagtagtcctaagttagcggcgcagacggccaatttattggctaagtcggtgcagcagcatttaccgcagctagtaccaaatagcggcacggtacagatcgttgagcaggccaagcctaagcaggcaatgttgatcaacggcaatcgtgtgcaaaaactaacgctaggtgggttattatttggtctgtacttaggcgttttggcaacgtttatctatacagcttggcggaggtagtgcgatgatgataaaatcatctactggtcggatcacggcggcaggcctgtatttagcggcgtttggcctttttttcggctatgccttttttgcgacgtcgatgtacaacgatgcgctgccggtgcgttttgaactcgtggtcatggcggtggtgctgccacttctattgacgaaaatagtcgcctttgatcattatagtatggggcagtggatcgtgatcttcactggcttagttttggtggcttggacggcgcggacttcggggcgttatattttgcttgccgtttatctgttgatcattggtgcgcggcgtgtctcctttgcagcaatcgctaaaactgcgttattagttggtttagcgacatttattttgatttttgtatctgcttggttggatctgatccctaatctgcgttatttgcggcaggggacgtaccgtaattcattcggtattcagtatccgactgattttgcggcgcacgtgttgtatttgttattaacttatgcggccgtgaagcagggccacttcaaatggtacgattggttgctgagtttatttgccgcttggtttgtgtggacttattgtgatgcacgcctcgacactgttttgatcgtgatcttgttggtgttattaagcgtttattggttgatcgaaaaaggctttaagccggcgttgttagttagttggctcagtgttggcgccatggcgatcggtgctgccatatctctaggtttaagctacttttattcaccaaagataaaatggatcgaggagctaaatcagttattgtcatcacgattacgtctagggcgtgaggcatttgaccgttacgatccgcagtggtttgggcaagtggtacggacgaccggctggggtggtagtcaaggtttcaagcactttaccggcaagttgattacgaaagaatattttttcattgattcatcatacttaacggttttactaacttttggtttgatcgtttcggtggcgttgttggtggggtatacttggtttgcttggcgggaagtccggcggaaagagtatttgttgccacttttgattgcggtgaccgcaatcagttgtatcgtcgatcagcatttattggatgtgtcgtataatatttttgtcctagctttattggcggacacaaccagttttcggctaccgataagtggttgagaatattgctgtcttagcgtcagcggatctaaatttatgatcacgctctagaaacgaggaatgacatgaaagtcgttaaaaattatctttataatgcgggttatcagatttttctgttactcgtccctttgatcacaacgccgtacattgcgcgggtgatcggaccaactggtgtcggtatcaatgcctacactaattcaattattcagtattttgtgttgttcggtagtatcggtattaatatgtacggtaatcgtgaggtagctttttaccgggatgatccgcataaattaactaaagccttttgggaaattgaattacttcgtttctcagcgattattgtggcggaagcggccttttttatttatcttggttttactgatcaataccacacttatttattgatgcagtcattattgattaccgcagctgcgtttgatatttcttggttctttatgggcttggaggattttcgtacaacggtggtccgtaatacgattgttaagatcgtatcggtgattttaatttttgcgtttgttaagacggcacaagatttagcggtttatattttgatcatttctgggtcacagttggttggtaatttaactttatggccatttttacgccgtcacttagttaaagttgattggcataagctgaatttattgccacatttacggccggctttagtattgttcatcccacaaatagcaacgcagatctatttggttttaaacaagacgatgttagggaagattactggtgtgactgcagctggatttttcgataactcagataaaatcattaaaatggttttagcagtggttacggccacggggactgttatgctgccacgggttgcccacacttttgcccaaggagataaggcgcaagtacggcgttatttgtacagctcatttgattttgtcaccgcggcttcggtgccaatgacgatggggttagcggcaatcgcaccgaagtttgccgtttggttctttggtgctaagtttgcggcaaccaatgttttgattatgttagaagcacccgccattctaatgattgcttggagtaatgttttagggatgcaatatttgatgccgaccaatcgtaatcgtgattttacgatctcagtcacgatcggtgctgtggtcaatttgatcctcaatattccgttgatcattaactttggtgccgcgggtgccgccgtttcgacggtgttgtctgaggctagtgtgacgatctatcaactatacgttgtccgcgatgaattatcggttcgccatttatttgccgatctatggaagtatttggttgcggggatcgccatgttcgcggtagttttctggctcaatacgacccagccatttaacaccatgtggttattgatcgaagtcggtgctggcgtaattatctatgctggattgatcgtacttttacgagcgcaaattattaaacaagttcgtcagttacttggacggtaaaatttagtggtatgacttagcactgattcgtttagcttcttcctacttggaaaaagtttttttatacctgcaactaaccagaagttcccaccaattttgaatattgtgtgaactttccaagtttattcggtgaaagcggtttacaaaagggttcgcgcgttttatgattaagttagctaattagatccagctaattgaaaaaataaaaaacaccaagacaaatctctgttatcattgatgttccaacacaaaaatgaaagcggttggtcgcctgataccgcggtgggccgcgctaaacttgaaggcttatatcaacctgaggagatggtttcgaccaagacgttatatcactatatcgatgcgcaactacttgaagtccgtaatcttgatctgctcgaaaaaaaccggcgccgcaccaaacaccaccattcacccaagcataagcgtctggccggacgaagtatcgaagagcgacctaaaagtattgatcagcgccaagagttcggtcactttgagttggataccgtagtcggtaaacgtaacggccaagaaagtgtcattctaacgctgatcgagcgccaatctcgctgtcagatcctgcgtttgattgatggccgtgacgccgattcagtcaactacgaactggctaagatctgccaagaatacgggcacatcatgaagtccgttaccgctgacaacggggcagaattcgcagcggcggggacggtgcttgacggggttgccgacctttattatgcccacccttaccgctcttcagaacgaggcacaaatgaggcgcataatcgaataatccgtcgtgatgtgcctaagggcctgtccatgaatactttaggccctagtgatatccaagcagtggaagccaagctaaacaacttaccacgccggcagtcaggttaccaaaccccaaaagagcttttccccgctgccgccggctaaagattgaatctttaaaatatgaatatcaatgaaaatactgtcttaccgggatttattgcgtggctaatttgttcttgcaatttgggaataaattatacattatgaatactataaattttaaaggcaaaagataaggggagtgaagcacaatgatcaaattatttacgcagacaagttgtaattcttcacgaaaggcgcgccaatggcttcgggaccacgatgtccaatttgaagaacaaaatgtcggtaaaaaggcgccaacgaccgcagaattgaagcacattttaagcctgactgaaaatggtttagatgatattatttctactcgttcgcgtgcgtatccagaagttgctgctcagctaccagatatgtcatttaatgaaactttaaaattactttgcgaacggacccagttactacgtaaaccgattattgtcactgaaaataaagtacaaattggcttcaatgatgatgaaattcggaaattcataccgcggcatattcggcgcttggattttatgaaagcgatgatcaacgcggctggagtctagatgtaaaatttaagcaagcttttgtaatacagataaaataagattgaggttgaagccgggctaggggtggcacggcttttttgatacaattaaattaaaagagaggttttttagatggaaataaaaattaggccagtgcaaccagccgaatatgcaacaactaaattagtggtaaaacaagcttttgcggggattgaatataccgacggtgatgagcatgagctgataggacggctacgccaggagcatgcttatcatccagaatttgatgtggtggcacaggcaactaacaggaaaattattggtcatgcgcttttgtcggaaattacaattcgtgatcaaaaacagatggttacagcagtagccctagcaccactggcggttttaccggaatatcaacatcaaggcgttggtggacgcttgattgcttatttggagcaggcagcgcggcaagccggttatcctgcaatcagcattttaggtgatcccgcttactatagtcgctttggttatcaaccagccagcaactatggtatcaaagcaagttttacggtaccagctgcctactatttgcttaagccgttggtccgcggtggtttatcagctgttaaaggtacgatttattatcaggctgcttttggtttgaattaaaagctaacatggatatgttattttacgtctaagcaaattttagattggtatttggtaacaagttgctaagaaagccctaattttgccggttattggttgtgctaatttctagatatgttatggtatagccaacagataaattaacaaccttacgtgtcaattagaaaggaagagaaccttgttagccacgagaactatttctgattatgaactgtttcagcatttcaaaagttatttgttagaccaccgtcagcaagtcaaacaatatcgatcagtcaaggaatacgtgcaaaaggaacaaccgactatgaccccgtttatgcgcagccaggcccgaattcctaagcattataagcgggtgatccgtcagttaacaccgcaagatttcgcccagttcgaacgacaattaaatcgttaaccaagcaaactcggaagtttgtcaaatggtgttgaaggatagtttctatcctttggagatctcctcgtgtgggagatcttttttgttgttttattagttgcggcgtttaatctggtgtgttgtctgaatatcgtacttgaaggcataacaaataagcctaccatcgtgacgttattgtggtagataatctaggcaatcagctggtagacgcgtgtgaacatattggcctgattggagaagccataaca

SEQ ID NO: 509 - DNA, 8428 bp, Unknown
  Metagenome-assembled genome
tgatttaatgctttccagggttcaaataagttattaatcgcgattaatgatttatttgagctgtggaaggtaaacgcggttctgaatgtctcttaaaatctgtctcaaatattgacttcaatccaatgataacagagatttgtcttggtgttttttattttatcaattagctaaaagtatttggctaacttgattataaaacgcgcgcagaaattttatgatcatttgggtgggcagcgaacgagtcattaaaaaatatttagcacagggaggttcgatcgatgaatgatgaaaaagtgcaggcacagttggtacaattaacgacggttattgaaactgcgccagccgattcggcagaatattttcaggctgggcggcaatatcaaaaattattatttgcgcacatgacgctgcgggaatacgaattcatcacataaaatgtcacccatgagctaaatttagcagacgaagcacgtttgattactgccgctgcccaggggaaaatgctgtcgcaagtggtcgacttaaatgaggacgcgcaaattgcctatcagttacgctggttacgcaaaaaaaagcagttgacccaaactgaggtggcggcgcaggtcggcatgacccagtcacagatcgccaaaattgaacgcgcacaagttgaagttagtttgccgcggttacggcgcttattgcaagcagttggtggtgacctagagtggcgggtagtttcttaaaaaaatgcttttaattgcatacaacttaattgtgagctaaacacttgcttaaattcagcgaagtgctaaactattaattgtaccaactggtaggtttttattttaaataaattttgaggctgatgtaaatggacagtaagacaaaaattattacagcagcgcggcaattgatttaccaaaatggttatgaagcgacctcgatcagtgacattatggcggcggccgcggtcggtaaaggccaattatattattattttaagtcgaaaaaagacattggcttagccgttttgcagcagatcgtcgccgaatgggatcagcaattggtccacggtattttggcggctgatcaaccggcggcaccggcgttgacagcgatgttggcttgggtgttggattttcatcgccagcaggatgagcattatggctgtccaatcgggaatgtgatcagcgaaatgtcgactaaggatgaagattttcgtgttttgctagatcaattgatgacggcatggacaacggcattggcggttaaattacaacaattaacgccagtgattgccgccaaggaagcacaggtcaaagtacaaaccatcatcgccacattacaaggggcgatcttgttgatcaaagtgcaccaagatattgcgccattggaacaagccgttaattatttacggcagtcggttttacaacttgaagcatctcgataaggagcgattataatgaacattaatattaaagcagcggcagcaacttatttagcaaataaaattcccgccggcaagcacgtttttttagcgctagacgacggttctaataagttttccaaattaggtggttcatgtgcgatcggcaataagttccaattagttatcgctgatcaggcggatgcagaatacgatgttgtcttggacaataaagcagggttgaatttgaccagtgcaacaccagaaatggctttcctaggcagcggtttggccttggactataacaacggcttgttgaaattaactgatgacagtggtgttttggatggtgccgttagcgtggctgattatgtggcgccaaccgcagacgaacaagcactgaaggctgaaatgcaagctttaggtggcaagatttgctaatttaatagcgggtgactggtgacgtacggtttgaatcgatcgttcgcaagtacaaaaatagcggtgcggcataaatccattatgtcacgccgctttttttagctaaaacttgaccgcggttaagttttgttagggtggtttccggtatgctaaggctatcaaatgaaagaaggaagccattatgaccacacaaacttttatcgacgctgaatttgctaagttaaatttctatacgagccagatcttaaaagtccacggcgctcatcatccggaactagcggtcgtgcgtgatttatttgtcacgatgcaagaaaaagtggcgacgactgccaatgctgatctcacacctgaattaacgcaattagcagccgtcaccaataattatgaggttcccgccgatggttgcgaggcttaccaagcaacttatcagttgttacaccaatttcattctttagcgttagcgggctagaaaagtaaggggatgtgccagttaggggcgcatcttttttttgtgggcaagttggaccatacaaagaaggagctggacataattgctgtcacaactccttgtggtttacgctgtttgcttagtttcaacgcggtattttaagaggtagatattgatcgccgaaaaaatcagaatgatcacggctagcgcaccgctaaaggctaaggtcccagggaggacatcgggatcgagttgaccggtaactagtggcgcgatcagtttacccaacaagtcgccgacggtgtttaaaatgcggatcaagatcacaccaacgatcacataaaataggaagtaaacgaattttgaacgcatttctggtagccaactgctgatggtgcggccgatcagatgaactaagctgatgaagacccagccgtacaatactagggcaaaaaaggcgagcatgccggacccagcgtagcggtaactgtcactggggatgctgacgttaggtacggtcaatagcgcgaggccactaagaattgcttcgatcacgataaagtaaacgtagcctaataacgtagacactagattagccacgtacaactgcaggtcggtggtcggtagtagacgataaaaattgttggtccaaacttgttcggtgtggcgtgccaataagataaataggatcatgccgccgaaaaagccgtagcctaaaaggctgcctaacaagatcgtactgtcatattgttgtttccatagtgccatgatgaccgtgatcaccacagcgatcagttgtaggccgacgatcaggtgaacgctgttgcttttctttttgaataaggtgctgccaagtggccagaatttagtcatgttgctcgcctccggtataaatagtttcgtaatagtcttcgatgctttggccgtactgttcgcgaatggtgtcggcttgttcgttggcgaccacgcgtttgtccttgataatgatcacgctatccagcaggttggcgatgtcgtcgacatggtggtcgctgatcaggatcgtggctgcgtctggcttccactttaaaatgctggcgaggatctttttgcggctcatgccatcgataccgtcaaacggttcgtctagtaggtatagtggcacttggcgggacaaggtcagggcgacgatcattttcttgcggttacctttggatagctggttgaggcgcttggttaggtccaattcaagaaaagcagccagttgttcgaattcatcattggcaaaatcagggtacaaggcgcggtagtcgcggacgattttgtccaaacgggcacggtcgctgacgccatctagttggtggctaaagctgacaaattgtttccgttgggcggcggcggtggcgccgttgacggtgatctcaccgtgataacctttggccacgccgctgatcaagcgcatcagggtcgttttaccggcaccgtttgcgccgagcaggccgacgatcttgccttcaggtactacgcaggtcacgccatcaagaatactagcgagatttagtttataagttacattttggatatttaaaacgtcagtcattttgcgtcatcctttcgttgggcaatgtagtcttccaggtactggaccatctcagttgggctaatgttcagcgccgtgagatgatcgtaaagctcactgaattcggcggtcagcacccgttgcttcaaggccaccaagactttgaggtccgtagtgacaaaattacctttgccccgctgggagacgatcacgccttcactgatcagttcgctgagggcgcgctggatcgtgttgacgttgacggtcagtgtgaccgctaattcgcggatcgcgggtaatttatcgccggcgcgcaggtgttccacgatcagctcacggtaaatatattgcttgatttgataatagattggcactttatcatcgaattgcatgttgaccctccttagtcgtgtgtatttggacaagcggttagcttctgcgtatcagcctagtggcgcggaagtagctgctttttcaatcacgttaaaaactaaccgaacaatttactaaacctgatctagtttcatacgttaatagtgtattagctttctattacactataatacaaactgatgaatttggcaagttattttgctgggcaactttggttgcgctttcttggcgcaactgctagaatttttgggaagactaaaaagataggagcggtaaaatgagccaaacagaaaaagtggtcgcaacgctacaaacattagcaacaggtgcaacgggacaagccacgcaccacgatattgcgacgcagatttttgccagtcaaggttttactaagttaagcgataaatacacaggtcacgccaccgaagaacgtgattttgccggccaatttatggcgcggatcctggatctggatgggcagttgcaacacgaagcccaacccgcacagcaggtattcaccgacatcaaggcttatatgcaagccgaagcggacatttcacaaaaaggcatcgccgcattgacgccgctattggatcatcaactgttggatatcaccagttatgacttggtcaaagcttacattgaagacgaagtggaagatttgaattggacgcaacaacaacttgacctgatcacattgatcggccagcaaaattatttgactaaaatgttgtagacttgtgcgccccgctatggcagctacctagcggggtgttatactttggtcagtgaggagggggtttaatgaaaaaacggcaggaaaaggtggaacagatgctggatcagatcagtgcggcctacggcgatgcggcggtgaaagcacggccagaattgcggcagttgctgttaaaagcagcgactgaattggacaaaactggtgactacgcattgaccgcaactaaactatgcaaaacgatcgccttatattattggacgcaccaacaagacttcccgccggcagtcggtcgcttacatcaacaattaaaaggtgaagccgtcaaatatgatgcgacagctgcggcggcctttttgctaccggtttggttttagagtaaataagcgcttttttcatgaaactcgcggctaatcagtgattttggaaccgttatttcaaattttctattgacccacccaattaatgtgctatattagttacggtaatttgtgggaaggggtggaaaataatatgcacgaaaatgacgaattactggattacttggcaatcaacaccgtggtcgactatttatgcgcgcagcataacaccgatccattggcggcgatcgccaaattgatcactgcggtggccgagtatcgggttgaaagatttgtgggtgatcgtgatctgtatcaggcttccgtttgttacgccgatctaccagctagtgggcgtcgtttagttcgtgaacgttatttcgcttatgtgaagcagacacaacaccagcagtctaacgatgatcattgttcaacgccgggggtcgagtcataattgaagtgtgttttaggtgagtttctggcggtggctggaggcttttttttattggtgtagaccaaaaagtgataaataggggacaatactgatgattgcgttagaagtcgatcttattgacacactaagtttacctgtattatattattcaagataatagttgaatggtggtggagatatgagttcagacgtagttaagtataaaagccagttgtacgctgaattagcacgagttggcaaaggactcagtagtgataagcgattagaaattttagacttactcacacaagcgcccaaaacagttgagcatattgcaaaagaaactgggatcagtgttgctaacacctcacgtcatttacagatattaaaagacagtagattggtcacaatgactagagatggaaaccatattatttataatctcagtgcgccacaaattacctcgttggtccgtttattgattacggttggtgaaaatgaactttctgagatgagagccatccaagtaacggctgataatcagaaaaacgttaaaactatttcccttgagcaggtacgtcaaacgtacagacaaagctatattctggatatccgcccacgtgatgaatatgcggctggtcatattaaaacagcgactaatatcccgcttgaggaattaactgataatttggataaattaccaaaacagcagcaaatcattgtttattgccgcggacgtttgtgtcccaacgctaatattgcatcgcaaatattaaatgagaacggatataatgcttttagcttaaattatagttattatgactggcaagatgatattacagaatagatccttaactaggagttgtcgcataagtaattatgttgcaactccttctttgcgcttccaaacaataaactaatcagatattggactaatttataaaatagaatttgttttccattgttgcttaaattaagccgaagttcggcaaggttaagcgataacgtcccaaaaatcatcgctagtgagtagctttgggccacgcacactaatttttgataagctttttagttgcacttataaaaagtacatgttaatattcaactattcaattaattgattgaatagattttgtgtaaaaagtatacaatgctgatccactggtttagctcggggtaagttgcttacagggataagctacttttacgaatattaatagaaattatagggagcgataaaagtggaaattaagtactggtcagatattgcctgcccattttgctacattggatcgaatcgaatgaaacgggcaatgaaagaattgggtatttacgaggatacaaaacttgaattaaagtcatttcaattggatccagaagcaccacaaaagacagatgaaaagtacatcaatcattttactcatggtgtaaaatcactagagccacaggcaaagcaacaaatggcgtctattgccttgatggcaaaagcagacgatttagcttttaatattgaagacgcggtgccaactaatacactagatgcgcatcggttgattaaattggctgaaagtaaaggtgatcgggttttaacagaacaagttattacaagattttataaggtatattttcatgatggcgtttcgatcgctgaccatgatgtattgacgaacgccgctatagaagctggcttggacaaggacgatattgttcgcgtgctcaactcagatgaatttagaaaagatgtaattgcggatgagctagaagcacaacaatctggtatccaggccgcgccgttcttcgtacttaataataagtatgcaattagtggtgcacaaccatatgaaacttttgttagcgcgttaaaacaagtccaagaagaagataatcactaatcggaggaaatacactaatgactgaagaaaataaaaaagtacttaaagttaaaattatcggtgctactaataacacggcgaccacttgtggtccagatggttgtagcattgtggatcatcaaaaacaagaacagcactcgcaaaatagttctaagtaattatggcaattatctactttcatgaaagtgcctgtaaatcaatcaataagttatgattatgattgcttgcttttgttaggcaggatttttataatgggaaaatcagcttaaaaactaacaaagtgagtgaacaaataaatgaatttattggtgacgattattatgacgcttttcctactggggcaagcggtgattttttggctgttataccggcacaatcggcgaatcagtggccatggccaggaggctaaatgggtccattactatcataatgggatgctggcgttcggtgtgatcgtgatcacaattggtttttgttcgctgtttttctacggcggtgcccggctgaacgtggtcaacacggtgttttattgtttggttgttgatttttgcgcctatgaggttgaatcggtggtgcggtcgaagtagggatgtaccgttcacttaattatgtaagtgaatggtaagcaccaaataactgaccgactatcaaactaactaaatccaagttatgattacctcatcaaataattggtgaggtgatttttattggcaaaacccgatattgtacaaatcaaaatggatcaatctgaaccaca

SEQ ID NO: 510 - DNA, 6070 bp, Unknown
  Metagenome-assembled genome
atgcgctatcacattatacaagaggtaccttagggctggtcaatctcttttgcagaacttggtcaatttcttcgcttaatggggtaaaattttatgccgaagggggtaaatgggaatgccgtcatcataattaaaaagaatgatcctaaggatgtgctttctcctctttactatagcattactagaactacttatgagatccaaggatatccaacaaatggacatgtttctgcatcacacacaagcattaacccgaaaacactaattaaaaaagcaaaagatcttgaaaaaattaatcagaaaaaatttgaattaattaaagttaaacccagtgatatttttagtaattcaagaatccgtagtaacactgtcgaaagttacgtaagtcttgagttacatgatgaattactaaaccactacaagacacgaaagggcacacatattaaaaaagaaatgacaaagttgagtaatgtaattccttctaaagagccggtaattaagtatatccgaaagaacctaccaaatactatcaaaggtgatagtgatgcctttgaggtaaatttaacagataatgatgtccgcgcaattgataaaagtattacaagacaatatgataacgttgaaacatatgttagaaatcgtttaaacaaatatgaagataaagtaattgagcttacaaatagtaatgctaagtacgccgtaatgcgtgaaaaattaaaaaactatcttgaatatgaatattacgataaaagagtcattgagttattcacagataaaacagctcaccatattattggttccaagttaaggaatatgcttgacttataaaacaacctaagattagttcagaacgaaaataatcttaggctgttttgtaattgttaaggttaatttaatcactgttaccttttattgaactaaaattacgtaatcatcactaccatcttaatgacattatttcattacttgtcgattcagtgatatcgtctcaagtaaactttgagctgtacttgcaccctcgtttcccatcttcaaaccggcccgttgcattgcctgttcagcattatcggttgtcagcagcccaaacgttattggaatcttcccttgcaagtttaactgcatgattgcactagtgacattttgacaaattaagtcatagtgatcggtctctcccttaataactgcgcctaatgtcataatcccatcaaatttattattagcgagcagtttttttactgtaaagggaatttcaaaagcgccaggaacatggtaaacgttaatttgatcgcatgctaggccaaatttaagcagagtattaatcgctccttccttaagttggcgggttaccgtatcattaaaatccgcaaccacaattgcaatatttacgtcatgttgattaaattttccactaatctccttcattatttaggcctccaaatttaacatatggtgaaacttttgcttttttgttattagatatttttgatcatgaatattaggagcaatctctaaaggtaaccgtcgaacgatttcaatcccatccaactttaattgttttattttgtctgggttatttgtaagtaaattaattctgtgaactcctaattcttgcaatatttgagctgctatttcataatgtcgttcatctgctttaaagccaaggtgagtatttgcttcaactgtatcataccctttttcctgaagacgataagcttttaatttattccgcaagccaattccacgaccctcttgacgtaaatatagaattattccacggccacgtttttcaatttgctgcattgctttgtgtaactgagggccacaatcacagcgcaatgagccaagtacatcccccgtaaaacactcagagtgcaagcgaaccatcacaggatcatccccactaatatcacccttaattagggctaagttatctcctgtgaagtaatgaagcttaaaatttccatattctgttggtaatttcacttcctctaccgatttactcacttcatttttccgatattcttgtaactccttaatcgtaatgattggtaaactgtattcttcagctatttcatgaagttccttagagcgagccatctcaccatttgacttaagaatttcacaaatatacgctactggttcttcaccagcaagtttagcaagatcaacagccgcttccgtatgtccatttcgctctagcacaccattttctttagctactaacggaaaaatatgacctggcttatagaagtcttcacttttagctgatgagtcagccaagtgtgtaattgttctccaccggtcaaatgcagaaattccggtagtagtcgatttatggtcaacactaatcgtaaaagctgttccaaaaggatctgtattgttagaagtcatctgtgatagctgcagtttttctgcaatttttggtgccatagggacacacattaacccacgcgcgtatttggtcatgaagttaactttttgcggtgtagctttacttgctaaaccgatcatatctccctcagcttcacgatcttcatcatccattacaatcactaacccgccattttttaaatgagtcaatgcattctgaattttcttgatatccattaatttcccctcatttctaaatttgcagcaacatattttcctagaatatcggtttcaaggttaacctgactacctacctgtagttcatccagattagtaatgctctgtgtatgtggaattaggccaacacacgctctggtaaggttattgaagatatcgtggggagtgattatcagggaattataatgtgcgatggttatggcggctatagtaatcgcctttatccaaacgctaagtttggatcatgcctagtgcatattcggcgtgaattcatcaatatcattaaggcatcacacaatcgccctgccaaatcttcgattgcccaacaggcagtatcattattaaggtcggttttccatacggaaaagcacttagtatatcatactcaagaagaaaaagccgcagagcgaaggaaaagaatcaggctattattagattcattttatgactacattagtcaggcccggcggcccctaggcaaattaaagaatgccattcaaaacgcgttagcgttaaagtcacgagtctatcggatttttgaaaatggccaagttccattgaccaataatccagtggaacaggccattcggccatcaacgttaattcgtaaaaatagtctttttgcgaaaagcattcgtggcgcccaggctagtgccgtatattacacgatagtcggcacagctaaaatgaatcatttgaacatctataaatacttcaagtatctgtttgatcacttaccgaatcgtgaaaacaaagatcttgagggctttttgccatgggcaaaagaggcccaggctcaatgtcatatttaaaataagcaagcgtcatgcgtaacatcaaaaccgatgtcgtgcatgacgctttttttcaatacgtgttgttattcggtacttacgcaaaaacttactatctgggggctataatttataaaatcaattgtctgccgacaagcgttcaattaatgcttgttgctgtggaaacatcttttttaattgctcctttttcggaatcaaaatttcattcgaagatgatgacggtaacgtgacactaatttgagaaaatccagttgctctcttcacactttccattgcaataaaagtattaggctctacataaaagccgtgaacttcatcattatccttattcaaacctagtttaaccaagtgataatgaccatcttgagtaaagtaatgcacattaaccggatcaccatatgaatacattagtgacttaccgtactttaccatatgcaaatgtgatgggtgttcatggtcaattgtcgtatacataacaagttcccctggacgataacccttatttacactataagatggataaaagtttttgaagattttttcttgtctttgttgatcttctggagataattgcggtgccggcttagcaggcccctgtgtttcaacttcacctttaccacttattaaagcattaaatgcttcgataattgttgatgagaaaccaatggagcgatctgcaataacactagggatatttaactgccccttattaattgttatataacggctactcttattgcctgcaactaattgcatacttggcgccttaatcattcgattttgtgggccaattcctaattctaagacaagaatttttttgtcttgataattatttaaaaagttctcaaagccgttgacctgtgtttggtccatactaaatacaggacctggaatattaagtgatagtttctctccacaagttgcgcatgttggtaaatcatcttctgttaatgtaccagtttggtcttttttataaatttcatgaagggttgacttcaaatcaacaagtgggtgttctttagggtgtttagagcagatgccagtctgccaatttccttccacttcgagaagatgatcaaattcagctaacgcaaaatggtgatcgatattcgatgtccagatgaaataaggcttgttaccaatcacctgtcgtaatttatccattaattcaccaggatagtaattataattatagtattctgcaattcgtgcataaactcgccatttatcaagttcattgggataattatagttaagtgctcctaataaatttggtaaattatatttctctactaagtcacccagaaccgttgacaatttactgtcctttgcaaataagtttagtccctcagaaattgaaaaaccgttactagcagttactaaaagagcatcagcatcacttaaccattgttgagctgtttttaccgtgttagtcattttgtcctcctttgattaattcagaaatattttgtaaagccctagccgtatcactattaatcaacagtgaacgatcttttattgctggatttgttaagacatcacgaggattgaaattaatatagaatgactgtggcatgtagttggtcatttcccagaatggctcttgtataaacattggtgtcatccgaccaaccccaatttcaatgaaaagtatcttctttaactggtatttgcctagaaactgatttgctttttcgtattcttcatagtatttcttatcttcaagaaattccggaccacgtacccatgggataaggggagtaccatcaacttcacttttaggaattaattcagttggaagacgattatcaacgattttaggtattaattcatctaaataaccatcgataggatacaaatttttatctgttaatgtatttttactctgaaagaatccccatgatccttggatttcactgacatgttcttctgggaagaatttcttgaacaacatatcttgattgcttgtaataatatggtaaggcttattgtcaatgattgtctttagataatcatataccctattttgaggtggaatggttgaaaccatttttaacatttttaataaataagcccatcgctcttcttgagattcaaaacggttatagaatcctttaaaaataccttcaaagtgatatttttggtaaaagtcactcatgtacttcatgaataatggactagcttcataccaaaaatccattcccgcggcatttgacattcctgaaccagctccaattaaaattgcatctgcatcattaattcgagctactacattttcaagtctattcattttattcctccttattgaatactatgtccatttttgaacataatgtagttaaatgatatgattaggcagattgtaaaatttaagttgaacatttaagtggacagaaaaacccatcaaggtctttaatggtgttaccacacaatccattagaaagaaggaccttaaccgtgttgtcattgaaacgcttcataatgaaggacgttccttgcgatacatcgctaactacttagactttagtaagaccaccatctttaacgaacttcaccggctaaatagtgagtaccaggctgggctagcgcaaactgactttgaacgaaaggttagtcaacgggggcggaagtcttcgctcactaaaaac

SEQ ID NO: 511 - DNA, 7045 bp, Unknown
  Metagenome-assembled genome
tgggatcaatttaatataccctaaaatactatttttagattggctactaccaatattgccgctttgatctgggtaaagaaaaaagaaagctgattatatcaactttcccttgactaatggtagaaaaaggcactagcaaatggcgatctattgccatttgctagtgcctttgtgatatatcagattatgcggttggttgttcatcattagctgtttgtttttgtgcctttgtctgcaccaaatcattgtaaaatgccgcatacgttgccgactgataaggtgcgatccacaagaacccaatacccaaggtgagcacccctaaaatgtcccagcctaggaagctcagcattaaaataaagtaatccattttatgaccatacattaattcgcgactacgagtaatggttgccagtggtgtcgctggttttcggcccgccaaacgatcatcttgataaataagatacgcttgactgtaagaaaatgacttgatgagccccggaatcaaaaataacatcgaccataacgtggtgtaaacatagattccaatcgccaaaactagtagtgggacaaaccaaccagcatcaaaagtgaaaaaaggatcccgaaatggtctaattttacgctgtgggtcacgtagccaacgtaagtaggtcagcgaaacccccactgccgctaaagtcgcaacaatccggctcaacacttggaataaccacgccaatatgctgacatcatctcgaaacatgcctgtccaaacaatcacaaaccacaaaacaaacgtcaaaatatttggtattaaatttagtaaaattgcggtgccccaatgaccacgcaataaagcttttgcctcagcctttaattcggctcgagttttcgtcatgtttttcgctcctcgttttatattctcagcaagaaaccctggcctgcaatttctttttaatgtctagaatatcgctgacgcataaaataatttctagacacactttacagtataactgaaaaattaaattgggggaaatagtcagtgtctgtggatttttacctagggctacataaacaatgacctctgttaccgctaatgggcctgatctgaatgttttacggcacacatgttctccgctatgcgttaaaaactttcactacttttggttagccaatctatttcgcccctaggcaactgcgtttaacgttcagcacaaacgtggtttactggtgcttgttacgaccaaattaaacagcctacctagtaggtatttccatgaaaactgcgtataataaagtataactactcaaaaggaaggtgttactttcatgaaaatgagcaaacgaactgccgccgaattagtggcccccatgttagtggcttcaagtgtcttcggcgctagtttgcggctgttcaactacgcattcaagcgcgtcgattatgtgccagaaacttcggctgaaaagcaaaaatatgccgatgcttactggcaatatatggactggtacaaacaggtaaacaaggcaacctggcagctgcacccaaatgatgctgccaatcatttagttgcccatttcattccggctgaaaatagtaagcgtgtcgttgtcatttctcacggttacaaaggcaacggttcaacgatggcgaactatgcgcaaatgtttcatcaactcggcttcaacgtcttgttgccggataatcgcagccatggcagcagtgctggtgaatatatcaacttcggctggctcgaccgcgttgactacttagattggttacaaatgatcatcgaaaaagttggccccgaggcagagattgtcttatttggtgccagcatgggtggggccacggtggaaatgatgagtggtgaaaagctgcctacccaagttaaagccttgatcgccgacagtagctactccagtattgaagccgaattagcttatttactgaaaaagcaatttcatttaccaaaatatccgtttgttcccttggttagcctaatcaacaaacgacgcttaggctactatctaaacgccgttcaatcgacgacccaattgaaaaagaatcacttgccgattttcttcatccatggtgatcacgatagttttgtccctagcgagatggccttcgataattacagcgccacccaaggtccccgcgaattatggttagtcaaagatgcgacccacgttgaaagtttctggatcgatccagcacggtatcaacgtcatattgttgcttttctaaaaaaatatttacctgagcgcaaataaaaagccggctaagcgatttaatgcttagtcgacttttattttagttatgcactgctagtcgtgtcgttaccacgcggtaaacggcggcaacaaaagcaacaccgatcacacggtccaagtaatccgtaccaacttgaacgatgaagacggcggccgttttgcccaggcctaaaccagctaaaagttgaaccagtaagctggagcccgatgaagtgataccgttaaaaagtaacacggtgatcagtgtgctgatcaaggtgccaggtaatgaaatcgccagtgcgcgccaccaaacatttttggcttgtgcttgtggccgataacgataaaccaacccagcggtcaagccgacgatcagttgcaccggtaagtaatatagcgagaatagatcggtggtcaaaccagtaactaagctacccgttaagccgaccaacatcccagcccacggtcctagacatgcggccgctaaaatcgtacccaacgtatctaaatatactggtaaccgcagcaacaacgccaagttgccgccaactagattcaaagccacacacaatgccaagaaaactagcacccgtggtttcatttttcgtgccatcattcagcctccgtataatgtaattgtcgtaaaataacacttaattcaggttcctgtgcacttataacccgattcaagaacaattgccaaaaacgaaaagctgcgacttcagttaatactaaactgttggtcggtcgctgccaaaaattagcggtgtcactgatagtttgccccagcgcaatgccgtccgtgactacagtggtgtaactgctaaaaccgcaacacaaactaggatcgatcgcataggctacggccaatggatcattgatcacgcaaccgatgactttttcttgctgccaatgaaaatcaaaataaaattgggtgatctgggcgataaaaccgccgacttttggatctacccgctgcgcataggccaacaaactaggtgtgagcactattttacgcgttacgtctaaaccgatcattttgatcggcaccggcatggtcgcataaacttgctgggccgcatccgggtcacaccaataattatattcagccactggtgaacaattgcccggactgtgaaagctgccacccattgacacaaactcagccacatgttgccaagcagttagatcctgctgcaacgccaacgcaatattggtcagtgggcctaacgcgatcacagtcacatcatgatttgcctgtaacgtgtgattcaggaaactaactgcacccatgtgcggccgcacttcagtgacgttggctagcgccgattcgcctagtccatccataccatgggtgtcttgcgcgctaacatagtcgcgctttagtggttgcgtagcgcccatgtaaacgggaatatccaaacgttgcgcccgctgcaagattttcagcgcattttcagcaccgagaccagtgggcacattaccacaaacaatcgtgatcccaataacatcgaattccggtgacgccaacgctaacatcagcgccaaactatcatcgatgccaggatcacagtcaataatgacttttttcgcattcattctccaacctctttcttcaattgagatacttggttttttatcctgggaagttcacgaaccagaccagactgacgcctgtttttataaatgcacagttttagtatacaagttagccgtagctttgcctagcgcaggttgccccaaacaaaactttaaaaataaactataaaaaacatatttacgtttgccaaccacttaaaactgctaaactaagtctatttagaagggatcaaattaatgctcacacagtttatggcggcatttttagctatctgtttgccgctgatcggctatctatttttactaccttttttattcgtattggtgcttacttacctcaatcgcaactctaaacagatgttagtcaatcaattcggcctgcaagcccaagtttatttaggcggtctaggcattgttttgcatgaaactagccatctgctaacagcgttactttttcaccataaaattatcgattataaattattagtgctaccctggcacctcaatgcaaattcgaccgagcaagcgcttggttacgtcaaacacgctgcaactaaaatattttggcctacaatgggtaatttatttatcggtatcgcgcctattttcggttgcaccgcagcgatgtaccttagcacctacctgttattaccagtgacttatcagcgtctagaaacttttgtcactaatcccagcggcgacgcattgcaatggctactaggtagcttttcgcttagttcgttacccttattgctgatttggctagtgttaataaccaatatcactttaggcggctttgatttaagcccggccgatttcaaaaactcagccactggcgtattaccgacgctactgctagtgctgatcattagcggtttgatcgcaattttaggcttaagcgacaacgcagccaagctaatcgaacatgctggcttaatgatcgtcagttggttgatcatgtctgtgatcattagcctgctgctaaatggcctactacgagtattgcggctggtacattagctgctccaactaaaaagtgctgtgaacgtgttaaaccactaaaatggtttgacgttcacagcacttttttggttacagttgaccatattttgataaaatacaattatttcgttccacatgaaacaaattctatcaaaaaaatcaacccatttaggtgtaaatttgttagaatacgtattagagatgacctaatgtctttattagccattattactggtattttaacgttagccaactacgcttttctaactggacagatttatcctgtatttatcggcgtctttttgcaagcggttttaacaattgttactttcatgacagtcctagcctatcgcggtcgacgctagcgtcgtgactacgtacacggtggttataaaatttttacgctgcgtttcggtatcattatggtatcttgcttaggtaatcttgctgttcttattgtcatattattgaatctatttggacgtttaaatcatttttaattaggcatttcacccattcacttttgtgtagaaaacgcttatagtggatatagtttttacggagaaagataggtgaacccatcatggcacattttcacattgatcacgctgcattaactggtaatcaggaaaaatcagctaagtcagctaaaccaaaggaagattttcctaacgtatttgattatcccgattttatcgaaatgcggccgcaattgcgccaagcggtacacacagtcgcggaagaatcctttgatcaaccagtactgcctgtcaaaattgaacgcttagcagtggcactggaagaagaattagaacaagaaacacgtaagtatgaggcacaaaaagccgtttttacgaatcaaaagactgagtgtaatgacctgatccgtttgtatacgcaaattttacaagttatcagtcgtgaccctgatccaaataatactgatattgaagacttgatctttgcggttgatcagacacggcaggccttgcgtaaactacctgaaaagcctggtaagggacctttatatgatcctgatagtgtgcgcgcgatcgaaccagcaactttttacgattttgtaattcaacgtttagcgcacccctactttattagtaattcgcatgaactgcaccgcaagaatttatcccctgaaggacagcaattcgtcgaccgtctgtcggcctatgcattccgtgactgggatgcttatttgactcatgaatatgatgcccagcaaatcattaaaaatgagaaaaaattagaagaccgcgtttattatacgaaattggaagagatcgaattgaagtatgccgataaagcttatgcacaagtcttcgctgatacctttaatgactttgccaaggtcttgacgccgggctatctaaatcattttgatatccatacaacaccaattccggttgcgaatgctgttttgcggcaccatttgtcggctatcgtccatcaacattttttggtcgacgataagggctatgagcacgtgatggatgaacccatcaagcagatcaaggctaaatacgcgttttatctaaataatttctcttagacaacgtgctaaatgcctttaacctcaatgaaagtaagtgatcccgcgtgaatcttagcgcagaacctggtagtcctgaatttgaaaatgctatttttattttaaagcaaccaattacagccaaaactgcaccgttattggtttttcacgataacgtcgtgcctgaaccgatggacgcagaagcgtgggccatgcctgcttatctcagcgatgattttaatttgttttttgttttcgcgcaaaacatgggcaccaattggtctgccactttcgctcaagtcacgatcgaaaacggcaatcaaatcaccagcatgtccaacgttgtgcctacgggtacgggatttaacgcgcttgctcgcgttgatcggcacgctgctattgaattactcgcctattttgaaacccttgctgccagtaatttagggcattgggaaatgggtgcttaaataaagtagcgacaataatgttactgaaatgcttatgtataaaaatggttctatactttttcctgttgatagcttaacatggtaatctattagcaggattttttagtgcaaaataaaaaaggcccataagcctcgcacctaaaaaatccacccactacagcatcttttttaaaggacgtgaaaacttatggaccctgta

SEQ ID NO: 512 - DNA, 10663 bp, Unknown
  Metagenome-assembled genome
aagaccaaaccaaaggaacaatttccaaacgaaaaatctttagacaatttcattggagttcaagtcataagctataacgaaaagtacttcaatcgtagccatcgcggatttggtcaagtcaaagacaggttagaatcacttttcgattaatacattattttgccaggagaagggattttcatttacacaaacttcttgacactccctaaaaaactgtcattattaagtgagatagaggggattttcgtatgcggataaccgtatttcataattcaaatactaaatcggttcacacagcggcagatttaattgctaagctgaagcgagcgggcttttcagtcgttaaaaataatccagaaattgtgattacgatcggtggcgatgggacgttattgtctgcttttcatgaatacgcacatatgttagatcgcgtccgttttatcggggtgcatacggggcacttaggtttctatactgattggcgtgattatgagttagatgaattggttgcgagtttaaagggtgatggcagtgagcagatcatcagttatccattattagatgttggcgttcgttatgctggggataattcagtgacccattatttagcactgaatgaatcgactttgaaacgagtttcggcaaccatggttactgatgtttatattcgcgatgaactgtttgaaagttttcgtggtgatggcttgtgtatatcaacaccaacgggttcaacggcatacaataaatcaattggcggcgctgttttgcatccacgcttagaagcaattcagttagccgagatcgcgtcgatcaataatcgtgttttccggacgttaagtgcgcctgttgtgatcgcccctgatgaatggatcgacttgtatcccgatcctaagggtaaggatgattatgtaatgaccgttgatcgcttcgtccccaaaaaacgattgatcacggcgatccgttatcaaatcgctaagcaacgaatctcttttgcgggttatcgacatacgcatttctggaatcgggttgaggacgcttttattggcgataagcagcacggatgatttttacatggcaatatttcggtgcagcgccgcaaagtgtgcgtacttttttaacggcccagggaatctcgcgtactttactcaagaaaattaaatttcatggtggtcaactaagtgttgaacagcagccagtaacagtgcggacgctgttgacaactggtcaaacactgacagtccaattaccgccggaaggtgcgccggctacattgacggcatcagcaacaccgttaaaagtggtttgggaagatgagcatattctggttgtcgataaacctgcccaggtggcttcgctgcctagtcatatttatcctaaggacacgatggccaatcgtgtgttaggttattaccagcggcacggttatgcaaatcaaggtattcatattgtgacgcgattggatcggggaacatcaggcttgatgatttttgccaaacacgcttttgcgcatacgttattaagcgaacaattgcacacacaacaattgcaaaagacgtatttagcagtggtacaagggcagctgacttatactcacaatcggatcacttttccaatcaaacgagccccttggtcgtttattgagcggacgactgctgtcggtgggcgtagcgctttgactgaatattggtgccagcagcagtttaagaatgcggcactggtcaaagtccgattgcatactggtcggactcatcaaatcagggttcatttcgcggcaattggacatccactacttggtgatcaactctatcaaggaccacaaataataaatttacaacgaccagcactacattgtgctcagttacatttttatcagccatttttggcaaaggatttggatctggcgagtccactaccggcagatctacaagtattattgaatactctcaaataagtaaaggggcgaggaaaattggcagatatagaaaataaggtttggttgactcagctgcgccatttaaaacgcttgttggctgctaatgatcccactgcttttcatgcggcttttttagagttgcatacttgggagcaagcgcaattttttcttggcttaaaccgttcggagcgaatggccttatataaagtacttagtgcaagtgaggttggggacttttttgatgatattgacgatgatgaggcacagctgacggtgttcttagccgaaatgcgccctgaatttgcggcgcagatgctgactgaaatgtatattgataatgctgttgatattttggagcatttggataaagcaaccgtcaatcggctgctagcacagatgccacatcagacggcagtggatatgcgcagcttactgcattatgatgatgaaactgctggctcgattatgaccactgaatttgtggcgattgtggcagaacaaactgtggcctccgctatgcaaactttgcgtgaaaaggccgaagatgccgaaatgatctactatatttacgttttagatgaggtgcaacatttagtcggcattatttcgttacgtgatctgatcgttaatgaccagactaaaaaagtgcgcacgatcatgaatgaacgggtgatctcagtgcaggtaacggatgatcaagaaagtgttgcccaaacgatccgtgactataatttctttgcgattcccgtcactgatgacgagaatcatttattgggtattatcacggttgatgatattatcgatgttatcgatgacgaagcagcatctgattactctggtttggccggtgttgacgtggaaaatactagtgagaatccattgaaagcggcagtcaaacggttaccgtggttgattactttactattcttagggatgtcaactgccagtttgatcaatcactatgaaagtttggtcagtgaggcaagtgtgctggcggtatttatttcattgatcacggggacggccgggaatgctggtacccaaagtttagccgtggcggtacgacgtttaacttttcctgatcaggaacgcagctttgttcagtcgttattggcggaattaataactggtttgatcactggggtagttaccggtgttacgatcacgttggtggttggcgtttggaagcataattttacgttgggctttgtgatcggtctggcgatgtgttgcgccattgtcgtcgctaatctagcaggtagttttattcctggtttgatggcgcgcttaggctttgatccagcggttgccagtggtccgttcatctccaccttaagtgatctaaccagtgtgctgatttatttcagcattgcccagtattttattgcctcatttgtacagtagcaatcaagcggtctgcgttggcagatcgtttttgttttgcagtgataaaaaaagctggatgtttgacgtgaactctatttaagttcaatataaaagtctacacaaattgtgtacaatgaataactgaaaggcggttttatgatggcaaaagacgatgcagaattacggcagcgaatcggtgatgaggcatatgaggtgactcagcatgctgcaactgaacggccatttagtggcaaatatgataattttgatcagccgggaatctttgttgatattgtcagcggcgaaccgttatttagttcaactgataaatatgatgctggttgtggttggccgtcattcactaagccaatcgctaaaaagcagatcaagcagcacgttgatcgttcgttgggaatggctcgtactgaagttcgtagtcaaaatgctgattcacatttaggccatgtttttacggatggtcccgttgataaaggtgggctacgttactgtattaattcagcagcgttgcgttttgtcccagcaactgacttgacagcgcaaggctatggcgattatcaatttttatttgaataatggagggaatcaacttggaaaaagcaatttttgctggtggctgtttttggtgtatggtcaagccgtttgatacccaaccaggaattgaaaaggttgtttctggctatactggcggtacagtggctaatccgacttatgaacaagtggctagtcatacaactgggcatacggaagcggttgagatcacctatgatcccagcgttatttcctacgctcagctagtagaaagctattggcggcaaaccgaccctactgatgctatgggacagtttcaggaccgtggtgacagttaccggccggtaatttttgtaagtaatgaagcagaacggcaaattgctgaagcttctaaggctaaattagcggccagtggtcgttttgataagccaatcgtcactcaaatcgaagacgcccaacctttttatccagccgaagcagaacaccaagatttctacaagaagaatgcttggcgctatgcgattgaggaacagggcggacgggaacaattcattcacgaaaaatggcaataaattttttagtgagtcgtctagtattgtgaaaatactaggcgtttttttgtgaccaataaagggacgaacaaaatggagctacgaaaaggccttaaaagcgtatcaaaaaactcttgatcttcgtgttcatcacactaaatcaagagtttttgatcaacctaatgtaccaacaactttggtaccatgcacttctgggatacctaattctgtagctaattcagttgcgttatcggcagtgatcccgccaccaggtaagatcgttagccgaccattagctgtcgcaattgtttgctttaatgcggcaatattaagtggttcggttaatgggccaccatgcgtcaaaatacgggttacttgatgttcagctagccaatcaattgctgcaggctgttggtccgcagcaatttcgtcaaaagccatatggaaagtaacttccatgccaccggctgctccaagcagcatttccatagcttcttcatcgatctgatgatcactagttaagcatccaaagaccacaccatcggcgcctaattgttgtgctgtaaaaagatcagcctccatcatgcgtaattctaaatcgttataaacaaaatcaccaccgcgtggccgaatcatcgtaaaaacgggaacgtctttttcatgagcgtaacgcattgtttcagccattacgccgtggctaacggtcgtcccaccaacggctaggttatcgcacagctcgatgcgattagcaccttgacgaatggcttgtggtaagttggtaaagttttcaagacaaacttctttgatcagcatgataagctcctttattgtttcaattaaaaattcaaaaagcgcacgcaaactggttcagtacaagcgatatctttttgtagtaagcttagtttaccagttttagcgtcacgtgcaaacaatgttagattgctggtattttgatttgcacagacaacaaatttttcggttggatcaaaagcaaaatcgcgggggaattcgccttcggttgcgattaattgttgtaattttaagctgtaatctgctttgatcgcaaagctagctagtgagtcgtgaccgcgattcgaaacatataagaagcgaccatcagcggaaatacgaatcgcggcagcaccattatgagtcgtgtgttcagcggggattgttgcaatcgtctgtaaatgagtgaaacggccagtggtagcgtcataattcaatacttcaacggcactgcctaattcaccagctaaataagcgatcggtgcggttgggtggaagacgatatggcgtggaccaaatccagcggcagtttggtaaacggccacttcagtaacttgtccatctgcggtaacatcataagtgtgcacttcatcggtgcccagatcacaagtgactaaacgttgatccggagtcaaatcggcaaaatgaacgtgtgcaccgtcttgttctggttttggtccgtgaccatgatcggtaacggttgtcactaattcaaggccaccgtcaggcaaaatacggtggatcaataattgaccactgtggtattttgctgaatagactaactggtgtgcttcatcgaccgttacgtaagcaggtgatgagccgggttgaactgatttattgatcaatttcggtgcattaaaatcagccagatcataagcgactaagccaccagcatctttttcggctaagacactatacaagcgctttgcttgtgaaacggccaaataagtaggattgccggccgtaatgtaggctgttggttgtgctaattgctttttttctacatctaaagtggtttgatagataccagtgccggcattgcgggtgtaactacctaataataattttactgacaaaatgaaacatcccttcttgcttaggtttgttgatcaattagtgattcggctcacagttattttatagtacgtttaacactatcttagcatagttggttagacacggaaaagagtaacgagggtactgtttttgtgatacactaatggcaatgagtagtggtggccaatttaattgaaagcgtcaccttaattggaggaaaaattttatgagtacagttacgagcacggttattgcaatcggcaaccatgccattgaaaatgaagatccattggttattttatttgaccaagaagcaacgcctgagttacaagacattgcggtgatccaagaatttagtgagccagcggcaatgaagacgttgaccttggcggaaggcgatacgatcacaatcgatgacaacacttatacgattgcatacgttggcgacgtcgccaatcaaaatctgcagacaatcggccatatcaccttattatttgcaccgctaccagcttcagatcgactaggtaacggcgtttatttgaccacaacggttaagcccgcttttcatgtgagcactaagattagttacgagacagacgattaaagcatggactaccatttattttttataaacgatcgccatgtcggctaaggtattcatgtgggtaaggatcgcagcaagttcatccagccaaggcatcagcataacggcgccggtaccttcgccgacacataattgtagatcaaagtagggttccagtccaagctgttgtaaagcgcgctgcgaacctttttcatgcgaaacatgggatggcaccaagtaatcagtgatggttggtgctattttttgtgccaataatgcggcagcataggaaataaagccgtctaaaatcaagggcgtgtggtgttcggcggcagctaacatagcaccgactttaccgccaaattcgaagccaccaactttggccaaaatatcgattggatcagtggaatcaggttggttgcgcatcaatgcttgctgaacgatcgatattttatgggccaatttggcatcggaaatattagagccacgaccgacgacttcggcagcagtacattgtaagcaggcggcaacaacggcagaggcggtggtggtgttacccacacctaactcacccacggccaacacttcacttccgttattaatggcagctagggcggtagcatagccgattttaatcgattttagggcttgttcacgcgtcattgcggggccttgggcaatattttgtgtaccataagcaatcttggcattgatcaacttaggaaaagtccgttgcgaatcgatcccaatatcgatcacttgaacctgacaatgagctgcgattgctaaagcagccacggcagtgtgtccggccaacatattaccggcttgaacaatagtgactttttttggtgttgctgaaacgtgctctacggtcacaccatgatcggcggcaaaaactaaaagtgttttttgccgtaagcgtaagctagttgtggcctcgattccggctaagcggatggcaagctcctctaaacggcctaagctggcaatcggtttggccaagccgtttacaatttgccgcatagcctgtgctgattcgctagcgagtggtggtaggtgataagtgtttgcctgaaatgtttgcatcgtaacgcctgatttcctgtagaataaatccattgtaaaacgctatcatggatttgaaaaggatttaatttaaaaaagcacgaaatacgcagcacacttgactgccatatttcgtgcttttggttatgagtaaaaataaattattttagcgtaaataagccggtaaagggagccttctattgatatattttaatattgatcgccgttaaaaatcgaatttttaacgattacgtaatcaactttagttaacgcttttagatctttgccaccagcatatgaaattgccgattgcagatcttcttgcatttcaactaaagtatcggcgatatcacctttataagtgactaacatttttttaccttcgacattgtgatgtgcgcctttttggtattccgaagcggagccaaaatattctttgaaaagttcgccatcccgttcgattgttttacccggtgactgtttgtggccggcaaaaagggaaccgatcatgaccatactagcaccaaagcgaattgatttagcgatgtcaccatcagttcgcacaccaccatcggcaatgatcggtttactagctgctttggcgcataaacgtagtgctgctaattgccagccgccagtaccgaaaccagttttgatcttagtaatacaaaccttgccggggccaataccaactttagttgcatcggcaccagcattttctaattcccgcacgccttcaggagtgcctacattaccggcaattacaaagctgtccggcaagtggcgcttgatatgttgaatcatgtcgatcacccgttgactatgaccgtgagcaatatcgatggtgatatattctggattcagcttggctgtggccaattgttcgataaagtcatattcttcgggtttaacgccgacactaattgaagcaaatagattagcttgatgcatatcacgaatgaaatcagcgcgggttgccggttcgaagcgatgcatcacgtagaaatagccattattggccagatcttttgctaggggtgcgtcgataattgtctgcatattagctggtacaacgggtattttgaatgtacgtggcccaaatgtaacccgggtatcacattctgaacgactatcaacgatacacttattagggactaattgaatatcttcgtaatcaaatacttgcatgtaagccaactcctcataattgcgcatcatttacataaacacgaacaataactttaaataatgtcacatttttcgttccttagatagactaacccaatttcaagctaacgtcaatactaaaaacggataatattatattgattcgatttattgttcgtgtgttttgctttgagcgataacagtgtagaatatgaagtaccataaataacttagaggaatgatttttgaatgaagaaaattgagcgcggtcagcagtttttgcgccagcaccttaatttgtttcaatgtccggtttgtcacgaggcttatcatgcagttatcgagaacagtttgagttgtcccaacggtcatcaattagacctcagcaaaaaaggcaccctatattttctacagcgacaagtgcaaagtgagtatgacgcagcaatgttagccagtcggcgacgaattttgcaagcaggcttatttgatggctttttggatgtggtacgggaaaagctacccaaagcaggcgttggcttggatgtcggctgtggcgaggggacgccgctacataagctggaagccgacttgaaaacggcgatcgggtttgatatttctaaagcgggggtcaacttagcaacgcagcaagatacggcggcttttttctgtgtggcggatctagcgcacctaccatttaatgccgcaacatttgacgttattttgaatattttttcaccatctaattatcgggagtttgcccgaattatgcggccagatgcacaagtgatcaaagtgatcccaaatactgattatctcagtgaattgcgccaagccttatttgctggtgaccggcgggcagtttattctaatgagaaagtactagcccattttaaagagagttatcgccaagtaaccgcacagcgcgttcgttaccaatttacgattcccccagaaaatttcgctgatcttgttttgatgacaccgcttcattggcaagccacaccggagcagctacaacagctactggcacaaccatttccgcagatcacagttgatgtgaccgttttaattggcgcgcaatcagtattagattgaactttttgttaagaaaatgtaacctgaagtagttgtaaaacgcgacgtaaggtgttatagtattttcaaggtattttttcattaacttttatcagaataacctttaagttttgataaaaattggtgattaaaacttcactaacgtactgtctcgccgtgcccacaccgagatggtacgttttccattttaaaaggacacccagcttacgatatagtgagttgggtgtttttagttacattctgttgtgcacaagctaattgttttaacatttggtagattgtaaaatttaagttgaacatattagtggacagaaaaacccataaaggtctttaatggtgtcaccacaacattccattagaaagaaggacctttatgggcaccactattttatcatttgaagaccgcgttgtcatcgaaacacttcatcatgaaaagcactcacttcaatatattgccgattatttaggctttagtaaaaccac

SEQ ID NO: 513 - DNA, 10554 bp, Unknown
  Metagenome-assembled genome
ctaggtgaaaaactcgacatggcggttgaaacattaactattatttttgacgaatttataaaagcattaccgagtagcctggccaggctactcggtaatgctcaatgaagtggaaactagtaatatatcgtgccataaccgtttgacatcaatggttacggtctattttgatactttcaacctttagtcattaatataaaaaatagcggctgcttagcgccactattcaaactaaatttattttgcgagctttatcagaattacatctttacaataaacagactatcaagtgtgtttaagaagacatattttttcaagtacatttcattctattgatatctcaccccacgtcgaaatctcttccagaagctggtgtcatcggtttgtaacatcaagccttcgtaaataccgctgacataacggatcaagcaaaagatactagctaatagaagcaccaacgaaccggcgatctcccagttgctgacactttcgtcgatgattcgcagtggcatgaagtatgacgagaaaaacggcacgtacgacagaattttcgccgttaaggcatcggcgttattttggaacggaaaagttgcgaagaaagcgatcatgctcaggtaagtagcgggctgcgctgccttaggtgcgtcctctgccttagcgaccagcgcaccactgaaggccgacaagatcgtatataagatcaccccgaggaacaaataaagcaaattgatgcttaaaatattgtgcagcactttgccgatcaggtcctgattattcgccacaatgtctttggaaaaagccgcccgttgcgccgccaaataactggcccaaccgccgataatgtaaacaactaactgcgtcaaaatcaccaacaaaacgccaagaatcttgccgagaaagtatttgctggcggtggtactggaaaagataatttccatgatcttggtgcctttttcggaagcaatttctgatgcagtgatcgaggaataggtgatcaggatcatataaaccataaagaccatgatccaaaatgagatcagccgcgccaacttagcgttaccagtctttttgtgtacgatttgcttaagttgtggtgcttgctgcaacgctttgacttgcgcggcgcttaatttagcattaaccacattaagttgctgctgttgctgcattaaaaaggtatcaacttgtgttttcagactgctatccagtgattgaccaccgcgataagttgccgttgcccgctgtgcatcctgccgcaaaattaagtacccggcgatctgatcagctttaaccgccttttttgccgccgcaacggtagtaatgcttgctttcacatcgtccttattttgttgtacgaactgcttgcgtacactcggctgctcagcaatcacggcaattcgattgcccgcttgactagaagtaccactcagatagccgaccccaaaggtcaacgccaacattgcaaatggggctaaaactaaaatcaaaaagctccatgatttgatttggcgcaggtaagtttcaaaggtgatgatccataatttacgcatcctgctcacctactttcatccggaagatctcatctagcgtcggcgcttgttggctaaactcttcaatatattgtccttgcgttaattgacggaaaatttccggacctgccgccggatcagctagctgcagtaaaaatcgtctggccgctaattgagtaaccttaaccacttgtggtaattgcgccaatcgttcctgtgaccagtcagtagtgacaaataaatgatttttgccaaactgttcgcgcacatcgtctacccggccgttgagcacgacttgccccgcttttaacatgatcaagcgatcacataatgccgtcacattgcccatatcatggctggaaaaaataatcgcggcgccttgctttttggcttcaaaaatcgcctgctccaacagatcaacattgactggatccaagccactgaacggttcgtccaaaattaataacttaggtcgatggatcaaggtgcagatcaactgaattttttgctgattacctttggataggtctttaatcttgtcagtccgcttgcccttgaccgcaaatttagctaaccaatcatcgatctgtggccggatctccttagctgatttatttttcaaacgcgccaaataaacgatctgctgctcaacggtcagcttgggcatcagactacgttcttccggcaaataaccgatctcatcgaacaccgcctccgtgatcggctgatcgtgccaactaattttgccggcgtatttcaaaaagcctaaaatactgtgaaacgtcgttgatttaccggcaccattttggccgatcaagcccatgatctcgccagtttgcacggtgaaactaacatcctttaaagcctgcaatgacccaaactttttcgatagctgcttgattgctaacataaaatccctccagagtggctgaaaaagcgcccagactttttcagccacgttttcactaaaaaaatgatacaaactacccttttgcacgtttctgcccgttaactgttttaacacaccttagattatactggaccgggcctaaaaagcgctaccaatttaggcaaactaaaaagcgccgattaattgatagacgctgatcactttattgtaataaactaaacttcttagtcagcgcccgaatggcaccatcttcaccagaaagcgcgatccccaccggctgcaactcgactagccctttttgactgatcatcgcggcgtattcagcaaaccgatttgttcaacgattgcccagtagccgtaaacaccacgctctgaatttccggccgttcaactaacgacttagccaagttagcaatctgccctgaaccgcccttcaggactaccgtactatatttgatccccgcatgacgaaccttatcctcatccaataccggctgcgcagcaaaaagagtcgacgcgatctgtgccaattgccccatcaggatcgccgccacattacccacttcaccgactgaaagatttttcgccaaaaccaacgcattacgttgcataaccaaccaccccttatcttaagttaaatgtaagcataccataagtcgcgcccctttttgaccacaaaatttcacttgcttgcatgaccgttttggaagcggtatattttagataaaaatcagccgcatgtattcatttaaagcggcttgcccacataaattacagctgaatcgaggtcacttgccatgcaagacacaaaatattccttactcgatatgtttaagtttgtctttagtgaagtgctgcaaaagcgctggctattagtgctgaacgtgggggcactgactgtgatcacgttgctacaatttgtgatcccgcaaatcgagcagttcatcatcgacaaagttatcccgcaacataattacaattcactattgaccgtgatcggtttattgatcggcgtgacgctagttcttggtgtcgctaattatttgtctacctattatatgaccattatgagtcaaaacgcgatcactgatctgcgcaacaatttgtatcaatacatcgtccgtttggatacggcctttttcgaatccagtaaaaccggcgacttgatgacccgcctgaccagcgatatcaacaacctgcaaaacttaatttctgccaatatgctatcaatgatcggtaatcttttcactttagtcggcgtgctcggcttgattttttacattaattggcaaatggccttggcggtcagtctgaccttcccgttaatgtttttgatctaccgggtatttcgcaatcggatccacgaagctttccgcaaggcgcggctatcgcaagctcaaatgtccaaccaaatgcagcagatgctgacccagatcgacttgatcaaaggctacaccagcgaagagcttgaggcgcaacgctttgatcgcttggcgcagaattaccggcaagacatgatcaacgccggcaaaaaccaagccattttttcaccgctgatcgacagcattaattacttgggcatcggcattatcatgagtttaggtgcctacttcgtgatccaccaccagatcaccgtgggggcgctcgtggcgtacttgagctatgtggcgatgatccaaagtccgatccgctcgttcactcgcctactgaatcagctacaacaatcgctagtttcttacggtcgcattcaatcgattttagcgatcaagccacaagtcagtgacggccctgacccgcaaccatttcctaaattacaacagggaatcacgttgcgcgacgttagttttgactacagcaccactgaagccaccgaccggaaaagcgccaccattcagcatgtcagttttcagatcccctttggcaaaacaacggcgctagtcggtcattctggctccggtaaaaccacgctgacccgcttgatcacccgcttgtacgatctcgatgacggcgatattttattcgatgaccattcgatcaaaagtattggcctgcaatcattacgtcaaaatattgccatcgtttcgcaagacgttttcatcattgatggcacgatccgtgacaatattatctacggtcggcctgatgccagtgatgccgatatttggcgcatcgtcgctttagctgatttaactgactttatcaaccaattaccggaacaactggccacgcaggtcggtgaacgcggcgtcaaactttccggcgggcaaaagcagcggctcgccatcgcccgcggtctacttaaggatgcgccggtgatcattttagacgaagccaccgccagcttggataacgaatcggaaaaggcgatccagcacgcgttggataatttgctgaaggcgcgcacggctttggtcatcgcccaccggttatcgacgatccacaacgccgatcagatcatcgtccttgatcacggcagcgtggtcgaacaaggcacccataagcaattgctgcagcaaaacggcgcctacgctcaactgtacaacgcgcaatttgactagttcggccggcaattttcatttttgatcaatatagctatacaacgtatatttagaaatattgaagtacgcggcgactttatcgccggatttagtgaccagaaaagcgccgtgctggtttaagtaatgaatgcagtgcactttgtcagccttgttcatcaacgccaccggcttgccgatttgtttgaccgattcagcaatcaaatcatccagtagctgcgtcacattttgggggatcaggttcatgctagttgcggtttcggtggtctgcgtaaaatcctgcaacaccgattccgtggcaatcaaatcagaaatatcaaaattcagcgataggatcgcctgcaatccagcggcatcttttaaataaacggtgcttgagcgcaatacacggccatcatgggtatgagtcagataattgatccgatcatgtaattcggcagggtctttagtcaagctttctaaaataatttgtgacgggccatccgccactgttcgttccgtcacctggccattttcgatcatcacgatcgaatgcgccaagtgtgcttgatcgattttatggatcacgacttcgcagcggctgccaaattgcccagccaaggcccgacctagttgcgtcaaaaattctatttgttcatttaacataagctcagctcatttcgtgaagtttttgggatgtaacggtaacgcctgcaggccagttgtggcgagaatcaaaagggtgccgactgcttccggccaaccaaactgaacctgaaagatcaaaacggtgaggatcgttgaggtcagcggctcaaaggctcctaacaaactggtgactgtgggtgcgatgaaccgcaaactttggagaataaacaaataagcaaacaatgtgccaaataccacgacaaaagccaccgtcgctagtcccggcagattcaaatgcgccggctgccgtaacgcaaacggcaagaagccgcaaccgccaagtaacattgaccagccaaccaccggcaccgcgccaaactcacgcaataatttacgcggaaaaatcgtgtagatcgccgtacttaacgcagtcaacaggccccaaaccaagccggttggcgaaatacttagtcgggtcaactggccatgggtcaccagtaaaaaagtgcctagcagcgctagcgccatcgacaatagatcaattccccgcggtcggcgccactgacgcaacgcaaagtaaagaatgatcaataccggactaagaaattgtaaaatcgttgccgtggccgcattactgtatttgatcgccataaaataggtcaactgtgccggtaacatgccgataaaactaaaaatcagtaacgccccaatcgcgcgcggctggtgccacaaggtcaacattgagtggggctgcgttaaataaccaaaacctaacagcagcaccccagcacctagcattcgaatgcccactaaccattgcggactgacctgatcaaccgtaaataaatattgcgccgcgatccctgaaaagccccacaacaacggcccggcaatcgccagaataattccgcgctgccgtaaattactacttttttccattatcaaccatccccgacctaatttgtgtttgaaaaatattattaagttagcctaaacgtggttgaaaacgcagcttattacatataactacgctagccaaacgcatcacgatgtgctgcttattgtctagctaggttatattccataagctggacgctttttcaacgcactctaaataaaaaagacgcctacccatagagacactaagtcccttgggtagacgtcatcaattacttaagtaatattttcagcgaacgtcatcgctatctgaattaactataccataaaaaaattctttgtaaattaatttttttgtgatacaacctcaaacatctttttgctcggttcccagaatcccggtttgccgataatagcttattttaacttggtccaaaaccaaggttgcgctaaccacaattcccatcaccactaggacatttacccagctgacctgtgcggtaaccaggcccgccaaggccagcaccgtcgctaacccaatatttagaaaaacgacccatcccactaacttacttggtgcgtattcccaaaagtgatcgcgcgttcgcgtcagcatgatcgtcgtcatcgcactatagatcaaataaagaaacatcaacgtgctaattttagccccacttaattgggccacagccaaataaaaccacagcatgatcaggccaaccgcgacccacacaccggcaaagataccggcaatttgggccaaatgaccaagtcgccagtgttctggtagccgtgtgggccaagcccgatcagtccctaacgttaacgtcacccaatcattcatgatcacaatgaaaacgattaggtttaacgcaaccggaaagaagccagcaaacacgaaaccaagtgttagtaacgcggccaattgcgccgttcgcgataatttagtgatcgtccaagtcatcattctccgataaacacgatgaccactgtcgatcaccttaacgatatcggctaaattcgcgcgcgtcagcacaactttggccgctgacttagcaatatccgtggcgttggcaaccgcgatcccaacgtccgcgcgctgtaacgccggtgcatcattgatcccatcaccggtcatgccgaccaccagccctagcgactgcagttttttaacgatctttaatttatcttgtggataaacatcagcaaacccattgaaggccagtggtgtcaccgcagcatcagctaaggtgcccatccgcgcgccaatacccacctgagtagcaattactgtcgccgtaagcggcgtatcgccggttaacaacatgacccgcacgccgcggctttgaatggcattgacggcagcaagcgcatcaggccgcaattgatccactaattcgatcaagccaataatttctgatcgggtcgccgtttgccgcgcaattgctaatacccgcgcaccttgctgcgttaataccgtcaattcctgccgaaaatttgcgggtactgtcgcgttagccgccacaatatccggagaacctaaaataagtcgctgcgctagagtcgcttgagcaagcgtcgcctgtgccgtcttggttgcaggatcaaaagcggtaaaggcggtgcgcttaagtggcgttagtgttgccgcaacggcagcttgttgcagcgctacactaactgtatccgcagccgtatcgtcgatcgttgtcaccgcaaattgtaaaatctgccgcggcgtaaatgggccaaatgctgtgattcgcccaactttcggctgatcggcagtgagcgttcctgttttatcgatcagtaaaatatccatgttggccgcttcctgaattccggttaagccagtaactaggactttttcttgagtcaattttttagcttccaacgaattggccaccgtaaaactcgacggcattgagatcgggatcgtggcgataaacaaaatgaccaaaaatggcaatagctcttgccaaggcgtaccgcgaaataccgccgcaatcactagaatgatcgctaaaataatatccacataggccagatagcgcacaatattgaacagtaatttttgcaaccgccccggtgccgtctctgtacgcgccaattcggcagttttaccgtaagtgcttttaaccccaatttgcgtgacccggcctaaggcttcaccacgaataacggttgccgccgaataaagcgtgttccctggtttcttcaaaattgttttactttcaccggtcaacgcggcttcattcatttcaacggtgccactgatgatcgccaagtccgccggcacaatatcgccagcacgcacatggacaatatcattgggaaccaagccggtagccgtgacggtcagctgacgatgcagtgtcccaaccgctttttgggtacgttgttcctgaatttcgccatcgatcgctgaaaaaagtaggagcgcgaacacaaaaaaggcctgggttcgttttcctaacaaaaattcaaagagcatagcggcttctaataaccaaggtgtcggcccccacattctacttaaaataccaaccaacggtcgccgcctggtttcgggaatgacattggcaccgtacttggtttgatagtgttgtgcggcttgttcagttagtcctggccctgtatagcccgcctctaaatgatcaactttacttttcggtagcattggtattcctccctaaacttattcacggcggtgacaaaatacaacaaaaaagaaaagacgcctacctaaagagaaaattctccttaagtagacgtcatcaattactttagtaatagttcgcgaacgtcatcgcgtttacactcttaaaataccacttccaaatagaagtgtaaactgaaacactggctaaggtcgttaattttgtggtcaaaaaagctttgtggcccactatttttctgcaattggttgaaaatggcgctacccaaaattagattttagtgataaactagtgcttacattatagttttcacataattatgctttgaggagggatcgacgtgaatgagcttttgattggtttatttgccattgctggtggtatgacacgttatggcgttgatcagttactcgttgtcggtcatttgccggttgccacttttacgatcaatttggtgggtagctttttgttagtctttttaactaatactttagcgcagatcgacggttttccagcgcaattaattctaggcctaggcactggctttgtcggcgcctttacgactttttcgtcttacatatttgaaatttggcaattatatcaggcgcaagcatattggttggcggccgggtacgccctacttagtttagttgctggtctgctcggcgcctacttaggcctacacgccagccaacttgatttaaaacggcttggcaaacgtgaggtgagcaaatgacgccttacttattagtcggcggcggtgccgcggttggtgcgatcgcgcgctatgatatgaccaaattgatcaagcgctacgccttaggtcgctttccggttgccaccttgatcatcaatctactagccgccttgatcctcggcattttagccagtcatttcggcaccggcgttgatagttacttattattaggtactggcttctgcggcggcttgtcgaccttttcaaccatgagttacgaaactttgattttattgcaggaaaaatatagcgttttggcgctgctttatttggtgctctcattagttgccggattgatctgcgtggcgctcggtttaattatcgggcgtaccttttaaacaagatttaatcgctttcaagtcaaaagtgctaaactataaatagaataaaaaaagcaatggtgtttgctaaaactgcgtcagctgataacacctaggccacttttggtgcgcctaggtgttattttttggtaacgtcaaaagttctatgaaaaccgtggttcagaaggtggtgtagatgcaactgtagaaatcgacttaaggattgagtggtctagttggttagttctgtacgcgcacagtattaatccggccaa

SEQ ID NO: 514 - DNA, 9321 bp, Unknown
  Metagenome-assembled genome
gtggttttactaaagcctaaataatcggcaatatattgaagtgagtgcttttcatgatgaagtgtttcgatgacaacgcggtcttcaaatgataaaatagtggtgcccataaaggtccttctttctaatggaatgttgtggtgacactattaaagacctttatgggtttttctgtccactaatatgttcaacttaaattttacaatctaccataaactaagctaaagtgtttgctatggagtgcacttcaaggtttagaatgatgtcattgtcgtgaataattatggtgtgatcgccgctaagctgcctggggctaagcggatcatcgccatgagtcggcatgtggatcggcaaaagctagcgtgtgaatttggtgccactgatgtggttgctgaacgtggcgacgaagcagttgctaaggtcatgacgttgaccgataataacggtgctgatgctgtgttggaatgtatcggtacggaacaatcagttgccaccgcagtcaaagttagtcgccccggtgcagtggttggccgtgtgtgtgccacaaagggcagaaatgaataccaacgaacttttctggcgtaatattggtttgcgtggtggtgttgcgttagcaactaccgatgacaaaaccgttttattggacgttgttttaagcggtcagattaatcccggcaaagtctttacttaacggtttaatcttgcgcatattcaagacgcatatgtagctatggctcaacggactgcaatcaaatcattggtcaccattagcgaaatctaagcttttaacgagcagtcggtagttaacagaaataatctgttggctaccgactgtttttagtactttggtcgcgacagacatccagggaaagtcgtataatgaaattatgcttacaaaatcggaggtaaccttatggtagaattgacgcatttttatcagactttccagccaacgcattatgatgtttatttagatattgatcgggctgcaaaaacgatcaccggtaagacaacgatcactgggtcagcacaaacctcagcaattgcgatccatcaaaaagatttagcagttgcgacggtgcaagctgacggtcaggctgtaccgtttacgatcgatgccgctgcagaagccattcgtattgaactagctaaagtgggacaaaccactttgacgatcgagtatacggcaccgctaactgacagtatgatgggcatctatccgtcttattacgaagtcgctggggttaaaaaacaaatcattggcacacagtttgaaacaactgcggcgcgccaagcttttccttgtgtcgatgaaccagaagccaaagcaatctttgatctagctatcaagtttgacgaacatcctggtgaaacaatcttagcgaacatgcctgaaaatcgtgtggctgatggtgttcactattttgatacgactgtgcagatgtccacttatttagttgcgtttgcctttggcgaactgcaaagtaaaatcacgaccactaaaagtggcgtcaaggtcggcgtttttggcaccaaggcacatcaagctaatgaactagattttgcattagatatcgctaaacgttcgatcgagttctacgaagatttttaccaaacaccttatcccttaccgcattcttggcagttagccttgcctgatttttcggctggggcgatggaaaattggggcttagtcacttatcgggaagcttatttattgttagatccggataacacagccttggatacgaagcaacgggtggcaactgtgatcgctcatgaattagcgcatcaatggttcggtgacttggtgacgatgaagtggtgggatgatctttggttgaatgaaagttttgccaatatgatggaatatgttgctaccgatgccttagagcctgattggcatatttgggaatccttccagacgtctgaagccgctgcggctttacaacgggatgctaccgacggggtacagtccgttcacgtgcaggtggaagatcctgctgagatcgatgccttatttgatagtgcaatcgtttacgctaaaggcgcacggatgttggttatggcgcgtgctttggttggcgatgacgccttacgggctggcttgaagaattattttgcagcacaccaatttggtaatgccactggggctgatttgtgggcggctttaggcgccgctgcacagctcgatgttggtgcaatcatgaattcttggctggaacagccaggctacccagtcgttacggcagcagtcgtggatggacaattaaccttgacgcaacaacaattctttgttggtgagggtcaggaagtcggccggcaatggcagattccattgaatagtaattacgcggccgcacctgctattttcaaggataaaacggtcacgctaggtaattatacggagctacgtgcggccaacggtaagccattccgcttaaatgttggcaatgaatcgcattttatcgttaaatacgatcaaactttgttggctgatattttggctaatgtgactgatttaacggcaatcgatcaactacaattattgcaggatctacgcttattagccgaaagtggtcagatctcgtatgcaacggtagtgccattgttaccaagatttgccaatagccattcgaaagtggtcaacgaagctttgtatcaagtcgctggcaatttgaaaaaattcgttgtgcccgattcagcggaagagaaaagcttaaaagcgttctttgatcaattaagtgctgaacaggtagctcgtttaggttgggtcgctcaagctaacgagagtaatgatgaccaattgacacgtccttacgttttgaatgctgcattgtatgcagaaaataaagccacaattacggcagcacatgagctatttacaacgaatcgagatcatttggcggctttatcggcagcagtgcgcgtgtttgttttgactaatgaagtgaagcactttggtagtgcggaattatttaccgaattgttacaggcttaccggcaatcagctgatgcgagttataaagctgacatttgcgctgccttgaccagcacacctgatgcagcattgatcgcacaattgattgaaaagttcgaagatgcaactacgatcaaaccgcaggacttgcgtgcttggttccggggcgttttggctaatcatgacggacaacaagctgcctgggattggattcgcaacgagtggggttggcttgaagcaacggttggcggcgacatggaatttaccacttatattacggtgattgctggtatcttccggacaccagcacgtttagctgaatttaaggcgttctttgaaccgaaaatcaacactcctggtttgacgcgcgagattactatggatattaaagtgatcgcaagccgggttgatttgattgcacaggaacaagctgccgttaatacggctgttgctgaagtaatcaaataaagctgacaacggtagttagtttttggatacagttcgattcgatcttaattgtttagaaaaataaagcaggagttgcggcatgtaatccatgtcacagctcctgctttacttttcaacaacatctgcgctggcaatatcatcagcagcaagaattttgtgttggctgccatcgtaggtaatatcatatttgacggctcgaccgatgttgagaaagtcatggctggtggtttcgatcactgcatcattagtcgtgacagcaacggtggagacttcgttaagcgtgatcgtttggccgttggttaatttgatcgttaaaatgttatccataataatatcccttctattaattatttactcactgtaaattgtagcaccggaatgaaagtacgacgtattagttgctaaaattagctaaattacattaaaattggactaattaaaatatatttaaccgtatagttgatttgacgccagcggttgcacatgctaaagttatgaacgtaaagtgcagttattctgcggtacgatctaatttgagatcacggcgctgacgtttaaaaggggtgcggttgatggcaagtgtcaaagtaagcttagcctgcacagtctgtggcgcacgtaactatacagttcgggttaaagcacaacacacagaacgtttgaccttaaataaatattgcaaacattgtcaaaaggaaactcagcatcaagaaacgaggtaagttactttaatgaaattattccgttacttaggttcggttcgccaggaaatgcgcgatacaacttggcccacacgtaaagaattacgccatgatactagtactgttgtctggttatcgatcttgttcgctgcttattttgcgatcatcgataatggcatccaatggttactaaatctgttcatttttaaataatgacgtgtatctaggcttattttctggtatacttttaaccagagacgaaaacttcgcgtggcgaggtttttttatttgtcgttaattttaggcgcagtatttttgcgttaatcagaacactatcaagatagatgaaggagcaataaaatggaaactgaatcagcagaaaaacaatggtatgttttgcacacctattcaggttatgaaaataaggttagaggcaatctagaatcacgggcccaatctatgggtatggaaaataatattttccgcgtcgttgttccagaacaggaatcacgggagatcaaggatggtaaagaaaaagttaccatgcaaaaagaattccctggctatgttttagttgaaatgatcatgtctgatcaggcttggttcattgtacggaatacccctggtgttactggcttcgttggtagtcacggtgccgggagtaagccagcgccacttttacctgaagaagttgaacggatcttgcgtcaattagggatgagtgctcggcataccgatgttgactttaacgttgacgatacagtaacgatcattgatggtgccttttctggtctttctggtaaaatcaccgaagttgatgctgaaaaactgaagttgaaagttaacattgatatgtttggtcgggaaaccagtactgaattggattacgatcaagtcgataaaatttaagctttggggtgagtggtgtggcgcagcaacttaaagtatcgcggcattacactcaatcagttagttttactaatgaattaacggtggtcgttacactatcaggatcggcgcattttatggccgcatggcaagtacgtcgtttagccaaacaggggctagccggttggtagcgaacggtttatcttggtcggtcaactgaaattgttacaacggcgaatttagataatccactggttttggtggtcgtgccacgacggtggtcacaggctgaacaagttcagcgattagaacagctgattgctcaagtgctgcagcagcaagccactataaaattagtttgtgcgctacccttgaagtttacgcccaatcagcggcaacaagtaagttgttggttggcaattactatgcacaccaaatcgtggctgactgaatatttttggtcgccgcggcacacccaagtgagtcgagattcaactgggcggattacgcatgctagttatcaacgattatggcgtgccgatatcttttctagctgatacgttccgagaactgcctttttaatgaggcagttctttttgttaagcacggcttgcttctattaagggagcgtgctatactacttgggtgcgaattttcgcatcgtggcacattggtgtcgcgttaagtgggaggccaaaatcagcttggccaaattaccacagcacggacttaaggaggttttgtctcgtggcaaaaaatgtcgtaaatgtcgttaagttacaaattcctgccggtaaagcaactccagctccaccagttggcccagcattagggcaagcaggtatcaatatcatgggcttcactaaggaattcaacgcacgtactgctgatcaagcaggcatgttgattccagttgtgatcagtgtttatgaagatcgttcattcgatttcgtaactaagaccccacctgctgcagttttactcaaaaaagctgctggtgttgaacatggttccggcgaacctaacacgaaaaaagttgctactgtaaccagcgaccaagtacgtcaaatcgctgaaactaaaatgcaagacctaaacgctgcagacgttgaagctgcaatgcgcatggttgaaggtactgcacgttcaatgggcttcactgtcgaaggctaaagcgcgcacggattttcaatgaaaattgtctaatcaagtgggaggaattgcttcctgtgaccacatttgcaaggaggaaaaacacaaatggctaaaaagagtaaaaaatacgcagcagctttaaagcaggttgacgctgacaagaaatacagtgttaacgatgcagttgctttagttaaaaaagtcgacttcgcaaaattcgatgcaacggttgaagttgcctacaatttaaatgtcgatcctaaacaagcagaccaacagatccgtggggcagttgttttgccaaacggtactggtaaaacacaaaaagtgatcgtttttgcccaaggcccacaagccgaagccgcaaaagcagccggtgctgacatcgtcggtgctgaagacttagtgcaaaaaatccaagatggctggttggactttgatgttgccgttgcaacaccaccaatgatggcccaagtaggtcgtttaggccgtgtcttaggtcctaaaggcttaatgcctaaccctaagacaggtacagtaacgatggatgttactaaggctgttaacgatatcaaagctggtcaagttgcttaccgtgttgataaggctggtattgtccatgccccaatcggtaaagtatcatttgatgacgctaaattagttgaaaacttccagacgatgcaagataccattactaaagctcgtccagcttcaactaaaggaacttacatcaagagcttaacggttacttcaacctttggccctggtgttaaagttgatcttgcttctttctaagcaattgaggacacagtcagttatactgactgtgtttttttgtaatttgtgttgaaaatccgctcggtttttgaatattagcctagcaagacagcaagttacttttgcaaccagatgtacgctagtttggttgttaaattcagcttttcttgaaaaaaacgattttagttacaaagctgcttgacgggtgccgttattcatgatatattagttctcggttatatttctacctaagactcaggtggctttgccttaaacgtttagttcactaaacggcccgccgaggagaaagtttgtacggtttaaacagactctctgcggcgttgtgtctttgtacacagcgtttttttattaggagaaatccaccaacagggtgttcgcactctgattctaacaggaggtgagattctcgtgagtgaagcagttattgcacaaaaagcgaaagttgttgaaagcgtcactgaacagttcaaaaatgcagcatcagctgttattgttgactctcgtggcttaacagttgcgcaagatacagatttacgtaagcaattacgtgaagctggtgttgaattacacgtcatcaaaaacacgattttacgtcgtgccgctgataaagctgggtttgaagggttagacgatacattcgttggccctacagccgttgctttttcaaacgaagacgttgttgcacctgcacgtatcttggctaaatttgccgaaacagcagacgcacttgaaattaaaggtggcctgatcgaaggtaaagttgctactttggatcaaatcaacgatctatcgaagttaccagaccgcgacggtttactttcaatgttactttctgtattacaagcaccagtacgcaatgttgcgtatgcagttaaggctgttgctgatgcaaaaccagctgaagaagctgaagcataataataattacctattctaggaggaacttaaaatggcattagataaagatgcaatcatcgcacaattaaaagaagcaacaattcttgaattaagcgacttagttaaaggaatcgaagacgaatttggcgtaagcgctgctgctcctgtagctgctgctggtgctgctggcggcgacgctgcagctgctaagactgaatttgacgttgaattaactggcgctggctcagctaaaatcaaagtcatcaaagccgtacgtgaaatcacaggcgctggcttgaaagacgctaaagacatggttgacggtgcacctactgttattaaagaaggcgtttctgaagacgaagctaacgaacttaaagctaagcttgaagaagctggcgcagaagttactgttaaatagtcattcatctattttaaaggagctaaatgctgttaaatcagcgtttagctccttttttgcgaccaaaaatggcggacttagtgaaatttactcactttgcccgttttttttgagtttgagtgcagccgattgagatcaattgtggtcgaccaagatagtaaccttgcatgacatcagcatgataatgggaaccaatacttaactcagctttagtttcaaagccttcgattgcaaaaaatttatgatggatctgggcatattggcgccagaattgtaacaatggactgatgatagaactaaaatccgtatattggcggaaattttgtaatgcaaatttatattcagtcacatatggatctagtgcattagctagtctgatcgtattatcaccggtgccgacatcatccaaacaaacccatagttggtttgcttgatattgtcgtgcggcgtcgataaggtcagagaggggcaccttttgtgggcgttcggtcaactcaatgacgacttctacgggatagcaggctttctgaacttgggtcatgccagcgataaaatcaggacgaataaactgaatttgatcaagattgattgatactaaggcaacgtttttaggtaaagctttgattgaagcaatcgccaaatctcgaatctgttgggctgagaattgattaaagttttgcggaaagacccaattaccttgatgatattgacgaataaagaattcatatcccaaagtgtcattagcggtcgaatatttaggttgaccgaagaagcggatcataaactagcctcctaatactactaaagtaaaaaggcccgtacttgcactaggccctgtcaagttgacaaatgaaataatataaagttgaatctgtttctaagcggcttcactccagtattcatctggggtgaggccgtttctttgtgctgagcgattgtggtgattgaaatattcgattccttcctcaaccagtctcacaagctcttcgcaagtctttgctagtggatggcga

SEQ ID NO: 515 - DNA, 26431 bp, Unknown
  Metagenome-assembled genome
aaaaagatgctgtagtgggtggattttttaggtgcgaggcttatgggccttttttattttgcactaaaaaatcctgctaatagattaccatgttaagtaagctatcaacaggaaaaagtatagaacccgattttaagcaggatcacagatgtgatcctgctttttttctgaaaagataaaattataattcaatgagtgttttaattgtgctataataataccatgaatttgtcgtgcgtcgactaaattctgtatatatatattgtcgtatagtcaaatttgggcctaacttcaactgcaggttctgtcgtagttgaatgggcactgtcgatcacattaggtagtcgcgcaatcgatcagctaatgtgcaataggaggaaaaatatgtcacaagcaactgaatatatcaaagaagttcgggcgaaccttgctcaacgcgatggcaaccaagctgagtttcttgaagcggtcgataattttctagcaacgatcacgccggtgtttgaagcacatcccgaatatattgaagctaatattttgggccagatcactgaacctgagcgggccttccaattccgtgtaccgtgggtcgacgatgctggtaaagttcagatcaatcgcggcttccgggtgcaatttaattctgctattggcccgtacaagggtgggctgcgcttccatcctagtgttaacttgtccgttgttaaatttttaggctttgaacaaattttcaaaaatagcctaactggcttaccaatcggtggtggtaaaggcggtagtgattttaatcctaaaggtaaatctgatggtgaagtcatgcgttttgcccaaagctttatgaccgaattgcaaaaacatattggtcctgatattgacgtgccagctggtgatattggtgtcggcggtcgtgaaattggttacttatttggtcaatacaaacgtctaaatggctttagcggtgggattttaactggtaaaggtctcagctacggtggtagcttagcgcggccagaagcgactggttttggcttactttactatgtggatgcgatgctcaaagcacatcgcgatgatctcagcggtaaaaaaatcaaattatctggtgccggtaatgtggcaatctatgcgattcaaaaagcgactgaactaggtgctaaagtcgtaacggtttctgattctgatggctatatttatgatgaacaaggtattgactacaaggttgtgcaacagatcaaagaagtcgaacgcggtcgtatcagcgaatacgctaagcgggtctcaacggcagaatattctaaaggttctgtttgggaagcaccaattgattgtgacgttgctttaccatgtgcaacacaaaatgaaattgatgttgatggagctaaattattgatttccagcggcgtccaagtggttgctgaaggggccaatatgccaagtacaccagaagctatcaaagcttatcgccaagccggcttattgtacggtccagctaaagcagctaatgctggtggcgttgccgtttctgcgttagaaatgagtcaaaacagtcaacggctagcttggtcgtttgctgatgtagatcaacgtttacagaagattatgcaagatattttccaaaaatcagctgatgccgctaaacagtataatctaggcgacgattatgttgcgggtgccaatattgctggtttcttgaaagttgctgatgcgatgtacgctcaaggtattgtctaaccatgactttaccgaatcaggttttgatcagccaggatctatcctgtgttggtcaagtttctttaggtgtggcgttaccgatcgtggcaacgctcggtctacaaccggctattttgccaactgcattattatcaacgcatactggcggctttggtgctaacacctaccttgatctcagtcaggaaatgcaacggatcatcgctcattggcaaacgctggagctgaatttttctgcggtgtacttaggctatttaggtaccgccgctttaccagtaatgagacagcacttaccgactttagcaacacccgcggcgcggattctactagatcccgtgatgggagatcacggtcgtttatacaagggctttggccgttcctatgtggcgggcatgcgccaactagctcatcgggccactgttattacaccgaatgtgaccgaagcacgcttactattggaattgccccaagatgagcagccattgacgcttgcggcagcagaaaaattagtgcaacagttaagcgcacaattgtcggttgccaatgtgattctaaccggtgtaccattgaatgatggtcaaattggtgtagttggttatactgaacggacgatttggcattggtcaacaccacaattagcaggccattattttgggactggtgatatttttgctagtgtttgctttggcttgtggttacatggatcaacgctgcaaagtgccagtcagcaggctatggaatttgtacagcaagcaatcaaacgaacagccactgcggcaacggatgtgcgttttggtgttgattatgcagctggattccaacaattattagaacaagtactaccagtttaaatagtgacttagcgtaaaattttgatttaggtaatgacctgatcaattgggaaaataatttactgggttacggtgaatattaccgtagccctttatttttggggagagaatgtagatgcgacaagagaagaatactttacgggcgattatttttacaggtttatttgcggccatcatttttatcgggatatctttattaagaattccaataccagcgttagttgggcggccatttatccattttggcaattctttgaccgttttagcgattttattcctaggtggtcgtaatggtgcgttagcgggcattattggtttaggtggttttgatttattaaatggttatgcggcgacgtcgtggttgaccgcgctagaagtgatcgtgatcgctttagtggtcaacaccggctttaacctctttcagcgggacgatcgcgctagccacattgtgattttaggtatcgttgctggattgatgaagatcgtgacgacttatgcagtgtcgatcgttgaagcactaatggttgggactagctttaaagtagcattgatcaattcatttttaagcttgccagcgacggtgatcaattcaatttcgactgccattctggtgccgatactgtattttgctttacgcggtagtctacaaaccgtacggcggcgtgcttaattaatcgtagtgtacagaaaaacttgctttgccaatacgccatttctattgtagagtagtagctgagtctattttgagggaggtggcgttgttgccacagcgcttattcgtgatcaccggggcgacaggaacgggcaaaacaaccgtgagtcagtacttaactaagtattatcaaattccgcgggtcatcactcatacaacacggccaccacgggtcggtgaggaaaatggtgtcgactattattttgaaaatgaagtcagcttctttactaagcattatattgaatcggtgcgctacgctgattattactatggttcatcacgtgaagccctagctgcagcctgggaaaaatgcgcttatgccagtatcgttttggataccaaaggtgcagtgacttacgtacagacgctaggtgcacaggtgataccgttgtttctgacggttgaacagcctgcgtcactggtgacgcggttaactaagcgcggcgatcagcgggaaatgatcgcacagcgggtagctagtcctgagtatgagcgcgatctgcggctaccaacggcgttagcagatcaggcgcaagtgatcgttaatgatgactggctagttgcacaaaggcagttggatcaaatcatgcaaaattatggcctaacaaaaagcgccgacttgatataaaattaagtcagcgctttttagattatcgattaggccgtttgatcggcgtgattattaagggtcacgggttgatgtgcttgtaacgctaatttacgtactgcctcatcaatggtgacaccgctggcaacttgttccggatgttgcttagaagttgcataaaaaatttgttgatcggtgtctaatgagatccgataccaactatcactaaaattaccaaatttcatggtgtatacctccttgtatcaaggaaaatgtccttgtgagttagtcccgccaaccgaagcaataggttaacggtgactaagatgttacgttaattttgtaacgcccagcacgtgttcaatagtctacaaccaaaatgaattttacgcaaggatttagctgtaaaattgtctttgcataaaacataataaaaatcactcgcttctttgtaaacggttaacgtaacagcttacagaatagtttacaatatcattttaaaattagcaagtgaaatgcaacacaaatttaaattgctgttttactaaaccctacagctaatgcaaactatcattgactataagttttcactaagtctatttttatgaaagcttttgaaatatagccaattctttacattttcgttttcaattcaacaacttgcaagttagacgcgatatgctaaactagatttaagaacaaacgttcagccgcacgcagaaggattagccgattgctaatttttcggcgcgttttagtttgatttaagtttaaattaagctgaaatggctagacttggtcgtggtttaaaagtagactcgaatgaggccaatacttaatgtaattttaccgacactaaattttaataattctttaccaataagacgcgcaatgttaaagcagatatggtttaatgaaacattagaagatcaatacgaaggaggaggtttttgaatggcttaccggacaccgccatttatcaccccatttgcgattgtttcaatcgttttaggtttagccgcgaccaatgttgtggctgacaaagttgccccagttaaaagcaaaactgaacagacaagtcaagttgatagttcatcagtcacaagcggttccagcagcttgcgtcaaagtagtagttctacacatcctgaaagcagtcaatcggtgaaggagagtagcaatagcgtgcaagaatcgactgatgataattcacagacaactaatgatgatggctcagaagcacaaacaacgacgacgccaacacaaaatagtcaaagcacaacggctaattcttcaagtgcaactagtgctagttcaagttctgcagctgctgattcgtcatcagccggtgggacctcaaacacaacaacgactggtaacacgacaggtacgggtacgacaacaaccacgacaaatgacacaacaactgaataattggaggtgattgggtgttatctttgcttgatatgttgaatcactatttaggctatttcaacatgaacgttaaattaaaaaaccgtgtgtatacattgatcggtgtagttggtgtcctttatctaggttatcttgctatttatttcctccgtgctggcgcctggacacggggcttactatttttactggtttttgtcatcttggtttactttacggtgttaaatgtcatttattactttacaacgaaaaccgctaagtttgacatttcgccgaagatcgaaaagctattaggtggtcgtgctgctagcgctgctgatgacccgatgatcggcgggaagcatgctgcacatacgacaactgtaatcccagcagctggtttgtttcacgaacagagcttattaccagctaaactaacggtggatgcaacgcaacaggccaatcttgagcagctagctgatagtctagtggctaatggctatttacaattaaattatgctaaccgctcggatgaacaaatttatgagcaagcacaaaaaacaggtcagccggtttatgcgcttggtgatttagtccaattaccattttatgaattacggcagcagggcgatcactatctggtttatgccggccggaatgcaattgatagtttacccgttggggaagttactgaagttggtttgatgccgactaaagaagcagcggctagatatcagatcgtgttggccagtgcgcaattaactggtgggccgtataagattgctggacgctcgggtgctgtttctggcagtgaaccatttaagcttgtgatccaagcagcgtataagaatccaacagcagccccaaccagtgctgtaaaggcagagcaagtggctgccaataatctatcaacaccaacgtcgtctgctgaaccaacgcgtatgtcgcggcgtaatcgctaaccttaaaatggagttgtgacataagtaatttatgtccagctccttcttttttttacggataaatgctgaacacgaaaatgattgacgatttctaataacaaggttaaacttaaattaaaataagctaataattaattgcatcataactgtagcggtgactgcggactgctgatagtttagtggatgaacatcaaggaatttagtgttctaatcacacagcagtaacttctaatggcattaatgcagtcaaaagtgtgattgcttttaactcacagcgcttatgctgtgggctttttttatttgtgtagtacaggtgaatattttaagtcggcttaatcaatggaggaatttaaaatgaaaatcttaatgtacagtgttcgtgatgatgagcaacccgcaatcaaggcttgggcacaacgcaatcaagcaacggttgatacttttgatcaagatctgagtttagctacggttgagcgtgctaagggttatgacggtattgtgatcgttcagcatgctaaaatcgacagtgatcaagtttatcagaagctacacggatttggcattaagcaaattagtttgcgcagtgcgggttatgatgttgttgatctagcagtagctcaagctaacgatttgatcattaccaatgtgccagcttattcgccgcgttcagtggctgaatatgcattgacacaaactatgcgtttaattcgtaatttggaattattcgatgaacggacggcacaccatgattttcgttggggtggtctaatggcccatgaagtacatacattgacgattggtattattggggcaggccgtattggtgggaccgttgctcgtttgttccatgctttaggtgctaaggtgattgcaactgatccagtagaaaatccagaacttgctgagtttgttacctacatggatcaagcaagtttattaaaaacagctgacgtggtgacgttacatacacagttattgccaacaacgactcatttgatcggtgccgagcaatttacacagatgaaaccaaccgcctttttaatcaatgcttcgcgtggtccagtagtggatacccccgctttagttgcggcattaaaaaataaacaaatcgctggcgcagcaatcgatgtcatcgaagacgagcaggaattcaacaatcgtgatctcacaaagactaaaataactaatcccaatgtgctagcattacaagctatgccaaacgttatttttacaccacacattgctttttacaccaatatggcagtacaaaacatggtcgatatcagtttggatgatactaaaagtattcttgaaacaggtcaggcgcagcatccggtaaagtgatgacagatcgttatgtttaaaatgagatttttctcatattaattttaattttaaaaaaatatccagaaattaaccagatttatttgcgtagagattaaaaataaattaaaattaaaaaggtggctttggaccacaggaattagctacgcgattatttggtaattattaacagcaattaccagtgatcgggtgtactcaagtttggagggaaagttatgtcaatgatcgagtttcacgatgttgaaaaatattatggcgattttcatgccctaaaaaatatcaacttgacgatcgataaaggagaagtcgttgttattatcggcccatcaggttctggtaaaagcacgctactccgaacgatgaatggccttaatacagtttcttccgggaagttaattgttaataattttgatttagcagataagaaaacggatatcaataagattcgccgggatgtcggcatggttttccagcattttaatttatatgccaataaaaccgtgctggaaaatgtcaccttagcaccacgcttagttttaaaagaggataaagcacaaagtgaaaaagaagcaatggacttattggatttagttggtttagccgataaggcacaatcttatccaagtatgttgtctggtggtcaagaacagcgggtggcgattgcacgtagtttggcgatgaaaccgaaagctttactgtttgatgaaccaacttctgcattggatccagaaatgattggtgatgtactggacgttatgaaaaaagtcgctgctgatgcagggatgacaatgattgtggttacccacgaaatgggctttgcccaagaagttgctgaccggttgattttcatggccgacggtgaaatcttggaagatgacgatacaaagtccttctttgctcatccaaaagaagaacgggcgcggcagttcttaagtaaaatcattaatcattaatgaagggaggcttggacatgaaaaagtttgtccaacgcatactgccgcttgccttcttattgagtttggttttactgatgagtggctgcggtaatcaaagtttatcgaaacagaatgttttaaaagtcgatcaagccagcaaaacgatgacttggggcgtaaaagccgatacccgcttattcggactgatgaatatcaaaaccggcaatattgaaggctttgatattgatatggctaagacaatcaccaaacagatcttaggtaaagatggtaaagctaagtttatccaagtgaccagtaatactcggattccgatgttaaagaatggtaatattgatgcaatcattgccacaatgacaatttcgccagaacgggctaagcaggttgatttttcgcaaccatattttaatgccggccaagcgatcttggttaaaaagggcagtaagatcaaagacattcgtgatctgaattataaaggtgctaaagtcctggcggttcaaggatcaacttcagctttaaacgttaaaaagtttgcacctaaagccagcgttttggaattatctgattacgcgcaggcctttaccgctttgcaatcaggtcaaggacaggcgttgactacagataacgggatcctttatgggatgtcgctagaaaatccaggttacgttgttgtgggtggtaccttcaccaaggaaccttatgggatcgctgttaataaaggtcaaaaagatatgacggctgccgttaataaggctatcgacaatatgaaaaaatcaggtgagtatcaacgcttgcaaaataagtggtttggtaaagtacctggttttgacgaaggggggaactaaaaatgatttcgattttagttaatcattggccggaactttggtctggctttctgtttacccttggttctagtattttagctttagttggtagtttgatcgtggggacgttctttgcgtttatggagatcagtgagcgtaaatgggttcatgccctcggtcgcatctatgtagaagttttccgtaatattcccttgttagttattaccatgtttttctacgttgtgattccaatgtttcttactggggtcagcggatttactgctgggacaatcggcttgacgatctatacttcagcttttattgctgaaactgttcgtgcgggtattgaagcggtcgatccagggcaaatggaagcggcacgttccaacggtctgacttatactcaggcaatggcgcacattgtttttccacaagcgattaaaattacgattccaccgttgggtaaccaattcattaatttggttaaaaactcatcagtcttagcctttgtggctggttttgatttaatgtatcaaggtaatctgatcgcctcgacgacttttgataccacaagtacgtatttagcaattgggttattgtacttgatcctaacactaccattgagctattttatgcgttatctagaaaagaaatgggcttagaagggggaataactaatgaataattttattcaagcatattcatggctgaacatccgttatctcctggaagggctatggatcaccgttgaaatttccgctatctcaatcgtgctgagttttattatcggcggtttactgggcttgttacgttacgtgaagatcaaatatctatccgcgttagtgggttttgtgatcgatattattcgtaatttgccgctactgttgattttgttctttacgttcttcggtttgccgaatatcgggatcaagcctgatgttgttatggcggcgatcttggcgatgacagtctttgaatcagcgatggttgccgagatcattcgtagtgggattcaagctgttgatcctggacaaatggaggctgcgcggagtaacgggatgtcctatcgccaagcgatgcaacatattattttaccacaggcaatcaagaaaatgattccgccgctggtcagtcaattcgtctcgttgatcaaggatacttctttagcaacgatcatcatgttaccagaactgatgtaccacgcgcagatcatttacggacaaaatacgaattttgtgttgccaatgtttttagcgttagcagtgctttattttattgtttgttacgcactatcctggctttcccgtgtactggatcggcggatgggcgcttaaacctaaagtgtagttgttgagagaaaaactcagcggctgcacttttttgattgtcgttaagacgtttctgtgctaaagtgaaagctactatgaaaaaggccattctgcttgtgatacgaattttgccacaagaatggtcatcgtccgtaatatcaagatttattaacgtactgtgctaatgaattaccattaattatgaagtagagccatgtttcttgcggcacgaattttgccacaagaatggtcatcgtccgtaatatcaaaatttattagcgtactgtgctaatgaattaccattaattatgaagtagagtgaggataagcaatgataactgtaagtgatgttagtttacgtttccccgatcgccaattgtattctgatgttaatttaaaattcaccccaggcaactgttatggcattattggcgcaaatggtgccggtaagtcgacttttctgaaaattctttccggccaattagcgccaaccactggtcaagtaacaatttcgcctaacgaacggatgacgagcttgaaacaggaccattatgcttttgaggagtatacggttctggatacggtgatccaaggacacgaaaagttatatcaagtgatgcaggaaaaaaatgccttgtacgccaaacctgattttaacgatgaagatggtatcaaagttgcggaattagaaggcgaatttgcggaaatggatggctggaacgctgaagctgaggccgcacaattactgcaagaactcggtattgatgaaaccatgcagcaacaaaaaatgagtgaactgactgaaaatgagaaggtcaaagtgttgttaggccaagccttatttggcaagcccgatattttactattggatgaaccaactaatgggctagacgcacccacgattcaatggttagaaaatttcctaatgaattttcctaataccgtcatcgtggtttcccatgatcgtcatttcttaaatacggtctgcacgcatatgtgtgacgtagattttggcaagatcgagctgtttgttggtaactatgatttctggttacaatccagtcagttagccgcgcagttaaagaaccaagccaacgctaaaaaagaagaccaaatcaaagaattacaagaatttattgcccggttcagcgctaatgcgtctaaatccaaacaagcaacctcgcggaaaaaacagttagataaaatcacgttggaagatattaaaccgtcgagtcgccagtatccatttattaaatttgaaacggcacgcgaaatcggtagtgatctgttacgggtcgataatatcagcaagtcgattgccggtgttaaaattcttgaccaaattactttcactttgaaaccaggtgaaaaaacggcgttgatcagtcgtagtgatgtggcgacgacaaccttgatgcaaattctagccggtgaattagaacctgatactggaacagtaacctggggtgtgaccacttcacgagcttatttaccgcgggataactcggcggaatttactgctgacttaacgatcttggattggttacgacaatttgctagcaaagaagaaagtgataacaccttcttacgtggattcttaggtcgaatgttattttctggtgacgaagtgctgaaaaagttgaacatgttgtccggtggcgagaaagttcgctgtatgttagctaaaattatgctcagccaggctaatgttttgttactcgatgatccaaccaatcatttggatttggaatcgatcacagctttaaacgatgcgttagttgattttggtggcgcattagtctttacttctcatgattacgaatttattcaaaccatcgctgatcatattgtcgaggtcagtgctaaaggcgtcgttgagcgttttgatacgcactatgatgagttcttggctcacgatgatattcaaaaacaggttgccgcattgtactaaaaaaatccgccatgattggcggattttttgctaggccggttgttgcccaacaatagaaaaattaaagatcagggtgctgttgttgtcaaataagcggtcaacaggtgttcccggcggtgtaccgcgtaaaaggatatttattgacgctgcgccttttttctcgttatgcttagaacataacttagcagaaagggtgctggcgatgatcaaacagttacgcgtatttattttattaagtgcggttggtttgctgaccggctgttcacaacccgattcagatcaagaatcatctagtagcaaagcaagcagcgtgaccagcagcacaagtagtcaagcgctgacctcacattcaggaaccaacactttaacattaaaccgtcaggcggatgagcaaaaggtactacttaatcagacttggcagtttgaacaacttgcgatcacctcggttaaaggtgaattagacgatgatcagcaaatggaattagaaattggttggcgtaatttggccactagtaatcaacattttgccgatttagctacagtgaccgttcaccaaggggatgcagaattagcgatggttgaacgggatgatgattttacggactcggtggcgccacaagctgatgaggattttgaaattacctaccaattagataaccaaacacaaccattgaaaattagtattgtgcctaaaaaaggaaccgcgaaaactttaacggttaacttggaataatgatccatttaagacggtcccgtgtggaccgtctttttacttgccttgcatcagttacagttattggttagaataggtggttgaaattcacagacgaaagttatcaaaaacagcgtagattaagtatagagcgttaaataaaggggcacggacttgatggatgcggcaacaatattaaaaacaaagtttggctacacacaatttcgtcatggtcaaaaattagtgatcgataaattgatggccggagaaaatgtcttggcgctaatgccaactggtggcgggaaatcgctttgttaccagattcccgcactattattttctggtttaacgctggtaatctcaccattgatctcattaatgaaggaccaagttgatgcgttaaatgaaaatgcgattccagcaacatttatcaatagttctttaacttatgcagaaattgatcagcgcttggatatggctgctcgcggtgaggtcaagttactgtacctctcaccagagcgcctagaaatggcggattttatggctgaactgaatcaattaaagattgatctggtggccattgatgaggcccactgtatttcacaatggggtcatgactttcgcccaagctatctccaagtaacggcacgattgcaagaattgcggagtgatcctgtacttgttgctttgactgcgacggcaactgaacgtgtggcaactgatatccgtcaacgattaggtattgctgctgaaaatgaagtaaaaactggctttgcgcgcaataatttagccttacaagttgttaagggacaggatcgcgatcgctacatgctggattatttaaagttgaatgcacatgaatcaggtattatttacgccagtactcgtaaagaagtcacgcggttgacgacgttatttcaacaacatgacctaagtgtgacgatgtaccatgccgggttaagtgaagaagtccggcggcaaaaccaagaggattttttatatgatcgtaaattagtgatggtggcgaccaacgcttttgggatgggtattgataaaagcaatgtgcgttttgttattcatgcgcaggcgccgggaagcttggaagcttattaccaagaggctggtcgagcagggcgcgacggcttacctagtgaagctattttgctttaccggccttctgatattcagttgcagcgcttctttattgagcgttctgatatggccgatgcaccacggcagcaggaatatttgaagttgcaagcgttgatgcaatacgccaatacccaaggttgtttgcaacaagcaattttacaatattttggtgaaaaagctgaaccatgtggtcgctgtggcaattgcttagatcaacgcgaagcagtcgatattacggtgacggcgcaaaaagtattatcgtgcgtttatcggatgcacgaaaactttggtaaaacgttggtcactcaggtgctgactggtgctaataatcaacgggtgcgtgaattggactttactaaattatccacttacggcttgctaaaaggacaaacgcaaaaagaagttggcagcttgatcgattttttgactgccgcaggttatttgcaagctagtggtggacagtatccggttttgacggtcactgctagtggggcggaagtgttgcgtgggcagcagcaagttctacgtaaaactgcagtggcaacgcaagcggcccaaccagaaaatgatgcgctatttgaaaaactgcgccagttacgttcagaattagcccaagcacaaaaagtgccaccgttcgttattttttctgatcggacattacatgagatgtgcgcacgtttaccacaaaataccagtgaacttttagaggtcaagggtgttggtgaacataaagctgaacaatatggtgctgcttttcttgagattttagcaactgcgggtacggccaatgaaatttaattggcgaaatcaaggaccaaaaactactgtggcgcgatttttacaacaccaaggtttaagtaagcatatgttgcagcgcttaaagtatcatggtcaagtttgggttgcggggcagcccagtcgcctgatcgaccaactgccaaccaatgcggaaataaaaataaagctgccagcggaaaatggtgatccgctggcagctattagttcacagccgttaatgctattgtatgaaacaccagactggctagtgatcaataaaccggctaatttggcttcagtttccggtccacagacaggtatcgatacggttgttagtcgtgtgcgtgggtatctgttgcggcaaggtgctgagaatattgtgccacatttggtcagtcgtctagattatgccactagtggtgtgttattagtggccaaacacgcttttgctcatagtcgattagctaactcagcgactaatttagtacgtgaaaaaacttatttagcggtagttgcaggcgcagtacacacagaacatggtatgatcacgttacctttaggtcaacgaccgacacaagcggctggtatcatcgatttaaatggtaaagctgcacgcactgaattctggcggcaaacttatttgccacaattggacgctagcgttttgaaggtgaagttacacactggccggcgccaccaaattcgaatccacctgcaagctataggtcatccgttgctaggcgatgctttatatggtggtccaatggatcgaggtattcaccgccaagcactacatgcatggcaattaacgttcactgatccgtttacacaacaaacccaaacgtttactgcaccattgccgctggacttacagcagttgcttaaaagtaagaataacctttaaaatcagcactatcgataatttcaaaatgatcagcagtaatgccagtggcttggctgatcgtcgcggttaaatcatttttactgatgtgactccaaaagcgataatcgttttcgccgtagtgcatccaatcaccgagttgactaatttgtggatactgagttagatccggacgggtaacatcgatgaaatggagtacatagtcggcagcgtcatcactaaaagcaggacgaggttgaaaataatggcggttgtgcatagtatttccctctttctcacgggtgacaaaagtaacgttttccttgttaaaaattatacgtggtcctgcttaaaagtacaagtaattaagtttttgcttagactaaattaatttttactgaatggtgtcgagcttaagctaatgtgtcctgtagccactccactgctaaatcaagccagtgtgcgacatgcggttggtcagcgtcagccttccacgcggtttgctgattggctaatgctaagccgtgggggccgtgacggaaaatatgactttcaaaaggaattccattttttgctaaggcgttgaggtaatagaggctgttttgcacaggcaccaatggatcatcagctgtatgccagataaatgttggtgcacatgccgaattaactaatttatccgcggcaaattgatcaggttgtgcacttaaattggccagtttgtctgctgcgggccaaccggcattcaatcgaataactgggtacgcaagaatagcggcatttaactgaagatcaatatctggggctgcttgttgcagccagtgttcctgccaactgccattgtaggtactaacaatatgacccccaactgaaaagccggctgccgcaattttattgggatcaaggtgccaaacggttgcgttttggcgcagttgctgaacggctgccgccaaatcaagcagtggctgtggcaaaagtggactcacttccgtgttaaaatgataacggaggtaaaaagcttgaaagccacgcgcagcaaaggccaaagccaaagtctctgcctgtgcttcaggaatatgagtatagccaccaccagggacgataatgattgctggataagtggtttgcggtgtattgtcatcaggttggcgaatgtaagcttttaagtaagctggtgtcgttaaagggaccgtaataatttgcaaaatataaaacctgcctctcataattaagtgtcaaagtatttagtatgatgttagttgctaaaactattgtagcgattttaatcaatttgtgcaggcgaaaggcctaagcaacattgttgaaaaatttaaatttatttaaggagctgactgctatgcgtttaacgacaccgcgtctggtgattcgaccatttatagaagctgatttaacagatttacacgaactcatgcaaaatccgcgtttaggcgccatggccggctggcaaccccatcattcacaggctgaaagtgaagctgttttgacgatgtttttgcgcagcgatgaagtttttgcggtggtggaccaagtcagcggtaagatgatcggtacgattggtttacatcgccgtgcaccgagtgggacaacgccgagagacgatagtcgtgaactaagttttatgctcaatgaagctttctggggtcaagggttgatgccggaagcagtcaccgcaatcgtgacttttggttttaatcatttaagattgcaagaaatttgggtaggtcattttgcggataaccagcgctcgcagcgggtgatcgaaaaaacgggctttcattttgagtatgaatttgagcgaccacgcttatttagagatgaagaaccagtggacgaaatgtactataaaatgacactggctgattttagacagcgttaacagaaaatgaaaatatcatgaaaatattgcaactatagtaaagcttagcttttgctcagtgtcgattatggtataatgagccgagatagagatattggaggtaggaatgatggacgtgtcacaggagcaattgaaaataatgggaaaagcttatcaggaacgactggcagcaattgaagctaattcacggttgacgatattagataaagtcgtagattatagtgcggattcacaaccagttacaccgtacattgtttataccgattttaatcgtgctcagctcaatgaaaaaagcagctcgatttttgtctacacagcttatgaaaatgtagataaatacgggcactcgaaaactgattatcaaaatgaattgttatttgaatatgatgcgtgggctaaagcgattcatattacagtattggagactctgggtgctgaaagccagttagctttttacgattttcaaaatcatggtttggcgcaattgtcattgcaatatctattgaaaattgcacgtgctaaccaagtcgtaaaaattgatggcaatgtcagttcatttgatggtgaaagtttaaaaaaagttatggcgttgtttgaaaaatttgggtttgaatttaagattcaaaatgcacagcaagggttagctagtttttatttaacactcgcagaataagccgactgttttttttaagacgtggctgcggtatacttaaactacacccttggcagggagaaggcgattatatcagatgatgatctggtgtaagcgccttttttctttttgcgccacatttatatttgtgatatgatatgtccataacaaataggtgaataacgatcgtccgtaacatcagaatttattagtgggttaagctaataaatatccttaattgtgaagtagagccatgtttcaaggcgtactttgccatagttgaatggtcatcgtccgtaacatcagaatttattagtgggttaagctaataaatatccttaatcgtgaagtagagccatgtttcaacttggcgtactttgccgtagttgaatggtcatcgtccgtaacgtcagaatttattagtgggttaaagctaataaatatccttaattgtgaagtagagaggtgtctggtatgcaattaacccgtggttttgaacaagctgcttgtattattacattgttggcgacacaagatccggaaattccaatttcatctgaagtgattcatcatcgcttgaatggatcacaaacttatttgcgtaaaattatgcgtaaattagttgttggtgggctgattaagtccgtttctgggaacaatggtggtttcacaattgcccggtcaccgaaagaaatcagtttatatgatattgtattggcaactgagggggatatccatacctatcctgattctggtctgatcgatatggtttttaaagattttcaaccggtcgctaagcagggaacttcagtgatcaaccaagtttttcatcaggctgatttgttatggggcgagtcgttgaagaagcaatctgtttaccaagtaatcagtgaaacgcttggtgatagtgagattccactagttaattggaatgaatctgatgagaagcgagaattattgattcaaaaattattacgtaatattcgtagcgataagtaatttcgactgtgatgctgacggttaaaatgctgaattaatgagcacgcttttagaaaaaagcgttataataaagttaacgagtgttagcccgttacttcaatattaaaagaggcggtaacaatggcaaagaaactctctaaagctgagaagaaagagttgatccaaaaagctgaagaggctcgtgctaagcatccacaacctaagtcagctgtttctggttttgaaacaattgataaggaagctgaaaagcttagtggtcgtaattaaatttgacgatagtttaagtgtggcttgatttttctaatctgaaaaatctggacacacttttttaatacccattttttgtcgtgtgttacttatttttagcgtaatttcacaaattagaaaaatttggcggtttacatgcttgtgaaaaatcataaacattgaatttcagcaattacggtatttgtaaatgatttcacttaattaaattcacaagaaattatgagaagagtatgctatgataagaaccggttttgaaaataaattaaaaacatgaaaagaattttattttggagggatttataaatgacggaaaaacaacgctatggcgccgatgccatccttgaaagtttgatcaaccatgacgtcaaatacattttcgggattcccggtgcaaaaatcgatcgtctgtttgaactattagctcatgccgacaatgcgaagcggcctgaattaattgttgcccgccatgaacaaggggctgcatttatggcttctgggattggtcggatcaccggtaaacctggggtcgttatgactacttccggtcctggggtcagcaacttagcaactggtatggttactgcaactgctgaaggggaccctgttttagcaatttctggccaagtgcagcgcgctgacttactacggttgacacaccaaagtatggctaatactgccttgatggcaccaattacgaaatatagtgcggaaatccaagaaccagaaaatgcttctgaagtgatcgccaacgcttatcgtgcggcttcatctgccaagcaaggtgccagttttgttagtgtgccccaagacgtggttgattcaaaaattgaacggccagctgtaatgccgttacaggcacctaagttagggccagctagtcccgctgacattacgattttagcgcgtaagattaaggaagctaagctgccagtattgttagtggggatgcgcgcttcttctgctgaagtaacacgggcattgcgcaatattttatacgtttccgatattccagttgttgagacgttccaagctgcggggattatttcacggaacttagagaaaaacttctttggtcgtgtcggtttattccgtaatcaaccaggtgacatgttgttgaagcaaagcgacttggtgattacgatcggctatgatccaatcgaatacgaaccacgtaactggaatgcagaaaacgatgcgcggatcgtagtgatcgacgatatggcggccgaaatcgatcataatttccaaccggaaactgaattgatcggcgatattgcccagacgctggacttcttattgccatatttgcgcggctatgaagttaaagccgaatccaaggattacttggaaggattacacgatcagtttgaaaagcgtgacttaccaccagttgtcgcaccagaaactaaattgacccatccgttagcggttatttcagcgctacaaaaacgggtgactgacgagatgacggtaaccgttgacgttggtagtttctacatttggatggcacggcatttccggagttatgaaccacggcatttgttattctctaatgggatgcagacgctaggggttgctttaccatgggcaatttcagcagctttattgcgaccaaatacacagattgtttccgtttctggtgacggtggcttcttatttacaggtcaggaactagaaacggcggtgcgcttgaatttgaacatcgtccaattgatttggaacgatggtgcttatgatatggtcaaattccaagaagaaatgaaatacggtcaaagtgcggggactgattttggtccagttgacttcgtgaagtatgcggaaagctttggtgcaactggcttacgtgttgatcaagctggtgatctggaaaaggtgctcgatcaagcttttgcaactaagggtcctgtgatcgttgatattccgatcgattattccgataacaaaaaactcggacaaacgattttaccagatcaattctattaaaaatcactgatttttgaatcagtgtcgtttatgattaagctaacaaaacgtggctaaattttagccactctctaaatgggaggatgtttatttaatggcagagcaaaaaaagcagtcagttctttttcaacatggtacgcttagtttgttagtgcccggtttatttgaagggacaatgactgtgggtgagttgttgcaacatggtaattatggtattgggacagtgcaagactttaatggtgagttggtcgtacttgatggccacgcttatcaagtagttgagtcgggcgcggtcaatgaattgtcagcggagcaatccgtaccttttgcaacggtccattttgatgatccgctggaacaagttgaattatctgatttgaataagggcgaagtcgaacgctatttattgcaaaactacccgtaccgcaatgtattcttcgcggttaaaattacgggtgaatttgctcatatgcatacgcgggtcgttgaagagcaacaaaagccttacccgagcctgacggaagcaactaaaacgcagccaaagtttaaccaagataatattcatggcaccttgatcggctactatgcaccagaattgttccaaggggtagcagtttcaggttatcatgtgcatttcttaagtgacgatcataagacgatcggtggtcatattttggattatcgtttgcaaaaaggtcaagttacgatccaaccatttgccacgttggagcagcatttcccactggataatcacgacttcttacaccagaattttaactatgatggtatgagtcaatcgatcaaccaggcagaaaaataagcactagccttgttaaacaattaaatattcggtatactattaacaattagattgaggttgcagagatcatgagtcaccagtcggaggcgaaaagcgtcattgagggctggcaaaagggtgatctgccgaaatgcttaattgctttttcaattaagtgttggggcttggctgaataagtcaagtactgtcgtgatgaagtcatcacggggcgctatcgactgacagaaagagacaccgtctttttgtgtagcagtgggtgctacataaaagggcggttttttgtgtttaagtggcgcacctctaaatttagacttggttcaggaggaatttttagatggcgcaacagcatattgatcatgaacaaggcagcgtaaagcgtgagctgaagacgcggcatttgtcgatgatcgcattgggtggcagtattgggactggcttatttgtcgcttcaggttcggcaatttcgactgctggtcctggtggggcattgatcgcctatattgggattggcttgatggtgtatttcttgatgactagtttgggcgaaatggcaacttatattccggtatcgggatcttttgccacttatgctggtcgttttgtggatccagcgttgggctttgcaatgggctggaattattggtttaactgggcgatcactttggcggtggatgtatccacgactgcgatcgtgatgcatttctggttaccgcatattcctggttggatcttcagtatgtttttcttagcggtgatctttattattaacgccttatcagtgcgctcatttggtgagactgagtattggttatcgatcatcaaagtcgttacggttattgtctttttgatcgttggtttcttaacgatcttcggtattatgggcggtaagggcccagcaattgggctacacaactttacgattggtaaagcaccgtttgtcggtgggattccagcaattttaagtgtgtttgtggttgccggcttctcctttcaaggaacggaattgatcgggattacagccggagaatcagccacaccggaaactagtattcctaaggcaatcaaacaagttttctggaggattttattattctacatcctagcaattttcgtgattgcagcaatcttaccgtataccagtaaggatctacttggttcgggcgccagtgatgtggcgatcagtccgtttacgttggtattccggcgcgttggcttagctagtgctgccagtgtgatcaatgccgtgattctaacgtcagtgatctcggcagctaattctgggatgtacgcttcgacacgtatgttgtgggccatgtcgaagcaacatatcgcaccgaaaatttttggtcgtgtgaacggccgtggtgttccggttgctgccttattgatgacgaccgttgttggcttgttcacttttctgaccggcatctggggaccacggatctatctgttcttagtttcggcttccgggctaactggttttattgcatggctagggatcgcgatctctcattatcggttccgtaaagcctttatcgcgcaaggccaccagctaagtgagttaaaataccacgctaagttattcccatttggaccgattttggcgatggtactaggtattttggttattattggccaggatctacatgcggtgaagacttttgattggcaagcgctaggagtcagttatatgagtgtgccgctattcattatcttattcacgtattacaagattcgttacaagacccacatgattccattgaatgaagtggacttgactaagatccatcatgattaattattaaagggaaagaagtgctagcagccgtcatggttgctggcactttttttgtcgcgaatcataaaaataaccgccgcgcaaagctgcgcaacggcttagttggatcttgtagttgtttgtttagccgtataaagtgttttgatcttggtatataactgaaaaaaattagtatcctgggcttccagattccaatgtaggataggaataccagtggtggccatttgttgtattagcggagcttgaatatcaatagtagataaaattagatcagcatcagtcggttgtgccggtggttgcatgatttgcgcgatttttaagaactttaggaagcgttgaagctcgtcagttaagcggtcgttattttcagccactagccaaatgcggaccatttggtggtcttcaaagcgatgcaatttcagctgcagcagatagcataaataagtggcaagctgttcacggtgatgataaagctgtgcggcattttgcgtcactgtggtccggctgagaaaggctagtatatattgataaagttgtgtttgggtgtaactagtcaagtcgggctgataaaaatcaatcacttttgggtaattaccttgtaacgcagtcgtggtcatcaatagccgcaaaatattataagttaatgttggttcgttagtgacagtcaatttagtcttgtaagtagttgataggttacctaaaagttccacagttaagtgccataaaggacttttctgctcagttaggtaggccgtcagctggtgtgcacgctgttgggtagtcgttgcagaagtaatcagactaaattgcgcgaaaaagaagaattcagtctcacgttgtcgattgcgcgcggaaagataattaaataactcagttggtagacttaattgttcaaaactaggattatgtgcggtgagaattttgaaaagattattattgtggatcaaataaccattggtgatgcgcacacgcatgataccaagcaacaatcttttttgtaaagtaaggatcgtgtcatttgctggtgtgttaacggttgtaagtgattgctggagtgaactttcactaaaatgatgtaacggccagcgcataccatgaaaaccgatccaataaacaataaatagaaaataacgaatattgcattcatcaccaacaattttcagatccgtataagaaaatcgcagtgagtactgcaacatgaaacgttttaaagccgctgacttgcggagtaaggttgatttactgacgaagtgttgttcacaaaactcactaactgaaggcgctgcttcttggactagatagtcaataaactgaaagactagggattgttccagtagaaaaaggcgatagcgctctaaagaagttttgaacgtgtgttgagatagtaattcatgtcgattaagggttgaatcgagttgtggattcattgtttgcatatcttgtaatagatcttgaaaggtattataagtttgttgatatgaaaggtgtagctgttcactaatatcattgatcgtaaacgaattagtaccagctgattttagaacgcgaaacatctgaaacttctgcagatccgctttttctaaaaatatttcttcaaacagcatcacaaagctccttacaagtatttattttgtggctacttttctcattttactattctattacctaaaagcaaagcgacgctgaacgtactttgactaacaaaaaactctcagagggcgcgctttgcttcgccctcgtatccatgatatgaaaccgtcttcgctcttgatataatcaagaggaaggcggctttatttgttcatcgctggtttattggtggttctt

SEQ ID NO: 516 - DNA, 1636 bp, Unknown
  Metagenome-assembled genome
gagcacgttttctacgtatagtcaatatatatagaggattacagcgtcatttaatgtcagacttcgtccgacagatgaagcagttcacctaattttatagttaaatacttgtttcaaggtataccaaataagccttacgtatttatttattttcgcaaggttggtatgattactgtgaccagtcaattaccttagctttggttgagcacttgggtaatcatatttctggttggtagtaattaagtgatacatggtgcggttcaaatgatggatggcgccaatggcaatcttcttgaaactagactttccgggagattgctttttctttcgaacaatgtagtcattgatgtgtgaaggcttggttcgtgagctggtcataatattgagaattgttcggaacaggatcttacgagcatatgggtttccacgtttactaatatgatcaactgccacaaactcacctgattcaaaatgtctgagatcaataccctcaaacgcattaagcttattggcactcttaaagcgacgcacatcacctagctccccgataaggcgaacggctgtattgattgaaattccaggaatgctttcaagaatatcaagttctggtaaattctgggcaagaattgccattttattgataatctcagttttttgagtatcgagccttaacagttcagtcgccaaataacacacttcttcaaccatcgctgatttttctccaacacatggataagattctgaagccaactgagaaagacgattggctagctcaatactccgctgatgcgatacatggggcactttttcaattgttttactcaactgcgttgagcttagcttcgtgactgtgcttgagatagggaattgccgtaacaagtgccaatataggtggccggttggagcgttgagcaggttttcaacctctggaaaagtgcactgaagggccttatgaaggcgattcttatcctttactgcatcaactgttacttgatcataaaaacggctccaatctagcaatgattggtaaacgggtggctggacatatgttaaggctcgcgtaatctgaaactgcgtttcagccaagttaaacgcatcatttttatctgatttgtttggccgcagtcgatccaattgcttcttagatgccaatgggttcaattgagtgtaacggtaaccataatcgtctagaaatacccgcagccggcgtgaatatagtcctgttgcttcaaaaacaatctcaggtttttgaaagttggctaagcttttcaacagcttatcaaatccggaacgattattttgaacttcaaacccagccactttattcttgtttacaacaactgcaacagttgaagttgccttactaacgtcgataccaaaaaccacacgcatttgtatcacctaacctttcaaagttgttgcttcaagtcttataaatctaattttcaatacacggcattattgccaacagacttagagcagatttgtataagaacaatgaagttggccagttttagctgcggcgtccagcgccaaacgtgctaacgaccttatcaacttcacaatcactttaaaacaaaaagtgatgaaccaaaaccccgtcgggttttaattcatcataagcttagtctgtttt

SEQ ID NO: 517 - DNA, 46772 bp, Unknown
  Metagenome-assembled genome
aaactaatcaaactaactaaattaagtcaaacttggctagtcatgactagcccaagtcgtgaatatagagaaattacgtaaaactgataatttggccaatcaatttgatgcatatgcataattcagggaaaaaaataaaaattaggaataatacttgattttgcaaacgattgcatttatgattggggtatggaattattatttaatttcaattttatctaggtagtccagttattatttattagttatttggcttagccacagtgattttatttgcacgaaccaacttgtaggtcaaaggggggatcatgtcgtttaacgcttatttttttaagtttaaccgcaaccggttgcatagatttgggacgcagctggtaattaattttgggaggtaatttctaatgcacagtaaactgtggaaacggatcggaattgcgacaatggcagcaggtctagcgttaactctaggtgcatgcgggaatagtagtgcgcaagacaaaaacgtgaagatctcaattttgcaagggaaagtcgaagcgaacaaagaatttaagcaaattgctaagcaataccataagacgcatccgaacgtcaccatttcagtgacttcaattggtgggggtacgcaatatgatcctgttttgaagacgcggatctcttcgggtaacgcgccaacgatttttagtttagcgggaccagcggatgtggaaatgtttaaagcacatgaacttgacttatccgatatgaaagctgttaaaaatgccttaccgggcacgttagatacggttaaatctggcagtaaagtcgtgggcttaccatttaacttggaaggttatggctttgtttataacaaggaagtcttcgctaaagctggtattgacccgacaacattgaccacctatgacaagttgaacgccgccgccgaaaaaatcaatggtatgaaggacaaacttggtttgaagggtgtttttgccttgccaggcaaggaaacttggacgttatctgatcatttagccaacctttacttaggtcaagaatacaactatagcgccaaaaagatgtacaattccaagacgatgaaattcaccgccaatcaagaaatgaagcaaatgatcgacctgcaaaagcaatattctgcacaacctgttttgcaaatggattactcaacccaagtcaatcaattattctcacaaggtaaagtggccatgatccaacaaggtgactggatcgcgccaacgatcaaacagatcgatagtgatttcttgaagaataatgttggcatgtttccgatcccagttaagggccaagaaggcaaaatgccagttggggtaccaaattattgggcgatcaatagcaagtccgataaagcagaacaaaaagcagctaaagatttcttgaactggttatatacgtctaaagccggtaaaaaagacgtggtgaacaagttgcaatttatcccggcatataaaggttttgccgatgctaaaatggctgatccgttgtcacaagctgcttttgactacaagaaagccaacaagactttcggttgggccttcaacgcttacactgggacgtcatgggatccagatgtcttccaaccaaacttagcgaagtacttatccggcaagcaaagttgggatacaaccgttaaaaattcaacagctggctggaagaaacagcaagctgatcagtaaagcaatgtacgtatctaatttttgaaattatgtataagtgtcggtcaatggcgagcacctcacgtttgtgtgagcagcaaacggcatttaccgacactttttatttcagcaagttaagggggatcgttaaatatgaaaaatcgcagtctctcattttggctgtttctaacaccaacgttggtcgcgctaagcttagttgtgatcattccggtgatcatgggcctattttattcatttacgaattgggatgggatcgcgtttaccgaaatggttgggtttaaaaactacctatcattgtttcaagaccatgattttattaacgctttttggttcacggtcaaattcgtgatcactacagtcattttattaaatgcgattggcttgagtttggcgttgctagttacccaaaaacttaaaaccagtaattttctacggacgatcttctttatgcccaatatgatcggtggcttgattttaggatttatctggcaattcattttcactcaagccttcaccgccttaggcaacgcgctccatttatcgtggttacaaaattggttgaccaacgagaccaccggcttttggggcttagttatcgtcaccgtttggcaaatgagtggctacatcatgatcatttacatcgcttatttgcaaaacattccacaggaagtgatcgaagctgcggaaatggatggtgcttcggcgtggcagcgatttaccaagatcacctttccaatgatcgcaccggcgttcaccgtctgtatgtttttgacgctttccaatggctttaaaatttacgatcaaaacttgtccttgaccaatggtggcccgtataaatccacgcaaatgttggcgctggatattgttaataccgcttataacgcaggtaatttcgcgttagcagaggccaaatcgatcattttcttcctgatcgtcgcggcgatttcgttattgcaagtgtattataaccggaaacgcgaggtgaaactctaatgcataaaacaagcaaatggttgctcgggatattcggtctattgattggtttaatttggttattccccttctacctgatcattgttaattcgtttaaaacgccaaaaggcatcttcgcatcggttttgaaattaccggcgccgctgaccaccgctaattatggtgattcgttccgggcacttaattttctcggttccttgactaattcgttcattattaccgtcgcgggcgttttgttgatcattttggcttcctcgatgggggcttacgcactacaacgtaatcacagcaagctaagcggctttatcctgatgttgtttatttcagcaatgctgattccgtttcagtcggttatgattccgttgaccgccatgtttggtaaagtacacatgcttaatatggtcggtttggtgatcatgtacctcggcttccaatgcagcctgtcgatctttctgtatcaagggacgctaaattcaattccagtcgcgatggacgaagcggccgaaattgaaggcgcaagcaaatggcagaccttcttcaaagttatttttccgatgttgagtccgatcacagtgaccgtcgccattttaaatattatcgcgatctggaacgattatctgttgccatcactggttttaccacaaagccagtacacgattccgctacaaatgtttaatttctttggtgaatataccaagcagtggcatttagcattagccggcttagcactgtcgattttaccagtgatcattttctatctctttgcgcaacgttacattatcaaaggggtgaccgatggggctgtcaaatagctaactgattggaggacaacgccgtgcttaatctacaaacaaaattcgggcaaaaagcaacattagtcggcaattggttgttgagtttggtcagtatcaattttgtctggtttgtcttcagcatgccggccttattgatgctggtgctgctacagagtctgccgttaaacggggtgtatttggccacttggttattactagttttaatgctagccgtgctcgtattgccggcgacttatggcgtttttcaagccgccgctcagtgggcccatgatcggggcagtcactattggcgcccaacgctccacggttatattgccggcttgaaacaatggcgccaaaatagcgtttttgccggcttgattggcttgtggctgatcgctgaacaaattggcggacggcaggttttctggcaaagtagcttgttgatattaggcgttgccttaatcgcagcggtcattttaggcatgctgcgcggcctcggtcctcaagcggtagcgcaagcactacaacagccgctcaaattactagccgcaacgctattaacgttagctttactgctggtcaatctggcgttaccgctactattttgcattgtcctactgagcgtaagtttaagtgcgtgggcagtgatcaaaataatgaaattttaacgcacgctgatcaatcttaattgtgaagtagaaccatgtttcttgcggcacggtttaagctacaagaatggttatcgcccgtaacatcaaaaaagttggttagcggactttgctaaccaacttatccttaattgtgaagtagaaccatgtttcttgcggcacgattcaagccacaagaatggttatcgcccgtaacatcaaaaaagttggttagcggactttgctaaccaacttgtccttaattgtgaagtagaaagggtgtttttaatggtcgaagttaatctggaacacatatataaaaaatacgccggtaacgataattactcggtcagtgattttaatttacaagctaaagatggcgagttcattttcttcgttgggccatcaggctgtggcaaatcaaccattctacgcatgatcgcgggtttggaagagatcactaaaggcgacttcaaaatgaacgataaagtcatgaacgacgtggcaccgaaggatcgcgatattgcgatggtcttccaaaactatgccttatatccgcacatgacggtgttcgataatatggcgtttggcttgaatattcgtaaaaatgataaagccgataccaaacggcgcgtggatgaagcggcggcgattcttggcttatctgattttctacaacggaaaccagctgctttatctggtggccagcggcagcgagtcgcgttagggcgggcgatcgttcgcgatgccaatttgttcctcttggacgaaccgttgtccaatttagacgccaaattacgggtcaacatgcggaccgagatcgctaaattacatcagcggttgggtaccaacatgatctatgtgacccatgatcagatcgaggcgatgaccatggccgatcgaatcgtgatcatggacactggtaaagttcaacaaatcgggacgccatttgaattgtacaatgaacccaaaaacaaatttgtggctggctttatcggctcaccagcgatgaacttttttgacggcaaaatcagtggcaatcaatttgttaacgatagtggcctggctgttgtcattccggaagggcaactaaaagtcttaaacgacaaagggtataacgataaggcactgacactgggtattcggccggaagacattcacgccgagcaagtcgccttggacacgtttcctgaggctgtgatcgatgctaacgtacaagtttctgaattactaggtgcggattcaatgctgtatttacggactggcaatatcgattttattgctcaagtcgatgcccgcgattaccacaaacctggtgatgacattaagttagcctttgaaatgagcaaagcacactatttcgataacgacactgacttaacgattttataagcgtgtcaaaaaaaggcgctcagattatggaagcgttgttacgtggaataatctgccttttttgcacgtttaagctcgtattatattgaaaaacgctttttcaaaggaggcaaaattgtggcaacctcagaatggtggcaaaaagcagttatttatcaaatttatccgaaaagtttcaatgacagcaatggtgatggtatcggcgatctaccgggcatcactgccaagctagattacctgaaagcattgggtgtggatgcgctgtggatcagtccgatctatgcttcaccgcaagtcgatagcggttatgatatcagcaattatcgcgtgatcgatccgcggtttggcaccaatgaagacctctatcgtttgatcaccgaagcccatacccgcaacattaaagtgatcatggatttggtcgccaatcacacctcggaccaacacgtgtggttccaacaaagccgccaatcacagaataattatttcagcgacttttatatttggcgtgatccccgtcctgacggcagtgcacccagcaattggggctcgtattttggtggttcagcttgggaatacgaaccaatgcgtaaacaatattatttacactatttcgccaaggaacaacccgacctaaactgggaaaaccccttggtgcgtgaggcagtttatgacctaatgcgtttttggaaggcgcacggtgtcgacggttggcgaatggatgtgatttcgggaatctccaaatttactgattttcccgactacccgacaccgaataacgaatcattcgtagttggcgcattacacgcgaatggtccccggctgcatgaatttttgcaagaaatgaatcaagaagtattgacgccatttgccatgatgagtgttggtgaagcaccagggagtacggcacataacgcgcgtcaatttgtcgatcacacgcgccgtgaattgaacatggtgttcacgtttgaccacatggacatcgatcatgatcataacgcaccatttcccgaaaaattccatccactaccttttgatttggtgaaattaaagcactcgcttagtgagtggcaaaatattttatttgagcacggttggaacacgctttattttgaaaatcacgatcagccccgggtgatctcacgttggggtgatgaccagcagtaccgctaccaaagtgccaccgcctttgccaccgtgctgcatggactgcaggggacaccatacgtttttgaaggtgaagagatcggcatgaccaatgcctataattttgaattggccgattacaatgatatcgaagtcacgaacactgccaaaatgctgggcacagcagtcaccggcttgtccgccaccgaattgttggcggcagcacataaaatcagtcgcgataacgcacgaacgccaatgcaatgggatgcaaccgctaatgccggttttaccagtggccaaccgtggctgaaaatgaacgctaactacgccacgatcaatgtggctacagaccggcagcaaacgcaatcaatttttgcttattatcagcaactgatccaattacggcataacgctgaatgggtcaccgccggtaaatatcaattgttgctagctacggacccgcaactgtttgcttacacccgcacctatcacgaccatagctggctgatcgtggccaatttaagtagtgccaacgcagccacgaccgcactgcaacaggcgttgggaaaacaacaatgtggtcaattagtggtgcaaaattatccagcgcgacagacactggcggccccactacaaccgtatgaagcattgattgctgaattaaaataggctgttgttataagcatggatgccttaattgtggcatagggccatgttgcttgtggtgcccgcaacgggttgagttgaggaaacgcagttgcggactgtgcaactacgctcattaagatttggccacaagaatggttactggcgctcattcttatcaacgcttttggtaaatattatttaaggaacatattggccaaacagtacgaacctgccgatgtcgattggactgagccgaagtccggcaagtccaagtcgcaccgtctggaacatcagaggttattagcgtttttggctaataacttccttaaaagtggcataggaggtgcaaaatgcaacgtatttttgagattgatccgtggcacctgatcagtcatcagttagatgataaaactaaattacttcaagaaagtttgaccagtatcggcaacggatacatgggaatgcgtgggatgtttgccgaggattattctggtacgacccacgctggtatctacatcggcggcgtgtggtttcccgatcggacggtggtcggctggtggaaaaatggttatccggagtattttggtaaggtgatcaatgccgtcaactttgcccaagtgaatttttggttgaatggggaaaaggtggatctggcgcaggatcaaattagtgacttcacgttagatttagacatgcagcgtggtcagttaacacggcaatttacagtgactaagggggaggcgcaggtacaagttagtgtgacccgctttgtcagtatcgcgcaaaaagaattatttgtactccgctatgagtttcgtaatctcggtacaactaaggtcgatctacaaattgattcagcaatcaatggtgatgtttataatcaagatgccaattaccacgaacaattctggcaggtcaaaatgcggcaacaaaccgaaactactggcttattagtcgccaaaacgaaaccgaatccctttgcaacaccacgctacaccaccgccatgcaaatgatgaatcagacacacctaaccgcacagtcagctactgcggcggccaaacaagtcgttaatcggtttagtggtgaattagcaactggggctagcactgattttgaaaaaagggtgatcgtcacgacttcgcgggattacccagatcaagcggccgtagtgacagccgcgcagcaattaagccgaaaagtagcccaatactcgtacgccgaattggcagcggcacagcaacaagcttgggcaacacgttggcaacaggcggatgttaaaatctctggtgatcctgccgcgcaacaagggatccgctttaacttatttcaactattttccacctattacggtgaagacaagcggttgaacattggaccaaaagggttcaccggggaaaaatatggcggggccacttattgggataccgaggcctttgcgctgccactgtatttatccgtggcaccggctaaagtcagcgagcatctattagaatatcgttacgatcaactacctggagcggtgcacaatgcgcaggcgcaggggttaaaaggcgcactgtacccaatggtgacctttaatggtatcgaaagccacaatgagtgggagatcacttttgaagaaattcaccgcaacggtacgattgcttatgcgatctataattatacccgctacaccggggatgaaacttatttacgcaccaaagggatcgatgtgctagtcggtattgcccgcttctgggccgatcgcgttcatttttcccagcggcagcaacagtacatgatccacggtgtcactggccctaacgaatacgaaaataacgtgaataacaactggtatactaatttattggcgcgctggacgctccaatataccttggctaccctcgctaaagtacccgcaaagcagactgaattagccgtcagcgctgctgaaaaggaacattggcaagatatcagcacacgaatgtatttacctgaagacaagcagcagggaatctttgtccagcacgataccttcttggataaagatattcagccggtaacggcgattccagcggcacagcgcccaatcaatcagcattggtcatgggataaaattttacgctcgccgtatattaaacaggctgacgttttacaaggtatctggtatttcattgatgaattttcaccagcagcgaagaaacgtaactttgatttttatgaaccattgacagttcacgagtctagcttatcgccgtcagtccacgcaattttagcggctgatctacattatgaagccaaagccgttgaaatgtatgaacgcacggcacggttagatctggacaactataataacgataccgatgatgggctgcatattacctcgatgaccggtagctggctggcaattgtgcaaggctttgccggaatgcggattcgtgacgggcaactccattttgcgcccttcgtaccgcaacaatggcaaggctatgagttccaaattaatttccgtggccgcttattgcatatcgaagtaactaaaaccggcaccgagatcagcttacagtcaggggcaccattaaccattgacttagcgggccaacaacttgaattaaattaaaaaagtggcgccgggatcaaaatccgcggcgccatctttttaggcgtatttttgtaaagtcgaacgtacgatactaactttaaatagtagaaacaataagacactgtaaacgggaaaagtgatcaattcctgaacaaaacggccggacaacaatggcagccatggtgtttggtacattaaatgtaaccacaaactatttagtcctagataaagcaccattgtgacgattaagttagccagtagaatatggctgagccgcggcgtttgattgtgaaaagcataaccgaacactaggcccactaagaaagcggtcaatacaaagccggggaaaaaagtaaatttcggaaatagtaacatacctaatatattagctaatgcactactgccagcagtgacccacggtgaaaataaggtcgccatgatcgcagtgatgatgaaaccaaacgagatcttggtcaataaaaattgtaacgaaaacatactgccaagaacggtttgcaaggcgatcagtacaccgagtaaggtaatttgacgtgcttttgaatgttgtaacatggcaatgacccccaaaaaaagaatgatcattgcaaccagcactggcgttaacgcaaaaaaagccgcacgaccactggctgcaactgattgtcggacaaaagccactggtacatgcggcgaatgcggacccaaaaccgcaaatcagcaagttacacctatcctttcagtgtggttggctgatttttcgtccgtcgttcacattccgttccggcggcacttaacgctttgggtcctaccccgataatttgatttcattataggtcatgcgatctgaaaatactagtatgtatttctgaaagtttgaaataagatcaagtcacaggtgatttaaacaatttaatggtacattaaaggtgttgaaaaaataatagatttagggaggctttttcatgaagattggtgttattggcgcaaccggcaaagaaggcacgttgatcgcgcaggaagcagttcagcgcggccatcaagtcacggcaatcgtgcgccatccagaaaaattacaattaaaaatacctgtgctcgcaaaagatttatttgcgctgatcacgtctgatttaactgattttgatgtgatcgttgatgcttttaatgcaccggcaggtcaagaagaacagcatcaaacctcattacagcatttggttgatattttacatggtacgccagttcgtttgttggtcgtcggtggtgctggctcattatttgttgacgatgcacagacgatgcgtttgtacgaaacgccagactttaaggatgaatggaaaccaacctcggtcaatatgggcaaagcattgatcaacttgcaaaaagtgaccgatgtgcagtggacttatcttagtccagcggccgctttcttagctgatgcaccgcgtaccggcagctatcaagtggggcaagaacgtttactgactaacgccgccggtaaaagtgagatcagttatgctgattttgccttagccatggttgatgaaatcgaaaaaccacagcatattcaacagcattttacggtttgcagccggtagctcagcggctaagcctgtagcgcttcagcgataaatatttcaccagtacggcggcggggaacgaagaaccctgcggccgtatttaggttatataccatggcgccgttaggaaataggccgcggatctgaatgcggtcgccttggcgcgcgctgtatttatcggtatcgaattgcggttcgatttgaaaatcagcgatggcgacgtagatttgcccagaaattaattcagctaatgtttgttgatgtgtcggcataattattcccccagtttttaattaaatcgtagcaggttggcgcaaaaatgcaatgctttttgcttggatctggactaaaatggaaactaatctaaggagttggtcaaatgagtcaagcaattaccccagctgcacaggctaagtttaaaaaaacattagcggcccagccacaagcaaaagttgtgcagcgtgcagttatgaatactggtatcaacgctgctagtgaagatattacggtgcaaacgcaattagatcgtactttctcattggaattaccaacaggaaaagtgtctaatcagaaacatagtggccgctgttggctattttcaacattgaatacattgcgtcacgaagtcgcagtgaagtataacttgaaggatttcgaattttcgcagaattatttatctttctgggatcggtttgagaaagccaacgccttttatgaaaatattatcgccaccgctgatcaagcggctgatagtcgaatcgtaacttggttgctagattcgcccaatggtgatggtggccagtgggataacgccgcagccctgatcaaaaagtacggcgtcgtgcctaaatcggttatgcccgaaacccaggccagcgaaaatacgactgaattcaaccaagtactcaatttacggttacgcaaggacgcggttaaattacgccaattagtggctgctggggccgatgttgcggccgcgaaaaccgaaatgttgaccgtgatctatcggatgtgcgcctatgccttcggtacgccagtagaacactttgatttcagctaccgcgatgacgctaacaagtatcaccgcgatacagacttgacgccgcaaagttttgccgctaaatatttaagccgtgatctagacgactatgtgaccgtgatcaattcaccagacaagcctttcaatcagctttataccttgccgattgaagataatgtggtcggcggacaacacgtgacgtttttgaacgttgatctagcaacttttaaagcattaacgattgcgcaactgcaagccggtgaaacgatttggttcggtaatgacgttttgcaacaaatgaatcgatcaaagggactgttggacagtcacttatttaattacgatcaactatttgctactgatttggagttaagcaaaaaagaacggctgcagtatcgcgaagcagtggtttctcatgccatgactttgaccggcgtcgatctagttgatgatcagccgactaagtggaaagtcgaaaatagttggggtgaaaaggttggcgcggatggttacttcgtgatgagcgatcaatggtttgacgattacgtttatcatgtggtgatcaagcgcgacttgctcagctcagaactacaacaagtgttacaaagtaaaccaactgaattagcgccatgggattcgatggcgtaaacaaatagcgtgtgcggttaggtcgcttactgggcctgagcgcacacgctatttttgagcaacaaaaaagcagccaccaatgtagttggtagtggctgctgggcgttcaataaagaacgcggcgcgacttataaatgcgcgcacagactcgagggtctgtaaggtctggcaccttatctgcgattataacatacttaccagatgctgacacgtttttctggcgctaaatacataccatcgcctggttgtacattaaatgtacggtaaaaatcagcgaagttttgcacctgaacattggcgcgtaatttagcaggggcgtgaacatcgatcgataacagtaattgttgatattctggctgggctttggtccgccaaatcgtcgcccaattggtgaagaaggtcgttaaattaacatcggtttcacctttggcggcttctaaggcacaactcaagccaccagcatcggcaatgttttctgacactgtcagtttgccgttgacttggctgccggcaaatggaataccgttgaattcgccgatcattgcttgggctaattccttaaagtgcgcagagtcagcgtcggtccaccaattgtgtaaattaccaaattcatcaaaaagcgcaccgttattatcgaaggcatgggaaatttcatgggcgatcaccgcaccgatcccaccataattagcacttgatggttgcgttaaactataaaatggcgcctgcaaaattgccgctggaaaaacgataatattgcggaaaggatggtaataagcattaaccgtattagcactcatttcccattcagttcgttcgactggttgattccatttactgaaacgatccgcaatggtgatatgggcaaaacgcatggcgttgcttaataagctagccccagtattgacggtgaattgcttgaataatggcttgatcgtatcgggataaccgacttgaatgcctaaattatccagcttaacgatcgctttttgccgcgtgctggcggataaccaatcattattttccaaccgttttttataaacgccgatcattttaacgaccatttcatgaacgtcagccttggcggcctcaccgaagtacttgcgaccatagtaatcaccaacaacttggtcaaattgtccggcggccaaataataggcactcttttgcggtttcatcgcttctttactaccagaaagcgcccgcccgtaaataccgccgatttcacggaaatcattacttaaatagccactcatactgcgtactgtgttgacgatcaaccagcttttcagtaggctaaagttctctgttgtgacgatctcgtcaaaggccgcaaagaatttaggttgggtgacgatgattttttccggttgcgcaccaatcaattctggaattaggcggctaaagtcgatattgctgctatgggctgtgaattcagtgaaagtctgcggattatacattttactgtagtcggctgactcttcagcgcttttcacatgtggggctaagcttttatcgaacgcaatggcttgctctaagatcaattgcgtatcggcggtgctgtagccagccatttccatcaattgttgcatcatttgttggaaaacttgtaataattgtgggccactaggattatcagccgcgtagtaagttttgtcgggtaaaaataggcttggtgcgctggcaaataaagcgttgatcttggtgttcttcatgtcagcgtccacgtctaaatcaaatggaactggtaaaccatctaaaagccaatctttgagatccgcttgccagtcggctagattatcatatttagcgatccgccgcaaataaggttgtaacggtgcagcggcttgggcatcacgctgttcaaaatcagcggctaacgcataatactttagaaattcaccgatcagtggactgctagacgattgcttttgcattgctgcaaagtctgccattaaagttttttcaatattttcaactagatcttgaaagccaccagtagcgggacggtcggctggaatcttggccgttttcaaccaatccgcgttgattgcgttataaaaatcatcttgtaagcgtgaatggtcacttgattcgctggttgtaccagcggcaaattgtaattgttgcatataccgcacctccatgttcttaatactgttatcatacactaacttttctgcgttggcgcaggattagtttgggtgcgccgctttttgattgcttctttgacgtaatatatcacgtagcaggcgatgataaagggtaccatataaaataatgctggccgttgggtcgggtcaaaaataattagcacacacgacaaaaagcttagaataaaagcggctagcggtatccaaggatagcctggagtacggaaggtcaattcactaagttggtgaccttcagccaaaaattgtttgcggaaatttaattgggatagtgcaatcgccatccagacaattactacagccaagccggagattgaaaccaacactaaatagacggtttcagcggcgacgacactagatagtaacgctaaaataccaccgagcatgcttaagcttaaagccagcagtgggataccacttttagttgttttggcgacacgagcgggaatcattttttcattggccagcgaccacagcatccgcgtcgaagcatataggccggaattggcggcggacaagattgccgtcagcacaacaaaattcattaagtcacctgcaaaaggtaacccaatttgacggaaaaccagcacaaacgggctttggctgacgccagctttttggtaaggaatcaacgcggccatcacgacgatactgccaatgaaaaataaacacaagcgcaataaggtggtgtggatcgccttaggaatatttttgccgggatctttagtttcgcccgcggtcacgccaatcaattcggtgccagaaaaagcaaaattaactgtcagcattgtggtgaacacagccttgatcccgttaggaaaaataccgccagcaactaaattatgtagaccgggtgcatggtgataaccggaaatagggagtagaccaatgattgccgcaccaccgaggacgataaaagcaatgatggcgatcactttaatgctagagaaccaaaactcggtttcagcaaagaaacggactgataatgcgttggcaataaaaatagcgatcataaataaggcgctccacaaccaagttggcgtgtgtgggaaccatttttgcatgatcaagccagcggcagtgaattccgagcctagggcaacggtccaggtcaaccaataaagtagggcaacggtaaagccagttccgggaccgatatatttagtcgcgtaaacatgaaatgagccggtaaatggcatggcgaccgccaattcacctaaacataacatgacgagataaactaaaacggcacctagtgcgtaggcgagaatcgtcccgattggacctgcttgatgaatcgtgtagccagagctaagaaataagccagtgccaataacaccgcctagtgaaatcattagtaaatggcgcgcttccattttacgtttcagcgttgcgtttgccataaaaaaagcctccaaggattgatatttaactgcaattagaatatgatgagaaaagtttaatagatttaacatagcatttttttaactaaaaagctatatttcttgcggaattagcgctgaataaacgacctaattatggaggaagtggacgtaatgaattttcgccaagcagtcaaacaaccactgattttagatggcgcaatggcaactgaattagaaaaacgtggtgtcgacacgaatagtgagttatggtcagcgcgagcgttgttgactgatcctaacacagtttatgccgtgcattatagttattttgccgccggcgccgatatcgcgatcactaatacctatcaagccaacgttcctgcttttgaaaaaattggcttgaccgctgcggctagtaaggccttgatcgctaaaactgtccaagtggcgcaacaagcacgcaccgattatttggcagctagtgataatgctcgtgacctctatgttgccggtagtgttggtccttatggggcttatttagcggatggtagcgaatatactggtgcttatcagttagatcgtaaagcttaccaagtttttcattacccgcgcattgctcagttggtggccagtggcgtggacgttttagctatcgaaacgcagcccaattttgctgagatccaagctgtcgttgcacttttacaggaagaattcccgcagcaggcagcgtgggtatcgttgagtattaaggatgcgcaaacactttgtgatggcacaccattagctgaagtggtgacttacctgaatcaacagccgcaagttgtagccctaggcgtgaactgtacagcgttgaccaacgtaacggctgtgttacagactctacagccactgacggataagccattattagtttatcctaattctggtgaggagtacgaccccagtgataaaacgtggcatatgcagaaagacacgcctcaatttagtgaactagtacctaaatggcaagcaactggtgcccaattgattggcggctgttgccggacaacacctggtgatattgaacaaattagccaaatattacgctaaaaaaggtgaacctcgttaatgtcgaggttcaccttttcgtttggtggctgaatttatgcataaattatagttgcgcgatcaaatattgaccaaagtcgctggtgctaagctgcgttgcgctaggaattttggtagcaaaatcccaagtcacttgtttgttttgaatggcggtggcaacggtttggcgaattttggcggcaacttctggccagccgatataatcaaataacaaagcaccagataaaatgatcgaagtgggattcaatttattttgaccggcaaactgcggcgcggtgccatgagtggcttcaaaaattgcggcgccggtgacgtaattaatgttcgcacctggtgcgatcccgatgccaccaacttgggctgctagtgcgtcggaaatataatctccgttaaggttgggtgtagcgatgacggaaaattgttccggtgccaacaacgcctgttggaaaaagttatccgtgatcacgtctttaatgatcaatttaccggcttgctgcgcagcctgataagcggcatcagcagcggattgatcagttttagccaattggcgataggtttcccaagtaaaaatttggtcggcataatcttgggcagcaatttcgtagccccatttcttgaagccaccttcagtcagtttcatgatattacctttgtgcactaaggtcacagacggtaaatgattggctagggcatagtcgatggcgcttttgaccagccgttgactgccactttttgagattggcttaagggcaaaggcactttcttcaggaaaacggactttactaagttgttggtccgtagctaataactgccgtaagggggcactggctgcaccgggagcgtactcgataccagcgtaaatgtcttccgtattttcacgaaaaaccaccatttcagttttttctggttgttttagtggggaaggcgtcccagcaaaataatgaattggccggaaacaagcatataggtcaaatttttggcgtagggtcacgtttaaggagcggtgaccgccaccaattggcgtagtcagtggccctttgattgcgactaaattagtttttaaggcatctaatgttgcttgtggtagccattcgccggttgttttaaaggctacctcaccggctagtagtggcagccactgcacggccttagtgtcgccgtaaaccgcagtgacggcggcatcaaataacggttgtgccgccgcccaaatttccgggccgataccgtcaccagcgataaatggaatcgttggttgcgctggaacttgcaacttgccatttttcttggtaattacgctcatagtgcggcacctccttcttgtttaaatggccgcggtgttaaatcacttaactgcagctcgctaggcacttttttatcataaacgccggtgtagtgtgagctaggccgaatcagataactagcggctttttgctcacgaatatgtgccagccacccagcggtacgactgatcgcaaaaattggtgtgaaaatatcgtggggcacaccgaggcaatggtagatgatcgccgcatagaaatcaacgttgggtttcaactgcttggtttgccacatgtaggcagctactgcttcagctaaattaaatagcgccatttgatcgtaatgttgcgccattattttggcatagtcgtgtaagtaaaaggctcgcggatcaccatgcttgtaaatacggtgaccaaagcccatgattttctcatgattggctaatcggctatctaagtattctgcgactgtttgcccgctagaacgaataccgtccagtaataagtaaacttgttcattagcaccaccgtgcagcggcccttttaacgcacagattgcggcagttaggcaggaatactcatcagcgttagttgacgcggcaactcgcgcggtaaaggtagaggcgttgaattcatgatcagcgtgcaggagcaacactttgttaaacagatcgttttctgccgcactaggtactttgccggtgagcaagtaaacgaagttaccagcaaagtctagtttgcgccgcgcttttaagggcttttttccggcacgtagccgcacgatcatggcgacgatcatcaacattttagcttggatcgcggtggcgttactttctgccttagattcagttgaaccgaggaaagaaacgctggtgcgcaacaaactcatcggatgtcgctgaatcttgctaatttttttcaatgtgtctaggaagtcaggagccaactccatttcggcgaaaagagcggcccgaaaattctttaattcagcgttggtcggtaagcgctgatgccagagtaagaaaacaactgcctcataggggacatttttggcgatcagttcggtgatcgggtacccagcataagtcaacatatcgtttttcgtggaactaatagcggtgtcagcgatgacaacgccagctaaacctttaggtaaatccatgtggaacctccttttacattgcttaagttgtgtttagaaattattgctacgttgaattttgtagaacagattttaagccaaatctgcttttcgccgcaaaactagtggtaaaataccatcattttcgtagtaagtcatatcagtgggggtatcgaaacgtaatttagcggtaaatttggtttgtttgccggtcgcagtggttgcggtaacgtgggccgtgtggtcggtgaaactgatggcaaatgattcagcaccgctaagaccaagactagtggcgttttcgccggctacaaactgtaaaggtaaaacgcccatcatgaccaaattggcccggtggattcgttcaaaactttcagcaatcactactttgacacctaggagtttgacccctttagcggcccaatcgcgggatgatcccatgccataatctttgccagccagaatcactaagccggtaccgtcagtctgatatttagtggcagcatcaaaaattggtaagatttcgtcagttggccagtagcgcgtataaccgccttctttttctggcgtgagctgattttggattcggatgttggctagtgtgccgcgcatcatcacgtgatgattaccacgacgcgaaccgtaagaattaaagtctgtcggggccacattttgggcttgtaaatattgccctgcaggggtgttttgaccaataaagccagcaggcgaaatatgatcagtcgtgatcgaatcaccaaatttagccagtgctcgtaagttggttaaatacggcaatccagtgtgtcgtgttagtttttggaagaacggcggtaacgcaatgtaagttgagttgtcttgccaagcatagctactaccagtcggtgcggctaacgcattccaagtctcattagcggtcaataatgaagcgtactcgcgcttaaacgtgtcagcggtgactgtttgctggatcaaggtatccacttcactagctgccggccatagatcttttagaaaaatcggatcaccagcacgatcatggcctagcggttcggtggctagatcaatgcgtaaagtaccggctagagcgtaggcaacaatcaatggcggcgaagcaaggtaagtatctttgactagcggattaacccgaccagaaaagttacggttaccagattcaatggcagcaatcgggaaattagcggcatctactgcttgttgcatttctggttttagttggccggaattaccgatacaagtggtgcaaccatagccgactaaattaaaaccaagctggtccaacgccgattgtaaacctgccgcagcgagataggcagttacgacttttgaacccggggcaaaggatgttttaacgtatgctggcacttgtaaaccagcggcgacagctttttgtgcgatcaaaccagcagtcaatagcaagctaggattcgatgtattggtacaactggtgattgcagcgattgctaagtcgccgcgttgtaattggtactcatgatcagctacggtaacggctaatttttggttatctgtaaattgttgtttcaatgcggtcaatggtacaagatcttgcggccggctgggaccagccaaactaggtacaatcgtggccaggtccaaactttcagtttctgagtagtggcattgttcagtagagtcgtggaataggtgattttggtgtgcataatcgctgatcaattgaatttgttcagtgctgcggttagttagtttaagatagtttagcgtttgctgatcaattgggaaaaagctagccgtcgcaccatattcgggtgccatattggcgatcgttgctcgatcagcgatcgataacgctactaagccaggaccatagaactcgacaaatttacctacgacgttatgagcgcgcaataatttagttatggttaacgctaaatcagtggcagtggcaccttccggcaattgattgctaaggcggacaccaacgacttgcggaatctgcatgtatgaaggttcgcctagcatactggcttcggcttcgataccaccaacgccccaaccaagaacgcctaaggcattgaccattgttgtatgcgagtcagtgccgacaacggtgtcaggaaaggcccagtgctcaccattttgggttgtactacgaacaacactggccaaatattcaagattgatctgatgaataatgccggtatcaggcggtacgatccgcagatttttgaaagcttgttgtgcccattttagaaactgatagcgctcatggttgcgagcaaattcttttttgatgttggtctggaaagctgctgcatccccagcacggtcaacttgaaccgagtgatcaatgatcagatcaacgggtacatcgggattaatggtatcaggatcgccaccatcagtgactaattggctgcgcattgcggcgagatcgactaaagcaggaacacccgtaaaatcttgtaggatcacccgctctggcttgaaagcaatatcttgatctgcctgtggccagcttagaaacggcgctgggtcagtcttttgctggcgcagcgtcatttctaataaaacccgtaatgagtagggtaagcgcgccacatcaaagttgtgcgcttgtgcccagtcattgatcgcgtaataatgataagttgttccacttgatttaaaagttgcttgataagtcgtcatcgctaaacctcctagaaatcgcccacaaaggattaaaaataaatgagttattaattagttatctttaatttaaaaggtttgcaaaatagaagtcaaacgaaattataaaatagttagaaaataaagattttcacatttaaatttaatttaaagcgaaagtagtgctataaaaatggttaattataaagtgagttacataatcgatgttaaccagaatcttggcttatacgcctctcattagcaaaattatgctaaaatgaatgcagaccgcagcactgctttttggcggtgcgctaatttaaaaataaaggaatttatcatgcaattaaaacgtctaacttggttatttagcgcgctagttgtcttactgctattaccaacaccgattcatgctgcaaataaagtcacaactcagcaagcaccctttgccggtaaaattgagaattatcggtatcgtaatcgtacttatcagattccagcagcctatttgcaataccaaaataaacaactggcactgctaacggtcagtaatgataataaaggccacgtcatggtggtgagctatatcggtacgggcaccagcgagcagaaattttatcgttttaccggacaattacgctattttgccagtttgtatgaattgaaagacttcatgtccgcctataatcagcgcagtggcgattatttagccaaaacaatctatgcggcgactcatgcccagccaatcattaatcccgacaaaaaatcattacagttcacgacttcaccgctgttatatcaatttgaaggcatgaatcaaactaccagtcacccgatttataagcaaaatattaagtcatacaaaaaagtccacttaacgtcactaagtgattcggcgctaaatctcccacaagtaaatatgcttaattcggctggcgaaagtgctgctttgtattatcaaactgctgatactagccagattattgttgatccgttaggaattttcgtgcgagtagatgaataaacaataaactaacagactagttacttagatgtcgaattctaagtgctagcctgttttttttgtaaaaaagtcattgacaattagaaagtagctcattataatttgaaacaatcgaataaaacattaaatcaaaatgaaaagatgagtaaattgatttgctatttgaagagagtcactaattggtgcaaagtgacattagcaggcagttgaagatggtcttggatttgaattacagctgagcataggcaaagttgtaacgggcactcccgttaacgagttagagtataccgattttagatcggtgcacttgaagaggaatgattcgtaaggattatttaaattaaggtggtaacgcggaaaagcactttcgcccttgtatagcaatatactggggcgaaagtgcttttttcgttgctaaaatttgaggaggaagaataaatgcctaagttaattgattttaaaatgattttgacgaatataccacaattgttgcagtatctaccgatcactttagcaattgttattttatcgatgattgttgggctagtctttgcgctgattatcgcattagtgcggttgaataaaataccggttttgactcagttatttacgttattagtttcatttgtacgtgggacgccgctattagtacagttgtatttatcttattatggagtgccaatcgcattgaaatactggaattattataatcatacgaattataacatcaataatttaccggcattcctgtttgtttttgtcgcgtttgcaattaatgaagcagcttataattctgaaaacattcgtggtgctttactttcggtggatcgtggtgaaattgaggcagcacaatcgctgggcatgactggcggccagattttacggcgaattacaattccagaagcattggtagtcgcgttgccgactttaggaaatcagtttatcagtttgatcaagggaacctcgctagcttttgttgccggtgtgattgaaatgactgctgagggtcagattattgctggtcgtaattttagatattttgaagtctatctttccttggcaataatttattgggcattaacggtaattaccgaggttattattcgttttgttgaaaagcggctcaataagtttagaacggtccaaaaagtagttgaaattaatgacacacttgaagacaatgcattaccaattaaacgctcgttacaagttttagaaactgaaacaaaataggagggcgataaaatgattgaaattaagcatttagcgaaaacttttagtaatcatgagatttttaatgatattaatttaaaagttaacacgggagagattttagcaatcattggtccttctggctcaggaaaatcaacattattacgttgcctaaatttacttgaaaaaccagatgaaggtgaagtgactattggtgattcgcatttcaccgcacctaatatttctaaaaaacaggcagtgggaattcgccaggaatccacgatggtttttcaacaattcaatctgtttagacaaaaaacagcttggcagaatgttgctgaaaatttaattaccgttaaaaaagtgaacaaagtggcagccaagcaacgggcgcttgaagagttggataaagttggcttaggtgcctatgccaacttttacccaggacaactatctggtggacaaaaacaacgagtagcaattgctcggtctttggccacagattctaaaattttattgttggatgaaccaacgtcggcgttagactcagaattagttggtgaagttttgactacattaagggcggtcgttgaaaaccatcctgattatacggttattttagtgtcacatgaactggaatttgtgaaagaagtagccactaaagtgattttctttgaaagtgggcaaatcattgaatcaggtacaccagaagaagtgttgaataatccgcaacaagcacggacacagcggtttttaagccgttttacacagcaagctattgcacaataaaagagttggaggaattttttcatgaaattaaaacaaaaagtcgttctactaacattggccattacagctacgacagcaggtacaattaatttaccaaataatacggttaaagcagccactaaagccaaaacaatcactgcgattactgatggtaatgtggcaccattcgcggttaaaagtaaatctggagaaatcacagggtatgatgctgatgttttaaaagcagttgtgaaaagactgccgcaatataaattaaagtggaagttggctaacttcgatgctttgttaggtaatattgatgctggacgcgcagatataggggttaatcactttggtaagacggctgagcgtaaggaaaaatacttattctctaaaccaatttttgaagataaacctgtcttcattgtgaaaaaatcaaataatacaattaagagcttcaacactgctgccggaaaaactacgccagcacaagttgggactggtttttcgcttaatttggaacaatacaataaagataatccgaaaaataaaatcaaaatttcctacgttaaagattatcatgatttacaagatgttagttctggtaaatatgattttgcttataccgatctatcaatgtataacgctgaacagaaagaatacaacattaaaaacgttaaagccgtgaaattacaacgtaataaagatggcaataattttgatcatccgtatacttattttgtttttggcaaaacagccaaggacaagaagttccaacaagcagttaatgaagagttagttaagttagctaaggatgggacattgactaaaattagtaataaatatttaggtagtgatttttcacctaaagttttaagggaataattaggaggctaatcatatgagtcatttaagtctagcagaactagaaaaacaattaatcacgtatcggcatgaattccatgaatatccagagttagccaatcatgaatttaaaacaactgcgaaaattaaagcaattctagaagcgtggcacattaaaattttgccaacaaagcttaaaacaggtgtttttgctgaaattgggcttaaaactaaaccgctgattgctttgcgagctgatattgatgcgttgccgatcactgaagcttcgggtgtgtcttttagttcaaaagtaccgggaatcatgcatgcttgtggtcatgatacacatattgcggctttgcttggagcagcttatttgttgaagcaagaagaagctgctctgccaggtaagatacgattgattttccaactatctgaagaagatcaagaaggtgccttgcaggtgatcgatgatggtcaattgactgatgtacaggcaattttagggtttcataatacgccgcaacagccagttggtgcaattggtttaaaagcgggcattactagtggagccattgataaatttaaagtcactttaagcggcgttggcacgcatgcctcagcaccgcaaaatggtaaggatccgattccggcactgggagcgacgatcagtgcattacaaacaatcgttagtcgtaatctagatccttttaaggcaggtgtcgtcagtattacccatgtgaatgctggaaatacctggaatgtattaccggaaaaggcattttttgaagggacagtgcggactgcggataaagaagtgcgtaagcaaatcaagcagcgcttttttgaaacagttaaatacaccgctaaggcacaacaaattcaggctgatatcgactggtatgatggtgatccctcagtagataatgatgctaaattaactgcattagtgcaagatgagacggaaaaatttgcgcccacttatgtacagcaatctaaattaggtagcgatgattttgcttgttatcaagctttgattcctggcgtttatgccaacattggcaatggtggtagtgttagtgcccataatccacattttattgcggacgataaactgatcattgtcggggcacagttctttgaaaaaaatgcccgacgttggttagctgaacttgctgattagtactatggaagataaatctcccagatgaatgaaaaaagtggagggataaattttgaaacctgaacattttgatacggcacgcttacatgctgggtacgatccggctgctcatttacaatcgccattagtgccgatttatcaggccgcggcatttggtttgggtgacactgaaacggctgccgcaattactgcgggaactaaggctgacgcctacacttattcgcgagttggtaatccgacagtgcgggcttttgaaaaaaggctagctgctttggatggtggtactgatgcagtagcagttggttcaggaatggccgcaatttcttatgcgcttttaaatgtggccgaaggtggtggccgtatcctagcaccaaccaatatttatggtgctagtttggatgaattcagaactttgttacctaaatttggaatccaatttgattttttcgatgatattaatgatctaacaacgatcaaatcattattgcgaccggagacaaaagcaatttatattgaaagtgtcgctaatccgagcacagaagttgcggatattgcggcacttgcacagattgcgcatgccgctgggatacccttgatcgttgataatacctttcctacaccatatttatgtcgtccctttgaatttggtgctgatattgatgtttattcctcaactaaaggaattaacggtcatggaaatgttgtttctggtgtggtcattgatcatggtcaatttgattggaacaacggtaaattcccgcagatgactgaaccagagtttattttaggtgacgaagcgcagcacaaaactactagtttctatagtgaatttggcgctaatgcgtttattaatcggatccgcatgaagtatttgcgcttgtttggtgccgtaatgagtccattcgatgcctacttagcactacttggattagaaacgatttctgagcgtttaagtaaggaagtacaaagtgctacagcaatcgcacaatatttgacgactaatccacatgttaagcacgtttactattcggggattgaaaaggataatcagttggttaagaagtattttccacatggtattggggctattttatcgtttgaacttgctggtgatgaggaacaagtcgcaaaagtattggataatgtacatgtctttacttatttacctaacgttggtgatgtccgttctttgatcgttaatccggttaaggtcacccatcgagaaatgccgcaagcaattcggttaaagcatcaattaaatcaacaagtgctgcggctttcgattggcctagaagatgttcaggatttgattgccgaccttgatcaagcgattagacaggcatttgttttgccgcaggaatgacaacaacccataataaagactatatataggaggaaaacagtatggcagcagcatgtgaatggcacccaggacaggctaaggtagctacaaaaagtcaaaaaatacaaacaccaattgcaattcaagctggacgctatcggctgatttggggtaagttttgtccttgggcgacgcaaattgcgatcgaaattgatttattaggtttagatcaagttatatctaaaggtgagattcaatcattgtgtcgtagtgacttagacacagattgggtgtttggggccaccgatcaagttaaagatccagtgttacagacagcacgattatcagaaaactatcggcaggcactaccgacatttaatggtcgtgcgacggtaccagcattagtcgatacgacgacaggtgctgtagtcaacaatgatgctaatttcttgttggataatttagcgacagcctggcgaccttattttagcactgctgcaccagaactttatcctacagaacaaaaagaggcagttcatcagacaagccagaccatactgcacgaaattaatgaagtccctggcaaaattttacaggctaaatcacaagtagagtacgaacaactggctcagactttctttacgcgtttagctagttttgatcaaatattgtcaactcagccctacttattaggcgatcagctgacacaaccggatattcgcttattcgttacgttggtgcggtttgatttagtttattactaccagaataaattaagttataaaaagttaaccgattatccagcattatggtcgtacgccaaacgattgtatcgactacctgcatttaagcaaaatactgattttaccgcgatcaaagctcatttctatcaagtcgatgatacaccgatcaattcgtttgatcgagtaacgccatttggtatcgatgcggcaaaatggacacaggtcgaatgaatatctaggtagaaaatgttgccttgtgaagcacgttttgcctatattatatttggaagtacaacgaaagagttgcgacataacttacttatgtgacaactcttttttgctggattgtctttttcatgaaaaatggtaggcttaaattaaaatgttttcagaaagcgggtgttggggtatgcagaagcgctatcgttggttattattgggaattattctggtagggacttgtttgcggatgccgattactgcaattccggcgttgttggatacgatccagcgtagtttacagttgccggctagtttattaggaagtttgacaacaattccgttgttgtgttttgcgttattatcgccgtttgcgccacagttagcgcgtcgctggggcaatgagctgacgatttttatcgcgctagtgtttttgatgttcggtgactttttacgtggttttagcgcgacttggttattggtcggcacgttattgttaggcgtcgggatcgcggtaatgaacgtgttagtaccagcggtgattgcggatcattttccgcagcagttgggcagcgttacaagtctatatactttttcgatgacgttattcagtgcggttggcgctggtgccagtgcgccgttagccaaacaattcggctggcagccggttttgcagattttggcgttaattgctggtgtgattgcgctgctgtggttgccgaatttacgattaaatcatcgtctagtaccagcgaacaatcaaccaaaagtacgctcggtttggcgggtacgcggggcttggttgatgaccgtaatgatggggattcagtcgttgctgttttacacggttttaacgtggctgccgaaaattatgactagccgcggtgttccagcaacaacttcgggtttaatgctgggactatttcaattagcagcgctaccggcagcttattttattccaaccttggcggccaaagccaaacagcggagtgacttgatctgggcgatttgtgggatgttcgtactcggtttatctgggctgttagtaccaagtcattcattgtggtacttaggtgtgttgtgcgtattgcttggtttagccagtaccggtgcatttggtttatgtatgaccctgtttagcttaaaaactaccacggcggcagaaacagcggcaatttcgggaatggcacaatcggctggctatttattggcagccgtagggcctgtgtcgtttggcttgatttacggtgtgcttcattcatggacgctattgttgttaattttgcttgttttagatgtaatgatgttgatcgtcggtttggcagttgagcggcggcaaacgatctttgactaaattaaaaatgccagcgagggcaaataatgtccttgctggcatttgttttatgcagttttaacagctttcttagccattccaggtaaagtttcaaacttttcgcgaatcaagccggcggagcgtttgaatttagcttcttccgcggcagtcaatggtaattcggtgacactaacgacaccgtctttaccaatgatagctggttgaccaacataggtttgatacttttcgctgaaggcggagcatggacaagcaaggttagcatcggctaaaacggcctgacttaatttaacggcacaagtagcgatggcatagctagtataacctttaccggaatgaacggcccagccgccacggcgggcagcatcttccaactcatttagatcaatatctttatcagctgctaattctttgattggcaagccgttgactcgaaccgtcgaccaagcagaaaattgtgattcaccatgttcaccgtaaacgtaaccagtgacgtttttaggatcaacgtcaaattggtcgctaacgactttttgcattcgcgcggtatctaagaaagtaccggtgccaaggacgtggctttgtggtaagccagtcgttttctgtaagtaataagtgatgcagtcacaaggattcatgacatcgatcaatacgcctttaaagccagaagctttgattttaggtgcaatatcttgcacgatttcgcgagtgtaactaaattcagcccagcgattgccgctggcgttgtccaacgcgtggatgttaccagcagtcacaaataaaatatcggcatcggctaattcagcgtaatcaccgactttgattcgtgtgcgagtgtccagacgtgcttgagcgtcttcaaggtctaacttttcggccattgcttttgcttcgttatgatcatcgaggaggatgagttcatcggcaattcctttggtcaccaaagtataagcagttgtggcaccaacatggcccacaccaataattccgtatttacgcatctaatcactcctcattaatagtggataaatttttgtgtcagcattgcaatactgactcatctgtttatcatttaattttaatttatgatgcttattttagagccgtattagagtgatgtcaaccccttttatgatgaaaaataaaatatatgcaatgatttatgtgtaattcattaaataaatacggctaaaacttaattaaataaagcaactgaaaaatagtaagttagttacttaacgcatttttttgtggccatccacggcgcatggtagaataaaggataacaagatacgtttaaaaacaattatttgaagctataaaataaagcttaatagtgttttatataaagggggttagagcatgcggcaacggctaaagtggctgttagtgctgataggtggtttgttgatatttggctggtctgcagcggtgcaggctagaagttatgatattactgattatgatatggcaattgatgtcgcgaaagatggtagtgcggcggtaacgcagaaggtacggtacgattttgatggtgactttaatggagtttactataatcaggatacggcggggatcgatgggatgactgcgcttagtgtagcggtgcaatctagctcaggagtcaaggccttgacggctagtaatacggaagcacctgggacctacacaacgactgatagtgataaccggcgccagataaaggtattctatccggttagtgatgatacagtgacctttttatatcgctaccgcttgaatggtgtggtgaccaattatcgcgacaccgctgaattgaactggaaagtgatcggtaccggctgggacgtaccactaaataatgtaaaagtgacaattcaattgccgcagaaaaatgtgcgtcagctgcaagcgtggacgcacggaccgttatctggtaataccaaggttgaacgtaaggctggtcgtgtagtgatcactttggataaaaatccagccaacacttttgttgagagtcatatgttgtttccaacggcggtgaccgcggacaacgcgaagactagtgataaaaatcgtaaaaaagcggttcagcagcaggaggctgattttgctaaggaagccaacgcggtacggcggcgggcacaattgatcccgagtttgattgcttttgccagtctgattttaggtggtattgtattagtaacgcagctattctggttacgcaagcatccagccgaacgttacccagaaccagcaccaatcaagcattggtacgatattcccgaatatccgcctgcggttgcccaacgtttggtgaacgcttttggcccgaacaaaaaagcttttacggccacattgatggatttggcggtggcaaagaaaatcacgatcacggcgactaaagttggcaataaagatacttttgcgttggcaccgaccgctaaatttaccaatccggagcgtgttttcaaattattatttgaaaccgtgcctcgccgcaatcgtgatgaaggagtcacattggtggatattaaaaactacgggcgaaccgataaaagcgggcttttaagcaaagcgtacgaagattgggaaatgcgtgttcgtggtgcggttgatgaattgcattatgaaaatacgattaatgggcaaattcgtaatcgcgcttgggtgatcgcggtggctagcacagtctttgcagctggtgcaagtgtggccgcgctgttcactttccctagtgtccgggtaccattgtggggcctgtcggtgttgttagtattagccggctggatattacttttagttaaaacgcacgctttgccacggtatactcaacttggcgcgcagaaaattaacgaagtccgcggttttaagcaaatgttggaagatgttggtcattttgatatggcacaagtcggtgatttaatcctctgggatcgcattttaccttatgcagtggcgtttggctctgcggataaggttgtcgccgcattgaagatgaactttagtgaggaacaattggcgaccagcatgccgatcaactatccactatttatttacggttatggtggttttggtggccaagccgactttggcgaagcgtttaccagcggtttcggtagtagtttagcggccagtcatagtgccagctctaatgtgggcggcggctctggtggtttctccggcgggaactctggcggttttggcggtggttccggtggcggtgcgttttaaaaataacgctaaaattaaaaaactttggtgcatttaaggttagtttaagctaatgaccgtatattataaacataccccaaacccctaactaacctcatctaatttcactgaaaagcaaaactggcgtggcaactaatgttgtcgcgccagttttgtgttatttaggatctaagcctaatttagctagccgtgcttttgatttgtgttgtaaacgaacactgatgccttcgtaactaccgagatggggaccagcaaattttttgcgagcactgaagtagtagtcgagacacaacaggacgatcacggcaatgaagatttcgccagtcgcgtaatgcaaggtcaggtgtttggtcagggtgatcgtacttggcgaaatgatcatcaaactgaccaagaagatgatccacaaacaagcaatcaagtttactggcatactccatttacgcaaattccaagggccatcgtcagcggcggtccaagccccgcgtagccgtgcgcggatctttaaggcgatgggaatgaagtaggaactgtataagccgattacacttaatgaagtaacgattgcataaacgttatcggacaggctggacaaaaaagcgatgccactgactaaccaaattgcagcggccggcgtatggtaacgaggtgaaactttggcccacaacttggaaaatggcaggccattgtcccgactaaaggcgaacacgatgcgtgatgcggaggtgattgctgataggccacagaaccacatggcaatcgtgactagccataagattgcttgaccgatggtgccgccaactgcttgttggattacggtcataaaggcgttatctccactttgggctacagccagcggatttttgattgacatagtgaccaaggctaacaaaatataaccaaaaataccggagatcgcgacggaaaggaaaacaccccatggagccctaacttgtggatccaaagtttcttcactggtgtgggcggaagcatcatagccagtcagcgtccactgcgcttgtaacaaacccagtagaaaggcaaaccagtaaggagtactgccggaagtgacggtagaaaagttagtggtgaaaatatagccgactgaatgtttcgggccaaagtagactaatacgccgatgatcagcaatacgccgatcaaatgataaaaagccgaaatagaattgagtttatcaatgatacggataccaacatggtttaaaacggcgtgggataatagaataattgcgaaaacaatcaaagtttgcggcttggtcggctgtgcaaatagcaatgcagcagtaaagctggcacaaccaaagtcgatcccggcaacgatcgtcacttggccaacaaggtttaaccaagcggtgagccaaccccacgttggtccgcctaggatcgcagcccagtgatagatcgcaccactggtggggatcgatgaggtcagttcagccatagcggcggctacgaataaaacgaaaaaggtaacaatcggccaaccaagacccataacgccagggccaccttggttaaaaccgtagctatataaggtgacggcaccggtcagaatcgaaataatcgaaaaggaaacggcaaagttggaaaaaccacccatatcgcgtaacaattcttgtttgtaaccgaaggaatgtaattgtgtttgtgaatgaccagcagcacgagccgattggacactgcgactagcttgccaaatgataccgccgatcaaaataataacgagtaaaatcagattgaaacctaataccattgaaatcactactccttcgtgttgtctcttatgtgaatgctattattttaaagtatttgttctgtaatagatttagtccaaacgcatttggtaatgtgattttaattggctattctttgtgatgtctttgtgctagaggctaacttttgtttcaacgcaacgccagataagtggtaccgcagcatagcttggcaagcggcgttgatttgctgggcagctttttgaacggtggtaccaccagcgtgaatgttagaaatgacggtgcggcgggcttcgggcatgccgacttctgggcgataggcgatatatgcactcaaagaattagcgctaactaaaccagggcgctcaccgatcaacatacaaactacatcggctttggtggtggcgccaatggcatccattgcggctacccgagcgtatttgatgaaaggaatgtggtcacgatcgattggggtgccagcctttttaaacgtgtgttgtaacagcggcaatagttgaccaagattgcttgtgattgcggcagaactcaggccatcaccgataataagctgaatagtagcgtattgaggtaattggctggttaactgttgtaatgcagtcgcagtgaattggcgccctttaggcggatttttaagatagtcttgtttgttttgacaagtcgtttgtgcggtgatcaagccaagttgttgaataaatttaggcgtgacctcggttaaaactgcatcgcgtgcagcggcgtgatcggctaaaaatttcaatcgtggttgggttaaatagcgcgtgccgcaacgaccaagaccaattctagccggtgtagctattttcatttctaataacttttgacgattgattggcgtgagtaaaatttgttggtgctgtttttgttggtaaggatcgaccaacggggttggatcaattggactaacacggcgacaatgggggttgcgcttaaattgcgctggagacatgatttgtagatcggcttcttcatcaaattgcatcatagtaaaacttcctttcgtgaaatagcggtaaaagcactagcatcgccggctagtgatgtcaaatgaccatcttgccagaagcccattttttctagccactgggtaaattcagcggtaggtgtcaaattaagcaggtcgcggatcatcgctgtttcctggaacccagtactttgataattcagcataatgtcatcggcttggggcacacccatgatgtagttgcagccagcgttggccagcaacatggtcaagttctcgatgtcattttgatcagcttgcatatggttggtgtagcaagcatcgcagcccatcgataatccagtgagcttacccataaaatggtcttccaaaccggcgcggatcacttgtttgccgtcgtataagtattcagggccgataaaaccaacaactgtgttgactagaaaaggatcaaagcctttagcaaagccgtaacagcgagcctccatggtcacttgatcagcaccaaagttagcttcggcagataattctgagccttgaccggtttcgaagtacatcacgttgggaccgctgacacaatgttcgctgatagctagcgctttggcgtctagcaataactgccgattgatgccaaaggcagtattggctttttctgagccggcaatcgattgaaataataagccagcgttggcgccttgtttgatggcggccatttgggtggtgatgtgagctaacacacaaatttgcgttggaatttggtagcacagacgaaactgttctagttttctgatcaagcttgccacgtgagttggttcatcgatcaccggattgataccaatcactgcatcaccatttcccatactcaagccctccattgtactagccaaaatacccgaccaatcgtcaatgggatgattgggttgtagtcgagcagaaaaagttcctgagcggccgatcgttgtgttggcggttttttcaatggttattttcttggcggcggtgatcagatctaagttggacattagtttacacacagcggcaatcatttctgcggtcagtcctggagttaatttttgaatagctgccccagttgtttggctggctaataaccattcgcgcagctccgcaactgtccaatatttaattttgtcgaaaatggttaaatcaacttggtcgatgatcgtacgggtgacttcatcttctgcgtaatcgatcactggataattgaacaaatcatttagcgtcagattgcttaatacaaatttggctgcaattcgttcttgctggctactagcagcaaggccagctaactgatcaccggatttttcttcatttgctttggcgagtacttccttgaccgaagtaaaatgataaactttttgattgagtttggtattcaattgcataagcacaccccgtttatgaaatttgtgttactttttataacatgaacttactttatcactaagttcactgataataaagctttttcgtgagaatgttagctactattttttgttaaaatatatgaaatggccggtaaactaaggttgaaatacttaaatttttttgtaaaaatagtaattggatgtaataagatataacgtttagacggcacttgtacgtttgctttttaaatttacggacaaaaaaagcgagagcagcagtaattttgctctcgcttcttaatgtctaattaatgtgtgctacgccgccgcaaccaatacttccgcacttcttcaatcaacaatagtggaatcggaatggctaatagatatagccactcgccaccgcgtaatggggcggtattgaagatgatctgcagttcgggtaggtacattagcgccagtaatagtagtacttcgaaaatgatccctccgataattttacggttactgaagatcccaatgcggaaaacggatgagcgctgggtccggcaatttaacgctgcagcgatttggcaaaagatgatcgttgccagtgtcattgtggtggcttggcgataatcaaatccaccagtggctaagttagccattgtccaaccgttgacgcggttcgtcaagaagtaaccaatcgttgagaggatagccgcaatcaacccataccaaccaaatgcttttaaaagaatccgccggttaagcagatgcgcgttatgggaccgtggcggttgtgccataattccgggttcacttttttctgcccctaaacctaatgcgggcaacatgtcagtaccgaggtcaacagttaagatctgcataacggttaacggtagcggtactaaaccgcggctaaataggaaaacgactgaaggggcagcctccggtaggttactgttaaggatgtacagcaaaaatttctggatattgctgtaaacagttcggccttcttcgattgccgcgacgatcgaggcaaaattatcatcggttaaaatcatgtcagcagcgtctttggcgacgtcggtgccagtcatccccatggccacgccgatatccgcttttttcagggcaggcgcgtcattgacaccatcaccggtggaagcaacgatctcgcccatactttgcagcatggtgacaacgcgatacttttgttctggggcgacacgggcaaaaatcagctcatcacttaaagctgcttttaagtcagcgtcagtcatattggttagttcgtcaccagtgactacacgggcctgatcgctagtaataccgattttgcaggcaatgcttttggcggtcaaggcactatcgccagtgaccataatgattcgaatattggcggcgtgacatttagcgacggcggcatagatttccggccgcggtggatcagccatgatcgtcaagccaacaaaagtcaactgctgttcaacatcagcctgaacccatgttgtttgtggccgcagctgccgataagccatcgctaaagagcgcaaaccggcggccgcataacgcttatcagccgctaaaatttgctggcgatcttgatcagtgagcggccgtacttgaccgttgtctaaaatcgtagtgctgatcgccaataaaccatctaaagcacctttaacgtaagccactggttgttgatcgacagtttgaatcgtggtcatccgtttccgttcagaatcaaatgggaattcctgttgccgcggtagtttagcttgtaaagctggtcgatcaagctgtgccttttcagctaaaataatgagtgcggcttcggttggtgtacccagaattttagcctgttgaccactattttccggtgctttaacggtggtgttattgttcagtacactaatttgtaacaatagatcgagatcgtgcagctggccaaatgtgtaagcttgttggccgatattgatttgaccgttgttgacgtaaccttgtccggtaacctcatattcgccacttggcaaccaaatatggttaacggtcatttgattttgggtcagtgtcccggttttgtcggaacagatcaccgtagtttcacctaaagtttctacactggacaaatccttgactaaggcgtgctttttagccatccgttgaaccccttgcgccagtgacaacgtcacggttggcaataacccctcaggaataaaggcaacgatcatacctaaagcaaagataaacgacttcacaatcgggtagtgaacgaagaagatcgctaaaagaaagaataacacaccaatcaaaatagctagcaacgaaatctgctgggtcaaatgattcagttctttttgcaaaggactaacgttatcacgctgattttgggttaactgagcgatttgaccaaattcagtggtcataccggtatttagcgcaatcgcctgggcgttaccactagcagccattgtaccggcgtaaataatattggtttcggcaaatttaccatcgccgggatggtaagctactgtttttgactccggtacagattcgccagtcaatgctgattcatcgacttgtaagccagtggcgaagatcaagcgagcatcggcgcagacgctattgcccgcttgaatcgtgaaaatatcgcctggtactagatccactgcatccagccgctgttgctggccatcgcgtaagacttgtgtgtatgcgggcaacatttgccgtaaggaatcagtggctttttgagccgcgtgctcctgccaaaaactgaaaatgccattgatcagattgactgcccaaatagcgatcgctaattccaacataccggcaaataaagcaatgatcccactgacccataaaagaattgccattaagctggtgaaatttttgatgaacaacttaaattgtgattggcgttggcctcgttgaatcgtattctgcccataagtggtcaatcgctttgctgcttcctgattacttaatccggcagcacttgttttgaactgttgataaacttgttctattggtacgttagcgtattcgccagctgctttaattttttgttgccccatcagcacatcactcccttaacgtattgtttcgataataaaacgcttttttgaaatagctactttcaacgtcattataggtctaataggataaaaaacaactatgggtgtggtataagggggttaggtttgaacagttttcgactatgtcgtttggaaaaataaaaaagagctgtaacataattacttatgccacagctccatagtttactttaaatgatattcttgttgcgtcgcaatctgctgcaaggtggcgtaaatgcgcttaacgtcagtcggtgtgccgcgtaattcgtaatcaccgatcacgggaaaaccgaagtcacgagcgtaacgtttagcagttagacaatattgctcgttgaaattacggttaccagaaccgacaacgccaagacaaaattggcgattagcgttgtaaccaatgtactcaccgagtacattggtcagcagctctttaacgccgttgtcaataccgttaccgccatccaagtaagtagggacgaaggcgaaatagggtgccgtttcatctaccagcggactggcttccgagatttctttcaacgtgatcaagggctgatcagctgcggttttgtgctgctgttcggcgtattcttgcagatcttccacaaacgcgcgggtgttgccggagatcgaaatatacaaaattctaattggttcgggcatcggggccactccttttgcaacatgataggataactgaggcttaaataagttgctagtctaattaatttaaacctagccatgcgagtcgtttttaacgtacatcctatcatatcacaaaatgttgtatcatcgcagtgctaatatactctatttagtgcaatcggcgactgatgcagcttgccgtagtaaccaaccgactaagataatgctaacaccgaccataacggcgccaaatagtggtgtgatgcccagatcaagcttagcggtgacctggccgccaattaatgaaccgagggcgatgccgatattaaacgccgaaatatttagtgaagaagccaaagtgatgtcattcggcgtgtacgtttcggctaatttgacgatatatagctggagcccgggaacgttcatgaaggcgaagaagcccatgactaaaacgttgatcaagcctaaataatgcatcgaactagtggctaacaaagccactaaagtgagtgccaaaccgataaacattttacgtagcgcttgtaatggttgtaaattggcccagcggccgccaagcgtgttgcccacagcgaccattaagccgtaaacgactaaaataatcaccacagttgtagctgaccaacccattttttcttccaagagtggtgataagaaagtgtaaacggtgaaggtaccgccgtaacctaaggcggtgatcagcaacgctacgaataattgcgggttaagcaagatccgcagcaagccacgaggatcagttttaccaggtcgcggtaaattgcgcggaatcaataagctgttggcaatcaaaccaatgaccccgatcgcgctgataaatagaaatgacatgtgccacgaggcgatttgaccaataaaggtgcccaaaggaacaccagtaacggtggcaaccgttaggccggtaaacatcaccgcgatggccgaagcgcatttagccggtgcgaccacgtcagcggcaatgacggaagcaactgacataaacaagccgtgagcgaatgcggccagtacgcgggccaccaacaaaatcgcaaatgtgggcgccagtgcggctagtaaattactagcaacgaataaagtcatgatacccagcatcaatgttttgcggtcaaaacggccagttaataacgtcaatagtggtgcaccaatcgtgatccctaatgcgtagattgatacggtccagccggcttgactaacggtgatgccaaaactttttactagtaagggcatcaaaccgacgctgatgaattcagtggaaccaatggcaaaagcgctgatggctaaggccaataaagtccaagtgggggcaatttgttttctcatttattgctacactccaatctcaatttgtgctacaatttgccattatacgtgtagtggttaaaaaaacaattacgcactattttgtatcatagggactaaaaagtacctatgaacgtaaaagcgagaggagtacattatgccgaaaacttataatattggcgttgaagcaactatggaagtcattggtggtaaatggaaaccgattatcttgtgtcatttacgtaaaggcgtaatgcgcacgggtgaattacgtcgggcgatcccgaagatcacacaaaaaatgctgactcagcaattgcgtgaactagaaacagctaatattgtttgccgaacagtttaccagcaagtaccacccaaagtggaatatagtctgactgattatggtgagagtttggaaggcattcttcatcagctttgtgtttggggtgaagaaaacgtcgaacgccgccaggaaaaaggtgaagcagttgaattgttggcatgggataaggtagaagcctagtaaaacaaaatgaacttattactacgataaaaaaagataaagctgcccttgacagttttgaaaaatgagactattgtaataatcattaaataacgatgataaataaattaaagcgacgacgaagacagtatgcctgcttagttggttcagcgaggtccatttggtgtgagggatcccaactaacagtcagaacatcccttctgagcggtgctgtgaagtaaaacagcaatgggcgcaaccattatcttgctaacctgtcggcttttggcccgcaggtgataaggtctatttagtgataaataggtaaattagggtggtaacacgtttttagcgtcccgtaattagatttctagagtctaattgcggggcgctttttttcatcgttataggaaatggggaaatggtatgaagtttcgattaaaattatttacagtagcagcaacagctctgacactgggcggtagtttaactggttttgctggtgcgactaaggcggcaacgttggcggcagatagcaagcagcatgtcaatgtcatggaatcatctgatctagtcacgttggacccttcgaaggcgcaagatctgaccagctttgatgccttgactaacagtatggaaggtttataccgggttggtaaggatcagaaagtggtaccgggcttggcaaccagcgtggtgacaccaactaatgatggtaaaacgtacacctttacgttgcgcaaagatgctaaatggagtgacggcaccccagtcaccgctaaagattttgtttattcttggcggcggacggtcaacccgaagaccaaagcagggtactcctacatttttgataacgtggtcaatgcacaagagatcatggacggtaaaaagtcacccgacacattaggggttaaagcagataatgactatcaacttacggttaatttaacacgggctacaccatactttaagtatttgttagccttcgggacctatttcccagaaaatgaaaaagcagtcaagaagtacggtagcagttacgggacaacagctgccaaagccgtttataatgggccattccagttgaaaggttggaacggtactaataacaaatggacgctggctaagtcgaaagattattgggacgctagcaatgtacatttgaataaattaacggtacaagtagttaaagaaccaagtactgccttgaatttattccagaatcataacttggatgatgccattctttctggtgaaatggctaagcaagaagctaaaaaaccaacctatgtcgccaataaacaagcacagatcggttacttagactttaactttaagcataaggtcacggcgaatgcgaatgtgcgtaaagcaatttctctggtcatgaatcgtaaacaattgactaaaaatgtcttaagtgatggttcagtggcagcagaaggcttcgtaccagctaagtttgccactaatccacaaactaacgccgactttacaaaagatacgtacactaaagctgccgttaccactgataaaacgcaagctaagcaattatggaaacaaggtctgaagcagttaggtaaaaagcacgttaaattgacgttattaactagtgacgttgattcaatgaagaaagtcggcgcttatgtccaaagcgcgatcgaacaggaattgccaggtgctaaagttactgtcagcagcttgccatacaaaacttatcagacacgaatggaagatggcagtaatgatatcgttttggcacggtggattggtgattatccggacccagcaaccttcatgcaattgaagacaccaggaacggcttataactacggtcaatataataacaagacctatgctgacgcggtcaataaagccaatacaaccgacgctaacgatccacaagcacggtataacgattttgttacggccgagaaacaattgatgaacgatcaagccgttttcccattattccaagcttcggatacacatttacgtaaccagaatttcaaaggtgtagtttaccaccaaactggtgcgccatatgactataagtgggcctatgtcgctaaataatcagccggttttaatcggtatttaattttaagtaaaaacttgccggatttacaatgtaagtgcaacaccaaaataactagaccaaaaaggccatgaagccttaaacttataagtgacaaaaccaataagttaggacggacttcatgacccaatctaaagataccatca

SEQ ID NO: 518 - DNA, 5551 bp, Unknown
  Metagenome-assembled genome
tgtggttcagattgatccattttgatttgtacaatatcgggttttgccaataaaaatcacctcaccaattatttgatgaggtaatcataacttggatttagttagtttgatagtcggtcagttatttactacttacggaaattcacgctgaaaagcggcgatctgttcatattcactactcaacttttccgttacactagaccaaatcggaatgattcgctgataaactgctacatcagctagcacaggaataatctgcttagcagtccccatcatcgtggcaacatcgtgtagctcatcaatgtagccaaggctcttcatacctagcaccactgcacctaaggctgagctttcaatacttgtggggatactgaccgtctgtgcaaatacatcagccaaaatttggcaccacaatcgactgtgtgcaaagccgccactagcttgaatcgttagtggaccgtcagtcaaagtcttcaacaactgtaaaacggcgttcaaattataaaccacaccttctagcgttgcccggaccaaatgagcacgcgtatggctttgcgtcaggccaaaataactgccgcgcgcgtcagcgttccacaatggcgcgcgttcgccacctaaataaggttggcacagcaagccgccggcaccagccggtaccgtggccgccaactgggttaatttttcatataaatcattactctgttctgccgctattgctttttccggcgcaaataattggtcacgtacccactgaaaaacgatcccgccattattcacggggccgccgatcacccaatgcgttttatctaaataataattgaacagacgcccggcagcatcaactttaggggttgctgcaaccatgcgcaccgcccctgacgtaccaatcgtaaccgctactgcacctggacgaattgcgttgagccccaaattactaagcgtgccatcgctggcaccaataataactggggtatcggcggttaagccaattgtggcggcaatttcctgatccatcccccgtaattggtaatcagtatcgactaattctggcaattgcgcccgtgtgattcctgccaaatccagtgcagcttcgtcccaatctagggtattaatattaaataagcctgtcgcattggcgatcgagtaatcttcaacatagcggccaaacaaacgccatagaacatactcttttacaccgatcacttgtttcgtttgtcgcaataactccggctgattctgcttaaaccacattaatttagtcagcggtgacattggatgaatcggcaccccagtccgtgcaaataattgctggctattggctgagtcttttagtgctttagccgtcgctactgcgcgattatccgcccacgtaattgcccgcgttaatggctgatcatgctgatccattagaatcacactgtgcatcgcactggaaaaagcgattcctttgatttcggtttgccgaacagctttatcgtgaaccactgccgccaagccagcaatcaccgccgcaaatattgtcgctggatcctcttctgcacgatcaggcagctcgtggtaaagcgagtatagttggcgactcaccgtctgtagttttccatgtaaatcaaacaggacaacctttgtgctggtagtcccaatatcaacgccgatcatataatccattattactccccttattcataccaaatcgatcacttaacttaaaattaactactattggctgcggtttcattatattgaattgaattttctaattcaatcaaatatttatcaaaaaatattaagcgcgcttaatatcgcgcttaactactgccatatcaataattgactacaaattactttttagagtaacgactcgatcgttgctaaaacgccggcatggtcattatccgctaccgtaacctgtggcgcttgctgccgaaacgtcgccgccgcatttttcattgcaaaaccatacggcgtcatttgcagcattgccaaatcattttcattatcgccaaaagtcatgatctcatcggcggcgatgttgtagcgcgtttgtaattcacggatccccgtcaccttatcaacgcccgcattaccgatcaattctgtgttgaaccctgaattttggctcattaatgtagttggcaaagttgctcgtagatgttttactgccgctggaaaatcgacttgcggcgcaaaagtgaccccaattttagtcagtggatcgtggacttgcgccgtcgaaagattgaagaaatcatcgactggctctaaagcatgataataacgctgaatcgtttttaacgttgccgccggtacttgccgctcaatgtaagttttacgcacaccggagatagtccgctgaacaatcatgttagtcggaaaatcttgttgtatcagttgtagtgtctgttgtagatcatcgtcgttcaaaaccgagacctgcagtaactcatggccatgatggacaagtgcgccattttgcgaaataaaatccagctcatccttaaccgccgcgaattggttttgcaagcgttggtactgcgacccactagcgacaacaaagcgaattcgcgccttttgtaaccgagcatatagcgccatgaagcgcgcttgatcgtacgtactttgttcatttaaaaaagtgccgtccatatcgacgacgatcattttgatagtcatttaatccgtcctcactgatcagaattatcttattcgcgcaaaatctgccgcacatcctgctgtagtgccgggataacatcttctgcaaaccaagtatttttatgcatccagccatagtttaatggtgacggatgaaccaaaggaaaataagctggcagatagtccgcgtagtggcgcactgtttcagtcaaagttttttgccgtattttctgtaaataatatttctgtgcatattgcccgatcaaaagcgtcaattttacattcggcatcaattctaataagggttcatgccacttttctgcgaaacctttgcgtggtggtaaatcgccgtgtgcgcctttgccaggatagtaaaaatctagcggcataacgccaaccttcccagaatcatagaattctactttagtgacacccatccaattgcgcagccgatccccactcggatcattccaaaaaaccatcgacttttgcgctttgcggcttggcgcttgactaatgatcaaaatttccgcggtcggaatcacgtggtacagaggttggatcccctgtgccgtaaattcttgattttgcggatcagcctgaatcgcattaaaaatctgtgttgcggtctgcataatctaccttctaacttagaattttcgtcgtgtcggaataaaattacgaataaactgaaatcgtttgtgctcatgttcaatgtataaataaccaaaaatactgaaaaatagtgcgcctataaaattcacaaacagatctttcatcgtatcgaccacgcctacatccaagtagccattattgatcacagtagttatttttttgccgtcagcggttttactatcgatcacagtacgttggatatcttgcaattggacgaccgtattgtcccttgaaccaagatcaacactgttgacacgacgcacgatacgatctttttgcatgtccatattcagccaacgatccgccgaaaattcaacaaactcccaagcgaccccaacggtcattgaaaagcaaaacgtggtcaccgcgataaatagtggcgttaatttcaggatcgtggtattttcgttcaacaaataaatcaatgaaaaaccgaccccggcagccaagaagccattcaaggtgtgtagtgcggtgtcccagatcggaatataaccgtaaaaatcgcttaattcgcctaatatggttgagctaaaaataaagctgatcacgatcagttctagcaggctaggtatattgatatgcaaataagtttcaattatatacggtaacgtaaataaaatcagtgtcagcactaacaaagcaacgtgcgaccactgttgtctatataaactactacctaacataacaatgacgatcaaacgataaagtgcgtaaagcaacgtgacgattttacttacttgcggtggtggtatgtgcagtgaaaaatttcataaagcacctccagtatttcgcagtattcgcattgatttctagtttaagcttatgatattagcggtgccagttcaagtcgtgcgcaaaataaaaaagatcagctcaaaacgcgagatgatctcgttaaactcagccatattagtcctcccttttaaggatataaataaactgcgtgcaaatacaagctagtaactctagcatcgttgtgtttaggctgttactgccggtaaaacaaaatcaatatgcggaatattatcctccaagtaaacggccgaaacggctttgaaatcaaatgactgatagaattcacgcaaataactttgcccggcaattttaatcgcttggtcgggaaagtgccgctggatctcagcaattgtcgcggccacaatgcgccgacctaaatgtaactttctaaatgctttgaccactaaaacacgaccaaaactgatatggatattatcatcgtgttgaataattcgcgtataggccactaggtcatctgctgatttcaacatcacgtggcgcgcagtataatctttatcgtcaacttcctgatagggacaattctgttcaactacaaataccgctgtacgtacctttagaatatccaaaagttccacattcgatagctccgcggttgttttaactactaatttaaattcagccattatttgcctccaaaatttataagtatttactcgcttcacgcaccgccaaattgctcaactggtgcgtattcaaaaattgcatcacccaatcaggtgaaaacttactatattgtcggatcgcccagccgatcgccttttgaatgaaaaattcatcggtatattgatcgaataaaattgcttgtgtcagcatagtggtgtcgacggcgtctttttcttttagctgcaaagtgagcgcgatccgtcgctcccataagttaggactttggtaaaaaagctgaaatatagcagctttttgctcaggatggcgctgaatatatttgccaaaaaccgtgccccaatgatcaacgctatcccaccagcttttctgagtcacaaattgcttaaaaattacaatatcggcaaattgccatctgctgacattatattcagccagatcaagcgccaaatactgatattcgcgttgctcaagagcatacaagcgcttgatccaagtgtggatcgttgctaaatcagcttggcgactggcttgtaaaagtggcttactttgcgcacgacgatctggtgatttgacaccgagaaacacaaaacgatccttcatatagtgcgccatcgctggggcattttccggatttccagtgaacgtaaaatctagtttttccataattataaacattcctttcgcgtaccgctcaaggcacaaaacgcaatgaaaaagcgtttgcctgcagcggtatttctttgtatatttaacttgtgatcgtaccttgtacactacaaatcacgtg

SEQ ID NO: 519 - DNA, 9753 bp, Unknown
  Metagenome-assembled genome
gtggttttactaaagcctaaataatcggcaatatattgaagtgagtgcttttcatgatgaagtgtttcgatgacaacgcggtcttcaaatgataaaatagtggtgcccataaaggtccttctttctagtggaatgttgtggtgacaccattaaagacctttacgggtttttctgtccactaatatgttcaacttaaattttacaatctaccattggtaaaaacttcttcatcggtcagctcactggcatcgatattatcagcggctggctcgtccagttgatcggcattcccttaggcatcgcgatcggcttctggacgcaaaaaagggtcatcaaacaccgtaaaacagcgctgctattgaccgcattgatcgctattattgccattcaatcgggctcaatgttcggtcaaaccagttggctcaattatgtatttcccccgatttatccagttttcttaatgctgggcaaaagtaaccaatttcatttagcttccgttttactggcgtttattattgtctacggctatgcgctactattattgttactgaatttctattacctcaaccgctgcaaattcgatcgttaaaaggagtgtccactatgttaactggtgttaatcagcccctcgccaaacaagttgccctgctggagcacattttgcggttaaaccccgcgctatatgaactgatcacagcggtcgcccaactgaaggagttgtgacataagtcgtttatgcccaacgccttctttgcacttccgagcaatatagttaaaacgtgtgacataaggcaactttttccgcttagctacgatcgtcaaataatccactgcgtgaattattcgccgctctaggctaatgctcaaaagctgagcgccttatgtcacactctcggtagcatcacccaatcggtttggaacgcgctttttcaccaaacaccgggttacggtatcagcgacgtcgatattgtgtattacgaccccgacttaagtgttgcaaaagaagctgccacgcaagaaaaaattgcgcagcagctcgcaggaaatcaatacacgattgacgtcaaaaatgaggcgcgggttcatttatggtacgcacaacgctttggcaaaacgatcacaccctatcaatcaaccgaagatgccatcagcacctggccgacgaccgcaaccgcgttaggcgtctatattgacgaaaacgcacggttacaggcctttgccccttatggtctgaatgatttattcatgggcatcgtgcgccccaataaaaagttgatcacagcagccgtttatcaagctaaagcacacaagtggcaacaaaaatggcctgatttgaccgttgtggattggtgatcatcccctcacttcacgaatgatccgcgccaccacttcactttggctcaattccgccggcagcaactgttcctgcggaatattcaagtagtcgtgctctaaccaccacttttgcatgacttcggcaccaaattcctgagcctgagcacgctgacggtgtcggcgcaatgtttcggcaaaagtcagatcaaagtaataagcgtagacttgctcatcaaaataagtgatcaaatcgcggagcatcggctgatactttgccagccctaaaataccttctaaaataacgtagtcacacttgcccttaccgtatttacaaatagttgctagcaaatcgattgccggattagccggtcgatctttcacattgagcatgcctaagcgcacttcgtcttgtgatacccgtaacgcctgaccagccggaaaagcgtgctgcaatttgattaccgtcgtcgttttgccgctaccagaattaccgcggagaatgatcaatttagtcataatggcaccccctgatgttaatcatcccaccttaaccaaaactttacccatttttcggtcagtcttcacaccttcaccaccaaaaagttgtacactatacaaacaaactgaacccattggagctgtaagttatggcaaatcattattcagatgcacctatgagtcgtgaagaattgcggcaccgcaaacaagcacaattagccgacgagcaagcggaagccaaattaaataaagtgcataaaaagaaaaagcgccgccgtcaccataaattctggtttggcttgatcattttgatcctgctcattggcgcctttttcatgtggcacggttcacgctccgcgctgactggctcgtgggtcgaggtcagtactgcccgcggcaacgcgtacaccaatagcagcgatatcgccgatctcagtaccttgaccatcaaaaatgataagtacacctatacatcgaaaaatgagcaaagcagcgcaactacaggtagctttgctgatgatagtaatagcggtcaggcgacgtttgacaacgataccgccgattacacactaaccgcagatgacgatcaggtcacctttaccgctaatagtggcacgatcaccggtctcggcagcaacacgaaagtgacttttgtgcgctataactcaactgagtataagcagatcaaatcacagatcagcgcccaaagcgaaagtcgcgctgccgcggccagcagttccagcgtggcggcagcggcgtctagctcggctgccgaatctagctcaaacaagctcagtagcaccattgccggcattaaagataaaattaccaacaattcatcctccgcaaccagtgactccagtagtgacggtagcacggatagttacagttcaaccgactcagccagtagcagtaccccggattccgccaccactgacagcagcactaatattatcgatcagctgcaagagcaagtgcaaagctggctcaacgatctcggcatccaatcaaattaaagtcactaaaaaacgacgagcaattgcccgtcgtttttatttcgcaacgctagccttttcttgggccacgtaagcttgttctaattcaatgatctcggcagcttgtggcgaattataaatacgcaatttataatcaatttcctgcaaactagccactaattgcttctgctgcgccaacactttttgccgttgcgccgtcagtaattcactgcgttgcgcgactgtatctgcaccggccatcacataatcaatgtattgacggatgtcgtcaattttcatccccgtatccttcaaacaacaaatcgtatgcaataaattgagatccgaatcggtaaaaacgcgataacctttttcatcacgcaaaacaaacggcaataaaccagctttatcataataacgcagcgtatagatcgacaaaccaaccttagctgcaacttctttgatcgtataagtcattattttctcccctttcataattaaggtcgtctattaaccaagtaggctaataaacatgacgttccgagtcgcatcattcaactacggtaaaaatcgctgcgttgaaatagtgttcttttgcttgccctatagtatactctagggactattataaacaaaaagaagccataaacaaggatcatgctacttaacggcatggcatacatgactgattaaattaaccctcattagggaataggagcataacatcatgacaaaaaacgtatcagttaccggcggcaacggttatctgggtctgcacattatcttacaacttttaaatcaaggttatcacgtccgtgccaccttacgccaactcgacaaacaaaccaccgtccgcaccgccctaaaagaaaatcaggcgcaacaccgcgaaaatttaagttttgtcgccgctgatctcactcaagatgctggctgggcgacagccatgcagaacatcgactacgtgctaagtgtagcatcacccgttttttccaatgacccgaacagcgacacaactgccaccgagggtattttacgcattttaaaggccgcccaacaggcccacgtcaagcgtgttgtcatgaccgccaactttggcgccatcggcttcagtaatcacgaccaaacgagcatcaccactgaagccgattggactgatcctaacgaaaaaggcttatcggcctatgaaaaatccaaactgatcgccgaacaggctgcctggcagtttattgaacaaagtcacggcagtttagaactgactacgatcaatccggtggcgatcatgggcccagcattagacgcccacgtttctggcagcttcgatctattgaaaaatttacttaacggtcgtcccaaaatgattcccaatatcccactcaatctgatcgatgtgcgcgatgttgctgacttacacattcgtgcgctgaccgcacctcacgctggcgggcaacgttttctggctagtgctgctggtcagatatcactaccagagatagcagcactgattcgccaaaaacgaccgcaaattgcccaaaacattcccactaaaacgatgccgaactggcttttaagcagcgctgctttgttcaaccagaccgcccgcgaaggcaatttattagtgcacgtcaatcgtctgttgagtacccaaaaagcgcaagatatcctaaaatggcagccacagtttgataatacgaccatcgtattagatagcattgacacgttaattcaatatggactactgccttaaattataaatttatttttatcacccccttgacaaacacttaaaatcgcgttaaattatagccacatgataaatcaatgagtaaattaaacgctgtgataagaaaagtataattgtattcaccagttaagcgagcgtcgtttggtgcaaggacgtcaaggtgcgacaattagaaaatcatctttgagcgatggatgcgaagtttgagcgttcattgggggctcccattatcgagctagggtatttcgtaccaattggtgcttgtacccgaagaggctgttttcgtgagaaaatggcaaatcaaggtggtaacgcgtttattaacgtccttatctgaaattaatttttcaggtttgggcgttttttgtttatcgtgattattcccgcgcaggatgatcgccgccattactaaagtcgacttagcaatggcaacactcatgatttaaacgtggggcaacagacgcttagtctttgaaccacatttccacaacctacaaaatttaaggagtgctgcttatgttagaggaacgtaaactcactaaacgcgattatttcgtggttagttcaatgctttttggtctattctttggtgctggtaacttgatttttccattacatttaggccagctagcgggacagaattgggtgcctgccgcgcttggcttcttagtcactggtgtgttattgccattattatccgttttagcaatcagtatcactcgttccgaaggtgtctatgatgttgggcggcctttaggtcccgtattcgcgctcttattcatgatcttgatccacggcaccatcggcccactttttggtacaccacggacagccaccgtttcctacacggttggcttagcgccactagtaccaaagaatttccaaacagttggtttattagttttctccgctgttttcttcggcttagccctagttttctcattagaggaaaataaaatcgtcaacaatatcggtaagttattaaatccagttttcttagtcttattagctggcgttttcttcttagcttttagttcaccaatgggccacgccggtgttcaacacgccaccgctgcttatacatcaggctctttcgtcaatggtttcttgcaaggttataacacgatggacgccttagctggcttagccttcggggtcaccgtagttaccgccgttcgcaccttaggcaaaaaacgcgctaacagtgtcgcgctggtcactgcccgtgccggcgtcttcgcaatggcaatgatcgccgtcatctacgttggtttgatcttcgttggcgcgatgtccttaggtaaattcaaagtttccgctaatggcggcatcgcttttgaccaaattgtcaatcattatatgggcgtcgctggtcaggccatcttagccactttgatcaccgtcacttgcttaaccacggcgatcggtttagttgcggcttttgcccaagactttcataaacattttcccaaagttagctaccgcacttggttagttctaactactctggcatcattcttgaccgctaatatcggtttaaatcaaatcatcgcttggtcaacgccaatgttgatgttcttatacccactatcaatggtcttgattttattgtcagtcgcttcaccactgttccacaaagacccagtcgtgtataaattcgttgttctctttaccgttgttcctgcttttttcgacatggtaactgcttttccagcggtcgtcagccaaagtagcttcggtaaagcgatgactggcttcgagcaggcatacttgccattcgccaactacggcttagcttggttagtccctgccttagtcggtgccgttttaggggttgccgtccacgtcttcaaacgtgttagcgcccgcaacaccgtttcacaaactaaataggtaagtcaaaaaaacgttcacttgcggtgaacgttttttattgcctttaaatttattttcacatcacattgcccttcccgtaacctagtagtaggagttgaaggtcaatgaaaaaatgggtactcagcagtctacttgcattactaatttttaattttgggcaaactgttcgcgcacaaactacgctggctggacaaagttttcaatcaccaactaatcgtaccaactatctacacctgactttaatcgatcaaacaaattatcgtgcagctaccggcttggctgcaggctttggtgtggtaatcaattttgaacaaggtacttaccatgtgcagcacaatcggcttgttttaaaacctagtcagatcgatccacaagtaagttattcagacgtcaataatggcgattgggaacatccagcaaactataacaacatcgtcgaaacgcatcccgacgccattaatcaccgctaccgtttacgcgtcaaacacgaccatctatgcgctacctttaaaaaaagtgctacgcaaatcagtcataccaaagcgctaactttacgaccaacaaccatgacgacatcgacttatgccgcatttatgcagaatctaccacaaactaaaaactttcggcaagcagactaaaaactatccttattcccataagccataaacgccccaccagcgggaccagcacgtttgccgatctcagctaagtccctgatcaaacgctcttgctccttggtcaaacctaaataccccacggtccccgtcgaatagatcaaattaaccaagcgactgtaaagcggctcaatgtttgccgtctgatccgttttattgtagaccttcaacaaggctgctcggatatccgcgatttccggtgctttattactgcctaaactattgtacaactcatgaatcgtttgctttgcttgtgctttatctggtttcattccctagttccccctcgtatttatttcaaccaaatgcttgccgtcatagcaccgcgataagctgctgccgctgacccaaccgcggacgatagccgcattaaagctggtgctgccttgaattggtgagccaacaaatacgcattgatgcccttatctattgtgcacatcatcaattgacacttttaagcctcaataaccccatttaatttcaactaatgccatcagagatttcaaccgcgcctcattatcagcatcgacgacaatcttattttcccgcatcactttagcaacagcaacgttcattcgactcaaaatgtacggaatcgactgactttgcgcagctatttcctgatggaattgaaataataactgctttaacggtaactcattatcgttatttaaatggttgatcagctcagttaaaagttcaaccgcttgctttcctcgctctgtgccaccagcgtaccatttcattgtgcgctaccccccattaagctcactcattatatttatcgtatcatacctatttaatagcgttaatactttgtcgctggacaactgaccataattgtccactaaatacgcaaaacaaaaagccgccacaagtgtgacgactctgtacgacaataaatcaggcaaataaatcgacggcttgcccttgctcagtcaaaccagcgttagtcgcaaatttgcccagttgttgctgcaacgcgatccgcgcctgtaactcattgaaaacctcactatacatcgcgcccgccatttgccgtgcaatcgtattatgcgttgcctgcggcgcaaacggtgcgtcctccgccaaccattcattatgggtgattacagtgcggaacgcatcgaccacgtcaaatgatgacactggctccacctgataaaatggcgcggtttccgtgaagtccaccgctaaatggccaatgatctcggccttgaccgtcggcagctcttgctttaattgcttcaaataatagaacagcttatccgtggcatcaaagccagctttgccaactggctgcatgatgaccacataattggtgctagccaaacaattatccatcaccgcagcgaatttggcatcactatcaatgaaaatataatcataacggtcgcgtaaaatattcattaatggcggcactaaccctaaggttcgtgccgttttagttgtgcccgccgcttccatagcggtattaaaataatcttccagcgttgggacgccagcaataaaatccaatcccgcgcgcaacggggtcactactttagccaaatctttgactgccaagccagtcaatacattactagttggttcaatattaaaaatctgtttaaaattttgtgttgcttttaaagttgttgtcgcatcgatcactaaaacacgctgtttaaacaactgatgagccgccaacgccgccataattgtggcagttgtttttccggttccgacttttgagccagcgaacatgaccacttgacccataaaatcacccacttcgtttgttttgtatccactttcattatagcttaaaaaagtggcgctgacagctgttatttcagcgcacctatttttgttccagtgctaaaagcgtttgtttcatgattaccccaccacgataaccgcctaactgaccgtctttacgcaaaacgcgatgacaaggcgcaacgatcaatagtgggtttttaccaaccgcactcgccaccgcgcgaatggctttgggatagccggcttgctgcgccaacgtcgaataatccaccgtttgcccgtacggcactttaagcagtgcttgccagaccgcttgctgcagtggcgttgcttgcggccaagctattgggatcgtaaattcgcgccgctgaccgttcaaatattgtgctaactcggtggccgctgcttctgtttgtgtcgttgccggtcgtaactcagccagtggataaaaactttgtagatcggctaatgtttgcgcccacgaaccgacaaaacacaacccctgcgccgtggcgcctaaataataagtgtgtcccgccaagttatgtcggcgataataaattgttggcatcatgccaccccctcttttaatttgaccatagtatagcagaaaaaagtcagcttaaacttcactatcttgcttttcaattcaaatcactcgaaattcaccccacttttgcgtatgctagagtgggatgagaaataatgcttattaatatcggtaacgtcaaaagttctatgaaaaccgtggttcagaaggtggtgtagatgcaactgtagaaatcgacttaaggattgagtggtctagttggttagttctgtacgcgcacagtattaatccggccaa

SEQ ID NO: 520 - DNA, 16419 bp, Unknown
  Metagenome-assembled genome
tgtggttcagattgatccattttgatttgtacaatatcgggttttgccaataaaaatcacctcaccaattatttgatgaggtaatcataacttggatttagttagtttgatagtcggtcagttatttggtgcttacattttatagacataaaaataagttatattctgagtgaaattctcaagaatataacttatttttttagtaatattttagtaatttaatatttcaattaatttacttttttcacatatttacggcgatacaatacaatgacaataccttgtaacacgatcactatcactgcagcgataatatcaaattgaatcacagacttttgccatggtaataacaaactctgatttcctttatcgtttttataagcagcgctattaacgaccgtgtagagaatattatgcgatgcattccgcatattcttaaccgtttgtgggttatcagtatgcgtaatgtttgcacccatttcaccattagttgatagcataagatcattaccattagcaatccctgtattaccaagcatataaccggcacccatgaagtaatctgtttcaactaatccacggtaaccccattcgccacgtaatacattttgcaataagttgctattagcaccggaccatttattgccaataaagttaaaggatgacatcgttgccgttgctccaccatcctttacagccatttcaaatggtttaaggtaatcttcacgaattgcttgctcactagaccaagtcatcaatttatttgtccgattagtttcttgatcattcaatgcaaaatgtttcatataagcataaacaccatgctttttagcaccagcaatttcattggcagccatataccctgaaagaatactatcttcagagtaatattcaaagttacggccggcaaaagcattacgatgtaaattcattgctggaccataccaaccagttacaccaatctcactaccttgcttaccaaccatagagccacgatctttggctaagtttttattccaagttgctgcaatcatggctgcagctggaaaagcagttgtattcatgtttttgaccataaaactagttaacccagaaggaccatcaaaatcataggtatgttgtgcgtcaaccgaattcaaactgacagtttgatagccaccatacgtaatcaaattattcatatctttgaccgatagctgatctaatagcttgttccactctggatcactgtaactcttgcctcgtagtgctgctaatttcacattattattagcattagtcgttggcattttagcattagatttcttgtattgaacgtttttaacgtttgtcgcaccttgttgcatattttgagacaattgttctttacctggggctgcagttgcctggctataatttgcaaagttattcttacgactcaaataatccacgttaccttcagcataaccaaactcattcttagcaacttttttatcgctactccgcttattatcgctattgtaggtaactgtttggggaacattataatcttttgagcctaatacatcatgtgcatcagatttaatctgaatttggtatctacccttatccagcacgtaagcaccaccattattctcattataagaagctaaatcttcacgatctaacgtaaatggaatggtttggctctcgcctggtttaagattttttgttttggcaaaatcaattagattagttgacgctttttcagtaccaccgttagtatacggagctgtatagtacgtttgaaccacatctttaccagcaaccttaccagtatttttgactgtaacgttaaaatgaatcttaccattcacagattgcttaatgtcacccatactttgactaaacttagtataacttaaaccatagccaaatggatattgtacagcctggtcataggcggcgttattattttgataataagtttcataaaatttataaccaacataaatattttctacataattaacatatttgtatgaggcgtttgtgtactggaaatcacctacgttattataagtcggcgttttatttaagtcacgggcgtaagtatcaacagtccgtccggatggattgacggtgcccttcagaattttacctagggctgaaaagcctttttgtccggggcctgacatccacaacgcgcctttaatgtttttatattgatttaagaagcctaactccattggattagatgcattaattaatacaatgacgtttttaaagtttgaattaactagagaaagcatatcacgttctgattttgataattgtagataattatcgccttttttgaagtcacctttattaccattataagtgacgcctttggcacccatatctttaggtaaatcagcaccttcaccgccagaacgtccaagtacaactaatgcagtatcagagaaattctttgctttattaactaacttattagaataatcgtttcgtgctggctctggaagtgtccaatcttgtttcatcatactaatgtctggccgtgttttacgatacttcgtgtaaaacttactcaaggaatcattagttttaaaaccagcatctttcaaactttgataaatatcaactgaatttgcacccacagcaccacctgaaccagtaccaccataaagtggattagttgaggcccagccaaaaacgttaatatttttagcattaattggtaagtagttattcgtatttttcaataagacagtgccttcatttgcaatattttcattcacgttattgctttgcgctaccgtactggcacttacctgatcaagcttagcaaaatttagattaaataaagctgacattggaacgaagacaacaatatttagtgtaagtactaaagcaagaaagaatgcgaccaatgattcccactttaaccaaaaattaaatttcttacttctattgcggaatacaatcaacgcaataataatgacaactaaaataatggctattggaataaaataagtgcctactttattaatagttgtcataatatcattcatcgtgacaacaccttgctttattaggttactaataaagatatatccaataccagctactgctaaaagtgcaatcacaatagcgctgagcgtaataatgagactacgatttttcttcatcaagcttgctcccccttttatttataacgcttacattttcaattatactaagtttagttatttagaatccttctcagcataacttgtcacttagtcttcataacttgtaaaatagcaatattctcctgctaaaattatctataccaatcaatacttaactttattagttaaacccgtacatccgctgtgcaatgtgataagcaccaacggcagtcttgcgacctattttccctggaagatgaaccccaataccaaaggccccatgacgtaattgtttgtatagtgtttcatcatactgtttaacgaaacgccagagatcctttttcaacgctaaataacgtggggtcccacccttgaccaataagattgaagaaaccgtggtaatgatctctacatatttttccatatactgactaaccggactgctgtcagtaatattttcagcataaaaaataatcaaccgcctattaattttcaattgttgatcaatccgcgacaacatcacatcttcatttacagattgatcggcacgaccgataaaataatgataaagttctacgttcaaatagtagatttttttaacaaaaggtagtggttcaaagacataaatattgtccacataaaaagtgtgccggggtaattccagctttgcttcatcgcgtaataaactggttcgataaataattgcatgcatcaataaatatttacctgcaggaaatctgacatcttgccaaccaaaaacttgaccctgcggtaaaattgttggataacgcatcacctttttatgccgtgcaccttgccggtcataaatataattactaacgatcatatccaaagcttcaccctgccgattggtttcccgcaaaaaatccaatacttgctgatacgcagtagcatctaaccaatcgtcactatcaacaatttttgtgtacagtcctgttgcggcatgtaaaccggcattgattgctgcgccgggaccaccgtttgcttgatggattgcacgaacaattcctggaaacttatgtgcataataatcaatgatttgtggtgtccgatcattggaaccatcatcaactagaagaatttctacttcttcaccaccaagtaacagtgaattaacacaacgttctacataatcttccgagttataacaagaaacaattaaacttaaacttttcacgtacttctcacctatttcataatgacaaatttcatcattggataattaatcacaacttggatcacaatgttaacaatattagcaaccgtcgccgcccaaccaccaattatcggtgtcagctgttgaatgatatatggtggtaaccataccgaaattattccagcgaccgcaacggttaatacataccagaacagaacttttttgatctgtacagtagcgccaaaaaccaccttgcgctgcacgataaaattgacgatctgggcacagatatacgcaactaaaaaactaagaaagccacctaaaccgccctgactagcattatagtgaaaaatccaccaattaaaggaactatctagacctttgaaaaaaatacctgtacctagccacaatacgataaaatttgtgatcgttgcaacattgctcataatattaaataaaataaattcatagagatcaggatatttatttttaaacttttttaaaacgccaacaacaccgtttgaatggtccatcaactcatctccttttgccaaactttattttgcttgcgatttttgaaatagttattaattaagcgcgttaaacctgaccagaaatgcccattgaccatacgtaagattgcgttgaccatatccaaactaacttggccgttagtcattttagcaatagctcgaaacggcatattataaataaaaagtaaatttaaatcaggtttaccttttgcttcacttttggctagcgcgtgttttaggtagcgataaacttgacgcgctaaccaatttttggcataccgcatttctgcaatcgtactgttaatggctaattgttgcccaatttcagtcttgactgcaggtaacgtttgcccatataaagctgaaaaatctgccaacgtcacttggcttaaatcggcctttcggtaatgcacaagattcaatgctggcgcaacattttgtcctgcttcaacaattgtgccccgcaaacgaatatcatctacactagcgccaattaatatgtcataagtaccggcttcgacttgccaactattcgatgtaacatcgaaatagcggaacgccttatcatcaaatctaatgttgatttgtttagcttcacctggtgctaaatgtactttagtaaagccctttagctcccgtcgtggtcgaataagttgagagtcacttttaccgatatataattggaccacttcgttaccttcacgttcaccagtattcttgaccatagccgttactcccgaagacgcaacatgcaagtcactataggcaaacgtcgtatagctgagaccaaaaccaaaaggaaaccgaactggcttttctgcagttgtatagtaacgataaccaacaaatgggccttctttgtagtaaacatcccgttgcgtggccggatattccttaccaaaaggcacatcgtcataggttaagggataggtttccgctaacttaccgctaggattttgtttaccaatcaaaacatcccacatagcactagcacctgcttcgccacctaaatagccatgaacgacagctgctactttatctagccatggcatttcaaccaccgaacctgccgataaaacaacaacaattggagtactagtttgtgcaagtgtgttgatcagttcaacctgattgtctggcaactttaaatctgtgcgatcaagtccttcactctcagaaatttcgtctaaaccagcacaaattacggcaacatcacttttgttagctaatgcaactgcggctgcacttaattcgtgatcaacaataccgttacgttggtagccttgttcgtaaccgataaaagtaatcggttgatcaacagccgttgcaaccatattttcaacttgttgtgcgttaactagcgaagaaccagcgccttgataacgcggctgtttggcaaaatctccgatcaaaactactttagtagtgtcagccaacggtaacgttgctgctttatttttaaggagaacaatactttcagcggctgctttgtgagcaacttgatgctggtgtgaccaatccacctgttgctgtgtattttttcctgcagttgattgcagaatctgtgtcaataattcatcaacacgttgattcaatgtttcttcggccaattcacctgatttgactgcctgaattatttctaatggaccattagcccctaaggttggcatcgctaagttgccaccattttgcactgctgcaacatgatcgttatcaccaccccaatcactgacaacaaagcccttaaatccccattctttacgtaaaatgtcctctaataagtacttattctcatgtgcataaataccgttgatttcattatatgcggacattaaaactcgtggtttgccctctttgactgcaatctcgaaattagttaaataaagctcacgcaaagttcgttcatcgatcaatgaattagaagccatgcgccgatattcttgattattagctgcgaaatgtttaggactagcaaaagtccccgttgattgaatacctctgatcatagccgcacccattttcccagctagatatggatcctcactataatactcaaaatcacgtccacagcgcggattacgcttgatattcaatcctgggcccagtacaacttgaacatctaatgctcgcgcttcgttacctaatgcagcaccaacttggccaatcaagttttcatcccaactattagctaaagttgccgcagttggaaagcaagttgctggttcactagcatttaagcctaaatgatcagttgctcccgtttgtttacgcaatccgtgtgggccatcagccataaaaattgccggaattttatcggcaactgcatatgtctgccacgttgactgcccagttgttaatgccgctttttctgcaagtgttaattgttcaattattttttgattattcaacatttacttgtcctccattggtatggcttattttaaagttaacaactatgtgaacgctttaaaagcctaattgcataaactgcaagatatcgttcataccttgtcagaaaccctctatttcgctccccgactttattcgttataattgagattgactaaagaggtgataaacttgcgcattgcaattgttgaggacaaccaacaagaacaaaatagcttactaactttattaaataaatacgcaatcgaaaataatattgccattgagccaacaatttttaataatggtttacaaattgtcgaccaataccacagtaattttgatgttatctattttgatgtccaaatgccgcttatggatggtatgacggctgcaaaaaaaatacgtcaaattgatgataatgtaattatcgtctttttaacgaattatgttcaatgggcagtcgaaggctactccgttcatgctttggattttttacttaagccactaacctattttaattttcaagagcattttaagaaaatacgccaccagctcgcaaagcatcaaaaaacgttaacccttaaaagcagtaacggtttgcgaaaaattatccttgataatctttattacgttgaaagtgagggccactatttacactttcatacaatcgatggcacgattgatatactagatacaatgaaaaatattgaacgtgaattaaaaccagatcatttctaccgttgcaacaacggctatttggttaatctcggtcacgttaaggcaattaatggtaatattgctgaagtaggaccagataaactacagattagccgaccacgaaaaaaagcctttatggccgcattaactgattatttaggatcggagatgatctaatttggcaacaattctgcctaacattccacgtttttataccggaattgcagagtggctggcgtgtatgcttcttatttttcgtttaaaaccaagtaaacgacgtatcaatcatctagctattattgctttaggtattggtcaaatctttctacaaataatagttggcttttggccactttggtattgggtattcggtatgttagtcaacttactatggatgtttcttactctatattggagtgaaaaagtcaatctatcagtaaagctataccatttaagtaaagcctttattttagccgaattctgggcctcactatcttggcaattatattgttatctgttgttgcagctaaaattgccacaatggaatgaactgatttttatgtttagttgctacgtgctgctattcatcacttttttcaaactagaaaaaaaaaccaaatatcaatacgctttgcttaatataaaaaaacgcgaagtcattagtgccatcgttactgccagcatggtctttatgatcagtaatttgggctttgcattgaccaatacatttcttaacttaggtgattcggttacgattttcatgatgcgaacgtttattgatctttgtggaatattattattgaaactacaagaaaatcaacgctacgaaagctttttaaagggtgatctgactgcaatcaacaacatgttccaatcacagtatgagcaatatcaagcttatagggaaagtagtcaattagttaaccaacggtttcacgatttaaagcatcaactagatgtcttagctttagaagatgatgctgacaaaagaaaaatttaccttagtcaattgcgcaaaggaatcacgcaatatagatcagcggttaaaaccggtaacgcaatagcagatgtcatcttaacccgtaaaaacacttactgcattcagaacaaaatcacatttacctgtattgctgatggtgcactgttgaatatgatcgaaactatggatttatgtagtttattgggtaacgcattagataatgccattgaatcgagcttaaaaattgctgacacagaaaaacgcttgatcaatttacgaatcgcccaaaaagcaaattttattcttttttctctagaaaactacgttgaagcaccaccatcatttgaaggcggcctacctaaaaccacaaaatctgatcaacaacagcatggctacggtttaaagagtatcgattatattgctaataagtacaacggttccctaactgttggtgtaaaagacaattggttttcaatcaaagtcctattgccattaacttaaaacatcccgcagaaagttactgctttccacgggatgttttattttcctattgcgccaagaatgtcaacagcgcttgattaaacgccgctgactgctcggccatcacaatatgcccactatcagcaatcactttagcttgcccaaatggtgctaacgccgctgctgtagaagcaaattttggatcaaaatacgggctttcgccgccggcaacaaataaaatgggacactgcagatcagcaatcacgtcacgccaattttgcatggcatggtcgactaaaaatggcaaattcaattccgcatcatagggataagcctgctgaatcggccgaatttgcttataggtttcatcatcaatatgcttaaaggttgaccgtcccatcggtagttgtaaataagtataaaaattatcccaagctaattgtttaaacccgtaaggccattcgaccgtattgatcatttgcggtgattgatcaacatcaatgattttagtgatattttgcgtgccataaagtgacacataggcaaaaatcgtggctgcgcccatcgaattacccaccaaaataacctgttctagctttaaggcagcaatcaattcagccaaatcctgggcatggcggctgattcgcaaccctttagcagtgtgttctgattgcccttgattacggcaatctaggttgaccacccgatacccagcggctaacagcgcactgatctgttgccgccaaatttctttgacgccgcctaacccggtcaaaaccactaccggctgcccggtaccttgatcagtataatctaaactcactcgatcttttgttataaatttcatcatgatcaccctttaaaattttaagtttatcttcatcataccgcagtctgagtgactaccgctattcaactttaattaaatgcggtatgatagtgttggttcgtaacgtttacatgtaaaatcgaacaacgaaaggagccaaattatttggcatttaaaaaatttcaaaatagcaacgagattcgccgtttgatcaatcgtcagaatttgatccaaaaacgagccgttgccatgatcaaccgcggtacggataaaggtaatctgtaccagaagttgaatcaacgggtcggcatcaaacgacaaatgtcgcaagcgaccattaatgtaatgatggatatcttccgtaacgagcacatcaccgccatccccgacaacagtttcgtcgtcttcgcacggaccactttgaacgtacacgacggcgaaccacaggaattactgttgcaactgaacaaactcgactcttatactttatttttagcgccgaaacagtccagtgaaaaaatcttcagtactccgaaacgtggttggttgatgactttgcgcgatgacggttggatcctgatgttaccgggacagaatcccaatcaaggcattcaattacttttacctgaaacaaatgaagcagaatcaacgccagcaccaaaaaaggcgaccagtaacgcaacatggcccaagtcagcgactagtgcacgtgcagctagatctgcgacaactagtgcgaccaagcataattcggccaaaccggcagctagcagccatgctagggtggctactagcagtcatgctaagtcaagtgcaagtagtcataacgcgcctactagtagccatgccagcgccaatagccatgtagccacaccaataagtcaaacaacagctattgacaacagcacagttgccaactcagctaatagtcaagctgattcgatcgccgttagtagcaccacgacttatagcacccccagtcacgtagccagtgcggcagcaacaaagccattacctggtccacgtgaagccgatgaattgatcaaaaacttagtagaatcaggccgtcgctatcgggtggtcggtttagactacggcaagatcaatatgatcaccgcaactgatggtgccgataatttattacaagtacccggttccgtgatctcaaaacatattctcgattaccaacacgagattcgccaattacaacggcaaacccagacgttagatgatgacgttgaattgacccgcttatcttacatgttaaaacgttatgttcttaaatcttgccgtaaaattgtcaatcaattgatcgagcattatggggatgacgttatttatgtgaccgagctccaccctagtttggacgttaataaaacacctaatattattttgagtcctgattatttctacaaagcattattcacgattttatttgaattagtcggccaaaatgccgccattattcaagttcctaataacgaaacgtcgatcatctgccctaactgcggctttaccagcgccggcaatcggcaaaaagaactacacacgtttaaatgcttaaattgtggctttgaaagtaacgatgatcaagcggcagcgacgaatattcgccaacgcggcttacgctacatctctaatcttactaaaaatatgaacttcgctgtgccgacacctgaagtgactcacgtatcagctcaagaagaagtataattttttcacaatagctagggcaatccctaattctaaaacaccaaaaagtgctgctttttggtgttttaatttacctaaatactgttgtaacaactttttagccttaattaactgactaagtgcaaggctcatttgtcaagagaaagccttttcttttttagattaaatgacctatactaagggcatagatagttaaagttattaaatgataatgattatcacttagttaaggaggcttttcttatgaaggtcagcatattcaccacttgtatgatggatctaatgttcccacaagttggtaaagatatggtcgaagtactggaacgcttgggctgtaccgttgatgttccggaaaatcagatctgttgtggtcaaccaacgttcaactctggctacgttgaagctagttggtcggttatgcataatcaaatcgatgctttgtcagcaatcgattgtgattacattgtctgccccgctggctcctgtactgctattttaaaagaatatcctgatttattagccgatgacaccactgatccaaccggcgaatacatggcacaagctaaaatattggccgcaaaaacttttgagttttctcaatttatttggcgtgtcttaggcattgccgattgcggtgccgagctgaatacgatcgccacttaccaccggtcctgccacatgacgcggttattaggtgagcgggaaacaccattctggttattggaaaatgttaagggcttagaaatgcggcagttacaaggtattcaatattgttgcggttttggtggtactttctcagttaaggaacacgagatctccgaattaatggtcacttctaaagtgaagcacatcgaggaaactggggcccaagttctgatttcctgcgatcctggctgcttaatgaatatcggcggtcgtttcaatcgtttaggcaagccaatgaaaatcatgcatattgctgaggtgctgaaccacaacgttgacgaaagtcggatcaaaaaagttagcgaagtcgctaccccagcgccggcgccattcccttaacttggaagtcaggaggttattatcatgggacttaaaacaagtactttaccatttaaagaacgtattgcagcgtcagcgaaggatcaatttgcccacgcttcgatcgccaaagcacaggatacacaatacaataagcgcgaaaatgcccgcgctgagcttggccattggcaggattggcgtaaactagggcaatcgatccgccaacacgtgatccagtacttaccggactatctggaagaatttagtgataatgttgagaagcgcggtggtaatgttttttttgcccaaaccactgaagaagccaatgactttattttaaacgtgatcaaggaacaaaatggccatcacgtggtcaaatcaaagtccatggtcaccgctgaactcgatttagacaaaaaactgcaagcattaccggacgtttcaattttagaaacagatttagctgaatttattttgcaggaagacgactgggatgaaccatcacacatcgtctttcccgctatccacaaagatcgtaatcaagtccaaacgatttttaagaaattaggttacgacggtgacaatgatccagagcacatggcacgctttgctcgtaaatatctgcgccaacgctttttggaagctgacgttggcatcactggctgcaactttgcaatcgctgattccggcattattaacctagataccaacgaaggcaacgccgacttagctgattcgatcccgaaaacacagatcgtggtgatgggaatggaacgtttggtacccagcatgaaagaagccgaaattttggataatatgttggctcgttcagcagttggccaaaaattgaccacttatgtgacttttgaaggccagcaaagtgttggtgaaagcgatggaccagaaaacttttatgttgtcgtgctcgataataatcgttcgaaagctttaggcaccgaatttcaagaaatcctgcaatgcatccgttgtggtgcttgccttaacgtttgcccagtttatcggcaaattggtggtcatggctatggttcgttataccctggcccagttggtgctgtcttatcgccaattttaggtggctatgaacaattcggtgagctgccttttgcctccagcttatgtgctgcttgtaccgaaacctgccccgtattgatcccactgcataatttattgatcaaacatcgtgaagtcgaaacggatcgtctgaaaatgatgcatggtttcaacgatttccaaatgcgcgtggtcggtaaaggcacggcctcaccgtttctatttaaggcggcgctacgcttcaagcattttggcttgtcgccatggacacaccaaaaaccagttaccgcgactaatttctttgcgtataacggcgcaatgatcactaaaggccccgggatggtcggcggttggaccgatgttcgtgatttaccagcaccaccaaagcatcgtgatgatttccgtgtttggttcaaacaacataagcagcaaggaggtgcgcccaaatgacgattcaaaatcgcgataaattcttagaccatttggctgaacgcttaggtcaaccccgccaccaattagcggatcacccttatcagcaactcaacgatctgccgcaacaaacgcttagtgataaaactcctgctgagctgctggctttagcgcgaaaaactagcgaagcattaccggttactttctatgaagtagcggcagtggaattaccccaactactaaccgattatgtggctagtaaaggcggtggaccactattgctaccaactagtaaacattttgctgactataatttaaccgactggcaagctagtattgctgcaactgaaacagtcaattactggcagcctcaagcagatcgagcaactaatttaaaagctgcggaaatggcaaatattagttttagctttgctgattttctattggctgaatcaggaacgatcacggtcagtactaatcctggtcaagggcgtgccctgcatttcttgccgacccattacctcagtatcgtcccccgttcacgtatcgttgcgcgctcgactcaagctgttgcctggtatgaacaagaacgccaagcaggccgcctagatagttcagcgattcattttatcactggcccctcaaactctggtgatattgaaatgcaattagtcactggcgttcacggtccactagacgtaacctatgttgtcgttgatgattaatgaatagttctggtagctattttatgctgctggaactgtttttttcgatttaaatttaacaattcgccctaaatcaggtaaacttactttatattcagtagaaaatgaggttattcaatggcaactcaaacattaagccaattagcagattacttagaagcacataacgacaaaatcaaaatcggcgaagaaaaatttgatccccaaactatttatgcagcgcttgatcaattagctatcttggctaaaccagtacaagattactttacgatcagtgaagatgattattatgaacaagaatctgatcatctcttaactctgcaagatggcaaaaagccattaggcgagctgcaagatcgaatcatcgtgacccatactgatggtgagcttagtgccggcgacttgcgttacacttacgcccatgaagacgcctgcaccggttatgacgtgcaaaccgatttgcatattttaacttatggcttggaagtcatcggggcaactgatcgtttagatcatgcacaagtccaaaagacattagctaaggatgcagtcctcagtttagctttggcagctaaggcagtcaatgattggcaagcaactaaataagttctgttttatctaaataaagcgtacccagaaaaatcaaatcttgtttttctgggtacgctttttctagttaaaataattttcagaaagcgttcttcattttaatttattttcagaaaaccattgacatcgtccgcaaatgctcgtagggcatataggttgtccttttttcttggtttagtaacttggcgaatagccatagctagttaggagtaaattattaaaatgtttttctggatcatcagcattatcttattgctattgtttgtaactttgatcacgcgtaccgcactcaaacacccagcattcctatcaataagggctttctgcactcgtaaacacttggtcacaacactttttgtcttaatcgcattgttaatgccgctattattgcataattcaaatgtcgccgctcaaaatgatagcttccagacgcagcgaatcagtgacaaaaagataacacccaagaaaataggcaataaaaacgaactaacattagtggtgaatcatgattcgacggaatcgtggttcaccactttgcttttttctggtaaagtggtgtcgaagttgacatgtcgttgtggtctttggcgctttgacgtcgtaataaaaact

SEQ ID NO: 521 - DNA, 15177 bp, Unknown
  Metagenome-assembled genome
gtggttttactaaagcctaaataatcggcaatatattgaagtgagtgcttttcatgatgaagtgtttcgatgacaacgcggtcttcaaatgataaaatagtggtgcccataaaggtccttctttctagtggaatgttgtggtgacaccattaaagacctttacgggtttttctgtccactaatctgttcaacttaaattttacaatctaccatattataaaatcactccgtagctttcatttagttgattatcataatgttattttgtgttgggtaataaaaaaagattgcagccgtagccacaatctcatttctagatcaaaatcccgttacaatgatcgacttcatgctgaatgatctgcgccacccagccagaaaattcctgcgtgtgcgagcgaaaattttggtcggcgtattgcacagtaatatttttataacgttgtgtgcgacgttgaccactcagcgatagacagccttcttcagtggtgaaggcgcccgattttttggtgatcactggattaactagtgggaccgccagcggacctatttggcaaacgatgatccgcttgttgacgccgatcatgttggcggccatgccgacgcaacggtcagcgttggcattgagtgtgtccaacaaatcggtgattactgccgcgtcggccttagtggctggtgcggctttttgcgcgagaaaggtggggtcgtgcatgattggtttgttcattgtaagctgctcctaaacttattttgtttccattataccagttgtgtccacgaaaaaatggtggtatgctactatattgttagctgactaacgaaaaggagtgaccgaatcatgtcagaaaatattggccgattattgaaacaagcgtccaatcagcttagtcgccgctttgatgagttcgcacaacaatacgatttaactggtgtacaaatgtcgatcatcgattatcttgggcggcatcgtgctgagccagttttgcagcgtgatattgaattagaatttgccatccaacgttcaacaacgacgctgatcttgcagcgaatggaaaaaaagcaattgcttacgcgacaagttgcccccaatgatgcccgacaaaagacgatcaggctgacggataaagcgttgcagctggagtcggtggttcgtggctatattgaccagcaagagcaacaattgtgcactgatttcagtgccaccgagctgcgcatatttacgaaaatgctgcattattacttgtagcgctaggttagtatcttggtcacaaagtaaggagattttatttaatggcgcaacaaacacaacgaatttcgccgcgagtattaggtgcggttttggcaacggggttaatgtcgttttgcggggtgatcgttgaaacggcgatgaatatcactttcccgacattgatgcgcgaatttcacgttaacacagctagtgtgcagtggatgacgacgatttatttattgacggtggcaatcatggtgccactgtcagctattttgaaaaaaagattccgcacgaaaacactatttttagtagcaaatcttttatttattattggtttagtgctggatacttttgcgggacaatttccgatcctgttgcttgggcgagtggtccaaggtttaggaacggggatcgccttgccattaatgtttaatattattttggaacaggtaccaatggctaaaattggctttatgatggggatcggtaccttgattaccgcgattgcgccagccatcggtcccacatttggtggaattgtagtgtcaacgttgggttggcgctatatcttcgttttcttgttgccaatcttggtattttcgctgattatcggttcaagatgtattgaacaaaaaaatacgctacaacgcgtttcatttgatggctttagtctggtgctgatcgtggcgacgtttggcggtttgatcattggcttcagtaatatgggcagccagccgttaaccagtttacttgtcggtggggcatttattgttggtttggtaggattaatcggcttagtgattcgttcgttacgactagcaacgcctgtgatcaatttaaaattattgcgtaatggtgattttgccggtcatacgttaggctttttcttaatgcagcttactgcgctggggttgtcgtttattttgccaaattacattcaattggttaatcaaaactcggcgacaatcgcaggcttggtggttttaccaggtgcgttgcttggggcgatttttgcgccctttagcggtcgtattttagatagtttaggtccgaaaaagccgctactgcttggctcaagcttggcgacattatcgttactattgtttagttggttaggtcgtggattatccgatagtttgatcattgccctttatttgttatttatggctggtgtcggcttggcgtatggcaacattatgaccaacgggttgaaattattgaccgtagaacaacaagccgacggtaacgcgattttcaccacgattcagcaatttgctggggcaatggggacggcgatcgtcgcggcaattattggccaaagccaaaatggtgcacttaaaaccacgatagccacggcaatcggttcacagcacgctttttatttcctactggtcttattagtgatcgaattagttgtgctgggcaaagtgattctttggccacggcagcttgacaagccagctaagtaacggcggagccaatggcgtaaactttacggctaaacaagtttggccagaagattagtgtacaatgtgaagcaatccagtgctgggttgcttttttgttgccgtttatttgtggtatattcaagttaatatcatttgaaaggagcagtcgtatggctattgaagattatttgatcactaaaggtaagaattttccggcgctatggaaaacaggaaaggtttccgcagatgcacaaattgctaatctttttcaaaatccccaatccatttttaccgttagtcaccgcatgttaggtggaacgccgaaacatacacacgacttctacgaatttttgtacatttttcgtggacaagtattaaatgcaacggccacaaaaatgatctatatgtcggccggtgatttttgtattatgaatttggcgagtcgacactcactacaagaaatcgatccggatgcgatcgtggtcaatatttgtgtgcggcccacttgttttactgccggcacgctgcattcactttataccgctgacaattttcttagccagtttttacgcggtgttggtgccgaagattatctttattttccacatacgttttctagcaatattcaattggtaatggccattttacaagcaacacagcacaatgatttcatcaatcaaactcgtgctactgctgatgtgatgttgctgattgctgatctgatcagtcgacacgcttatagttttcacgggattgatgaaaatacacgtaagattttacattacattcaagcccatgcggcaaccacgtcattgaacgatgtcgctaagcaatttaattataatccgacgtatttatcgcgtgcactcaagcaaaatattggtaagtcattaccgacgcttttaactgagactcggatgacacaggcacaaaccttgttgacgactactgatgaaagtgtgcaaaatattgcacagacagttggctatgccagttatagtcattttcatcggcgctttaaggctatttttaaacaaacgccaggtgaatatcggcaaaaacaacgcaatattcagcagaggaatctttgaccaactgcttttttgatacgactacatgatcgtctcaggtagtcttttttatttatattcattgctaattcagcgattttaagtcttaataccgctattaatccgaagcggataccattttaataggtaaataattcacatatagtaatcaatatcgggcattgtaagcgtttgccgtgagcgcaataatagagttggttgcagcccaacagaatgactcagattagatggttatttttaagcataattgtatgtgaaaggtggactcattttgaaagacttaaaaactagagttggcgtcctcagtatgtgtattttggcaatgagcgcattagtaatcaccaacgcatttagcgcgatcattgcggcttttcccaatgaatcggtggctaagattcaaatgctaggtacgattccctcgttaggcacgttgttgaccactattcttgttggtatattggccgtacatataccaaagaaaattttagcattgactggtgtcgttttagtaggtgtcggtggattattacctttattattccacacgaatctaaacttattacttgtctgtgccttgattttagggattggcttaggctttacagtgccggttacgacgatgttgatctcaattttgtttgatcaagatgaacgggcagacgtgatgggccaaaatacagcgatcaatagtctaggctcagttattatgatgcttggtggtggtttactgggtggtagatattggcaaaatacttactttattttcctgatcacaatcgtcattttcttattagttttattcttgatcccaatggataaggttgcacatatcaaatctgaccaaggtcaagtcgagaaaacaagtgcctggacgttattacgacatttaagtaaatacgcttttattgtgtcatttattggtttgttcatgtcaatgatttatacgatttatccaactaatttatcgatcattgtggcggctaagcaccttggtggtacaagcattaccggtatcgtcaacgctattggtaccattggcggttttgttgctggttttagcttgaaatatttcaataaattatttaaagataaaattttagttgctggttttatcactttaggcattacgttcttgctaattcggctagctaataatctaaccgttgtgatcattggtgcattattatctggttttgccatggcgatggtaatggcgacaatcccattctatgtttctgttgtgtcagcaccagttgaaatcgcgatttctatgtcactatgtcagtttctaaattcactcggtggcacctttacaccaattattttaagtgccttgcatattccagcagggaacgcggcgtttactgcgggtgttattgcaagcgctattatggcggctgtttgcttgctcttcaatattggtaaacgtgtcatgactaatggacaaggtcaacaaacaactgacacaacagtaccaaatggtgttgaacaaggatagtataaaatagaatacatgggtaagctataagcttgtgccgagtgacgatttagcttcagtgaccctgttttaataagaaaataccattattaagtgagatagaggagttttgatcatgcaaaaattagttagtcatgtcattcgtaatcgtgccgatcggtggtatggtaaatggatcaccgccgattttgcgacggtcaagccagaaccagaattctcgttggcgcaaatgttcagtggacaaatgccgccgcaaacgccagtggttgaccgattgcgaccaccggtagtgttctataaagaatttaatgtgcccactaaagcattgcaagcagcgactttaacgattactgcgcaaggaatttatcaggcgacgatcaatggtaaatctgtgactgatgccatttttacccctgattacacggcttactcgaaatttttgcagtatcagacgtatgcggtcggggacttgttacaggtcggtaagaatcgattacaaattgtggtcgctgatggttggtttgcgggtcgggtcagtgtttccggtggcagtggtcaatttggtgatcaactagcagcgttagccgatttagagattaattttactgatggcactgatctacatgttggtacggatgaaacatttagtgcaaccacaggaaagtggcgctacgcggatattgaaattggcgaaaaacaagatctagcgttaaatgcggagccaacagatggtaaacaaatggcaaccataggtgattttgattattcacgtttagcaccgcaagaaggtccacaagttaaacgtcaagaagtccttaatgcgcaaaaagtttggcatgaaggcaatagtttggtggttgattttggtcaggtgattgctgggcgtgtgcggttaaatgttactttagcggctggtcagacgatcactttggaacatgctgaagcattagatcaaactggtaagttctttcagaatattgtgggtcggaataaagatcaaactgatatttttgttggtaatggagcgccggccgtgcttgaacctgattttacatttcatggattccgttacgttaaaattactggtctaagcgaattagcgttggctgatgctcaagcggttgcgatttatagtgatttcaaagccactggctcggttacaactagtgatgcgtccgtcaatcagttattgcaaaatattaagtggagtcaacgcggtaatatgctgtcgattccaaccgattgtccacaacgagaacgtgtcggctggactggtgacatgcaagtgttcgcaccggcttcgactttctattatgataccaaccagtttattcaacggtggctaaaaagtgtccgcattgatcaacaaaccaatggtgaggtcgtggattattcgccagcacctaaggacttttttaattcaactgaatttacgggttccgtatcttcagctggttggggtgatgcaatcattatggtgccgtggacgttatatcagcgctttggtgaccagcaagttttaaccgataattttagcgctatgcagaaatggtttaattttgctaaggcaagtactgctggtgataaagcaggggatgcacgctacatttgggatactaaattccattatggtgattggatgtttcctagcgtgatgatgaagtcgggcaatccaatggagacggcgcaattgactaaagatatagtcgcaactgcatttttagcgcatagtgctgaactattgggtgaggtttgtgcggttttaggtgtggatgcagcaccttatcgggactatgctagcaaagttaagcaagcctttgcccagcattttattaccgtcgatcagcatttgactagcgattttcaaggttgttatgtattagcgctagcttttgatatggtgccgccagcaattaagccagctttagttgcacggttagttgagaagattcatgctaaccatgatttgctcgacacaggatttctatcagtaccttatttacttgatgtattggttgacaatggacacgctgaattggctaagaaactatttctacaggatgaatgcccgtcatggctgtatgaagttaaaaatggcgcaaccacgatttgggaatcttggaatggtatccaaccagatggtactgtcggaacgttatctttcaatcattacgcgatgggttgcgttttagattggtttgtccgcgttgtggttggtttgactagtaccacgccaggttatcagaccgtaaccattgccccacgcgttgcagtggttgatgaatttacagttaactatcaagctgctagtggtgaatttaaaattaaacaaaccaaacaagcagataagcaccatttagcggttaagattccaactggggttaccgccaaagtgattttaccgcaaagtaaacctgaaacgattagtgccggcacttatgaatttgtttattaaataaagacgtttgctaaaaataaaaaggccttttcaggctttttttggtcatgcaactaattgatccgcatatgttctaaggctttcatcattaattcaaaatcagaactgttgatgaatttgaattgttcggcttctaatttattgaagttttcaattaacatgtaagccgttaggtaccgttttagcgcatctttgctggcgcgggtgtcgtcgtctgcttttaaattagaaccaccaataactgccaatgcaaatgcgttaggatcaatcttaattttctcttttgccacaatgaaacctccaaatttttttcacgttattacactctagtcgattggcctagtgctggtcaatggcaaaaaaaggtttattagtgatgattagtattttatatacaggtacaacgctttctaaaatttagttatgtgctataatgactaaatagcaaaaattcgaataaattacctgccgctgggtgggctgtaagcatggttatcattccgttaggtcgttgtcggaatggtagcgatgctttatttttttgctaaaattttggcaattggaggaatttatatggcgtggatctacctgatcgtggcgggtttgtttgaaaccgtctgggcgacaacgcttaaaatgagtcatggttttcaaaaactggattactcaatttacacaattattggtatgggacttagcttttggttgctggctaaagcaattaaaacgttaccgttgggtattgcttatccgatttggacgggaatcggtgctctaggcacgattattttaggggtcactttatttggtgatcgactgtcgccgctaacctgggtgttcgtcggactcttgctgatcagtattattgggattaaaataacggtacattaacttggaggaacagataatgagtacaattcaattaaaaaaagtcactttagccgacttagcgacactacggcaaattagtattgaaacgtttacggatacatttggggcacaaaatacgccggaaaacttaagggcctatttagatgaagcctatcagccggccaagttgcaacaagaattaagtgaaccagcggcacagttctattttgcttacgttgatgggcacttagcgggttatttaaagctcaatcatgatgcagcacaaactgagacgatgggtaacacagctttagaggtggaacgaatctacgtacggacaacttttaaacgccatggtttaggcagtcgcatgattgcgcaagcggaacaagtcgcgcagcaactcggtaaacagaaaatctggttaggggtgtgggaaaagaattttgcggcccaacatttttacaccaagcttgggttcgttcggactgggcaacatgattttatgatgggtgatgatcggcaaacggattttattttaacgaaacagctttaaagcttggtgttgcgtcgtaaagctaatataatggatgcaagatgacgaaaaaggaagttaactcatgatccattcaaaagtaacggttgctgattataattggatcggcacggaaaagttgactgcagaagaacagacgcaattgcaacaaacgtatggtttgacgactgaaatgatcacctacgtgactgataaagatgaaagccccaattatgtttatgattcggatacggctgatgaattattcattgtacatgtaccctatatcattaatttggcgcaattgcgctacattacacgaccaatcagctttatcatccacggtaataccgtgtttacctttaacgaaagcgggctagactgggttacgcagatttttaccaaggtgcagcaaaatacggcaatcaaaacggccgatcagttcattttacagacgttgtttgcgttgatggatagttatattgccatcgtcaaggcgatcactaaaaagcgtaatcaactagacaaagtattaaataaagaagcaaaaaacgcggatctgattgcactatcgtatttacggcaaacgttgactttctttttaggtgcagtccaatttaatctcaatttactacgtcacttgccacggacccattttggcttggcgattggtccggcgaagcaagaagtgttggaagacgtgacgattgaagccgaacaggtccaatggatgatcaatattgaaacccaggtcgtcgatcgcatcggtgatacgtttgacagcatcgtcaataataatctgaatgatacgatgaaattactgacgatttggtcactgacaatggcagtgccaacggtcattactggcttttttggcatgaacgtgcatttaccgttggccaaactaggcggggcttggttactgacgatcggcgtttcgatcctattgatcgcttggttgctgattggtttgaagttacatcataaattgtaggtgtgaataatgaagacacgcataattaaggttgatcagttgaattttaatgtgtttgatcaaggtacgggcgagccaatcgttttattgcatggctttcccgactcattaaaagtttggcgtaaattgattccccacttgctggcagccggctaccgcgtgattgcttatgatcaacggggctttggtgcaaccgatgcaccaattggcgtgactaattaccgtagtcggaacatgattgccgatctcgtcggtattttacggacgttacacgtaactgaaaaagtgaaattgattgcgcatgattggggtgccaacattggctggggtgcggtgatcgcgcatccggaattattttcatcctacgtcacattaggggtaggtcatcccagtgcttacgctaaagctggcggttttgagcaactcagaaaaagttggtatgcggtgagtttcttagccagtggttgggcagaaaagctttattcacggcataattgggctttgtttagaaagtttaccagaaacaatcctgaagccagccgtaattggttacctgacttacaacgaccggggcgtttgacggcagcgttaaattggtatcgtgctaatctgaatccttattattgggaatctcaagctgtgaaagtggatcggacagtggacttgccagtactaggtatttttggtgagcaggatccttatttaagttacgcacagctgcgcaactctgtacgatatgcgccgcagttgaaaattatggcgatcgtcggtgctgggcactggctacagcttgaaaacacgacgttgatttttcaacggatcagacagttttacgcaaaatagaggtgcgagcaattatgctcacacctctatttttatccgctcattcatttccttaagttaattatcctgcaaatcaaaggtaatttcaagactgtttctattgtagaaaagttggtatgctagcaacctagatcatggtttgaatttggggaggtcattgcttggataaactatttgtacaagaacagcagcgattaactgatctttttcagcaactaacagtagaacagcaacatttcttacagctacagaagcaaaatcaacaacaagcgttgcaagtaaaaggtggtttggcgcaggatgcaagtctgaatatggctaatattagtgataatttagacacttttgcggctttggaagcgatgaatcgtgagatcaatcaatataatttttcagctagtgtgctaaccaataaaatccaacaattaaagttattattaccagctgcttatttcagtaaaattgtcgtgcgctttgctgatgagccgacggaaagtgaaacttttcatattggaattactggttaccagaatttagctggtgaagatgtagtgtacgattggcgctcgccaattgccagcttgtattatgatcaagtgctgggggccagtgcgtatacagctaatggccagacaattaaagcaaccattgatctacggcgtcaattcaaaattgatcatgaacggttactgggttattttgatacgcaattagcggtggaggatccgttattgatcgaggtgctagctcaagatcaccagcaatatttgactgatattacggcaaccatccagaaagagcagaatcaaattattcgtgatgaacagacggatgcgctaattatccgcagtgttgccggtagcggtaagacttcggtggttatacaacgtattgcttatttactttatcgcaatcggcagaaggtaaaggccagtgatgtactgttgttgacccctaacgagttgtttagcgactatgtttcccaagttttaccgaccttgggtgaggaaaacccctggcaagcgacttatcagcaattactcacacaaatcatccagcagattctgggaccaaccactgcatttgcagattggccggcaggaactagccatttggcgcagttaacaaccgccttaacgacgatcacagttaacgcggacttgtttcagaatttaacgaataggcttgatacgacgcgtttgttagctttgtttgaacaaacaccaatcaacgcaacattagctgatcgcctggagtcagtccgtttgaatttacaacaactactcactcaagacgtccgtactgccgctaccaatgaacaaattttggctgaattagatgatttgaccactgcacagcaggtgaaaatatttggtcggccaaggcaggtcaacaatgagcgacaattagcacagtatgcacggaaactgcgccggtatcagttaaccgagttagcgactcaaatcgatcaatacgcttggctagattggtcagcttggatgcaacaactattaccaggcattactgccagtttgacggatcttgtttttgtattgatacattcaactaaattcaactacgatcagatcaagtttttgatggttgatgaattgcaggattatcaattagacgagttacaattagttgtgatgctattcccccacgcaaaattgaccttacttggtgatgaaaatcaagcaatcaacacgaatacacctggttttgaccagatagtaacgcaactgcaagtgcaaggaaaatcggcacacttatttgaattgaccaaaagttatcgctcaacgcaagaggtcaccaccttattccgtgagtttgcagtagacaaaaatttagaggtagtttctgtgcaacgccacggccaacgacctgaattacggtcaagttctgattttgctagtatgttagctgatttaaatcaagtgttgcagcaagaaaattccggttcaacagcaattgttacattactaccagaaatggtcgagtccatttatgcaggtttaaaggcgctgacgccaacgctggcgcttgtgaaaaatggtggtatgactaccaaacaagctgtgatcttaccgctgactttagctaaaggtctagaatttgaccgcgtattactattagatgtgagccaagcacaattagccgtagtaacaccagaacgtctgaataagttattgtataccggaatttcacgggcaaccaaaaccgttcagctgtttgcttcaggtacagttcatcctacagtaaccgctgcatttcaagcaattaaataaaacaaggtcagcataacacgctgaccttgtttttatttaaactgttatttccgtagtaagatctgatttagtggcttatgttcgctagcttgaccatgatcgtcacttttaccaatagcaattaataatagtggcagataacgttccttgtcgattccaaatgcagataagatttcgttatggttgaaaccagtcattgggttggtgacgtaaccgcgattttgcgcgatcaacattaattgcatgccagctaaaccggcatttaaggcatggttggttaaagtacccgcatctggtgccggtgtgccatgactagtgctaaaagctggtgcatcatcgttgactaagtcagcgacgatcagcactaaactactggcggtttcgatttgactttgattaaagctgacctgttgtagtaacttagtacgtgcttctggtgaatcgagtactaagtagcgcaacggctgtttgttcattgcagtgggcgctaaagcagctgtggcaatcatgtcatcaagttcggtagtagaaatgggatgatttgtttcataacgacgtacactgtgccgttcgtgaataattgtttctaactcagccataaataggacttccttttaatagttttgcttacttttcattatagcttaattaagcgctgtcagtgcagtataatatgcttaacacagctataagttattgaacggaataaattagccactttagggtgggtgtagaggaggaatttttgtgcaagcggcatatattaaacggaccggcgcgccaacagaaattcaattaggcgaattaccgatgccgtatgtagcgtcacatgatgtcttgatcaaagttaaagcagttgccgtcgatcatgtggacacttttattcgtgggggaagttttaagactcagctgacgtttccgtttattattgggcgtgatgcggtaggaaccgtgattgcagtgggcaatgcagttgatcaattcaaaaaaggtgatttagtctggactaatagtatgggctatgccggacgccaaggtgtaactagcgaatatgcagcgatcccagtggcgcgcgtcttcaaagtacccgcggccgttaatccgctgcaactagtggcagctgtccattcaggagcaacggcggctattttgttggccgatattttccaggcgcggcctggtgcgactttattagtagagggcgcagcaggtcatgttggccgtaaattagttcaattggcacacgatatgggcttgactgtgatcacaacttcgcggccgtgtgactttgcgcaactaaccaaattaggcagtgcagcgccgtatgattatcagacagattttgccgtcgaaattgctgataaatatcctcaaggtatcgattatatcgttgatacttctggccgcatagcgttacagactaatctagatctattagcacaacggggaaccgtggcgctgatcactgcgccagtaactgatcaatttgattttcgggtgcgcgatttttatacgaccgataaaaatattgccggctttgtcattagccatgcgacactgagtcagctgcagcaagcggccaaaacattgaatcatgaattcagtcgtggtcgtttgctggaggataaattggcggttaatgcttttgcctatgcggctcaagctcaccaattattggccgctggtagcagtaaggataaaatcattttggttccaacggcggatgaaattgactagtattatatgttattgttataagaacatccggtgtttaagcaccagctttgattaaatcaaggtaacgtcaaaagttctatgaaaaccgtggttcagaaggtggtgtagatgcaactgtagaaatcgacttaaggattgagtggtctagttggttagttctgtacgcgcacagtattaatccggccaa

SEQ ID NO: 522 - DNA, 16416 bp, Unknown
  Metagenome-assembled genome
tcgtcctgagccaggatcaaactctcatataaaatgaaaattgattgctcaattgattttgttgctagcgagttataattcaaattgaattgacttcgcaaatgtttgctttatctcgaaccggtccaaaggccggtaaaaaataaagaccctacacatttgatttgtcgaaactttgttcagttttcaaaggtctaccttgtcgctcaacacgacttaattagtttaacatgtctcacacaatctgtcaagaacttttttgaataagttttgaatatttattcaagtttttaaatcagtaacgtgtgacacgcaacttttatactataccaagtttaaatgtttctgtcaacaactttttttaaatgatttaaaatcatttaaatggattgctttgaacacttaaatttgacaacttaaataatatactacggttttaaatcagcgtcaagcattaattcataaaaatttacaattcgcatgaacattcactctgtagttgcttggcgcaaggtacgatccaatgcactaccataagtttcgccaaataagttaaggtgtgccattaagtaataagtctgataccacgccacccgttgctcatagtttggacgtagtggatacacttcattataggcttggtagaaagcagccgaaaaaccaccaaataattgagtcattgctaaatccatttcccgatcgccgtaaaatacatctggatctagtagcactggagtaccgtcttgtaaaaagttcacattaccagcccataaatcgccatgcaataaactaggcgtcaccggcaccgtagcaaaatatgcgcgtatccgctgacacagttgttggagcttttgttggcgggaatcattccaataatgattccgacgcgctaaatcggctaataccattaaacgctgctcaatataaaagtctgcccaactattttgccagtgattgtacttaggtaacttcccggctataaaatcatgcgctaggccaaattgcgctgcatgctgttggtgtactcgcgcaactgcacgacctaaatcggcgtcatccccttggcctaaatctaaccactctaataataaataagcatcaccggcaatttctccgctagcaataatctgcggcacacggactgctggcgctaaaagtttgaggccttcctgctcatgttcaaagaaagctgattgctgctgggcctgcacctttaaaaaataatgctgctgtactgtatcgatccgataggcttggttgatatcgccgccactgactgctgctacccgtttgatttcagatagtggcaactgcgctaaccatgactttgttaacattttacttcctcgattctccaataaaactgctaagttacacgcatatcctgtactggcttcttctataataaagcaaaagccacccgtaaattgggtggcttcaaatactatttagaaccaagtacactggcattcaatgaaatctggctagtctcaatgaccttttcgtaatcactttgttgtaataagaagagattacgcacaccggccttgccagtcaggatattattcgccaaagtcgattgcttttctaaatcagcgatcactggtaataaatcaacttgttctggcttattttcaactaagtaatcatagaaatcgctggccgtgttgatcagcaattgactgtgattattcgtgaagaccatattcttcaaccaccaaatgatcaattcattttcagttgagaacacttctaataagacgcctgcttcatttagcagttggatcgtctctttatcattctcgttatattccttaaccaatactaagctaccgttagtccgataaaagttctcactgacaacccggttagcgttattttggtcaagatattgtgtggctgaaagctggccttctaggtcaaagacgtcccgtttgataactttaccttgactatagtaaagcacataccataaggtgtcgtcatcccgccgcttcaactgcatcaccggttggttattttgatcgcgcactaattcagaatgtgtggcttcatccttggtgtactgccagtcatcattttgcggaataatgttgtccgctgccgcttgtggttgatcactgtcttgcaatgactgatacaaattcaataattgggcatttggagccagcaagccttgttgctgataatcgtgccaagttgtctgtaagtagtcgttataatcgacagtaatataggttggcgccacctgtgcctgcttaaaggttgctgccgtcgcctgcaaggctgctttttgttcagcgctaggtgtccgttccaaattacgttcaaagacaaaataacgggcttcctggtccagtacaacctcatttacactttcagtcacctggaaataatgctccaattttttcttcgtattttccaattgtgttgtgtactgctgatgccgattctgagcgttatccaaggcactttgagtcgaagttaaacgccgttctgctgcttgccgtgctttttctcgatccgcttgcttagcatcgatctctttttgtagcttatctagctgttcatccaaaacattttgcttggacttaatgttgtcgacttctttaggtaattcagcctgccgcgtctgcgcattgttcagcttaacttcaacaacttcgatttgacgcttgatgtcgtcttttttcgcgttcaaaacttgaacgtgactcttttgttgttcagccaaagagatcatcgttgccaagtcagtctcttgcttgatcttctcgaccatgtcagcttcttcttgctcgtagcccgctaattcttccttagcaccgtcagcttgcttttcatattcggcaattgacttggccacgtctgcctgctgctgctctacattggtcaactgttcctgtgcccgctgtttttgccgcttagtgttggcaaactggaccgtcgtctcgtcctcaacatcaccttgcaaatcagcaactgactgctgatccttctgctcgtcttccttgagcgcttcgatctgaggcacaatcttattgatctggttcagcaacattttccgctcggtaaagagttggtcgcgtaactcatctttaacagctttgagttgactttccaaatcagctaactgattttcagtggctgaacgtgtgttgacgatatccgtaagcgtgacatcgctggccgtgcttgctgtatctgttgatttactcgttgtctccatctccatctcatgattattattcaagtcaccttgaaaaacccacttttgcgagcgttcgccgttcacatcaatcgcttacaaaaataagctgtttagcctaattctaatgcattcggccggtggcatcaactcaagacaccaaattttgctaaattgttaaataaatgacccgaaaatgagacaaaagcggaggcctgccgcaattatctctactttttgacttaaaaattggcctaatccgcaaaatctagtcatttgccgctaaacagcattatattattaaaactaataaaattagcgtattggtaaatcaagcaaaaatcttacttgcggatactgggcagctaactgtttgcctgattgcgccgcttgccacttcgtgtattgccgtgcttatccaactaatctgactatcaagtgtcaattttagccaagttttacgcgcacctgcaacgctattttgaattgtatacttacctctactcatactttactccatatatattcatgcaaagtgttgccagtaacactgttgtatataactgaataaaaaaagcagcgctagactacgccgcttacaaaaactattcaaaatcacgattttgcccaaaaatacgcatcttcattttgataccagttggggttgcggccaaaccaccgcggcccgtttcccgcagtgattgtggcatctcttcgccaatcttcttcatcgcacctacgacttcgtcagctggaattttattagtcaaacctgccaaggccatatctgcggctaccaacgcattggtcgcgccgatcgcattacgcttgacgcagggcaattcgactaagccagcgattgggtcgcagactaagcctaacaaattactcaacgccatcgctagagcttccgctgattgctccggtgtgccgccagcaatttctaccgccgccgctgccgccatccctgacgcgctgccaacttctgcttggcaaccacccgtcgcaccagcgatcatcgcattattggcaatagtcataccaaaggccccagctgtaaataagaaacgaaccatttgctcatgagacatatttagacgttcttgcagcataaagagtacgcccggcaaagtccccgaggcgccggcagttggtgtagcgcagacaacacccattgctgcattgacttcgttggtggcgatcgcattttgcaccgcagctaacataacatccccagataagctttgatgagttgcccgataatttttcaatttgattgcttcgccgcccgttaaaccagttttggaaaaagcgccggcaccggtgctgccgcgtttaaccgccgcagccatcgcggccaagttatgttccattgctgaccagacttcggcgcggctattaccgctattgcgcacttcttggtcgatcatcaattctgaaagtggtacgccagccgttgttgcggccgccaccagttcagcaatcgttgtataaagctgcattttaccttcccctttttccctatagataaactaaatcagcggcgctctgctgcaaactggcgacttcatgctgttgcagattacgttctaaatcaaactcgatcagctgtttagctgcgtgtgtgtagcgctgctgatgtaggattttcgtcattttagctaatttagtctgaatgatctgatcattatcagccgcaccccaaactagtaagatcggcagcggtccccgtggtgtcagctcaaaaccatctacggtaatgcgccggatctcaatcgttccgccaccgattgaacagccagcaactgtgatcgtttttttagcattgcgcaaggtcaagatagctgcgttagggtgaccgattgggcttttcccagtcatttcaatgaatttaactgttagtccttgctgctgcgctaacgctaaagcatttggcacccgcgcgtcagctggcgctaagcctaaaacgcctgccaccaacgcataatcagtcccgtggccgcgatgtgtttccgcaaaggattcatagtagcgcaccgttaaaccagtcgctggtgcccgaaaaattttccgtgctgcatggccgatcgccaccgcaccagccgtatgcgagctggaagggccgatcatcaccggcccaataatatcaaaaacacttttataatttgcggtcataagcagccaccttccagtcaataatctctttagagtcatcataccgagtatcgattaagcgcgcatgaattttactcgtaaaattctaagaattacaaaaaaataaccaacgcattgagtggcgttggctagtttcattgagtttagttatggtgtgcaatacctaacttgattgaaacgtgtttaaaaagcaggtcactgcacctaacctaagcgcttttttaaacactctgcagtttttctatatcaataacgcggtcgatccagccgtcgtagaagccgggttcgtgggtcactagtaaaacactgccttcaaaatcgcgaaccgcgttggccagtgcttttttagtgccgtcgtccaaatggttggttggttcgtccagtactaataaattagctgggaacaacattaataggcaaagtttgaccttagtctgctcgccaccacttagcattttgatcggtttttccacgttatctttttcgatcccggcacgcgacaatgcttggcgcactttgcgttgggtcatgcttggtgctgccgcctgcacgatttgtaacggtgtttgcttcggatcatcccagatcaattcttgccggaaataacccactttggtcgtcgctgaaaaagcaaaatcgccgcctaaagctggaataatgcccaacaacgtcttgatcagcgttgatttaccaataccgttaaacccagtcagtgccaccttttccggttgcgtgattgagaaattaaatggtgccaataacggtttttcgtaaccaacctttagatcactaacttccagcaacatccgcacggcactcggttggtacggaaaggcaaaatgcgactccaataaattgcctggtggcgtcaaaatatccatgtgcgccaactgcttttcccgacttttagccatagttgagcggctgccggctttatatttacggatatacgccttagttttctcaattttcttctgctgcgtcgcataagccttcaaataggcttccttattatcttttttctgacgcagggcttgttgcagattgccacggtatttagtgatcttaccgaattcgatatcacaaatacagttggagatctgaccgagaaaatcgtaatcatgggagatcacaatgtaagcactaggaaaatcgatcaaatagtcgatcaaccaagtaatatggttagtatccaaatagttagtcggttcatccagcaacaacacatcgggctgttctaatagaagcttggccaaaattactcgcgaacgctgcccaccagaaagctcgttggcattggtatccaggccaaaagcatcgatacctaaaccagtcgctacctgattgatcgtcgtttcaatttcatagaagttacgcgattcaagaatttcttggtttttaccggctttttccagtaatgcatcgtcagggttattagcataatccgcatagatctgggcgttttccgcatccaattcatacagatcactgaaagctgtttttaaaaattcaaaaatcgattgctgcgctgttaagctcacatattggtccaaataaccaattttagtgtgcttcttccaggtgatcttgccgttgtccggtaagatctgccccgtaataattttgatcagtgtactcttaccgaccccattttggccgataatacccatgtgatcttcctgattcagggcgaaacccgtgtcgtcatacaacgttttatccaaaaactgctgacggaggtcttccactgtcagtacactcatggcgatcaacacttccttaatttagagagtgctttaaaagaatggtcagcttttgagcattagcctagcttgacaataagagacacgcaagtggctcgttcggtaagcgtaactaagccagaaagttgtctttttaaacacgtttacgctagctcggctgtcatacgcacagcagaaagctatttcacaattaaataaccttaccatagataaaaagtacggtcaaactaagggtttcttgaaaatggaactcacaaaaaatcccctgcacagttgcagaggattcgctgtttacatggtctagccaatttagttcgcttgctgatggtcctttttatctgttgtgtgccgcggctgtgtcggtattcctaacaagctgatcagcagcatgctaccaccaaatatcaacaaagtttctaaaagcatacggtcaccctcttttcaatatatcgaatagaaaagaagtctaccaaattagccagctataatgcaagtagattgttgtttatttttctacggccgcaacggtgagctcttggcgataagcttcgatcagttttaattcataaaaattacggttcaacttggcgaaggcgcgcgcatcatggaggtagtcctcaatttcagcttgtggcttaccctgagcgtgctgattacgcgctaagcgaaaggccacccgcgccaaataataggtaacatgattttcagcgcagatctcataggcgtaattaagtagcgcatcactagattcatattctttgacttccgaataaaacttaccgcaattataaacgatgtttagtacacgccagacatccgttgtcgtacgaatgcggtaatcgtaaatttctttcagtacgcgattaaagtaaaaatcagccttttcattttcttgcttaccggcgtaaatcattccgaaacctgtcagtgccaataaattgtagatcaccgcgtaatctttagcgtcggcagccaagatctggctaaacgcgaataacgcatccgtggtctcgccttccagtaaggtgatcaaataaccttgcaaatacaggtaacgcaaccgttgatcatcgttatcaatattggcaaaatcgatctcctgcaataattgctgggccttggtgtaatccatggtgatcagtttaaattccgcgtcggccattttctgattaagcgcactactagcttgttccacctttggaaaaagatcggctaaactgaggttaagtcgattacacagtttgatcaaaattttgattgccggaacttggccatttttttcaaagcgacttagggtggcttgagtacagacaccgtcgcacaattctttttgcgataaacccatttttttacgggtttcaacaaaatacgcaatgttcattttttatcacgatcctaatttttataattatcatagtatatgctatttagtgagcataattccaccgtctgcgccaaaaataaacatttttgttaactaatggcgggtgcagccttttatataatatagtataattacgttatattaaatatacaaatattataacacagttaaatgtaagcgtattattttggaggcaaatttaatgcaaattgttcatattcatcatccctatattcctgaaaaactcacgaccaccccgtgtgtactgacgctaggtttttttgatggcgttcatcgtggtcatcaagctgtgatcaaacggggttacactgcggccaagcaacaacatttaccgttagcagtgatgacattcaaccaacatccccgcctggtttttcgtaaattagcatatccagaaacaacttatctatcgacccttagccaaaaagaacagctattagaacaattaggagtcgccattctgtacgtgatcgactttaccagcgcatttgccagcttaacgccagcaacctttgtggaacaatacattgtcggtctgaacgcacaaaccgtggtcgctggttttgactacacttttggcaatcaaccggcgcacgttatcgacttagcgacttacgcacacaatcggtttcagacattgattgtttcacgggaaacagatgccgccttaaaaatcagttccagtcggattcgcactttattcgaacacggtgatctacagcaagctaatcagttgcttggctacgtttataccacaacggccaccgttttgccgggcagccatgtggccagtgagctacaagtcgaccccgccagtcgactacccattgctggccaatataacgctcgacttaaatttgccgggcagtggtatcgggcgacgatcactgttcccaggatagacaccgatcagcgcatccagctaaccagtagtgaggtaccgcaacctatttttggcgaaacggttattttagcttggttgaacaatcttgatcaagctgagcaactaccagtgagtagtctgggagcttacccgacgcgctaacctaggcttatatttttcagaaatacaaagaagtcctgccgtcaaactaatgacggcaggacttctatttgcttagtttaatcgttgatcgaggcaccagacgtttcatcaactgatggttgtgccgccggtttttcttcaacctttggttcatcatcgatcgaggcgccagaagtttcatcgactttgtcttctggttttgcgttaacggatgcactggaggcaccatcaacagttggtttgtcccgtaaggaagcccccgacatggcgtccggatcatctactaatttttggcccgtttttgctaagtaccatttgatcgttggcattaaatcaagcacaaattcattgaccccagcataatcgccgttttcatcgtgcatggctttatagtaatgcattaaaaagacatcggggccagtaaatggtacgcgcattttcacaatatccgtttttccagtccgcaacaagttgatcacttctttaacaggttcaacggcccgatcagggtggacggccgacaatggatcaccagcttgctttggatagcgcggtgctaacatttcatcatgcggtgccatattgttgtaatacaagaactgattattttcatcagcgtaggtcaattccattggcatcgaattcaagaaatagtttaactgattgaccgtcaaaacaccacgatccaatttaacgtaatcatcgccttcggccgcatgcgttttagccgccgcttgttcaacccaatcgtcagcgttcatatcaacgccttcgatggtcgccctacctttacctgaggccgttagatcttcagctgccgcacccgtttggttatttttttccgtttcactcatttttaagtactcccttctaaatttacaattcgtgtgtcattgaggaataaacttcccccgttttagtgatcacaatgccttcgatctccggtaattcagctaatttagccatgatcttttgccgtggttggccgaataagcgcgtcgtccacagctcaccagtcaatgatctatctgaaatgatcgtcaaactagctaaatcagtggctaacggatagccggtttgcggatcaaggatatggtggtaggtgtgctggtcaacggtcaagctccgctcataaataccggaagtgacgaccgatttattttgcacacggaccactgtcttgtagtagccccggggccgctgcggatcttggataccgatccgccactggtgatcagtatgctgtaacattggccctaatgtgaccacattgccacctaaattgaccagcgctgaggtaacgccttgctgcttcaaataggtgatcagcaaatcagcgatataacccttagccagcgcaccgagatcgagcgccatccctttttcttgtaaaaacaccgtatgggcagcatcatctagcaaaattttatgtggatcaattttagctaacgcctgtttgatctccgccgagctaggtagtttggcgtcggtaaagccgatccgccaagtttgcaccaaaggcccgatcgcaatattcagcttgctgtcagtggctacactatagtgatagccgattttgatcaagtcatataactctggcgctaccgccactggcttgattcccgcttgatgggtcactgccatcaattctgaggtatccgcattagcgctaaaacgatgttcatataatttgaggcggcgcaccatttcgtctaacaacggctccggggtggcggcggtaatttgtaatctgatgatcgtgcccatcaaatgaatttctcgtgatgcttgttccataattgtggctcccttgcttgacatccacccgaaaaaaaagggtttggaacctgattcgtccaaacccttttaccttaaatacagttagcttagagcttgcctgcttcagcgtcttttagataagcactaaatggtttcaagtcttctgcttggtatttcgtgacaaattctttgatcttgtccgcatcttgccaagctggatcgatgaacatatgttgcgttgtcattggcatctcgtgggtcaatttaacgtcgatcaacactgggccatccactgcaacagccgccttaaagactttgtcgatatcatcaaatgtccggatcgtatatcctttaacgttcatcccttcagcgactttagcccaatcattatctggtaaatcaaccccagataatggttgatgtgtatcatcgcgctgttcagcttcaatgaaacctaacgtttcgttactgaacacaatgttgatcgtcttcaaattgtacttagccgccgtcagtaattcttgtgacatcatggcaaagccaccatcaccacttaaactgaagacttggcgatcagggaaagccaccttagccccaaccgcagctggtaagccatagcccatggttgcgtactggcctgaagtcgtccatttttgggtggtctttaagtcgagcaaccgcatgacgttaatattgacgttcccaacatcgataccaaagaccgcatcatcgtcagcgtatttattgatcgccgcaaaaacaggttctggccgtaatggttctgatttatcattttcaaaactagcttgccaagcacgctcgtccttatggttagctaaagctgcccggtagaacggtgttggttccaattcatcgcctttggctactaaagcggctaaagccgttttagcgtcagccaaaattggcaagtcgatattgtgccgtttacctaatttttcattgtcggtatcaatttggatgacttttgcccgtggattgaataggaagatactaaatggtgaatcgttaccgacccacaaaatcaagtcagtattgaaccctaattcagtaccggatttaccagcaggccgcccagttgaacccatataagctggataggtatcttcaacaattcctttagcgatcacggttgaaactaatggtaatttgaatttttctgaaaccgcctttaattccgcaccggcttttttcgccccaacaccgaagtaaacgatcggctttttagccgccttgatcaattcaacggctttatcaatcgccactggatctggttgtgggtaaagtggggccaaatgattcttcgctgtggagatgaagttgtctttgatctctgtccaacctaaatttttagggatgataacaacagaaacgccattgtacttgtaagcttggcgaatcgcagtgtcgatcaaacgtggcaagttttcagcagttgttgctgtccggttaaatacggcaacatcatcaaagattgggccttcatcgattgcttggaagaagtcgatgttcatccgtgcctgtgggacttgggcaaccaacgccaaaacgggtgtgtggtcgtgtttagcatcatataaaccatttaataaatgtacagcaccgggaccagctgaacccattgtaacagctaatttaccagttaattttgattcagcagcggcagctaatgcgccagcctcttcatgccgtacttggacgaacttcattgtattttggcgatcataaagcgcattcattacatcgtcaaatgaaccaccaggataaccaaagatgtggtcaacgccccaatcttcaattactttaagcgcagcgtctgctgcattgatctttgctacttcagccatcaataatttcctcctagaacaaataagtcattttttaatttataaattaagtataatggttttttcgaaaatgtaaacgatttattgctaaaaaatgtattttacttaatttatgcctatataatagcgtaagcggaaccaagtaaacttgatcaaaatcaagtttactcatttttataaaatcagttactttatattttattaatattgttataacgttgttttggataaagcgttaccatataattagagttggatcagactaaattattttcatagaaagcaggtggtcattttgaccaatattttaattttaggcgcaggctatgccggcttacgcgcagctaaagttctcgcacaacagaaactcgacgcaaccatcaccttgatcgaccgcaatcggtatcactacgaaaccacgtcactgccagaagtcgcggccggaactcggcgggcgcaaagtattattttaccgttacccgaaaatctaccgacgcaaattaatttcattcaagcaaccgtcactaaaatcgaccgcggcgccaagcaagtcgatctcgctgacggccaacaactgacttacgattatttagttgtggctcttggcttggaatcagaagactatggcatccctggtgctgccgaatttgcactgccaatcgtcgatgttaaaagcgccttggccgttaaaaaacacctcgaaaatcgtttccagaattatcaagctagccaagaccctgacgacctacgaatcgtcgtctgcggtgcctggttctcctctttcgagttcatgggcgccttagtcaaccgcttgccgaaactggccgcgcattatcaagtgccgctagataaaatcgaaattcaatgtattgaggccaaagacatgatcttgccaatgtttgacgatgatctcactaattacgtcaaacaatggttaagtgaccacaacattgttttacgcacaggcacgccgatcaaggaagtgctggctaataaagtcgttactgaagaacaaacttatactgctaacaccttagtttggaccaccggcgtccgcggtagccacgtcatcggcgattctgacttcgagcaacgacgcaatcgggtcatggtcagtgatgaactcagcttagaagatgatcccaatgttttcctactcggtgacgttgccgctgtccgccagcctggcaagccttaccccttcccagctaccggccagatcgcctttcaaatggcggatgctgcggccgcaaatatcgccgctgatctaaacggcgcaccacggcaagatttcgtctttaacgatctaggtaccgtgctcgcccttggtagcaaggacggtgtcgctaaagtatttggcgatcacaaattacgcggctacactgccgccgtgatgaagcgggtcattgacgaccgttcattactcaaacaggtcggcgttaaagcactgactaagtatggtcgtttcccactgtaaacaatcgttttagctccgtgcttaatttctataacataagcgatactattggacttgccatattgaataaagggactttggaaaataatccaaagtccctttatttatgtttaaccattagtttttggcgatcacttgcttataattgagcaagtccttatttcagcgtttctcttttagttagatcaaacaacttttcttcaaataacgcagtttttttctgcaaaaatatcttctgcgtttccgtctcggcgattctctggtccagcttagtatttaagcgttgtaaaagcgctaaggcttcctcacaggcttcaaccgttagcttattaccccgcgacagcatcagcatctgtttagtttcattgaccgaagcacctaacttccgtaaatggttcagtttatccaattcaactagatcagtatctgaatattcacggcggccttggctatcccttttcatcggcggcaacaacccttttttctcgtaatatctgagcgcgtcataggtaaccttgtatcgttcggcaactttatgaattgaatgcatgacgatttctccaattaattagatttttcatttgcgctagtgtaacaccagcgtgctaaattagctaataaccagttgaaaggaaatgaaaaatcatgaatacagttgaagttattacgctcgtcaccggcggcaatcgcggtatgggcctagagatcgttaaagaactgagtcaaaaaggccaacacgtcatcatgggttcgcgccaacttgaaaacgggcggcgggcaattgagcaattagcaataacaagcggtaaggtcgacctagtgcagctagatgtcaccgacccagcgtcagtgactcgggccgcacaaactatcgccaccaagtacggctaccttactattttaataaacaatgccggcgctgtcttcgactataggcaaagcgcggctactgtgacatccgaaaatctgcacctagatttcgaaatcaattattttggcttagtcgatgtctcacaaaaaatgttaccactgcttaaaaaaagtccccaggccaaaatcatcaacatttccagcatgatgggttccaaaactgcggcgctagatcctcagtcttccgtttataaggccgttgcggttggttaccaatcagcaaaggcggccgcaaatatgtataccgttcaattagcaaaggaaatgttgcgcgaaaagttaccgatcacagttaacgcgatcgaccccggaatggtcgcaaccgaatttggcagtggcgatccagaattagccaaaaaaatgggggccatgccggttgaacaaggcgttgcacgaaccgttgaaatggccactgacgcaaacagcacagacaccgctacgtttacaaataccacaggaaccgtcggctggtaggcttgaccgtctcgagcttagattcttgagtaagaatatcatcaaataattgttttcgcgcgttttataattaagttagccaaatacttttagctaattgataaaataaaaaacaccaagacaaatctctgttatcattgatgttcctacacaaacaatgaaagaggctattgtcttgatgcaagaacagaataccacagtcagaaaaaaaggtcagcacctaacttcgtttgaacgaggcagaattgctacgctgcacagccaaggctattccaatcgtgcaattgccagagcg

SEQ ID NO: 523 - DNA, 31469 bp, Unknown
  Metagenome-assembled genome
atccagtgagaagcaacacctgaattaagttcgattcatccgtgaacggtgattccatatattaatcgtcatccccccttgaacatccggttttgaacttgggtttcatggaactttagacgttaccagttaggtttatttctgcgtccaagcaatcgtatctaccggatattgtagtccctttaaccaagcatcgtctgccaacttaaacaaagttagcgaaataccggccatatctaacgaagtcatatagttgccgaccttagtgaaatcaacagtaatcttttcagctgctaattgatccaacacatcatgggtaaagacatattgttccattaatggcgttgcccccatcccgttgatcaaaacagcaaaatggtcaccagcttgatacttaaattcagcctttaaacgacctagaagttcagtaactagtgccttagagggttgtaacttttctttacgataaccgggttcaccatgaattccgactccatattcaatttcatcatccgctaaatcaaatccaggtttgccaacttctggtaccgtcgcaccggatagtgccactgcgatcgttttgatattcggtaaaacttttttagccaatgcttctagttcatccaacgaagcaccttgatcagccgcagcaccaataattttatgcatgaaaattgtcccggcaacaccacgacgaccttgtgtgtaggtgctgttctcaaccgcaatatcatcatcaacgacgatcgattttacttgaatatcatcaagatccgccatatccttggccatatcaaaattcatgacgtcgccggaataatttttaatgaccataaatacacccttaccgtgatcagcagccttgattgctgcgtagatctgatctggtgttggtgaggtgaaaacttgaccagcgacagcggccgacagcattccggcaccaacaaagccagcatgggtcggttcatgaccgctaccgccaccgctgatcacaccaaccttgttttccatcgatgctttatcatgacgaactaacgcttcagtttcgggcaagcgctcaacgtattgcggataggcttggaccaaaccagctaccatttccggcacaatgttttgtggatcgttcataatttttttcatcaatctggcctccaattttgattacgttcacattcagtataaccgttttctgaactcggttacaagattaagcaaccgtcttttaattaaacttaaacatcactaacctcccagatttattccgccgatcgcttcttttttggtcaaaataattccggtaaaatgaaacccaattcactagcaaaatcaggtatacttggaggtaataactgattggaggaatttattatgggtacattgattttgcttgggatcattattattttagtggttgcgttattactactgacggtcaaaatcgtcaatcaaccaaacaagggcgtcgtcgtaacgttaggccgctttgatggtattttagaaccggggatccacgtgatcaaaccatttatttcacacattattactgtcggtactgcacaaacgccggtcgatctgaatcaacaagtggtgatcactaaagataacgcagaaatttctgtgaagatttccttaaagtatcacgtgactaatattgaagacttcgtttttaaaaacgaagattccgtccgttcaatggttcaggacacacgagcagctttacggggaatcattggtaacaaagaattaaatgaggtccttaacggcactcaagagatcaacaaagaattattcaaagaaatttcatcagtcaccgccggctacggcttaaatgttgatcggatcaacattgactcagtcaacccatcagccgatatccaagcttctatgaataaattactgcaagcgactcgtgaacgtgacgcggccattgccagcgctgaaggtaaagcgcgctcgatcacgttagaaaatcaagcgaataatcaggcgttgctggagaccaacgaagcgaataaccaagtcttggtcaacactgctaccgctaaagcaactgcgctccggacaactactgatgcgcaagtttaccaaacacaacaattaaatgtggtcttggctgacgccgggcaaaactactttgttcaacagaacattgacgcttttcgcgatctagcaaagagtcctgcaaatacagttgtattgcctaacgcaactgccgatagtttaggtcaactaccagtaattggtgatttattgaccgttgataaagctaagaataaagcagccgcaactaaataacattttaagtgaaccccgaaacgaagccacctgctttgttccggggtttgttttttcctaagcaacaaattccattagccggcaatcggtctagacagatatctaactatgctatactgtaagcggattattaaattaaaccccagttttcgcggtattagctgaccgctaacaattgggtcgcgaacgttacagataactaaaggagagttttttatgagcaaattaggcgtttccgtctatcctgaacgtgcaacttttgaacaggatcaggcttatttagatttagcacacaagtatggctttcaacgtgtcttcacatcattattagagatcactggtgaccaacaagaagttatagcgcactttaagcaagtgatcacgtacgccaatagtttaggcatgcaagtaatggtcgatatgaaccctaacctttttgaacaactgggtatttcatatgaagacttaagctttttcaaggagttaggtgcttggggggtacggctagatctaggctttaccggccaagaagaagcacggatgacccataatccctatggtttaaaaattgaagtcaacatgtctaaaggaacccattacctagatacgatcatggattattcaccaaatcgcgataatttgctgggctcacacaatttttatccccaaaaatttaccggcttaggctacgattatttcaaagcttgttgcgaaaactaccgtcaatacgcaatcaatacggctgcctttgtgactgcaccaagcgcaacttttggaccttggccagtggctgacggattaagtactttagaggaacaccgtaacttaccaatttcaatacaagttcagcatttacggcttagcggcttgattgatgatgttttgattggtgatgcctatgcgagtgaagccgaattaaaagcggccagtgaggcctttttcgcaccagaacccattttgcacgttgatgtagaaccaacagccaccgccactgaacgtaaagtgctttttgcccaaagtcagacgtaccgtggtgacttctctgattatgtcattcgctcaactatgactcgtgtcatctacaaagatgctgcctttcccgccaacaatacgacaccgatctatgctggtgatttattgatcgacaatgacgattacggtcagtacaaaggcgaattgcaaatcgcccgccaggattttgccaacgatggccgcatcaatgtggttgggcatatcagcgctgccgatcaaattttgttaaaacacttaaaaccatgggccgactttaaattagtcgctaacaactaggtgtgcctatgaattatcgtttaaacacaaccgatgaggtagatttttatcaattgtatctttacgcatttaacaagccagatagcccgcagcggcgcgcttttttcagtcagcgttatcaacacgcgtgggtctacggactaaaggaacaacaacgtttagtcagcggtctttatagcattccctttcaggttaatttccatcaagtcatctatcaaatgaatggtattggtgacgtgatgagcgcaccagagtttgctggtcgtggtggtgccggcacattattgcgcacagcactaacggaaatggcggctaaaggcgtcacactatcctacttagcaccgttttctttccgttattatcggcgcttcggttatgagcaagtctttgatcacacactttatcaaatagcgagcgcggatttaccacgacttaaaatcgatgttcatggtcaaattcagcgacttcccttagccacagcttggccccaattacaggatttttataccgctcaactaagtagccagcgtggcgggctcttgcgccctgattggtggtggcagtatttaagtgctaaaaatccagcatgggaagttgccttacgttttgatgcacaacaacagttgacgggctatttgatctatcaacgcacggccacaaccttcgatgtccaagagtggcaatttgtggacagtgcgacttaccaagaattggcgttgtttatcactaaacacggcacaagctaccaacaatttagttatgccgcgccaacagcagcccagcttgatcgcttgactgaaccatatgcactaacggcgaaaaccgtgccttacatgatggcacgaatcgttaatttaaaggatttcctccagcgttacccatttacctgtgattttgcgccgattactttacaggtcagcgacgatattttaccagctaaccaagcaacttggcagttacaacgccaacaggaccaaacgcaaattgccactagtaccgtcgcaggcgaactcaaattaagtattcaaagcttaactaaagctagttttggttatcggcgcctaactgatttattacattatggtgagatcagtggcagccagcaagtggcacaaaaactagatcaagcgctagtccatgaggcaccatgcttgatcgattatttttaaaatacgttaaaaaagtctatcaaaaattatttggtagatttttttattgcttgacatattattatattaactatatgatgtttttatattaatactatacgatatataatatagtgaggagcatagttatgaatattcctgttagttcggaattactggacggttgcgtcttagccttgttagccgataaagattattatggctacacgatcacccaacaggtccagcaaacgatcacgatttcagaatcaactctatatccggtactgcgccgattaaaaaaagatggcgcgctagaaacctatgatgaaccctttaaaggtcgcaaccgccgctactatcgtattacaccactggggacgcaacgactaggcgaaattcgccatgactgggaagactacaaacacaacattgaatggctactcaaaaaggaaggtgaaatttgatgaccaccgctgattatttaaaagaatttgaacagttactagttgggttaaatgtcgatgaagttaacgatgtccttgaatattatcaagaatatattttagacgccgatttagctgattattctgcggtcgcggctaaactgggtaccccacaacagttggcgcgcaaaatcttggccgattattcaattcgccaaactgagaccgttaccgcaacaccgcggcataatgcccgtttgatttggatcattgtacttgccctctttgcctcacccatcgcgattcccttagccggcgccataattttcatgttgattgccggcgtattggtagtaggcgcaattatttttgcggcaatgatggtcgttgccgcattattatttgcgggcggttttgctttgatcagtggttttgctattttgatccagtccttcgccacgggtattttctacatcggtatggggttagccggtttgggcgcaggcgttttagccatgttgatcggttatatggtggtcaaagtcttgctccaaatgggcgttgtcgtgattaaatttatctaccataaattccaagaacgccaccagaaagtagttgaccacgtatgagaaaaatagctaaatgggcaaccctgattttgatcgttggtctgctttttgccgggatcggcgcactaatgggtggcgttaacagcgttacttttgaccatggttttcggatcgtacgtaatggaacaatcacccataaacttggtcaagtcaaacaattgaatttagacgtgaccgatacagatgttgaattagtcgccggtcaacaagctagcgtgaccgtttccggtcccgaagttaaagccactaaagtcaatttgagcgctggtattttaactatcagccgaaacagtagtttacctagttttggctttgatttcgtcagcaatcatcagccacatgtcaaaatcgtcttaccccaaaaaacattggcgcaacttgacttgaatctcaacagtggtgatctgtcgatccaacaagtggccgctaagactgccactatcactcttggttcaggcgacatgactgtcaaccaattgtcggtaacaaatcaaggtgaatttaaaaacaacagtggtgacatcgatttatcccacgtgactttaaataaagtgactggccaattaaactccggtgaattatcgatcgacaatagcacgctgactgaatttaatgcaactaacaacagcggtgatactgatattgaacacactaaacttagcggtattatcggtttgactaaccacagcggcgacgttgaactaaacaatagtgataccactggctatcgcttaaaagctgattccggtgatatcagcgttcatgacgctgagcacagttctccctacaatcaagaacctaatgctgcggattgcttagaaataacttcagcgagcggtgacatcgatattgaatagcggtactagaaatacgaaacagacacacaaggaaaggtaactttgtgtgcctgttttttaatttcaattcagcaaatattcttcgaatttgaccaaacattcaacgcggtattttttgtgcgaatggcgtataatagagaattaggagcaatattcggtataggaagaaggctgagttaatgtttgatagtaagcaaagtcggttcgcatcttatggtgtcgttgctagcatccctggtgaattgatcgattcaatttgggcgatcattgataataatttgcagggtgtttttcccctagcacatactttggtttttgaaatcagtaacaatcacggcaacgtcacttatgattatgtgcaagatcatgaagtcgtcgctagttttgatactccatttacgtacactagtgattttccagcaacgatcctcgcctatgatagcggtactcaacagacgatcctgctaccacgtgaggcagaagcctaacctaaaaatacccaccaatgtcagtcgtgtcactgacattggtgggtatttttaattaaaaagttgctctggaataaatagatcacctaaagttgccgccataattgctttgatcgaatggaggcgattctctgcttcttggaaaaccactgattggtcgctgttaaagacctcgtcagtaatttccaaggcagtaacgccacactcatcttctaatgctttaccaacttccgtatttttatcatggtaagccggcaggcagtgcatgatgatcgtatcagctttttcagtttgcgcgactagcttagcattgacctgataaggtaataattctttgatccgttcttgcggtgaaaccgcctcgcccatcgagatccagacatcagtgtagatcgcatcggcacccgcaacggcttcagcgggatcagacgtcactaatactttgctgccacttttagcggcagctttttgcgccattgccaccacggtcgcgcttggttgcagggctgttggtgcgccaatatgaatattgacgcctaacatagcggcggtgaccaacaaggaattccccatgttattgcgaccatcacccacgtaagctaaggtcaagcctggtaaatgaccaaaatattcctttaaagtcataaagtcagcgatcatttgggtgggatgccattgatcagttaggccgttccacactggcacaccactatattgcgccaattgttccacagtatcttgggcaaagccacggtactcgatgccatcgaacattgaacccaatactttagcggtatcggcggtcgattcttttttaccgaattgaatatcccctttacccaaaaattccgggtgcgcaccgagatcagttgccgctacggtaaaggctgaccgcgtccgcgtcgacgtcttctcaaacaataaggcgatgtttttaccttgcaaataatgatgaggaatatgctgttgctttagctgttttaaatgcagggcaaaatcgatgaagtattctaattcactaggtgtaaagtcgatttctttcagaaatgattgattagcaaaatgattcatagttggcctcctcttatttcacaattaaggtgaatttattagccaagtacgctaataaatttctgctgttacagacggttgtccattttgacggcggcagaaagtggtacgtagttgcaaagtccgcaactgtgtttcctcaactcaaaccgtttcagtcatcgtcaaagacctggctgtaaaacttgtttgatcgtcgccacaccttgggcaagttgttcttctgtgatcgttaacggtggtagcaatcgtagcgtatcgtgcttggctgacagcgttagtaactgtgcgtgctgcaacgcggtcacaactggccccaccgcgacgttcaaatggattccctgcattagacctaagccagtaataccggtaacttgcggtaaaggtgctatttcagtttgtaataattgttccaaataagcagctttagcttgaacttgagcgagaaatgctggcgtcagttgcgtcaagactgctttagccgctgccatagctaatttattcccgccaaatgtggtgccgtgactgccgggcgtaaatgcactggctaagtcagcattcccaatcaaagcccccaccggcaacccattagctaagcctttagcagtcgtcacaatatctggttgcaagccataattttggtaagcaaacagttgcccagtacggccgttgccagtttgcacttcgtcgatgatcagcagcacctgttcctgcttacatttagctgctacctggtgtagccactcgctactagctggattgacgccgccttcgccttggacgacttccaaaattaccgccgctaaatcggctgtgatctgcgttaacgcagcagcatcattgtatggtgcaaaacggatatcgggcaccaacggtccaaagcctacttggatcgccggtttatcagtcatcgataacgcaccatacgtccgcccatgaaaactatcgctaaaagctagcactgcgcttttaccactagctttacgcgctaattttaatgcggcttcattggcttcagtaccggagttgcagaagaaaactaatttatccgcgtcgccgactagcaaagtagcgacttgctcctgcaattgactttgataaagattcgacgtgtgccaaattttttgtgcttgttcagccacactagcctgaacagcagcgttactgtagccaaggttacaaacgccaataccgctggtgaaatcaagataagtattatcacgatcatcagttaagtaacaatcatgaccgctcacgatatcaaagggataacgcgcgtaggttggaaataatttactcattgagtgatccctgctttctgtgtaatgaatgtggttccagtgtgggtcaagtcatcggtgataaatgcttgttggacgccatgattcagtgccgcaaacgctgctttgatttttggtgtcatgccgcttttgatcacatcagtggcgatcaaggcgtgggctttttgctgcgacaattctggcaagacttcaccggctgatagcacgcccggcacatcagttaataaaactaatttgctagcgtttaatttgttggcgatctcggctgcagccgtgtcggcattgacgtttaaccattgtccgtcgattgtttgtgccagtggtgccaatacgccgatctgccggctcaagatttgttctaaccaagtggtatttaattggtccagcacaccaacttcgccgtaagttggctggtctaaatgatgaccttgtaataaatgattgcagccagcattcaggccgatcactggtagaccatgcgcactcagtttgctcagcaattccggctggactaaacctagcaaaactgccttagtcagttctaaagtcgcagcgtcggtcacccgtacaccagcaattttcttaactgttaaatgtaattcctcacttaactgggagattttcggcccaccaccgtgcacgatcaggatctgctggccttgttggcgccagcaggctaattgttgaaaaaaactatccggcaactgggcgactgcattgccgccaatttttatcacgatgatttgcttcatatgactctctccctctactttatgacttacttctaactatgataagtggcgttgatcttgacgtaatcgtaggtcagatcgcaaccccaggcctgcccttgaccggtgccattatgtagctcgacggcgatgttgatcaccttagcagctagggcagcttctaacttgctcacttcagtcgttgccgcttgactagcttgaatcaacggcagctcattcagtgtgacgtcgaccgcagtaaggtctaaatgtgcatcagtttgtccaatagcaaccatgattcggccccagttaggatcctcgccatagattgccgctttgaccaaattcgaaccaacaatagcttttgcaacttgctgaccttcaaaatcagaccaagcaccggcgaccgtaaccgcaactaatttagttgcgccttcgccatcagcggcgatttttttggctaattcaccgagcacataggtaaaggcagccacaaacgtctcatagtcagctgaagtagcggtcaatggcgtgttgccggcggcaccgttggcaagtaccgtcaccatatcgttggtcgatgtatcgccgtcaacggtgatctggttaaacgtggtatcggtggcttggctaagcagctgctgcaatagcgtgccatcgatggccgcatcggtggtcacgaagccgagcatcgtcgccatattcgggtggatcatccctgagcctttacaaaaaccgctaagcgtgacggttttgccatcgatttggcaggtgaccgcgacggttttggcgtgggtatcggtggtcaaaacggcttcggtgaccttagtgttatccgttaattgtagctgttcaattcccgcagcgatcacgtccatcggcaacagttcaccaatgatccccgtggaagccacaccgaccaagtcagcatttaaacctaatttaatcgccgccaactgctgcatttgcgcagcatcctgttcaccttgcgcgccagtacacgaattggcgttggcactgttcaaaacgatcgcctgcaattgatgctgctggttgatcgtttttttagtcaacttagtcggcgccgcctgaaattggttggtcgtgtagacgccggctgctgccgcaggttgtgccgaatacagccaccccatatctaattttgctttacgtaatccagcatggacaccgtcggctttaaaaccttggggccaagtgaatggaatctttgtgtattttgtttccatcttatttctcctctatcctatgtacctatacaattctatgcaatttttacggcattaccgcggccaactgcaaaccagctgtcgtgctaaaaccaaaatattgattgaaattctgcactgcttggcccgcagcacccttgactagattatcgatcacactgaccactaaaaccgtgtgggtcaccggattatagctgatacccaagtcacaatagttagtaccgacaacttcctttaaagtcgataattgccccaccggtaacacgcggacaaaaggagaatctgcataagtcttagcaaatgcggcgtgtaactgttctgccgtcgcgtcagtttttgcgtagatcgtatccatgattccgcggactaacggtaataaagtagttgtaaattgaattgctggaacgctcgcatcccaaatttttaattgttgcatgatctcgggaatgtgttgatgctgattcactttatatagttgtaagttttcatccgtttgactgaaatgcgtgctagtggctaactttttaccggcaccagacgtccctgattttgcatcaacaatgatgctagccgaatcgatcaagtgctgttgtaccagcggtgccaaaccaagtagtgtcgccgttgcgtagcagccaggattagcaatgtagttatgccctgccgcatcagcgaactcggccaagccgtaatgactttgttgtaacgctgctgttgcaggcgctggcttgtggtaccacttggtaaatgtttctggatctcccaggcgataatcacctgataaatcgatcactgggaaatcagcttcaataaaaggtgtcgctaattcagtggttacaccagcagaagtggcaaaaaagataaggtcacaactggccatcaccaccgctgcatctagcggttcgatcaaggtctgatcaccaataaagttagggactgctgtcatcaatggttgcggttgactatcagggtggccgaacaagcgcaccgtcgccacctcaggatgttgttgtaataattgatataaaaccataccgctataaccggtaacgccgactaaagctacgttcatgtccctcaccgcctttaattatttaatggaacatctctagtttgaaccaagcctgaaaaagtaggcttccacatgttgccacgcttgtcaaacgaaccactacgaaccaagttaggttcagtactacatcgcttgcgtaaacgtgtttgaaaaagcaggtacttccatctaactacgcttagctaacgatccgctgcgcgtatcttatagctaagctaggttagattccagtacctgagcgcttttttaaacactctatacttttccaatgaatttttaatcaaactatcattgaccaacagcttacacctgccatttttggaatgcaagcttttttagatttttatgcaaataatcttttatttttgcatattacagcgtatatatttagaaatatacatttattttgaattttatagttgacttataacttgaaatgcggtttacttaatgacaatcaagtcgaaaaataattgtatttttatgtgaaaggatgaaaacgaatgaaaagttatcttgttttagaagatggtttaacatttgccggcgacgcttttggcgcccacattgccgctgctggtgaagttgtttttaataccggcatgacaggctaccaagaagcgatcaccgatccttcctatactaatcagttgattacctttacttatcccttaattggcaattacggcatcgatgccgctcacaatcaagcaaaagccgctggctgtgccgcgatcatcgtgcgccagttagccgatctacctaatcattacgcacaacaaatgaatctagatgaattcttgcagcaacaaaacgtccccggtatccaaggtatcgatacccgtcagttgaccaaacatattcgtcaacaagggacattaaaagctattttgaccactcagccgttaaccgttccttttatggcagcctacgccgcgatcaagcaaaaaaaagccccgctggaacgcgcgacttttacgacaccacaggcacagcaacacgtggttttgattgattttggtactaaacaagcaatcattgatcaattattagcgcaacattgtaatgtcgatgttgtgccctatacgactttattatcagccattgatgcgttacaaccagatggcattttcctatctaacggccccgatgatcccgccgattatcaggcagctttaccattgatccaggcgctacaaaccaaatacccgctggccggtatttgccttggtcatcaattattagccttagctaacggcgctaaaacttataaattacagtacggccaccgaggattgaatcaccccgttaaaaatattgcgactggcaaaacgattttaaccagccaaaatcatggctacgcggtggcagctgattcattggctgatacgcctttacagatgaccgcttatgaattaaacgaccacagtgttgaaggcctgcgccacgaaagtttaccggtaatttcggtccaataccatcctgaagctaatcctgggccaacggatgcactgggtttcttcactgaattttgcaccctaatgaacaccaataaaacgaagaaaagtagcgtggcttagcggccttaaccgaataaattgatcttaaatcgtgaaggaagaatgcaaatgccgaaattaactaatattcataaaattgctgtcatcggctctggcccgatcgtgattggccaagccgctgaatttgattatgctggtagccaagcttgcttgagtttaaaagaagaaggttaccaggttgttttgatcaactctaacccagcgacgatcatgaccgacgatgaaattgccgataaagtttatttagaaccattgaccttagaatcagtcagcgcgattctagccaaagaacggcctgacgcgttgctccccacactcggtggtcaaactgggctaaatctagccgttgaattggacgacgcaggtatactagccaagtacaacattcaattacttggcacaggtctagcaacgatcaaacaggccgaagaccgggaaagctttaaagaattgatgcaaaaaatcggccagccgatccccgccagcaaaacggtccacgccgtccaagctgcgttggattttgctcacgagattggctacccagttatcgtacggccagcttacacgcttggcggtactggcggtggcattgccgctgatgctgcagaattgcagaaaatcatggtccgtggcttaagcatgtcgccagccaatgaatgcctgattgaaaaaagtattgccggctttaaagaaatcgaatatgaagttatgcgcgataatctcggtgataaaatcaccgtctgcaacatggaaaacttcgaccctgttggtattcatactggcgattcgatcgtttttgcgccttcacaaaccttaaacgacaccgagtaccaaactttgcgccaagcatcgttggatatcatcgatgcactggacatcaagggcggctgcaacgtccaattagctcaagatcctaatagcgaacactactacgtgatcgaagttaatccacgggtcagtcgttcgtccgcattagcctccaaagcaactggctatccgatcgccaagatcgccgccaagatcgccgtcggtttgaatttaagcgaactgcgcaatcccgttactaaaaccacttacgctgcctttgaaccagcattagattacgttgttgccaaaatcccccgcttcccctttgataaattcaacactgccgagcggaaattaggcacacaaatgaaagccactggggaagtcatgggtatcggcagcacgatcgaagaatcgctgttaaaagcgttgcaatcaatggagatcgaccaagcagcgatcaatcagcttaaacctagcaccgtcacaccagatctagctgctgctttgcacacatcgactgacgatcgattgctggttatttttgcggccttacgcgctggttatagcgtggataaaattcaaacgctgacgcagatcgaccgctttttcttggacaagttagcccacatcgtcaccttgcagcaacaattagcgcaagatctaactgcaaattacaccaccgccaaaaaattcggttttaacgatgcgatgatcagcgccgtcactactgaaccgttgcccagattggcgccagtttacaaaatggttgacacttgtgccgacgaatttgccagcagcacgccttatttttacagcacttattttggcagtgaaaacgaaagccaaccgctcggcagcagtattttagtaattggctcgggcccaattcggatcggccaaggcgttgaattcgactacaccaccgttcactgtgtccaagcaattcaacaagctggctaccacgcaatcatcgttaacaacaatccagaaacggtttcgactgacttttcgatctccgacaaactatatttcgaaccgttaacgttagaaagtgtgctgcacattgccgaattagaacagccactaggcgtgatcgttcagttcggtggtcaaacggcaatcaatttgactgcaggtttagtggccaacgggctaaaaattcttggtacttccttacatggcatcgaacaaactgaggaccgccatcaatttgaagctcttttacaacacttaaacgtgaaacagccggccggtaacactgctactagcttagcagcagccagcaaaattgccgctaagatcggctatcccgtgatggtacggccaagctttgtcctcggtggccgggcaatggcgatcgttcatgacaaaacggaattggctcattatttgaccaacgccttacacgcggcaccagagcagccgatcctgattgatcattacgttcaagggttagaatgcgaagtcgatattctcagcgatggtcacgatgtctttattcccggtatcatggaacatatcgaaggtgcgggcattcattctggcgactcgatcgccgtttacccaccgcagcgcttgactgcagtgcaacaagctgagatcgtatcgatcgccactaaaatcgggcaaaacgtccattgtattggcatgatgaacattcaatttatcgttgctgatcaagtctacgtcatcgaggtcaacccccgggctagtcggacagtaccttttatgagcaaagtcactaaattgcatttagctaaaattgcgacgcgtttgatcctgggtgcaaactttgcagaattaggcctaacaccagggttgttgacaccaccaaacttagttgccattaaagcgccggtattctccttcactaagttaccgggcatcagcactgcgttgagtccagaaatgaaatccaccggcgaatcgatcggtatcgccactgattacgccacggcgctaggcaaagcattgaccgacagttatcattttcatggcagtcacgctgggcaattcgtcttgctaacacctaccctagctgcagatacgactgtacttcaagaaattgcgcacgcccagttagtaccgcaagtcctgactgccgatacagttcccgaagtggcggcagaacaagtggcgttggtagccaataccaacgatcaccaaactgccgctgacccgctgaactattttgctcttagtcagaatattccgctgttcaccgccaaagatacgctacttgccgcactaacagtgaattaacaaaatgaaccgcacaccctttttggatgtgcggttcattttatgctattatacgttgcgcaactgtttaggctcacgcaaaaccaaatgtcctacaactgcaatcaccagaaaaattgcggctacactgcaaacgccgccccaaccatagtgactccaggcaaacgtactaaagaaagtccctagcgcaccacctaaaaaataactaaacataaaaatcgaattgttacggctgctggccttacgattcaacgactgcacgattgcctgattagagacttgactgaattgcgtccctagatccagcaaaacgatccccaccatcaagccaataaaaaagtggcctaagactgcaaaaacaagaaaagcaaccgttgagaagacaatccctaaactaattgttaaccgtggtgaataacgatcaactaactggccaatgatcgaagcgaataatacccctgtaattcccagtaagcctaataatccagcaacatcactgcccatatgatactgggccgccaagtaaaaagccaacgttgaccacaagacattagaaacgccaaacaaacaaaagccgttgatcgcagcactctgtagataccgttgttgccgcaataatgtaggtaacgaccctaaaacctttaaatactgtaaattaggctgttgccgggagtcgcgaggtaaataacgatgcaggaccactaacaaaataacgccagccgcagcggcgaacaaataaacaaattgccaacgcataacactgcctaataaaccactaaccgagcgcgataataaaatccccgttaacaacccacttaacacattgcccagcactttaccttgatgcaaagccggtgctagggaagccgcataagggatgataatttgtggcgcgactgaagtaacacctactagtaacgatgcaataccaaaaacaacgattgatggcgaccagaaagctactaataaagcaatgatcgataaaaccagcattgcttggatcaaatgataacgattaaataaatcacctagtggtacgatcaataataggccaaacgcgtaacctaattgcgtcaacatcgcaactattcccacggttgcttttgaaacatgaaaactagctgcgatcaacccttcaatcggctgaatataattgagattcgccacaataacgccagcagcgattgccattaatagaactgttttaccagataatgttttttctgaattcaaatcaataccttctctgcagtcaaaatttttaactaactaaaattccgatcataccgaaaaaggattttcaatgcgcataattaaccaatgaaataaccgcttgctcaacacgacgctacaacctccatttttaaaaactgtcgctaaatagttctgcttagctagcataatttagcaacaatgcttagtataactcaaaaatagattgcactacaatattaatacagcaatagtttcatgaaaatcacgataataatagctcaaatccacctaacgttttggctgatttaaattgcacaatcttttcgcttgccaaataaatcagttgccgctatgctaatgatgaaaaattagcatgggaggtcagcacaatgacagtgagcaaaagcaatgcaaaagttggtatgatcgtcaccgttaaagccaccgaagatatgcaagccccatttaaaggtcgcatcgaaaaagtctacgaaaacgccgctttactgacgatcaccgattatgatgcccgtgatgaactaaacgttaaagccttacatgataaaatcgtcgtgagtttgaaacaattgaaaaaagtgagttaaaaaagaaaatcgacagtacagcgaaattattcgttgtactgccgatttttactttttctgtatcgtttgccggtaactgatccaagcagcaaacagaccaatgatcgccaaaacagcgatcaaccagtagtccgttaaggcgccttgggctgtgctaatgcgcaaattaatgtgctgcaactgatagactccgatgattgcagcaaaaatattggtacctaacgaacccgcgtattgctgcgtcatgttgaaagtagcgttgatatccgccttttgttttggttggacttgtacgctggcatgactgatcgtattgccaaacgctaagttgaagcctaaccgcaacaggaagtaaaaaccgatcaataatgcgacggtcaactgctgatcataaataataaatagtgctgcaccaatcagaaaaatgacgtgaccaactacgatcggtaatggcgtctgcaatcgatccatccagcgaccagcaagtggcgccaccaccacacctaatagtgcgccaggcaataagatcatcccggcaacaaaggcattttgaccaagaatatattgcgccacctgcggaatgacaaacgacaagccaatattgatgaattgcaataaaaagtagcctaataaatgccaactaacgatggtatttttaaaaattgagaaatccactaaatgacggctagaatggcgattataaacgtaaaagccaaccatcaaaagtacactgatcagtagtaagccccagaaattccagctaagaaaaccaaccttagcggcccggttaaaagtataatcaaccaaaaacaaaattaaagccaacaagccaaagccccagaaatcaaagcgatcttctttggcaaagggttggagcttgagattaaaaataccaagaaaaaagacgatcacgatcaacggtaataatagccaaaaaatcatccgccacgaccaagtcgccgttaacaaaccaccatatgtcggccctaacgctggtcccaatgcaatcaacattgccgccattccgttataagtggctaagcgccgcggtggtaccgacgtcaaaataatgtggaacatcaacgggatcgataaccctgtagaaaaagcttgaatcaagcgtcccagcaaaataattggaaaacttggtgccaccgcactaagtaaatcacccagtgtgaagcacgtgatcgcaatcaaaaatagcgttttgaccggatagcgtttgatcaaatgtgccgaagcgatcatcgtcaatgttgttaacagcaaataaccagtcgtcagccactggatcgtggctaaattaacctgcatttgcttagtcaatgtcgcaaaggtcacatttaatgacgtttcaactaaagtacccataaaactcaataaacccgtagcgataatacttaaaactgtcgcccgggaaagacgctgctgcatttgtcatcccagctttcaaaataattaataatccgttaaagcctaacagaaatattttaaaataaaaaaagtcacactcattccaagtgtgacgtcactaacttaaaacaaaactcattcactttaatgtaactattataaaactaaatcaattcatcttcaactggcccagcagtcttagcgggcattttcttaggcaagacttgattcaagaggattgctaacaaggcactcacggcaattggtgaactcaacaaatattgaatcagctggggtgcttccttcgttagttggctggggatcaaaatcaacgccagcgtcataataatcggaatacctaagatgtacagatcacgttcagcaaactcttgctgccgaatcacctgcaagccacttaacataatggttgaacaaataattgcaaaaaccccaccaataactgctgcaggaattgcggctaagaaagccgctaatttaccgataaagctaaaaccgataaaccaaatccccgccgcaataaaggcttttttactggcaacaccagtgatcgaaaccacgccggcattcgtcgaataaccagttaccggtgtggctccagctaaagcagcaatcaagcaactgatcccttcaccgataataccgcgattccattgcttatcggacattggtttatgcaacacggcactcatggcaaaccaagtaccagaagtttccgtcaatagtaccgcatagatcacgaccatggttaaaatggctgacaatgagaaatgaaaaccataattagtgaccgcaaaatgtggcaaactgaaccactgggcatcgatcaccgttttaaacgaaaagcggcccattgccgccgcaatcagcgaaccaccaagtaaggcaatgatgatcgaactcactttaaaaacacgttctaaccgcggaaaccgcaggctgattgccacacataaaactaagattgcggcagtcaacacaccaagcagaacgttttggtttaagttaccgctggcttgaaaaatattatcgtttaatgctgaaggaatcaatgacaaaccaaccaccgtaatgatcgtaccaccaaccaatgacggcactaatttacgaatgattttttggaaaaaaccagttaagccgaataggatcactaaaacagcgccaactaataacgaaccaaacactgttgctaagccgttacgaccaccaccattagctaagtagattccagcaattgccccaattggcacaaatgatggtccttgtgtcatcggcatcttcatgaaaaaccttgtttgtaaaattgttccgattccggccgcaaaaaaagttgcttgaattagacccattttagcatccatactcattgccaataaaccagcaatgatgaatggtggtacgtatacatccattgccaacacatgctgcaaccctaataatgctgcagtatgattcttcaatggttcatcaggtccgacaattaaatttttttcgcttgccaaaataattccctccattgttcgttttctacgctattagagcctataaaaagttttattattcgtttatcatcggtaataagcgaataaataggttgaaaacagtatatgactatagttaggaatattcaagaacaaatttgcacttaatgttctgttatagtatcaatcctttgcgcaactagtgcttatttagtacacttttctgaaaaatcttgattgatcgatttaccaaccattaattgttgctgtcaccccataatcggccagtattgtctgataatgtaataaatcgtcgctttgcaattgactaacattctttagagcataatcacgttggagatcatggtatttttttaacccaaattgatgaaatggcaataattctacagcagtcacaccgatatgctgaaacagctcaccaaatttatgtgcatcggctgctgtatagttgaaatgtggaataaccggaatgcgtaccgttaaaggttgccgcgcggcaagtgccgtctgtaagtttttgaggatcaactcattaccgccaccagtaccgcgtcgatgttgctcgctattccaatgtttgcaatcaaaatacataaaatccatttgctgcataaattcttgaaatacggctggggccgcataaccagttgtctcgcagatcacactgatccccgctgcatggattgctttagccaactcaatggcaaacggcgcctgaaacaaaacttcaccaccagaaaaagtaaccccaccaccagattcagcataaaaatcgcgatcctgtaagatcactgccataatctcagccaccgttttgtattcgccaatcatggttggtgcttgcttttgttcatcatacatggactccggctttccagattgtgactctggattagcacaccattgacaacgtagcggacaacctttaaaaaagataaccgtgcgaatacctggaccatcatttaagctaaacttttggatattaaaaattaaacctttactaggagcagccttttgtgttgttttcatcattacgcacctccgttttcgcttatatcatagcatcaaaatattctaacgtaaatatttatatttcttacgaaacttttttaaatgcaaatttatgctaaaataaagtgaataagttttgatcaggaggtcaatatgtcaaaacgcagtgaacaattattggagctcgttaaccagaataaaaaaattgaagttaatcgtttagccgagttattacaagtttctaaagtcacaattcgcaaagatttgactgatttagaacaacgtgggttattacgtcgccgccacggttacgctattattaacaatccggataatttaagcttccgtctagcccaaaactacgatactaaaatcaagattgcgcgtaccgccgctgcacaggtcgccgaaaatgaaacgatcatgatcgagtctggctcaacctgtgctttattagctgagcaattagggcaacaaaaaaaacacgtcaccatcattaccaactcctatttcattgccaactttgttgaaaaattcgatagtattgaaacgattttactcggtggcaaataccagcctagcgccgaagtcgttgttggaccactagctaaaatgttactacccaattttcacgttaaacaattattcatcggcaccgatggttttgccgctgacaccggctttttcggcaatgatttaatgcgcgctgagatcgttcaagctatggtccaacaagctgatcgaacgattattctaaccgattctagtaagttcaaaacgttaggcgtcgttaaacaattgccactttccgcaattgctgcagtcatcacagacccacaaattcccactgctaccgttaacttacttaaacaacaaaaaattaaattacacctggtttaatttaaaacacgctaaggccgcttccagatttttttcaggtttggtgattaagcgtacaaagataaaattagttgggtgccggtgcgtaaccgataatttcgataatttaaaattgaatcgtatctaccagcaaaaacactgatgaaaagtgaatcatttttcatcggtgttttttgtattataactaaagtcgctactacgcaaaaaaataattttaaattcaactgtaggcctgatggagtaacatctagcgtattccgtggctttttagccagtcttgagagtgaatcctgctcacacgccactcttttttattttgcattttaattataatcatgttattcttatttcgttagaagatatttaagtttcgttcgataggagaaactaaaatgcaagttgctgaaaaaacagttgaaagacactttggtcgcttaagtccgcggatggcccgctaccgggaaacgatccttgatgctaagccctacgttgatgcagaacgcgctattctcaccacccaagcctacaaagcacatcagcatgaacaagtcgatgttttacgcgcagaaacgctagtcaatattctagaacatatgtcgatctacattgaacccgatactttgctagctggtaaccaagcacggcaaaatcgctgggcaccaatttatcctgaatactcaatgaattgggtgatcgacgaactagatcagtttgaaaaacggcccggcgatgttttttacatcgctgaagaaaccaaacaacaattgcgtgaaattgcgcccttctggcaaaacaacacgcttgaagatcgcggttacgctgcctttccaccagaaagtcgcttattttacgatttagggatcatcggtgcagacggcaacattacttcaggtgatggccacattgcggtcgattataaaaatgtaatcaataaaggactaaaatggtacgaacagcgtgttaaaaatgccatggcacaactagaattaactgacattaatgatcagaaaaaactttacttctatcaagctagtttaaaagtgatcactgcagtcaaagattttgctcaacgatatgctactttggctcggcaacaggcacaagaaattaccgatactaaacgtaaaaatgaacgacttaaattagcacaaattttagaaaaagttccttacgaacctgccacgactttctacgaagcaattcaatcagtttggctcgttcacttagtactacagatcgaatcaaatggtcattccgtttcctatggtcgtttggatcaatacctgtatcctttttatcaacacgatattgaaagcggcaccattgatgctgaacaggcaactgagttattgaccaacctctgtctaaaaacattgaccattaataaaattcgttcttgggcgcataccgaattttctgccggtagcccactttatcaaaatatcacgattggtggtcaaacaccggacggaaaagatgccgtcaatccactttcttacttaattttgcgggcaatcgcacaagcacatttaccacagcctaatttgaccgtacggtatcataaagggcttagcgataaatttatgcttgaatgtgttgcagtgatcaaacaaggcctaggcatgcctgcctttaacaatgacgaaatcatcatcccttcattcattcggcgtggcgtcaagaaagaagatgcctataactatagcgcgattggttgtgttgaaacggcggttcctggcaaatggggttatcgttgcaccggtatgagcttcattaatttcccacggacgctattgatcgtcatgaataatggcgttgatccagaatccggtaaacgcgtattacctggctatggtaactttacagctatgcaaagttatgccgagctcaccgctgcctggaacaaatcattacgcgagatcactcgtcaaagcgtcatcattgaaaatagttgcgatctcgctttagagcaaggctatcctgatatcctgtgttcaacgttgactgatgattgtattggtcgtggtaaaacaatcaaggaaggcggcgctgtttacgactttatcagtggtttacaagttgggattgctaacttagcggactccctagctgcaatcaagaaactagttttcgatgaacacaaaatcaccccaactgaattatggaccgcattgcaaaataattttgctggcactgaaggtgcacgaattcaacaaatgttgctcaatgacgcaccaaaatatggtaatgacgatgactacgttgataatttgattgttgctgcttaccaaccttatatcgatgaaattgctaaatacaaaaatacgcgctatggacgcggtccaattggtggtctgcgctacgccggcacctcatcgatctccgctaacgttggtcaaggccacagcaccttagccacacctgatggccgcaacgcccggacacctttagctgaaggttgctcacccgaacacgcaatggatattgacggccccactgctgttttcaaatcagtttcaaaattatcaaccggtgatatcactggcggtgtactattaaatcaaaaaatgtcgccacaaatcttacgtagcaaagaaagttgcttaaagctgatcgcactattgcggaccttctttaatcgactacacggctaccatgttcaatacaacatcgtgtctcgagatactttgattgccgctcagaaaaagccagccgattaccgcgacttgattgttcgtgtcgctggttattccgcctttttcgttggcttatctaaagaaacccaagacgatattatcgctcggactgaacaatcattatagagaaagaagctgttactatggaatttctgcttgataccattcatttagctgatattgaaagatacaccaagtgcctgccgatagcgggagtaacctctaacccaacgatcgttaagaaagaaggcaaaattgactttttcccacatatgcgaaaaatccgccaacttatcggaccaaaggccacgctacatgttcaagttgttggtcaaacacctgaagcaatgttggccgatgcgcacaccattttaaaaaacatcgatgaatccgtctacattaaagtgccaactaccgaacttggtttacaggtcattaaacaattaaaggctgaaggccaccatgtgactgccactgcaatctacactaaattccaaggctacttggcaattgccgctggcgctgattatattgccccctattacaatcggatggaaaatatgaatttagatgccgctactgctgtagctgaatttgccaaactaattcaacaaaacaatgctaatactaaaattttagcagctagttttcacaatgtcggtcaagtcaacaccgcattcgaaaatggtgcacaggcagccacaatgggcgtcgatattattcaagctgcgttgcaaatgcctgctattgatcaagccgttaaagctttcaccagtgattgggaaagcatttatgggccacaacaaactattcatgatctataactataaaaaagacgaccagcggcagaaataccgcggtcgcctttttcattcaaagttgttttagtcttattttaaattaaactaacgcttgtacacgccgttcgatctcatcacgcacctgacgaaaaacggttaaaatttccgcttcactgccttgcgcctgtgctggatcaggtagcggccaatgttgctttttaactgtcggtggcgtaacgggacaacgatcgcgcgcatcaccacataaggtgaccactaaatcgctgctgttcaaatagtcaatatcgatcagtttggaatgatattggctgatgtcgatccctttttcagccatcacttgcactgcgcgcggattgagcccatgagtttcgatcccggcgctagcgattcgccactgctgaccaaaatattgtcgggcaaaaccttccgccatttgactgcgacaagaattgccggtacagagaaaataaatttgcggcatagcactcaactcctttttgctttcattatgctatattggaaaagaaagctcaatgaaaggatgacaaaaatgactttacaaacagaactaatgcaacgtctagacgctgctgaagatgaaatgatcacaattcggcgtcatttgcacgcgcacccagaactatcatttcatgaaaaagaaaccgcagcttatattaaacaattttatcaggtccttgactgtcaggtaagtgattgcggtgatggctatggtatcgtcgttgatattgctgggggttatccaggcccaaaactcgctttgcgcgcagattttgacgccttggcggttcaagaagctaatcagttaccatttaaatcacaaaaccccggcgtcatgcacgcttgcggacacgatgcccatacagcttatttaatggtactagccaaaaatttaattgcactgaaggcacaactacatggctcattacgcattttacatcagccagctgaagaagtgtcgcccggtggcgctaaaggcatgattgctgctggctgcttgagtgatgtcactaatgtgatcggcctccacgtgatgacttccatgcccaccggcacgatcggttaccatttaggtgaaagtcaaaccggccgttctaacttcacagttaagtttaccggtaaaggtggtcacgcctcaatgccgcaattagctaatgatgcaatcgttgctggcagttacttcgtcaccgcgctacaaacgatcgttgcgcggcggatcaatcccttcgatactgctagcgttacgattggctcatttgatggcgccggcagtttcaacgcaatcaaagaaagtatcaccatcaagggtgacgtgcgcgtgatgcaagaaagtacgcgccaactagttcgggcacaagtggaacaaatcattcacggcgttgaagcgatgtttggcgtgaccgcgcaactcgactatgacgacaactaccccgtcttagtcaacgagccaaaattgacccagcatgttgtcagcgttcttgagcaagctaatttaccggagatcagcaccgttaccgattacggcccgcaagacccttcagaggacttcgcttattatgcacaacaagtcccgagctgctttttctacgtcggttgcatgccagatgatcacgccaatcatccccatcacagccctgactttctactcaatgaaaagagcctgctgattgcggccaaggcagccggtacggtggcactagattatttatccgcctaattaattacggccaggctagaaaagcgttcatactctgaacgcttttttgatctactctggtttgataccagcgctttagctgtgttattacagcaataatgctatgatagagctacaattagtcactcatcgtttaaccaaggaggcgcgctttatgcctaataaaccaacgagctggtttaaccgactttttctgaataacaaagcaacgatttacttattaaatattttactcggtttactcgtcatttggatcgccagcaaactcacttggatactagagccggtggggcaatttctagccattgttgccccgccgatcattgtcgctggtgttctgtactatttactcgttcccctcgtcaacttattggaacgtcattggcacgttaaccgttcattgacgatcggcgttttattcatcgtattagttattttgatcagtctcggcatgcggcgatttattcccgccgttcagcagcagatcagtagttttgccagtgccgcaccccaatactggcgtgagctgactaaaatcgtaactaatattgccgatgaacaacactggcccgattttatcgacatgaatcaaattggtaaagatctaactgctttcttcggtggcaaaagcggtaacttagtcggtggtactttctcccaactcggctcaattctcagcactgtcggcaacgttgtgatcactatcgcaacggcaccctttttgctattttttatgttgaaagatggccctaattttcctaagtacatcgctaaattattaccggaacgctaccaagcaactttattggatttactcaatgagatcagtaccaaagttggccaatacattcaaggccaattgacagttgcctttttcgtctcgatcatttttatgatcggctacagcgtgattgggttaagatttgcgctggtgcttggtttattagcgggaccattgaatttaatcccttatttgggttcaacactggcgatgattcccgccttaattttaggtgcgttgacctcattacaaatgtttatcgccgtcatcgtcgtttttttcatcgaatggttactagaaacacaagtgatctcaccactagtcatgggcagcaatatggcgatgcacccagtgacaatcgcaatcgttttattaacagccggaaaattatttggcttagtcggcgttattctagggattcccggctatgcggtgctaaagatcatcatcagtcgcttgttcaattggtatcgtaagcgctcaagctggtatcatccacacactgacgacgaagcttagtgtatcttaaaaaagttgcaacttaaattagtgctttttcagccttgcgctagaatgggaagtcaatgagaatttgcctatattttgctaaatctactcagaatttgtacatgaattacccttctgctgtataatttggtaatgtgattacgtgttagctaggaaacctgcctttgggctgctaatacgtagccgtccactttattatataaacaattgggggcattatttatgggactgcgcgaacgcaaaaaagcgctcaagcgtcaagagatcgttaccgtcgcgatggatctattcgatcagaagggcttcgataaagtaactgttgccgagatcgccaagcaagccggtatcgcaccaaaaacgctatttacctacttcaaaagtaaagatgacattatgtttcataacgaaaccattctgcttagcggaattcgtcatttaattcagcaacaaacatcgatcgcaaatctgtggccggcctttcaccaattcactgaagaattgccaactgatgaggccactcaaggtgcgctagaagcgatgcgccaattaatggccaacgttattcgcaatccagagctaggcaatcgccgcttacaaatgtgggccacttatgaaacgcagatccaagcggccttgatcgagcaacgtctaactgattcgttaacggcacaagtgttagcccatcaaatgatcttagtcttgcagatcatgttcgccgaagaagttcccgacgatttctggcaggcgcgcgtcacccgaattttcaacgccaccagtcaagtggctagcttgaccaatgaagtcgatatgacactctagcagcctaaagcaattgtaatttagagagactatgccataataaattatggtcccaaattgcaagaacaaattagccacacgataaatcctattaaatcagtattttcattaatattcatattttatggacttaacttaaccggcggaagcagcggagaaaagcgctttgggtgt

SEQ ID NO: 524 - DNA, 1439 bp, Unknown
  Metagenome-assembled genome
aagataaagcaggcgtctataccattccgccaaaggaaaataccaaagacaagtggacctgtgattaccacgtttattgtgagcgccatttgattgagaacttcttcaatcagttgaagaactttcgtaggattgcaacgcgttatgataagctcgctcatgtttatctggctacggtctacattgcctcaatttgcatcttacttaagtagttttcagacggaccctagtcgaagaatattataataactagttatcttatctctttatcgttgctatgccggctttgacaatcaaaacagatgaacttgactgcaaagtttgcctgattttttattatttttacagttattcccacagtccttgtctttctttacaaatcaaagaataacaaaaaagccaccttgtctgaggtggcttttttgcgtaactataacttttctgtaatataatctaacattttaaacagtactcttttattctcaataggtacagttttttttagaatatcagtagcagattgaccaagtaccgaattttttatatatgggaagtcattaacaaccatttcacgtacattatcagcttggggttcaaaatggaactgtaaaccaataactcggtgattcagcacaaatccctgatttttaacagctttacttgagaaaagaagttgagcctcatatgggatttcaaacatttcttcatgccaatgcaaagctaataattcgtctggcaaatcaggaattaccatacttttacgataaactggagcccaccctacttctttagcaggagatttggtaacagcgtatcctagtgttttagtaatttgttgagcaccataacagacaccaaacattggaacattcctatctaaaagaccttggattaactcacgttcctgtttaatccattgaagatcgtcatttggactcattggaccacctaaaataactaacatatcagttttttctgctgtcggcaaatatccaaatcgatatgggtgatagatatatacttgatgattatggatttgagcccagtctaaaatagcccctggtccttcattaggtgtatgttgtaagacatttattcgcatataaaatcctctccacactaaaagtgccaacggcaatttgatatgggtttcgcctgcaactgccctaaattacgataaattataactcaacttgaaaataattgaaagagatgaattcaaccaacactataattgataactatataaagaactaaaggttgaaagtatcaaatagaccataaccattgatgttaaacggttatggcacgatatattactagtttccacttcattgagcattaccgagtagcctggccaggctactcggtaatgcttttataaattcgtcaaaaataatagttaatgtttcaaccgccatgtcgagtttttcacctag

SEQ ID NO: 525 - DNA, 6461 bp, Unknown
  Metagenome-assembled genome
tattcgccacatgaacgaggcagtaatgaaaatcgcaaccgagtactacgccgcttcattcccaaaggtcaaccgattgatgagattaccgatgatgaattgattcaaattaactggtatttgaattgccgaccactcaaatgtttaaattggcgaacaccgattgagatctttttgcgtaatctgcgttactaaatttgttcaagttatttcttgcaatctgccatgaataaaaaaggccaagaaaagtattttcttggcctttttaatgcatttatttaatttgatacgttgtatccaacagttcaactttagcgcgcaagccagcggttaaatagatctgctgatttttagtcacgtaaatagcggctaaattcggctgttgtgcgatcaatttagtactgcttaagccttggtaaaaggcgattgtcgtccaaatatcagcggtcagtgagtctggggcaatgatggtcacgctagctaaattattggcgatcgggtagccagtttgactgtcgaacatatgatgataatcgtgaccgtcaatttgcagatgacgctcataaataccggaagtgaccaccgccgcggccccagtggttaagcgtaggatcatgtggccgcgttgctgttgtggtgattgaatgccaacgcgccactgctgctggccaactaatagaatattgccaccgagatcgataatcccttcagccacgcctcgttgctgccataatgtacggatcgcatcagcaatatagcctttggcgatggcaccgaggtcaagttccatgccgggttgccgcagccaaacactttgctgctgatcatttagtacgatttgttgcggatcgatcaacggcaatttagcggcaattgcttctggactaggtttacgggcatcgctaaaaccgatgtgccacaatttaactagcggaccgatggcggcattgaagcctaaagcttgttgactgaccttgaccgctgttttgaccaattgataggtcaacgttgaaacttgaactgcgtgccgaccggcggcatgattgatcgtcattacttctgactgtggccgattaacggtcagcacatcttcataatgttggatcaaatggtaagccgcttcaatatcagctaccgttgccggcgcaaaaacagttaagttgatcaaggtgccgagcgcaaaataacttttcttaattggttgcattgtttatgcgtggacggttttagctaaggcatttttaacggcgctcttgatcgcgttgctggaagctgaggcaccagaaaccgcatcaacatcgtagctattggttgcaaccattttagctggtaattgttcgactgctgctttgccgacatcttcactttcactttgtttaacgacttcaactgcttggatcttatcgtcagcgtaagtgacacgaacaaccacttggccaccaataccggcttcactgacacctaaatattggttggggccgacactgataccagctaatgaatcctcgctgcttaaatcattgccgccaagatcgacgttagcggttgttgttactggcgcaaccgtcgtttcacctttggcttttgcggcattttcaccggcaattttaccgaagatcaagcattcggctaagttactgccaccggcgtattggttagcgttggcgccaccaagttcaccagcaccgtataaatgcggaattggttgttgctttgtgtttaagatttctgcttttgcgttgcgtcgtggaccaccttgagtgttcaacatgccggattctaatttaacagcatagtatggaccagcagcgaaagcccgcatcgttgcagcatcacgatgctgactgtagtcaacaccatttttggcaaaactattaaattcagtcacggtttgttgtaaaacgtcagggttcaattgcgtttgcgccgctaaatcagccaagctatctgctttgatcacacgactgaagaaatcaggatcaggtaattgttttgcggccttaaattgatcatattgtttttgatcgaaaatcaaataaggatgatcttgcgctgttgggatccgccaagtaccgtgatcatacaagcgaccgtggcggttggcttcatcttcacggaagtaacgactaccatcgtcaccgaccacaaaaatactgccggtgtacagatcaggccaaggcgctaaaattaatttgcctcgttcgccgggatgggtggcaaacgtcataccggaaagcaggcctaaaccttcataactcttcatatgccacatgtcagcgccaatttcttcggccattttaatgccgtcgccttggttatacaaagtgccgatcggtgccaaatgtggggcgcctaaatagtcttggattgcttgcttgtcagtttcaaaaccgccgcaagccaagacgaccccgtttttagcctgtatgttgacgctttgaccgttacgcttgatcgtgaccccaatgattgcttttgtagttggatcttgaatcaaatgttgcgctggagaagctaaccaaacatcgatattttggttgcggtcaacaacgtgttggcgtaagtttttccataaagcagcgtcgaagaaaccttcgtgcacggtggttagatcaaatgtatcggcaccttcatattccggatattcaggcgctaagcctttagctacttcgccacgagaaccatttttgtaggtgtcgttgtagctaactggttcaacatcgaggtaatcgcggaagtattggcgcatattgaccataccgtgaacgtaggtctgcaataagtcagaatctaaatcaattggaccgagcatggctttatagtaagccagcattttgtcgtagtcggagccagtagcaacgacttggccagcgtagcggacattgccgccttcgtgaccttctggagcggcatcggtcaataagactttcgcaccgttatcagcggcaaagcgggcggcagttgcaccagcagcaccgaaaccaataacgatgacatcataggcaccattccaagttgtttttgcagccaattttggggcttcctttcgatatgtgtgattgatcacacgagcaaaatcaagataatgcgtgaaacattcttctaaaaagctgatcgtctgggcgtcttttaactgttgatcgccgtcaaaggcttccttaacgtgacccagtaagaattcattgccaggtaagacgatcgcaccgacaccaggtgaatctaaaatttgacgcaaatgttgctgcgcccgtgaagtgccttgaggaccatacgaggcaccgacgatcatgactggtttgtgggtcagtgggtgtaccttacaagatagccactcgatcgcacttttaagggctgccggaatagaatgatcatattccggagtggcgatgatcacaccatcagcggcgtcaatttttgcggctaattgagccacgctgtcaggtgttggcgtgacgatattttcattgaataatggtaattgattaatttcacaaatttcgatcgcgtgctgcgcgccgaagtgtttttgcatgtattggagcaaaatacgattggttgaatagtccgcatttgtaccaacgataccaataaatttcattgaataaccctctttgatagtaatttttgggccaaggatttctgatgttatggtcgctgaccttactgatggcggcaatcacgcttatcaaaaacgtggctttgtaatatattctataaacgatataacgtgtttttatgcacggaaagtaatatctcttttgaagattattaggattaaattaaccttcattctctatactagtccattttaacaaattgtgaaataattattttgtgttaaagttatgctgtttttggcatataatgaatttatctagtagaatgaggtgaacggggtatgacaccattagcaaaagataaacagtttatcgcgattttagaggcggtggctaaattgggtaatattactgcagccgctgaggcattatttatgacccagccagccgtcagcaaaattattcagcaacgggaaaatcatttggaaacgcgcttgatcgaacggcgccatcatccactgcaattgacttatgcgggcgaatattatttacaacgactacagcatattactgctcaatatgattcactgtatcatggcctggccacgctaaatgaagcagggcacgggcgtttgacaatcggtgtgacccagtcattaggggcgcagatcttgccccaactattaccgcagtaccacgctacttaccccaatgtggagttgcgtttggtcgaatatcctagcagtgaagtagaaaatgaactggctaatgacaatttagatttatatatcggcgttttaccagtggataatcataaaattcactatcaattgtttgagcgcgagccgatttatttgctggtaccacctagccacccggcataccgtaagcccaccaaggcagtgacggtgatcaatgattgccgcgatttaattgaccggcagccattaattttggaaaacgaaaattcgggctttcaacgtttgatcgcagaatatttagccaaaaataatattgatccacaaatcgctttacgcacggccagtttggatacggggatcaaattggtgcagcacaacttcactgccgcaacgtttgtaccgtactcggtttggcagagtcatccagcaacagcagcattagcaacttatcaattagcgaccacggagttacaaagcgaaacagtgatcgcttataaacgtgaccgcctgctgacgaagcaggaaaaggcatttatcgatttggcagtggtagttgggcgaggagtttagcaaatttatagtgtggtgtatttcgcatgatttgctgaaagtaacgttgatatttaaattaggcgtatctctagctatgcataattgtaatagataaccataacaaataagtatgttgttgggtcaaagttgtggcttacaatatatgtataaatgttatttaactacagaaggagaaatgtttatgcctgaaactaaagtagcagcgctggaagcaactggatctgatttcaaaacttttcatcatactataatcaaaagaagagcattacgaccagatgatgtggcaattgacattaaatattgtggaatttgtcactcagacatctcaatcgttgaaggaattgatagtatctttaagcgcccaattgtgccagggcacgaaatatcgggaatcgttagtgctattggccaaaatgttcataagtttaatgttggcgatcgagtaggtgtaggttgttttgttgattcgtgcggcaaatgtaaatattgccaagccggcgaagaacaattctgtgaaaagggcgttatttctgtatttgttggcgatgattatgctggtaatcaatcagaaggcggctactctcaatctatcattgttaaagatcgctttgttttatcaattcccgataagctagatttagctgaagctaacccgttactttgtgctggtatcacaacatataatcctttaaaacgttatggtataaagaaaggatctaaagtggcgattgttggtttaggcggattaggtcatatcgctacccagtttgctaataagatgggtgcggaggttacagtgattggacaatcagaatcaaaagccaacgaagcaaaagaatttggcgctaaagcgtatgagatactaaaaacgccagaagatttcactcgcttggatggtcaatttgattttcttcttagtacagttgcggttaagctagactggaatgagtattttaaattattgagcgttaaaggcattgcttgcagtgtcggcttgcctatcgaaaaccaagaatttagtttacaagcgatgtttaatcggcagaatacgttaatcgtatcgaatgttggcgggatcgcgttgacgcaagaaatgttaaattttgccgcggaaaatgatgttcatcctaaaatagaaatgatcggtattgatgatgtaccagccgcatatgaacgcattctgaatagtgatgttcactatcggttcgttatagatatgagtactttgaagaaatgatgtgggtcagtttgctaacagatgtttgtcgattttaaagtcactgtgtgaacggaaaaattagcgtaaaaataacggtgcagcagaatctaattagattttaccgcaccgttatttttatggctctttgtcaaatcctgttgatgaatagcttttacagagttgaaagtcatgcgactttcaactctgtttttttcattggttttgttctcatttgccgtaacttaatacgtgaaatcatatgatggtaattacggaatccaaatgctgtgcgttgaatttgtttaatcattcgattcatgccttcgactgggccattcgtatagtccgattcactggcgttgagtacaaccactaagttctttttgaacgtttgaaacactgctttcatgt

SEQ ID NO: 526 - DNA, 74864 bp, Unknown
  Metagenome-assembled genome
gccacgtaaaatcttcggctacaaatcggctaatgaattcttagctgaacagttgcttgcatgaccaacacctagaccacttataagtgaaatctagaaagtgttgcacttgatttgacaattcgggtaaagaaatcaatgcttaaattggtgataataagcggctgcctatgaggtagtcgttttttttttgctgcgttttgtttttttataatgaaatcgattgcatttctaatgggatagactatgctgggtgtagctttagtttaagttgtgtttttgccgcagtaacggtcgatactaggcacacttaaatttttaactttaaaaggaggcttcatgatgaaattacttgggagtttagtgatcattgttgctagtttaggcattatctatggtggattacgttatatacgtttcagtaaggctgcttttgctaaagccaacgttaaagttgattttactaaaacgccagctgcggtcggttttgcgccgggtattattggtgcgatcatcatgctagtcggttttgcaggctgtgtttggggcttaatgttattctaatcttgttttggggaccagcattagttggtccttttttattttcttagttctatgctatgattaaatttatgaaagcggatcaatatttggaggataagtaatgtataaactgatcgtatgtgatttagatgaaactttattggatcgtgacgcgcgaatttcgaaacaaaatgaacaggcaatcaaggcatttgttgcgcaaggtggccattttgtgccgaatactgggcgcagttttttatcgattcaagatgatttgcagcaattaggcttgttgcagcagccaggtcaatacgttatttcctataatggcggtgcaattgtggagaatgccggtaaccaggttttgacgaccaatccgcttgattttgccaccgttaagaagatctatgatattgcccgtgcagagcaggtcagcgggcatatttacacgttggaaaatctgtatgtttggcagccaagtgtggcggaacggcagtatttagatcagcgtggggttaaatatatgccggtgcctgatgacagcttagactttttgcgcacgcaaccgttgatgaaaattattttacaggatgacgattcggcacgacgtgaagcgcttggtcaagcaattcctaaacaggtaacaacaccgctagcaacgactttttcatcaggtcgttatgttgaatttaatcacgtggctgcggataaaggtaaggcgacgctgcaattggcagctaaattaagggttaagccggatgagatcatggctctaggcgataatagtaatgatctggccatgatcactgccgctgggctaggcgttagtgtgcaaaatggaacagatgtggtcaaggcggcggctgactatgtgacgactgcagactatgcgcatagtgccgtggctgaggcaattgaaaagtttgccttgcgctaaaaaattggttatgctgaaactggtttgaaacaacacagaagggaagttattttatgggacaaacgattccagaagttacgctaaataatggtgttaaaatgccacaatttggtttaggtgtatttaaagtcgataatgccactgatattaaaaattcgatcaagtgggcgttggctgacggttatcgcctgatcgatacggctatgatctatcaaaatgagcaatgggttggcgaagcaatcaaggaaagtggtgtgccacgtgaagacttgtttatcacttcaaaattgtggaactcagatcgtggctatgagggcacaaaggcagcattcgcagcaagtttacagcgtttaggcttagattacttggatctatatttgatccactggccagctgatggttatgttgaatcgtggcgggcaatgactgatctctatcatgaaggtaaaattcgagcgatcggtgtttctaattttgaaccccatcatatcgatgacttattagcacattccgatgtggttccagtggttgatcagatcgaaacgcatccactcttccagcaaaaggaattgcatcgttatttagctaatcatcagatcgcccacgaagcttggggacctctaggccaaggtaagagtaatattttggtggatccagttttaactaagatcgctgctaaatataataaaaccaccgcacaagttgttttgcgctggcatattgaccgtggggtaatcgttattcctaagtcgattcacgaacaacgcctggccgaaaatgccaatatttttgacttcgcgttaactgatgaagaaatgcaggctatcgctggattagatcaaaataagcgtttaagtcgtgatccagacgatacagaatggttgaaaaaaacgcaagaataagtaaaatgggccgctgaccaatgtcagtgacccattttttaaatatcgagataaccaagaaacatcgcgacaactaagatgatcagaacggtgctagtgatcgccacatacaggcggtcattttctttagcaaacgcgtagatcgaaaccacaacccgcaacactggtgttagaattaaacagaatatacctaacataataatggcgaagggtttgaattgaatcaagccgtgaaaaatagcgccaaaatgcgtaggaaaattctgaccactataaccactatggccggtaaataaaaggaggagtagaccgatgccgataatgattgctgagatcagcacgccaatctgtaagatgccgccaatgatcttctcaacttgtgccatttctgtatttgtttggtctttatttggctgcattagaagctcaccccgaatcctttaagaatcatttcgccgccaatatagatcagtaaggggacgaaaatgatccgaatccatcgtgctggtaatcgttgcatgatccgtgtacctaacgtggcaccaatcagtacgccaacggccaacggtgctgcgatctgcggtaagattgagccattaaaaaagtaaacggtcgcgctagctgctgcggtaacacccatcatcaaattgctggtggcactagagggttttaacggcattttcatgacggtatccatcgccataactttgaatggcccgctaccgatacctagcataccactagctaaaccagcaccaaacataacacttaaaccaccaggaatatgctcgacttgataatcgacttgctgttgcgtatttttatcataataactgctgttgagccgcaacttttctgccagtgggtccggctgtgccttatgcaaaacttcactgccggcacgtaatttgcggtacatattccaagaagaaaaaagtaatagaccgccaaataaaacatatagaaaattagggtgtaccataccaactaaaagggcgccgataattgcgccgacagttgttgcaatttccaggaacattgtaacacgcaaatttaataaatcatctttaatataagcgatagttgcaccagagctagtcgcaatgactgaaatcacactggcaccaattgcgtatttgatatctaaaccaaagcctagcgttaaaatcggcgtaatgataatgccaccgccaataccaagaatcgcacctaaaataccggctagaataccgataccaaaaataatcaatactgtttgtaacatagtcgcccctctttttatagttgatcaagcgtgcccaaacacaacacgccaattaataaggatagtttgcacgttctagtttaacatattcctgtaataatgcacttttttccggctgagcaagttgatagaggtaatggacaactcatgttaaaatctagccatatttatcaggtaacatttattgatagattttacttgctgttaagtacggcgtgaagaattcggcgatacaattccgtgggggaagattttagtaacgctacgtttgataattagtaaataaattatagtctaaatattaataacgcttttgttacttttttggtacaatatgtaagggcaaacaaagcgaaaggccgtgaatagaaatgtctaagcgagttcgtaaatggatcataaatattggtatcggaatcttattaattgttggtttagcgctggtatttaatgagccaatcaagaattgggtcatcagtaacatggcgcaaaatcacattgagcagctaactaaaaagaaagtgactgctaatgctaagaagaagaccacgtttaattttaaacaagttaaatctttaggcgttaatgaggtggcccatgctgcggtaaatcaggatggcgttttgaccattggtaagatggctataccaagtatcgatatgcgtttaccgattgttaagggcttgtcaaatgatgcactggcaactggtggtgcaacgatgaaagaagatcaaaaaatgggtcaaggcaattatgcattggctgggcactacatgttgaataatggtgctaatttattttcaccattggataatattcaaatgggtgcaactatgtacattacggacttgacaaaagtttatcaatataaagtgacattcaaaaaagtggtcaacccgtatgcaactgaactgatcgatgatgtgcctggtaaaaagttactaacgttaatcacctgtgcagacggtggggtcaatcggttagcggttcaaggaaagctgattgcgacaactaaagcaaccaagactaatctcgcagtgttcaataaataatggtcgtatgaattggtgtttgcgtgcgctaagggagtatagatatgaaaaaaggcgtcttgttggtcaatttaggaacaccggaaacgccgacagcagcggctgtgcgtacttatttaagtcgttttctagctgatcgacgggtgatcgatttgccacgaccgttatggctaccgattctgtatggcatgattttacccatgcggccgacgcgttcagcagccttatatcgaaaaatctggactaagcaggggtcgccgctgctactttatacacaagcacaggcacgacagttacaagccttgttgccggaatctgttgtacgttacgcgatgtgctatagtgagccgactgtaaccacggcattgcaagagatgcagaccgacggagtcactgatctgacggtgattccacaatatccgcagtattcgaccacgactgttggttcagtgtttgaccaagttgcagcgtactttgggcaaacggcgacatcgccgcaattgcattttgtgagttctttttattaggaaccaagttatatccatgcattggcaaatcaaatcaaacgagctctaaaacagcagccagcggggcatttagttttttcctaccatggtattccgcaacgatatgctgatcaaggtgacccatacccgcagcaatgcgagcagacaacaaaacgggtaatggcgctggttggggacgtgccatatacgcagtcctaccaatctaaatttggccccgggcaatggctacagccagctaccgcgcaagtgatgcgtatattgccccaacaaggtgttaagcaagtgatcgtgatcacaccaggatttgttgctgattgtttggagaacttgcaggaaatcgatcacgaaaatcgcggttattttatgcaaagtggtggtagcgagtttacctatttgcatccattcaacggtagtcctacttttacccgcctgttagccacgattgcagttggtcaagcgtaaccattttgaagtgattgtggtacacttaaaagtagttattgcgattaaattggtgaaggatggtgcattgacatgagtgaatcacgggaattaagtgcgttagcggaacagattattcaataccaaaaacgtcacgatcagactgataatgaattggcatttaatagtcacgtttcggtagaacatattcacgctataaaagcgatggagatgacgccgccggccgatgacgttaaacgcattcaagagtatattcaaggtaaataaacaaaaagcgtggactgaaaattaattcggtccacgctttatttctatttatcactaacttttttagtttgctcgtgagcaactaaggctgcttttagagcctgctgaattaggtgtgcagtcacatcattgttgatctttttgtctgttcgtccggtaattttccgccggaaattctcttcaactaaacgcattgtaaattcctccaatcaaatatgattgaaaataaaaacgcccctttagccttggctgaaagaagcgctggaatacgtacattgtgctccttatctactcagctacttgctgctggaattagcaccttgctttgtggtaggttgctgtgctgtcatcgggccagatccctcaagcactctggataaagacgttcttaatttcactgttagtgtagcaagttttatttgtaaatgcaaacgctatctattatgcgaaatagtgatgggaatttttaccgtaatataattttaaagttatgtaaaaagtagctttttatatagcaagtgctacaattaagaattaagtaagcgatttcttttatctgttattttggtacggaggtgatcgatttgcgtaaaattagttttgcggttaagggttcagctgaagagcaagattggttgaatggctgggcaaagttaggctggaatttgcggcatgtttcaggatatgtttattcgtttaagcagcaaagctttccagtattcattgccacacgttatttaacgacgttaccagaacggacaactgatgataatatcattcaagatgtggcattgaagacaccgcaactatttgtgcaatatgcagcggtggccaagcgcgcgtatgctagttcaaaaacagccgctgatgacatcgtcagcgggaaaatcatagcggcagcgcggcaacgtctgttgaaagcagagttactgtgggctttgttggggtttctggcaatatttagccggatggtttatttgaatgttagcgggtttacagcacctagtgggatgggtattttaggtagcctgatgtctagtgtcccgtttttaggcggcttattactctggctagtaggtcttgctggactcataagtatcaatcatcaaatcgggcagcgtgatcgacagtatcgcctgctcaacaatgacttcgcaaatgcagcgctaacagcgaagtacgtaacacttaccagtactgccgcccaaatcgacttaacaccggtagctgatctgggtcggtggcaactattatcagtcaaggctggcgatttccattatcgcctgcaaactttattgactgatgatgaaatcgagcaacaagtgactgctaagttaccgacagtacaacaggtaacggtcactaagtggttaggatttatgtatataccaatctaatattcataggataagttataaactaaaataataacagtaattaatatacaggaggggattattatgtttgaacgtttaggcgggataggttttttattgatttcactttggcaattttatgctttttataattcatttcggacgattcaccaaaaaggaaatcaagctacttcagcttttgctagcttagctatttggtacggtcttgcgttcgggattgtttttttcctattgggaattgcattgttaatgggtgctttttagctgtctaattactgataaaatttgatccaggatcggttcataccggtgctggatttttttattggcaaaatgctggttgatttaagtaacagtttaccaaaataataatttaaattttaatcatgcgcagctgataatttatgttatactagaaaacgtcgcgaataaatacacaacatgttgtgcctaaactttaaaattatcaattagaatactatatattctggttgatgtttatatagaggagacacataatgagcaattatattaaatttttatcccatcaattacaaggctggccgcagcaaaattactatttgtttttctttagtttagggtgccaggtcatgactttagtcaatacaccgatcacgccattgacgattttgacctttattggtacgacactaggcgttttatgtgtcttggcgatcaatgccgctaagtcggttaacggttggttaggtattttatcagcaatctgctttattatcaccggctatgctgctaaaaattaccttagtattggtgaacaacttgcgtacatggttacgctagatattccggtgttgcttagtgctagctggaatgttaacatggccgcgaaaattcgtaaatttacagctagcagctggaccattgcggtaatcgctacagtgattgtttatggagtttctggttatttgattcaagcattcacagatgatccacggccatggatcgatgccatcagtttttcaatcagcttaagtgctggggtgatctgcttcctacgcttcaataatcagtatttctggtgggtcgcttctggtctggcgcaaatggtactttggtttatttccttccgccaaggctccgcaacattagcaatgtttattaatagttcgatttacttggctaatgatgttttagcgttcaccgtttcaccatggtacaacaaaaaagagcgggcacgcgttgttgcgcaagaaactgagtatgccgctaaactaaatttagataaatctagtctatagtaaaaagacgtttagcaattgataccgttgctaaacgtctttttagttcacttaacttatataaaatgttgaattgtaccactttcccagatgatcagacaacctagaccaatataaatcaatgccatgatccagttgccatagcgggctaggaaaactttaacaaagctaagatgagccgatttttcacctagcgtgaccagaatgtaaatacaaataataaaaattactaaagtgaccaataattgccaaaaggtcaaggaaacaaagtaggggacaaataatccgatattatcggcaccgcaagaagctatcgtggtaattgccactgttgccactaagcttttgttctggcgttgatctaatttttcattgacttcggcggcttcgtcttcatcgctgagtaaatacttgatgccaaagaaaattgggatcaatcccaataaaccgagcagccatttttgcgggacatagtgcaaaacaaaggcaaaaaagaggctgatgccaattaaacaaagtgagccgatatattggccgatataaatattacgccgggcgttgcggccgggatatttagaaaataacagcattagaatcacgagtagatctaacgcagttgaggtatagagaataatggcggtaagaattgttttcagcataaagtgtcctcctgtaactgcctacattataacgggttttatagttctcgcctagcgctgaaaaaatatttttaggtgttggcaagcttaacttgtgatggtattctctagccgctgattaaaaataaatgagaacgttaagacgagaagagtaattgctgagagcaacggcagagagttccggttagtgaaaaggaatggtgcgatggcaatgaagatgaactccgagcgtttggtagcgagctacggttagttaccaacggttgtgcccgatacagcaccacagtctgttgttcatacaacgcactggtagagtctaacgctgtgaaacgttagaaaaataaggtgataccgcgatcgcgaaagcgtcgtcctttgttatacaaaggatggcgctttttttagtgcaattatatgggaggatgagaaaatatggtaaaaagtagtaatcaaggttatccacggttaggtgaaaaacgggaatggaaattcttactggagcatttatggagtcataaaattgatgaagctgaattcacggcacaaacgaaagctttgcggttagcaaacttaaagaagcagcaaactgctggtgttgatctgattccagttgctgattattcgaattatgatcacgtattggatacggcagttgcttttggcgctgtaccgcaacgttttggtaagttcacagaaaagctaagtttagctgactattacagtgttgcccgcggaactaaggatgctgtcgccgcagaaatgacaaaatggttcaacaccaactatcactacattgttccagaactcgaccacgttcaatttaaattgttagataatcgctggttgacttattataacgaagctaaagctgagctcggtattgatggcaaaccagttattcttggcccagttagtttcttgaagttgagtaaagttaacgatgaatatgtccgtggtgaacttttagctcaattactggatgagttactgcccctttatgtgcagatcttccatgaattagctgccgccggggccaaatggatccaactggatgaaccaactttggtcactactgataaagcggaacttgatctgtatcggcatgcgttggaagtattgtatgaagcggcacctgaggtcaatgtgctagtgcaaacttactttgcctcgttggattattacacggagatcgttaatttgccggctgaaggctttgggcttgattttgtccatgaccatggtgaaaacttgcaagcattgcaagcacatggtttccctgaaactaaagtgttagctgctggtatcgttgatgggcgtaatatctggcgcagtgacttaaccgctaagcaaactttggtcagccagttacgggaaaaggtagccagcgcgcaattatggttacaaccatctaattcattattgcatgtgccgatcactaccgctaacgaacataagttggatccagtgatcaaaaatggtttagcttttgctgatcaaaaattggctgagatcgttactttgacgaaagcggctaacggtgctgatgttaccgccgacttacaggcgagccagacagcattagatcaattaaatcattcagaacaccggaataatccagaagtcgcccaagccgtcaaagcaattttggctacaccaacggaacggcattcagcttacccagagcgggtcaaagcacagaaagtattgcacttaccgctgttaccaaccacaacgattggtagtttcccacaatcggctgaagtccgttctcaccggaaagcttggcgtaaaggggacttatcgacagccgactatcaagcctttttggatcaagaagctaagcgttggcttaaaatccaagaagatctcgacatcgacgtgctggttcatggtgaatttgaacggactgacatggtcgaatactttggtcaaaaattgaaaggcttcacgactacgcaaaatggttgggtgcaaagttatggttcccgcggcgttaagccaccagttgtctttggggatgtacaatggacggaaccaattaccgtgcgcgatacggtttttgcccaagagcagactgaccgtttagttaaagggatgctgacttcggccgtaaccatcattaactggagttttgttcgtgatgatttggcgaagaatcttgttgctgatcaaatcgggctggctttacgtcatgaagtgcaggcgttagaggatgctggtattaagatcattcaagttgacgaaccagccttacgcgaaggcttaccactgaagccgcgttaccgggctgactacttggataacgctgtcaaagcgttcaagatcaccacaactggagtcaaagacgaaacgcagatccatacgcatatgtgctattccgattttgaagatattttgccggccattagtgcgttggatgctgacgtgatctcaatcgaatcgtcacggtcacatggtgaaagtatcaaagcatttgaacaaacgaaatacgacaagcagatcggcctcggtgtttacgatattcacagtccacgggtgtcatcagttgaagaaattgaacagaatatcgaccgcgctttacaagtgattgacgttcatcaattctggatcaaccccgattgcggcttgaaaacacgtaaagaaccggaaaccatcgccgcattacgcaatatggtgcaagcacgtaatcaagtttgcgcaaaattaggtgtaactgagtagtgcgtgtttgcgcaaattgagttgcaggcggacttagcttgcgccgattgtagaaccaattaaggaagggggattagggatgagtttcaaggaagcactgcaacaacaagtattgatcgctgatggtgcgatggggacccttttatacagtcaatatggcgttaactctgcatttgaaggtttaaatttgacccacggtggtgatattctcaagatccatcaagcctacattgcagcaggcgccgatgtgatccaaactaatacgtatgcggccaatcgcattaagcttaatcgctacggtctagctgataaaacgaaggccatcaacgaagcggcggttagtttggcgcatactgctcagatcgccgctgaacatccggtttatgttttaggcacgatcggtggcatcgctggggtcacggatacggagattgaaccgttgacggcggaagaaattgatgctggtgtacaagaacaggcaacttgtttattgcagactcaagctatcgatgggcttttgctggaaacttactatgatatcaatgaattgaaacgggcgctcaaaatcgtgtgcgcgctgactgatctgccagtggttactaatgtgacgatgtatgagccaggggtattacaggatggtacgccattaaatactgcactacaagatctggctgcattaggtgctgatgtggtgggggccaactgtcgcttaggaccgtacaatatgagtcgtgcttttgaaagtgttgcgttaccggaaacagctgctttagcgatctaccctaatgcgggcttacccgatgtccaagacggtaaaacggtttatgatagcccagctgaatattttgaaaattatagtgataccttccggcggcagggggcacgtttgattggtggctgttgtggaacgacaccagcgcacatcaaaggcttagttgcgggattacagtcacgccagccggtgacggacaaaaaagtaaccgtacctgcagctgagacagtgccaacagcagccgacccgcggcaacatgattttcttcaacgggtacaacatgaaaaagtagcgttggtcgaacttgatccaccaaaaacttttactacagcgaagtttttccgtggcgctcaagcgttaagtcaagctggagctggtgcaattacgttagacggtccgttggctaatccaacgatcagtaatgtggcgttagcggcacagctaaaatatcaatacggcatcacgccgctggttcacctgaccacccgcaatcataatttgatcggcttacagtcagagatcatggggctacacacgttaggtatcgctaatattttagtgatcactggtgatccagctaaagtcggcgatttaccgggagcaacttcggtttatgatttgcattcagttgaattgatgcagatgatcaagaaattcaatgccggtatttccccaacgggccgtaatttgcaggaaaaaaccaattttgcggtcggcggggtttttaatcctaatgtccgcaacgttgaacgcgcctgcaaaatgatcacccgcaaaacggcgtacggcgctgactttattattatccaaccaattttgatgttaccaaggttcacgaattgcgtttagccttggacgaacagggcattaccacgccgatttttgttggctttatgccattgttatccttccgcaatgccaattttttgcatcatgaagttccagggattcgtttagctgacgatacgctggtacggatgcaacaagcggaggcagatggtaatgaacgcgaggttggtttgcagatcgccaaagaaacgattgatgcgatctgtgctgactttaatggtgttcatattaatacaccactacgccaccacgaaatctcactagaattattgaattacgttcaagctaaaaatgccgtgagtgtttaaataaataaagcagttctgccgataagttggcggaactgctttatttatttaggtttattttagtaggttttcgatcgtatccagcacgccaaaatgattattgtctaagcgagtaacaaagctggcttgttgctgcactgcgggttcggcgttcaacatggcatagccatatttggcccggcgcaacatttctagatcattatagttatcgccaaaggctgcgacctcatccggtgtcagttgccaataatcttctagctgctgtaggccaacgcctttgttgatgccggcagggataacatcgatactgccaaaaccgctagcggttgcgtgaaaagcaccgggaaacttagcatttaaataatcggctttggctttgatatcctcgtgtttccacgctacgttaactttataaatatgatcagtcacttgcccgatatcatcgactaattgcagattactgataaagtaacgcaattcaacatcgttgacgtccgggtcagtccgattcatataactagcctgttggcccgatagtcgaatcgaatcaggttgcaacagcggatcgtcatgtaagatccgcaatagttgctgcattgtttgctgtggtagccgcgtttccgccacgatcgtctgttgatccatgatcaaagcgccattttcagccatgaaggtgttgatgtgagagcgggcagcgaaaatatcgactaaatggccgtagtgattgccactggcgattgcaaaatggatctgacgccgccgcatttcctgcaataattcattaaagcggtcgatcgcgtattcatgttggtcgttgagaaaagtgccatcaatatcggttgcaattaattttatcgtcaagtcgccaacctccagaaataagttatctctattgtaccgtagaaagcgtattctgtgttaacgaaagcgataaccgattttacgcccaaaactggttagttcgttgagcacaggtgcggctaatagtttcaaggcgattaaataagtgagcccgcctgcgctgaccgccaaaataagtccggcaaaattatgtaccggcagtaggtgtaataggctaaacataagcagcccgctgagtaaatatttccaggttgcagtaaaaagttgccggcggctaataaaatcacgcaccgcgtgcagttgataggcagtcacactaaattcagtcaatactgtcgccacggctgcacctaacgcaccggcgagtggaattaaaatcagattagcgcctacgctgatgatggcgccgagaaaaaccgagcgggtgtacgcctggttacgattaagtggcaataacagttgcacgccagtaacgttgccccaagcaatcagtagaatagctggtgcttccacgactagcagctgtccggtgagggtgtagccacttcctaaataccagcgactaaaacttggtcccagcgcggcgatccccaaagtaagtggcacggctaatgcagttgtgaaatcgaaggaacgatataaatttcgtttaatcgccgtgtactgatgctgggcaacttgatttgccatatgcggtaaaataacggtacccgaagcggtgacaataccgatcactagccggatcacccgatcagcataaccgtaatagcccaccgccgccattgaaaccaaccaacccaataagttgcgattaaggcttaagtagatctgcgtggcgatcgtcggtaaaaataaagtcagactaccacgtaaatggcggaaaggctgcagttgtcgtagtgggatgcgctgaatttgcttggttaaataaggccacatggttagattacccagtaggctgctaccggtattaaataaaatgtacaaccataggtcagcggctgaatgaaccaatgtaaaagtaagcccaatcgccagcaaacggactaaggcgttccgtagcacaaccttgccaaaatcttccatacccataaaataccaagagatatcaaacgcagccgctggtaaaatcaaagcttgaagcaataaataagtgcggtattgatcagtgaataaccaataaagtatgaaggcgccaaaagctaagctgagcgtcaatagctgtaagcaagtgatctcccaaaataagcgtgaacgcacaactttgttatcgcgctggtaagctaacgtacgattagcgtatagcccaatacctagcgtaccgaaaattagaaagtaattgacagcggcaccagtgtaatcactaatacctacaccagtaacaccgatcacacgcgaaacgtagggtacagtgatcaacggtaagatcagtaataataaattatagcttaggttatatagccagtttttaattaatttcatcagtaatgaccctttccataaatagatccattactgatattaagcgttttgtaactcatttagcgggcgacagcggtcaacgttgttaaaagcacggtcagcgtaataaatgattaagtgccgccactttacggaaagctactagacaactctgttgatcgggaaagtaagccactcgtttagccgtgtcaaaactgacgattgtttgcggatttaacaaaatactacggtgagctaaaaataagtgtgggtatttggtggcttgttcacttagcttgccgatgaattcggcttgacgttgttgcgcatgaatgatcaatttaccggtattaccgggagcagtttctaaaaagtaaagttgcgcaaacggaatttcatagtaacgttggccgattcgataaccaaatttttgtgtattggtaacgatcgtttggttataacgctgtacggctagctgaatatctgcacgtaattgagcttccactagcgtcatacccttatcctttagcaaataatccattggcgcaattttgcgttcaaaggtgaggaaagccatctcggtgtgggtggtcataaaaataatttgcgcgtcaaaaaagcgttcgcgaacccaaaccgctaaatcaagcccagccgttagctccgtaccgatttcaatatcgaataaaaataagccgtgcgtctgcggattctgtactaaatcatcctgaatcgctgctggtgtggcggtgacgactgctaattgcatatctaattcatcgatcatgatctgggtgcgcacaacttgctgatagtaaaaacgctgctggggattatcttcgagaataaaggtggtcaacatcaatttgcctccataaaagttagaatcacacgaaattcagttgcggtttggcttatatctaacaataagtttggctgttgttcagctaattcacgtagactggctaaaccggtaccacgctcagttcctttttgtgagtaaccgtagtcaaataaatgaccaaagttaggtgcagtcgcaaagttgttggcgacgatcaattcagcgtcgccgtttgggtaactgaacaaagcgacctgaacagctggtgtcgtagcgcttttagcggcctcaagcgcattgtcgagaatgatacccagcattcgaatttgtgccactgagatcggtgccgctaaagcgaatggcttagttagctctaatttgaccgtcaccgcatcctgttgtgcttgggctaacttttgcagtaaaatgctgcgcaacggcttatcggcaatcaaatctaagttggcaaattgtggcgctacttgtaattgagcgttggcgttatccagaatctgctggaaatactgttgtagttctggttgctgactttcgttaacgtaggtctgtaatgacagtagaatattttgctggtcatgtttgaatttacgcaaagtgcggtcatttttttcaatcgcttgggcgtaaactaataaattctgataatcacgttgcgcaaccaattgttcgttacgtaaattaaaaatcttcagaaaataaacgaaaataaaggcggtcagcaaaattaggctactgaaaccggcaatcagtaaactacgactggccgtattcaattggtaaaagtcaatcaaccataataatgcggataaggcactaaagcagatcagcaaaagggcgagaaaatatttctgtacttggacttggcggaaaatactggtgatcgctgcaaaaattttcaggtagtgcagtaaaataataaagccaccgatcaagccgtaatcaatcattaaactaattatggttgcgtaatcagtgagtacgggccataatttaccgctagccaccgcaaaaatcatagctaaactgacaaaaatcaattgtaagcttagcgctgaacagaacttgactagctcagtcaacaccggccgctttttctgttgaaggacataatagcttaagtaacaaagtagcaggagtacaaaaacgattcggccccaaaatagtaataaactgccgaaaagtaaactcaataaaattgcgtagccgcgaatacgccaggttcggcgctcgacagcaatgtagtccgctaataagtgaacgcctagtatcagtaggcaagaaataatccagttcacgatggcaactccttaattggtttcttttagcatactcgatttagtgctattttgcagaaccagctcggtgagcgtccttaattagtaatttaacgtcaaaaaaatagagcaaccaaatcggttgctctattttaattttgtttcaatatttgatcgatcgtatcgagcacgccaaagtgattgttatccaagcgggtaacgaaagcagcttgctgttgaacttctggtacagcattacacattgcatagctgtatttagcacgattcaacatttcgagatcgttgaaattatccccgaaggcggcgatgttagcggccgttaaatgcaagtgatcttctaactgttgtaagccagtccccttattgacgccaccagcgataatatcgatactaccaaatccgctggcagttgcgtgaattacaccgggaaacttagcgttaaggtaatccgctttgggcttaagcggtacatgattccagatcgcgtttaatttgtaaatatgatcgtcgacctggctaatatctggtactagcttgagattattataaaaatatttgatctcgggtgtcgttgttgcggcttcggcttcattcatgtagctggcatgttgaccagataggtgaatcgattccggctgtaagctagggtcgtcctttaattggcgtaataattgctgaataatagttggtgccaatcttgattcagcaatgacttgaccacgatccatggttaaagcgccgttttcagcgataaaagtgacaattggcgatttagccccaaaaatcatttgtaaatgactatagtgattaccactggcgatggcgaagtggatcttgcggtgctttaattcttgtaattgttcgttgaaacggtcgatctcatactgatgttgatcgtttaaaaaagtgccatccacgtctgtggcgattagtttgattgtcaaaaaagtacggcctctcaaaaatctgatggctctattgtaccgcttgaaccgggcgctggctatcagattttaattatagcttagcgtactttggctgcgctaacacccgcgtcaaaatttgacctaaacgtttgacgccaagtttgatcgttgccgtgtctaggttggtaaaattgagccggagaccgttagcttgatgactaactgggaaaagacttgcgctggggacgtaagcgactttggcttgtggtaaaatcacttgcttcagtaattcgccagtgtcgatatcagcgggtaaggttaaatagatgaagaagccgccacgcggacgagtgaagttaactgcatctggcaggtaatgatctagtgcatttagcatggttgccattttagcagcatatgcctgattcattttggcaatatgatcgctgaggtcatgttggcctaaatattgatcaattgcgctcataaccagagtagaggattggacgtcattaccgagttttaattcagttaggggcaccaacaactctggtgtggtgactaaccaacctaaacgcaatcctggcgataaaattttagaaaagctacctaaattaataacgtgatcagtggtatctagactagctagtgagggtaacgactcaccactgaagcgcagatcgcggtaggggctgtcttctaaaataatgacatcatagcgttgcgccaaacgtaataaagcttgacgtttcggtaatgatagtgtgctgccagttggattttgaaaatcgggaatcgtataaataaatttaacgtggtgcgtcattaacgttttctgtaaaacgttcagatccataccgtcgtcttgcaatggcacttcgtaataagtgggctgataggcatcaaaagcagaaagtgcacctagataagtgggcgcttcaaccacaacaccatcgcctggatcaagtaataactttgctgttaggtcgagaccttgctgcgcaccttgagtcagtaaaatttcagcagcagtaaaagtccgtcgtggagaactgatgtgttgcgcgattttagcgcggagactttttaaaccagcggcaccactatactgcaaggaggtgctatcggttaaactagatgcaaaggcgctttttaattcggcttgcggaaataaatgattgttaggatagccggcggcaaatgaaatcagcgctgggtcgttggcataagtaaagatatcatttagtccgttgtcgcaaggttgaattcgatttgcaaattttaccatggtaatccctccaataattaattacagtgtcgtttacgagttgttgtctattatgataaaatgaactcagtgataagtaaaactcaactttttcatatttagatgaaatatattcatcagtatattatttgacggcgtgtattgaaaaagcgccaagattttgagcagctggtcctcacaccccgtacttcgtctggctgctaaacattgaaacgttgtttgtacatagtgaagacaatagagaaaatttatttccagcgtcggtttaagactgctagttaacttgaagattgtgaactattaaaaacccgatttactatcaaacgattgaactaatcaataatttaggtagttcattttcagaactcgtacaacccaatgtgaaattttcgtcattatacttggttactggtaaagtctgtgcgttattaaggaggaaatttgaatgtccactttctcatacgaaatttttcatgcagtcgtagaacgtaaaaccttttatcaggccgcagtcgcgttaaacgtaactcctagtgcggtcagtcattcgatcaatcaactagaaaatgaacttggttttccgttgtttattcgtaaccgcactggcgtggaattgaccagtgatggtaaacgtattttgccgatcgtgcaggaaatcctaaatacggaagagcgtttacgtcaggaagcggccaacatcaatgggttaaatgcaggctcgattcggatcggtgcttttagtagtgtgtgtatcagctggttaccgcagatcattcagaaattcaagcagcaatatccggatattgcgatcagtattgtccaaagtgatttcaacgatattgtcaatcaggctaaaattggtacgatcgatatcggtttttccgctttgccgattgctgatccattggtggtcacgccgctgattgctgatccaattttctgtattacaccgcaaaattttgttccggcacataaaagttatattaccgctgccgatgtggctaatcaggattttattttgcagcaaaccgattatgatcgtgacactaaacgcgcgctggatcgttacaatgtgcggccgaattcattgcgctacagtattgatgatcaatcaattttagctatggttgaaagcggtcttggcatgggtattttaccagagttagccttgcaaaaattatccggtaatgtgaatatttatccatttgatcaagactttcatcgtacggtgactttagtggccaataagatccaagccgttgcaccctccactaaaaaaatgttgcaagcgatcaaagcatatattaatcaacgatatccagagaatttactggcataagaaaagggtgggatgatcggcttttagcagcgactcatcccaccctttgtgtttaatctaagtcatagtcagcacttgattgtgcggttctttgttttcgttttaagcggaagtacttagtgatctcgagacagatcactgagccaaaaattgctggcaccgtgatccaccatgcagaagtggataaattggtgagagcgaaagcttgctgaagccagggcacaaaggcggtggccaaaactagactgatcgcgatggtgacactgatatttaagggacgattatgcttgagtgtgcgccaactcagcatttgatgggttttgatcggataaacgtcgatcactgagcccaatgccagtaccagaaaggccatcgtcattccttgttcctgcgaaccgccagttaagctgaaacggccaaggtagtaaacgccgccgactaatagcgtgaagactaaggcccgtaaccctaaccgccaaccgagaccatcggcaaataacgagcgatttttgctaactggcggttgttgcatgttatcgcgatcaccaggttcgtaaccgatataaaagccggggagtccgtcggctagtacgttgatcagcaatagctgttcggcaatgagaatagtgccccagccgagactgacgctgatcagcatcaagaagatctgagcaaagttgacaccgactaagaattcgatcgcttttaaaatattatggtaaacggtgcggccttcttcgaccgcatcgaggatcgtggcaaaattatcatcggtgaggatcatgtcggcggcatttttagaaacgtcggtcccagtgatccccattgcgataccgacatcagcggctttcagcgcgggtgcatcgttgacgccatcaccggtcatagcaatcgtggcgccgttagcttgccaagcggtaatgatccgcaatttgtcttccggagaaacacgggcaaaaacactatagtcggcaatattatcttttagttcacgatcacttagctggcgtaattcggcaccgctgattgcttgatcaccggcttgcaagatgccaatatcactagcaattgctttggcggtggctaaatgatcaccagtgatcattaccggtttgatgccggctgcatgagctttggcaatcgctgcgggtacttcagggcgtggtggatcaatcaagccaattaagccaactagggtcagttcttgctcgatctcgacccagtcagctgtcggtttagtgggaaattcacgataggcgatccctaaaatacgtaaggcgttgaccgcaaaatcgtcgtgtacctgcatcatttcttttggttgctgtgctagttgtagtcgatcaatggcgcctttgacgatcacgacataatgaccgtcaggcatttcgtgtaaagtcgccatggttttcttagttgaatcgaaaggatcttcatctaaacgtggataatctttttcaaagtcacgacggtgcaaattgaatttttccaggagatgaacaattgctagttcggttgcgtcgccatgggcttcaccgtcatcggttacttcagcattggtagctaggcccatatacgtaaaggcttgctgttgctcaggcgtcagttcatttagatcatctattttctgtactggctgttcaggttgccaaaagcgggtgatcgtcattttattttgcgttaacgttcctgttttgtcgctggcgatcacattcacattaccgattgtttctaccgcagtcattcggcgaatgattgcccggcgctgcgccattttacgtaccccatgagttaagcttagagtgacgatcaccggtagggtttcgggaacggcagcgacggctaatgaaattccgatcaacaaactatcggccatattgtcttgatacaagaaaaagtttaaaagaaaaatcagtacaccggcaattaaagcaatggtggtcaaacgcaacgctaactgagataagcgttgttgtagcaaagttttttgctttttagttttgttcagtaatgtggcaatcttaccaagctcagtatgcattccggtggcggtcaccacgaagctaccgttaccttgcgtgactgccgtaccggagaaaactaagttaaaactatcgccaatactgtcggggtcagccgccaaagtttccgtttgtttactgatggcttcactttcgccggtcaaaatggcttcgtcgatggtcaaattctgcgccgtcaacaatcgaccgtcagctggtacactattacccgcagtcagtaaaacaatgtcgccgggaactaattcgggtgcaggtaaagtcgttttagtgccttcccgtaaaacagtaacggtcggaacgtgtagatcttgcaaagctgctaatgctttttccgcgtgatgttcttggaataaagtaataacgacatttaaaacgatgattgcgccgatgacgatcactttcagccaagaactatcgctggtgatagctaagtatgctgcgatcccggtggcaatcaataagataatggaagtaatatcggtaagctgctgaatgaccttgcgccacagcgggattgggggcgctgcggcaagttcattggtgccagcaatagtgcgttgtttgtcaacctgtgcttcagacaagccttgttgggggtcaacttggtattcgcggcaagtgtcactgccgctgcgagtggcatgtgtcatgttgagtagcctcctttgttggcttcagaaatgaataaacctacaatttaattgtaacaagcagttaaattaaccgtcaaaagatgtactagcaaagtcgatcaaaaaagcgccaccgaatattcggcgacgcaggacacggttaactcatatgcagaccaccgtcaacggtgatcgtttgaccagtaatataatctgaacggtcattagccaaaaaagtgactaaattggcggcatcttctggttcctcgatgcgccccagagcaatgcgctcgctgaattgtttcaacgcggtttgtcgatcggtttggtctaatttttcggcttgtgcggtgactaattcccacaatggactattaacaatacctggcgaataagaattgactgtgatatgataaggcgccagttctttggcggctgcttgggttaaaccgcggacagcaaatttactagcagaatatgcgctgagcaggggcattccctccatggcgcctagaccagcggcgttaataattttgccgccgtgttcttgctttttcatgaaccgcgccgctgcttgaataccgaacaggacacctttaacgttaactgccattaaatcgtccacttctttatcagtaacttgctcaacaggaccgactttaacgataccggcatcattgaccatgacgtcgatatggccatgctcggtgacgacttgctcaactaaatgttggacatcatgttggtaaatgacattcgtttggtaggctgctgcacgatggtgttgctggtgaatttctttgacggtacgttgtgcggcagcgaggataatatcggaagcagccacgaagaatccgtcggcagctaaagctttagcgatggcgcgaccaataccctgaccggcgccggtgatgactgcaattttttgtggcatattaatagttcctcctatgaatatggtttcaggtttagtatagcatcgatacgcgtttatgtttaagcaaacgctagctttggttgtcccgcttgtcaaagctgggtcaacagcttatactaaaatgtattgttgaagtcgttataatacggcaatgaattctaagttaatcactaatgtataaataatctatatcaatgaataatcaatgcatataaggggctacgaaaaatgaaaaaagaaactgtcaaatcatggctgtgggtcgtgattgatattgtgatcgtcgtaggtgtggcaatgttattgcgcactttcctgatcacgccacataatgtggatgggccttcaatggaacctaattttatggacaatgatcgcgtgctagtttggcgccatccctcacttaaacgtgggaacgtggtgattctacacgcaccggatggctcgttatatatcaaacgaattattggtttaccgggcgataccgtgacgtcaaaagatgatgtaatgtacgttaatggcaagaaatacgatgaaccttacttgaacagttataagacacaatgggcggatgataacaacggtttgttcacgcaaaacttctcgttaagcacattgaaagcaacgaattatgccaagaaggtaccgcaggaatcatactttgtcatgggtgataaccggccgatttcaaaggatagccgaatgatcggttttgttaaacgtaataaaatcgaaggtaaagtcgtttggcgttattggccactgaacaaaatgtcgatttattagcgtgtatcattaagttaatgactagcagcgaaggagttggacgtaatttacttacgtctaactccttttttgtacttctgaaccatatagttaaaccgggttccataaggcaaccttattagcggagtagctggtgtcttatgtcatacgcccttttttgcgcattgttttcattgcggcggcgtgctagattaaagctaaaataatgaaagtagtgacttaaatgaaaaaggatgggcacagccatacagaattttgtccccatggtagtggcgacgacgttgaattgatgatccaaaaggctattaaatttggctttagcgaatacagcattaccgagcacgcgccgttaccaccggattttaagcacgattatgctggtgcgatgactggcttgactgaagcctcaatggcgttgaatgatctaccagcttatttcaagaaatgccagcaattacaagcaaaatatcgcgggcaaattaaaatcaatattggttttgaactagattttttgcccactcaagtcgcttggacccgtgatttttgggctgagtatggcccacagacgcaagataacgtactttcaattcattttatgcaaggggcagctgctaagttttggtgtgttgatgatactaccgctgacttcaaaaaaggcttactcgatccacaaaatggtgatgctcaggccttatacggccaatatttacaggcgttgctggttgccgtacagactgatttaggcccccacgcaccaacacgattgggacacatgactttgattaaaaaattccaagaatattttaatttaccaactaaatttagtgcgaccaatttggccttagttgatcaattatttgctagtttaaaacagcgccattttagtttggatctaaatactgctgggttatataagccttactgtaatgagacttatccttattctgacttgattctacgggcacaagcggcaggtattccgttaatttatggttcagatgctcatagtattgccgaagttggtcatgcctatcatcagatcgaaaaatttgtataaagccgcttgactttttgaaaacaactgctattatgagaacaacattaaaaataaaatgaagttttgattagaaaaagtagcaagcaaatgtttcgagagagtatccagacggctgtgaggatatagcataacttgtgaacacacatctatgaactttggcgctgaatcacagtaagtaccaacgcagggtctgcgttaaaaactgttacaagttaatttgattctagtgtgattattcagcgcacgttttaaaaatgacacttaatttgcaacttgaggtctggcctgtaaggcccagataaacttgaggtggcaccacgatcattcgtcctcgtaagcgataagcttgcggggattttttgtattcagagtgtttgaaaaagcgattagacactggaacgtagcctagcttagctataagatacgcgcagcgaatcgttagctaagcgtagctaggtggaagtggctgctttttcaaacacgtttccgcaaacccagttagccaagcgcaataatctgctttttcaaacacgtttctacaaactcagttagataggcacaaaaactacttcgtaaacacattttcaccaatcatcaactcaaaaaagaaaggggcactgaccatgttgaatcgtaatttaccagtcggtacgcgcgatgaatttggtgccgtcgcacaggctaaagaaaaaattaccggccagattcaaacttactttcgcagccgtggttttcaaaaattgaccacaccgttacttgaatataaggcggtgttcagctcaatggagcaacaaacttatcagccctaccagttactagatgagcacggggagaccttggttttacggcctgatctaactttaccggtggcacgggtgatgagcaccaccggtatcaagacgccagtcaaatggtattacagtggcgaggttttccgagtcaaaaagcgcttatccggcagctataaccagcaaacacaggccggaattgaaattattggttatcgttcgttaaaagccgaatgggagtgtttgactgctgcaatcgaactttgtcagcaattggcggtcagtgatctccacgttgagttaggccacgcccgttttgttaaggcggtgttacaggcattaccgttgaataccctgcaacaagcaactttgcaacgcacattattcagtaaaaacgtcactgcctatcaagctgtgatcgcgccactagcggatgatcccttttatcccttcttacaagtttggccgtggttatttggtgattttgagcaggtactcgctaaattagagctgttaccggcaatgcctgagttacagtcgatcatgcaagaattatctgccactcaagtctttttacagcaacaatttccccagcaaaaaattgagctggatctatcgatcgaatcgccgcaggcttattacacagggatgatttttcacggttatagcgattcgacggccgaatttttattcagcggtgggcgttatgatcagttgttatccagctttcaaaatacgctgcagcctgctgttggtttagcttttgaagttgatcaattagcgcaatacacggcggtcaccacgacaacgcccacgactttgatctactttgatgaagccagttggggtgcggcacaacaaattttgcagcaacaaccaaatagcagtttgtgtttggcggaaactaagcacgaagcggagcgaatcgcccggcaaactaacagtaaactgatcgacgtcacggaggtgcaaccatgagtgcattgaaaattgctttgaccaaaggccgtaccgaaaaacaagtactgccgttactggaagctagcggtattgattgtacagcgatccgcaataagcagcggcggctgatttttaacgatttgcctgattatcattttatcctggcaaaagggccggatgtgctgacttacctcaatcgcggtgcgatggatatcggtatcgtcggtagcgatattttggaagagcagcacaacgaacaatatgaaatgcttgatctgcaaacgggtaaatgtcatttcgtcttagcatcgacgccggatttcgatccttatcaggtcaaacgcaaaattatcgccactaaatacccgagcattactcaacggtatttccgtagtatcggtgaggatgtggagatcatcaagatcgaaggttcagtggaattagcgccgctagtcggtttagccgatgcgatcgtcgatattgtcgaaaccggcaccaccctaaaagaaaacaacttacaagttttcgcaactttacagtcggtctcgacgcgattagtcgttaaccgtttagccttgaagcaacatcaaaatgcgatccagcaattgataacaaatttacagcaagcaattcaaacggaggtctagcacatggaaattttgcaacaatcattggcggaacttaaaaaacaagtgaatcaacggacgcaacaagcgactcatcctgaagttgaagctagcgtcgcggcaattttggctgatgttcaagcaaatggcgacaccgccttgcggcaatacagtgaaaaatttgatggcgtgaccctgactgatttgcaagtgccacaagcggagatcgatgaggcttataataacagcacgccagaattactggcggctttaaaattagcccagcgcaatattacttccttccataaaaaagaaatcagctatggcttcatcgacagtgagcgtcctggcgtgatccgcggtcaaaaagtgacgccgttggccgctgttggcttgtatgtccccggcggaacagccgcttatccctcaacgatcatgatgagcgcgatccccgctaaattagctggtgtcaaaaaaatcgtcatggtaactccaccacaaaaggagggtatcaaccctgccgttttaactgctgctaaattagttggtatcgatgcgatctaccaagttggtggcgcacaggctgttgcggcgttggcttacggcacggaaaccattccgcaagtcgataaaattatgggccccggtaatatttttgttgcgaccgctaagaaacaagtatttggtaaggtcagtatcgatatgatcgctggaccttcggaaatcgggattatcgctgacgacaacgccaagccagcccaagtcgccgcggatctgttgtcacaagccgaacatgacaagttagctcggccgatgttggtcacaccaagtttagttttagcccaagccgttaacgttgaattagaaaaacaattagccacgttaccacgtcaagaaattgcccgcgcatcattagataatgaagggtttattgcaatcgtggcttcgttagctgatgcatttacgttgatgaatgctattgcaccagaacatttggaagtccaagttgcggaaccgatgcaatatttggcacaaatcgaaaatgccggctctgttttcttaggtagtacagcctctgagccgctcggggactatgtcgctggtccgaaccatattttaccgactagtggtacggcgcgtttcttctccccattaggtgtgtatgatttcgtcaagcgcacgcaatttattcaatacacggccgccgcgttgcagccagaagccagtgccatcacgactttggcgcggacggaaggtttggaagcccacgcccgggcgattgaagctcgttttcctaatgcgaagtcttgatcaagttgtatcggaacaaaaataaccacgaagaggtgtaaggatgagacaagcaaaaataacgcgtaatacacaggaaacgcaaatcacggttgctttaaatttagatgatgccagcatgatcaaaatcaatagcggcatcgggtttctcgatcacatgttgaatgcttttgctaaacacggccgcttcggcttgatcgttgaagctaagggcgatctcaatgttgacccacatcacactaccgaagatatcgcgatcgtacttggtcagtgttttaagcaaactctcggtgataaggccgggatcgaacgttttggcaccgcctttgtaccgatggatgaaactttggctcgtgtggtgatcgatttatccggccgctcgtatttagtttttgacgctgagttaaccaatccgcgcttaggcacttacgataccgaagtgacggaggactttttccaaggcttcgcgtttaacgctgagttgaattgtcatgctacggtattatacggtcgcaacacgcatcataaaatcgaggcgctatttaaagcccttgggcgagcaatgcgtggcgcggtggcaatcaatcccgaagtcaaaggcattccatcgactaaaggggtgatctgatgttagtgatcgttgattatgataccggtaatacccgcaatttgaaaaaggcgctggattatctcggcatcgccaaccaactttccagtgacccagcgacgattttagccgccgatggtttaattttacccggcgttggcgcttttcaaaaagcaatggcggcgttagcagaacgtggcctagtcaccgttttgcaaacggccgcccaaaaagggaaaccgattttaggaatctgcttgggcatgcaattattagttgaaacgggttacgaatttgggatcacccgcggtcttggtttattacccggtgaagtggtgccgatccccgctgataatgggctaaaagtaccccatatgggttggaacaccaatcaagtcttgcagcctaatccggtggctgacgtttttgatcagcaagcaacttacttcgtacactcattttatgtccaaacagcggcgaagaatattatcgcccaaaccgattacggcgtgaaaattcccagcatcattcaacaagataacgtgatggggatgcaatttcaccccgaaaaaagcggtcaagttggtctacaaggcttggcacgcttcaataaggagttggttcgcgtatgaagttatatcccgcaatcgatttaaagaacggccgcagtgtccgactgtatcaggggcaatttgaccaagaaacggtggtcaatgattcgccgctacaacaggccaagcaaatcgcagctgccggcttgaccaatttacatttagttgaccttgatggggccaaggatggccgtccggtgaaccaagcgactatcgctgcgatcgtcgaacaaacacccctacaagtcgaaatcggcggcggtattcgcaccttagcgcagattgaaacttatctgaacttaggtgttacccgagtgatcattggctcggcagctttgactgatcctgaattggtcactaccgcggtcaaaaaattcggcgccgctaaaattgttgtcggtatcgatggtaagcagggtaaagtcgctaccgaaggctggttggcgcaaagccaagtcacgatggctgacctagtcgctgccatgcaaaaagtcggtgtacaaacgtttatcgtcaccgatattgagcgcgatgggaccttgcaaggtcctaaccaagcacagttagttgaactcgccgcacaatttccggcggcaacttttgtggcttccggtggggtgcgcgatgcccgcgatcttaaagatctagcggcagcgggcattgagcacgcgatcgtcggtaaggcactttatgccggtagcgtgaccctagccgagctggctgagcttagtcggaataaatctgaattgtaaaaatatacgaaaaaaggggggtgaccatatgttagctaaacgaatcgttccctgtttagatgtcgatcatggtcgggtgaaaaaaggcgttaactttgtggatctgaccgatgttggtgatcccgccgaaatcgctgcggcttacgagcaacaaggggcagatgaactagcctttctcgacatcacggcgaccaatgaagcccgcggcgcaatggtcgatactatcgaaaaggtggcggcacaagtgttcatgccactaaccgttggcggtggcattaaaagtgtggctgatatgcaagctttgttaaaggccggcgccgacaagattgctttgaattcagctgcagtgacgcagccagaattgattcaagctggcgccgaaaagtttggcagtcaatgtatcgtggtggctattgatgttcgctgggatgaagccgtcaaagaatatcgggtttacgtcaatggcggtcgtaaagctactgatctagaagcaatcagttgggctagaaaagtggtcgccttaggtgctggtgagttactggttaccagcatggatcgcgacggtactaaatctggctatgatctgaaattatatcaagcactgacggcggcggtcaatgtgccgatcgttgcttctggcggctgtggtaaattagctgatttcaacaccctttttgcggaaactgacgttgatgctgctttagccgcctcagtttttcattatggcgagctaactattccgcaagttaaacaaagcttgcgggaacaaggggtgactgtccgatgatccaacttgattttagcaaattgccgcaacaattactgaccaccgtcatcaccgacgccagtaacgggcaagttttgatggtggcgtatatgaatgaggaaagttggcaaaaaacgttagccagcggtgaaacttggttttggtcgcgcagccgccaagaactatggcacaaaggtgaaaccagcggcaatacacaaaaagtggtggcgatccgcgttgattgtgacgccgataccttgttgatcagcgtgaccccagctgggccagcctgccataccggccattatagttgtttttatcgtgatattgaaggcaatgaaatttaatttaaagaaggcaataactatgcaaacagtcgaagaactttatcaattgattctacaacggaaaagtaatcccgaaaaaggttcgtataccgattatctattcactaaaggtttggataagatcttgaaaaaagttggcgaagaatccaccgaagtcatcgtcgccgctaaaaatcccagtgatgatgaatttgtgtatgaagtcagcgatttagtctatcacgtgctggttttaatggctgaccgcgggatcagtgtcgatgatatcaaaaccgagttggctaagcgtgaagggctaatgagcaaaacacaagaacgccgcgagatcgataaattatagattgatattatccgaaaaaagtgagtagaggaggaactgcgatgctgaaaaaaacggtcagtcagttacaaccgtacgtgccagaaacgccattgccggagctagaaaagcagttaggcttagcttcagtggttcgattatcggctaatgaaaatccatttggcacttcaccaaaagtccaacaagctttacagaattgggactttagcaacagccgctattatccagatggcgatgcggcagcgttgcgtcaagcggttgccgactacgttaaggtggcgccagaacggttgttatttggcaatggccttgacgaagtgatcgaacttgtttccaggacttttttggaaactggcgatgaagttttggaactcgggccgactttttccgagtacaaattacacgcgcaaattgaagataccgttgtctgcgatgtggcagtacaagcggatggtatcgctgatttgaccgcactggctgccgcaatcacgccgaaaacgaaactaatttggttgtgtaacccgaataatccaactgggaccgctgtaccacaaacagagatcgctaaatttatggcgcaagtgccgcggacggtgttagtgttgatcgatgaagcctatattgactttgtcgacgagttagcgacctatacggcgttaccgctattagatcagtacgataatttaatggttttgcgcactttttcaaaggcgtatggtctagctaacttccgcgtcggttacgccgtgatgccacctaaattagcgccgagcttgcagtcggtgcgcttaccgtataacttaagtgcaatcgcccaattagccgctcagaccgccttagccgatcaagcctttttacaagcaacagttatccgcgtacgccaagcgcggcagcaatgggaatgctttttgcagcagcacggctttactttctatcattcacaagctaatttcacctttttccaagcaccacatgcgttgaaattagccgattacttgctgcacaacggctttatcgtacgcactggtttacggccagattggttgcggatcacttttggtactgcggagcagaatgaaaagctgcaacaattgattctagcgttttatgagaaataaataatcgtcagctatcaacttcctaatgaaggcgttgataactgacgattttattttgcgctgatcaccacgcgataatccagtggccgtttactgcctaaaataaccaaccgttgctctggcaagcgaactaagcttacttgcgccgactcagtctcatagtgccaactaaagccagttgaattataatcaatgcttaaacaaggtagttgtgattctggaattggccaacgtaggtgctgctgcagcgtgtgtagctgtaaatgatgtctggtgaccgtgagccgactgatctgtcggcgttgattatcggtcggtaagtacagtattggctgctggccaacaccgaaatttaattctaagtgaaattcagggggtgctggcgccaataaaacgcgttcagcaccatgaagatagccgttaaagacttgcttcatcgatcgttgttgtattgtgggagccacgctcagcagtgaaaacagtgggttctagctggtcagtagcaacgacaaaagtgaattcagtgttggtcgctacaccccaattaccagctttgtccaaagcgactacggatacggcaccgatatgaccactgcgatgataaagttcatcaacaaacgggtaaacggcttgatcgcaggcttcttgcggggtagcgccagcgcggatcaattcattgatcttaaatggtagcatgcccttcatcaaatcctcgcctaatccagtggtaaccacgccagccaccttattatcgcaataaaaaccagcaccaggcagtggcgcatcaccgacgcggcctttagctttcataaaaatacccgttgttgaagtccccgtgtgcagccgttcacggtaatctagactgatcacggaaacggtgtcatgggtattcaacacgtcatggcgcgtagcatttttacgtacttgcttgccccagaaagcctgcatttcaggggtcagcatatttttattcgtgaagccgtgccgttgtgcgtaagcatcagcaccgctgccggctaaaaagttatttagttgttcatgtgataaattacgcgcgaccgcgatcgggtgtgcgatatcgtgtaaggcagtcacggcgccaatacttaatgtgtcaccgttcataaaggcagcatccatttctacagcaccttcagcattgggtagaccaccgtaaccgaccgtattaaaagctggattgctctcgacatcttcaattgctgtttggaccgcatccccgcttggccgcccttcacgtagctgctctgcggctttagtgaccccatccaggctcatttgccacgttgaaataattccccaagtcatatggattcccccttaagtaaggtttgattttagttaaatataaaaatgaaaaacgtgcgccagcaatttgcggcagcacgtttgagtcaagcaacgactaaattgggtaatcgcaactgtttttcgccggcgcgcaacgccaaaatatagccattcttgataatcaacgtataacgaacgttgggctgtaactgtagtcgttggcccagataattataaattggtaaagctgtgcttgtagcgatgctcagcctccttcatttattactatcttcattgtactgattatcaagtgaaatatcagcgatttaggcgccaattttgtttacaatttggtaacattttttagaatgcttaaaaaagcacttgctcagctgattttccagtgtgaaatgtgctagtcggcgatgatctcgatcacaagtttgccttgcgtatgaccagcttccaataaacgatgtgcggtgatcatactaagttcagagaaggggagacaacgacctagtgggacttgtaatttattgtgacttagtagatcgactaaatgctgtaactcagtaccatctgggactaaattaaaatcttcctgtgtcgctagatagcggccttttgcactaagtaagttcgttgtaattggtttggtcgttaagtcgagtattacgtcgtattgctgctgcatagcagtggctgcatcgactaaattaaaatcagattcctgagtggtttcgggagtgatggccgtaacttcagcaccaatacccgcagctagttgagcggccaattgtccagtacaactggtgaagtcgttgatcaaaacatgttgctcattttcgaccgctaaatgcattacgatcgtttgccaagcagttaacccggcagttggtagcgcagccgctgtacgaaaggcaacgttgtctggtttataagctaggttggccgcatcgactgcaacatactcagctgctgcaccgggagtcgtcaatggtagacgagcaagtacggcgtcaccgactaagaaatcagtgacggcactgccagccgcaacgatggttcctgctagatcccaacctaaggttaagggaaaatttgctggaatttgtgcaagtaattggcctgtacgtaattgaatgtccaattggtcaattgaaaaagcatgcactttaaccagtacttgatgcgcagaaatttctggttgtggttgttccgtcaaggtcaacgcctttgcggaaccgaattgattaattaccattgtctgcataacctgatagcctctattcgtcattaattatattccattattatacaattagttgtcgatgtccaagatattggcatttatgcgtatttattgccagtatttatgatcaatgttaatttgttcttaatcataacgataaaatggaggcgtaataaaatgaacgaatttgatgtccagaagcgttatctgcagtgtgtcacttatatgatcacaaagttgaaaatgtttgatcaaggttttcgcgattatgaaggccgttacttgcatatcatggatacacgcgaagcaactactggagaattagtggaactcaaaactaattttaaacgtggcttgatcaatttcggtagtttagttgatcgcttccaggaattagaagcacccacacaatatcaacagcaacatcagcatttaatttggatctatcgtgattatgctgctgctgtttgtgatatgatcgatgcttttaacgttactgattatgcgatttgtcataccaaacaagatagtggtcacgcccaacgaacacgtagtctgactgatgttaaacaattattggccgaagaatatcagattgcttaatatgtactgaaaataggcgcttttacccaattatgactaaaatttgcatgattttttgagctcgtttaggcgaatcaagctgggattagtccagttaggcagattctttggcgtagatagcggttcaatgttaaattgatgatgagcagcgcaaaaagtaatttctgtaataactttaatgtcagtgagtctaagggggcttatagatgatgttcgatgtgctatttattggtagtggtcaaggtgcctggaacggtgcgattcccatgagtcaagcggggttaaaagttgcagtggtcgaagaagatttatttggcggtgtttgcagcaatcgtgggtgtaacgctaaaattacattagataagccagtggaattggtgcgtaatattgaacagttgcaggggcgcgggtttgatagcgtaccccagatcaactggcctgatttgatggcgcataagcatgaagtgattggtcggctagcggcaagcaacgaacaaaaattggttaaagctggtgtgcaagtgatcaaaggccatgccaccgtcactgctgctgataccgtcacagtcggggcaaccgaatataaagcagagaaaattgtgttagcccttggtcagttgccgcatcgtttggatattcctggtcaagcttatctgcgggatagtaccgatttcatggcattgactcagatgccagaacgggtgacgatcattggcgctggctatgttggaatggaatttgcggcaatcgctaatacagccggagctgaggttaatgtgatcgttaaaggtcatcagccactgcgcgaattttatcaaccttacgttgaacgattagttgtcagcttacgtgaacgtggcgtgcgctttttctatgatcaacaagttgagtcggtgacggagtcaacatctggtttgttactgcaggggactaatcaatttgctttggaaagtgactatattcttgatgccaccggccgtgaaccccatgtaacggacagtggtctagagaacattggtatcgcgaccaatgcaaatgggatcatcgtggatgatcatttgcaaaccaacgttgctggcgtctatgcaacgggtgatgtggtcgataaaacacagccgaagatcacgccagttgctatctttgaatcacaatatttggctcaattatttactggacagacaacggcgccaattaattatcctagcattgccacaactgtctttacttcaccacggatctcgcaggttggcattagcccaactgaggcggctaaatcgccagatcaatatacgatcgaaacttttgagtatgctgaagattggttccgccaagtacaaaatgaaaccgatggtagcctgaccttggtttttgatcaggaaaatatcttggtcggggcggtggaatatagtaacgaagcggttgatacgatcaatggtttattggaggtcattgaattacgcttgacccatgaacaggtccaacgctttatttatactttccctagtctgcagcatagctattttcgtaaggtttaataaaaagttagcagtcttaaaaaagaaaatccgtttagaaatcatttgatttctaaacggattttttaaatagttaattatataacgtagctctattcagccaagcgccgtgagtcacttcgactaagtgctttgaccttttgccaaagtgcgtgcagaccaaaagcagaagcaaatgatagacaccaagtgcaagcataggtcaggataacgcctaataatatgttttgaccggtgagctgttgtccaaataaatgccagatgagttgtgaccagaagacattggacagataagctttataggcaaaaccggcaaacttgtggacgaaggcggtaaaaggtaacttgcgttgaatttgaaaaagtgccaacgcggcaattaagccaattactgctagatcatagatcgtcatggatggtttgtaatacggggcattagctagatcaactggcgtaccgaattggtgtaattcatagtttgtccagtagaaactagctaggaaaatgacgattagaatcggccaaaatttttgtagcacacgattaaagcttgcccggtactgccaggcaagtacgccgccaacaccgtaaataaagaaactgataaataagcgatcaaataaataccaactttgggcgtgtgggccctggaaaattgcggtgtcataaaatagcaaccaggcagcggtgatgagcagcgtgccgcctaaagtgatccagccgcgttttttgttagtcccgcaccaatgaccgatggcccaaaaaagtggcatcaaaataatgaattgcagcatcatagtgttataccacaaatgtggcgctgcattcccattaataaaatgccacaagaaactaggtagatcatgaaatttattgacctgttgcacattgggcatcagtaataaataggcaaaagtccaccaaatagtcggaataaataacgcgtgccactgcttgtttaaataactaccataggttagctgggcattaagcgtggtgcgggtggtcgtatataaaataccaaatataaaagctggcgctgtaaattttactaagttatagatgagtccaatgccgaattgacttccggctgcggggtgcgctgtaagtgctaaacttaaaattggttgtagcataacagctgtacaggcacaaagcttgagataatcgccaatatccgcgtttatttcaagcttttttgacttgctcataagaaataccaccttttcgataattgtgagaccgattaggcagtacgtttcgcattcaatctaacaaataatctcaaaagaagcaagctaaattttaagtgaacgcttgcgttcggcaacaaatagttcaactagcgcgttggcaacaattcgtgcaacgttggattctgtttgttgattttccgttaaataaatggtgcgaaatggtgggttcgaaaagatgcgcgccaggtgcaattgccggccgaccttttgccacgtgactgcgggaatgaagccaataccggcgccgcttaataataattcgcgaattgtcgcgggatcgtcggcttcatactggtagtttaaatgaatgtctaaggcttcgaagtaactatcaactttatcacgtaggggattgtgccgccccaaaccaatcactggtaatcgttgtagctcggttggcgtaacgtattgcgatttaaactgctgctgggcgctaccaacaagaatttcttcatttagcaacggaatggcggtacggtcgagctgtggttgccggctggagataataaagtcaaattggcgcggttcgctgagcgtactgatacgttgagtgagctgaactggtgctgccggaaaatgttgttgaatgatgtggataattttgggaattagtgacgaggcaacttcgactaaaaggcgaatcggctttagttggttagttgttttagtcgtgacggcatcaatgcctttttgcagttggtcaagcacagtggtgacgtaagagaagaagagctgaccttgagcgtttaattgaatggtgcggccagtacggtcaaaaagttgtacaccaagttctttttccagttgatgaattaatttggtcatagctggttggctgatataggctaatttagcggcttgggtaatactgccagtttgggcagcgaaaacaaagccttgtaattgtgcaatattcatttggattccccactttaataactaatggttattatttattaatataattcattatacatcagaattaattcgcgttacattaagcttgtgagactgattagactgtttcgtcagaaggaaggaacaaacatggatgcgctatggatttttcctggtcaaggtggccaatacgcggggatgcttaagcaggtaccagcagcattgcgtcagcatgtagaaacattgctagacttaccgttgctagatacgacggccggctacgcggattcagtgcaactacaagttagcattacgttgctgcaagttgctcaagtgcaaatgatccaaaaaatgggcttccggccacgcttggcggcgggccactcattaggtgtttttgcggccgcctatgctttggattgtttagcattagatgatttattcaaaatcgttaagcaacgcgctgaattgatgcagcaagcctatcctgtaggctatggtatgggcgttattgtgggtttaacgcgtgcggaggttacccagttagtggcacaagtcacgactactgcaaagcccgtttttgtctcaaatcaaaatgctgaggatcaagttgccttatccggtcatttagtagcaatcgatcaggtgttagaactagctaaagcccaaggtgcggctaaggccttgcgcttgaatgtgccagtaccctcgcattcgccattaatgcacgatgttgcagaaaaattgcaacaaagtttagctgaggtcacttttaaccgtccgcacggcatttatctagccaatgacaatgggcacgccgcccggcagatcattcccgtgcgccgtgatctaggtgataatctagtgcatccagtttattttgagtcgatgatggccgttgcaacgaactacgcgccagatgtcattattaattttgcaccaggacatcctttcaaacaagtgttagcacaaaaattcgacgagcagcaccaactctacttggcgcagttttccaaggcagatatacattacttattagaaaaatgggaaagaggttctaatttatgagtgattcagaacgaaattgggcaagtcatcgccaagctaaagccgctaaattagccaatgtcgctaatttacttgatggcaagtttgccaagactgaagctgcaacacaaattttagaaacattgatcagtagtggtgacaaggtggttctggaaggtgacaatcaaaagcaagccagctttttatccaaaacgttggcggcagttgatccagaaaaagttcatgatctgcatatgatcatgagcagtatttcgcgaccagaacatttagatatttttgaagacggtattgccagtaagatggacttttcatttgctggaccacaaagtacccgagtttcacaaatgatcgctgatggtagtttaaaggtcggcgatattcatacttatttggaactttatgcgcgtttatttgttgatttaattccgaatgttgtcttagtcgctgctgataaagcagatcaccaaggcaacctttatactgggtataatactgaagaaacaccagtgatcgttgaatcagctgcctttaaagatggtattgttatcgttcaagccaatgagatcgtggatcaattaccgcgcgttgatattcctggggactgggtcgatgtggttattccggctgacgaaccttatcagttagaaccgctatttactcgtgatccacaaaatattactgagatccaaattttgatggggatgatggcgattcgcggaatctatgagaaacataacgtgcaatcagtcaatcatggtgtcggttttaataccgctgcgatcgaactattattacccacttatggtgaacaattaggtttgaaagggaaaattgtgcctaactgggaagtcaaccctacaccaactttgatccccgcaattgaaagcggctgggttcaatcgatccacagttttggtggcgaagtggggatggaaaaatacattgccgcacgcccagacgttttctttgtcggcaaagatggaaccatgcgctctaaccgtgcttttggtcaaatggctggtcagtatgccttggatatgtttgtaggctcaactttgcaactggatcaatttgggaactcatcaacggttactaatggtcgtttatctggttttggtggtgcaccaaatatggggagcaacccaactggtcgtcgtcattcaacaccagcctggcaaagtctaaagccagcggaagatcctttggcacgtggtcaaaaactagttgtccagatggtggagacatacggtgccaataaacggccagtatttgttgatcatttggatgcagaagaagttcgtaaagaagccaaactagctaatgtgccagttatgatctacagcgaagataccacacatatcgtaaccgaagaaggcattgcttacctatataaaacctatagtatggctgaacggcaagcggcaatcgaagctatcgctggggtgacaccaattgggttacgtagtgatccagatacattaaaggatctccgtgcgcgcggcatcgttgctttaccagaagatttaggtgttcggcggaatgatgctaagcggtcattattagcagcacaaaacatggctgatttagttaagtggtcaaaaggactttataatccgccagcgaagttccgtagttggtcataaaatgatgaacagtattgcagaactagctgttgccgcattaaaatgggaggccaattttacccctaaaccaggtttggttgacgccgtttcaaatggtgcccatcaggacatggatgtgactttatttagacgttctgccactagtttatcttcgtattttgaaagcatcgtacaggtgtcgagtggcgcaacgatcgatcgttcattacgaacgaagattggcgctttaggtcggcaggctgaagcaactatgtatcagacgactaatggtgtcaatacacacaaaggagctatttggaccttggggttattagtcagtagcctcgcgatcacaccagatgctgcgttagcagatattcttactggagcggctgccttggctagtttacctgatgaaaaattggttgcaccaaaaaagtcctacggtgaacaagctcagcagaagtatggattaggcggtgctaaggcggaagcgcaacaagcttttccgcacattgcccctttgctacaatggcctttaaatagtcaggatgattggttaagggtactgttgcaactttatgcgactgttgatgatacgaacattgttcatcgcgctgacttggcaacgttacgtaattttcaaaagcaagcacaacagatcgttgccgatgaacagccggtgctggccaattctcggttacgtgagttagatcgttttactttaaaaatgaatatttcacctggtggcagtgcagatctatttgcggcaatcagatttttaacttggatcaatatttatcgagaggagcatgaatcatcatggaaaaattacatttcacatttaaagccacagaacctatcagccaccctgtccatgtaggtgtggttgcgtctggggacttggaggttattatgcggccaacaactaaagatgctgaattaaatattgttaccggtagtgatggctttcatgatacgtgggaacatgttttacaacgcttttttgcccgttatccactacaggctgactttgaaatcaatgattttggggccacaccgggtgtcgttaatttgcgattaactcaagcaatggaggcgttgaatgatgaacaatagttttgttgaattacatgcacggcaacgtgcactagcgttattggacgcaggtacgacgcgtgaattgatcgatccatttaccgatatgatctcaccgcatttggaaccccagaatattgttccagaaagcgatgacggggtcgttattatgaaaggccaattagctgggaaagctgctgtagtcattgcaattgaaggcgcatttcaaggcggcggtatcggtgaagtcagcggggctaaaattgttgctgcgctggaacatgctttagctgataatcaggctggcaatacgatctatccggttttgattttagatactggtggtgttcggctgcaagaggctaactatggtttactatcgatttccgaaattcaaaatgtgatcattgcgttgaaacagtttgttcccgtgattggtttagttcctggccgggtaggttcttttggtggcatgtcgatcactaacgcgctgttgtcttatgttattggaaccaaccgtgcgcgtattggtttaaatggccctgaagtaatcgaacaagaagctggggttcaggaattcgactcaagtgataaagatttgatctggaataccttgggaaccacggaacggcaagcaacaggcattattgatgaagttgtagctgatgacgtgactgcatttaaacaagcgattatcgcggctattgacgagaaaaaagatagtcaccgcgatcagcaagttgatctttatctatcattattggatcaacttgatcctagtcaaccactggatattgccggctatcgtgacctttatcaccaagttaaggtaacagaacatcacttggctgcggcaaaatcaagtgctgttgctggcaccaagagtcgtggccgcttatggtttgaacaattaacgggtattaaaaacgctcaaagtgaggttgcaacagtattgcatgctcaagccgatggccgtgagtatattgccattgtacctgatgcacaaaatcgtttcccgcgtgtacgtgaaggtgaagttgggttacttgaaggctatactgtcgcgtcagtagtcaatgacttgatcaaggcggatcaagccaaggcaaacaagacaccattagtgttgatcgttgatgttcctagccaagcatacggttataaagaagaattgatcgggatccacatggcattagcctctagcgttagtgcttatgcccgtgcacggcaagcaggacacaaagtcgttgcctttattcctggcgatgcggtttccggtggctttttggcacatggtttgcaatctaatcgattgattgcattggatgatttagcgattacgattcaagcgatgagtaaagcaagcgccgcacgaatcacacaacggacgatcgaagaattagaagaagcaacgaagcacgttcccgcaatggcttacgatattaaaaattatcaaaaactaggcgcactgtatcaattagttcctggtgtaaagggctatgatgatgatcctaaagctattgccacgattcaagcggttattgctgaagctttagctagcttagatgacgtacctgcagatatgagtttccgctatacgaattcaattgctaaacaaagcggccgggtggcgactaatcaagtccgtcagctgatggatgaacaatggaacggatagcgccacatacgctgcttaaattaaaaacggtaaccgacttgattttcactggtgacttaccagaatgggtaacggatatgttggcgcaagcaccatacgtcattgtccgacgtggtcagcaagatacacagattccgattggtattcgcggttatcagaaaaatcaacgcttcgctgcttggatgccgctaggcgcatggcaacaagtaattacgccacaggcggcgctaaaatacttaccacaactggctgcgactagacaaactttagctgcttttcaaaccttacggcagatcacgccgcttttagctgattatcagtggggtgtcggtggtagtttacaatatgaattagttactggtttaccgatggctcgtgcagctagcgatgtggatgtgatcatgacgttgccacccaaaaaaatgacgccagcaacggccaagcagctagtcactactttaaagcaaatgagccaacacgttgatattcaagtagtcgctgatgaatatggcttttcactagaggaatacgggatgcagcgcagcacggaaattttagttaaatctaatcagggaccacaattggttcatgacccgtggacttttattcaagagcggtgtgactaatgaaacatcatttagccgatggaacagaactagttgttgatattcagggtcaaaggcggccaatcatttttctcaatggttttggtggttatttagaaatttggaccgcccaactaaggccattgctggctaacggttaccaaacgattcgttttaattatcgcggtcagggtggttcaagcggtggttacgctgctagcatagcaactttagcctgtgatttagccgatctatggtccagtttgaacgttacgcgtccggtgatcgttgcgcattcgatgggggccagtgtcttgtgggcgttgcgggctgattttccacagttagtgccacaagcacaagtgatcgtggatcagtcacctaaaatgcttaatgcagctgattggcagtttggtttttgtgatgcgacagccagtaattaccaaaaatatttaacgcaggcacgcggacacgaaaccttgcatgggttggttcctgaggtgatgcggcctctgatcagcgcgcagcttaaggcaccgttcaagcggcaacaagctcacatgttactggaaactcattttcaagccgattggcgcgcacaagttcagattgaacaggtaccaacactgttcatcagtgcacagcaaagcccatattttgccagtggctttggtaagtgggccgccgcacttaatgcaaagattcaggcagtgacgattgcggattgtgggcatgatattatggcagaagtaccggcagcattcaatcaaacattaagacatttcttacgtcaaacttgttaaagaagaccagcaaaagctgatcttcttttttcattagttattttaatttgttcactggtcttttatgctaatatggagacaaaagggcggtgttagcgatgaagccacgtaaacgagcgcgcttatggcaaattattaaggtgctacgtcaatataatgtactacgtaattttactcatcaaacccatccggaacaggtacggcaggcttttaccgagctggggccgacttttattaaggttgggcaaatgctatcgacccgcaccgatttgatcacacctgaatttgctcatgtgctcaaggaattgcaggatcaagtgccggctgatgattttacggtggttaaggcgacgatcgaagcccaaacaggtaaaaagttaaccgagcagtatcagcaattcgatcaacaggcgtttgcgtcagcgtcgatggggcaagcccatcatgcagtcactaaggcgggccagcaggtggtggttaaagtccaacatccgcacattcgggctgatattattaccgatctagcactatttcaaaaagcaatcagcttactgaaatttgtaccggaggccagtgtgatcgacccgcaagcgatgtttcgcgaaatcaaacgggccttgtttaacgaattaaacaccgcattggaagtggaaaacggccagcggttctacgaattaaataatggctgggatattattcgtgtgccccaggtcgatactgcgctttcgcaagggacggtgctagttaatcaaaccatgcccggcaagcgaatcactagttttttagcggatatgccaactgagcagcggcattatctcgcccaaacattggtgcagaactttttaaagcaggtctttacggacggcttttttcacgccgatccgcatccaggcaatattctattgaccactgaggagttgccaccagtaactaaggttaagcgcgcttttcagcgcgctgactttacggctacgcaaaccgaaaccttaccaccataccggttagtctatctggattttggtatgatgggccaactagccccagcaatgattacgagcttagctaatgtcgtgatcgcgatcaccggcaaagatagtcgccaaattggccaagccttactggcaatctgtaatcgaacaggcactgtggatgaggaaagcttttatcagcaattaggtgcgtttatgcaaccttatttcaacgctggcttaggtgaaattgattttgaggctttgttgtatgcagtcattcaactatgtcgcgctaatcaattacagatgaaacctgaagtgacgttgctacttaaggcgtttggtgtgttggaaggcacaattgcccagctagatcctgatttatcaatgctaacggtggcccgtcactttgcccgcgattatttccagcaacactttgattggcgccaagaaacggaagctagtgtagttaagttatggcaattcgcgaaaacagcgccccagctaccggtgaaattacttagcgcgcttgacgtgtttgagcgcggtggggctaaagttaacctagagctaaagcagcgggatacattattggatcgcttggaaaatattgtcaatcgtttggtgatcgccattattttagcggcggtgatcataggctcttcattgttggttcaagcccgggaagccaacgacttgatcgcccgcttaggggtaattggctatagcgccgcactgctggtgattatcgggttagtgatcagtagtttatatcgccgctaccaacgttggcgtcataaatgatagtcttttggtgcttacgttgtagcaggtttgatttagttggcactagactttacggtcagtgcaaccatgatttagaaattgattagcaacaggcaaaagcgcgcttaatggcgcgattttttgttatagttagggtaaatattctagagatgaggtgagtggatgcgaactttaattattgtggctcatccagaattagccagttccgggacgcaacaatttttacggcgtggggccgaattagtggccgccgactggcagccgctgagtacagattttaatgttgccaccgagcaagttaaattacgtgccgctgagcgaattatttggcaatttccactttattggtatagcgcaccggcaatattgaaagcttggcaggatcaagtgttaactagtaaatttgtgctccacgaacagggcttagctggaaaagaactggggatcgtggtgacgacggataccaaagctagtgactatcagtcaggagcggttgaacaatttacgctggctgaattattgcggccttatcaagcactagcgaataaagcggggctgcattggttgccaccatttgtgatcaaccagtttagatatcaaacggaaagtcaacaacaggcgctactgatcgcctatcagcaatacttaacgctgccgcagccagccacatttactcagcggcagcactggtttgcccagcaacttcaacaaatgatcaccaatgcgactggtgaacgtaaaacccagttagtgctggtcgaacagcaattagcggctaagcaggatgagctggaagagttacggtggacgatcgaacaaatgcgaggtgacgactaatggattcgtggttatatcaaacggcccagcaattggcgcaagatagtgctgcctatgaagagcgtgcctttttccaggcgttaagtcaattagctgtagaacaagaaaagcggatcgcgcaagcgcaaggtgagatcgatggacgtagttgggatgaaaaggcatggtgaacgagacggacgaccaagcaacagcagcattttgggatgattttgcgccggattatgttgcctctcaaaatgagtcgcggttagcgatcacaatggatctaaccgcctatttaacgcagcaaaatattttaccgcaggccagtgtattggatgttggtggcggggcggggcggtttgccttgccatttgcgcgtgtggcgcgtcaagtgacgatcagtgatatttcgcagcaaatgttgaagtttgcgcggcaagctgctgtgcaagctggactgactaatttgaaattccaacacagtgcttggtcacagctgccggcacagccgcaagctgacgttgtttttgccagtatgttgccgctggcgccggctgagctgcaaaaattcagtcaattaggacgtcattttgcggttcttaatcgggcggtgcgtcatacggatagtatttcaactgagttgcagcagttgctagatctgccgccagtgctggacccaactaatgacgctaccatcttttctgaatacgtgctggcagtccgccaactcggttatcaaccttggcagcagacatttacctaccatttaactgagcaagtgacccgtgaaatgttggtagccgaattggcggatgaattaacgctacatcagcagcgactattccagcaattgctaactgaaaagtttgcgcaacacgatgagattacggcacaacagacttatgcgttcaagactttactctggcgagtcggattgcagtagctaatttcacgtgaggcagctataatataagcaaagtaattagttagctcgtactttccgatggtgattaaactaatgccgtgaactggcaagtttaagtcgcactgtccgtaatattaagaatttttgatacaaaaattaaccacttttgtggaagaggtgcaaaaatgatgacggtatttgacgtgctaaaaatggtcaccatcaaccatatgccggttgatgttcagcaaattgtcatgacggatacggatggcaaaccaaatagtgttttaactgacctgttaaatgacgttttaggaaaagttcgaatttttatcgacttacaggaaatgactggtgttagtcagttggtcaatgagttaaaaatgtttacgccgctgccaacggatgtattagatgaatatacgaagattttagagcagccggtcagcagcatcaattttgcaccgcgtaagcagcaaatcgaattggtttacgatgaatatacgtattaagtaattaaagtgaggttgtggcagaattttttgtcgcgatctcactatttattttatatagtagaattagtttttagccaaacatgtgttctttgaaacgtgatttcatggtatagtttaattattaaaacgaatgcagagaaagtgggtgcacaaatgcgttttttacatactgctgattggcatattggcaaaaaattgcatgggtatgagctatggactgaacaagaagatgcctttcaacagattctagccttggcccagcaaaaaaaagttgatgcagttgtattggcgggtgatatttatgatcgtgccctgcccagtgaacaggctgtggcaacagtcaatcaaatgttacaacagatcaatttgacggcacaactgccattgctggcgatttccggtaatcatgatagcgcgacacgtttggaaacggggagtccttggtttacggccaccaatttttatttgaatactaagctcgaacaagcctttacaccaattgagctcgctgatacgcagttcttcctattgccttattttgagccctttgccgcgcgccaatactttggtgacgataatttgcggacgatcgcgcaggcaatgccaaaaatcgttgcggcgatgcaggaaaaatttaaagccgacaagaagcatgtcctagtggcccatttttttgcagcgggtagccaacaaagtgattcggaaactaaagtaaccgttggtggactagacgcagtaccaacggatgcattggcagcttttgattatgtagcattaggccatttacacaatgagacggcgctgcatgctgagcgcatcaaatatagtggttcaccattgaagttttccgtttcggaagcacaacagcagaaaggggtttggttgatcgatacagatccatttcaggctgagtttctaccattaaagccgctgcgggatgttgccgaagtgactgccagctttgcgcagctcacggatccagcctattatggccaacttgagcgggatgattatttggcgatcaatttaatggatactaaagttattcccaatgtgatgcaggaactgcgtaaaatttatccctatatactaagcttatcccgcgaaaatggtcgcgaagtcactgcaacctcaacaccacagattcgaaccttatcaccaatggctttgttggcggacttttttcaagaaacgacgacgcaattcttgacgactaagcaagaaaaattagcagcggcagcacttaaagcagcacaaaaggacggtgagtaggatgcggcccttaagtttgatcatgaccaattttggtccctacgcccacgagacgattgatttcacgaaatttcaggaaacaccgttattcttgatcagcggtaaaactggcagtgggaaaacaacgatttttgatggcttatgctacgccttatttggagtgacttcgggtcaggagcgggatggcaaaatgctgcgctctgattttgcgactgcagccgatttgactcaagttagttttcggttttctcatcgcgaccgtgagtatctaatcgttcggcaacccgatcaattagtagctaaaaaacgtggtgacggttatcgtgatcagccagccaaagtaacgctgaccgtttatcaacaaggtaaagaaattcaggaattaactaaaaaaggtcaagtagcaacttatattcaagcgttacttcatttggatgccaatcaatttgcccagatcgttttattgccacaaggagagttccggaaattcttgatgtcagatagcaacgataaagaaaaagtactccggaatctttttggcacacagatttatgagcgctgggcgcaagtgttaaaagaccagcggcgaacagctgataaagcttttgctaatgctaaccagcaagtgactgtaatcttacaacaggctttttggttaccagaatttcaggatgcggcggatagtgcaaatcccaatgatgtgttggccgctttacagcaacaattaccagagctaacgcaccaagtaactgtggcggaacagcaaatgcaggcaacgcggcaaagcgagcagcagcaacaggctgccttaactgcagcgcagcagcaagctaaatggctgcaagaacagcaggctaatcaagtcgctttggcggctttagctgaccaagaaccagcgatggcggctttgcaacaacaaattaaagcgttggaatgggcgcaaggggttcagcctttggcgcagcaatgtcagcagttgacggaacagcagcgtgagttagaacagagcttaacgactttgcggcagcaacaaccgcaatatcaagctgaattatccgcagccaatacgcgactgaatgatttgcaagcaatgagtgagcagcaggccaaccggcaagcacaattgcatcagtggcaagctttactgccgctttatcaggaagttgctgaattgaccgaaaaaattaaagcgacaactacggctgcagatcaggcacaacaagttgaacaacaaatcaggacgaagcaagaacaactaaccactgaacaaactggactgaatgagttaatggcaactggcggcaaagtggcacaagaattagcggaattgacgagtcaacaacaggcacagcaacaaatacagcaacagatcacaactttgcaacagcaagccactcaaataaagattgcggaaactgatttggcccagcagcaggcgaagttaactgatttgcagacgactagtgccacggctgaagcaaactttttacaagttaaaagtgattgggcagcgacgcaaattatccgtttgcagcaggagctattaccaggacaaccctgccctgtttgtggcgccgtggaacaccaagtcgtggcaccgccacaaactcaggtggtcagcgagcaggactaccaagcggcggaaacaacctggcaacaagctcaggcaaatgcagcgcgcttagcaggccaagtcgctaatgccgctgaaaatgttgagcaacaacaaacggcttggcaaacagccgttgcgactttacttaaagcgacaaccaccagcgcaactgatttaactgaactaacggcgatcgtaacgcaaactcaacaagacttagcccagcaattggttgccaaacaacagcaacaaggccaattggaccaggcggcggcgcaattaaccaagttaaaatcagccgtaactgctaatcaagcggctttacagcagcaacagcaacaacgtcaagcattaacccagcagctgatagaattaaaaacgcaacaacaaaataagcaacagcaattaccagaagcttttacggatcaagcggctttgcaacagcaactcaggcagttgcagcaaaaaattacgctttttgagcagtccctcacagcagcaacaaagcaacagcaagctgcaagtgaagctagtttggtcaatcaaacgcagatagcggaacaaaccaagcaactggctgctgtcacccagcaattgacccagcgccaagccgagttgacccagatcttagcagcggcaagcaaaaccgaggtccaactacaacaattaatagcaacattaccgcaattaaacgcgcagcgtcagcgattgcaagcctttaacaatcaacggttgcagttgacgacgcgtcagcaaagtttggcagcgcaattaactattacaacaccaccagacctagcagcattacaagaacagttagcacaggccacagcaaaattgcgtgagcaagaaaaaagctactatcaattaaaggaatactgtgaacgtgatcaacacgttattcagcaagccacaacgcaacttgccggtatcaggcagcaaatggctgatctagctgaattgacccaattagctgaagttgccaacgggggtggaccacaaaaattgagtttggaacggtttgtcttacaaacttatctgcgggaagtgttgtgtgtcgctaatcagcgactcagtgagctgactcaagatcgttatcaattccaattacgagcggccaatggtagtttccggaccaataccggcctggaaattgacgtttacgatgataattgtggggccattcgcagtgtgcataccttgtctgggggtgaaagtttcattgccgcgttgacgctggcattagctctaggtgaggtgattcagcaggaatccggtggtgtcgagatcgaggctttatttattgatgaaggctttggttcattagatgaagatgcgctggaaacagctttagatactttagaaacagttgaaggtaagcatcgtatgatcggtattattagccacgttaaggaattacaagagcgggtaccagatcaattgcaagtcactaccaatgggaatggtcaaagtcatattcgttatcagctcggctttgaagtttgatattctcattaaaacaagtcgaatattcaatgaatatcgcgctaaaattaattaaaggttagtatttaattaaaaaatgaattgacaagtaacactattatacttaccatttaaagcatggtttgacttttaaataagtcgacaatcaaattaatggtgtggtggatagtgtgataaaaagatatgatagcgacaaaatcaaacaattagtattaacatttatcaagcttatgggttttctgaaacacaaagtcataaggtagctgaaatgttgatctatacggacttacatgggatagaatcacacggtgtacagcgcttggtcatgtatgaccattttattcaaaatggtaaaatccgggtacatagccaaccagagatcgtgaaagaaaccgatgttagcgcggtagttgacgctaagtttggtcttggtcaattaaacggaatctatagtatgaatttagcaatcgaaaaggctaaacaacatggtattggtatcgtgacgacccgtgattctgggcattacgggattgctggctattatgcagatatggccgcacagcaaggcttgattggaatttcatcgtgcaattcacggccggcaatgttgccaacgcatgcaaccaaagcttttgttgggaccaatccgattgcatttaccatgccggctaaaccgcacaccttcatttttgatgccgcgaccaccacggttccgcaaggaaaaattgaagtgtacaataaattggaaaaggatcttccggctttatgggtagccaagaatggcaatgagccagtgtatgaccacacacaaactgaagattttaaggctttgcgtgatcctgatgcgacggttggtttagcacccttaggtggtgtgtcggaaaatacaggtagtcataaaggttttggcttaggaattatcgttgaagttttcacttctatattatcaatgggcaatatttcaactgagatcacgccggaggatttatcagtgggaccttgccaaagctttactgcgattgatccagctatttttggcgataaagagcagattatcgatcgtttctcgcgttatttgcaggatattcgtgaattaccggcaattccaggcaaaacgatctatgtacatggtgataaagaggcggctgcctacgctgatcgtaaaaagaacggcattgaaattgatgatcggacattggaagaaattgaatcaatttctagccgcttgaatattgactatacaaactatgttgcttagtatttaaatatattgaagaacttttaccttgaaccagaggtggaagttctttttatttgtctgtgaatttttgtgtggaaatgggctaaaaaatccgatttcaccaaaaaaactcagttttaatcattttctaatctaaaaaatggaattatttttttatttatcgtgaaaaaaaggcgtttttgtaatctaaaaaaagactattatatcaagaacgtacggtcgttttgaaaaaattatattgcaatagattacagcgatatgacaatgtttcatgaaaatcccgttctgtaatggtttaggtatttgtttgtcatggcgagttgctataatcatcctcgttgattaaattaaatcaacattcatgtgaacgtcgttattaacaaacaaattttacaaacccaaattttaggagtgatatttattttattaagtaaccgtattaagatgttagttttatcaactgttggtgccgctagtttattcgttggtggcgttgctcaggcaagcgcagctactgtaactgctcaatctggtgacacagtcgctaaattggcaaacgcaaatggtgtttcgatctctgcatttgaacaagcaaatggtatcaacacaagcacacatttaatttatgcggggcaaacttatacgcttcctggtagtactcaaacaacaacgactacaactgcagtagcacagcctgcagcaactcaaacgacaacacaaacaacacaacctgctgctactcagtcgacaacaacacaagctgcttcaacacaagcagcaacaacatcgaccgcagcaacgacttcaactactgccacaacttcaagttcaagttcagatgaagctgctaaagcatggatcgctaataaggaatccggtggtagctatactgcaaccaacggtcaatatattggtaaatatcaattaagctcgtcatacttaaatggcgattactcagcagctaaccaagaagcagtggctaacaactacgtcacttcacgttatggttcatggactgccgctcaatcattctggcaagcaaatggctggtactaagctttaaataaatgattaacacaaaaagctgcgacttttagtcgcagctttttttcgtgtagtgtcatgaaaatggggcaactctgcaattagtttgcatttctgtcataatagaagttaaagtgaagaaatgaggtggcataatgccacaaattacccgggtacaggtgcgacaatttttcttgatgatcgtcgcactggaaattattgccgtgagtattaatttgttttatgcaccccatgctgtagcagcaggtggtgtcactggtattgcgattcttgctgaagcggcctttggcttgccggtatcgactgtggtgctggtgttgaatacggtgttactgatcattgcgtattttttcttggagcgagcgacggtggtccgtattgcgtttggtagctttgccttaccgttgtgtttagcattaacgccgcaggttaaggtagtacaggatcgtttattggccgtgatcgtcgggggcgttgtctttgctctgggtgtttcattgttataccgaatggatgcttccagtggtggaacgactgtaccgccaatgatcttgaagaaatattttcagatcaaaccagcggtcagcttactcgttattgatggcttgatctgtcttggtaacttgtttaccgctaattttgaggtgtttgtactagcgctgttgtcgttggtggtgacttcattattgatgaattatattgaaaccggactggatcgcaaacgagtgatttacgtcatgagtgagtatgaagcagaaattaaagctttgctggtcgatgatatggctcgcggactgactgccttacaagtgaccggcggctttagtggtgatgcacgcaaaatgttgatgctagtggtagaaaatcaagattatccccatgtgatcaaacgaattcgtagtatcgatcctagtgcctttttaatggtgcacgatgtggctgaagtccatggtggaattttttgaaaagctaagtggatcgagaaagtgttcagatcatgttgtagtggtgggaagtaggttaccgttaattggttattaaaactaagctggcataaattttcaaacacaacttcgataaaaaatgttattatcaagccatggtagaaattttcagaaattagcaggtaaggtaaatgcaaaaaaagagtatacgtaataaattatcaattgctggcattctcgtaactttaggcattgtttacggggatatcgggacgtcgccgttatacgttatgaatgcgattgttgccgattctggtggcttgcaacacgcgacccctgattatgtgatcggcagtatttcattgattttttggaccttgatgttagttacaacggtgaagtacgtgttgatcgcattgcgtgcagataacaatggtgagggcggtatttttgccttgtacgcgttggttcacaaaaacgcccgctggttgatgattccggcattgatcggtggtgcggcattgttggccgatggaaccttgacgccagcggtaacagtaactagtgccgttgaagggttaaaggggcaagcattcggtaaattagtttttagtcaggatcaaaacgtagtggtgctgacgacgatcattattttgttactattgtttatgattcaacgctttgggacgtcaacgatcggtaaagcttttggaccgatcatgttcctgtggttcgccttgatcggtgtgatcggttttattaatatggtgcctaatttagaggtgttaaaagctttatcaccagtttatgcgatcaaaacgttattcagtccagctaataaagttggtgtcttcattctaggtagtgttttcctagcaacaactggggcggaggcgctgtattcagatatgggtcacgtgggtaagaaaaatatctacgcgagctggccgtttgtttacgggatgctgacattgagctactttggtcaaggagcatggttgattcgtaattatcatagccaggctgcaactggatttgccaatccgttttttgaagtgattccggctaatatgaagttattcgtgatcatcgtggcaactttagcagcgatcatcgcttcgcaggccttgattaccggctcatttacgttagttgctgaagcaattcgcttgaagatcttgccacggatgttgatcaaatatccaagtactgaacgtggacagatctatatcggcaacgtcaactggctgttgtgtctagtcacgttagccgtgacgttgtattttagaacttcagaacatatggaagccgcttatggcttggcaatcacggtaacgatgctaatgacgacgctgttgttgcattcgtatttggcacacaaaatcaatcgcttggctgcattgctgatatcactgttctttggtgctgtcgaagttgttttcttcactgcaagtatcgttaagtttgcccacggtggctatgtgaccgtgattattacttgtttgattttggcagttatggcgatttggtattatgggaataagattcgtgatcggcatgaatcggagcgcgaatatgtttcattattggcatatcgcaaccaattagttgagctgtcggcggacgaaacggtgtcgttgtatgccaccaatttagtttatatggctaaaatgaagcccggccatatgatcaagcgcagtatgctgtactcgattttggataagcgaccaaaacgtgcccgtgtctactggtttgttacggtggtgatcaccgatgatccgtataccctgaaatacaagatcgatatgatggatactaagagcgtggtcaacgtgaccttgtatttaggcttccggcgtaatcaatggatcaacgtctatattcggcagatcattcaggatctgatgcgcgaaggcaaagttgattatcaaccacaacgttatacgacgattcctaatcggcatgtgggtgatttccgttttgtggtgttacaggaactactgtcgccggcaacaaatatttcaaatttagaaaagctggttattggagcgcggatctggttgcaaaaccataccgcttcgccagtccaatggtttggacttgaatttagtgatgttagcattgaagctgttccgttaatattaggcgaacggcatcatattaaattaaaacaggtcaaataaaaaatgcggtagccactgacgattttacgtcatgtggttgccgcattttatttttattgccgtcgtgcttgccaccaagcaacgatctcaccgacactcatcaaaatcaagaaggcaccgaaaacctggaagcccaataatacactgcggaatggattgaatagtaggaagccacccgccaaaatgatcaaaatactgtaaataatcccgccccaaggcgttacattaacaaactgacgttgatttagtgtctggcctaatttgaagattccgtaaacaagtaagagaataccgaggaaaattggtaaaatactaacgatgccccgagcaaaaatcaacacgaatagggctgcgataattttaaaaataccactgaaaaaacttaaattataaacattgttctgacgttgtgcccgctgaccgttgaccagatcaagaattcctgaaatcaatagataaagtgaaatcgcgtaaacgccgatccgaaaaatcggatgtgggaaaattaaaataataacaccgaaaataaaatacgctaatgcgcgtaaccaaatattacgttgtaagttttgcatcgtatcatcccatctcaaattaaggttaattttgtcttcatagttagttcttggctaacaatcaacttgattttaccatgaaagttattttactacctcatttaagaataattatttcttagcgaatgtactactaaacttgagagcacttattttgtgatcaaacgtggccccgttttgaaattaaggttttggccttaacttagcgtaagtgtagtcaaattgaattttcgacgttacctaattgttgacagtcaccatactctacttggatcgtaatgtgttgaatattataatgagttcgcaattgctgatctaaatcgtttaagaagcaatcgttgttttcagtagtatcccgaactaaatggacacttagcgcattatcagaggtgccaatggcccagacatgaagatcgtggactttagaaacgctaggttgggaagcaatgcattttgtgatggccgccaaatcgacgttattaggtacgccattcaaagcaagattgattgcgtcacgcaataatccccaagtgccgatcaaaataataaccgcgatcactaaactaactacaggatctagccaagtccaatcagtagctaacataataaaaccggtgaccacgacacctaatgaaacgccggtatctgctgccatatgcataaaagcacctttaatattcaaatcttctttttgaccgtgaacaaaaagaaaagtagtaacaccgttaacaataacaccaagcaatgcaactgaaattactgtccagccgtggggagttgctggctgatttaagcgttggatagcttcggtgatgatcccgccgatcgcaatcaataaaaagacggcattgaataacgctgctaaaattgaagcgtttttgtagccataagtacgcttagctgtaggggctttttgacttagccaaactgctaaccaagcaactagtaagccgagtacatcactgaaattatgactggcgtctgcgatcaaagccatcgaatttgttgaaaacccaaaacccaattcagcaacaatataaataagattgagaataacaccaataacaaatggtgtttgtttttctgtaatagtcaaatgatcacgcctctctctactttttatatgaatatctgctcatatgtttactataacacattataaaaagtttgccaacctaaatataattttgtgtatctgatttataatcgacttggccagaattgtggtaataaaaaagttgtgactttttatcgtcacaactttgggaaacataactatggaatcaacaagtataatgcagcaccgatgatcccaccaaccattggaccgacgattgggatcaaactataagcccagtcggaaccgcctttattggagatcggtaaaacagcatgggccaaacgcggaccgagatcccgggcagggttgatcgcgtaaccagtggtcccaccaagtgataaaccaatggcaatgatcaagacaccaacaacgagtggattcaagccggctgtaaaattgccacgggtgaaggcgagtaagctgaaaacaagtacgatcgtaccaataacttcactgataaagttggcagcgtaactacgaattgctggaccagtggagaaaataccaagaatcgttgcttcgtctttagttgcccgccagtgtggtccgtagtggatccaaactaatgcagcaccaacaaagccaccggcaatttgtgctagtgaataaggtagaacggaggaccatggaaaatcgccggcaactgccataccgattgaaactgcaggattcaggtgggcaggactgagaaaggaagaagcatagaccccgagggtgacggccattccccaaccaagtgtgatggcgacccaaccagcatctttagcttttgatttattcaaacttacaccggcaacgacaccatccccgagtaataccaagaccagagtaccaataaattcacctagtaattgcagcgtcagactatctttcataatattcacctctacttccacatctagtggataatttttgtgtcacaagaattgcgttgttagttcttagttttaagcaagcttaaatcagattcagcaattgtttgatttaattgatctaattgcgcttgtttttcagcatcggtccagcctaagtggcgcgccatttcgtcaacgacgccggctttaacgtcggctaaggtttcgcgttggaagagaatgtggttggtccgccgcagtaaataatcgactggcgtcaaggccatttcttcatccatagcgtagtgcagtcctaaggtttcggctaagcttaaaccaggagccatgatgattttatccattaaggcaaaaacttttggcacgttagccccgtagagattggctaagtgaagtgcatcagcttccggtaaaccttttgcttgaccttgtttagctaaggcagcaagagcgtcgtctacattagttgaatccaactcaccaccagaaacagctaggttttgtgaatcgattggggtgaaatgttcatcaaaccgactagccagtaggcgactgatcacggttaaagcaccagcggccattttccggtaatcggtgattttaccaccagcaagcgtgatcaatccattagtggcaaccgtcaaatcactaccacgagaaactgcggatggattgactttgtgctcacttagggcactttcaaggtcgtttaatacgtgctcgacatcggcgcgtgttgcttttccgttctcgtaatcgttgacaacttggataacggcgtcaaagctctgatcggatagttttccggaatcaccaccgttgtaatcggagctaccattagtggcaatcagtggccgtaagccggcccaactagcttcgatgtcatcaatcgtcaagttaacatctggatagcgactattaatgatcgccaataaataatcgacatcttcacgagtgacagttgggtgtttgaaatcagctgtatagtcggtatcggtagtaccaaaatacgttttattggcccggggaaccacaaataccatccgaccgtcttgatcgccagtatcgaaataagttggttgtggtaccggtaatcgcgcaccgtccacgactaaatgaacccctttagttggccgcatttgtggtgtgatcggtgtgtcttgatctagtttgcgaactaaatcagaccacggcccggctgtattgatcactaaccgagcatgtatatcgaactcttcgccagtgaacagatccttgacccgagcaccatttagcatgccttgttcgtcgtgtaataacttgattgcttgaacgtggctggccatgatgccgccattttcgtgcgcctttttgatgttttcgatcactaagcgggaatcgttgttaatataatcaaggtaaacaccaccaccaactaaattttcagattttaattgtggttcacgcgctaaaacttcatcacgtgatagggtgtagttagtgtaacgtgggtcggttacgtcggctaaacgatcgtacagatccatggcgactttaagcgaaaacatagtgaaagttgcaccaggctcgtcataaattgggatcaacattggatctggccgtggaatatgcggggcgatgtgttgtacgatggcccgttctttaacggtatcggcaacgacttcaacgtcaaacatctttaggtagcgaataccaccgtggactaatttagttgaacgtgatgaagtgccttcgctgaaatcctgcatttcaatcaatcctgttttgatgccagttgcgctagcctggagtgcgaccccagcaccggtgatgccaccaccaataatcaataaatctaacatttcgttttttaaacgtgcaatattttctgtgcgcgtcgttgcagaaaaggccatgtcaattcctcccttgttaaaagatgagtgaatatccgactcaatcaacacttaaatcaattgagtacaaagtaatttttgagaaaagggaagaggttgtggcataaatatgatttatgaaacagcctctagtcatgtgacggtagcattaaaatgagtgtttttgccttattttagtgatttatgcttgaaggtctgcgttgcagcaaccgcttcttgccaaccactgtacagattgtcccgctgtgctgcttccatttggggttggaaagtttcgccagcagcgtattcagctttaatagcatcaagatctttccagtaaccaacggctaagccggcaaggaaagctgcccctaacgcagtcgtttctaggtcgtgggcccgctgaattgggatatttaaaatgtccgcttggaattgcatcagcatgtcatttttagccgcaccaccatcgacttttaatagtggaatatcgataccagaatcgagcttcatcgtatcgacgacatcccgtgtttgataagccactgcttgcagtgttgccttaacgaaatcttcccgagtcgttccccgagttaagccaaagacggaaccacgtgcatctgaatcccaatatggagcgcctaatccagtgaaggctggaacaacgtaaacttcattatcgtcggttgaagcccgtgcaagtttttccgattcaggtgcagtgctgatcaggcgcataccatcgcgtagccactgaattgccgagccagctacaaaaatactcccttcaagggcataataaactttgccgttgatcccataaccaatggttgtcagtaagttgtgggttgacatttgcggcttttcgccggtattcattacgataaatgacccagttccataagtgtttttgaccattcccggttcaaaagccatttgtccaaagagggcagcttgttggtcaccagccatcccggaaatcggcacttcgctaccatagaaatgataatccttggttttaccataaacttctgaatttggccgtacatcaggtagcatggccttagggatgttcaaaattttaagaatctcatcatcccaagtcagatcatggatgttaaataacatggtccggctagcgttggaatagtcagtgacgtgaacatcgccgccagtaagtttccaaacgatccaagtatcgatagtgccgaatagtaattcacctttttcagcacgttcctgtgcacctttgacgtgatctaaaatccagcggatcttggtagctgagaagtaggcatcgatcaataaaccagttttatcatgaattaattctgaatagccgtcttcctcaagttgggtggcaatatctgcggtttgccgcgattgccagacaatagcgttataaattggtaagccagtttttttgtcccaaacgatcgttgtttcccgttgattcgtgatcccgatcccggcaatttgggttggtttgacgctagattcgataaaggcattagcaatagttgatagtactgcattccaaatttcgttggcattatgttcgacccaacccggttgaggaaaatattgggggaattcacgctgcgaatcggccaccttactaccttgatgatcaaaaatgatcgttcgtgtactagtggtaccctcatcaattgctaaaatatatttttcttctgccaaaatgatctcctccttaaattaatacagttcgcaacaagcttatatgactcagtaactttctttattataaaggataagagaaacgatagaaagcgttatcatttcgatgctcacagaataccgcgtttttgataatttgttaacttttttgactcgtaaaagttaacaaaatttatatttaatttatactgatactggtatggctgatttatgcttaaaaatataagtaattatttttggataagggaataatcaggtatctgatgaaataggtttatcttgcactaaatagaaatgctaagttaaacttagagtaatgaacaacatttacttatatatcatatttgtgcgataaagcgggggtgaatttatgttaattagtcagcggcaggaaaagattttggcggtagttaactcacagcgtttcacaacaatcgccgagctagctgcggtgttatcagtatcggatatgacggtgcggcgtgatttagatcagttggccagcgcggggaaaatttctaaggttcgtggcggtgtacaaagtgtacaagcgctagcgttcaatgatttatcagtggcacaaaaacaagatctgaatttgccacaaaaacggcaaattgctaaggcggccgcacgctacgttttatctggtgaaacaatttatctgggcagtggcacgacgatcgcgttgctaagtgattattttgagcaagattatttacgggttattaccaatagtttgacggtttttaacttactattaaaacgccatccgcgctatgacgttacgttgatcggtggcaatttgcggcaacgttctggtgtgtttattggcggtattaccgaagatacattgcaacggttaaacttcgatcgggcgttggtcagtgctgacggcatcgccgatggacagttaatggatatcgtaactgaagaagggcgcagtcaaggcattgcgatggcacaagcgcaagaacgaattgttttagccgatcgaagtaaactggatcatcgcgccttttatcctttcgcccgtttacacgatgcgcgttatttgattaccaatgaattatccgctaaacaacgggctaaatatcaagatgatactgaggttgtcacgatttaatttttgctgcgccaacttgtgctacaataggttcgataatgcttttgatgtgtgattcagttttaaaaataaatcttagctgaaggcatgtaagctagacatttctatgtgagatagaggaggacaagtatggcaattttagtagcaggcggtgctgggtacattggctcgcatatggttgatcggttgatcgaaaaggggcaggatgtggtcgttgttgataatttatcaacgggtcacaaagcagccattcatgaaaaggcgcgcttttatcaaggtgatacccgcgataaggcttttttgactagcgtttttgaaaaggaaaaaattgatggcgtgattcatatggatgctttctcattggttggtgaatcgatgactgatcctttgaaatattttgacaataatatttacgggatgatcgttttgctggaagtgatgaaggaacaaggcgttaagtacatggtcttctcttcaactgcggcaacttatggcgaaccggaaaatgaattgattgctgaaagcgataagcaagaaccaatcaatccttatggtgaaagtaagttagccatggagcggatgatccggtgggctgatgaagcctatggcatcaagtttgtcgctttacgttactttaatgcagcaggcgctaaggctgatggtagtatcggtgaagatcatcatccggaaacacacttgattccgattattttacaagttgcggcggggcaacgggacgaattgcagatctttggcgatgattataagacgccagatggcactaacgtacgcgattacgttcacgtcttagatttggccgatgcgcatatgttagcattagaatacttacaagccggcaacccgagccaagcgttcaaccttggttcttctactggtttctccaacaaacaaatgctagaagccgcacgtaaagtaactggcaaggcgattccagctaaaattgcgccacgccgcggcggtgatcctgattcattagttgcggacagtcaaaaagcccgtaaagtgttaggctggcagccacagtacgatgacgttgaagatattattcgcaccgcttgggcatggaaacaaagtcacccccaaggttacggtgataaataaactaataaaaaatggtccgcgattttaacatcgtagaccatttttttatttcatcgttaagtttaattggcccaagccagtaatttcaccggtcacttgatcgccggcctttaagaaaatttgtggttcatgaccaacgccagttccgcttggcgtaccagtgaaaattaaattacctggctgtagttcgacaatgctggaaagatagctgatcaactgtggtacggtaaaaatcagttggctcagaggtgcttgctgcatgatttcaccgttaactttggtcgtgatcactgcttgatctagggcgtcgatttcatctggtgtcgttaaccaaggcccgattggggcaaagttggcaaaagattttcctaaagaaaattgcggcggtgtgttagcaaattggactgtccgttcagataaatcttcaccgaccatataaccagcaatatagtcagttgcttgatcgatagagatatcgcggccagctttaccgatcacaacgactaattcagtttcccaatctgtttgtgcaccaggaattgtgatggtcgtttgcggtgctgctaacgcactactgaattttgtgaaaatactcggcactttcggtaactctaagtgaatctccttggaatgatcgaggaaattcataccgattgcaaagatttgattagtgttttgaatcggcgccgccaattgtgttgttgtaaatgattgtgtcggtcccagttgccagtggtcctgggttgcttttaaagccgctagaatcgatggttgattggtgatcgagcgtccagtagtgggactatcgatcagaaaagggtgctgatctaacattgcaagtttcattagaacatctccatttcacaataattataatgaatttagtaacaaaaaagccctaaagcttagggcttcatttgctgagataggctcatcttaaacgttgactgctgttttcaatgtttcctctaaccatttaccaaagaatgggtaagttttagataattcataaatttgggtgtcagcatcaggatagtgtagcgttaaggtttcatcttgtgaatcgaccgtgatgcctaattcttgttcgttaggcaactctaattggaaactaccgacttgtgcaccagtccgcatcaaaatattgttgccagatgcgatcacaaataagttatctaggcaaggtaacgtatcaatcgcaactgcttcaactgtcaacgtcagggtttggttcgtcaattctggtagatgctgtgcttcccagctgaaagtaccaccagcagaaacgtggggcttaccaatagtagttacatcattgccagtttcatcgaccacgttgaagctccgaacatcgtaatgaccaatctcaacattgatcttaaccggtgtggctacattattgctaaccttaagtgtggccgtgaaaattttcgcatcagggaacttcacaccaaaatgtaagttattaactggctgcaaaacggtctcttttggcgacaagaaatgtaagtcagcaacgtataataacttgatcatttgcagtaaggcggggaacattttctcgttgatcatgtaaccttgtgcttcattattaatatcggctaaaacaggcaactcatgcgcggtcaaatgcgcctgcatatgcaaagcttgatcgattgaaaaaagtaagtaattatcgccggattcgtcagcgtagttcacattgactgctgttccgtgttcttgctgtacgacttgtaaccataaatgatctaatagggctgagtcaccgatcagttcatcatcgttaaaagcttcccataatttatccatgaacaggcgggtgtagctagcaccaaattcaaaaagggcatcatcattatggacccagtgggctttatccgtatataattggcgcttttgttggtacaggcgggcgagatcagttcggacttgctcaatatcagcaggagcttcgatgacatcgcgtaattgtggttgtttgaaattaagcattgtcgtcgtcactctccttttgagctgctaattgtggaccggctgctaggctagccatatagctatcagcaatgtgctgtagtgaattttcgaattgttgcaatgaactatattggctgatgattgcttgatattcatagttagtaactgccgcttcgacttggatctggcgcttttcttcgtcgtaacgcgcttgtgcttctgcccgagctgccttgagctgtgattgtaagctagcaacttcactggaatcagtttgactattttgtggggccgcttcgttttcgggttgatcgatgaaattcttcatcaagcctttgaaaccaccaccactacgttcacgactgctgcgggtcagcgcatcaggttctgcagcaactgctgcttgtgcttgttccaaacgactttgtaagtgatcagcttcactataagcttcatcatgtaagttagctaagcgtttttttaagtaattttctggatcagctgcataagtttctagatcgggtaagatttggcgctcagcatcggaatattgcatgatctgccgcgtccaaacatcgagcacaccaaactgccgccggtgataccaatcaccgaacatgacaataccgtcagcactgacttcgaaaaacgggatatacgtttgtaaccattcaacgagtcccttttggagataagcccgcaattcagattgcgcttgcttatcgtatgccaaaatgtaacctggaacttcggagaggtcaagccttagtgcatcggcggttgcatcaattccacggtagagatcaagatcagagtggtcttgccaagccgccgcaaaattagtaaaaaaccgtttttgatagtccaaagatttttcaatatccacggaaaaattccccccagcgatttatttttgctcttgttactattctacagcttttagcgctatcttggaaagctttatatccttaagaaaattgtaacaaattaatttaagaaaattaattggacagtacaaaaaaatcccgcgaatgcactaggccctgtcaagttgacaaatgaaataatataaagttgaatctgtttctaagcggcttcactccagtattcatctggggtgaggccgtttctttgtgctgagcgattgtggtgattgaaatattcgattccttcctcaaccagtctcacaagctcttcgcaagtctttgctagtggatggcga

SEQ ID NO: 527 - DNA, 18048 bp, Unknown
  Metagenome-assembled genome
agatggaccaattttgaaaaatgagcaaaagaatgatgaatatcagtgtcattgtattgtatagtagacataggcatgaaactcctctgtatggtttttgtttagacgctttaagtatacagatgtgaatggtttcatgtctatttttgtagcaaaaaagccctaacagatcagggcttaagtggaaatattaactttcaacctttagtaattattattgaacacgacccagacttgagagagacaagtgtgggtcgttttattttttggaggaaaagcttatgctatgtttctggggacaaccaagattttcacgaaaacctttttctgcatttggctatgaactgtttttgcgtgaaggcgaaccaggtaaatggcgcgtgccaaatgattttagccagttttctgcacagcaaattatcgacttgttagttaaaacggtgccacaactggcaccgaagataccaaatatttcgatcaatgcagatgtcgatcaatttattgacccggcgttttatcaaccattttcccaggtcaaacaactgctaccgatgatcaatttagctattgaattgactgagcacccagctgctcattggatcgcaacaactaagttagtgaccgctgcggcaagtttcaatcagtttggtatgcgcgttattcttgatgatgtcggttcaggtgataaccaattagagcgtgtacagttgttaaatccttatgtccatgaatataaatttgcgattcaaaactttcgtccagcctctacattgaaagatattttaccgcaattggcttattggcatagtctggcccagaaaaaccataaggcactgacaattgaaggcatagaatcagtaactgatattgcgcttttatcgcgttataaaattgatatgttgcaaggctattttcttggccgccccgaatatctacctgcacagcattaagttaatcatgaaacaaaaaaccactgaaaaatgcaaattgcatttttcagtggttttattttagccatgatttttcatgacccgctgtaactcacggtcttgatcacgccgctttaacgtttctcgtttatcgtaagtgtgcttccctttagccacgccaagtaataacttagcgaaaccatgcttaagataaacacgtaatggtactaaggttatccctgagccttgagtagcccctaacaatttaccgatctcttttttacgcaataataactttcgattacgtaacggatcaacgttaaactgattgccctgttcataaggactgatgtggacattttccagccaaacttcgccattacggactcgggcgaaaccgtctttcaaattgatccgcccattacggactgattttatttcagtaccggttaaaacgatcccggcttcatacgtttctaatatggtgtaatcgtgacgcgcttttttattctgcgctaaaacattatctgctgactttgctttttttgccactccaatcacctctacttcacgaatataggttgttgactagcttggtgcatttcacaacttatttatgctcgccatgactttggttgttacggatcgtaaatgggtggttgccgttgccgccacggcgattgcggttactattagtacttgcacccgaatggttacgattaccgttgcttgcgccctgacgattatggctgttgccattgcttgaactatttcggttaccccggtaaccaccacgactattgccgttgcgattgctattgccaccaggtcgacgattattactgccttcacgccgctggaaattccgccgtggttttggccgctcaactaaatcacctaagtcactggttggtgtgttttcgtctggtaataacttgaaattgatttggctttgatccatatcaacatcggtcaaagtcaccttaactggctggccaacccgataagtcttcttcgtgtgttccccaaccatcgccatataactctcgataaagttgtaatagtcatcgcccatagttgaaatatggactaaaccttcaactgtatttggtagttcaataaacaaaccaaacttagtcactgagctaactacggcatcaaaatcttcaccaacgtgtggcagcatgaattctgctttcttcaaatcgtcagtatcgcgttcagcatcgatcgaacgccgttccatttcagaactgtgtttagcgatctcatccaactgatcacgatatttatcctgtgcttcttcatcggtcccattttccatgtaccaatggatcaagcgatgcaccatcaaatcaggataacgacgaattggtgacgtgaaatgcgtatagtatttagcagccaagccaaagtgacctagcaactgatccgcatatttagcttgtttcatactgcgcaacatcatgatctggattactggttgtacaggttgaccttcaattttagccaaaacagcctgcagcatccgtggcttaatgttctgactatcacctttagccacgaccccaatattattaataaattcatagaaggcgcgcattttttcgctatcaggtgtttcatgaacacgatataagaatggtacatgtaacttgttatagtgttcagcaacagtttcgttagcagccaacataaaggattcgatcatccgttcactggtcccacgatcactgaccacaatgtcagtcggatgaccttcactatcaacaataattttcgcttctggcttatcaaaatcgatggccccacgatcatgacgcatttgccataagattttgtgcaaggtacccatttgttcaaacattggtactaattcagcatattctgcccggacctcagcatcgttgtcatccaaaatttggttgaccgctgtataagtcatccgtgcagcgctcttaatgaccgctgggaaaatttcgtgcttaacaatattccctttggcatcgatctccatttcgcaagtcatcgtcaaccgctcaacttgcggattcaaggaacaaatgccgttagacaagcgttctggtaacattggtaaaacacgatcagtcaagtaggtacttgtcccccgttcaaaagcctcagcgttcaaagcggtccctggggtaacataatgggcgacatcagcgatactaacccctaaatgataatgcccattatccatcttccaaacaacaacggcatcatcaaagtcttttgaagtttcaccatcgatggtcacaaagttttggtcagttagatcacgccgtccttgcttttcttctggctggacttcactaggaatttcgttagcttcctgcatcactgcatcaggaaattcagttggaatgccgtagcgataaacaattgatagaatatcgacaccaggcgcattcttattaccaagatcttgtttagcgatccctaacatactcttaggattttcaacgcttgggaacttggtaatatcaacaacgaccatatcaccatcttgaggttggacaccgtcatcggtaataaatacaggaacatcctgcagactgcgctgtgtcaagctaacatagccaaattggcctgagctctttacctgactggttggaaagccagtaaactcacccacaaccgtcgtaaagttacgcttgataatattaacgatcttaccttcagggcccttaccgctgttcggtacggcttccttgatcacctcagcttcaacttcatcaccatttaaggcaaaagcggtgttatctgctgaaacgtaaacatcaggtagttcaggatcgtagctaataaaaccaaaaccgcgatcgttagcgtgaaaaacaccactgaccttttgtcgctcaactgcgacaccaaaatgaccgctaccgtttaatttaatttttttatcttgttctaattgggtcaaggtttgcaccaagactttaaatgcagctgcattgcgcaactttaattgttgatctaactcctccgccgtaaaataatggttggcgtgttcagttagaaaatttaatacttcggcttgaaataattcagcgtttttcaaagtaaacctcatttcttctcataaaatccctataaatcagcaaaaaacctcctgcaataataacaggaggttggcgactagtgcgatgacacgtaagccaaagctaacgaaaatacaaaaaataaaacgccgagtacgatcgttactttttgcatgaacgcttcaaaaccgcgtgccttttgtttaccgaataggtcctgtgcaccgccggataaggcgctcaatgcatcttgctgcttgcttggctgcattaagaccgcaattacgattagtacagaaacaatcaacagcagggttaagatagtgttgtacaccctagttcctcctaacatttaagcatgttcatatgtgctattttagtcactaagttagtgttcaatgactggccaacttattgtgaccaaccgtttttgttcaatattagtattataccattgatttatatagaacaaaacctaaaacaatcaagtttgcagatttttgcgttttgccgcaacctgcattaacttccgtcgaactataccacgtcgctcgtgggcagtcaaaacgatcaacgtatcaccagcgcgtaataaggtatcaccatgaggaatcacttcacgattttgccgccgcactgcgatcagcaagctttcctgtggccatttcacatcacggacttgcttatcctccaatggactaccagcaaaaactggcatctcgaggcgatcatttttgccgctcatccgcgctaaggtattaccgaagtttaactgcgataataacgattcatagattggcgcaccacccaacacatcaacaacgatataggccactagtgaaactagtgccaatggcattaaatgacgtagatcaccgaccatttccgtgatcaataaaatcgccgtaaacggtgctttaccaataccagcaaaataaccggccatggcaaaaataacgaagttcatgacatagatttggggcatccactgccattgagcaaacaatgtccctaacaatgccccaatcaacgcgcctaaagtcagaataggcagaaaaatccccccaggtaaacccgaaccataggaaatcatggaaaagataaaccgcaataaaaacagcgctaataatggccaaaatgaaggtaacttaattgccaacccaagaatcactagattaccgccacctaatgcatgcggccaaaaatagccgattgggatcactagcaataacggaatcacaccttgaaaatatcgtggtaaccacttgagcttaccgtaccatttaggtaaggccagcagcacccgttgatagaaaaagcccgccaagcccaacacaatccctaaaataatcagttgccagtataacgccagtggaaagctgtaagcataatgaatatgtaaaactggcgtcagaccaaaaaagtttaacgaaataaaatcggccgcgattgcgctggctaacgaagtcatccacactaacggcgaaaaattatgataaatttcttccagtacgaataacgttccggcaatcggtgcgttaaaggcagctgataatccagcggcggcgccactagccagtaaaattcgtttttccgaatctgaatgacctaaccgagtcgccacgccctgcccgaccgcggcgcctaattgaatcgcaggtccttcacggccaagaaacaaacctggcccaatgcctaatacgccagcgacgaatttacgccataaaaccggccaccacggaatcgttaagtcaccagctagttgaccttcaacctgtggaatgcctgaacccataatattcggctctcctttgaccaacattccgatcaaccaggccaacgcaatgctaataaccggcaaagctaacaaccaaattggctggaaatgtagccactgaaacagctgaattgattgttgcaaactgatctcgatcagccaacgaaacaggctcaccactacaccacttaataaaccaactaataacccttttaaaataaattttaagcgtttattatcaaatttttttaacctttgcaagtaatacacctcttctaaaaaatacattactaaactaatataacattttaactaacaacttaaaaatgtgtttggatcaactaaacaaattacctatagtcattttttagcgatcaacctgctttacagcgaaaataaaaaaagctgaaaactttttttattgcgcaatgccttaattagcaagctttctgccactaatttctcatctaaattcattattttttcattttactatttattatcacagcaaataatgttaatcttttaattaataactaaaagataataagaaagacaagtacgattcgtcgtcctgacagtgagtcgagatcagtggaaactcgatgaggcaacagcgttttggaataaccctttctttgatcgcgggctgaacgataactagtaggctacgccgtgaccggtacgttaccatccggaggcgcatgattgtgcgcttagtaaggtggctcgtttagcgagcaacttgggtggtaccgcgaaaatagtccttttcgtcccttgatcggggatgaaaaggactatttttttcgccacgaaatcaggttaaaaagtaagtcgttacgttatttggttaatatttatcggccgaagccaagtaaataatgtacttacacacgattaaaaattaatcaagctgcttaagcggcttttcacttaagttaaattaatacacgacaaggagatactaatatgcatttaattattccaactgaatatgatccaaaattatctgttcgccaaacccaagaagctattcgctatatccgtgagacctttcaagatgaattcggtaaacaactcaacttatctcgcgtttccgcaccaatgatggttgatcgtgccaccggtttaaacgataacttaaatggcatcgaatcaccagtttcatttaccatgaaagacatgccaactaaaaccatggaaatcgtgcatagtttagctaaatggaaacgtaacgctctaggtcattttggctttcaacctggcgaaggtctttacactaacatgaacgccatccgtaaagacgaagaccttgacaacttccattcaatctacgttgatcaatgggattgggaaaaagtaatcacaaaagaagaacgcaccattgcgaccctgcaacaaacggttcgccaaatctttaaagtaatcaagcatatggaacacgaagtttggtataaataccctaacgctgttcatcacctacccgatgaaattcatttcgttacaacgcaagagctagaggatcgttggcctgataagacgccaatggaacgtgaagaccttattgccaaagaatttggttgcgtctttattatgcaaattggcggggccttaaaatctggcaaacgccatgacggccgcgctcctgactacgatgattggtcacttaacggtgatctgattttttggtacgagcccttagactgcaagctagaaatatctagtatgggtatccgagttgatgaagtcgcaatggctaagcaattaaaaattgctggcgcggaagatcggctacatttgcctttccatcaaaaaattatgcatggtgaattaccttacagcattggcggtgggatcggtcaatcacgcttatgtatgctgctattaggcaaagcacacgttggtgaagtccaagctagtgtctggccacaagaaatgctggatgaatgtgctgcgcacgacattcacatcctatagtccttgcttcaggctatcatataaaaagggagttacgacataaatattgccgtaactcccttttattgtgcctttaagtaaaaaaaagaagcaggcgtccctgcttcttcgtaaaaacttaaattagtcttggtaatgtaccaattctaagaatgattcaggttgtaagctagcgccaccaacaaggccaccgtcgatatcaggttgtgccattaattctttaacgttagctggtttcattgaaccaccatattgaatccgtacgttttcagcagttgtttggtcataaaggccagcaactgtttcacggatcaaatgacaaacttcttgtgcttgttctggagtagctgtttcgccagtaccgattgcccagattggttcgtaagcaataactgcagaagcaacttgttcagctgataagcccttcaaagcagctttgatttggccagaaacccattcgtcaaccttgccggctttacgagtttctaaagtttcgccacagcaaatgattggtgtaacaccatttttgaacaaagcatgtgcttttttgttgatgtcttcatctgtttcatggaaatattcgcggcgttcgctatggccgataatgccgtagttaacacccatttcagctaaaacttttggtgaagtttcgccagtgaaagcaccagcatcttcaaaatagttgttttcagaagcaacttttaaatcagtacctttagcagcatcgatcaaagtttgtaagtcaacggcaggagcaccgataacagcttcaactttagtagcgtcagctaacttgcctttgatgccagcaacaaattcagcagtttctttagggttcttgtttaatttccagttacccgcaatgattggtttacgcatttgtaacatcctttcatgtctgttatgtaaacctggtgccagatgcaccagatttgttaaatttatttattagagatagcagcaataccaggtaattctttaccttcaaggtattcaagtgaagcaccgccaccagttgagatatgagtcaattggtcgccaacgcctaattgtttaactgctgcagtcgaatcgccaccaccgacgattgttgttgcatcagttaaagtacctaagaacttgccgatttccaaagtgcctttagcgtagttgctcatttcgaacacacccatagggccgttccaaacaactgtcttagcgtctttaagcacatctttaaattcagcaattgacttttcgccgatatctaaagccatgtagccatcaggaatgttaccttcaacatccttgctaggtacatcgttattgaattcttcagccacaatattatcaacaggcaagactaacttgtcgccagctttgtcgatgatttgtttagctaaatcaattttatctgtttcaactaatgacttaccaatgcttaaacctttagcagcatagaacgtataagtcataccgccaccgacgataactttgtcagctttacttaataaatgatcgatcacaccgatcttatcagaaactttggcaccacctaagatagcaacaaatgggtgcttaggattgtcaacggcatcacctaagaacttgatttctttttccattaagaagccggcagccactttttggcctttagctttcatagcagttgcgataccaacgtttgaagcatgggcacgatgagcagtaccaaatgcatcattaacgaaaacgtcgcctaatgaagcccagtattcgcctaatttaggatcgtttttgctttcacgcttgccaaagtcattgtcgatgtcttggaaacgagtgttttccataacaagtacttgaccagcagtcattgcattaacagcatcttcaagcttcttaccttcgttaacaggaacaaaagtaactggttggttcaataattcagccaagcgagttgcaacaggttgcaagcttaattcttttttatcttcgtcagatttgatccggcctaagtgagaaagcaagattgctttaccgccattttcaaccacatatttgatagttggtaatgcagcaacaatccggttatcgtcaccaataacgccacctttgatcggtacgttaaagtctacacggatcaacacttttttatctttaacatctaaatcagaaacgattaatttagccatagtgaatagcctcctattttaactatttagtcgttgccagcccgcgggccctgcgcgctgaccaacaaaaaaagcagagggagtcaacctccctccgcctttcttaaagcattatgcggttttgaaacctactagttctaacggattagagagtagcgaatttcaataaagtacgaaccatttggcaagtgaagccatattcgttgtcgtaccaagcaacagtcttaactaattgcttgtcgccagcagttgtaacttctgtttgagttgggtcgaagattgaaccgtaagttgtgccaatgatgtcacttgatacgatttcgtcagcgttccagccaaagctttcgttaccttcagtatgcttcttgatagcttcgttaacttcgtcagcagtaacctttttgtcaaggatagaaactaattcagttaatgaaccgtcaacaacaccaacacgttgtgcatggccttgtaatttaccttgtaattctgggataaccaagccaatagctttagcagcaccagttgaatgaggaatagtgttaacaccagctgcacgagctgcacgtaagttaccgccacgaacagggccgtctaataacatttgtgtagaagtgtaagcatggatagttgtcatagtaccaacttcaacgccaaattctttgttcaagaagtaagccataggagctaagcagttagttgtgcatgaaccagctgaaacaattgtgtcatcagcagtcaatacatcgtcgtttacgttgtaaacaactgtcttcaaatcgctaccagctggagctgagatcaagacacgttttgcacctgcatccaaatgagcttgtgatttagctttggatgtgtagaaaccagtacattcaaggacgaaatctacgccgtcatttttaacccaaggaatatcttgtgctttaggttcagcatatacacggtattctttgccgttaacaacgataccattgtcagtagcgctaacttcgccagcaaaagtaccatgtgttgaatcatatttcaataaatgagctaacatagcaggtgaagttaagtcgttgattgcgacaacttcgatatcgttagatttagcacctaattcgaagatacgacggaaagctaaacggccgatacgtccaaaaccattaataccaatttttacagtcatgcctaaatttcctcctttaggaaataaaaaatttattttaaagggttaccccttttaaaatcaagtttgcggcaccttcatccgtgatcaaccacgtctgatggggtgctagttgtgtgtatgccttgatagcagctgctttatttgcgccaccagcaacagcgatcacactgggaattctttcaaggtcgcgaagttgtaaaccaattcgaggaatcttataaacgacttctcccgcttgattaaagaaataaccaaacgcttcgccaaccgcctgtctttgttgcaacatggctatcgtttcagcagacatatcccggcgctttgccattggaattgcctcaccaatactatgaaccaccgccgaacttttgtcaactaactgtaacacttctttaaccgcaggctcggctaacaaaggtttataagtctgttcgctgacatgttcagggatatacaacacacgatgttcgccgccagtatggaccgccatacgcgcacaaactgcatttgcttgaatatcaactgcttcacctaagccgccacgagcaggcacaaaagtcaaatgccgctgctgcgataattttggcgtcaacgaattagctacattagccattgttgtgccacccattgccgcaataacgttctcacctttgggtaaaataacgtccagcgtttcattaactaacttgcccatatcggtcagaactttcggtaacttggtggaatcgccagctacgatcaagcaatgatcgataccgagcactttactcagttgtttttctttcgaatgtacaccgagcaaacgctccatgacagttgttaaactttgatacgcttcttcaccttgagtggtcaaaatcataccagacttagaagttgtgatcaaaccgtgtaaccgtaaaaaatccgtttcggttcgtaatgcacgctcgctcatgttgagttcttgggctaataaccgccgaccaattggtgccagccaataaatggattgcaacacttggtaacgctgtttaaccacgtcgatcaagtccggcgccaaaatttctagccaggctaattcctgatgcatgctgatcctcttccttagtgggactataatcgtccagctatgccgtataatgacccatcatggccaaaaagtaaagtgcacagtcaatctgtccactcctcaagcacaaaaatattataacaagaccactgctgaaatgcaaggctcaacccccgataaatcaaggatattaatcgaagcgctttcgctttgatgaggctgcaataccaagactttcacgatacttggcaaccgttcttcgcgagatcgtcactccagctttacccaataaagctaccagatgttgatccgataatggcttatgcttatcttctgctgcaatcagatcctgtaattgttgtttaacactagctgcggaatcggcttgttggttgccgacagcattggtaaagaaatgctttaattcaaaaataccaaagtcagtctgcaagtatttcccattcaccgtgcgactgaccgttgactcgtgaacacctaacttggtcgctacatcgcgtaataataacggcttcagtggtcgttttacattgaaaaagaactcatgctgccgttgaatgatctcttggccgacacgaaggatcgtgtttccgcgctgcccaacactttttcgtaaccattcaaactcctgctttttttctttcatatactcagtcacttcgcggtcattggttttcagcatacgatcaaaataatgctgctgaaaaacaagctgcggctgtgattcattagttaaatttaactgtagctcatccccttgtgcgtggaccaccaactcaggacgcacaaaattgttttgggtttggctaaaggcagcacccggccgtggggtcaacgtctgcacgtaatcgaaaatatgctgaatctcagcaatatcaacacgatatttggtcgcgatcacattccacttgcgttcgacaaaattagtgaaatcttcctccaaaacaatataagccaagttaggcgcactattatcactttctgtctgcaacaataagctttcctgtaagttacgtgcacctacaccaggtggatctaactgctgtaataatgtgatggcatctaaaatctgcaccgcatcagcacccgttttagcactgatctcttcattggtgatccgtaagtagccgttaagatcgacatattctaatagaaacaagactagatcacgcaacggcgtatcgcgcatggtcaaatgaacttgttctaataaatagtcgaataacgattgcgtcgtgtccggaattgcattcataaaattatcaacgcggcgctgactaccacttaaattagcttggccctgtgttgtgtggcgtaccgctaacaacggattttctaaacttttttgctgtaagaactgttgtaacccttcggcattgtattgcaaaatctggattgattgctgcaattgctgcgtcatcgcaagcttttggacttgtttttgttgctgactaagtccctgttggtatgccatgttgaccgttcctttcgtttgaccgtgctaagttactctctattttagtcaacttactttaatttggctatagattattttttctgtattaggacttgttttttatgcagttttccggtaagattatttatgttgttcagatgcgcctgtagtgtaatggatatcacgtgagattccggttcttgagatgggggttcgattccctccaggcgcataaataattttgagtttgacgtcttgttgatgcaaggcgttttttaattatcgcgataaaatttgaagctcccacttgatgatttaataccaaaaatcacccgactgtgcatttttgcataagtcgggtgattttgttttatccaggaaaggtgccgccgttgacatgaatagtttgaccagtgatgaaactactgtccactgcagccaggaatacatagcttggtgccaattcataagctttgccgccgcgtcccattggggttttaccccaattttctaatttatcttgcggaaaagtcgcgggaatcaatggtgtccaaatcggtcccggtgcaactgcattaactcggatatcacgttttaatagttcttcattttgcgctaaggcacgggtccaagaaacaattgcacctttggtcgatgaataatctaataaaagtggatttcctttgaaggccgtcactgaggtcgtattgatgatcgcgctatgatccgctaaatatggtagcgctgctttggtcagataaaactgaccgaaaatattggttcgaaaagtacgttcaaactgactatcagttatcgcacccactttttcttggacatgctgttcccctgcattattgaccaagatatcaatgtgttgaaaagtttgcatcgtttgatccaccacttgctgggcaaaagttggttcgccaatatcgccttggcaaactaacacacgccgccctaatgcagtgatcttatccttgattgcttgagcatcgtcagttgattcataatacacgatcacgatatctgccccttcgcgcgcatacaataatgccactgcggcaccaataccgctatcaccaccagtaacaatggcaactttgtctttaagtttatccgctggtcgataagtgggatggtcgatctcaggtgttggcgtcacatttttactactgtcattgatcaagtaattttctttgggctgccgttctgtcatctgtgaaccacctctttattaggattaagttcaaaataacaagtccggcgcagcaaaacaataaatacgcatgcgcttattttcagcggaattcctgctcaacgcgccgattaggaataaaccacagaatcgaaaccacaatgctagctaccaggccagctggcggccaaaccaaggtcaataagcagccgatgaaataaatcaacagcgataactagcgtttatgatcatgttgtgaaatgaccgccacccgtgaattttgtccattggcatgaattaagcagcaatcaagtaaattataggtcaatccgcacataaacgagacaattgcatagctcaattcgggcaacatcgcagtcaaattttcgccgacccaggcagtcgcaaatggcaacaaactaagccaaaataataaggcggtgttagcccacaatacaatgccatcaatccttttgacggtttgatagagatgatgatggttattccagtagatagcgatcgcgacaaaactaaccacatacgctaaaaaaggttcgatcaactgatgtaacgctgaccacgatacaccttctggtggccgtagatctaacactaaaatggtgatcaaaatggcgattacgccatcagtaaaagcttccacacgacttttagacatttaacctcaactccttgaatttaatacttacgatattttttcaaacatagaatagcatgttcaccataaatgagctcaggagttgtttcgcttacttgtgctatacttttagtcagtgattaattagaaagtagtgtgatcaaaatgcaggcactgtatgtaaattcagctactgcccatgaactcaatgcgctaacactcggggaacagcctcaaccacagcccgctgcagatgaagttcttgtccgcgtccacgccgttggtttaaatccagtggactacaaattagtggaagaaggtaatacaaattggcaattcccgcatatttttggcttggatgttgctggtgaagtcgtcacaactggtgctgccgtcactggctttaaagctggcgaacgtgttttttatcacggtgacctgactaaaaatggcggctttgccgaatacgcggtggtcaaaagttatgccgtcgccaaaatgcccaccggattaagttatgagcaagccgccgccctactttgtggcgccatgactgcctatgccgctgtctaccgtaaagctaatctgaccaatcggcattccgttttgatccacgccggttctggtggtgtcggcggaattgccattcaattggccaaacaaattggtttgaccgtttataccacggtttcggcgcgtaaacgcgcttttgtacaaagcttacagccagaccatattatcgattatcaaaccactgatgtgaccgcaacgatcaaagaattgactcagggactcggcgttgatctgatcatcaacacgattggttctaccgaggcgactgctgatctacagcggttggcttacaatggcgcgctagtcacgatcgtcggtgaacctgatctaagtcattatgatctcggtcgttatggtcaaagtgtccttagtgttaacttaggtggtgctcatcaaagtcataatccacagcaacaagcggatttagcaacaatggcaactgctttaggtgaactcgttgtgactaaaaaacttgatccaatgatcgatcatgtcttgtccttcgaacagattccccaaggcctacaggcgctcaaacaacatttaatcagtggcaagcttgtggcaagaatcgattaatttttcaaatatttagcaactaaatatttgaccttttttgaccaatagtctaaactagcattacacttaattgagtgctaaaattaatttaaacttgaaactttaggaggtcacactatgttagttcctacagtcattgaacaatcttcacgaggcgaacgtgcttatgatatttattcacgtctgttaaaagaccgtatcatcatgttatctggtgaagttaacgaccaaatggccaactcgatcatcgcccaactactattcttggacgcccaagattctgaaaaagatatttcaatctacatcaactctcctggtggctcagtttcagccggcttagcaatctacgatacaatgaatttcgttaaatccgatattcaaacgattgctatggggatggctgcttcaatggccagcgttttacttacagctggtactaaaggcaagcgttttgctttacctaactcaactgtcttgatccatcaacctttaggtggtgctcaaggtcagcaaactgaaattgagatcgctgcacgcgaaatcttgaagacccgtaatcgtttaaataaaattttggctgaatcctctggtcaagatcttgaaacgatccaaaaagataccgaccgtgaccattacttaactgcgcaagaagctaaggattatggtttgatcgacgatatcatggttaatcaaaaatagtttatttctgtaccctaccggcaattgttggtagggtatttttagtagtagacattcaaaaatggaggtactgattatggatacatctgcgatcgatttaactaagatcagtcagcgcgggttagttgtcggcgatattaatgcgccgatcactgtgattgaatttatcaatctgcgctgcccctatagcaaaacctggtttaaaaaggccgcccccattttagaacctgcagtggccagcggccgaatcaaacgagttttcaaacttttcgacaaacctaaagtgaccctaagaaaaggtaatctagcccaacatcacttaccctatgaccaaccggaacaagcctacgccgcaattaaaattttatttgcacaacaaaccgagtggggcgaacaattaaacgacacccaaattgaagcttacattaaacaacattttggttttaaattgcagccaaaccaagcaatgatcgatttagttttaaatgaagccgcagccgctaacattcaatttgtcccaactgtgattattggagaagcgatttttgacgaacacattacaactgaagaattagccaaattgatctaatcaaaaagccgaccaaactaataaacgtacaataccccttagggttgacactttaaataataaaagtgtgaatcctagggggtgttttgcattgtaagttattcaactattgaaaagcttaaattacttcatgattatcagaaatcggatta

SEQ ID NO: 528 - DNA, 9342 bp, Unknown
  Metagenome-assembled genome
tttggattccgtaattaccatcatatgatttcacgtattaagttacggcaaatgagaacaaaaccaatgaaaaaaacagagttgaaagtcgcatgactttcaactctgtaaaagctattcatcaacaggatttgacaaagagccataaaaataaggacagcagccgggatatatcggctgttgcccttgataagtaaattaaactgctgcgaattacaaagtcgctttaattgtaattcgccattaagtattatagattttttagcgcaatactgactgccagcgcgtcatcaacgtgtgccatcacttcatcacttaagtgagtcactttatcgcgtaagcgctgtttatcaattgttcgaatctgctctaataaaatcacggaatctttctcgatccctgtctgtcgcgccttgatcccaacgtgcgtcggcattttcggcttctgaatttttgcggtgattgccgcaacgatcacagttgggctgtaatgattaccaatattattttgaatcaccaatacagggcgcatgcccccctgttctgatcccaccaccggtgaaagatcagcgaaaaatatgtcaccgcgcttaacaactagctccaatcagcaccccctaaccgattcccttactttaatgaatacgtaaagcagcttcttcttcacaattgcaaaattccgcacaaatttctgtattcaaagatgccatctcggcgtaaccttgcgcgagagaatctagttttgcttgatgcgctttaaaaaacgcaatcttatcattgcctaaatcattttctttgatgccgtaatagtcgcaaaataagtcaactttgttcaacattgccttatcgcaaacgacagataagcgttgttttatttgtgtttccatgtttgtgacccccaaaaagcccatcaatacaagttattatccacattatagtaccacgcttacacgggaaagaaaagttaaattctttttactaagacttttcaggtaaataagtccgtggcacccggtctgtcaggttgcaagcaatttcataatggatcgtatgggcgtagtccgccacatcctgtaaactgatcgtctggccaccattttcaccgactaaagtggctttcgtccccactggcaactgcgctggtaagcgaaccatcatctgatccatgcacacgcgaccgatgatttcacagtactgaccattgatcaacacgtgaaagccctgtaagcgacgctgccaaccatcggcataaccgacgggaagcgtgccgacccactcagcttgtttagcatggtatgttgcgccatagctaactgcatcgccggtttgcatttgcttaacaaaaactagctcagattcaaaggtcagtgccggttgcaaggggtatggtgctgacagagctgttcctgagggattcagtccgtataaagcgacgccaaaacgcaccatattgccattgcaagcagcatgccataagctagttgcggaattggagacatgcacgtatcgcggttcggttgccaaggcttgacgcatttgctggaacttagccacctgttgcttaaaataagtcgtatctttttcatcagcggtggcaaaatgcgtaaataaaccttctaattcaaattccacatgctgctgcaaaaaagtatcggcagcttgcaatccagccgcatcgcgaaaaccgattcgtcccataccactatcgaccgcaaaatgaacggccaatttagtcgttagggccccactttgtaaaattggtaaagcagctgctaaccattcctgtgagccgacagttaacgaaatatgcgccgctgctgcaactttagcgtatgtaggactagtaataccaagcaccaggataggctccgtaaatccagcctgtcgtagcgctagtgcctcgtccaaaatagccacacaaaaaccagtggcaccagcgctttttgcggtggctgctacctctaccattccgtgaccgtaaccatttgctttaacgactgcccacaattccgttgtttgtggcaatgtttgcatttcttgctgaatatttgctttaattgcttgccgatcgatcactaattttgtcggtcgatgtaacccacttaccattagtcggtccctctttccaaaataacttccgacatcaccaatgtatcggtgtgcgaaattgaaactagcgcacgaccagcaaatggatttttagtcaccactggcttgcctagttcatcatccaatatttcaatatcaagtagactaacgcggccgattccagtgcctaacgccttaccgaaagattctttggcagaaaagcgcccagttaggtattctgcttggcgctttggcgttaactgttcataaatcgctagctcagccgcagttaatacccgcgctttaaattgtgcattcttagcttgagctgcttgaatacgtgcaatatctgttatatctacaccaataccataaatcaaccgcgtcgcctcacttttttaaaaaataatgtacttgtacattctagcaaatttttagtttagctgcaaaaaactacggttatcagccgataaaaatttttaaggtaatttcaaacgtttccaactaccgattaatgcgattttgtggtaaactttaggttcaatacaatacggaggcttaatttaatgaagattgttgtactcgcgggcggacgtagcccagaacgtaatgtttccctatcatccggcgctaagatcaccaccgcgttgcgcgaaaaaggtcacgcagccgttttgatcgatctatttttaggcgatgacttaagcgacgttaaaaacgttgctgatgtgttccaacgggatgcaacgacgacaaactatgcgatcagcgacgaaattttgaccgacgaagccatcgatgcattacgcactgatggcaccaaaggtttgtttggtaaaaacgtcttagaaatttgtgctgctgctgacattgttttcctcggcttgcatggtgaagatggcgaaaacggtaaagtgcaggctgcctttgacctattcggtattcgttacaccggtagtggttcgctggcttcaggcgttaccatggacaagaaaatctccaaagaattactattgcacaaccacatcaaaacgtctggctacgtgtcagtcaaaaaaggtgaaccaacgccacaaatcgacttcggctttccagttgttgttaaaccttccaatggtggctccagcattgggatgaaaattgccaatgaccaagccgaattagaagctgcgctacctgatgcttaccgctttgatgacgaagtagtgatcgaagaattcatcaaaggccgcgaattttcgatgggcgttgttaatggtgttgcgatgccagcaattgagatcattgtcaatgatggttggtacgatttcgaacacaaattccaagaaaaccaaacgactttccaaacgccaccagatattccagatgacgtacacacagaaatgcaggctatcgcgcttaagacaatgactgttttagggctgacaaactatggtcgcattgacttcttctggaacgaagatggtatctatgtgatcgaaggtaactcactaccaggtatgacgccactctccttattaccacaagaagcagcagcggcaggaatcagttatcctgatctatgtgaacagatcgttaaaggcaaattagccttatacgaagcaaaataagcaaaaaaatcatcagtattggcgcgcaaatctacgtgcagtactgatgattttttatttgtattgacttcccattatcgtactttcaagtaaataaaaaagtctgcgcagattcgcagacttttttagtctaattaagcgtgcgtatgaatagtatagttacgcttgccgccatcttttttatcaaaacgctttttacgatcataacgaccgccgccttcgtgactgtcgcgtgaacgaccatggccgccattacgactgccaccaccgttaccgccacgacgatcacgatcattacgatgaccgccacgataaccgccactacgacgaccgttaccgccacgaccaccagcactacgacgtggtaatggccgttctggcgtgatcttaactggcacttcagaagcatcatctttgctggttactttcaacaaagcggctgccaattgcaatggcgtatagctatctaacaatttttcaccttgtgcttcatagttgcttaagtctttgttatcgatcaattcttgaattgattcgattgctgaagacaattgaccttgaagcgcttctttagccgttggtgccttcaatggttgcatcttcaggcgcgttagtttttcaatcgtccgcaagtagcccatttcattaggtgttacgaatgtgattgaagttcctttatgccctgcgcgagccgtacgaccaacacgatgaacataactatcaggatcttgtgggacatcgtagttgtatacgtgagttaccccagaaatatccaggccacgagcagcaacgtcagtcgcaaccaagatgtctaaacggccagccttaaatgagcgtagaacactcatccgtttttgctgggatagatcaccgtggatgccttcggcgttatagccacgggcacgtagacctttagataattcgtcaacccgacgcttagtccgaccgaaaacgatcgtcaactcaggctgttgaacatcaaacaaacgagtcatgacgtcaaacttttcaaattccttagtttgaacaaagtattgatccaataaatcagccgttaattccttggctttaatttgaaccattttgggatcgtgcatgaaacgatcagcaattttacgaattgctgccggaatcgttgcagagaataataacgtctgccgagtatcagggacttgttggacgattttttcaatatcttccaagaaacccatatccaacatttcatcagcttcgtctaaaaccaatacttgaacgtggtccaaacgaatcgtccgccggttgatatgatcttgtaaacgaccaggagtaccgacgataatttgtggatgatcttttagcgaacggatttggcggccaatatcagcaccaccgtaaacagcttgaaccttgacttttttgtcttggcctaagcgataaagttcttcttgtgtttgtacagctaattcacgagttggtgaaataattaatgcttgtacattaggattttcaagatcgattttttgtagaattgctaagccaaaagcagcagtcttaccggtaccagtttgggcttggccgataacgtcgacgccagttaaggccaacggaatagtttccgcctgaattggggttgcttcctcgaagccttgacggcgtactgcttttaatagctctggatctaaacctaaatctgtaaatttcaaatagtttcctcctcgggtctgttaaacaatttgcaaaacagttcccgatcccattcgcgtctgccttgcaaaaaatatttaatgctttctaatttgcatctttactatgttatcacgaaagttaattaaaaacaaacttttgtatcaattcattttcatgaaatcgttctagccatcattattatgcattccgttggtcaataatcacagccgaaataaaagactatcagccttaactgtagtcttcaactcactaatctttattttgtaatgcccgtaaaacttcatccaaatgtagcccattactggctttcaacaatactgcgtcatcgacagtgactgttgctaataaatcagtgatcaatgttaattttttattaagcgggtaataatgaacacgccccttaaatgctggatttctagctagttcggttgccaaagcttgcatgatcggcccaagtagataaacttgttctattttagttgggtcgatggccgttgctatcccagcatgcaatgcgggtgcttgctcgccaagttctaacatgtcgccgagtaccgcgattcgttgccctttaactggtaccgccgcaaacgcgcgtagcacggccatcattgccgtcggatttgcattataaacatcacttaaaatctgttcaccttgtgcgccagtcagccattgcgtccgatttttggtcaattgcaaatttgccagtgctgcttgcatctgctgcggttggatttggaacagactcccaactgtgagtgcagccatggcgttattaacattgtatacgcccaacaacggtaaattaaattctgtatccggatattgattcagcttaaaatcaatctgcttactaccagcagtgacctcagttggatataaatcattattatcttgctgaccaaaagtcttcgtccgctgtgccaaatcggctgttcgttcccgtaataatggctcatcaccatcatagatcaacacaccatcttcttttaggccgtgcgtgatctccatttttgcatcggcgatcttatcccgagtgccgaaaaattcaatatgtgcttcaccaatcatcgtaatgattgcaacatctggtgcgaccaactgactaagaaaatccagttgtcctggacgatccatccccatctcgatcaccaaagtttcagtgttagtgctcatatttaaaatagtaatcggtacaccaatttcattattgaaattaccttgggttttaaccacattagaatgtggcgccaaaattgcggcagtcatgtctttagtcgtcgttttaccatcactaccggtgattgcgatcacacggggatctactttatttaggtagtatttcgctaattgttgcaaggctttcaacgggtcacgaacttccaaaactggaaaatcagttggtttgccgggatgacctaattgccaaaaagcagcaacggctccgttttgctgggcgttaccaatatagtcgtggccatcattagcggcgactaacggcacaaaaagggccccagcttttaatttgcgtgagtcaaagtgaacgctggtaatttctaaatcttgccaacgtgaatagtcattttccgcggctactgcctgcgcaatttctgcaagttgcattttcataaataaaaaactcctacttcacaattaaggtgattattagcaagtatgctaataattttgaggttacggatagtgcgacttcaggtcctattttgaagtcgctactacattagtattcaccactaatcagtctaaacatggctagtctaatcaaaaattctgttgcgcacgttgtcgcttaaagcgtttcaacgctaattggatcaattcttcaattaaatcgccactgttaaggcccattttctgccacaattgtggatacattgcgtactgatcaaacagtggcatggtattaatctcatttaataagacatccccattggctgtcaaaaagaaatcacagcgcgctaaaccagaaccgtccatgatcgcgtacgcttgttgtgcgtactgttgcattctggtgatcacttccgcactgatctgggccggaatgtccaaagccaaggctgccggcgattgtttagcaccgtaatcaacgaaattatcttttttgagtacttcaccaggaacggtaaacttcaaggtatcgtcgcctaataagcccaattcgatctcacgggcaacgattccttgctcaactaaaacgcgcgaagcaaactcaaaggctttttcaattgcagcaattaacgatgcgcgatcattaactcgactaacacctaaacttgaacctaaattagctggtttaacgtacatcgggtaaagtagtgagccttcgcaacgagccaaaattttatcggcggttgcttgccactgcgcttttaacacgggcacataaggtgcttgtgggataccagcttgctgaaacagcattttactgacaattttatccatccccactgcactagctaagacgccatcaccaacgtaaggcacacccagtgactgcaataaaccttgaatcgtaccgtcctcagcattttgaccgtgcatcactggaaaaacgactgagtctttgaccgttaattcaccaggccgaatcgctacaccaaccgacggactgttttcattaaatttagctatatcaccggccactagctgtaaagtggcagcactaggtaaaggttcatgcagcgttgccccacgcaaccattcaccagattgcgtaatgtagattggacacactgaataatatttaaaataaattgcgcgaataactgcaaacgccgaagcgatcgatagatcatgttcggcattttgaccgccatatagtaggtaaatctgcatacgcgccctgctttctaaagtgtagaaaatgcgccagcgcatctgactcagtgcattaaatttgagtcattgatctacactttctatctttcatttgcttaaagcaagccttgattagcaaaagctgcttcattgatcacatttaaacgccatttttttataccatgatcataaattaattctgctactcgttcttgatcagcactgtgccagtcgtcattaactagtttgaaacgactatttaaggacaaaattggaatatggatctccttttgccggctgtcaatatcttcaaatgagaacaacgccccatcgatgaataatggctgcaattgctgtaggatcactggatcaatatcttgaatcagtgagcgccgccggaataagaagcgcatatccgggtatttttcctgtaaatgacgctttaggctccgattcaagacggcataaaattgcggtaagtggcggtagtaggttttaaccgtgccatcaggtaaatctaaataaacataatcgttctgcaatttataataaaatggtgattctaaatgtgtataagcgtgccccaaataaagcagctgcgccacctcatttggcgtcacctgatctaaatacaattcatgcgcaaaatcgatccacttatgcgtcgttaaatgtggatcggtaaaatatgcggcaatcgccggtgcaccagaaataacattgaacccagtatggggatcaacatcatcatctagatcgactggcgtcagtagcaataaatgatgcggcacgcgttgcagcgcaccagcaaaatcctgcaaactgattccgtaagacaatattaaattagaaaccgtctctaaatgaacgtagacaacattcacactcatgatcccactccacatcacttttaaccaatacttactacattgtactacgaaaagaatggaaagccacttaaaaaacaagccgctacctaataaaaactacccccgaattgtcaaatcaagtgcaacactttctagatttcacttataagtggtctaggtgttggtcatgcaagcaactgttcagctaagaattcattagccgatttgtagccgaagattttacgtgg

SEQ ID NO: 529 - DNA, 1277 bp, Unknown
  Metagenome-assembled genome
ctttttgttggcccagctgattgatatttttgaccattcgcgcttgcccagcaccgataaaccaacctataaacgctttaatcaatttcaagttgacgataaattaccaattttagcagccgatatgacaccgtccaaaaagaagcggttcatattgcgatcagtattcggccagacggcacgaaagaagtcctgaactaccaagtggcgcccacggaatcaactgggatctggactgaattgctgggaaccttgatcaaacagggtgtcaaagatgtcctgttgtttgtggccgatgggttagttggtttggatgaaggcttgaatcggcattttcctaaggctaaacggcaacggtgcctggttcatactaggcacaatctgatgaacaaggttcgggttaaagaccgtaaggccgttatcaatgactttaaacaagttcatcgggctactaaccggcaagaagccgaactaaaattgaatgacttcgccaacaactggcatcagacctatcccaacttaatcaaaaatcggcttaaaatgccgaatctgctcactttcatggatttcccaccagctattcgcggttcattgtattcaaccaacttgattgagaactttaacaagcatctcaaacgcaacaccaaccacaaagaacaatttccaacggaagattcactgaatcgattcctggtttctcagtttaatgtctacaacgagaagtccatgaagcgaatccatcgcagattcaacggacttcaggacaccctgtaatcatcctttatttaaattaactacatattatatgtacggaggcatttcatttacacaagattcttgacgctacccatatttactcaatagattaatatcaaatggtgaaaatcaacgaaaaaaggagatctatcaatcaatctcctgcccaataaatctcctcttacataaagttatttatgaacactgatttaagctaagctgccgatatcacaatctcagcatctactaaatcagccttcaagtttttgacatccaagtggtcaaggtagaaatccgttaccttatcacgaatttgttgttcaattactctccgtaatggccgcgcacccattgcttcatcatagccttgttccatcagccaatcttttgccgatttagttacctcaagtttgatggattttttggctaacgttttttgtacatccgccaacatcaaatcgacaatttgacttaagtcttgcttagtcagatgtgaaaattccacgattccattaaaacgg

SEQ ID NO: 530 - DNA, 34639 bp, Unknown
  Metagenome-assembled genome
gtggttttactaaagcctaaataatcggcaatatattgaagtgagtgcttttcatgatgaagtgtttcgatgacaacgcggtcttcaaatgataaaatagtggtgcccataaaggtccttctttctagtggaatgttgtggtgacaccattaaagacctttacgggtttttctgtccactaatatgttcaacttaaattttacaatctaccaaattcaaatcattcgaccaaattataagtataccccactaaataaagtcattattataattaaaatatttaaaaattagatattcaatggaccggtttgttcgtcgcaatcacattcgtttttgatccggcgaattaagttacgacttttacctgtttgtcgttggatttctgtaattgataaaccgctttttagcagctctttaatggtaaagtaagttttgcgccgttcagaatcagggacgtttggcccataaagtaacggccggccatggtaagaacctcgttttttggctaactcaattccttgtcgttgccgctctaagattcgcatccgctcttcagcggccataaattttttaacttctaatagcatcgaacgcaataaacgctgaatattctgatttttcacttcgttaaaatctggcacatcaagcgctaaaagtttggcaccttttaaattaatctccagtaataacaacgttaaatggtctgcatcacggcttaaacggtctaagctagaaacgatcaattcatccccccggttttaacaaggtcaagactttagttaaaattggtcgtctcagcttagcaccagactctttttccttaaatattttttctacattgtaagcattcaagattgcgatttgccgggctagattttgatcttttgtgctaacgcgcgcatatccatacctcattttctcacctctaaatataaaaccgctcatgattacataagatggagtaatgaattaactatccttttaaggtgtacccaaaaaggacagtcactccagaaatcacggcggtactaaacattataagtagaaaaacaagtatcgtaaaatcaggacagcataaaaggatccgcggaaaacaattattgtttccgcggatccttttatgacgggtgcttaatgctgatcgaccgcgtaagttaattcaactaggcgaccgatttttttagttgtgatcaagtttaatggaacatcctttaaattcgtattaagtaacggggtaccactgccaagtaagactggggcaatcgaaatgatcaatttatcgatctcatgtgctttcagcagttcggcgaataaatcaggaccgcccaccaaccaaatatcgccgcctttttcttgttttaattggcgaacgaattcgacgacgtcaccagcaacaacggtggcgcgatcttcggtatcgtgcattgtggttgagaaaacaaaactttgtttgtcgctgtagggataactaccagcgcgctgtgtcgcccgcgtataggttttgcgacccatgatcaccgtttcaacccggctgtagaaattttgaaaggcgctgtcagcttcagtggtgttcaattgttgtagccaagtcatgctgccatcgctttcagcgatataaccgtcgagactttggatcaagtataaaagaacattgcgtgtttctgccataaatttcaccccgttaattttcttttactgctaatatcggcaatataaaaactaattaaatagttcgaatgcaccgatacttgaagataagttaagtatatcacgaaagcgctttgattaatatattcagcgttatgcgggtttagtattgaattatgaagtaagcaagttttcggctacgtcaaaatgcgataaatcataaagagacgcttagttcacaagtgggggtcgctttgctagaatagatacaggcacatgtttcttacggcacatgctttaccgcaagaatgatcgtaattttaaataaaataaaaagtaacagttaatgtgatgagcatggctacaccgatttggacagtaattacgctaatgatgaagtgaagggacgcgcaacatgacagaaaaatttgcaccagcagtgatgaatttacttgatgaagcacagcaattaagcggtcgaaaaattcaggttgaattaggcacaaaacaggtcggttatattcgtcatggtcagtcacgacagattgataatgacgatggtagtctaaccatcgcggtgacggatacgaccaatgttgattatacggtcagccatgaattattgcatttattgctaatgcagcgcggctacccgcagatccgctttaacttgactaccggtgaggaaatgctggatcgccaactgtgggcaacggcaattgaactctataatgtcgttagccatgtagtgatcggtgccgaacaacagcaattagggttggttgatgctcaggtgcaagaacaatatttagccggcatcttagcggaagtgccagcagaagaaaaggcagatcgcctagtcgtttttcgtaccttggctttattggataccttagttttttatcaaggggcaaccactgcgtttgcgcaaaaatttgagcaacgctatcctgcggcttatcatggtgctcagtccttatatcaagtgattacagctaaaacaatcgattcaccatttagttttcgccgcgcagttgtgaacttgtttgcggcctttgatccttggcttgctagtgttggtttggcaacgactaaccacaatcaattgatcacgttggatggcgtcttttctgaacggcaacaacgtttagaagtacgccaagtttttgaaattttgcattcagagctaactgtacgtgaaggcggtggctcagcctatatcggtttaggtaaaaacgaccaccagaatacctttgtgatcacagcaccaactgatcaggataaaagtgccgcctttttcaagcaaatttatggcgagtcagtgcaaacgtttatgcaacagcagcagattccatttatggaaaggaaatgagttgatgctcgatctacaagcaacgatcaaagcagctaaatttgtcacgtttcttaccggcgctggggtttcaacgccatcaggtattccagattatcgctccaaaaatgggctctacgctaatcagcaatcacctgaatatttgctgagtacagaaaacctacagcagtatccggccgatttttatcagtttgttaaggaaaatatgtattatccccaagcaaaaccgaatgtgatccacgaaaagatggcggcgatcagtaacgaaaaaggcgcgatcgtgacccaaaatgtagatggcttgcacaaagcggctggggcaaaacatgtggtagaatttcacggcaatttatatcatatctattgtcaaaaatgtcatcaaaacttcggttatcaacagtatttaaccagtgatcgccatgccgctgatggtggtattttacgtccagatattgtgctgtacggtgaggctttgccggaacaagcaatcagtcaagctgtggcagcagtaaatcaagcggacttgatcattatctgcggcacatcatttcgggtggcaccattttcattgttggtcaattacgcccagcctaatgctcgtgtgattgcaattaatgaagaaaagttggagctagcgtttccgtttgaaatggtccaagctaatgcggttgatgtttttcagcaactctaaccttgttttgcagtagtaaattgcttaaaattataattaaataaattttagatggagcgtgtgaaatgttagaagcagaacgccaagaaatcaatgaaatcgatgcccaattaaccgccttatttgaaaagcggttagcagtggcacataaaatcgcaacggtgaagtatgagaataaaattccgctaactaatgttttgcgcgaacaagaagtgatcagtcaacaaacagcggctttagccgacccaaccctggctccttatctgactgactggtaccgcagcacgatgttgattgcaaaacaataccaagcccacgtgatcaaagggctgcaaaacggtaagtcggtctaagctatggtaaactttagatagaaagagttgtgaatgatggcttacaaatatacgcttgcgttgttgcattatcaggatcaattgttagtgttgaatcggcgcaagccaccttatcctggtcagtggaatggaattggtggtaaattagaaataggtgagacgccagtagcagcggcccaacgggaaatctttgaggaaactggtattgcaaatgatgcttatcaaatgaaagcagctggtgtgatcgattggtttattgctggtcagtacgttgacagtatttatttatatgttgctgaattgcagcaaatcgatttaggtgcttatccacaacaaatgcgcgaaggtgtgcttaactttttcccagtaacgtggctgactcaaaccgctaatttgggcattgttcctgattttaaacggttgatcacacctgtattagtgggtaaacagcagcgctacatcactaatttcgttgatgaacagctggttgatttttgggtgaagccgttagattagtgtgtatttttactacattctggcctacacttcaaagcttatttttatcgctaatttagcataaacgtggttgaaaaagtctttggcaacactgcttagcaagtatccaatttgatgcgtattcgttagacggagcttgctttccaatgtcgattgaactaaggcaaaatccgccaagttcaagtcgtagattatggtagtgtcactacgctagtcatattgtctagttagattgcacgctataatctgggcgctttttcaactcacttaaaaaatagaaggggagcgttggtatgcgtctggatttttcagttgctgcgcatagtttactttatttagaacagaaaaaaccgcgcctggtgtccagccgtgaactggctgcttccatgactactaatcctgtcatgatccgcaatattttatctgtgttgcataaacagcattatattcgtggcgtggtgggaaaaaatggtggttatcagctggatcgtgagcttgcacagatcaatattggtgatttatatgatttaacgattccaccgaccttgagttatgcgcggtttacgacgggtaatactggtgcggttggtgagggcaatgatattagccgtaatattgaagaaacgttgactgatttatttaccctagctgatgaagggtaccgtgccttttatcatcagtttacgatggctgacttaaaacgtgatattgaacagcatggctatttcaaatcaattgcacaagcgccctttagtaagtgatattctaggtggcgattagataagataatgtgtagaaggtaaaggttagttagtggggaggccgcatatggtccgcgaggatttggtgttagcactacaattgatcacacaacggatgcgtaacgtgagacggattcaatttgttgttgattttttatttgcttatgtcttgttacgggtagcgttcagtgggttgcagctaacgatcttcgcagtatcttttacacgcggacgtgcggtggcggtggcttttctacttgcactgatcgcggtggcacttaactatattcgacgcaattatcggcataatggacaacgggtggtatcggcgctaggtcagcgtttaagtcagcaggagctatggctggtgcagcaatttcaacgttattgaatttgtgaatggagggaaactatgatcacactggcattaactacttggagtgaacacggcagtttgctgcatgaaggtcgtgaacgtaaattaactttacccgagtatagtcaatttttaccctgtgttgagttagacaccccattttatggtatcccacggctaagttcttttacaaaatgggccgaagagacaccggaacaatttcaatttattgttaaagcaaatcagatcatgacgcggcatcgcggtccggagactgccggggctttaagtgaacaagaagtatttgaccattttaaacaaaatagtgcaccattggtagctgctggcaaattaaaaacgattttatttcaatttccaccgttttttggcgtgaccaaagaaaatatcaattacttgaaaaaagtacgtgattatttaggcgatttaccggcggcagtagaatttcgtaatcaagtctggtatcaagaagcttaccggcagcaaatgcttggtttactgcgcaagttgaatttcagccacgtaatcgttgacgaaccgcaaacgccgacaggtagtgcaccatattttccggtggcaactaatcagttggctgtttttcgcttgcacgggcgtaattttgccggttgggccaaccaaggtaaggactggcgcagtcagcgtacattatggcgttatagccgtaatgaattgcagagctttattccggacattcaacgtttgactcaggaagccaaagaagtctgtgtgatctttaacaacaactccggcggggatgcggctgataatgcagtgatgttacagcaaatgttgcatctagaatttacgggtctagcgccgcaacagatggatctattttagtgaggagacggcaatagcttggcagataaacaacggtgtaactgggctaattctagtccagcgatgcaagcataccatgaccgcgaatggggacgaccaacccatgacgatcatgaattatttgagcggctgtgtatggagacttatcaggctggcctaagctggtcgacggtgctcaataagcgggcggcctttcatcgtgattttcatgattaccagattgaggccgtggcggcgatgactgcggcagagatcgacgcggcaatgcaagatgccgcgattattcgtaatcgccgtaagttagaagcgacggttaataatgcgcaggcctttttaaggatcgttgctgaatttggtagctttgcaacgtatttttgggcatttgttggcgcaccccagcaaaatacgtggaccgattatcgggatgctccggcgcaggcgccgacatcagcggccttagccaaagatttaaaaaaacgtggcttcaaatttttaggcccagtggcggcttatgcatttatgcaaagtgttggggcagtcaatgatcacgaaataaattgcgcctggcgctgaaacgcgaactgaatttagttttcgcgttttttattaccaccaaaacgcccaactacgttcttttatgctataattctggtaactatctacacaaaagcgaggaatataaatatggcagcagacactaaaccgactttctatattacatcaccaatttattatccatctggccgtttacatatcggtaattcatacacgacaatcgcctgtgacgttttagcccgctacaaacgcttatccggctatgatgtgttctatttgaccggaactgatgaacacggtttgaaaattgaacaaaaagccgaagaaatggggatcacaccgcaagaatacgtggacaacatggcggctgatgttaaaaaactatggcaattattggagatctccaacgataaatttatccggacaacggatgattatcacgttaaggctgtccaaaacattgttgaccgtttgatcaagcagggcgatgtttatttaggtgaatatgaaggttggtattcagtttctgatgaagaatactttactgaatcgcaattagctgaagtttaccgggatgataatggtaaagtgatcggcggtaaagcaccaagtggtcatgaagtttctttggtcaaggaagaatcttatttcttcaaaatgagcaaatacgctgaccgtttagttaagtattacgatgaacatcctgatttcatccaaccagcgtcccggaaaaacgaaatgttgaaaaactttatcgaacctggtttggaagatttagcaatgtcacggacaacctttaactggggcgttcccgttaaaggtaacgacaaacacgtggtttacgtgtgggtcgatgcgttgctcaactatatcactgcacttgggtacggcacgccagatgatacgttgttcaaacgctattggccagctgatgttcagttagttggtaaagaaatcgttcgtttccatacgatttattggccaattatcttgatggcgttggatattccgttgcctaagaaagtcttcggtcatggctggctgttgatgaaagatggcaagatgtctaaatctaaaggtaatgtggtttatccagaaatgttagttgaacgctacggcctcgatgcgttgcgctattatttgatgcgcgcaattccattcggtaacgacggggtcttcacgccagaagactttgtttcgcggatcaattatgatttagctaacgatttagggaacttgttgaatcggacgatcgcgatgatcaacaaatataatggtggcgttgtaccagcagcgtcagctaatgtaacggcagtcgatgctgacttgaaggctgttacggctgaaactttggctaaatatgaagagttaatggatgatttacacttctctgatgccttggacgaagtttggcgcttgatcagccgggcgaacaagtacattgatgaaactgaaccatggcgtttggctaaagatgaaactaagaaagctgaattggcaagtgtattgggccatttagctgaaagcttacgtttggttgccttattgttacaaccagtaatgacccacgcaccaaaacagatctttgcacaattaggtcttgattttgatgatcaggcaaaccaagaatttagttttggtcattttccagctgataccaaagtaatcgctaaaggaacaccgatcttcccacgtttagacatggatgaagaagtgaaatacatccaagaacaaatgaagatgaccgttggcactaacaaaaaagaacaagaaaaagctgacgcaccaacaggctggaatcctgaagagactgaactagcgatgacgaaaaaagccatcaagtttgacgacttcgataaaaccgaattgaaggttgcggtgatcaagcatgtacaaaaagtcgctggtgcagataagttactgcaattccgtttggatgctggcgatagcgaagatcggcaaatcctttctggtatcgctgaattctacccgaacttcagtgaattgacgggcaagcacgtgattattgtcgctaatttgaaaccacggaaaatgcgtggccagattagccaagggatgctactttcttctgaaaaagacggtaagatcaccttattaactgtcgatgaatcaattccagctggcgcattagtcggctaaagttgtgcgagtgtgttgaaaacgcgcctagctatacgtaataagctgctgtttcaaccacgtttcaactatattgtctgaaaaaagcaaaaaaagggccgcgacaattacttacgtcacagccctttattttttgaaagtgtttgaaaagggtgttcagatcagaaagcgtgattgcgacacctttttatactttggaggtaattatgcaaatttttgattcccatacgcatttaaatgatgaaccgtttgcggggcaagaagcggcgtatatacagcatgctcgtgaactaggggttacaaaaatggccatcgtcggttcagatgctaatttaaatcaaggagcgctggacttggctgcgcgttttgataatttgtacgcgatcgttggctggcatcccgaatacgctatggattatacgcagcaggtcgctgataaattgcgccagcagttacagcagccaaaagtgattgcggtcggtgaaatcggcttggattatcattgggatagtgaacaccatactcagcaacaaaaaattttccgcgaacaaattgagttggcacatgagctacatttgccgatctcagtgcatactcgggacgcgctagccgatacctacgaaatcttaaaagatgctcacatcgacgaatatggcggtgtgatgcatagttttaacggcagtgttgagtggatgaacaagtttttagatttagggatgatgatctcgtttagtggggtggtcagctttaaaaatgcgccattggtccacgcagctgcaaaagctgtacctgctgaccggatgatggtggaaacggatgcgccgtatctgacgccaacaccgtaccggggcaagcaaaacgaacctggctacacacgctatgtagtcgaagcaattgctaagttacgcaatgaatcagttgaaacaattgcggcgcaaacttatgctaataccactaacttttttaaggtgacaccatgacagaaaaaataaaagaagtgatcgtggtcgaaggccgtgatgatacgcgccgcttacaagatgtggtcaatgcggatacgattgaaactaatggctcagaaattagtgacgaaacattggctgagatcgcgttagcacaagcaaaacgtggcgtgatcgttttgaccgaccctgattttcctggcgaacaggtgcgcaagattattacccgtgcagttcctggcgttaaacatgccttcttgcgctctggccaagcacaaccagccgatcatcacagcagtttaggggttgaacatgctagtaacaaagctattttagccgcactagccaaattgtacaccccaatgccagaagcaccggcagtgatttcccgacaacaattacaacaagcacgactaactgcgggtgccaatgcccgtgcgcggcgccaacggcttggcgatattttgcacattggttacaccaatagcaagcaactttacaaacgcctgcaactatttcaaatttccaccgctgattttacagctgcggtggcgcaattagatagagaggaacaacttaatgactgaagaacaaaaaccgatcggtagtcgcgagcgcaccagggaaattttggcggcgtacggcttaacgtttaagaaaagtctaggccaaaacttcttaacggaacccacaattttacgccaaattgctagcgcggctgaattaactacagctgatgatgtgctggaaatcggtcctggtattggtagcttgaccgagcaactcgcacaaaatgcccatcaggtactagccttagaaattgatcaacgcttgttaccgattctagctgatacattagcaccttatgataacgtgactgtgctgaatcaagacgttctaaaaagtgacctcgcaacgttgatccgtgatcattttgacggccaacataaagttaaagttgtcgctaatttgccatattacatcacaacaccaattttgttgcgactattggaaagtggcgttgcttttgatcaaatcgttgttatgatgcaaaaagaagtggctgaacgcttagcagccgatcccggcagtaaagcatacggctcattatctgtagcggtacagtatcaaatgaccgttaaattggcgtttattgtgcccaagacagtttttgtaccacaaccaaacgtggattcagcaatcgtgtcacttacgcgccacgtgacgccaccagcagtcgctactgacgagaaagtgtttgcccgcttagtccgtggcagctttgcccaacgccgcaaaagcttgtggaataatttaacagcattgtacggcaaagatgcaaccacaaaagccgcactgactgaagttttagcagccgaaaaaattgatcctggcatccgtggcgaacgactgagcgtaaccgatttcgtccgcttggctaacgcaattagcgaccacgccaaactttaatgtttttcgctaagctttttgttgcgctgaataaaagcttgtggtataattgcaaattctgctgattcgtgatatactagtggttatcttaagaagaggtgaagcagatgccaattacactagcgagcattaaagcaaatctcgatagtaaagtcggaaagaaaatgatggtcgttgcgcaggcaggacggaagaaagttactagacgcaaaggaattttgcacgaaacgtatccttccgttttcgttgtcgacttagatcaagacgaaaatgctttcgagcgcgtttcctatagttatgccgatctactcacaaaaaccattaaaattgaatttgatgatgacaagcaaactgctgcatcctaaaaagaattttgactcaggactgaataagttctgggtttttttagtcgtttgaaataacgatgcatgtgataattaatacagtcagcaactttagtttgtacacggattcagtcaccgcatcctgcttagtttgtgttcttttacgcaaataaggggaaataccaattaaaaaaatgcgagcaaaaaaagattacaaataaaatggaatcggttacaattaggctggctatcgtattagaagtaatttgtagtgtttcggatattagttcctgagtgactgttggtaaattcaaatttaggctaatgaacaactacattctaagaagtaaaggaggtccagtatcatgcattggggtttatttataacggcattattaccgataatttggttgattttttcattaggtgttcttaagatggctggtagcaaagcttgtacgattggactcattttaactattttactcgcaatatttatttttaagatgccaattattgatagtctaacggcggcgctggaaggtgcagtgatgggtatttggccgatcgtttatattattattgcggcggtatttacctataatttaaccacagctagcggtagtatgacgacaattcggcaaggtctatcggggatcactagcgataaacggttgttggtattgatcattgcttggggttttggtggctttttggaagcaatcgctggttttggtacggcggtagcgattccggcaagtattctgatcgcttttggagtcaatccgattttgtcagccacgatttgtttgattgctaacacgacgccgactgcttttggtgcgattgggttgccggtgactactttagcacagatcagtgggctggatgtgctgcatttatcttacttagtgacgattcagttgttacctttgatcgtgatcatcccatttgtaatggtagcgttgatcggtggcggcattaaggcaattcgtgaagtttgggcgccaacgttggctgctggtttggcctttggtgttccgcaaatttttgtcgcgcgttttctgggagcggaattgccagcaatcattggctcgatcgtttgtatcattgtaacggtttggtttgcccggcgttatgagcggcgccatcctagcgcacaaaaggcggcggtggaaacgccaagtgttaataattttgtgttggcagcaatgccgtttattttagtctttgttttcgtgatgttggcgtcaccgttagtgccgccactgaatcattttttgactggcattaaatccgcacttaccatttacacgggtgctggagccaagccatatgtgttcaattgggtatcaacgccaggaacgttgattattttggcaacgatcattggtggcttggtgcaaaaaatgaagctgggacaaatttttaaaattttaggcaaaacagcggtacaaatggtacagacgttgatcacggtatgcgcgatcgttgctttagctaaagttatgggctatagcggcatgatcgcaacgatcgcagcaaccttggttggcgtgcttggcgtcttttatccagttgttgcgccgttgattggtgcattaggaacctttgttaccggctctgatacttcggccaatgtgttattcggtaatttacaacggcaagcggcagttgcgctgcatgatagcacttattgggttgtggccgccaatgcggtaggggcaactgctggtaaaatgatttcaccacaaagtattgctgtggcttcggcagcaaccaacttgcaaggtcaagaaggcgatattctcaaacagagtatgaaatatttcttgggttatttggtggtgatttgtatttggatctttgtttcgggcttatttatccacgcgctgcatatctaagtgtagtaacactaagtcctatacagtaggcgtaattactaggtaccaggctgctaagtgctggtaccttttttatgtgtgggtaattcgcggtgatcacggcttttaagttggtgcaaaagttagtataattgtaaacaaatcaagtgatcaggtggaatgagcatggaaataacggagaaggcaccggcaaaaattaatttaagtttagacgccctttttcagcatgccgatggtgagcacgaatggaaaatggtgatgacctcagtcgatttggctgattacgtcgagttatcgacggtcgcaacgcggcaaatcacagtgaccacggatagtggctttttgccagttgaccagcgtaatcttgcttttcaggcggcgcgcttattgcagaaaaaagcgggcatgacttatggcgcacgaattcacattcgcaaacagattccggtggctgctggcttgggtggcggtagttcggatgcggcggcagtgttgcgcggcttaaatcggttgtggcagttgaattggtcgctggctgatttagcccacttaggcttagcgattgattctgatgtgccttattgtgtgtactcgcaaacggcgttggtgacaggtcgtggggatgagatcacgttgttgccgaaattaccgccattttgggtggtactggctaagccaagcgctagcgtctcgacaccaagtattttacggtcgattccgtataacgaccaactttatcatccgccgatcgatcagatggtcgcggcaattcgtgcaaatgattatccgcagattttggcgagcatgggtaataccttggaggagatcaccagtcaacgttatccgcagatcaagcaattacggcaaaaaatgcaacgttttggtgcggatgcagcgcaaatgagtggcagtggacccacagtttttggcttgtgtgccaaatattcacgggcacagcatgtctttaatagtatgaaaggtttttgccatgaagtctatttagtccgaccattgttaaatgggctaagctgaaatgggttgttgaaagcgacgtttgcgctgaaattgccagtacaacggcgctttttgaatgacgatttagtctatatttgaaatttaaattccaactttttcccgtctttccaggctttttgtgataaaaaacgaactattttacttaaacagcgataaatgctagtttttttagggaaaagtctatataatagacaagcgaatgtcttgaaatgaggtggattaattgaaaataagacgaagtgaacgattgatcgacattacccgttatttattggagcggccccatacattggtcccgctaacttattttgctaagcgttatgaatcagctaaatcctcgatcagtgaagatttaggtattgtacggcggacctttcaaagccgtggtactggtattttggaaacaatcccaggtgctgctggtggtgtccgttttatcccgacgatcagtaaggatgaagcaaccgaatttatcgatgagatgacgacagaattatctgaacaaagccgattattacctggaggctacgtttatttatctgatttattgggtcaaccagatgtattacgtaccgtgggccgcttgattgccacgcagtacgtggaacaacaagttgatgcggtaatgacggttgcaaccaaaggggtaccaattgcgcaaagtgtttctgcttatttaaatgtaccgtttgtgatcgtgcggcgtgattcaaaaatcactgaaggttcaacggtaagcgtcaattatgtttccggatcatcggaacgggtagaaaaaatggaattatccaaacgcagtttaaagcaaggctcgcgtgttctagtcgtcgatgactttatgaaaggcggcggcactgtcaacgggatgaagagcttgatcgaagagtttgaatctgaattagttggtgtgactgtttttgctgaatcggcgtttgctggcgaacgagcgatcacagattacacggcgctgttgtcggtcgataaagtcgatagccgcgataagacgattcacgtggcaccgggtaactatttagcgcgtaccttcaaataagccgatgcgtgcctatttatatccgatcaaaatcgctatattggtatttccgtttctggctttagtaatcacaattccgtttttggttcgccaatatcgtaagtatggtgcgttaactgggtggcaagcttttgttttgtatacgttcgtcttttacttgttgacggcgtattttttagtcattttaccgttgccaccacggcatttagttgctttatatacatcagcacactataatttggaaccctttatgtttgtccgggaatttgtcgataaaacggtattgcagtggcaagtgccacacacttatttgccagcgttgaagcaggcggcatttgtacagccgacgttcaatgtgattttgacgattccatttggtgcctatctgcggtattattttggccgtcgttttccgcaagtactggcgttgagttttgcgttgactttattttttgagaccacacagttgtcaggattatatggcatttatccgcggccataccggttattcgatgttgatgatttaatgctaaatacgctgggcggtgtgattggctatggactggcgccatttctgactcagttattcccaacttcgcggcaaatgatggcggcagctttcgctaaaggccgccgggttagtttcagtcgccgttttgtggcttttgtggtcgattggctttgtttggcgttagtcacggcagtagtcagcctgctcagtcgccggttaccttacgatattaccagcacaccggcgatctggtatagtttggaagtgctcggctattttgtacttttgccgggattgtggcatgggacaaccttaggaaaacggttggtgaaaattaaaattaccgctgcgctaccagtaccattacattggtggcagttgatctggcgacagcttttattgtatggtgcggtggtaccaacgtttattttgccagtgattcttttaaatggcctgagtcaggcaccacgtgcacagttcgattactatttattagcgttactggttgtgggtgtcgttttagcagtgttttgtctacatgcgctgctgacaatgctatttcggcgtgatcggttattctacgaacgactgagccacaccaaagaagtcagtacgctagatcgtgcacaataatttagctaacacagtctaattattgtgtgtggaaatatttgtttaaattagcgtcacgaattaattttcgtggcgttttttcgtcgcgcgatacttgtcagtaattcaggactaagctatgattgatggagtaaatgccatccacttacatgattggtctagagtggtttaaaaactgttcagtgatatgatttattttgaccgagcgttgctgcagcggattggaaaacggttatttattagcatcactgctaatcgataaccttaattttagaatagaggtaaaaaaatgacagcaaaatatacggtaattttggccgctggtcaaggcacccgcatgaaatcaaagttagctaaagtcttacatccggtttgtggtcggtcaatggtggaacatgttttaactcaggcggaacagttgcaccccgatcagatcgtaacggtcattggtcacggcgcagatgccgttaaagctactttaggtcaacggacagactatgcgctgcaggcagagcagaatggttccggcgatgcggttttacgcactgaggcgttgttaggcgctaaagacggtatgaccatggtcgttagtggcgatacaccattattaaccgcgaaaacttttgagcagttatttgaataccataaagaaaagggcgctaaagccaccgttttaacggcaacggctgctgatcccaccggttatggtcgcatcgtgcgcaacgaattaggtgtcgttgaaaaaatcgttgagcaaaaggatgccagtcgtgaagaagctgcgatcacggagatcaataccggcgtttattgctttgataatcaggcattgtttgcggcgttgcatgaagtcggtaacgataatgcgcaaggcgaatattatttaactgacgtgatcggtattttgaaggctaaaggtgagatcgtttcggcttaccggatgaaagattttacggaatcattaggtgtcaacacacgcgctgccttggctcaggcaacggcgatcatgcaggaacggatcaatgcggaacatatggctaacggtgtaacgttgatcgatccagcagcaactcacattgatgttggcgttaagatcggtgcggacactaccatcgaagccggtgtgaccttgaaaggcaagacggtgatcggtagtgattgctatatcagttctggctctgttttacgggatgcaacgatcggcaataatgtgcggatcactagctcaacgatcgaagaatcgatcatgcgtgaccacagtaatatcgggccgatgagtcatttgcggcctcaatctgatatcggtgaatacgttcatgtcggtaatttctgtgaagtgaaaaaggctaaactaggtgcgtacaccaagatgggccacttatcttatgttggtgatgccacgttaggtgaacatatcaacattggttgtggcgttgtgtttgtcaactacgatggtttgaataagcatcattcaacagttggtgattgggcctttatcggtagtaatgccaatattgttgcaccggttaaggttgcggatcacgcattcgttgccgctggttcaacgatcacagcagatgttgattttcacgatatggccattgctcgtgcgcgtcaggtcaataaaacagattattgggataagttaccccacgaacctgaaaattaggctttcatgaaaatagcgtaagttttcgcagtcacgcttgatttgtacgactaaattacctattatttataatgtgggtttaacttaaacgacattaaattaaaatggaggctctcatgtcagaacattattttgatccaaagcttaaaatctttgctttgaattcaaacaagccattggcgcaaaaaattgccgatgaagttggggtcgagcttggtaagaccacggtcgatcgttttagcgatggtgaaattcgcattaacatcgaagaaagtattcgcggcgataacgtttacgtcattcaatcaacttcagcaccagttaacgataatttaatggaattgatgatcatgatcgatgcattgcggcgggcttcggctgcttcaatcaatatcgtgatcccttattacggttatgcacggcaagatcgtaaagcccgttcacgggaaccaattaccgctaaattagtcgctaacatgttagcaatggcgggtgcaacacggattttggctttagatttgcatgcagctcagattcaaggcttcttcgatattccagtggatcatttaatgggcgcaccattgatcgcagattatttcttgacgcatggtgttgacgatgatgctgttgttgtttcaccggatcatggtggggtaacgcgggctcgtaaattagctgaattcttaaaagcaccattagcgatcatcgacaaacggcggcctaaagctaacgttgccgaagtgatgaacatcattggtgacgttaaaggcaagaaatgtatcttgattgacgacatgatcgatacggctggtacgatcacattaggcgcacaagccttgatggatgccggtgctactgaagtttatgcgagtgcgacccacgcagtactttctggcccagctattgagcggatctccaattcaccgatcaaacaattggtggttactgattcaattcagctagccccagacaaattgatcgataaagtggtacaaatttcagttggtccattgatcggtgatgcgatcaaacggatccatgaaaacaaaccagttagtcctttattcgaaaataagttccacacagacactaaataataaatgaacttaacctgagtgtgctaagctagcggcaacgtcgctggttttagtgcactctttttaatatcgtggtcacgttccaacttgacgtgaatcaccttagtagcgggatacgaaggagggatgccgatgtggtggctgctaagtttattcggtatggggttactacttgcttattggcggcgttacttttggctggccggttatctgttaacgctagttggcggattggttggctggtatttggccgatgagttggcattactgaattggttactgaagttacaaatgattatgtacggtttagttagcgtggtattgtggggtgtcggcggctggttttggcgctttgcccaccaactgctacgccgccggggtgaaagtattgcttatcgcggtttacaattagtggcgataattttgctagtgttgccagttatcacgctagggtggcaaactaagatgatacaactactttggttaagtgttggctattttgcggttgggttggtggcctatgttgtggggtcgttattgttactgagttatccacggcaacgccaagtacagtatctgatcgtattggggtcaggtatacgagctgatggccagttaacggcgactttacgccgtcgcgtgcaacgcgctgcaaaaatttatcatggcggtaaaacgcaatatctcgtagtttctggtggtcaagggtcggatgagccaataagtgaagcccaagcgatggcgtctgctttgctcaaattaaatgtgccacacagcgccattattttagaggcccacgctacttcaacgcgagaaaacttacaattttcattagcccagttgccggctaccgcgacagtgggaatgttgaccaatgattttcatcttttgcgcgcggcactatatgcccgacgattaaggcgaccatttagctattatggtgcgacaacgccactaacttatttgctacgcggcgcattacgtgattatcttgctttactagtcatgacccgctgggcgcagttagtcggatggttagtgttactgggactggaaatttggctatgaaaaaggcctacgtgatcagcgtaggccttaagtcattacttattttgttgttgggctaaaaggtcgcggatctcttttaagtattcttcttccttcgttggaactggttcttcagcaacggcctcatggtgtccaagttcgcggagcttggtaattcctttgagtaataagaaaatcacaaaggcaataataacgaagttgatcacgtcattcaaaaacgaaccaactttaaaacgggcggtgccgagagtcaaaacgatccccgaaaggtcgaccttgccgacgaacaaggctaataatggattgatcagattggtggtcagtgatttgacgatcgtggtaaaggcgccaccgacgataacggcaacggccagatccattacgttaccgcgtaataaaaattcccgaaattctttgagcatggttatccccactttctataataattataattatagcgaaaagccgctagaaacccaattgaaaccggctctttttgcaggtaaacttgaattagcttgcgcccaacgctgaggtaggctaacataggcgtattgtgaacgcatgaaaacggaggcagtataatggtaaaaacgtccatttatggattgaacaaacaggatttaattaattggtttattgaacatggcgataaaaagttccgcgcaacgcaggcttgggattggctatacgttaagcgagttgctagctttgcggaaatgacaaacttgtcaaaggccaccatcgcgtcgttagaagaaaattttgatttcagtccgttgaaacctttggtagttcaagaagctaaagatggcgagacaacgaaatatttatttgaattagaagataaattaatgatcgaaaccgtactgatgcgtcatgattatggattgtcagtttgtgtaactacgcaggtcggctgtaatatcggctgcaccttctgtgctagtggtttagttaaaaagcaacgtgatttaacggctggtgaaattgttgcgcaggtggttcagatccagcgtaacttagatgaacaaaacaaaggtgagcgggtcagtcatattgtcgtcatgggcatcggggagccattcgataactttgataacgtcatgaagtttttggagatcgtcaatgatcaaaaaggtttagagattggtgcccgccatatcacagtttcgactagtggcttagctaacaagatccgtgactttgctgaccgcgatacgcaagtcaacttggcaatttcactgcatgcaccgaatgatgaattacgcagtaagatcatgcggatcaatcggacttggaatttggagaaactattcgctgcggtacattattatttagataaaactaaccgccggatcacctttgaatatatcatgttaaacgatgttaatgatcataccgaagaagcgttgcaattagcggcgttgcttaaggatattcgccacttggcctacgtgaacttgattccgtataacccagtagccgagcatgatcagtattcacgcagtccgaaaaaacatgtaacggcattttatgatacgttgacgaaacaaggtatcaatgtgcaaattcgccgtgaatttggtactgaaattgatgcggcttgtggacaactacggactgaaaaaatgaaagaattagatcagttgaaaaagtaagctaaaaattagacaaagcgacttgtattctgcgctatgcagaatataagtcgcttttgttataaacaataattttaatttatttttaatctaatattcatttttagctagctacttaagcgcagttcggctacaatataggtaatttcaaaagggggtaagctcatggatgaaatcgtgtttggcgaacgtgatcctaaattgacttataaaacccgtattggtgcctatgtggtagtgccggatgcagcgcaaaaacaaattttagtcgttgaaccacctaatcattcgtatttattaccaggtggtggtattgagcctggcgaatctgatgttgaaacgattgcccgcgagttgattgaagaagttggtggtaccatgcaaattacggattatttaggccgcgctagcgaatatttttactcaacttagcgcaagcaagcctactatcatcctgctcacttctatgcgggtactggcttgatcaaaacacaggcaccattggaaggtgattttaaccagatcaaatggatgccgcttgaggaagccgccgcagctttgaaacgaccaacacatcgatgggctttggctaaatggcgccaacaacatcactgttaaggcactagtgttccatttaaaatatgactttgaaattcttggtaagttgcggcaaacaagttgtcagtagtttcctgacgtagcatctctttggggaaaaagaagcgttcgtcgccggtcattttgccactgatcgcggcaacgatatcactcaatgcggataactcaatcaagctaccatccggttggctgatctcgatttgcgtttttggattagctgaatgcggattataggcatcgtagggtagatcgtaactgttgttgatcgcggtatagtaggttgtatcatacccaaccgctgcaatcaattggcgcattttaggtagtagattttgcgttttttcggtgacactcactgattttaatggtcgccgatttaagaaacggcttgccaagtcgctaaggatcgggtcatcgaaatcttgccagtgaatgaagtaagtcgtcagtacaccatcatctaattttaaataatcagctaaggtgaagtcgttctccaaaaatggtagcaacagatgcggtacggcttctgctggcaatgcattttcttcataaagcgttttgacccgctgaagcaagtgctgcaagatgacttccattgagcgagaaacgggatgaaaataaacttgtaagtacatctgaaaacgactaagaatgtagtcttcaacagcgtgcataccgtccatggaaaaagcgataccttccttgtagggctgcataacacgtaaaatacgagtcaaatcgaatttaccatattcagtgccagtattgtaggcatcgcgtaataaataatccatccgatcagcgtcgatttgacttgaaatcatctggacgacctgtggattaggatagtcatgggtgatgacgctggcaacttgttcgggaaattctggactcacacgccgcaaaaccgcgttgacctcagttgctggatcagtcaagattgcgacggtcacttgctcgtgattagtggcaaaaatatgctcaaatgtgtgtgagtagggaccatggccaatatcatgtaatagtgcggcacagagggcgactaaacgttcatgatcgtcccacaagccatcaccaggttgttgcgttggaaaattacgctggaaattatcacatatttggcgggcaatttcgtaaacgccaactgagtggctaaaccgactatgttcagcgccatgaaaggtaaatgaagcagtgcccaattgtttgatgcggcgtaagcgctggaattcttttgtattgatcaaatcaaggatcacttgatgttgtacgtggatgtagttgtgcacaggatcgcggagaaccttttcccgtggcaatatttgattacgatagtccatggttaacttccttttaaatttaaattgcgaaccgttgtttgctgtttattgttttattataccttttccactgaaacactgcagtaagttgtggatcatcaaatcactaaggtacgcagaaatcaatgggactgatataatagggttatacaaattgaaaaaaggtggcattaattatggatctttcaacaagcttgccgattatgattcatttagaaacggttgtacagcaggacggcgagtccacccagcacatttttgatgaacccggacagctcgtacaagtggggcgctcgctatatattcgctataaggaaacttctgaagatgacggtacaccggtgccagtaaccatgaaattagaagcggatggtgatgtgaagttaactcgtggcgctaaggaaggcaatcaacgactgcaattacattttagtcgcaatactcgcgtgattgctcgctaccaaacgccatatggggtgattccgattgaaactgttacgccgcgtgtggatattcggatcaaagaacaaccagtgtctggcgaaatttatattgaatatcaattatttggcggcaatgatcatctcggtgattatcaattacgacttgtttttactgcatgatattgctttttcgaatttagcatagtatgatgtaggatagactgctgaaaggacgtgtacctgttggaactcgacgtttttaaaggacagaaaaaaaacgaattatcaatgatcgaagtggcgcatgcgatcttagagcaaaagggtgatgtaatgccttttgctgacttagtcaatgccattcaaaaatatttggatgaaagtgatgaggaagtccgcaatcgtctgtcgcaattttatacagatttaaacgttgatggtagctttatttcattgggcgaaaacgtttggggtctacgctcgtggtacccattcgattcagtagatgaagaggtcaaccatccagaagacgaagaagatcagccacagcgcaaacggcgcaagaaagttaatgctttcttagctgatgtcagtgatgacgatgatgtgatcgattataacgatgacgatcctgaagacaatgatgacgatttagacgctgaagaagattatgtcgatgatgacgatgttagtggcgatacggatcatgatttattggctgatgttgacgctgatagcgacgatgcaccagacgaagatttgcctgatggtatcgaaggtgaattagctgaattcgatgacgatgatatcgatgatgacgatagcttcgcggatgatagcgattcagatgatgacgacgataacggttaatttatttcattgcaattgagtgcttgacgcttaagtgatttccatgtatcatattgcttgggcgctttacaagtatttgtaaagccaatgaacggttatgataagctccctattctaaggaatggggagcttatttttattttgagagtgtatgttttatgcgacctgattaagtgtagtggctgtaaccaagttagcgtaaacgtgttttgaaaggtaggttactgcgtatagttacgctttctgaacgatccgctgtgcgtatcttatcagcaagctagactatacttcataacctgagcacctttcaaaacactctcaggtgttccccgaataatattgaaggagttttgatatgaccaagtatatctttgtaacaggcggcgttgtttcatcattgggcaaaggaattattgcagcatcactgggacggctactgaaaaacagaggtttaaaagtaacaattcaaaaatttgatccgtatatcaacatcgatcccggtactatgaatccttatcagcacggggaagttttcgttaccgatgatggtgcggaaaccgatcttgatcttggtcactatgaacgttttattgatgaagatttaaaccaatactccaacgttacgacgggtaaaatttatagcgaagtcttgcaaaaagaacgtaatggtgactatcttggcgcaacagtacaagttattccgcatattaccgatgctttgaaagaaaaaatcatgcgtgccgctaaaacgacggattctgatattattatcacggaaattggtggtacggtcggcgatatcgaatccttgccattcgtcgaagcaattcgtcaaatgaaagctgatgttggccgcgataacgtgttgtacattcacgcaacgctgattccatatttgcgtgccgctggcgaaatgaagactaagccaacccaacattcagttaaggaattacgtggcatgggcatccaacctgatattttggttgttcgttcagaaaaaccaatcacgcaagatatgcgtaacaagatcgctttattctgtgatgtaactccagaagccgtgatcgaatcattggacgttgatacgttgtaccaaattcccgtcaacttacaaaaacaaaatatggacgatatcgtcttagatcgtttcaatatgaaaaatgtaccagccgccgatatgacggagtggaacggcctattacaacgggttcgtaatttgaagggtaagactaagattgcgttagttggtaagtatgttgaattacaagatgcttatatctccgtgactgaagctttgaaacatgctggctacttctacgatgtcgatgttgagatcgctaaattcaacgccgaaaacgttaatgaagctaatgttgcagaattattaggtgacgctgatggtatcttagttcctggtggttttggtgatcgtgggcttgaaggtaagatcacggcaatcaaatacgcacgggaaaataatgttccattccttggtatctgcttaggtatgcaaatggcctgtgtcgaatttgcccgtaacgtggtcggtttgaaggatgcgggttcttcagaaacacaaccagatatcgctgatccagtaattgacttaatggctgatcaaaacgctaaagaaaacttaggtggcacgttgcgcttaggtttatacccttgtgtgcttaaagaaggctctgtagctgcagcagcctatgatggtgcccatgaaattcaagaacgtcatcgtcatcgttatgaatttaacaataaataccgtgatctattagctgaaaaaggcttagtattctctggtgtttcaccagacaatcgtttggtcgaagtgattgaattaccacaaaatgatttcttcgtggctgcgcaatatcatcccgaattcttatcacggccaagtcgtccggaaggcttgtacaaagcattcatcaagactgctagtcatagctaaaaataaacacatcaaggtagagaattgcagtagtgcgattctctatttttgtacatagatcacgcaatgtgtataattctaaataatgaatcatgacgagtagcgaagtacaaacgcaagtgtagttagataaccgtgcgttttatattacattagatgacaattattaagaatttgtaaaatcctaaagttgcttaaaaggcctatttttaggtatagttgacctagctaggctttatggctgtaaagagattgttagaaattactaaccaattcggctaaggtattgtatttttaggttacattctttatcattgaaatgattataattgaagtgaggaaagtagcatatgaagaaaatgaggatccaaggtggcaaaccgctatccggcacggtgacgatcgggggcgcgaagaatagtaccgttgcgctaatccccgcatcgatcttagctgatacgccggtaacactggatggggtacctgatattcgggatgtacataatttaatgtcgatcttggcatcgatgcacgtgacctcaacgttcactgcggatatcctcaaaatcgatcccacacaaattgtgccaacgccactacctaatgggcgaatcaagagtttacgcgcttcgtattattttatgggcgctttgttaggtaagtttggcgaagctattgttggtttgcctggtggtgatgatattggaccacggccaattgatcagcatatcaaggggtttgaagcgctcggtgcccaagtaacgaatgagcacggtgcaatgtatatcaaagctcccgctgaaggtttacatggtgcacggatctttttggatatggtttctgtcggtgccacgatcaatattctattagccgcagtacgggctaagggacggacgatcattgaaaatgccgctaaagaaccagaaattattgatttagccacctttttaaataatatgggggcgcagattcgtggcgtggggaccgatatcattcgtatcgacggcgtggatcgtttagaagcacacaattcgcatacgatcatccctgaccgcattgaagcgggcacttatttagcgatggctgcggcaatcggggatggcgtgttagttaaaaatattattcccgagcatttggatgccttcctcgctaaaatggaggaaatgggcgttcaactagattatcacgaagatagcatctacgtgaacccatcagatcatctgaaaatggtacagatcaaaacatcgccttatccaggttttgcgactgatttgcagcaaccgattacgcccttattgttaaaagcacggggtgaagggctgatcattgatacgatttatccgaagcgagtcaaacatgtcccagaactgatccggatgggggcggatatcacgatcgaaaacgatgtgattattttgcatcatgccgatcagttatttggtgccgaagtctcagcagatgaaattcgggccggcgcttgtttaatgactgctggtttaatggcgcaaggtgagaccgtgatcagcaacgtagagaatattttgcgtggttacgatcgggtggttgataaattgcatagtttaggtgcgcaagttgaaattatcgatgatgtcgaacagatttcgatcacttcgcgctgatcatgttaatgggacgaagggcggctagcttcgctaataggttgaagcagcgtttttcgccctgtttttttgtggcatgacctttctgacacgcgacttttaatgaacggagcaacataatgagtgactttttgactatgggtgagctggaaaaccaaaccctgaaagagatttataaatacgcacgtgatttcaagattccttattacagtcaaatgaacaagaaagaattgtcgttggcagttttgcgagcacaggctaagaaacaaggttttgtttcaatggagggtgttttagaaattgtcagcaacgatggttttggctttttgcggccaatcaattatggcccatcgcaggaagatatttacatttcggcttcccagattcgccgttttggtttgcgtaccggtgataaagtggttggccgtgcgcggccaccaaagcctagcgaacgttactatggcttgatgcacgttgatacagttaatggcaaagatccagaagaagctaagcaacgaccgcattttccagcgttgactgctctatacccagaacggcagttacatttagaaacgacagaacaacaattagcaacacgcttgatcgatgcgtttgcgccagttggctttggacaacgaggtttgatcgtagcgccacctaaggccggcaaaactagtttgcttaaagcaattgctgcaggcatcgctaaaaactatcctgacgcttatttgattgttttattgatcgatgagcggccagaagaagttaccgatattgaacgttcagttaagggtgatgtggtctattcaacgtttgatcagcaaccagctaaccatacccgtgtttcagaattggttttggaacgggctgagcgtttggttgaagataagcaggatgtgattattttgcttgattcgatcacgcgattgacccgggcgtataatttgacgacaccttccagtgggcgcaccttatctggtggtttggatcccgcagcgttctatcggccaaagcgcttctttggtgcggcacggaatattgaagaaggtggcagtctaacgattttggcgacggccttggtggatactgggagtcggatggacgatgtgatctatgaagaattcaaaggtactggcaatttagaattgcatttgtcccgcgaactatcagagcggcgaatttttccagcattggatatcaaacaatcaggaacgcgcaaggaagagttactgttggctaaaaatgatttggaagccatttggaagattcgccgttcaatgactggtgatgcattggattatactgagcagttattgcgcttcatgcaacgaacttcggataatcgagcgttttttgaaaacttaaataaattagaatttaaacagcatcggccaagaaattatcatcgctgattgcaaaatcaaatcgcacatggtattatttattggttgtgtaaccaaattatctctgtttcgcaggctagcttaggtttaactagttaggctgtttccggctaactagttaacacgctaatgttagtatgattcagggcaaaggagcgaatagtaatgaaaaaaggaatccatccagattaccatcccgttgttttccgtgactctcagacaggtttccaattcttgtctggttcaacgaaaacatctgaccaaacggttgaatgggaagacggtaacacttatccattggttttagttgaaatcagttccgactcacatcctttctacaccggcaagcagaaatttacgcaagccgacggtgcagtcgatcgtttcaacaaaaaatatggttttaccgatgccaatgctgcaccggccaaagactaagcaattgctatggacgcttgataaaacttttgttttgtcaggggtcttatttttttgcactagaataggttaaaataaagataaatgctggtttaagttgtggtatgctttttgctgcaagaaacatggtaacgtgtcacgtgttctatgcgtcagcgaatggaacctaattaatttagtttaaacatgagtgctccgctaaataaaggagttctagccgttcccgttattaagtgagatagaggtgaggtttagtgaaaaaatggcgtatttataattatttgttagcttttattttgatctcaatgatcttatcgctgacttttactgttgtggcggtttcaacagtaccagcaaccggccgtggcaagcagatgttcttgttagtggagatcgtgttagggatcgtgattctgttgttaccgcaatggatcgctaagttaggtaattttaaattacctgaagtactatacgttttattcttactgttcatttatggttccgtttatctaggaacggtttatcagttttatagccgcattccgtattgggacaaaattttacacgttggtagcgccatgttactaggttgtctcggttatgctttgatcggggtatttgttcgtggtgagcagctgacgcatttgtcgccgttatttatgggcatttttgcgtttacttttggtttgtcgatcggtgtattctgggaattttatgaatttacttttgatggcttgctagggctaaatatgcagcgttatatgagccatggcgtcttgctgcaaggccgtgcggcattaatggacacgatgggtgatttgatcgccgacgcgctaggcactttcgcagttgccgcaatcggttatattggtattaagcgcgatattcactggttagataaatttatgttccgcaaaatagcacaaaaaaaataatcgtcagcttattgctggcgattatttttttgctttaaacgtagtggcttggtactgcgccaaacccaaacgaaattgataaattctaatgcagcggtggtaaagaaaacaccattatagccgagaaaaccggagattcctgaaccaattaatggcccagaaacctgaccaactgattggaaggattgattataactgaaaattcggccggctattgtatgcggtgaatacttggctagaattgtttggacggcgggtaataacgccgcatcggaaatgccgacaaaaacacgtaaaacggctaattgccaaacgttagtgacgaaaccttgtggcaagtagacgatagtggcgaaaattagtcctaataacaagatccgttgtgtcccaatccgatcaccaagtttaccgaattggggtgcggcaattaaagtggcgatcccaggtaaagcagccacgataccactgatcaatggcacattaccattaccatgcattaattcgcgcacgaataaggcaatgattgggctgattgagttattggcggccatgataaacatggtcgtgacaaacatcccaataattaattgcggctgcggtaattgttgaataattgccttggatggttgttgttgccctttttcaacaggttcaaaggtttcatgaacgaagaataggcataataagaaactagtggtcagtagcaaagcagtgatcaaaaaagtgacccgatacccgaaaaaaccggcgattgatccgccaagtaaggggccaatcatttgaccagtgacaccgcctgtcgaaagtgtgcctagtgcttgtccacttttgttgcgtggtgcggaagtggcaattagggcattggcgttactgatgaagccagaaacgaccccctgcaatgcgcgtaaagcaactagctgataaacgttagtgacaaaggccatggacccaatgatgatcgccattcctgcagaagcacgtagcaacattaatttacgacctttacgatcggccaagcgcccccaccaaggggagacaatcgcagtcactagataagttgcggagtaagtcaaaccactccaaaaattaagctgcatatgagtgaattttcctagtgtatccacatataatgacataaaaggtaggactaaactaaaacccatcccggtcatgaaacaaccaaaccataagacataaaggttttgttgccattgcgggcgtttgcgctgaaccgagttcaagcactcaccttctttctgaaaaacgagataattatatggtagcacgattgcgaaaaaataaaagggggctatcccactataagctgatcgttaactcgtaagcgccgagactaatttaaaataatgtagaccaatcaacaatttaggcagattttttgcctaatgcatcaatactttactacagtttggttatatccgaatttttgcgctacgctcttaattgacaagttgaatcgtatctgtgacaattaatgcaaatgaataataaaaaagaaaagagggtttgcaatgctgtggattattttaattgcgattttattagcagcggtggtcgtgatcggttacattagtttctataatgggctggtgcgaagccgtaattggaccgacgaagcttggagccaaatcgatgttcaactcaagcggcgtaatgatttgattcctaatttagtagaaacggttaaaggctatgctaaacatgaacaaggaaccttggaaaacgttattgccaagcgaaatcaattggcggcagtccctagtgacgatcatgaacaaaccatggccgtttctaaccagctctcagcgggattaaaggatatttttgccttagcggaaagctaccccgacttgaaggctaatcaacaatttggtcaattaatggatgaactgactaactcggaaaacaagattgcttatgcacgccaactctataattcaagtgctgtaaattataataataagatcgaaactttcccaggcaacgtgatcgcaccagcgcataatttccagaaaatcaattatctggagacgccggaagcagaaaaagcagtacctaaagtttcgttctagagataattaagtttatttgctaactaccacataattaattttatgtggtagtttttattagccggatttacaatgtaagtgcaacaccgaaacaactagaccaaaaaggccatgaagccttaaacttataagcgacgaaaccaataagttaggacggacttcatgacccaatttaaagataccatca

SEQ ID NO: 531 - DNA, 7962 bp, Unknown
  Metagenome-assembled genome
cctgatttaatgctttccagggttcaaataagttattaatcgcgattaatgatttatttgagctgtggaaggtaaacgcggttctgaatgtctcttaaaatctgtctcaaatattgacttcaatccattaataaaaggagattattatgtttttagctattaaagagatgctacatgaaaaattgcgttatagcctaatagtggcacttatatttttagtaagttatcttttgattattcttactggtttagccactggtttagctaacctaaacaaagcggcaattaacgagtgggatgcttcaagtattgtcttaaatagtgattctgaaggacgtttacaacaatcttttctttcacaggatgaggttgctagtttacccaataatggaaccagaatttcacagtatagtacacttgtaaaatcagaaaatggattaaaagagaatactcaattagtaggtcttgattccaaatcgttcatatttaaaaaattgaaaataacaagtggtagtaaaaatatccgaaacaatgccggcgtcgtatcggataaattcaaaagtgatggattcaaaatcggtgaccacttgttagttgctaattcatcattgaagattaaaattacaggttttacacccagggcaactttaagtgctcttcccgtggtttatatttcaccagacactattcaaccactgaataaaggtgtaacaaatgctgtggtattcaagaataagttaaagaattcaaaaataccaaaagggaccaatcaattgagcattagctcatttattaaaaaattacctggatatagcgcacaacaactcacattcgacttcatgattgcttttttgtatattattattctaattgttatttcaattttcttgtatattctgactgttcaaaaattacccaacttaggtgtcttgaaggcgcaaggagtctcaacgcaatatcttattttgagtacgttatttcaatcatttattatttcagttattggcgttattatagccattatattaggtgaaataacagctattacgttaccaagcgaggtacccattgtcatcgataaaagtaatattattgtaactggaatcggtattattattatgtccttgttaggtgcactgatacctattcgtcaaatcgccaaagttgatccttacaaaattattggaggttaatttcatgtcaaatctaatttttgaatcggtgacaaaagtttttggagaagggagtagtaagtacgtagcgctggaaaatattaattttaaagcagaaagtggtcagcttattttagttgtagggccatcaggatcaggaaaaactacatttttgactatagccggcgggctgcagacaccaactgagggtgacgtaaaaataaatgacagcacaattaaaagtttatccgaaaaacagcaaacaaaattaagattggaaaaaataggatttgttttacaatcttataacttagttccatttttaacggtcgaagaacagtttaaattagtagataaactaaaaaaacaaaatttaactgaacaaaaaatgcatgaacttctatctgatttaggacttttagaactcctaaaaaaatatcctaatcaactttctggtggacaaaagcaacgtgtggcaattgctagagcattatacactgatcctgactatatcttagcggatgaacccacagccgccttagatacggatagatctatgaaagtaatcgagttactcagagatttagcacataagagaaataaaattattattgtagttactcatgacttaaggttaaaaaatacggcagacaaagtttatcagataattgatggtaagatgcaaatgataaattagctactgtcttaattttacttgaaaacatattgaatttatgaatatctaataccacatctaaatgctcagaagtcaataaattggactatttttagtcagttaattagacaactggaaattgacggttcagcacattttcttggatgtaggtttcttgttgctctcgtcggttatgtttcttggcatgtacggttgtccgcacgttcttcgcattcatgacgtgagtaatcaatgcgaccaacttccagtagcatcatttttaagcatttgttattttacgcctgtttcagggcttctaatctattctgattatctcatgtaaaccggttcaatgcacatcgaatttctttcggtatctgataaaggttgtccgtttaatcccggtattacgggcaacatctacatcactcatgcccgtctggtaaagtttaaaagcatgtagtaaacggggatcatcttcggcatattgaggtttccgaccatgatatttaccctgctgtttagcgagggcaatcccttgttgctgccgttcaatgatccgcttacgttcgctttcagcttgatatttatacagttcaataatgagattcgtcatgagctggcgtaaattaggatccgcaatccctgtcatggacggcaagtttaacacatctagggtggcccccttattttgaatggtgttcatgatcttagttaagtcctggtggtttcggcctaagcgatctaattcagtgaccaggacaatatcaccctcgcgaacataggcgagcattttttgcagttctggtcgattggtgttggccccactcaatttatctgtgaatagcttatcaacgccctttaaaacagctagctgccgatctaaatgttgttccttggaactcacgcgagcataaccgattttagccattgtcagcacttccttttggacagttctaatgaacatttataattcctagtatagcacaggaccaaaaatgaccactagggtataccctattggtcgcttttgatccattatcaatggctttttaaattagggcctagtacttttggaattgaaatactttccaacaccaaaaattctagacccaaataattttacaatctaccatggctaaaatgttaagcatgcgcgatttcgactactccaagatcggcaacatctttgaactagacgaagtcacccctaaaatggcaactgaagaacgcattgatgattctggcaacaaaatcatgggcaatgatggtacaccgcggaaattcaacacggatgaaattgtcggctataagtattccgtcacgattctggaaggtgaacatcgtaagaagtccactcagatcaccgttgctggtctcgactgtccaatcaacaacgcggaaatcatgaaacgtgacagcgtgaaatgccgctttaccggtttagaaccaagcatggtcggcaacccaatctactacaaggctgaaaagattgaattagtggccccgcaggccaaatagaaacactctgggctacccaatctaaacgggtagtcctttttctcgcaattctacttggtcagttgccgataacgttcaaacagcatggcgacggtatcactctcggtggtgcctttaattgtcagcccatatgcccgcataacggctcgatcattatcttggtgggctttgcgcagttcaggaactgtcgccaacggatcatagagatcagctaagctactatccgggtaaagtttacgggcatcgagaatcccctgggctgtttgttcaatctgcgccttttgcttatcatcaacttctggccacggaaaatttgcatagacggttggcgagtaactgtaatcgctcttcattctaccagcaaccgcacgcatccacgccatatgcacattagaagtcatcacaccgaacatatacagactggcattcggaacgagatacagcttgttgctggcaataaccgctggagacatccaccccatcggcacataacgtcggttttcgctcgaaacctcagggaccgctagatccgccaatgctttaactgacggtgtaggacttttcaatcttgcttcggtgacggccgctaaccgttccataattggtggaacagaacgaaattgacttggtgatacaccctttaaccaaatgcagtaccgctcaacattattgataaagtctctggagccaacataacgtcggatataactttctgtttgcgggtactgcttaattaacgccgctcgttccgctggagaaagaattaagttacccccgtctgttggttggcttcccttagacatcacaggaaagttggcaccggaaatactagtctttcgacgtggctgtgggaatacatcagttcccgcggtaagatacgcattgatatggtcaaccagcttcatctgccccccttcaaacagacgcttcttctccttgcgtgggtagccggtgaagccaatgatgaccacatggacttgcgccttctccttggcctcactgctccagcggaatgtccgataggcgaattgaatttcaatgcccttctcgaatagttttggccaaagcgttggcgcttgctcaccttgcgtgatcgagttagttgaaacaaaggcgacctcggtcgtcttaccttgaatgaagtcagccgctttgttgtaccacgccgccacataatccagcttgccatacttggtaaaatcatggaaagcaatatccatgtccgctgcttgcgcgcgtgtccgcttttcgtgaccataaaatggtggattaccaatgatataagtaattctctcgccgccgactaccgtttcccaatcgagacggatggcattgccctctgtgatgttggtgtacgtcttcaatggcaaaaagtccatattcgcgtaaacaatcgccgccgtttcttccatcatctgcgattcagcaatccacagcgctgtcttgccgacggacaccgcaaagtcattgatttcaataccataaaactgttgaatggacaccttgatcaaatcgtcatcaactgccaacatgctttcattcccgtaaatcaagctgataacctggttttcgagcttccgcaatgacaaataggtttcagtcagaaagttacctgacccacacgctggatcaaagaaacgcaacttaccgagccgggcttgaaaatctgtcgcgcgctgaatcatggtcttacgttgcttaatttgcttgatttcagtcagctcatttcggagaccgtctaggaacattggatcaatgactttatgaatatttgcaatcgaggtatagtgcatgccaccttcacgtcgcgtgtctgggttcaaggtactctcaaacaccgcaccaaaaattgttgggctgatctcagaccagtcaaactccttgctagcttgatctagaatcaaagcgcgcaacgaatcggtgaattgtggaatctcaacttcctcattagtaaacattccgccattcacatacggaaactcagccaacttttcttccagatatgggtcgcgtttatcgattggcgtatccagcacacgaaacaggtctatcaaggccgtacgcagatgccgcgtctcaaattcattgagatagtcgtgaaacataccatgacggccaaaaatgccagcatcttcagcgtacaagcaaaacactagacgtacagacaactcgttaatactacgctgactgctggcattagtaggatcacgatactgcgtgaacagttcatcgtaaatcttgccgaccaactcaccagcttgcattgaaacttccatctctttgtcgagatgcggattcaactgatcgacgataaagtccaaacggtaatactcagtcggtaagtccttaagctggatcactgccggctcgccattaggttgctccatatcatacacgaagaactgggtaaagttgctcgtgataatccagcgcggccgcttagagtacggtaaattggcggaatatcgttttgcttgctcaaatggagacagcaaactgccgtcagactgccgtatgccgtcaaacaagctcttatttcggcctttctgttcaatcaacaccttggttgtgtcaatgaaaccgtcaataaagctggtgtgatccagcattactcggtcttcaaaactgatgtactcaccaggattaggaatatcatagacagtctccagcaagtccaaccagaaggtctgactatcctgtcgttcattaccacgatcttgccaacgcttgacaaaggccgtggcggctcgtttttgatctgcttccttcatgaaacagcctcgattcgtcagtattatgtttcaagtatcacgcatcaatcatataaagaaaagcgccagtctcgaagttccgaaaactgacgctcataaacatggggacatcgctatattctaagtgaattcaaccttgagcttctttcccagtgcaaaggcaatcttgctcatggtatcaaagctagtgttctggccatgctcgatgcgcgcaatcgttgattgcggcacatctgcccgctcggctagttcccgttgggtcaaaccggcgcgttcgcgctcgctcatcaacgccactgcgctctcaagtttggcagattcggcatcaaagcctgccttgaattcagggtccttaagttgttcagcgagataatcgtcaaaagaaatgttctttgccatgttacttacctcccaaattatcgtagtattctgtcctgagttctttggcatgattaagttcagacaccggcgtcttctgggtcttcttcgtgaagccatgcgtaatcacataacgcggaccttcaacgtgaaagtacaagccccgctggatattcgatcctgttgtccgaagctcaaagatgccatctgatatttttctgatccacatttggcgcgctgccacttgcaaaccaaatttctgtgtcttggcaatgacggtgaccagcttctgcttttccactggcttcaaactatctaagaattcttggaattcattgtgtccacttggacgcgtgtaaaactcgaacttaggattttccatgtgtttagtatacacctagcgagccacagtatcaatatatgctatcagcttctaaaatctaaatttcaaaacttcttagtctctaaatgagtgaattaaaagaccaccacgttcgggaacgtttgttcgaaaatcgaccataaaagccttctactctgctataatacgtatgaatcaataaaaattatatagataaggcggaacacacatgaagaaaagcctgccacgaaaaatcatctactttgacggagctcggcacggcgtgaagcacgccttaatgactgtgatatcagagttttagttgaccttgttcattaactcttgaccaacattcaagcgctactaacactgttcttaacaaaaatgctaaaatttaattgttgatatcaaatttcaaacggccgttctccttttgacaattctattgtgccgcaaacgaatggctaataatacggacacttttttgcgtttaagaaatgaggaagtattatgactgaatacaaagaaatccaggaacagacgtacctgaacctggataatgggaatgtttattttgctattgaagaagtattaaggattattaataatcaaacagaagctaatcaagccaatagtattccacctactaaacttaataaagttatgaatgctaacaacatcaattggctaactctagataggtctcaaattaaaccaataattggctaccatgcacccactccggatgatgaacatgccgcttcacttaataaagttaacgttatcaatagcgttgatatagtaaaactgataaaagcgattaggtcaatgaatccatctaaaaaaacaaaaaataataacttaccatacatcctgaattattcatagttcataaaaatcccgtcagttttcgtattttttcgaaaactgacgggtatgtctttatcttttgctgaaatacgatgtttatcagttctagctagtgagatctttcaactaactcagaattgctttgaacttttggatacacttgtcccttggttgtacagatttttttaattttgccggttattcaatagcctg
